United States Patent 11,464,842 (COMPOSITIONS AND METHOD FOR OPTIMIZED PEPTIDE VACCINES USING RESIDUE OPTIMIZATION) - sequence listing, part 7

SEQ ID NO: 99310 - protein, 9 aa, Artificial Sequence
  Description of Artificial Sequence: Synthetic peptide
  Seed: KAHEFIELI (MAGC3_HUMAN)
KSHEFIELR

SEQ ID NO: 99311 - protein, 9 aa, Artificial Sequence
  Description of Artificial Sequence: Synthetic peptide
  Seed: LILILSMIF (MAGC3_HUMAN)
LMLILSMIY

SEQ ID NO: 99312 - protein, 10 aa, Artificial Sequence
  Description of Artificial Sequence: Synthetic peptide
  Seed: TGYFPMIFRK (MAGC3_HUMAN)
TMYFPMIFRV

SEQ ID NO: 99313 - protein, 9 aa, Artificial Sequence
  Description of Artificial Sequence: Synthetic peptide
  Seed: EVDPDHFYV (MAGC3_HUMAN)
ETDPDHFYY

SEQ ID NO: 99314 - protein, 9 aa, Artificial Sequence
  Description of Artificial Sequence: Synthetic peptide
  Seed: YQAKEPLTR (MAGC3_HUMAN)
YVAKEPLTV

SEQ ID NO: 99315 - protein, 11 aa, Artificial Sequence
  Description of Artificial Sequence: Synthetic peptide
  Seed: IIDTTDDATAM (MAGC3_HUMAN)
IADTTDDATAL

SEQ ID NO: 99316 - protein, 9 aa, Artificial Sequence
  Description of Artificial Sequence: Synthetic peptide
  Seed: LSDLHFGSQ (MAGC3_HUMAN)
LTDLHFGSY

SEQ ID NO: 99317 - protein, 11 aa, Artificial Sequence
  Description of Artificial Sequence: Synthetic peptide
  Seed: EVLSAIGPIQR (MAGC3_HUMAN)
EMLSAIGPIQR

SEQ ID NO: 99318 - protein, 9 aa, Artificial Sequence
  Description of Artificial Sequence: Synthetic peptide
  Seed: KVDKLVQFL (MAGC3_HUMAN)
KIDKLVQFI

SEQ ID NO: 99319 - protein, 9 aa, Artificial Sequence
  Description of Artificial Sequence: Synthetic peptide
  Seed: LRSAEGSVL (MAGC3_HUMAN)
LKSAEGSVM

SEQ ID NO: 99320 - protein, 10 aa, Artificial Sequence
  Description of Artificial Sequence: Synthetic peptide
  Seed: LIFGIALTDM (MAGC3_HUMAN)
LLFGIALTDA

SEQ ID NO: 99321 - protein, 8 aa, Artificial Sequence
  Description of Artificial Sequence: Synthetic peptide
  Seed: ILILSMIF (MAGC3_HUMAN)
IKILSMIY

SEQ ID NO: 99322 - protein, 9 aa, Artificial Sequence
  Description of Artificial Sequence: Synthetic peptide
  Seed: YSAFHLGHL (MAGC3_HUMAN)
YWAFHLGHF

SEQ ID NO: 99323 - protein, 11 aa, Artificial Sequence
  Description of Artificial Sequence: Synthetic peptide
  Seed: TEVDPDHFYVF (MAGC3_HUMAN)
TQVDPDHFYVY

SEQ ID NO: 99324 - protein, 10 aa, Artificial Sequence
  Description of Artificial Sequence: Synthetic peptide
  Seed: GHLREVRLFL (MAGC3_HUMAN)
GMLREVRLFV

SEQ ID NO: 99325 - protein, 10 aa, Artificial Sequence
  Description of Artificial Sequence: Synthetic peptide
  Seed: SCSSPLLWTR (MAGC3_HUMAN)
SISSPLLWTK

SEQ ID NO: 99326 - protein, 11 aa, Artificial Sequence
  Description of Artificial Sequence: Synthetic peptide
  Seed: YALDEKVAELV (MAGC3_HUMAN)
YLLDEKVAELC

SEQ ID NO: 99327 - protein, 10 aa, Artificial Sequence
  Description of Artificial Sequence: Synthetic peptide
  Seed: SDQRMDSLVL (MAGC3_HUMAN)
SMQRMDSLVY

SEQ ID NO: 99328 - protein, 9 aa, Artificial Sequence
  Description of Artificial Sequence: Synthetic peptide
  Seed: WESEGPEAF (MAGC3_HUMAN)
WPSEGPEAY

SEQ ID NO: 99329 - protein, 9 aa, Artificial Sequence
  Description of Artificial Sequence: Synthetic peptide
  Seed: HLREVRLFL (MAGC3_HUMAN)
HVREVRLFG

SEQ ID NO: 99330 - protein, 10 aa, Artificial Sequence
  Description of Artificial Sequence: Synthetic peptide
  Seed: AMASASPSVM (MAGC3_HUMAN)
AKASASPSVF

SEQ ID NO: 99331 - protein, 10 aa, Artificial Sequence
  Description of Artificial Sequence: Synthetic peptide
  Seed: YALDEKVAEL (MAGC3_HUMAN)
YTLDEKVAEA

SEQ ID NO: 99332 - protein, 9 aa, Artificial Sequence
  Description of Artificial Sequence: Synthetic peptide
  Seed: LKYQTKEPV (MAGC3_HUMAN)
LQYQTKEPM

SEQ ID NO: 99333 - protein, 9 aa, Artificial Sequence
  Description of Artificial Sequence: Synthetic peptide
  Seed: LDEKVAELV (MAGC3_HUMAN)
LEEKVAELA

SEQ ID NO: 99334 - protein, 9 aa, Artificial Sequence
  Description of Artificial Sequence: Synthetic peptide
  Seed: MASASPSVM (MAGC3_HUMAN)
MRSASPSVF

SEQ ID NO: 99335 - protein, 9 aa, Artificial Sequence
  Description of Artificial Sequence: Synthetic peptide
  Seed: GKFSLRRAV (MAGC3_HUMAN)
GEFSLRRAF

SEQ ID NO: 99336 - protein, 10 aa, Artificial Sequence
  Description of Artificial Sequence: Synthetic peptide
  Seed: SCSSPLLWTR (MAGC3_HUMAN)
SGSSPLLWTK

SEQ ID NO: 99337 - protein, 10 aa, Artificial Sequence
  Description of Artificial Sequence: Synthetic peptide
  Seed: KKYKDYFPMI (MAGC3_HUMAN)
KHYKDYFPMW

SEQ ID NO: 99338 - protein, 9 aa, Artificial Sequence
  Description of Artificial Sequence: Synthetic peptide
  Seed: YALDEKVAE (MAGC3_HUMAN)
YTLDEKVAL

SEQ ID NO: 99339 - protein, 10 aa, Artificial Sequence
  Description of Artificial Sequence: Synthetic peptide
  Seed: IELIFGIALT (MAGC3_HUMAN)
IDLIFGIALL

SEQ ID NO: 99340 - protein, 10 aa, Artificial Sequence
  Description of Artificial Sequence: Synthetic peptide
  Seed: WEVLSAIGPI (MAGC3_HUMAN)
WTVLSAIGPV

SEQ ID NO: 99341 - protein, 9 aa, Artificial Sequence
  Description of Artificial Sequence: Synthetic peptide
  Seed: SQPEGKFSL (MAGC3_HUMAN)
SAPEGKFSM

SEQ ID NO: 99342 - protein, 9 aa, Artificial Sequence
  Description of Artificial Sequence: Synthetic peptide
  Seed: WESEGPEAF (MAGC3_HUMAN)
WMSEGPEAF

SEQ ID NO: 99343 - protein, 9 aa, Artificial Sequence
  Description of Artificial Sequence: Synthetic peptide
  Seed: IPPQGPPKI (MAGC3_HUMAN)
IGPQGPPKM

SEQ ID NO: 99344 - protein, 9 aa, Artificial Sequence
  Description of Artificial Sequence: Synthetic peptide
  Seed: ASEEVIWEV (MAGC3_HUMAN)
AMEEVIWEF

SEQ ID NO: 99345 - protein, 10 aa, Artificial Sequence
  Description of Artificial Sequence: Synthetic peptide
  Seed: AMASASPSVM (MAGC3_HUMAN)
ASASASPSVM

SEQ ID NO: 99346 - protein, 9 aa, Artificial Sequence
  Description of Artificial Sequence: Synthetic peptide
  Seed: LVQFLLLKY (MAGC3_HUMAN)
LQQFLLLKY

SEQ ID NO: 99347 - protein, 10 aa, Artificial Sequence
  Description of Artificial Sequence: Synthetic peptide
  Seed: IPSAFPSWYM (MAGC3_HUMAN)
IFSAFPSWYW

SEQ ID NO: 99348 - protein, 9 aa, Artificial Sequence
  Description of Artificial Sequence: Synthetic peptide
  Seed: SALAGFADV (MAGC3_HUMAN)
SLLAGFADA

SEQ ID NO: 99349 - protein, 10 aa, Artificial Sequence
  Description of Artificial Sequence: Synthetic peptide
  Seed: LILILSVIFI (MAGC3_HUMAN)
LILILSVIFV

SEQ ID NO: 99350 - protein, 9 aa, Artificial Sequence
  Description of Artificial Sequence: Synthetic peptide
  Seed: LSAIGPIQR (MAGC3_HUMAN)
LMAIGPIQR

SEQ ID NO: 99351 - protein, 9 aa, Artificial Sequence
  Description of Artificial Sequence: Synthetic peptide
  Seed: RPAREVLEF (MAGC3_HUMAN)
REAREVLEF

SEQ ID NO: 99352 - protein, 9 aa, Artificial Sequence
  Description of Artificial Sequence: Synthetic peptide
  Seed: VINTYTGYF (MAGC3_HUMAN)
VVNTYTGYF

SEQ ID NO: 99353 - protein, 10 aa, Artificial Sequence
  Description of Artificial Sequence: Synthetic peptide
  Seed: KLVQFLLLKY (MAGC3_HUMAN)
KAVQFLLLKY

SEQ ID NO: 99354 - protein, 11 aa, Artificial Sequence
  Description of Artificial Sequence: Synthetic peptide
  Seed: YFFEDTLDLTY (MAGC3_HUMAN)
YSFEDTLDLTY

SEQ ID NO: 99355 - protein, 11 aa, Artificial Sequence
  Description of Artificial Sequence: Synthetic peptide
  Seed: KDMEDRAQAII (MAGC3_HUMAN)
KEMEDRAQAIL

SEQ ID NO: 99356 - protein, 9 aa, Artificial Sequence
  Description of Artificial Sequence: Synthetic peptide
  Seed: ISPQGPPQS (MAGC3_HUMAN)
ISPQGPPQL

SEQ ID NO: 99357 - protein, 10 aa, Artificial Sequence
  Description of Artificial Sequence: Synthetic peptide
  Seed: RSAEGSVLDL (MAGC3_HUMAN)
RVAEGSVLDF

SEQ ID NO: 99358 - protein, 9 aa, Artificial Sequence
  Description of Artificial Sequence: Synthetic peptide
  Seed: TTDDATAMA (MAGC3_HUMAN)
TGDDATAMF

SEQ ID NO: 99359 - protein, 10 aa, Artificial Sequence
  Description of Artificial Sequence: Synthetic peptide
  Seed: KVAELVQFLL (MAGC3_HUMAN)
KLAELVQFLY

SEQ ID NO: 99360 - protein, 9 aa, Artificial Sequence
  Description of Artificial Sequence: Synthetic peptide
  Seed: HSYFFEDTL (MAGC3_HUMAN)
HRYFFEDTY

SEQ ID NO: 99361 - protein, 9 aa, Artificial Sequence
  Description of Artificial Sequence: Synthetic peptide
  Seed: FLSKLSSII (MAGC3_HUMAN)
FHSKLSSIM

SEQ ID NO: 99362 - protein, 9 aa, Artificial Sequence
  Description of Artificial Sequence: Synthetic peptide
  Seed: RTLSGSPGL (MAGC3_HUMAN)
RNLSGSPGY

SEQ ID NO: 99363 - protein, 9 aa, Artificial Sequence
  Description of Artificial Sequence: Synthetic peptide
  Seed: VPEEVIWEV (MAGC3_HUMAN)
VVEEVIWEM

SEQ ID NO: 99364 - protein, 10 aa, Artificial Sequence
  Description of Artificial Sequence: Synthetic peptide
  Seed: KYKDYFPMIF (MAGC3_HUMAN)
KYKDYFPMIM

SEQ ID NO: 99365 - protein, 10 aa, Artificial Sequence
  Description of Artificial Sequence: Synthetic peptide
  Seed: YTLDEKVDKL (MAGC3_HUMAN)
YLLDEKVDKF

SEQ ID NO: 99366 - protein, 9 aa, Artificial Sequence
  Description of Artificial Sequence: Synthetic peptide
  Seed: ALSPVVLPP (MAGC3_HUMAN)
AVSPVVLPA

SEQ ID NO: 99367 - protein, 9 aa, Artificial Sequence
  Description of Artificial Sequence: Synthetic peptide
  Seed: GPWSALAGF (MAGC3_HUMAN)
GMWSALAGY

SEQ ID NO: 99368 - protein, 10 aa, Artificial Sequence
  Description of Artificial Sequence: Synthetic peptide
  Seed: EAFCEESGLR (MAGC3_HUMAN)
ESFCEESGLR

SEQ ID NO: 99369 - protein, 11 aa, Artificial Sequence
  Description of Artificial Sequence: Synthetic peptide
  Seed: LTDMDPDNHSY (MAGC3_HUMAN)
LVDMDPDNHSY

SEQ ID NO: 99370 - protein, 10 aa, Artificial Sequence
  Description of Artificial Sequence: Synthetic peptide
  Seed: EKVAELVQFL (MAGC3_HUMAN)
EDVAELVQFV

SEQ ID NO: 99371 - protein, 10 aa, Artificial Sequence
  Description of Artificial Sequence: Synthetic peptide
  Seed: MQMNVINTYT (MAGC3_HUMAN)
MVMNVINTYV

SEQ ID NO: 99372 - protein, 9 aa, Artificial Sequence
  Description of Artificial Sequence: Synthetic peptide
  Seed: ALDEKVAEL (MAGC3_HUMAN)
AMDEKVAEI

SEQ ID NO: 99373 - protein, 9 aa, Artificial Sequence
  Description of Artificial Sequence: Synthetic peptide
  Seed: ATYALSPVV (MAGC3_HUMAN)
ATYALSPVA

SEQ ID NO: 99374 - protein, 11 aa, Artificial Sequence
  Description of Artificial Sequence: Synthetic peptide
  Seed: FIKGNCASEEV (MAGC3_HUMAN)
FMKGNCASEEI

SEQ ID NO: 99375 - protein, 10 aa, Artificial Sequence
  Description of Artificial Sequence: Synthetic peptide
  Seed: TDMDPDNHSY (MAGC3_HUMAN)
TSMDPDNHSM

SEQ ID NO: 99376 - protein, 9 aa, Artificial Sequence
  Description of Artificial Sequence: Synthetic peptide
  Seed: KLVQFLLLK (MAGC3_HUMAN)
KLVQFLLLR

SEQ ID NO: 99377 - protein, 11 aa, Artificial Sequence
  Description of Artificial Sequence: Synthetic peptide
  Seed: TTDDATAMASA (MAGC3_HUMAN)
TSDDATAMASF

SEQ ID NO: 99378 - protein, 9 aa, Artificial Sequence
  Description of Artificial Sequence: Synthetic peptide
  Seed: TTDDATAMA (MAGC3_HUMAN)
TMDDATAMM

SEQ ID NO: 99379 - protein, 10 aa, Artificial Sequence
  Description of Artificial Sequence: Synthetic peptide
  Seed: SLVLCPTYFK (MAGC3_HUMAN)
SPVLCPTYFR

SEQ ID NO: 99380 - protein, 9 aa, Artificial Sequence
  Description of Artificial Sequence: Synthetic peptide
  Seed: ATYALSPVV (MAGC3_HUMAN)
AAYALSPVV

SEQ ID NO: 99381 - protein, 9 aa, Artificial Sequence
  Description of Artificial Sequence: Synthetic peptide
  Seed: GEKAGSLPE (MAGC3_HUMAN)
GEKAGSLPA

SEQ ID NO: 99382 - protein, 10 aa, Artificial Sequence
  Description of Artificial Sequence: Synthetic peptide
  Seed: YALSPVVLPP (MAGC3_HUMAN)
YKLSPVVLPI

SEQ ID NO: 99383 - protein, 9 aa, Artificial Sequence
  Description of Artificial Sequence: Synthetic peptide
  Seed: HFYVFVNTL (MAGC3_HUMAN)
HAYVFVNTL

SEQ ID NO: 99384 - protein, 10 aa, Artificial Sequence
  Description of Artificial Sequence: Synthetic peptide
  Seed: MQMNVINTYT (MAGC3_HUMAN)
MHMNVINTYY

SEQ ID NO: 99385 - protein, 9 aa, Artificial Sequence
  Description of Artificial Sequence: Synthetic peptide
  Seed: MDPDNHSYF (MAGC3_HUMAN)
MQPDNHSYY

SEQ ID NO: 99386 - protein, 10 aa, Artificial Sequence
  Description of Artificial Sequence: Synthetic peptide
  Seed: TLSGSPGLQL (MAGC3_HUMAN)
TMSGSPGLQV

SEQ ID NO: 99387 - protein, 10 aa, Artificial Sequence
  Description of Artificial Sequence: Synthetic peptide
  Seed: FKLWRTLSGS (MAGC3_HUMAN)
FRLWRTLSGA

SEQ ID NO: 99388 - protein, 9 aa, Artificial Sequence
  Description of Artificial Sequence: Synthetic peptide
  Seed: SAFHLGHLR (MAGC3_HUMAN)
SFFHLGHLK

SEQ ID NO: 99389 - protein, 11 aa, Artificial Sequence
  Description of Artificial Sequence: Synthetic peptide
  Seed: ALWESEGPEAF (MAGC3_HUMAN)
ARWESEGPEAY

SEQ ID NO: 99390 - protein, 10 aa, Artificial Sequence
  Description of Artificial Sequence: Synthetic peptide
  Seed: SPLDSCSSPL (MAGC3_HUMAN)
SALDSCSSPV

SEQ ID NO: 99391 - protein, 10 aa, Artificial Sequence
  Description of Artificial Sequence: Synthetic peptide
  Seed: SAFHLGHLRE (MAGC3_HUMAN)
SMFHLGHLRY

SEQ ID NO: 99392 - protein, 11 aa, Artificial Sequence
  Description of Artificial Sequence: Synthetic peptide
  Seed: AIGPWSALAGF (MAGC3_HUMAN)
AQGPWSALAGY

SEQ ID NO: 99393 - protein, 10 aa, Artificial Sequence
  Description of Artificial Sequence: Synthetic peptide
  Seed: TTDDATAMAS (MAGC3_HUMAN)
TGDDATAMAY

SEQ ID NO: 99394 - protein, 9 aa, Artificial Sequence
  Description of Artificial Sequence: Synthetic peptide
  Seed: EVIWEVLSA (MAGC3_HUMAN)
EIIWEVLSY

SEQ ID NO: 99395 - protein, 9 aa, Artificial Sequence
  Description of Artificial Sequence: Synthetic peptide
  Seed: CHWVLDATF (MAGC3_HUMAN)
CQWVLDATY

SEQ ID NO: 99396 - protein, 9 aa, Artificial Sequence
  Description of Artificial Sequence: Synthetic peptide
  Seed: EMLTTVIKK (MAGC3_HUMAN)
EMLTTVIKR

SEQ ID NO: 99397 - protein, 9 aa, Artificial Sequence
  Description of Artificial Sequence: Synthetic peptide
  Seed: FVNTLDLTC (MAGC3_HUMAN)
FMNTLDLTL

SEQ ID NO: 99398 - protein, 9 aa, Artificial Sequence
  Description of Artificial Sequence: Synthetic peptide
  Seed: NAIGPWSAL (MAGC3_HUMAN)
NTIGPWSAA

SEQ ID NO: 99399 - protein, 9 aa, Artificial Sequence
  Description of Artificial Sequence: Synthetic peptide
  Seed: WRRGTGYTL (MAGC3_HUMAN)
WFRGTGYTM

SEQ ID NO: 99400 - protein, 10 aa, Artificial Sequence
  Description of Artificial Sequence: Synthetic peptide
  Seed: KKYKDYFPMI (MAGC3_HUMAN)
KWYKDYFPMM

SEQ ID NO: 99401 - protein, 9 aa, Artificial Sequence
  Description of Artificial Sequence: Synthetic peptide
  Seed: GYFPMIFRK (MAGC3_HUMAN)
GSFPMIFRR

SEQ ID NO: 99402 - protein, 10 aa, Artificial Sequence
  Description of Artificial Sequence: Synthetic peptide
  Seed: GHLREVRLFL (MAGC3_HUMAN)
GFLREVRLFV

SEQ ID NO: 99403 - protein, 10 aa, Artificial Sequence
  Description of Artificial Sequence: Synthetic peptide
  Seed: IKKYKDYFPM (MAGC3_HUMAN)
IYKYKDYFPY

SEQ ID NO: 99404 - protein, 10 aa, Artificial Sequence
  Description of Artificial Sequence: Synthetic peptide
  Seed: TAMASASPSV (MAGC3_HUMAN)
TVMASASPSV

SEQ ID NO: 99405 - protein, 9 aa, Artificial Sequence
  Description of Artificial Sequence: Synthetic peptide
  Seed: SIIPSAFPS (MAGC3_HUMAN)
SLIPSAFPA

SEQ ID NO: 99406 - protein, 9 aa, Artificial Sequence
  Description of Artificial Sequence: Synthetic peptide
  Seed: MQMNVINTY (MAGC3_HUMAN)
MDMNVINTV

SEQ ID NO: 99407 - protein, 10 aa, Artificial Sequence
  Description of Artificial Sequence: Synthetic peptide
  Seed: ATYALSPVVL (MAGC3_HUMAN)
AQYALSPVVF

SEQ ID NO: 99408 - protein, 9 aa, Artificial Sequence
  Description of Artificial Sequence: Synthetic peptide
  Seed: YALSPVVLP (MAGC3_HUMAN)
YVLSPVVLF

SEQ ID NO: 99409 - protein, 9 aa, Artificial Sequence
  Description of Artificial Sequence: Synthetic peptide
  Seed: AHEFIELIF (MAGC3_HUMAN)
AQEFIELIY

SEQ ID NO: 99410 - protein, 10 aa, Artificial Sequence
  Description of Artificial Sequence: Synthetic peptide
  Seed: TLSGSPGLQL (MAGC3_HUMAN)
TASGSPGLQF

SEQ ID NO: 99411 - protein, 9 aa, Artificial Sequence
  Description of Artificial Sequence: Synthetic peptide
  Seed: EFIELIFGI (MAGC3_HUMAN)
ETIELIFGL

SEQ ID NO: 99412 - protein, 10 aa, Artificial Sequence
  Description of Artificial Sequence: Synthetic peptide
  Seed: YTLDEKVDKL (MAGC3_HUMAN)
YALDEKVDKF

SEQ ID NO: 99413 - protein, 9 aa, Artificial Sequence
  Description of Artificial Sequence: Synthetic peptide
  Seed: YQAKEPLTR (MAGC3_HUMAN)
YYAKEPLTL

SEQ ID NO: 99414 - protein, 9 aa, Artificial Sequence
  Description of Artificial Sequence: Synthetic peptide
  Seed: ALDEKVAEL (MAGC3_HUMAN)
ATDEKVAEY

SEQ ID NO: 99415 - protein, 10 aa, Artificial Sequence
  Description of Artificial Sequence: Synthetic peptide
  Seed: SCSSPLLWTR (MAGC3_HUMAN)
SNSSPLLWTR

SEQ ID NO: 99416 - protein, 9 aa, Artificial Sequence
  Description of Artificial Sequence: Synthetic peptide
  Seed: EFLSKLSSI (MAGC3_HUMAN)
EALSKLSSL

SEQ ID NO: 99417 - protein, 10 aa, Artificial Sequence
  Description of Artificial Sequence: Synthetic peptide
  Seed: YALSPVVLPP (MAGC3_HUMAN)
YRLSPVVLPM

SEQ ID NO: 99418 - protein, 10 aa, Artificial Sequence
  Description of Artificial Sequence: Synthetic peptide
  Seed: ALDEKVAELV (MAGC3_HUMAN)
AQDEKVAELI

SEQ ID NO: 99419 - protein, 10 aa, Artificial Sequence
  Description of Artificial Sequence: Synthetic peptide
  Seed: ALWESEGPEA (MAGC3_HUMAN)
AMWESEGPEV

SEQ ID NO: 99420 - protein, 10 aa, Artificial Sequence
  Description of Artificial Sequence: Synthetic peptide
  Seed: ALWESEGPEA (MAGC3_HUMAN)
AIWESEGPEV

SEQ ID NO: 99421 - protein, 9 aa, Artificial Sequence
  Description of Artificial Sequence: Synthetic peptide
  Seed: YSAFHLGHL (MAGC3_HUMAN)
YTAFHLGHK

SEQ ID NO: 99422 - protein, 9 aa, Artificial Sequence
  Description of Artificial Sequence: Synthetic peptide
  Seed: FGSQPEGKF (MAGC3_HUMAN)
FASQPEGKY

SEQ ID NO: 99423 - protein, 9 aa, Artificial Sequence
  Description of Artificial Sequence: Synthetic peptide
  Seed: NAIGPWSAL (MAGC3_HUMAN)
NHIGPWSAY

SEQ ID NO: 99424 - protein, 11 aa, Artificial Sequence
  Description of Artificial Sequence: Synthetic peptide
  Seed: INTYTGYFPMI (MAGC3_HUMAN)
IPTYTGYFPMF

SEQ ID NO: 99425 - protein, 11 aa, Artificial Sequence
  Description of Artificial Sequence: Synthetic peptide
  Seed: LDSCSSPLLWT (MAGC3_HUMAN)
LSSCSSPLLWS

SEQ ID NO: 99426 - protein, 10 aa, Artificial Sequence
  Description of Artificial Sequence: Synthetic peptide
  Seed: MPAAGMPPLP (MAGC3_HUMAN)
MVAAGMPPLY

SEQ ID NO: 99427 - protein, 9 aa, Artificial Sequence
  Description of Artificial Sequence: Synthetic peptide
  Seed: QPEGKFSLR (MAGC3_HUMAN)
QAEGKFSLR

SEQ ID NO: 99428 - protein, 9 aa, Artificial Sequence
  Description of Artificial Sequence: Synthetic peptide
  Seed: TLDEKVDKL (MAGC3_HUMAN)
TMDEKVDKL

SEQ ID NO: 99429 - protein, 11 aa, Artificial Sequence
  Description of Artificial Sequence: Synthetic peptide
  Seed: AEMQMNVINTY (MAGC3_HUMAN)
AMMQMNVINTY

SEQ ID NO: 99430 - protein, 9 aa, Artificial Sequence
  Description of Artificial Sequence: Synthetic peptide
  Seed: MASASPSVM (MAGC3_HUMAN)
MNSASPSVF

SEQ ID NO: 99431 - protein, 9 aa, Artificial Sequence
  Description of Artificial Sequence: Synthetic peptide
  Seed: MEDRAQAII (MAGC3_HUMAN)
MIDRAQAIM

SEQ ID NO: 99432 - protein, 9 aa, Artificial Sequence
  Description of Artificial Sequence: Synthetic peptide
  Seed: KNCLLILIL (MAGC3_HUMAN)
KSCLLILIY

SEQ ID NO: 99433 - protein, 9 aa, Artificial Sequence
  Description of Artificial Sequence: Synthetic peptide
  Seed: EVDPDHFYV (MAGC3_HUMAN)
ETDPDHFYM

SEQ ID NO: 99434 - protein, 10 aa, Artificial Sequence
  Description of Artificial Sequence: Synthetic peptide
  Seed: KLSSIIPSAF (MAGC3_HUMAN)
KLSSIIPSAK

SEQ ID NO: 99435 - protein, 9 aa, Artificial Sequence
  Description of Artificial Sequence: Synthetic peptide
  Seed: SQPEGKFSL (MAGC3_HUMAN)
SRPEGKFSF

SEQ ID NO: 99436 - protein, 8 aa, Artificial Sequence
  Description of Artificial Sequence: Synthetic peptide
  Seed: KAHEFIEL (MAGC3_HUMAN)
KAHEFIEY

SEQ ID NO: 99437 - protein, 9 aa, Artificial Sequence
  Description of Artificial Sequence: Synthetic peptide
  Seed: TLDEKVDKL (MAGC3_HUMAN)
TNDEKVDKM

SEQ ID NO: 99438 - protein, 9 aa, Artificial Sequence
  Description of Artificial Sequence: Synthetic peptide
  Seed: WRRGTGYTL (MAGC3_HUMAN)
WQRGTGYTY

SEQ ID NO: 99439 - protein, 10 aa, Artificial Sequence
  Description of Artificial Sequence: Synthetic peptide
  Seed: FKLWRTLSGS (MAGC3_HUMAN)
FGLWRTLSGI

SEQ ID NO: 99440 - protein, 10 aa, Artificial Sequence
  Description of Artificial Sequence: Synthetic peptide
  Seed: SLTEVDPDHF (MAGC3_HUMAN)
SMTEVDPDHW

SEQ ID NO: 99441 - protein, 11 aa, Artificial Sequence
  Description of Artificial Sequence: Synthetic peptide
  Seed: TLWKDSDLPTW (MAGC3_HUMAN)
TVWKDSDLPTW

SEQ ID NO: 99442 - protein, 9 aa, Artificial Sequence
  Description of Artificial Sequence: Synthetic peptide
  Seed: FHLGHLREV (MAGC3_HUMAN)
FHLGHLREL

SEQ ID NO: 99443 - protein, 11 aa, Artificial Sequence
  Description of Artificial Sequence: Synthetic peptide
  Seed: RYALDEKVAEL (MAGC3_HUMAN)
RFALDEKVAEV

SEQ ID NO: 99444 - protein, 9 aa, Artificial Sequence
  Description of Artificial Sequence: Synthetic peptide
  Seed: MIFRKAREF (MAGC3_HUMAN)
MQFRKAREV

SEQ ID NO: 99445 - protein, 9 aa, Artificial Sequence
  Description of Artificial Sequence: Synthetic peptide
  Seed: HLREVRLFL (MAGC3_HUMAN)
HIREVRLFG

SEQ ID NO: 99446 - protein, 10 aa, Artificial Sequence
  Description of Artificial Sequence: Synthetic peptide
  Seed: FPSWYMDALK (MAGC3_HUMAN)
FPSWYMDALA

SEQ ID NO: 99447 - protein, 10 aa, Artificial Sequence
  Description of Artificial Sequence: Synthetic peptide
  Seed: REVLEFLSKL (MAGC3_HUMAN)
RLVLEFLSKL

SEQ ID NO: 99448 - protein, 10 aa, Artificial Sequence
  Description of Artificial Sequence: Synthetic peptide
  Seed: GSCVPEEVIW (MAGC3_HUMAN)
GTCVPEEVIW

SEQ ID NO: 99449 - protein, 10 aa, Artificial Sequence
  Description of Artificial Sequence: Synthetic peptide
  Seed: SIIPSAFPSW (MAGC3_HUMAN)
SIIPSAFPSY

SEQ ID NO: 99450 - protein, 10 aa, Artificial Sequence
  Description of Artificial Sequence: Synthetic peptide
  Seed: KVAELVQFLL (MAGC3_HUMAN)
KTAELVQFLR

SEQ ID NO: 99451 - protein, 9 aa, Artificial Sequence
  Description of Artificial Sequence: Synthetic peptide
  Seed: YALSPVVLP (MAGC3_HUMAN)
YGLSPVVLY

SEQ ID NO: 99452 - protein, 9 aa, Artificial Sequence
  Description of Artificial Sequence: Synthetic peptide
  Seed: KAHEFIELI (MAGC3_HUMAN)
KTHEFIELI

SEQ ID NO: 99453 - protein, 9 aa, Artificial Sequence
  Description of Artificial Sequence: Synthetic peptide
  Seed: LLILILSVI (MAGC3_HUMAN)
LLILILSVV

SEQ ID NO: 99454 - protein, 10 aa, Artificial Sequence
  Description of Artificial Sequence: Synthetic peptide
  Seed: TAMASASPSV (MAGC3_HUMAN)
TPMASASPSV

SEQ ID NO: 99455 - protein, 9 aa, Artificial Sequence
  Description of Artificial Sequence: Synthetic peptide
  Seed: ALDEKVAEL (MAGC3_HUMAN)
AVDEKVAEY

SEQ ID NO: 99456 - protein, 9 aa, Artificial Sequence
  Description of Artificial Sequence: Synthetic peptide
  Seed: ATYALSPVV (MAGC3_HUMAN)
AMYALSPVV

SEQ ID NO: 99457 - protein, 10 aa, Artificial Sequence
  Description of Artificial Sequence: Synthetic peptide
  Seed: MPAAGMPPLP (MAGC3_HUMAN)
MPAAGMPPLV

SEQ ID NO: 99458 - protein, 9 aa, Artificial Sequence
  Description of Artificial Sequence: Synthetic peptide
  Seed: QRMDSLVLC (MAGC3_HUMAN)
QRMDSLVLI

SEQ ID NO: 99459 - protein, 9 aa, Artificial Sequence
  Description of Artificial Sequence: Synthetic peptide
  Seed: SQPEGKFSL (MAGC3_HUMAN)
SSPEGKFSI

SEQ ID NO: 99460 - protein, 9 aa, Artificial Sequence
  Description of Artificial Sequence: Synthetic peptide
  Seed: NTYTGYFPM (MAGC3_HUMAN)
NQYTGYFPV

SEQ ID NO: 99461 - protein, 9 aa, Artificial Sequence
  Description of Artificial Sequence: Synthetic peptide
  Seed: VDPDHFYVF (MAGC3_HUMAN)
VQPDHFYVL

SEQ ID NO: 99462 - protein, 9 aa, Artificial Sequence
  Description of Artificial Sequence: Synthetic peptide
  Seed: MQMNVINTY (MAGC3_HUMAN)
MKMNVINTY

SEQ ID NO: 99463 - protein, 9 aa, Artificial Sequence
  Description of Artificial Sequence: Synthetic peptide
  Seed: AIGPWSALA (MAGC3_HUMAN)
ALGPWSALV

SEQ ID NO: 99464 - protein, 9 aa, Artificial Sequence
  Description of Artificial Sequence: Synthetic peptide
  Seed: NAIGPWSAL (MAGC3_HUMAN)
NWIGPWSAM

SEQ ID NO: 99465 - protein, 10 aa, Artificial Sequence
  Description of Artificial Sequence: Synthetic peptide
  Seed: YTGYFPMIFR (MAGC3_HUMAN)
YGGYFPMIFR

SEQ ID NO: 99466 - protein, 9 aa, Artificial Sequence
  Description of Artificial Sequence: Synthetic peptide
  Seed: ALSPVVLPP (MAGC3_HUMAN)
AISPVVLPI

SEQ ID NO: 99467 - protein, 11 aa, Artificial Sequence
  Description of Artificial Sequence: Synthetic peptide
  Seed: FPMIFRKAREF (MAGC3_HUMAN)
FPMIFRKAREW

SEQ ID NO: 99468 - protein, 9 aa, Artificial Sequence
  Description of Artificial Sequence: Synthetic peptide
  Seed: IQRPAREVL (MAGC3_HUMAN)
IHRPAREVY

SEQ ID NO: 99469 - protein, 9 aa, Artificial Sequence
  Description of Artificial Sequence: Synthetic peptide
  Seed: RTLSGSPGL (MAGC3_HUMAN)
RMLSGSPGI

SEQ ID NO: 99470 - protein, 11 aa, Artificial Sequence
  Description of Artificial Sequence: Synthetic peptide
  Seed: LSKLSSIIPSA (MAGC3_HUMAN)
LQKLSSIIPSV

SEQ ID NO: 99471 - protein, 11 aa, Artificial Sequence
  Description of Artificial Sequence: Synthetic peptide
  Seed: YALDEKVAELV (MAGC3_HUMAN)
YMLDEKVAELD

SEQ ID NO: 99472 - protein, 10 aa, Artificial Sequence
  Description of Artificial Sequence: Synthetic peptide
  Seed: YALSPVVLPP (MAGC3_HUMAN)
YQLSPVVLPL

SEQ ID NO: 99473 - protein, 11 aa, Artificial Sequence
  Description of Artificial Sequence: Synthetic peptide
  Seed: SLVLCPTYFKL (MAGC3_HUMAN)
SMVLCPTYFKK

SEQ ID NO: 99474 - protein, 9 aa, Artificial Sequence
  Description of Artificial Sequence: Synthetic peptide
  Seed: KLSSIIPSA (MAGC3_HUMAN)
KLSSIIPSR

SEQ ID NO: 99475 - protein, 10 aa, Artificial Sequence
  Description of Artificial Sequence: Synthetic peptide
  Seed: LPTWRRGTGY (MAGC3_HUMAN)
LITWRRGTGW

SEQ ID NO: 99476 - protein, 10 aa, Artificial Sequence
  Description of Artificial Sequence: Synthetic peptide
  Seed: EVIWEVLSAI (MAGC3_HUMAN)
EMIWEVLSAY

SEQ ID NO: 99477 - protein, 9 aa, Artificial Sequence
  Description of Artificial Sequence: Synthetic peptide
  Seed: VLCPTYFKL (MAGC3_HUMAN)
VMCPTYFKI

SEQ ID NO: 99478 - protein, 9 aa, Artificial Sequence
  Description of Artificial Sequence: Synthetic peptide
  Seed: DMDPDNHSY (MAGC3_HUMAN)
DTDPDNHSI

SEQ ID NO: 99479 - protein, 8 aa, Artificial Sequence
  Description of Artificial Sequence: Synthetic peptide
  Seed: SCSSPLLW (MAGC3_HUMAN)
SYSSPLLW

SEQ ID NO: 99480 - protein, 9 aa, Artificial Sequence
  Description of Artificial Sequence: Synthetic peptide
  Seed: SQPEGKFSL (MAGC3_HUMAN)
SQPEGKFSV

SEQ ID NO: 99481 - protein, 11 aa, Artificial Sequence
  Description of Artificial Sequence: Synthetic peptide
  Seed: SSEEEDTATWH (MAGC3_HUMAN)
SMEEEDTATWY

SEQ ID NO: 99482 - protein, 10 aa, Artificial Sequence
  Description of Artificial Sequence: Synthetic peptide
  Seed: NVINTYTGYF (MAGC3_HUMAN)
NVINTYTGYY

SEQ ID NO: 99483 - protein, 9 aa, Artificial Sequence
  Description of Artificial Sequence: Synthetic peptide
  Seed: LSDEQGMPQ (MAGC3_HUMAN)
LSDEQGMPV

SEQ ID NO: 99484 - protein, 9 aa, Artificial Sequence
  Description of Artificial Sequence: Synthetic peptide
  Seed: FPMIFRKAR (MAGC3_HUMAN)
FPMIFRKAA

SEQ ID NO: 99485 - protein, 9 aa, Artificial Sequence
  Description of Artificial Sequence: Synthetic peptide
  Seed: TLDEKVDKL (MAGC3_HUMAN)
TEDEKVDKL

SEQ ID NO: 99486 - protein, 10 aa, Artificial Sequence
  Description of Artificial Sequence: Synthetic peptide
  Seed: ILILSVIFIK (MAGC3_HUMAN)
ISILSVIFIR

SEQ ID NO: 99487 - protein, 11 aa, Artificial Sequence
  Description of Artificial Sequence: Synthetic peptide
  Seed: YSAFHLGHLRE (MAGC3_HUMAN)
YTAFHLGHLRR

SEQ ID NO: 99488 - protein, 8 aa, Artificial Sequence
  Description of Artificial Sequence: Synthetic peptide
  Seed: IFIKGSCV (MAGC3_HUMAN)
IYIKGSCL

SEQ ID NO: 99489 - protein, 9 aa, Artificial Sequence
  Description of Artificial Sequence: Synthetic peptide
  Seed: MEDRAQAII (MAGC3_HUMAN)
MLDRAQAIL

SEQ ID NO: 99490 - protein, 9 aa, Artificial Sequence
  Description of Artificial Sequence: Synthetic peptide
  Seed: KLSSIIPSA (MAGC3_HUMAN)
KESSIIPSV

SEQ ID NO: 99491 - protein, 9 aa, Artificial Sequence
  Description of Artificial Sequence: Synthetic peptide
  Seed: KVDKLVQFL (MAGC3_HUMAN)
KVDKLVQFR

SEQ ID NO: 99492 - protein, 10 aa, Artificial Sequence
  Description of Artificial Sequence: Synthetic peptide
  Seed: INTYTGYFPM (MAGC3_HUMAN)
IQTYTGYFPM

SEQ ID NO: 99493 - protein, 9 aa, Artificial Sequence
  Description of Artificial Sequence: Synthetic peptide
  Seed: NTYTGYFPM (MAGC3_HUMAN)
NYYTGYFPL

SEQ ID NO: 99494 - protein, 9 aa, Artificial Sequence
  Description of Artificial Sequence: Synthetic peptide
  Seed: TLDEKVDKL (MAGC3_HUMAN)
TADEKVDKL

SEQ ID NO: 99495 - protein, 9 aa, Artificial Sequence
  Description of Artificial Sequence: Synthetic peptide
  Seed: NTYTGYFPM (MAGC3_HUMAN)
NIYTGYFPL

SEQ ID NO: 99496 - protein, 9 aa, Artificial Sequence
  Description of Artificial Sequence: Synthetic peptide
  Seed: YQAKEPLTR (MAGC3_HUMAN)
YMAKEPLTY

SEQ ID NO: 99497 - protein, 10 aa, Artificial Sequence
  Description of Artificial Sequence: Synthetic peptide
  Seed: IPSAFPSWYM (MAGC3_HUMAN)
ILSAFPSWYF

SEQ ID NO: 99498 - protein, 9 aa, Artificial Sequence
  Description of Artificial Sequence: Synthetic peptide
  Seed: KLVQFLLLK (MAGC3_HUMAN)
KMVQFLLLK

SEQ ID NO: 99499 - protein, 10 aa, Artificial Sequence
  Description of Artificial Sequence: Synthetic peptide
  Seed: EVIWEVLNAI (MAGC3_HUMAN)
EAIWEVLNAK

SEQ ID NO: 99500 - protein, 9 aa, Artificial Sequence
  Description of Artificial Sequence: Synthetic peptide
  Seed: MIFGKAHEF (MAGC3_HUMAN)
MHFGKAHEM

SEQ ID NO: 99501 - protein, 10 aa, Artificial Sequence
  Description of Artificial Sequence: Synthetic peptide
  Seed: TAMASASPSV (MAGC3_HUMAN)
TNMASASPSL

SEQ ID NO: 99502 - protein, 9 aa, Artificial Sequence
  Description of Artificial Sequence: Synthetic peptide
  Seed: MDPDNHSYF (MAGC3_HUMAN)
MGPDNHSYF

SEQ ID NO: 99503 - protein, 9 aa, Artificial Sequence
  Description of Artificial Sequence: Synthetic peptide
  Seed: MPPLPQSPP (MAGC3_HUMAN)
MPPLPQSPL

SEQ ID NO: 99504 - protein, 10 aa, Artificial Sequence
  Description of Artificial Sequence: Synthetic peptide
  Seed: VLDLANPQGL (MAGC3_HUMAN)
VTDLANPQGM

SEQ ID NO: 99505 - protein, 9 aa, Artificial Sequence
  Description of Artificial Sequence: Synthetic peptide
  Seed: FGSQPEGKF (MAGC3_HUMAN)
FISQPEGKY

SEQ ID NO: 99506 - protein, 10 aa, Artificial Sequence
  Description of Artificial Sequence: Synthetic peptide
  Seed: FSDGSLGQWV (MAGC3_HUMAN)
FIDGSLGQWM

SEQ ID NO: 99507 - protein, 9 aa, Artificial Sequence
  Description of Artificial Sequence: Synthetic peptide
  Seed: EVIWEVLSA (MAGC3_HUMAN)
ETIWEVLSI

SEQ ID NO: 99508 - protein, 9 aa, Artificial Sequence
  Description of Artificial Sequence: Synthetic peptide
  Seed: TKAEMLTTV (MAGC3_HUMAN)
THAEMLTTL

SEQ ID NO: 99509 - protein, 9 aa, Artificial Sequence
  Description of Artificial Sequence: Synthetic peptide
  Seed: KKYKDYFPM (MAGC3_HUMAN)
KAYKDYFPF

SEQ ID NO: 99510 - protein, 9 aa, Artificial Sequence
  Description of Artificial Sequence: Synthetic peptide
  Seed: EAFCEESGL (MAGC3_HUMAN)
ETFCEESGV

SEQ ID NO: 99511 - protein, 10 aa, Artificial Sequence
  Description of Artificial Sequence: Synthetic peptide
  Seed: YTLDEKVDKL (MAGC3_HUMAN)
YTLDEKVDKV

SEQ ID NO: 99512 - protein, 10 aa, Artificial Sequence
  Description of Artificial Sequence: Synthetic peptide
  Seed: FFEDTLDLTY (MAGC3_HUMAN)
FVEDTLDLTL

SEQ ID NO: 99513 - protein, 9 aa, Artificial Sequence
  Description of Artificial Sequence: Synthetic peptide
  Seed: MEDRAQAII (MAGC3_HUMAN)
MYDRAQAIM

SEQ ID NO: 99514 - protein, 10 aa, Artificial Sequence
  Description of Artificial Sequence: Synthetic peptide
  Seed: IELIFGIALT (MAGC3_HUMAN)
ICLIFGIALA

SEQ ID NO: 99515 - protein, 9 aa, Artificial Sequence
  Description of Artificial Sequence: Synthetic peptide
  Seed: QMNVINTYT (MAGC3_HUMAN)
QVNVINTYV

SEQ ID NO: 99516 - protein, 11 aa, Artificial Sequence
  Description of Artificial Sequence: Synthetic peptide
  Seed: YALDEKVAELV (MAGC3_HUMAN)
YFLDEKVAELV

SEQ ID NO: 99517 - protein, 9 aa, Artificial Sequence
  Description of Artificial Sequence: Synthetic peptide
  Seed: EKVDKLVQF (MAGC3_HUMAN)
EHVDKLVQL

SEQ ID NO: 99518 - protein, 9 aa, Artificial Sequence
  Description of Artificial Sequence: Synthetic peptide
  Seed: KAHEFIELI (MAGC3_HUMAN)
KYHEFIELI

SEQ ID NO: 99519 - protein, 9 aa, Artificial Sequence
  Description of Artificial Sequence: Synthetic peptide
  Seed: LANPQGLAG (MAGC3_HUMAN)
LSNPQGLAF

SEQ ID NO: 99520 - protein, 10 aa, Artificial Sequence
  Description of Artificial Sequence: Synthetic peptide
  Seed: INTYTGYFPM (MAGC3_HUMAN)
IYTYTGYFPF

SEQ ID NO: 99521 - protein, 11 aa, Artificial Sequence
  Description of Artificial Sequence: Synthetic peptide
  Seed: YALDEKVAELV (MAGC3_HUMAN)
YMLDEKVAELT

SEQ ID NO: 99522 - protein, 9 aa, Artificial Sequence
  Description of Artificial Sequence: Synthetic peptide
  Seed: YKDYFPMIF (MAGC3_HUMAN)
YYDYFPMIF

SEQ ID NO: 99523 - protein, 9 aa, Artificial Sequence
  Description of Artificial Sequence: Synthetic peptide
  Seed: HSYFFEDTL (MAGC3_HUMAN)
HPYFFEDTI

SEQ ID NO: 99524 - protein, 11 aa, Artificial Sequence
  Description of Artificial Sequence: Synthetic peptide
  Seed: KDMEDRAQAII (MAGC3_HUMAN)
KEMEDRAQAIA

SEQ ID NO: 99525 - protein, 10 aa, Artificial Sequence
  Description of Artificial Sequence: Synthetic peptide
  Seed: LTEASPQQKK (MAGC3_HUMAN)
LSEASPQQKY

SEQ ID NO: 99526 - protein, 9 aa, Artificial Sequence
  Description of Artificial Sequence: Synthetic peptide
  Seed: SASPSVMST (MAGC3_HUMAN)
SVSPSVMSI

SEQ ID NO: 99527 - protein, 9 aa, Artificial Sequence
  Description of Artificial Sequence: Synthetic peptide
  Seed: ELIFGIALT (MAGC3_HUMAN)
ESIFGIALV

SEQ ID NO: 99528 - protein, 9 aa, Artificial Sequence
  Description of Artificial Sequence: Synthetic peptide
  Seed: MDPDNHSYF (MAGC3_HUMAN)
MPPDNHSYL

SEQ ID NO: 99529 - protein, 9 aa, Artificial Sequence
  Description of Artificial Sequence: Synthetic peptide
  Seed: IFGKAHEFI (MAGC3_HUMAN)
IWGKAHEFF

SEQ ID NO: 99530 - protein, 10 aa, Artificial Sequence
  Description of Artificial Sequence: Synthetic peptide
  Seed: RLWGEKAGSL (MAGC3_HUMAN)
RAWGEKAGSY

SEQ ID NO: 99531 - protein, 10 aa, Artificial Sequence
  Description of Artificial Sequence: Synthetic peptide
  Seed: ILFGISLTEV (MAGC3_HUMAN)
IMFGISLTEL

SEQ ID NO: 99532 - protein, 9 aa, Artificial Sequence
  Description of Artificial Sequence: Synthetic peptide
  Seed: LRSAEGSVL (MAGC3_HUMAN)
LKSAEGSVL

SEQ ID NO: 99533 - protein, 10 aa, Artificial Sequence
  Description of Artificial Sequence: Synthetic peptide
  Seed: LPTWRRGTGY (MAGC3_HUMAN)
LMTWRRGTGW

SEQ ID NO: 99534 - protein, 10 aa, Artificial Sequence
  Description of Artificial Sequence: Synthetic peptide
  Seed: YSAFHLGHLR (MAGC3_HUMAN)
YYAFHLGHLK

SEQ ID NO: 99535 - protein, 9 aa, Artificial Sequence
  Description of Artificial Sequence: Synthetic peptide
  Seed: TTDDATAMA (MAGC3_HUMAN)
TADDATAMI

SEQ ID NO: 99536 - protein, 9 aa, Artificial Sequence
  Description of Artificial Sequence: Synthetic peptide
  Seed: SPVVLPPQP (MAGC3_HUMAN)
SPVVLPPQM

SEQ ID NO: 99537 - protein, 9 aa, Artificial Sequence
  Description of Artificial Sequence: Synthetic peptide
  Seed: MPKNCLLIL (MAGC3_HUMAN)
MPKNCLLIW

SEQ ID NO: 99538 - protein, 10 aa, Artificial Sequence
  Description of Artificial Sequence: Synthetic peptide
  Seed: CASEEVIWEV (MAGC3_HUMAN)
CMSEEVIWEV

SEQ ID NO: 99539 - protein, 10 aa, Artificial Sequence
  Description of Artificial Sequence: Synthetic peptide
  Seed: EKVAELVQFL (MAGC3_HUMAN)
ERVAELVQFY

SEQ ID NO: 99540 - protein, 10 aa, Artificial Sequence
  Description of Artificial Sequence: Synthetic peptide
  Seed: CSSPLLWTRL (MAGC3_HUMAN)
CSSPLLWTRW

SEQ ID NO: 99541 - protein, 9 aa, Artificial Sequence
  Description of Artificial Sequence: Synthetic peptide
  Seed: LSGSPGLQL (MAGC3_HUMAN)
LTGSPGLQM

SEQ ID NO: 99542 - protein, 9 aa, Artificial Sequence
  Description of Artificial Sequence: Synthetic peptide
  Seed: LIDDQGMPK (MAGC3_HUMAN)
LIDDQGMPY

SEQ ID NO: 99543 - protein, 8 aa, Artificial Sequence
  Description of Artificial Sequence: Synthetic peptide
  Seed: SDQRMDSL (MAGC3_HUMAN)
SEQRMDSL

SEQ ID NO: 99544 - protein, 9 aa, Artificial Sequence
  Description of Artificial Sequence: Synthetic peptide
  Seed: MPAAGMPPL (MAGC3_HUMAN)
MVAAGMPPF

SEQ ID NO: 99545 - protein, 9 aa, Artificial Sequence
  Description of Artificial Sequence: Synthetic peptide
  Seed: MIFRKAREF (MAGC3_HUMAN)
MVFRKAREF

SEQ ID NO: 99546 - protein, 9 aa, Artificial Sequence
  Description of Artificial Sequence: Synthetic peptide
  Seed: IQRPAREVL (MAGC3_HUMAN)
IARPAREVV

SEQ ID NO: 99547 - protein, 9 aa, Artificial Sequence
  Description of Artificial Sequence: Synthetic peptide
  Seed: SLVLCPTYF (MAGC3_HUMAN)
SVVLCPTYY

SEQ ID NO: 99548 - protein, 8 aa, Artificial Sequence
  Description of Artificial Sequence: Synthetic peptide
  Seed: VDKLVQFL (MAGC3_HUMAN)
VEKLVQFL

SEQ ID NO: 99549 - protein, 9 aa, Artificial Sequence
  Description of Artificial Sequence: Synthetic peptide
  Seed: ATDKDYSAF (MAGC3_HUMAN)
AGDKDYSAV

SEQ ID NO: 99550 - protein, 11 aa, Artificial Sequence
  Description of Artificial Sequence: Synthetic peptide
  Seed: AEMQMNVINTY (MAGC3_HUMAN)
AVMQMNVINTF

SEQ ID NO: 99551 - protein, 9 aa, Artificial Sequence
  Description of Artificial Sequence: Synthetic peptide
  Seed: EFIELIFGI (MAGC3_HUMAN)
EYIELIFGF

SEQ ID NO: 99552 - protein, 9 aa, Artificial Sequence
  Description of Artificial Sequence: Synthetic peptide
  Seed: DALKDMEDR (MAGC3_HUMAN)
DTLKDMEDR

SEQ ID NO: 99553 - protein, 9 aa, Artificial Sequence
  Description of Artificial Sequence: Synthetic peptide
  Seed: KVAELVQFL (MAGC3_HUMAN)
KIAELVQFA

SEQ ID NO: 99554 - protein, 10 aa, Artificial Sequence
  Description of Artificial Sequence: Synthetic peptide
  Seed: AMASASPSVM (MAGC3_HUMAN)
AAASASPSVM

SEQ ID NO: 99555 - protein, 10 aa, Artificial Sequence
  Description of Artificial Sequence: Synthetic peptide
  Seed: LLKYQAKEPL (MAGC3_HUMAN)
LQKYQAKEPY

SEQ ID NO: 99556 - protein, 10 aa, Artificial Sequence
  Description of Artificial Sequence: Synthetic peptide
  Seed: RPAREVLEFL (MAGC3_HUMAN)
RMAREVLEFK

SEQ ID NO: 99557 - protein, 9 aa, Artificial Sequence
  Description of Artificial Sequence: Synthetic peptide
  Seed: KVAELVQFL (MAGC3_HUMAN)
KMAELVQFR

SEQ ID NO: 99558 - protein, 11 aa, Artificial Sequence
  Description of Artificial Sequence: Synthetic peptide
  Seed: ATFSDGSLGQW (MAGC3_HUMAN)
AIFSDGSLGQK

SEQ ID NO: 99559 - protein, 11 aa, Artificial Sequence
  Description of Artificial Sequence: Synthetic peptide
  Seed: ATDKDYSAFHL (MAGC3_HUMAN)
ATDKDYSAFHY

SEQ ID NO: 99560 - protein, 10 aa, Artificial Sequence
  Description of Artificial Sequence: Synthetic peptide
  Seed: KVAELVQFLL (MAGC3_HUMAN)
KLAELVQFLT

SEQ ID NO: 99561 - protein, 9 aa, Artificial Sequence
  Description of Artificial Sequence: Synthetic peptide
  Seed: YSAFHLGHL (MAGC3_HUMAN)
YLAFHLGHV

SEQ ID NO: 99562 - protein, 9 aa, Artificial Sequence
  Description of Artificial Sequence: Synthetic peptide
  Seed: EVLSAIGPI (MAGC3_HUMAN)
ELLSAIGPR

SEQ ID NO: 99563 - protein, 10 aa, Artificial Sequence
  Description of Artificial Sequence: Synthetic peptide
  Seed: KVAELVQFLL (MAGC3_HUMAN)
KIAELVQFLV

SEQ ID NO: 99564 - protein, 9 aa, Artificial Sequence
  Description of Artificial Sequence: Synthetic peptide
  Seed: FKLWRTLSG (MAGC3_HUMAN)
FKLWRTLSM

SEQ ID NO: 99565 - protein, 9 aa, Artificial Sequence
  Description of Artificial Sequence: Synthetic peptide
  Seed: HLREVRLFL (MAGC3_HUMAN)
HVREVRLFR

SEQ ID NO: 99566 - protein, 9 aa, Artificial Sequence
  Description of Artificial Sequence: Synthetic peptide
  Seed: FADVLSRLA (MAGC3_HUMAN)
FSDVLSRLL

SEQ ID NO: 99567 - protein, 10 aa, Artificial Sequence
  Description of Artificial Sequence: Synthetic peptide
  Seed: FKLWRTLSGS (MAGC3_HUMAN)
FMLWRTLSGI

SEQ ID NO: 99568 - protein, 10 aa, Artificial Sequence
  Description of Artificial Sequence: Synthetic peptide
  Seed: KLSSIIPSAF (MAGC3_HUMAN)
KNSSIIPSAW

SEQ ID NO: 99569 - protein, 10 aa, Artificial Sequence
  Description of Artificial Sequence: Synthetic peptide
  Seed: LDSCSSPLLW (MAGC3_HUMAN)
LCSCSSPLLW

SEQ ID NO: 99570 - protein, 9 aa, Artificial Sequence
  Description of Artificial Sequence: Synthetic peptide
  Seed: KVAELVQFL (MAGC3_HUMAN)
KRAELVQFL

SEQ ID NO: 99571 - protein, 10 aa, Artificial Sequence
  Description of Artificial Sequence: Synthetic peptide
  Seed: TGYFPMIFRK (MAGC3_HUMAN)
TWYFPMIFRK

SEQ ID NO: 99572 - protein, 9 aa, Artificial Sequence
  Description of Artificial Sequence: Synthetic peptide
  Seed: MIFRKAREF (MAGC3_HUMAN)
MSFRKAREF

SEQ ID NO: 99573 - protein, 10 aa, Artificial Sequence
  Description of Artificial Sequence: Synthetic peptide
  Seed: SLVLCPTYFK (MAGC3_HUMAN)
SDVLCPTYFK

SEQ ID NO: 99574 - protein, 10 aa, Artificial Sequence
  Description of Artificial Sequence: Synthetic peptide
  Seed: REVRLFLRGG (MAGC3_HUMAN)
RLVRLFLRGV

SEQ ID NO: 99575 - protein, 10 aa, Artificial Sequence
  Description of Artificial Sequence: Synthetic peptide
  Seed: YQAKEPLTRA (MAGC3_HUMAN)
YMAKEPLTRV

SEQ ID NO: 99576 - protein, 9 aa, Artificial Sequence
  Description of Artificial Sequence: Synthetic peptide
  Seed: FLSKLSSII (MAGC3_HUMAN)
FQSKLSSIV

SEQ ID NO: 99577 - protein, 11 aa, Artificial Sequence
  Description of Artificial Sequence: Synthetic peptide
  Seed: YFFEDTLDLTY (MAGC3_HUMAN)
YKFEDTLDLTY

SEQ ID NO: 99578 - protein, 9 aa, Artificial Sequence
  Description of Artificial Sequence: Synthetic peptide
  Seed: VLPPQPQPR (MAGC3_HUMAN)
VSPPQPQPI

SEQ ID NO: 99579 - protein, 9 aa, Artificial Sequence
  Description of Artificial Sequence: Synthetic peptide
  Seed: YTLDEKVDK (MAGC3_HUMAN)
YALDEKVDM

SEQ ID NO: 99580 - protein, 10 aa, Artificial Sequence
  Description of Artificial Sequence: Synthetic peptide
  Seed: MIFRKAREFI (MAGC3_HUMAN)
MSFRKAREFA

SEQ ID NO: 99581 - protein, 10 aa, Artificial Sequence
  Description of Artificial Sequence: Synthetic peptide
  Seed: QWVKNTCATY (MAGC3_HUMAN)
QLVKNTCATY

SEQ ID NO: 99582 - protein, 9 aa, Artificial Sequence
  Description of Artificial Sequence: Synthetic peptide
  Seed: NTYTGYFPM (MAGC3_HUMAN)
NFYTGYFPV

SEQ ID NO: 99583 - protein, 9 aa, Artificial Sequence
  Description of Artificial Sequence: Synthetic peptide
  Seed: VLCPTYFKL (MAGC3_HUMAN)
VICPTYFKY

SEQ ID NO: 99584 - protein, 9 aa, Artificial Sequence
  Description of Artificial Sequence: Synthetic peptide
  Seed: RPAREVLEF (MAGC3_HUMAN)
RPAREVLEY

SEQ ID NO: 99585 - protein, 9 aa, Artificial Sequence
  Description of Artificial Sequence: Synthetic peptide
  Seed: ALDEKVAEL (MAGC3_HUMAN)
ASDEKVAEI

SEQ ID NO: 99586 - protein, 9 aa, Artificial Sequence
  Description of Artificial Sequence: Synthetic peptide
  Seed: IPPQGPPKI (MAGC3_HUMAN)
IWPQGPPKF

SEQ ID NO: 99587 - protein, 9 aa, Artificial Sequence
  Description of Artificial Sequence: Synthetic peptide
  Seed: ALDEKVAEL (MAGC3_HUMAN)
AIDEKVAEM

SEQ ID NO: 99588 - protein, 9 aa, Artificial Sequence
  Description of Artificial Sequence: Synthetic peptide
  Seed: FLSKLSSII (MAGC3_HUMAN)
FNSKLSSIF

SEQ ID NO: 99589 - protein, 9 aa, Artificial Sequence
  Description of Artificial Sequence: Synthetic peptide
  Seed: NAIGPWSAL (MAGC3_HUMAN)
NAIGPWSAM

SEQ ID NO: 99590 - protein, 11 aa, Artificial Sequence
  Description of Artificial Sequence: Synthetic peptide
  Seed: RYALDEKVAEL (MAGC3_HUMAN)
RLALDEKVAEV

SEQ ID NO: 99591 - protein, 10 aa, Artificial Sequence
  Description of Artificial Sequence: Synthetic peptide
  Seed: MDSLVLCPTY (MAGC3_HUMAN)
MPSLVLCPTW

SEQ ID NO: 99592 - protein, 9 aa, Artificial Sequence
  Description of Artificial Sequence: Synthetic peptide
  Seed: GLQLSDLHF (MAGC3_HUMAN)
GQQLSDLHY

SEQ ID NO: 99593 - protein, 10 aa, Artificial Sequence
  Description of Artificial Sequence: Synthetic peptide
  Seed: ATDKDYSAFH (MAGC3_HUMAN)
ALDKDYSAFY

SEQ ID NO: 99594 - protein, 9 aa, Artificial Sequence
  Description of Artificial Sequence: Synthetic peptide
  Seed: EVLSAIGPI (MAGC3_HUMAN)
ESLSAIGPK

SEQ ID NO: 99595 - protein, 9 aa, Artificial Sequence
  Description of Artificial Sequence: Synthetic peptide
  Seed: VINTYTGYF (MAGC3_HUMAN)
VFNTYTGYM

SEQ ID NO: 99596 - protein, 11 aa, Artificial Sequence
  Description of Artificial Sequence: Synthetic peptide
  Seed: LSKLSSIIPSA (MAGC3_HUMAN)
LVKLSSIIPSI

SEQ ID NO: 99597 - protein, 9 aa, Artificial Sequence
  Description of Artificial Sequence: Synthetic peptide
  Seed: ALDEKVAEL (MAGC3_HUMAN)
ASDEKVAET

SEQ ID NO: 99598 - protein, 11 aa, Artificial Sequence
  Description of Artificial Sequence: Synthetic peptide
  Seed: TTDDATAMASA (MAGC3_HUMAN)
TMDDATAMASY

SEQ ID NO: 99599 - protein, 9 aa, Artificial Sequence
  Description of Artificial Sequence: Synthetic peptide
  Seed: YFFEDTLDL (MAGC3_HUMAN)
YIFEDTLDV

SEQ ID NO: 99600 - protein, 9 aa, Artificial Sequence
  Description of Artificial Sequence: Synthetic peptide
  Seed: FSLRRAVSV (MAGC3_HUMAN)
FFLRRAVSI

SEQ ID NO: 99601 - protein, 9 aa, Artificial Sequence
  Description of Artificial Sequence: Synthetic peptide
  Seed: LIDDQGMPK (MAGC3_HUMAN)
LQDDQGMPI

SEQ ID NO: 99602 - protein, 9 aa, Artificial Sequence
  Description of Artificial Sequence: Synthetic peptide
  Seed: WRRGTGYTL (MAGC3_HUMAN)
WHRGTGYTY

SEQ ID NO: 99603 - protein, 9 aa, Artificial Sequence
  Description of Artificial Sequence: Synthetic peptide
  Seed: WESEGPEAF (MAGC3_HUMAN)
WKSEGPEAM

SEQ ID NO: 99604 - protein, 10 aa, Artificial Sequence
  Description of Artificial Sequence: Synthetic peptide
  Seed: CATYALSPVV (MAGC3_HUMAN)
CTTYALSPVV

SEQ ID NO: 99605 - protein, 9 aa, Artificial Sequence
  Description of Artificial Sequence: Synthetic peptide
  Seed: LTEASPQQK (MAGC3_HUMAN)
LAEASPQQL

SEQ ID NO: 99606 - protein, 8 aa, Artificial Sequence
  Description of Artificial Sequence: Synthetic peptide
  Seed: YMDALKDM (MAGC3_HUMAN)
YFDALKDM

SEQ ID NO: 99607 - protein, 11 aa, Artificial Sequence
  Description of Artificial Sequence: Synthetic peptide
  Seed: MQMNVINTYTG (MAGC3_HUMAN)
MQMNVINTYTY

SEQ ID NO: 99608 - protein, 9 aa, Artificial Sequence
  Description of Artificial Sequence: Synthetic peptide
  Seed: HALPESESL (MAGC3_HUMAN)
HHLPESESY

SEQ ID NO: 99609 - protein, 10 aa, Artificial Sequence
  Description of Artificial Sequence: Synthetic peptide
  Seed: HEFIELIFGI (MAGC3_HUMAN)
HEFIELIFGF

SEQ ID NO: 99610 - protein, 8 aa, Artificial Sequence
  Description of Artificial Sequence: Synthetic peptide
  Seed: SGSPGLQL (MAGC3_HUMAN)
SISPGLQL

SEQ ID NO: 99611 - protein, 9 aa, Artificial Sequence
  Description of Artificial Sequence: Synthetic peptide
  Seed: KAHEFIELI (MAGC3_HUMAN)
KVHEFIELW

SEQ ID NO: 99612 - protein, 9 aa, Artificial Sequence
  Description of Artificial Sequence: Synthetic peptide
  Seed: LKYQAKEPL (MAGC3_HUMAN)
LHYQAKEPF

SEQ ID NO: 99613 - protein, 10 aa, Artificial Sequence
  Description of Artificial Sequence: Synthetic peptide
  Seed: LNAIGPWSAL (MAGC3_HUMAN)
LCAIGPWSAL

SEQ ID NO: 99614 - protein, 10 aa, Artificial Sequence
  Description of Artificial Sequence: Synthetic peptide
  Seed: LLKYQAKEPL (MAGC3_HUMAN)
LGKYQAKEPF

SEQ ID NO: 99615 - protein, 10 aa, Artificial Sequence
  Description of Artificial Sequence: Synthetic peptide
  Seed: MQMNVINTYT (MAGC3_HUMAN)
MFMNVINTYV

SEQ ID NO: 99616 - protein, 10 aa, Artificial Sequence
  Description of Artificial Sequence: Synthetic peptide
  Seed: INTYTGYFPM (MAGC3_HUMAN)
IKTYTGYFPY

SEQ ID NO: 99617 - protein, 8 aa, Artificial Sequence
  Description of Artificial Sequence: Synthetic peptide
  Seed: MLLPCHWV (MAGC3_HUMAN)
MMLPCHWV

SEQ ID NO: 99618 - protein, 9 aa, Artificial Sequence
  Description of Artificial Sequence: Synthetic peptide
  Seed: VIWEVLNAI (MAGC3_HUMAN)
VPWEVLNAL

SEQ ID NO: 99619 - protein, 9 aa, Artificial Sequence
  Description of Artificial Sequence: Synthetic peptide
  Seed: HSYFFEDTL (MAGC3_HUMAN)
HVYFFEDTY

SEQ ID NO: 99620 - protein, 9 aa, Artificial Sequence
  Description of Artificial Sequence: Synthetic peptide
  Seed: ELIFGIALT (MAGC3_HUMAN)
EAIFGIALM

SEQ ID NO: 99621 - protein, 9 aa, Artificial Sequence
  Description of Artificial Sequence: Synthetic peptide
  Seed: HSYFFEDTL (MAGC3_HUMAN)
HVYFFEDTW

SEQ ID NO: 99622 - protein, 9 aa, Artificial Sequence
  Description of Artificial Sequence: Synthetic peptide
  Seed: FHLGHLREV (MAGC3_HUMAN)
FRLGHLREY

SEQ ID NO: 99623 - protein, 10 aa, Artificial Sequence
  Description of Artificial Sequence: Synthetic peptide
  Seed: MDPDNHSYFF (MAGC3_HUMAN)
MQPDNHSYFM

SEQ ID NO: 99624 - protein, 10 aa, Artificial Sequence
  Description of Artificial Sequence: Synthetic peptide
  Seed: REVRLFLRGG (MAGC3_HUMAN)
RGVRLFLRGK

SEQ ID NO: 99625 - protein, 10 aa, Artificial Sequence
  Description of Artificial Sequence: Synthetic peptide
  Seed: WEVLSAIGPI (MAGC3_HUMAN)
WEVLSAIGPA

SEQ ID NO: 99626 - protein, 11 aa, Artificial Sequence
  Description of Artificial Sequence: Synthetic peptide
  Seed: AIIDTTDDATA (MAGC3_HUMAN)
AIIDTTDDATV

SEQ ID NO: 99627 - protein, 9 aa, Artificial Sequence
  Description of Artificial Sequence: Synthetic peptide
  Seed: LKYQTKEPV (MAGC3_HUMAN)
LQYQTKEPY

SEQ ID NO: 99628 - protein, 9 aa, Artificial Sequence
  Description of Artificial Sequence: Synthetic peptide
  Seed: IIPSAFPSW (MAGC3_HUMAN)
ILPSAFPSL

SEQ ID NO: 99629 - protein, 9 aa, Artificial Sequence
  Description of Artificial Sequence: Synthetic peptide
  Seed: QGMPQNRLL (MAGC3_HUMAN)
QQMPQNRLV

SEQ ID NO: 99630 - protein, 10 aa, Artificial Sequence
  Description of Artificial Sequence: Synthetic peptide
  Seed: TDMDPDNHSY (MAGC3_HUMAN)
THMDPDNHSY

SEQ ID NO: 99631 - protein, 10 aa, Artificial Sequence
  Description of Artificial Sequence: Synthetic peptide
  Seed: MQMNVINTYT (MAGC3_HUMAN)
MMMNVINTYN

SEQ ID NO: 99632 - protein, 9 aa, Artificial Sequence
  Description of Artificial Sequence: Synthetic peptide
  Seed: QGMPKNCLL (MAGC3_HUMAN)
QMMPKNCLW

SEQ ID NO: 99633 - protein, 9 aa, Artificial Sequence
  Description of Artificial Sequence: Synthetic peptide
  Seed: MASASPSVM (MAGC3_HUMAN)
MSSASPSVM

SEQ ID NO: 99634 - protein, 9 aa, Artificial Sequence
  Description of Artificial Sequence: Synthetic peptide
  Seed: LIDDQGMPK (MAGC3_HUMAN)
LGDDQGMPV

SEQ ID NO: 99635 - protein, 9 aa, Artificial Sequence
  Description of Artificial Sequence: Synthetic peptide
  Seed: EVDPDHFYV (MAGC3_HUMAN)
EYDPDHFYM

SEQ ID NO: 99636 - protein, 9 aa, Artificial Sequence
  Description of Artificial Sequence: Synthetic peptide
  Seed: QPEGKFSLR (MAGC3_HUMAN)
QSEGKFSLR

SEQ ID NO: 99637 - protein, 11 aa, Artificial Sequence
  Description of Artificial Sequence: Synthetic peptide
  Seed: KVAELVQFLLL (MAGC3_HUMAN)
KMAELVQFLLF

SEQ ID NO: 99638 - protein, 10 aa, Artificial Sequence
  Description of Artificial Sequence: Synthetic peptide
  Seed: YALDEKVAEL (MAGC3_HUMAN)
YLLDEKVAEV

SEQ ID NO: 99639 - protein, 9 aa, Artificial Sequence
  Description of Artificial Sequence: Synthetic peptide
  Seed: IPPQGPPKI (MAGC3_HUMAN)
IYPQGPPKV

SEQ ID NO: 99640 - protein, 8 aa, Artificial Sequence
  Description of Artificial Sequence: Synthetic peptide
  Seed: MEDRAQAI (MAGC3_HUMAN)
MSDRAQAV

SEQ ID NO: 99641 - protein, 11 aa, Artificial Sequence
  Description of Artificial Sequence: Synthetic peptide
  Seed: YALDEKVAELV (MAGC3_HUMAN)
YMLDEKVAELW

SEQ ID NO: 99642 - protein, 11 aa, Artificial Sequence
  Description of Artificial Sequence: Synthetic peptide
  Seed: MQMNVINTYTG (MAGC3_HUMAN)
MVMNVINTYTY

SEQ ID NO: 99643 - protein, 8 aa, Artificial Sequence
  Description of Artificial Sequence: Synthetic peptide
  Seed: SSIIPSAF (MAGC3_HUMAN)
SQIIPSAY

SEQ ID NO: 99644 - protein, 9 aa, Artificial Sequence
  Description of Artificial Sequence: Synthetic peptide
  Seed: QAKEPLTRA (MAGC3_HUMAN)
QIKEPLTRY

SEQ ID NO: 99645 - protein, 9 aa, Artificial Sequence
  Description of Artificial Sequence: Synthetic peptide
  Seed: LSDLHFGSQ (MAGC3_HUMAN)
LSDLHFGSY

SEQ ID NO: 99646 - protein, 10 aa, Artificial Sequence
  Description of Artificial Sequence: Synthetic peptide
  Seed: MPAAGMPPLP (MAGC3_HUMAN)
MPAAGMPPLA

SEQ ID NO: 99647 - protein, 9 aa, Artificial Sequence
  Description of Artificial Sequence: Synthetic peptide
  Seed: TTDDATAMA (MAGC3_HUMAN)
TCDDATAMF

SEQ ID NO: 99648 - protein, 8 aa, Artificial Sequence
  Description of Artificial Sequence: Synthetic peptide
  Seed: TTDDATAM (MAGC3_HUMAN)
TVDDATAI

SEQ ID NO: 99649 - protein, 11 aa, Artificial Sequence
  Description of Artificial Sequence: Synthetic peptide
  Seed: KVAELVQFLLL (MAGC3_HUMAN)
KIAELVQFLLV

SEQ ID NO: 99650 - protein, 9 aa, Artificial Sequence
  Description of Artificial Sequence: Synthetic peptide
  Seed: KVAELVQFL (MAGC3_HUMAN)
KRAELVQFY

SEQ ID NO: 99651 - protein, 10 aa, Artificial Sequence
  Description of Artificial Sequence: Synthetic peptide
  Seed: AMASASPSVM (MAGC3_HUMAN)
ASASASPSVY

SEQ ID NO: 99652 - protein, 9 aa, Artificial Sequence
  Description of Artificial Sequence: Synthetic peptide
  Seed: LLILILSVI (MAGC3_HUMAN)
LMILILSVL

SEQ ID NO: 99653 - protein, 9 aa, Artificial Sequence
  Description of Artificial Sequence: Synthetic peptide
  Seed: KAEMLTTVI (MAGC3_HUMAN)
KSEMLTTVW

SEQ ID NO: 99654 - protein, 9 aa, Artificial Sequence
  Description of Artificial Sequence: Synthetic peptide
  Seed: LSSIIPSAF (MAGC3_HUMAN)
LTSIIPSAI

SEQ ID NO: 99655 - protein, 10 aa, Artificial Sequence
  Description of Artificial Sequence: Synthetic peptide
  Seed: DMPAAGMPPL (MAGC3_HUMAN)
DFPAAGMPPL

SEQ ID NO: 99656 - protein, 10 aa, Artificial Sequence
  Description of Artificial Sequence: Synthetic peptide
  Seed: CSSPLLWTRL (MAGC3_HUMAN)
CVSPLLWTRW

SEQ ID NO: 99657 - protein, 10 aa, Artificial Sequence
  Description of Artificial Sequence: Synthetic peptide
  Seed: FKLWRTLSGS (MAGC3_HUMAN)
FILWRTLSGM

SEQ ID NO: 99658 - protein, 10 aa, Artificial Sequence
  Description of Artificial Sequence: Synthetic peptide
  Seed: REVLEFLSKL (MAGC3_HUMAN)
RLVLEFLSKA

SEQ ID NO: 99659 - protein, 9 aa, Artificial Sequence
  Description of Artificial Sequence: Synthetic peptide
  Seed: WESEGPEAF (MAGC3_HUMAN)
WASEGPEAM

SEQ ID NO: 99660 - protein, 9 aa, Artificial Sequence
  Description of Artificial Sequence: Synthetic peptide
  Seed: YFFEDTLDL (MAGC3_HUMAN)
YWFEDTLDI

SEQ ID NO: 99661 - protein, 10 aa, Artificial Sequence
  Description of Artificial Sequence: Synthetic peptide
  Seed: TTDDATAMAS (MAGC3_HUMAN)
TVDDATAMAV

SEQ ID NO: 99662 - protein, 11 aa, Artificial Sequence
  Description of Artificial Sequence: Synthetic peptide
  Seed: ALAGFADVLSR (MAGC3_HUMAN)
ASAGFADVLSK

SEQ ID NO: 99663 - protein, 9 aa, Artificial Sequence
  Description of Artificial Sequence: Synthetic peptide
  Seed: SAFHLGHLR (MAGC3_HUMAN)
SAFHLGHLF

SEQ ID NO: 99664 - protein, 10 aa, Artificial Sequence
  Description of Artificial Sequence: Synthetic peptide
  Seed: SPLDSCSSPL (MAGC3_HUMAN)
SQLDSCSSPV

SEQ ID NO: 99665 - protein, 9 aa, Artificial Sequence
  Description of Artificial Sequence: Synthetic peptide
  Seed: LRSAEGSVL (MAGC3_HUMAN)
LMSAEGSVF

SEQ ID NO: 99666 - protein, 9 aa, Artificial Sequence
  Description of Artificial Sequence: Synthetic peptide
  Seed: FSDGSLGQW (MAGC3_HUMAN)
FGDGSLGQM

SEQ ID NO: 99667 - protein, 9 aa, Artificial Sequence
  Description of Artificial Sequence: Synthetic peptide
  Seed: MDPDNHSYF (MAGC3_HUMAN)
MCPDNHSYM

SEQ ID NO: 99668 - protein, 11 aa, Artificial Sequence
  Description of Artificial Sequence: Synthetic peptide
  Seed: INTYTGYFPMI (MAGC3_HUMAN)
IATYTGYFPMF

SEQ ID NO: 99669 - protein, 9 aa, Artificial Sequence
  Description of Artificial Sequence: Synthetic peptide
  Seed: GKAHEFIEL (MAGC3_HUMAN)
GQAHEFIEM

SEQ ID NO: 99670 - protein, 9 aa, Artificial Sequence
  Description of Artificial Sequence: Synthetic peptide
  Seed: LKYQTKEPV (MAGC3_HUMAN)
LMYQTKEPL

SEQ ID NO: 99671 - protein, 9 aa, Artificial Sequence
  Description of Artificial Sequence: Synthetic peptide
  Seed: WEVLSAIGP (MAGC3_HUMAN)
WEVLSAIGM

SEQ ID NO: 99672 - protein, 9 aa, Artificial Sequence
  Description of Artificial Sequence: Synthetic peptide
  Seed: FHLGHLREV (MAGC3_HUMAN)
FSLGHLREM

SEQ ID NO: 99673 - protein, 9 aa, Artificial Sequence
  Description of Artificial Sequence: Synthetic peptide
  Seed: EKVDKLVQF (MAGC3_HUMAN)
EQVDKLVQY

SEQ ID NO: 99674 - protein, 10 aa, Artificial Sequence
  Description of Artificial Sequence: Synthetic peptide
  Seed: WRTLSGSPGL (MAGC3_HUMAN)
WRTLSGSPGI

SEQ ID NO: 99675 - protein, 10 aa, Artificial Sequence
  Description of Artificial Sequence: Synthetic peptide
  Seed: ILILSMIFIK (MAGC3_HUMAN)
IIILSMIFIK

SEQ ID NO: 99676 - protein, 9 aa, Artificial Sequence
  Description of Artificial Sequence: Synthetic peptide
  Seed: EVDPDHFYV (MAGC3_HUMAN)
ESDPDHFYY

SEQ ID NO: 99677 - protein, 10 aa, Artificial Sequence
  Description of Artificial Sequence: Synthetic peptide
  Seed: EVIWEVLSAI (MAGC3_HUMAN)
EFIWEVLSAI

SEQ ID NO: 99678 - protein, 9 aa, Artificial Sequence
  Description of Artificial Sequence: Synthetic peptide
  Seed: NTYTGYFPM (MAGC3_HUMAN)
NTYTGYFPK

SEQ ID NO: 99679 - protein, 9 aa, Artificial Sequence
  Description of Artificial Sequence: Synthetic peptide
  Seed: VPEEVIWEV (MAGC3_HUMAN)
VPEEVIWEF

SEQ ID NO: 99680 - protein, 9 aa, Artificial Sequence
  Description of Artificial Sequence: Synthetic peptide
  Seed: WVKNTCATY (MAGC3_HUMAN)
WKKNTCATF

SEQ ID NO: 99681 - protein, 11 aa, Artificial Sequence
  Description of Artificial Sequence: Synthetic peptide
  Seed: DMDPDNHSYFF (MAGC3_HUMAN)
DVDPDNHSYFY

SEQ ID NO: 99682 - protein, 10 aa, Artificial Sequence
  Description of Artificial Sequence: Synthetic peptide
  Seed: ATYALSPVVL (MAGC3_HUMAN)
AKYALSPVVF

SEQ ID NO: 99683 - protein, 9 aa, Artificial Sequence
  Description of Artificial Sequence: Synthetic peptide
  Seed: TAMASASPS (MAGC3_HUMAN)
TPMASASPM

SEQ ID NO: 99684 - protein, 9 aa, Artificial Sequence
  Description of Artificial Sequence: Synthetic peptide
  Seed: HFYVFVNTL (MAGC3_HUMAN)
HHYVFVNTL

SEQ ID NO: 99685 - protein, 11 aa, Artificial Sequence
  Description of Artificial Sequence: Synthetic peptide
  Seed: ATFSDGSLGQW (MAGC3_HUMAN)
AQFSDGSLGQF

SEQ ID NO: 99686 - protein, 10 aa, Artificial Sequence
  Description of Artificial Sequence: Synthetic peptide
  Seed: EKVAELVQFL (MAGC3_HUMAN)
EFVAELVQFV

SEQ ID NO: 99687 - protein, 11 aa, Artificial Sequence
  Description of Artificial Sequence: Synthetic peptide
  Seed: FIKGNCASEEV (MAGC3_HUMAN)
FLKGNCASEEL

SEQ ID NO: 99688 - protein, 10 aa, Artificial Sequence
  Description of Artificial Sequence: Synthetic peptide
  Seed: LTRAEMQMNV (MAGC3_HUMAN)
LLRAEMQMNI

SEQ ID NO: 99689 - protein, 10 aa, Artificial Sequence
  Description of Artificial Sequence: Synthetic peptide
  Seed: FSDGSLGQWV (MAGC3_HUMAN)
FFDGSLGQWL

SEQ ID NO: 99690 - protein, 9 aa, Artificial Sequence
  Description of Artificial Sequence: Synthetic peptide
  Seed: GYFPMIFRK (MAGC3_HUMAN)
GNFPMIFRK

SEQ ID NO: 99691 - protein, 9 aa, Artificial Sequence
  Description of Artificial Sequence: Synthetic peptide
  Seed: LKYQAKEPL (MAGC3_HUMAN)
LVYQAKEPY

SEQ ID NO: 99692 - protein, 9 aa, Artificial Sequence
  Description of Artificial Sequence: Synthetic peptide
  Seed: RGTGYTLSL (MAGC3_HUMAN)
RVTGYTLSI

SEQ ID NO: 99693 - protein, 10 aa, Artificial Sequence
  Description of Artificial Sequence: Synthetic peptide
  Seed: KVAELVQFLL (MAGC3_HUMAN)
KSAELVQFLF

SEQ ID NO: 99694 - protein, 10 aa, Artificial Sequence
  Description of Artificial Sequence: Synthetic peptide
  Seed: YALSPVVLPP (MAGC3_HUMAN)
YDLSPVVLPV

SEQ ID NO: 99695 - protein, 9 aa, Artificial Sequence
  Description of Artificial Sequence: Synthetic peptide
  Seed: TEASPQQKK (MAGC3_HUMAN)
TDASPQQKL

SEQ ID NO: 99696 - protein, 10 aa, Artificial Sequence
  Description of Artificial Sequence: Synthetic peptide
  Seed: KAHEFIELIF (MAGC3_HUMAN)
KMHEFIELIM

SEQ ID NO: 99697 - protein, 9 aa, Artificial Sequence
  Description of Artificial Sequence: Synthetic peptide
  Seed: SPQGPPQSP (MAGC3_HUMAN)
SPQGPPQSF

SEQ ID NO: 99698 - protein, 11 aa, Artificial Sequence
  Description of Artificial Sequence: Synthetic peptide
  Seed: TLWKDSDLPTW (MAGC3_HUMAN)
TMWKDSDLPTY

SEQ ID NO: 99699 - protein, 9 aa, Artificial Sequence
  Description of Artificial Sequence: Synthetic peptide
  Seed: TTDDATAMA (MAGC3_HUMAN)
TVDDATAMY

SEQ ID NO: 99700 - protein, 9 aa, Artificial Sequence
  Description of Artificial Sequence: Synthetic peptide
  Seed: KLVQFLLLK (MAGC3_HUMAN)
KGVQFLLLK

SEQ ID NO: 99701 - protein, 9 aa, Artificial Sequence
  Description of Artificial Sequence: Synthetic peptide
  Seed: MPAAGMPPL (MAGC3_HUMAN)
MAAAGMPPV

SEQ ID NO: 99702 - protein, 11 aa, Artificial Sequence
  Description of Artificial Sequence: Synthetic peptide
  Seed: RTLSGSPGLQL (MAGC3_HUMAN)
RVLSGSPGLQF

SEQ ID NO: 99703 - protein, 9 aa, Artificial Sequence
  Description of Artificial Sequence: Synthetic peptide
  Seed: REVLEFLSK (MAGC3_HUMAN)
REVLEFLSA

SEQ ID NO: 99704 - protein, 9 aa, Artificial Sequence
  Description of Artificial Sequence: Synthetic peptide
  Seed: ATDKDYSAF (MAGC3_HUMAN)
ATDKDYSAM

SEQ ID NO: 99705 - protein, 10 aa, Artificial Sequence
  Description of Artificial Sequence: Synthetic peptide
  Seed: RSAEGSVLDL (MAGC3_HUMAN)
RLAEGSVLDI

SEQ ID NO: 99706 - protein, 11 aa, Artificial Sequence
  Description of Artificial Sequence: Synthetic peptide
  Seed: LPAVSPGKRLW (MAGC3_HUMAN)
LGAVSPGKRLW

SEQ ID NO: 99707 - protein, 10 aa, Artificial Sequence
  Description of Artificial Sequence: Synthetic peptide
  Seed: MPAAGMPPLP (MAGC3_HUMAN)
MNAAGMPPLY

SEQ ID NO: 99708 - protein, 9 aa, Artificial Sequence
  Description of Artificial Sequence: Synthetic peptide
  Seed: RGTGYTLSL (MAGC3_HUMAN)
RETGYTLSM

SEQ ID NO: 99709 - protein, 10 aa, Artificial Sequence
  Description of Artificial Sequence: Synthetic peptide
  Seed: NTYTGYFPMI (MAGC3_HUMAN)
NYYTGYFPMI

SEQ ID NO: 99710 - protein, 10 aa, Artificial Sequence
  Description of Artificial Sequence: Synthetic peptide
  Seed: INTYTGYFPM (MAGC3_HUMAN)
IWTYTGYFPW

SEQ ID NO: 99711 - protein, 9 aa, Artificial Sequence
  Description of Artificial Sequence: Synthetic peptide
  Seed: WRRGTGYTL (MAGC3_HUMAN)
WARGTGYTY

SEQ ID NO: 99712 - protein, 9 aa, Artificial Sequence
  Description of Artificial Sequence: Synthetic peptide
  Seed: KLSSIIPSA (MAGC3_HUMAN)
KQSSIIPSA

SEQ ID NO: 99713 - protein, 9 aa, Artificial Sequence
  Description of Artificial Sequence: Synthetic peptide
  Seed: SAFHLGHLR (MAGC3_HUMAN)
STFHLGHLM

SEQ ID NO: 99714 - protein, 9 aa, Artificial Sequence
  Description of Artificial Sequence: Synthetic peptide
  Seed: FKLWRTLSG (MAGC3_HUMAN)
FTLWRTLSY

SEQ ID NO: 99715 - protein, 8 aa, Artificial Sequence
  Description of Artificial Sequence: Synthetic peptide
  Seed: ILILSMIF (MAGC3_HUMAN)
IQILSMIF

SEQ ID NO: 99716 - protein, 9 aa, Artificial Sequence
  Description of Artificial Sequence: Synthetic peptide
  Seed: FPSWYMDAL (MAGC3_HUMAN)
FTSWYMDAA

SEQ ID NO: 99717 - protein, 9 aa, Artificial Sequence
  Description of Artificial Sequence: Synthetic peptide
  Seed: VINTYTGYF (MAGC3_HUMAN)
VGNTYTGYY

SEQ ID NO: 99718 - protein, 9 aa, Artificial Sequence
  Description of Artificial Sequence: Synthetic peptide
  Seed: GFADVLSRL (MAGC3_HUMAN)
GVADVLSRI

SEQ ID NO: 99719 - protein, 10 aa, Artificial Sequence
  Description of Artificial Sequence: Synthetic peptide
  Seed: KLSSIIPSAF (MAGC3_HUMAN)
KASSIIPSAY

SEQ ID NO: 99720 - protein, 9 aa, Artificial Sequence
  Description of Artificial Sequence: Synthetic peptide
  Seed: NTYTGYFPM (MAGC3_HUMAN)
NVYTGYFPA

SEQ ID NO: 99721 - protein, 10 aa, Artificial Sequence
  Description of Artificial Sequence: Synthetic peptide
  Seed: SIIPSAFPSW (MAGC3_HUMAN)
SWIPSAFPSL

SEQ ID NO: 99722 - protein, 10 aa, Artificial Sequence
  Description of Artificial Sequence: Synthetic peptide
  Seed: HRQEDGRRGL (MAGC3_HUMAN)
HHQEDGRRGI

SEQ ID NO: 99723 - protein, 9 aa, Artificial Sequence
  Description of Artificial Sequence: Synthetic peptide
  Seed: EVLEFLSKL (MAGC3_HUMAN)
ETLEFLSKL

SEQ ID NO: 99724 - protein, 9 aa, Artificial Sequence
  Description of Artificial Sequence: Synthetic peptide
  Seed: LEFLSKLSS (MAGC3_HUMAN)
LEFLSKLSP

SEQ ID NO: 99725 - protein, 9 aa, Artificial Sequence
  Description of Artificial Sequence: Synthetic peptide
  Seed: VLCPTYFKL (MAGC3_HUMAN)
VVCPTYFKY

SEQ ID NO: 99726 - protein, 9 aa, Artificial Sequence
  Description of Artificial Sequence: Synthetic peptide
  Seed: EVLEFLSKL (MAGC3_HUMAN)
ENLEFLSKR

SEQ ID NO: 99727 - protein, 10 aa, Artificial Sequence
  Description of Artificial Sequence: Synthetic peptide
  Seed: CVPEEVIWEV (MAGC3_HUMAN)
CQPEEVIWEV

SEQ ID NO: 99728 - protein, 9 aa, Artificial Sequence
  Description of Artificial Sequence: Synthetic peptide
  Seed: EVLEFLSKL (MAGC3_HUMAN)
EVLEFLSKH

SEQ ID NO: 99729 - protein, 9 aa, Artificial Sequence
  Description of Artificial Sequence: Synthetic peptide
  Seed: SLPAVSPGK (MAGC3_HUMAN)
SAPAVSPGR

SEQ ID NO: 99730 - protein, 9 aa, Artificial Sequence
  Description of Artificial Sequence: Synthetic peptide
  Seed: LILILSMIF (MAGC3_HUMAN)
LQLILSMIY

SEQ ID NO: 99731 - protein, 9 aa, Artificial Sequence
  Description of Artificial Sequence: Synthetic peptide
  Seed: LWGEKAGSL (MAGC3_HUMAN)
LFGEKAGSF

SEQ ID NO: 99732 - protein, 11 aa, Artificial Sequence
  Description of Artificial Sequence: Synthetic peptide
  Seed: RGLTEASPQQK (MAGC3_HUMAN)
RTLTEASPQQR

SEQ ID NO: 99733 - protein, 10 aa, Artificial Sequence
  Description of Artificial Sequence: Synthetic peptide
  Seed: MQMNVINTYT (MAGC3_HUMAN)
MGMNVINTYI

SEQ ID NO: 99734 - protein, 11 aa, Artificial Sequence
  Description of Artificial Sequence: Synthetic peptide
  Seed: SSEEEDTATWH (MAGC3_HUMAN)
SSEEEDTATWY

SEQ ID NO: 99735 - protein, 11 aa, Artificial Sequence
  Description of Artificial Sequence: Synthetic peptide
  Seed: LSKLSSIIPSA (MAGC3_HUMAN)
LYKLSSIIPSV

SEQ ID NO: 99736 - protein, 9 aa, Artificial Sequence
  Description of Artificial Sequence: Synthetic peptide
  Seed: ALDEKVAEL (MAGC3_HUMAN)
AADEKVAEI

SEQ ID NO: 99737 - protein, 9 aa, Artificial Sequence
  Description of Artificial Sequence: Synthetic peptide
  Seed: SQPEGKFSL (MAGC3_HUMAN)
SMPEGKFSV

SEQ ID NO: 99738 - protein, 9 aa, Artificial Sequence
  Description of Artificial Sequence: Synthetic peptide
  Seed: KNCLLILIL (MAGC3_HUMAN)
KQCLLILIF

SEQ ID NO: 99739 - protein, 9 aa, Artificial Sequence
  Description of Artificial Sequence: Synthetic peptide
  Seed: HLREVRLFL (MAGC3_HUMAN)
HLREVRLFR

SEQ ID NO: 99740 - protein, 9 aa, Artificial Sequence
  Description of Artificial Sequence: Synthetic peptide
  Seed: IPPQGPPKI (MAGC3_HUMAN)
IMPQGPPKI

SEQ ID NO: 99741 - protein, 9 aa, Artificial Sequence
  Description of Artificial Sequence: Synthetic peptide
  Seed: VLCPTYFKL (MAGC3_HUMAN)
VSCPTYFKV

SEQ ID NO: 99742 - protein, 9 aa, Artificial Sequence
  Description of Artificial Sequence: Synthetic peptide
  Seed: HLREVRLFL (MAGC3_HUMAN)
HTREVRLFT

SEQ ID NO: 99743 - protein, 10 aa, Artificial Sequence
  Description of Artificial Sequence: Synthetic peptide
  Seed: KDYFPMIFGK (MAGC3_HUMAN)
KFYFPMIFGK

SEQ ID NO: 99744 - protein, 10 aa, Artificial Sequence
  Description of Artificial Sequence: Synthetic peptide
  Seed: FPSWYMDALK (MAGC3_HUMAN)
FVSWYMDALY

SEQ ID NO: 99745 - protein, 9 aa, Artificial Sequence
  Description of Artificial Sequence: Synthetic peptide
  Seed: LKYQTKEPV (MAGC3_HUMAN)
LQYQTKEPF

SEQ ID NO: 99746 - protein, 10 aa, Artificial Sequence
  Description of Artificial Sequence: Synthetic peptide
  Seed: WEVLSAIGPI (MAGC3_HUMAN)
WIVLSAIGPV

SEQ ID NO: 99747 - protein, 9 aa, Artificial Sequence
  Description of Artificial Sequence: Synthetic peptide
  Seed: VLPPQPQPR (MAGC3_HUMAN)
VFPPQPQPV

SEQ ID NO: 99748 - protein, 10 aa, Artificial Sequence
  Description of Artificial Sequence: Synthetic peptide
  Seed: YALSPVVLPP (MAGC3_HUMAN)
YALSPVVLPI

SEQ ID NO: 99749 - protein, 11 aa, Artificial Sequence
  Description of Artificial Sequence: Synthetic peptide
  Seed: DLANPQGLAGH (MAGC3_HUMAN)
DMANPQGLAGK

SEQ ID NO: 99750 - protein, 11 aa, Artificial Sequence
  Description of Artificial Sequence: Synthetic peptide
  Seed: LIDDQGMPKNC (MAGC3_HUMAN)
LIDDQGMPKNM

SEQ ID NO: 99751 - protein, 10 aa, Artificial Sequence
  Description of Artificial Sequence: Synthetic peptide
  Seed: IELIFGIALT (MAGC3_HUMAN)
IELIFGIALV

SEQ ID NO: 99752 - protein, 8 aa, Artificial Sequence
  Description of Artificial Sequence: Synthetic peptide
  Seed: FGISLTEV (MAGC3_HUMAN)
FPISLTEI

SEQ ID NO: 99753 - protein, 9 aa, Artificial Sequence
  Description of Artificial Sequence: Synthetic peptide
  Seed: HALPESESL (MAGC3_HUMAN)
HQLPESESW

SEQ ID NO: 99754 - protein, 11 aa, Artificial Sequence
  Description of Artificial Sequence: Synthetic peptide
  Seed: NTLDLTCEGSL (MAGC3_HUMAN)
NSLDLTCEGSW

SEQ ID NO: 99755 - protein, 9 aa, Artificial Sequence
  Description of Artificial Sequence: Synthetic peptide
  Seed: GLQLSDLHF (MAGC3_HUMAN)
GQQLSDLHW

SEQ ID NO: 99756 - protein, 8 aa, Artificial Sequence
  Description of Artificial Sequence: Synthetic peptide
  Seed: KVDKLVQF (MAGC3_HUMAN)
KSDKLVQI

SEQ ID NO: 99757 - protein, 9 aa, Artificial Sequence
  Description of Artificial Sequence: Synthetic peptide
  Seed: TSDQRMDSL (MAGC3_HUMAN)
TTDQRMDSY

SEQ ID NO: 99758 - protein, 9 aa, Artificial Sequence
  Description of Artificial Sequence: Synthetic peptide
  Seed: RGTGYTLSL (MAGC3_HUMAN)
RRTGYTLSY

SEQ ID NO: 99759 - protein, 10 aa, Artificial Sequence
  Description of Artificial Sequence: Synthetic peptide
  Seed: DMDPDNHSYF (MAGC3_HUMAN)
DIDPDNHSYY

SEQ ID NO: 99760 - protein, 11 aa, Artificial Sequence
  Description of Artificial Sequence: Synthetic peptide
  Seed: ALWESEGPEAF (MAGC3_HUMAN)
AMWESEGPEAM

SEQ ID NO: 99761 - protein, 11 aa, Artificial Sequence
  Description of Artificial Sequence: Synthetic peptide
  Seed: FIELIFGIALT (MAGC3_HUMAN)
FVELIFGIALL

SEQ ID NO: 99762 - protein, 9 aa, Artificial Sequence
  Description of Artificial Sequence: Synthetic peptide
  Seed: KAHEFIELI (MAGC3_HUMAN)
KVHEFIELI

SEQ ID NO: 99763 - protein, 9 aa, Artificial Sequence
  Description of Artificial Sequence: Synthetic peptide
  Seed: KLVQFLLLK (MAGC3_HUMAN)
KIVQFLLLF

SEQ ID NO: 99764 - protein, 10 aa, Artificial Sequence
  Description of Artificial Sequence: Synthetic peptide
  Seed: LSLPAVSPGK (MAGC3_HUMAN)
LTLPAVSPGR

SEQ ID NO: 99765 - protein, 9 aa, Artificial Sequence
  Description of Artificial Sequence: Synthetic peptide
  Seed: SESLPRYAL (MAGC3_HUMAN)
SESLPRYAI

SEQ ID NO: 99766 - protein, 10 aa, Artificial Sequence
  Description of Artificial Sequence: Synthetic peptide
  Seed: EVDPDHFYVF (MAGC3_HUMAN)
EADPDHFYVY

SEQ ID NO: 99767 - protein, 9 aa, Artificial Sequence
  Description of Artificial Sequence: Synthetic peptide
  Seed: TLDEKVDKL (MAGC3_HUMAN)
TADEKVDKY

SEQ ID NO: 99768 - protein, 9 aa, Artificial Sequence
  Description of Artificial Sequence: Synthetic peptide
  Seed: CPTYFKLWR (MAGC3_HUMAN)
CTTYFKLWK

SEQ ID NO: 99769 - protein, 10 aa, Artificial Sequence
  Description of Artificial Sequence: Synthetic peptide
  Seed: KATDKDYSAF (MAGC3_HUMAN)
KQTDKDYSAY

SEQ ID NO: 99770 - protein, 9 aa, Artificial Sequence
  Description of Artificial Sequence: Synthetic peptide
  Seed: GPWSALAGF (MAGC3_HUMAN)
GSWSALAGY

SEQ ID NO: 99771 - protein, 11 aa, Artificial Sequence
  Description of Artificial Sequence: Synthetic peptide
  Seed: RTLSGSPGLQL (MAGC3_HUMAN)
RVLSGSPGLQK

SEQ ID NO: 99772 - protein, 8 aa, Artificial Sequence
  Description of Artificial Sequence: Synthetic peptide
  Seed: TTDDATAM (MAGC3_HUMAN)
TNDDATAL

SEQ ID NO: 99773 - protein, 10 aa, Artificial Sequence
  Description of Artificial Sequence: Synthetic peptide
  Seed: YALDEKVAEL (MAGC3_HUMAN)
YWLDEKVAEM

SEQ ID NO: 99774 - protein, 9 aa, Artificial Sequence
  Description of Artificial Sequence: Synthetic peptide
  Seed: YSAFHLGHL (MAGC3_HUMAN)
YTAFHLGHI

SEQ ID NO: 99775 - protein, 9 aa, Artificial Sequence
  Description of Artificial Sequence: Synthetic peptide
  Seed: TRAEMQMNV (MAGC3_HUMAN)
TRAEMQMNL

SEQ ID NO: 99776 - protein, 10 aa, Artificial Sequence
  Description of Artificial Sequence: Synthetic peptide
  Seed: YSAFHLGHLR (MAGC3_HUMAN)
YHAFHLGHLK

SEQ ID NO: 99777 - protein, 9 aa, Artificial Sequence
  Description of Artificial Sequence: Synthetic peptide
  Seed: MLTTVIKKY (MAGC3_HUMAN)
MQTTVIKKF

SEQ ID NO: 99778 - protein, 9 aa, Artificial Sequence
  Description of Artificial Sequence: Synthetic peptide
  Seed: GFADVLSRL (MAGC3_HUMAN)
GAADVLSRF

SEQ ID NO: 99779 - protein, 9 aa, Artificial Sequence
  Description of Artificial Sequence: Synthetic peptide
  Seed: FHLGHLREV (MAGC3_HUMAN)
FALGHLREM

SEQ ID NO: 99780 - protein, 9 aa, Artificial Sequence
  Description of Artificial Sequence: Synthetic peptide
  Seed: MIFGKAHEF (MAGC3_HUMAN)
MAFGKAHEA

SEQ ID NO: 99781 - protein, 11 aa, Artificial Sequence
  Description of Artificial Sequence: Synthetic peptide
  Seed: LSKLSSIIPSA (MAGC3_HUMAN)
LCKLSSIIPSV

SEQ ID NO: 99782 - protein, 9 aa, Artificial Sequence
  Description of Artificial Sequence: Synthetic peptide
  Seed: AMASASPSV (MAGC3_HUMAN)
AAASASPSF

SEQ ID NO: 99783 - protein, 9 aa, Artificial Sequence
  Description of Artificial Sequence: Synthetic peptide
  Seed: AIGPWSALA (MAGC3_HUMAN)
AIGPWSALL

SEQ ID NO: 99784 - protein, 9 aa, Artificial Sequence
  Description of Artificial Sequence: Synthetic peptide
  Seed: KKYKDYFPM (MAGC3_HUMAN)
KHYKDYFPY

SEQ ID NO: 99785 - protein, 9 aa, Artificial Sequence
  Description of Artificial Sequence: Synthetic peptide
  Seed: FSLRRAVSV (MAGC3_HUMAN)
FNLRRAVSV

SEQ ID NO: 99786 - protein, 9 aa, Artificial Sequence
  Description of Artificial Sequence: Synthetic peptide
  Seed: NTYTGYFPM (MAGC3_HUMAN)
NAYTGYFPI

SEQ ID NO: 99787 - protein, 11 aa, Artificial Sequence
  Description of Artificial Sequence: Synthetic peptide
  Seed: IIDTTDDATAM (MAGC3_HUMAN)
ILDTTDDATAM

SEQ ID NO: 99788 - protein, 10 aa, Artificial Sequence
  Description of Artificial Sequence: Synthetic peptide
  Seed: EKVAELVQFL (MAGC3_HUMAN)
EHVAELVQFI

SEQ ID NO: 99789 - protein, 9 aa, Artificial Sequence
  Description of Artificial Sequence: Synthetic peptide
  Seed: YQTKEPVTK (MAGC3_HUMAN)
YFTKEPVTF

SEQ ID NO: 99790 - protein, 9 aa, Artificial Sequence
  Description of Artificial Sequence: Synthetic peptide
  Seed: IPSAFPSWY (MAGC3_HUMAN)
IPSAFPSWW

SEQ ID NO: 99791 - protein, 10 aa, Artificial Sequence
  Description of Artificial Sequence: Synthetic peptide
  Seed: YALDEKVAEL (MAGC3_HUMAN)
YMLDEKVAEA

SEQ ID NO: 99792 - protein, 10 aa, Artificial Sequence
  Description of Artificial Sequence: Synthetic peptide
  Seed: LLKYQAKEPL (MAGC3_HUMAN)
LRKYQAKEPF

SEQ ID NO: 99793 - protein, 11 aa, Artificial Sequence
  Description of Artificial Sequence: Synthetic peptide
  Seed: IIDTTDDATAM (MAGC3_HUMAN)
ILDTTDDATAV

SEQ ID NO: 99794 - protein, 10 aa, Artificial Sequence
  Description of Artificial Sequence: Synthetic peptide
  Seed: LDSCSSPLLW (MAGC3_HUMAN)
LHSCSSPLLF

SEQ ID NO: 99795 - protein, 9 aa, Artificial Sequence
  Description of Artificial Sequence: Synthetic peptide
  Seed: TEVDPDHFY (MAGC3_HUMAN)
TLVDPDHFY

SEQ ID NO: 99796 - protein, 9 aa, Artificial Sequence
  Description of Artificial Sequence: Synthetic peptide
  Seed: VIWEVLSAI (MAGC3_HUMAN)
VLWEVLSAV

SEQ ID NO: 99797 - protein, 9 aa, Artificial Sequence
  Description of Artificial Sequence: Synthetic peptide
  Seed: LTDMDPDNH (MAGC3_HUMAN)
LTDMDPDNY

SEQ ID NO: 99798 - protein, 9 aa, Artificial Sequence
  Description of Artificial Sequence: Synthetic peptide
  Seed: YSAFHLGHL (MAGC3_HUMAN)
YAAFHLGHA

SEQ ID NO: 99799 - protein, 9 aa, Artificial Sequence
  Description of Artificial Sequence: Synthetic peptide
  Seed: KVAELVQFL (MAGC3_HUMAN)
KTAELVQFR

SEQ ID NO: 99800 - protein, 9 aa, Artificial Sequence
  Description of Artificial Sequence: Synthetic peptide
  Seed: NAIGPWSAL (MAGC3_HUMAN)
NIIGPWSAR

SEQ ID NO: 99801 - protein, 10 aa, Artificial Sequence
  Description of Artificial Sequence: Synthetic peptide
  Seed: REVRLFLRGG (MAGC3_HUMAN)
RHVRLFLRGA

SEQ ID NO: 99802 - protein, 11 aa, Artificial Sequence
  Description of Artificial Sequence: Synthetic peptide
  Seed: TYTGYFPMIFR (MAGC3_HUMAN)
TATGYFPMIFR

SEQ ID NO: 99803 - protein, 10 aa, Artificial Sequence
  Description of Artificial Sequence: Synthetic peptide
  Seed: IPSAFPSWYM (MAGC3_HUMAN)
ISSAFPSWYW

SEQ ID NO: 99804 - protein, 9 aa, Artificial Sequence
  Description of Artificial Sequence: Synthetic peptide
  Seed: FGSQPEGKF (MAGC3_HUMAN)
FISQPEGKF

SEQ ID NO: 99805 - protein, 9 aa, Artificial Sequence
  Description of Artificial Sequence: Synthetic peptide
  Seed: GFADVLSRL (MAGC3_HUMAN)
GAADVLSRI

SEQ ID NO: 99806 - protein, 9 aa, Artificial Sequence
  Description of Artificial Sequence: Synthetic peptide
  Seed: HALPESESL (MAGC3_HUMAN)
HTLPESESY

SEQ ID NO: 99807 - protein, 9 aa, Artificial Sequence
  Description of Artificial Sequence: Synthetic peptide
  Seed: MASASPSVM (MAGC3_HUMAN)
MYSASPSVM

SEQ ID NO: 99808 - protein, 10 aa, Artificial Sequence
  Description of Artificial Sequence: Synthetic peptide
  Seed: KLVQFLLLKY (MAGC3_HUMAN)
KRVQFLLLKK

SEQ ID NO: 99809 - protein, 10 aa, Artificial Sequence
  Description of Artificial Sequence: Synthetic peptide
  Seed: REVRLFLRGG (MAGC3_HUMAN)
RIVRLFLRGK

SEQ ID NO: 99810 - protein, 9 aa, Artificial Sequence
  Description of Artificial Sequence: Synthetic peptide
  Seed: KAHEFIELI (MAGC3_HUMAN)
KFHEFIELF

SEQ ID NO: 99811 - protein, 9 aa, Artificial Sequence
  Description of Artificial Sequence: Synthetic peptide
  Seed: RGTGYTLSL (MAGC3_HUMAN)
RATGYTLSF

SEQ ID NO: 99812 - protein, 10 aa, Artificial Sequence
  Description of Artificial Sequence: Synthetic peptide
  Seed: LIFGIALTDM (MAGC3_HUMAN)
LVFGIALTDY

SEQ ID NO: 99813 - protein, 9 aa, Artificial Sequence
  Description of Artificial Sequence: Synthetic peptide
  Seed: EKVDKLVQF (MAGC3_HUMAN)
ESVDKLVQY

SEQ ID NO: 99814 - protein, 10 aa, Artificial Sequence
  Description of Artificial Sequence: Synthetic peptide
  Seed: LPTWRRGTGY (MAGC3_HUMAN)
LWTWRRGTGF

SEQ ID NO: 99815 - protein, 9 aa, Artificial Sequence
  Description of Artificial Sequence: Synthetic peptide
  Seed: AGFADVLSR (MAGC3_HUMAN)
AVFADVLSL

SEQ ID NO: 99816 - protein, 9 aa, Artificial Sequence
  Description of Artificial Sequence: Synthetic peptide
  Seed: QLSDLHFGS (MAGC3_HUMAN)
QMSDLHFGV

SEQ ID NO: 99817 - protein, 9 aa, Artificial Sequence
  Description of Artificial Sequence: Synthetic peptide
  Seed: NAIGPWSAL (MAGC3_HUMAN)
NTIGPWSAT

SEQ ID NO: 99818 - protein, 11 aa, Artificial Sequence
  Description of Artificial Sequence: Synthetic peptide
  Seed: SKLSSIIPSAF (MAGC3_HUMAN)
SQLSSIIPSAY

SEQ ID NO: 99819 - protein, 8 aa, Artificial Sequence
  Description of Artificial Sequence: Synthetic peptide
  Seed: MASASPSV (MAGC3_HUMAN)
MSSASPSM

SEQ ID NO: 99820 - protein, 9 aa, Artificial Sequence
  Description of Artificial Sequence: Synthetic peptide
  Seed: HLREVRLFL (MAGC3_HUMAN)
HTREVRLFY

SEQ ID NO: 99821 - protein, 9 aa, Artificial Sequence
  Description of Artificial Sequence: Synthetic peptide
  Seed: MIFRKAREF (MAGC3_HUMAN)
MFFRKAREV

SEQ ID NO: 99822 - protein, 10 aa, Artificial Sequence
  Description of Artificial Sequence: Synthetic peptide
  Seed: SIIPSAFPSW (MAGC3_HUMAN)
SLIPSAFPSF

SEQ ID NO: 99823 - protein, 9 aa, Artificial Sequence
  Description of Artificial Sequence: Synthetic peptide
  Seed: LKYQTKEPV (MAGC3_HUMAN)
LKYQTKEPF

SEQ ID NO: 99824 - protein, 10 aa, Artificial Sequence
  Description of Artificial Sequence: Synthetic peptide
  Seed: ALPESESLPR (MAGC3_HUMAN)
AVPESESLPK

SEQ ID NO: 99825 - protein, 9 aa, Artificial Sequence
  Description of Artificial Sequence: Synthetic peptide
  Seed: LSGSPGLQL (MAGC3_HUMAN)
LAGSPGLQW

SEQ ID NO: 99826 - protein, 9 aa, Artificial Sequence
  Description of Artificial Sequence: Synthetic peptide
  Seed: ELVQFLLLK (MAGC3_HUMAN)
ENVQFLLLR

SEQ ID NO: 99827 - protein, 10 aa, Artificial Sequence
  Description of Artificial Sequence: Synthetic peptide
  Seed: EVIWEVLSAI (MAGC3_HUMAN)
ESIWEVLSAK

SEQ ID NO: 99828 - protein, 10 aa, Artificial Sequence
  Description of Artificial Sequence: Synthetic peptide
  Seed: IPSAFPSWYM (MAGC3_HUMAN)
IHSAFPSWYF

SEQ ID NO: 99829 - protein, 9 aa, Artificial Sequence
  Description of Artificial Sequence: Synthetic peptide
  Seed: ISPQGPPQS (MAGC3_HUMAN)
ITPQGPPQI

SEQ ID NO: 99830 - protein, 9 aa, Artificial Sequence
  Description of Artificial Sequence: Synthetic peptide
  Seed: SLRRAVSVK (MAGC3_HUMAN)
SSRRAVSVM

SEQ ID NO: 99831 - protein, 10 aa, Artificial Sequence
  Description of Artificial Sequence: Synthetic peptide
  Seed: YALDEKVAEL (MAGC3_HUMAN)
YSLDEKVAEY

SEQ ID NO: 99832 - protein, 9 aa, Artificial Sequence
  Description of Artificial Sequence: Synthetic peptide
  Seed: MASASPSVM (MAGC3_HUMAN)
MYSASPSVF

SEQ ID NO: 99833 - protein, 9 aa, Artificial Sequence
  Description of Artificial Sequence: Synthetic peptide
  Seed: VPEEVIWEV (MAGC3_HUMAN)
VIEEVIWEM

SEQ ID NO: 99834 - protein, 10 aa, Artificial Sequence
  Description of Artificial Sequence: Synthetic peptide
  Seed: AEMLTTVIKK (MAGC3_HUMAN)
ATMLTTVIKR

SEQ ID NO: 99835 - protein, 9 aa, Artificial Sequence
  Description of Artificial Sequence: Synthetic peptide
  Seed: KKYKDYFPM (MAGC3_HUMAN)
KSYKDYFPF

SEQ ID NO: 99836 - protein, 9 aa, Artificial Sequence
  Description of Artificial Sequence: Synthetic peptide
  Seed: SPPEIPPQG (MAGC3_HUMAN)
SAPEIPPQL

SEQ ID NO: 99837 - protein, 9 aa, Artificial Sequence
  Description of Artificial Sequence: Synthetic peptide
  Seed: FADVLSRLA (MAGC3_HUMAN)
FFDVLSRLM

SEQ ID NO: 99838 - protein, 9 aa, Artificial Sequence
  Description of Artificial Sequence: Synthetic peptide
  Seed: SALAGFADV (MAGC3_HUMAN)
SALAGFADY

SEQ ID NO: 99839 - protein, 10 aa, Artificial Sequence
  Description of Artificial Sequence: Synthetic peptide
  Seed: LVLCPTYFKL (MAGC3_HUMAN)
LTLCPTYFKV

SEQ ID NO: 99840 - protein, 9 aa, Artificial Sequence
  Description of Artificial Sequence: Synthetic peptide
  Seed: YTGYFPMIF (MAGC3_HUMAN)
YWGYFPMIW

SEQ ID NO: 99841 - protein, 10 aa, Artificial Sequence
  Description of Artificial Sequence: Synthetic peptide
  Seed: TAMASASPSV (MAGC3_HUMAN)
TFMASASPSA

SEQ ID NO: 99842 - protein, 10 aa, Artificial Sequence
  Description of Artificial Sequence: Synthetic peptide
  Seed: FGKAHEFIEL (MAGC3_HUMAN)
FAKAHEFIEF

SEQ ID NO: 99843 - protein, 9 aa, Artificial Sequence
  Description of Artificial Sequence: Synthetic peptide
  Seed: VLPPQPQPR (MAGC3_HUMAN)
VQPPQPQPI

SEQ ID NO: 99844 - protein, 10 aa, Artificial Sequence
  Description of Artificial Sequence: Synthetic peptide
  Seed: VLSAIGPIQR (MAGC3_HUMAN)
VYSAIGPIQR

SEQ ID NO: 99845 - protein, 10 aa, Artificial Sequence
  Description of Artificial Sequence: Synthetic peptide
  Seed: MPAAGMPPLP (MAGC3_HUMAN)
MPAAGMPPLY

SEQ ID NO: 99846 - protein, 9 aa, Artificial Sequence
  Description of Artificial Sequence: Synthetic peptide
  Seed: QGMPQNRLL (MAGC3_HUMAN)
QAMPQNRLF

SEQ ID NO: 99847 - protein, 9 aa, Artificial Sequence
  Description of Artificial Sequence: Synthetic peptide
  Seed: MQMNVINTY (MAGC3_HUMAN)
MMMNVINTS

SEQ ID NO: 99848 - protein, 10 aa, Artificial Sequence
  Description of Artificial Sequence: Synthetic peptide
  Seed: LPTWRRGTGY (MAGC3_HUMAN)
LPTWRRGTGF

SEQ ID NO: 99849 - protein, 10 aa, Artificial Sequence
  Description of Artificial Sequence: Synthetic peptide
  Seed: SAFHLGHLRE (MAGC3_HUMAN)
SWFHLGHLRK

SEQ ID NO: 99850 - protein, 9 aa, Artificial Sequence
  Description of Artificial Sequence: Synthetic peptide
  Seed: ATDKDYSAF (MAGC3_HUMAN)
AFDKDYSAI

SEQ ID NO: 99851 - protein, 9 aa, Artificial Sequence
  Description of Artificial Sequence: Synthetic peptide
  Seed: MPAAGMPPL (MAGC3_HUMAN)
MQAAGMPPF

SEQ ID NO: 99852 - protein, 10 aa, Artificial Sequence
  Description of Artificial Sequence: Synthetic peptide
  Seed: SPQGPPQSPP (MAGC3_HUMAN)
SPQGPPQSPI

SEQ ID NO: 99853 - protein, 9 aa, Artificial Sequence
  Description of Artificial Sequence: Synthetic peptide
  Seed: MQMNVINTY (MAGC3_HUMAN)
MLMNVINTT

SEQ ID NO: 99854 - protein, 9 aa, Artificial Sequence
  Description of Artificial Sequence: Synthetic peptide
  Seed: EVLEFLSKL (MAGC3_HUMAN)
EMLEFLSKK

SEQ ID NO: 99855 - protein, 9 aa, Artificial Sequence
  Description of Artificial Sequence: Synthetic peptide
  Seed: TEASPQQKK (MAGC3_HUMAN)
TSASPQQKK

SEQ ID NO: 99856 - protein, 9 aa, Artificial Sequence
  Description of Artificial Sequence: Synthetic peptide
  Seed: HLREVRLFL (MAGC3_HUMAN)
HWREVRLFK

SEQ ID NO: 99857 - protein, 10 aa, Artificial Sequence
  Description of Artificial Sequence: Synthetic peptide
  Seed: ALPESESLPR (MAGC3_HUMAN)
ATPESESLPK

SEQ ID NO: 99858 - protein, 11 aa, Artificial Sequence
  Description of Artificial Sequence: Synthetic peptide
  Seed: FIELIFGIALT (MAGC3_HUMAN)
FVELIFGIALI

SEQ ID NO: 99859 - protein, 11 aa, Artificial Sequence
  Description of Artificial Sequence: Synthetic peptide
  Seed: KVAELVQFLLL (MAGC3_HUMAN)
KMAELVQFLLS

SEQ ID NO: 99860 - protein, 10 aa, Artificial Sequence
  Description of Artificial Sequence: Synthetic peptide
  Seed: KKYKDYFPMI (MAGC3_HUMAN)
KQYKDYFPML

SEQ ID NO: 99861 - protein, 9 aa, Artificial Sequence
  Description of Artificial Sequence: Synthetic peptide
  Seed: EVLSAIGPI (MAGC3_HUMAN)
EALSAIGPW

SEQ ID NO: 99862 - protein, 9 aa, Artificial Sequence
  Description of Artificial Sequence: Synthetic peptide
  Seed: LVQFLLLKY (MAGC3_HUMAN)
LTQFLLLKW

SEQ ID NO: 99863 - protein, 9 aa, Artificial Sequence
  Description of Artificial Sequence: Synthetic peptide
  Seed: REVLEFLSK (MAGC3_HUMAN)
REVLEFLSI

SEQ ID NO: 99864 - protein, 10 aa, Artificial Sequence
  Description of Artificial Sequence: Synthetic peptide
  Seed: EVIWEVLNAI (MAGC3_HUMAN)
ESIWEVLNAY

SEQ ID NO: 99865 - protein, 10 aa, Artificial Sequence
  Description of Artificial Sequence: Synthetic peptide
  Seed: YALDEKVAEL (MAGC3_HUMAN)
YILDEKVAEI

SEQ ID NO: 99866 - protein, 9 aa, Artificial Sequence
  Description of Artificial Sequence: Synthetic peptide
  Seed: IFGKAHEFI (MAGC3_HUMAN)
IYGKAHEFW

SEQ ID NO: 99867 - protein, 10 aa, Artificial Sequence
  Description of Artificial Sequence: Synthetic peptide
  Seed: AEMLTTVIKK (MAGC3_HUMAN)
AAMLTTVIKK

SEQ ID NO: 99868 - protein, 10 aa, Artificial Sequence
  Description of Artificial Sequence: Synthetic peptide
  Seed: YALDEKVAEL (MAGC3_HUMAN)
YWLDEKVAEL

SEQ ID NO: 99869 - protein, 11 aa, Artificial Sequence
  Description of Artificial Sequence: Synthetic peptide
  Seed: YALDEKVAELV (MAGC3_HUMAN)
YLLDEKVAELV

SEQ ID NO: 99870 - protein, 9 aa, Artificial Sequence
  Description of Artificial Sequence: Synthetic peptide
  Seed: SAFHLGHLR (MAGC3_HUMAN)
SHFHLGHLR

SEQ ID NO: 99871 - protein, 9 aa, Artificial Sequence
  Description of Artificial Sequence: Synthetic peptide
  Seed: QGMPKNCLL (MAGC3_HUMAN)
QGMPKNCLW

SEQ ID NO: 99872 - protein, 11 aa, Artificial Sequence
  Description of Artificial Sequence: Synthetic peptide
  Seed: AEMQMNVINTY (MAGC3_HUMAN)
AYMQMNVINTF

SEQ ID NO: 99873 - protein, 9 aa, Artificial Sequence
  Description of Artificial Sequence: Synthetic peptide
  Seed: VLPPQPQPR (MAGC3_HUMAN)
VCPPQPQPF

SEQ ID NO: 99874 - protein, 9 aa, Artificial Sequence
  Description of Artificial Sequence: Synthetic peptide
  Seed: ALDEKVAEL (MAGC3_HUMAN)
ADDEKVAEF

SEQ ID NO: 99875 - protein, 10 aa, Artificial Sequence
  Description of Artificial Sequence: Synthetic peptide
  Seed: ALDEKVAELV (MAGC3_HUMAN)
AMDEKVAELI

SEQ ID NO: 99876 - protein, 10 aa, Artificial Sequence
  Description of Artificial Sequence: Synthetic peptide
  Seed: SPLDSCSSPL (MAGC3_HUMAN)
SFLDSCSSPL

SEQ ID NO: 99877 - protein, 9 aa, Artificial Sequence
  Description of Artificial Sequence: Synthetic peptide
  Seed: WPLNEKRTL (MAGC3_HUMAN)
WPLNEKRTY

SEQ ID NO: 99878 - protein, 10 aa, Artificial Sequence
  Description of Artificial Sequence: Synthetic peptide
  Seed: SCSSPLLWTR (MAGC3_HUMAN)
SASSPLLWTR

SEQ ID NO: 99879 - protein, 9 aa, Artificial Sequence
  Description of Artificial Sequence: Synthetic peptide
  Seed: GFADVLSRL (MAGC3_HUMAN)
GQADVLSRM

SEQ ID NO: 99880 - protein, 9 aa, Artificial Sequence
  Description of Artificial Sequence: Synthetic peptide
  Seed: YTGYFPMIF (MAGC3_HUMAN)
YFGYFPMIM

SEQ ID NO: 99881 - protein, 9 aa, Artificial Sequence
  Description of Artificial Sequence: Synthetic peptide
  Seed: TTDDATAMA (MAGC3_HUMAN)
TQDDATAML

SEQ ID NO: 99882 - protein, 9 aa, Artificial Sequence
  Description of Artificial Sequence: Synthetic peptide
  Seed: MLLPCHWVL (MAGC3_HUMAN)
MHLPCHWVV

SEQ ID NO: 99883 - protein, 8 aa, Artificial Sequence
  Description of Artificial Sequence: Synthetic peptide
  Seed: YMDALKDM (MAGC3_HUMAN)
YADALKDL

SEQ ID NO: 99884 - protein, 10 aa, Artificial Sequence
  Description of Artificial Sequence: Synthetic peptide
  Seed: MQMNVINTYT (MAGC3_HUMAN)
MKMNVINTYW

SEQ ID NO: 99885 - protein, 10 aa, Artificial Sequence
  Description of Artificial Sequence: Synthetic peptide
  Seed: ALDEKVAELV (MAGC3_HUMAN)
AWDEKVAELL

SEQ ID NO: 99886 - protein, 10 aa, Artificial Sequence
  Description of Artificial Sequence: Synthetic peptide
  Seed: EVIWEVLNAI (MAGC3_HUMAN)
EAIWEVLNAA

SEQ ID NO: 99887 - protein, 9 aa, Artificial Sequence
  Description of Artificial Sequence: Synthetic peptide
  Seed: EVIWEVLSA (MAGC3_HUMAN)
ETIWEVLSV

SEQ ID NO: 99888 - protein, 10 aa, Artificial Sequence
  Description of Artificial Sequence: Synthetic peptide
  Seed: ILILSVIFIK (MAGC3_HUMAN)
IIILSVIFIR

SEQ ID NO: 99889 - protein, 11 aa, Artificial Sequence
  Description of Artificial Sequence: Synthetic peptide
  Seed: YFFEDTLDLTY (MAGC3_HUMAN)
YKFEDTLDLTF

SEQ ID NO: 99890 - protein, 9 aa, Artificial Sequence
  Description of Artificial Sequence: Synthetic peptide
  Seed: ISPQGPPQS (MAGC3_HUMAN)
IGPQGPPQI

SEQ ID NO: 99891 - protein, 10 aa, Artificial Sequence
  Description of Artificial Sequence: Synthetic peptide
  Seed: MDPDNHSYFF (MAGC3_HUMAN)
MPPDNHSYFL

SEQ ID NO: 99892 - protein, 9 aa, Artificial Sequence
  Description of Artificial Sequence: Synthetic peptide
  Seed: MASASPSVM (MAGC3_HUMAN)
MKSASPSVV

SEQ ID NO: 99893 - protein, 9 aa, Artificial Sequence
  Description of Artificial Sequence: Synthetic peptide
  Seed: AEMQMNVIN (MAGC3_HUMAN)
AEMQMNVII

SEQ ID NO: 99894 - protein, 10 aa, Artificial Sequence
  Description of Artificial Sequence: Synthetic peptide
  Seed: YTLDEKVDKL (MAGC3_HUMAN)
YQLDEKVDKI

SEQ ID NO: 99895 - protein, 9 aa, Artificial Sequence
  Description of Artificial Sequence: Synthetic peptide
  Seed: ATDKDYSAF (MAGC3_HUMAN)
AMDKDYSAM

SEQ ID NO: 99896 - protein, 9 aa, Artificial Sequence
  Description of Artificial Sequence: Synthetic peptide
  Seed: MLLPCHWVL (MAGC3_HUMAN)
MALPCHWVF

SEQ ID NO: 99897 - protein, 9 aa, Artificial Sequence
  Description of Artificial Sequence: Synthetic peptide
  Seed: RGTGYTLSL (MAGC3_HUMAN)
RSTGYTLSM

SEQ ID NO: 99898 - protein, 9 aa, Artificial Sequence
  Description of Artificial Sequence: Synthetic peptide
  Seed: KYKDYFPMI (MAGC3_HUMAN)
KMKDYFPMM

SEQ ID NO: 99899 - protein, 8 aa, Artificial Sequence
  Description of Artificial Sequence: Synthetic peptide
  Seed: YFKLWRTL (MAGC3_HUMAN)
YFKLWRTM

SEQ ID NO: 99900 - protein, 9 aa, Artificial Sequence
  Description of Artificial Sequence: Synthetic peptide
  Seed: DMDPDNHSY (MAGC3_HUMAN)
DLDPDNHSY

SEQ ID NO: 99901 - protein, 10 aa, Artificial Sequence
  Description of Artificial Sequence: Synthetic peptide
  Seed: RSAEGSVLDL (MAGC3_HUMAN)
RVAEGSVLDW

SEQ ID NO: 99902 - protein, 9 aa, Artificial Sequence
  Description of Artificial Sequence: Synthetic peptide
  Seed: DQRMDSLVL (MAGC3_HUMAN)
DQRMDSLVF

SEQ ID NO: 99903 - protein, 9 aa, Artificial Sequence
  Description of Artificial Sequence: Synthetic peptide
  Seed: MPAAGMPPL (MAGC3_HUMAN)
MMAAGMPPM

SEQ ID NO: 99904 - protein, 9 aa, Artificial Sequence
  Description of Artificial Sequence: Synthetic peptide
  Seed: MIFRKAREF (MAGC3_HUMAN)
MYFRKAREM

SEQ ID NO: 99905 - protein, 9 aa, Artificial Sequence
  Description of Artificial Sequence: Synthetic peptide
  Seed: SLPESEPLF (MAGC3_HUMAN)
SWPESEPLI

SEQ ID NO: 99906 - protein, 9 aa, Artificial Sequence
  Description of Artificial Sequence: Synthetic peptide
  Seed: WRRGTGYTL (MAGC3_HUMAN)
WQRGTGYTF

SEQ ID NO: 99907 - protein, 10 aa, Artificial Sequence
  Description of Artificial Sequence: Synthetic peptide
  Seed: IPSAFPSWYM (MAGC3_HUMAN)
IFSAFPSWYF

SEQ ID NO: 99908 - protein, 9 aa, Artificial Sequence
  Description of Artificial Sequence: Synthetic peptide
  Seed: DGSLGQWVK (MAGC3_HUMAN)
DFSLGQWVR

SEQ ID NO: 99909 - protein, 9 aa, Artificial Sequence
  Description of Artificial Sequence: Synthetic peptide
  Seed: MLTTVIKKY (MAGC3_HUMAN)
MSTTVIKKL

SEQ ID NO: 99910 - protein, 9 aa, Artificial Sequence
  Description of Artificial Sequence: Synthetic peptide
  Seed: FPSWYMDAL (MAGC3_HUMAN)
FPSWYMDAM

SEQ ID NO: 99911 - protein, 9 aa, Artificial Sequence
  Description of Artificial Sequence: Synthetic peptide
  Seed: SDQRMDSLV (MAGC3_HUMAN)
SEQRMDSLA

SEQ ID NO: 99912 - protein, 9 aa, Artificial Sequence
  Description of Artificial Sequence: Synthetic peptide
  Seed: KEPVTKAEM (MAGC3_HUMAN)
KAPVTKAEM

SEQ ID NO: 99913 - protein, 9 aa, Artificial Sequence
  Description of Artificial Sequence: Synthetic peptide
  Seed: RGTGYTLSL (MAGC3_HUMAN)
RYTGYTLSL

SEQ ID NO: 99914 - protein, 9 aa, Artificial Sequence
  Description of Artificial Sequence: Synthetic peptide
  Seed: YALSPVVLP (MAGC3_HUMAN)
YILSPVVLF

SEQ ID NO: 99915 - protein, 9 aa, Artificial Sequence
  Description of Artificial Sequence: Synthetic peptide
  Seed: RKKATDKDY (MAGC3_HUMAN)
RMKATDKDF

SEQ ID NO: 99916 - protein, 10 aa, Artificial Sequence
  Description of Artificial Sequence: Synthetic peptide
  Seed: NTYTGYFPMI (MAGC3_HUMAN)
NIYTGYFPMV

SEQ ID NO: 99917 - protein, 9 aa, Artificial Sequence
  Description of Artificial Sequence: Synthetic peptide
  Seed: IELIFGIAL (MAGC3_HUMAN)
IKLIFGIAM

SEQ ID NO: 99918 - protein, 9 aa, Artificial Sequence
  Description of Artificial Sequence: Synthetic peptide
  Seed: IFGKAHEFI (MAGC3_HUMAN)
IYGKAHEFI

SEQ ID NO: 99919 - protein, 9 aa, Artificial Sequence
  Description of Artificial Sequence: Synthetic peptide
  Seed: FVNTLDLTC (MAGC3_HUMAN)
FANTLDLTV

SEQ ID NO: 99920 - protein, 8 aa, Artificial Sequence
  Description of Artificial Sequence: Synthetic peptide
  Seed: LTYEGSLI (MAGC3_HUMAN)
LVYEGSLW

SEQ ID NO: 99921 - protein, 11 aa, Artificial Sequence
  Description of Artificial Sequence: Synthetic peptide
  Seed: TAMASASPSVM (MAGC3_HUMAN)
TKMASASPSVY

SEQ ID NO: 99922 - protein, 10 aa, Artificial Sequence
  Description of Artificial Sequence: Synthetic peptide
  Seed: SWYMDALKDM (MAGC3_HUMAN)
SVYMDALKDF

SEQ ID NO: 99923 - protein, 10 aa, Artificial Sequence
  Description of Artificial Sequence: Synthetic peptide
  Seed: REVRLFLRGG (MAGC3_HUMAN)
RSVRLFLRGA

SEQ ID NO: 99924 - protein, 9 aa, Artificial Sequence
  Description of Artificial Sequence: Synthetic peptide
  Seed: ELVQFLLLK (MAGC3_HUMAN)
EGVQFLLLK

SEQ ID NO: 99925 - protein, 11 aa, Artificial Sequence
  Description of Artificial Sequence: Synthetic peptide
  Seed: TTDDATAMASA (MAGC3_HUMAN)
TVDDATAMASV

SEQ ID NO: 99926 - protein, 9 aa, Artificial Sequence
  Description of Artificial Sequence: Synthetic peptide
  Seed: KLWRTLSGS (MAGC3_HUMAN)
KLWRTLSGL

SEQ ID NO: 99927 - protein, 10 aa, Artificial Sequence
  Description of Artificial Sequence: Synthetic peptide
  Seed: SIIPSAFPSW (MAGC3_HUMAN)
SWIPSAFPSM

SEQ ID NO: 99928 - protein, 9 aa, Artificial Sequence
  Description of Artificial Sequence: Synthetic peptide
  Seed: YFFEDTLDL (MAGC3_HUMAN)
YQFEDTLDF

SEQ ID NO: 99929 - protein, 9 aa, Artificial Sequence
  Description of Artificial Sequence: Synthetic peptide
  Seed: SAFHLGHLR (MAGC3_HUMAN)
SSFHLGHLL

SEQ ID NO: 99930 - protein, 9 aa, Artificial Sequence
  Description of Artificial Sequence: Synthetic peptide
  Seed: MIFGKAHEF (MAGC3_HUMAN)
MQFGKAHEK

SEQ ID NO: 99931 - protein, 9 aa, Artificial Sequence
  Description of Artificial Sequence: Synthetic peptide
  Seed: VLPPQPQPR (MAGC3_HUMAN)
VVPPQPQPR

SEQ ID NO: 99932 - protein, 9 aa, Artificial Sequence
  Description of Artificial Sequence: Synthetic peptide
  Seed: LSSIIPSAF (MAGC3_HUMAN)
LRSIIPSAF

SEQ ID NO: 99933 - protein, 9 aa, Artificial Sequence
  Description of Artificial Sequence: Synthetic peptide
  Seed: IPPQGPPKI (MAGC3_HUMAN)
IVPQGPPKM

SEQ ID NO: 99934 - protein, 9 aa, Artificial Sequence
  Description of Artificial Sequence: Synthetic peptide
  Seed: LKYQAKEPL (MAGC3_HUMAN)
LQYQAKEPL

SEQ ID NO: 99935 - protein, 9 aa, Artificial Sequence
  Description of Artificial Sequence: Synthetic peptide
  Seed: QLSDLHFGS (MAGC3_HUMAN)
QMSDLHFGL

SEQ ID NO: 99936 - protein, 8 aa, Artificial Sequence
  Description of Artificial Sequence: Synthetic peptide
  Seed: YMDALKDM (MAGC3_HUMAN)
YADALKDM

SEQ ID NO: 99937 - protein, 9 aa, Artificial Sequence
  Description of Artificial Sequence: Synthetic peptide
  Seed: GKAHEFIEL (MAGC3_HUMAN)
GRAHEFIEM

SEQ ID NO: 99938 - protein, 9 aa, Artificial Sequence
  Description of Artificial Sequence: Synthetic peptide
  Seed: KAHEFIELI (MAGC3_HUMAN)
KGHEFIELY

SEQ ID NO: 99939 - protein, 10 aa, Artificial Sequence
  Description of Artificial Sequence: Synthetic peptide
  Seed: RLWGEKAGSL (MAGC3_HUMAN)
RQWGEKAGSY

SEQ ID NO: 99940 - protein, 10 aa, Artificial Sequence
  Description of Artificial Sequence: Synthetic peptide
  Seed: KKYKDYFPMI (MAGC3_HUMAN)
KCYKDYFPMW

SEQ ID NO: 99941 - protein, 9 aa, Artificial Sequence
  Description of Artificial Sequence: Synthetic peptide
  Seed: VINTYTGYF (MAGC3_HUMAN)
VMNTYTGYF

SEQ ID NO: 99942 - protein, 11 aa, Artificial Sequence
  Description of Artificial Sequence: Synthetic peptide
  Seed: YFFEDTLDLTY (MAGC3_HUMAN)
YPFEDTLDLTL

SEQ ID NO: 99943 - protein, 10 aa, Artificial Sequence
  Description of Artificial Sequence: Synthetic peptide
  Seed: YSAFHLGHLR (MAGC3_HUMAN)
YEAFHLGHLR

SEQ ID NO: 99944 - protein, 10 aa, Artificial Sequence
  Description of Artificial Sequence: Synthetic peptide
  Seed: MDPDNHSYFF (MAGC3_HUMAN)
MHPDNHSYFM

SEQ ID NO: 99945 - protein, 9 aa, Artificial Sequence
  Description of Artificial Sequence: Synthetic peptide
  Seed: KFSLRRAVS (MAGC3_HUMAN)
KSSLRRAVK

SEQ ID NO: 99946 - protein, 9 aa, Artificial Sequence
  Description of Artificial Sequence: Synthetic peptide
  Seed: NTYTGYFPM (MAGC3_HUMAN)
NPYTGYFPI

SEQ ID NO: 99947 - protein, 9 aa, Artificial Sequence
  Description of Artificial Sequence: Synthetic peptide
  Seed: KVDKLVQFL (MAGC3_HUMAN)
KSDKLVQFV

SEQ ID NO: 99948 - protein, 9 aa, Artificial Sequence
  Description of Artificial Sequence: Synthetic peptide
  Seed: MLLPCHWVL (MAGC3_HUMAN)
MTLPCHWVK

SEQ ID NO: 99949 - protein, 9 aa, Artificial Sequence
  Description of Artificial Sequence: Synthetic peptide
  Seed: FEDTLDLTY (MAGC3_HUMAN)
FPDTLDLTY

SEQ ID NO: 99950 - protein, 10 aa, Artificial Sequence
  Description of Artificial Sequence: Synthetic peptide
  Seed: REVRLFLRGG (MAGC3_HUMAN)
RIVRLFLRGA

SEQ ID NO: 99951 - protein, 11 aa, Artificial Sequence
  Description of Artificial Sequence: Synthetic peptide
  Seed: SLPESEPLFTY (MAGC3_HUMAN)
SQPESEPLFTY

SEQ ID NO: 99952 - protein, 10 aa, Artificial Sequence
  Description of Artificial Sequence: Synthetic peptide
  Seed: TLSGSPGLQL (MAGC3_HUMAN)
TQSGSPGLQW

SEQ ID NO: 99953 - protein, 11 aa, Artificial Sequence
  Description of Artificial Sequence: Synthetic peptide
  Seed: RTLSGSPGLQL (MAGC3_HUMAN)
RILSGSPGLQI

SEQ ID NO: 99954 - protein, 9 aa, Artificial Sequence
  Description of Artificial Sequence: Synthetic peptide
  Seed: KKYKDYFPM (MAGC3_HUMAN)
KRYKDYFPV

SEQ ID NO: 99955 - protein, 10 aa, Artificial Sequence
  Description of Artificial Sequence: Synthetic peptide
  Seed: MDPDNHSYFF (MAGC3_HUMAN)
MKPDNHSYFL

SEQ ID NO: 99956 - protein, 10 aa, Artificial Sequence
  Description of Artificial Sequence: Synthetic peptide
  Seed: IKKYKDYFPM (MAGC3_HUMAN)
IQKYKDYFPM

SEQ ID NO: 99957 - protein, 9 aa, Artificial Sequence
  Description of Artificial Sequence: Synthetic peptide
  Seed: LRSAEGSVL (MAGC3_HUMAN)
LMSAEGSVM

SEQ ID NO: 99958 - protein, 10 aa, Artificial Sequence
  Description of Artificial Sequence: Synthetic peptide
  Seed: TGYFPMIFRK (MAGC3_HUMAN)
TMYFPMIFRY

SEQ ID NO: 99959 - protein, 9 aa, Artificial Sequence
  Description of Artificial Sequence: Synthetic peptide
  Seed: SPSVMSTNF (MAGC3_HUMAN)
SQSVMSTNY

SEQ ID NO: 99960 - protein, 10 aa, Artificial Sequence
  Description of Artificial Sequence: Synthetic peptide
  Seed: LDSCSSPLLW (MAGC3_HUMAN)
LSSCSSPLLF

SEQ ID NO: 99961 - protein, 9 aa, Artificial Sequence
  Description of Artificial Sequence: Synthetic peptide
  Seed: SQPEGKFSL (MAGC3_HUMAN)
STPEGKFSF

SEQ ID NO: 99962 - protein, 10 aa, Artificial Sequence
  Description of Artificial Sequence: Synthetic peptide
  Seed: MDPDNHSYFF (MAGC3_HUMAN)
MCPDNHSYFW

SEQ ID NO: 99963 - protein, 9 aa, Artificial Sequence
  Description of Artificial Sequence: Synthetic peptide
  Seed: MPAAGMPPL (MAGC3_HUMAN)
MHAAGMPPA

SEQ ID NO: 99964 - protein, 9 aa, Artificial Sequence
  Description of Artificial Sequence: Synthetic peptide
  Seed: TAMASASPS (MAGC3_HUMAN)
TLMASASPF

SEQ ID NO: 99965 - protein, 8 aa, Artificial Sequence
  Description of Artificial Sequence: Synthetic peptide
  Seed: IQRPAREV (MAGC3_HUMAN)
IQRPAREF

SEQ ID NO: 99966 - protein, 9 aa, Artificial Sequence
  Description of Artificial Sequence: Synthetic peptide
  Seed: ELVQFLLLK (MAGC3_HUMAN)
EWVQFLLLR

SEQ ID NO: 99967 - protein, 10 aa, Artificial Sequence
  Description of Artificial Sequence: Synthetic peptide
  Seed: EVIWEVLSAI (MAGC3_HUMAN)
EVIWEVLSAL

SEQ ID NO: 99968 - protein, 9 aa, Artificial Sequence
  Description of Artificial Sequence: Synthetic peptide
  Seed: ISPQGPPQS (MAGC3_HUMAN)
IVPQGPPQF

SEQ ID NO: 99969 - protein, 11 aa, Artificial Sequence
  Description of Artificial Sequence: Synthetic peptide
  Seed: SSSEEEDTATW (MAGC3_HUMAN)
SCSEEEDTATW

SEQ ID NO: 99970 - protein, 9 aa, Artificial Sequence
  Description of Artificial Sequence: Synthetic peptide
  Seed: ATDKDYSAF (MAGC3_HUMAN)
AQDKDYSAW

SEQ ID NO: 99971 - protein, 10 aa, Artificial Sequence
  Description of Artificial Sequence: Synthetic peptide
  Seed: YTLDEKVDKL (MAGC3_HUMAN)
YYLDEKVDKV

SEQ ID NO: 99972 - protein, 9 aa, Artificial Sequence
  Description of Artificial Sequence: Synthetic peptide
  Seed: LSAIGPIQR (MAGC3_HUMAN)
LYAIGPIQR

SEQ ID NO: 99973 - protein, 10 aa, Artificial Sequence
  Description of Artificial Sequence: Synthetic peptide
  Seed: ILILSMIFIK (MAGC3_HUMAN)
ILILSMIFIR

SEQ ID NO: 99974 - protein, 8 aa, Artificial Sequence
  Description of Artificial Sequence: Synthetic peptide
  Seed: TTDDATAM (MAGC3_HUMAN)
TVDDATAF

SEQ ID NO: 99975 - protein, 8 aa, Artificial Sequence
  Description of Artificial Sequence: Synthetic peptide
  Seed: YMDALKDM (MAGC3_HUMAN)
YSDALKDI

SEQ ID NO: 99976 - protein, 9 aa, Artificial Sequence
  Description of Artificial Sequence: Synthetic peptide
  Seed: HSYFFEDTL (MAGC3_HUMAN)
HEYFFEDTY

SEQ ID NO: 99977 - protein, 9 aa, Artificial Sequence
  Description of Artificial Sequence: Synthetic peptide
  Seed: FEDTLDLTY (MAGC3_HUMAN)
FYDTLDLTM

SEQ ID NO: 99978 - protein, 11 aa, Artificial Sequence
  Description of Artificial Sequence: Synthetic peptide
  Seed: FIELIFGIALT (MAGC3_HUMAN)
FRELIFGIALV

SEQ ID NO: 99979 - protein, 9 aa, Artificial Sequence
  Description of Artificial Sequence: Synthetic peptide
  Seed: KYKDYFPMI (MAGC3_HUMAN)
KTKDYFPMQ

SEQ ID NO: 99980 - protein, 11 aa, Artificial Sequence
  Description of Artificial Sequence: Synthetic peptide
  Seed: TDMDPDNHSYF (MAGC3_HUMAN)
TAMDPDNHSYH

SEQ ID NO: 99981 - protein, 9 aa, Artificial Sequence
  Description of Artificial Sequence: Synthetic peptide
  Seed: AIGPIQRPA (MAGC3_HUMAN)
ASGPIQRPY

SEQ ID NO: 99982 - protein, 9 aa, Artificial Sequence
  Description of Artificial Sequence: Synthetic peptide
  Seed: SEEEDTATW (MAGC3_HUMAN)
SMEEDTATW

SEQ ID NO: 99983 - protein, 9 aa, Artificial Sequence
  Description of Artificial Sequence: Synthetic peptide
  Seed: KVDKLVQFL (MAGC3_HUMAN)
KSDKLVQFY

SEQ ID NO: 99984 - protein, 9 aa, Artificial Sequence
  Description of Artificial Sequence: Synthetic peptide
  Seed: YALSPVVLP (MAGC3_HUMAN)
YALSPVVLI

SEQ ID NO: 99985 - protein, 9 aa, Artificial Sequence
  Description of Artificial Sequence: Synthetic peptide
  Seed: VLPPQPQPR (MAGC3_HUMAN)
VMPPQPQPL

SEQ ID NO: 99986 - protein, 9 aa, Artificial Sequence
  Description of Artificial Sequence: Synthetic peptide
  Seed: ALDEKVAEL (MAGC3_HUMAN)
AVDEKVAEM

SEQ ID NO: 99987 - protein, 9 aa, Artificial Sequence
  Description of Artificial Sequence: Synthetic peptide
  Seed: CLLILILSM (MAGC3_HUMAN)
CQLILILSY

SEQ ID NO: 99988 - protein, 9 aa, Artificial Sequence
  Description of Artificial Sequence: Synthetic peptide
  Seed: ALSPVVLPP (MAGC3_HUMAN)
AMSPVVLPV

SEQ ID NO: 99989 - protein, 9 aa, Artificial Sequence
  Description of Artificial Sequence: Synthetic peptide
  Seed: KYKDYFPMI (MAGC3_HUMAN)
KWKDYFPML

SEQ ID NO: 99990 - protein, 11 aa, Artificial Sequence
  Description of Artificial Sequence: Synthetic peptide
  Seed: ATDKDYSAFHL (MAGC3_HUMAN)
ALDKDYSAFHY

SEQ ID NO: 99991 - protein, 9 aa, Artificial Sequence
  Description of Artificial Sequence: Synthetic peptide
  Seed: YKDYFPMIF (MAGC3_HUMAN)
YADYFPMIF

SEQ ID NO: 99992 - protein, 10 aa, Artificial Sequence
  Description of Artificial Sequence: Synthetic peptide
  Seed: SDQRMDSLVL (MAGC3_HUMAN)
SLQRMDSLVY

SEQ ID NO: 99993 - protein, 10 aa, Artificial Sequence
  Description of Artificial Sequence: Synthetic peptide
  Seed: YALSPVVLPP (MAGC3_HUMAN)
YGLSPVVLPV

SEQ ID NO: 99994 - protein, 9 aa, Artificial Sequence
  Description of Artificial Sequence: Synthetic peptide
  Seed: QMNVINTYT (MAGC3_HUMAN)
QTNVINTYV

SEQ ID NO: 99995 - protein, 10 aa, Artificial Sequence
  Description of Artificial Sequence: Synthetic peptide
  Seed: INTYTGYFPM (MAGC3_HUMAN)
IITYTGYFPY

SEQ ID NO: 99996 - protein, 10 aa, Artificial Sequence
  Description of Artificial Sequence: Synthetic peptide
  Seed: YTLDEKVDKL (MAGC3_HUMAN)
YHLDEKVDKL

SEQ ID NO: 99997 - protein, 9 aa, Artificial Sequence
  Description of Artificial Sequence: Synthetic peptide
  Seed: MPAAGMPPL (MAGC3_HUMAN)
MIAAGMPPI

SEQ ID NO: 99998 - protein, 10 aa, Artificial Sequence
  Description of Artificial Sequence: Synthetic peptide
  Seed: LSLPAVSPGK (MAGC3_HUMAN)
LALPAVSPGR

SEQ ID NO: 99999 - protein, 9 aa, Artificial Sequence
  Description of Artificial Sequence: Synthetic peptide
  Seed: KKYKDYFPM (MAGC3_HUMAN)
KLYKDYFPF

SEQ ID NO: 100000 - protein, 9 aa, Artificial Sequence
  Description of Artificial Sequence: Synthetic peptide
  Seed: YFFEDTLDL (MAGC3_HUMAN)
YAFEDTLDV

SEQ ID NO: 100001 - protein, 9 aa, Artificial Sequence
  Description of Artificial Sequence: Synthetic peptide
  Seed: ELVQFLLLK (MAGC3_HUMAN)
ETVQFLLLH

SEQ ID NO: 100002 - protein, 9 aa, Artificial Sequence
  Description of Artificial Sequence: Synthetic peptide
  Seed: GFADVLSRL (MAGC3_HUMAN)
GTADVLSRI

SEQ ID NO: 100003 - protein, 9 aa, Artificial Sequence
  Description of Artificial Sequence: Synthetic peptide
  Seed: LILILSMIF (MAGC3_HUMAN)
LHLILSMIY

SEQ ID NO: 100004 - protein, 10 aa, Artificial Sequence
  Description of Artificial Sequence: Synthetic peptide
  Seed: IELIFGIALT (MAGC3_HUMAN)
IQLIFGIALI

SEQ ID NO: 100005 - protein, 10 aa, Artificial Sequence
  Description of Artificial Sequence: Synthetic peptide
  Seed: KLSSIIPSAF (MAGC3_HUMAN)
KLSSIIPSAM

SEQ ID NO: 100006 - protein, 9 aa, Artificial Sequence
  Description of Artificial Sequence: Synthetic peptide
  Seed: RGTGYTLSL (MAGC3_HUMAN)
RTTGYTLSM

SEQ ID NO: 100007 - protein, 9 aa, Artificial Sequence
  Description of Artificial Sequence: Synthetic peptide
  Seed: HLREVRLFL (MAGC3_HUMAN)
HVREVRLFT

SEQ ID NO: 100008 - protein, 9 aa, Artificial Sequence
  Description of Artificial Sequence: Synthetic peptide
  Seed: MPAAGMPPL (MAGC3_HUMAN)
MPAAGMPPI

SEQ ID NO: 100009 - protein, 9 aa, Artificial Sequence
  Description of Artificial Sequence: Synthetic peptide
  Seed: SLRRAVSVK (MAGC3_HUMAN)
SARRAVSVR

SEQ ID NO: 100010 - protein, 9 aa, Artificial Sequence
  Description of Artificial Sequence: Synthetic peptide
  Seed: KGSCVPEEV (MAGC3_HUMAN)
KSSCVPEEI

SEQ ID NO: 100011 - protein, 9 aa, Artificial Sequence
  Description of Artificial Sequence: Synthetic peptide
  Seed: RTLSGSPGL (MAGC3_HUMAN)
RSLSGSPGK

SEQ ID NO: 100012 - protein, 9 aa, Artificial Sequence
  Description of Artificial Sequence: Synthetic peptide
  Seed: YFFEDTLDL (MAGC3_HUMAN)
YFFEDTLDV

SEQ ID NO: 100013 - protein, 10 aa, Artificial Sequence
  Description of Artificial Sequence: Synthetic peptide
  Seed: MNVINTYTGY (MAGC3_HUMAN)
MPVINTYTGR

SEQ ID NO: 100014 - protein, 10 aa, Artificial Sequence
  Description of Artificial Sequence: Synthetic peptide
  Seed: ALDEKVAELV (MAGC3_HUMAN)
ASDEKVAELV

SEQ ID NO: 100015 - protein, 9 aa, Artificial Sequence
  Description of Artificial Sequence: Synthetic peptide
  Seed: LANPQGLAG (MAGC3_HUMAN)
LINPQGLAM

SEQ ID NO: 100016 - protein, 10 aa, Artificial Sequence
  Description of Artificial Sequence: Synthetic peptide
  Seed: KKYKDYFPMI (MAGC3_HUMAN)
KIYKDYFPMW

SEQ ID NO: 100017 - protein, 9 aa, Artificial Sequence
  Description of Artificial Sequence: Synthetic peptide
  Seed: IPPQGPPKI (MAGC3_HUMAN)
IYPQGPPKY

SEQ ID NO: 100018 - protein, 8 aa, Artificial Sequence
  Description of Artificial Sequence: Synthetic peptide
  Seed: KDYSAFHL (MAGC3_HUMAN)
KEYSAFHL

SEQ ID NO: 100019 - protein, 9 aa, Artificial Sequence
  Description of Artificial Sequence: Synthetic peptide
  Seed: IPPQGPPKI (MAGC3_HUMAN)
IPPQGPPKF

SEQ ID NO: 100020 - protein, 9 aa, Artificial Sequence
  Description of Artificial Sequence: Synthetic peptide
  Seed: VLCPTYFKL (MAGC3_HUMAN)
VFCPTYFKY

SEQ ID NO: 100021 - protein, 11 aa, Artificial Sequence
  Description of Artificial Sequence: Synthetic peptide
  Seed: LDSCSSPLLWT (MAGC3_HUMAN)
LSSCSSPLLWF

SEQ ID NO: 100022 - protein, 10 aa, Artificial Sequence
  Description of Artificial Sequence: Synthetic peptide
  Seed: REVRLFLRGG (MAGC3_HUMAN)
RPVRLFLRGK

SEQ ID NO: 100023 - protein, 10 aa, Artificial Sequence
  Description of Artificial Sequence: Synthetic peptide
  Seed: KLSSIIPSAF (MAGC3_HUMAN)
KFSSIIPSAW

SEQ ID NO: 100024 - protein, 9 aa, Artificial Sequence
  Description of Artificial Sequence: Synthetic peptide
  Seed: MQMNVINTY (MAGC3_HUMAN)
MPMNVINTY

SEQ ID NO: 100025 - protein, 9 aa, Artificial Sequence
  Description of Artificial Sequence: Synthetic peptide
  Seed: YFFEDTLDL (MAGC3_HUMAN)
YPFEDTLDY

SEQ ID NO: 100026 - protein, 9 aa, Artificial Sequence
  Description of Artificial Sequence: Synthetic peptide
  Seed: ALDEKVAEL (MAGC3_HUMAN)
AVDEKVAEA

SEQ ID NO: 100027 - protein, 11 aa, Artificial Sequence
  Description of Artificial Sequence: Synthetic peptide
  Seed: YFFEDTLDLTY (MAGC3_HUMAN)
YPFEDTLDLTM

SEQ ID NO: 100028 - protein, 9 aa, Artificial Sequence
  Description of Artificial Sequence: Synthetic peptide
  Seed: KFSLRRAVS (MAGC3_HUMAN)
KSSLRRAVV

SEQ ID NO: 100029 - protein, 9 aa, Artificial Sequence
  Description of Artificial Sequence: Synthetic peptide
  Seed: KLWRTLSGS (MAGC3_HUMAN)
KLWRTLSGC

SEQ ID NO: 100030 - protein, 11 aa, Artificial Sequence
  Description of Artificial Sequence: Synthetic peptide
  Seed: IIDTTDDATAM (MAGC3_HUMAN)
IMDTTDDATAM

SEQ ID NO: 100031 - protein, 10 aa, Artificial Sequence
  Description of Artificial Sequence: Synthetic peptide
  Seed: TAMASASPSV (MAGC3_HUMAN)
TFMASASPSI

SEQ ID NO: 100032 - protein, 9 aa, Artificial Sequence
  Description of Artificial Sequence: Synthetic peptide
  Seed: IQRPAREVL (MAGC3_HUMAN)
IPRPAREVL

SEQ ID NO: 100033 - protein, 9 aa, Artificial Sequence
  Description of Artificial Sequence: Synthetic peptide
  Seed: LIDDQGMPK (MAGC3_HUMAN)
LVDDQGMPV

SEQ ID NO: 100034 - protein, 9 aa, Artificial Sequence
  Description of Artificial Sequence: Synthetic peptide
  Seed: VIWEVLNAI (MAGC3_HUMAN)
VQWEVLNAW

SEQ ID NO: 100035 - protein, 9 aa, Artificial Sequence
  Description of Artificial Sequence: Synthetic peptide
  Seed: FHLGHLREV (MAGC3_HUMAN)
FFLGHLREL

SEQ ID NO: 100036 - protein, 9 aa, Artificial Sequence
  Description of Artificial Sequence: Synthetic peptide
  Seed: YSAFHLGHL (MAGC3_HUMAN)
YVAFHLGHL

SEQ ID NO: 100037 - protein, 9 aa, Artificial Sequence
  Description of Artificial Sequence: Synthetic peptide
  Seed: HALPESESL (MAGC3_HUMAN)
HPLPESESW

SEQ ID NO: 100038 - protein, 10 aa, Artificial Sequence
  Description of Artificial Sequence: Synthetic peptide
  Seed: MQMNVINTYT (MAGC3_HUMAN)
MKMNVINTYL

SEQ ID NO: 100039 - protein, 9 aa, Artificial Sequence
  Description of Artificial Sequence: Synthetic peptide
  Seed: KDSDLPTWR (MAGC3_HUMAN)
KWSDLPTWR

SEQ ID NO: 100040 - protein, 10 aa, Artificial Sequence
  Description of Artificial Sequence: Synthetic peptide
  Seed: ALDEKVAELV (MAGC3_HUMAN)
AYDEKVAELM

SEQ ID NO: 100041 - protein, 9 aa, Artificial Sequence
  Description of Artificial Sequence: Synthetic peptide
  Seed: LANPQGLAG (MAGC3_HUMAN)
LANPQGLAV

SEQ ID NO: 100042 - protein, 9 aa, Artificial Sequence
  Description of Artificial Sequence: Synthetic peptide
  Seed: TSDQRMDSL (MAGC3_HUMAN)
TMDQRMDSL

SEQ ID NO: 100043 - protein, 9 aa, Artificial Sequence
  Description of Artificial Sequence: Synthetic peptide
  Seed: MASASPSVM (MAGC3_HUMAN)
MMSASPSVI

SEQ ID NO: 100044 - protein, 9 aa, Artificial Sequence
  Description of Artificial Sequence: Synthetic peptide
  Seed: MIFRKAREF (MAGC3_HUMAN)
MYFRKAREY

SEQ ID NO: 100045 - protein, 10 aa, Artificial Sequence
  Description of Artificial Sequence: Synthetic peptide
  Seed: YTLDEKVDKL (MAGC3_HUMAN)
YLLDEKVDKL

SEQ ID NO: 100046 - protein, 10 aa, Artificial Sequence
  Description of Artificial Sequence: Synthetic peptide
  Seed: EKVAELVQFL (MAGC3_HUMAN)
EFVAELVQFY

SEQ ID NO: 100047 - protein, 10 aa, Artificial Sequence
  Description of Artificial Sequence: Synthetic peptide
  Seed: EEDTATWHAL (MAGC3_HUMAN)
EEDTATWHAF

SEQ ID NO: 100048 - protein, 8 aa, Artificial Sequence
  Description of Artificial Sequence: Synthetic peptide
  Seed: IFGKAHEF (MAGC3_HUMAN)
ITGKAHEW

SEQ ID NO: 100049 - protein, 10 aa, Artificial Sequence
  Description of Artificial Sequence: Synthetic peptide
  Seed: TGYFPMIFRK (MAGC3_HUMAN)
TAYFPMIFRF

SEQ ID NO: 100050 - protein, 9 aa, Artificial Sequence
  Description of Artificial Sequence: Synthetic peptide
  Seed: DMDPDNHSY (MAGC3_HUMAN)
DFDPDNHSV

SEQ ID NO: 100051 - protein, 9 aa, Artificial Sequence
  Description of Artificial Sequence: Synthetic peptide
  Seed: MLLPCHWVL (MAGC3_HUMAN)
MRLPCHWVF

SEQ ID NO: 100052 - protein, 9 aa, Artificial Sequence
  Description of Artificial Sequence: Synthetic peptide
  Seed: IIDTTDDAT (MAGC3_HUMAN)
ISDTTDDAV

SEQ ID NO: 100053 - protein, 9 aa, Artificial Sequence
  Description of Artificial Sequence: Synthetic peptide
  Seed: MASASPSVM (MAGC3_HUMAN)
MHSASPSVL

SEQ ID NO: 100054 - protein, 11 aa, Artificial Sequence
  Description of Artificial Sequence: Synthetic peptide
  Seed: YALDEKVAELV (MAGC3_HUMAN)
YMLDEKVAELV

SEQ ID NO: 100055 - protein, 9 aa, Artificial Sequence
  Description of Artificial Sequence: Synthetic peptide
  Seed: MASASPSVM (MAGC3_HUMAN)
MISASPSVM

SEQ ID NO: 100056 - protein, 9 aa, Artificial Sequence
  Description of Artificial Sequence: Synthetic peptide
  Seed: KAHEFIELI (MAGC3_HUMAN)
KQHEFIELV

SEQ ID NO: 100057 - protein, 10 aa, Artificial Sequence
  Description of Artificial Sequence: Synthetic peptide
  Seed: SDQRMDSLVL (MAGC3_HUMAN)
SVQRMDSLVF

SEQ ID NO: 100058 - protein, 9 aa, Artificial Sequence
  Description of Artificial Sequence: Synthetic peptide
  Seed: WVKNTCATY (MAGC3_HUMAN)
WTKNTCATY

SEQ ID NO: 100059 - protein, 9 aa, Artificial Sequence
  Description of Artificial Sequence: Synthetic peptide
  Seed: SQPEGKFSL (MAGC3_HUMAN)
SHPEGKFSY

SEQ ID NO: 100060 - protein, 9 aa, Artificial Sequence
  Description of Artificial Sequence: Synthetic peptide
  Seed: TSDQRMDSL (MAGC3_HUMAN)
TYDQRMDSV

SEQ ID NO: 100061 - protein, 9 aa, Artificial Sequence
  Description of Artificial Sequence: Synthetic peptide
  Seed: RTLSGSPGL (MAGC3_HUMAN)
RLLSGSPGR

SEQ ID NO: 100062 - protein, 9 aa, Artificial Sequence
  Description of Artificial Sequence: Synthetic peptide
  Seed: NTYTGYFPM (MAGC3_HUMAN)
NRYTGYFPF

SEQ ID NO: 100063 - protein, 9 aa, Artificial Sequence
  Description of Artificial Sequence: Synthetic peptide
  Seed: WRRGTGYTL (MAGC3_HUMAN)
WSRGTGYTF

SEQ ID NO: 100064 - protein, 9 aa, Artificial Sequence
  Description of Artificial Sequence: Synthetic peptide
  Seed: ALAGFADVL (MAGC3_HUMAN)
AIAGFADVF

SEQ ID NO: 100065 - protein, 9 aa, Artificial Sequence
  Description of Artificial Sequence: Synthetic peptide
  Seed: YSAFHLGHL (MAGC3_HUMAN)
YSAFHLGHF

SEQ ID NO: 100066 - protein, 10 aa, Artificial Sequence
  Description of Artificial Sequence: Synthetic peptide
  Seed: YALDEKVAEL (MAGC3_HUMAN)
YELDEKVAEC

SEQ ID NO: 100067 - protein, 9 aa, Artificial Sequence
  Description of Artificial Sequence: Synthetic peptide
  Seed: HALPESESL (MAGC3_HUMAN)
HRLPESESI

SEQ ID NO: 100068 - protein, 9 aa, Artificial Sequence
  Description of Artificial Sequence: Synthetic peptide
  Seed: KVAELVQFL (MAGC3_HUMAN)
KYAELVQFM

SEQ ID NO: 100069 - protein, 9 aa, Artificial Sequence
  Description of Artificial Sequence: Synthetic peptide
  Seed: LSDEQGMPQ (MAGC3_HUMAN)
LADEQGMPL

SEQ ID NO: 100070 - protein, 9 aa, Artificial Sequence
  Description of Artificial Sequence: Synthetic peptide
  Seed: VIWEVLNAI (MAGC3_HUMAN)
VMWEVLNAY

SEQ ID NO: 100071 - protein, 10 aa, Artificial Sequence
  Description of Artificial Sequence: Synthetic peptide
  Seed: SALAGFADVL (MAGC3_HUMAN)
SFLAGFADVV

SEQ ID NO: 100072 - protein, 9 aa, Artificial Sequence
  Description of Artificial Sequence: Synthetic peptide
  Seed: KKYKDYFPM (MAGC3_HUMAN)
KQYKDYFPA

SEQ ID NO: 100073 - protein, 10 aa, Artificial Sequence
  Description of Artificial Sequence: Synthetic peptide
  Seed: TDMDPDNHSY (MAGC3_HUMAN)
TPMDPDNHSL

SEQ ID NO: 100074 - protein, 10 aa, Artificial Sequence
  Description of Artificial Sequence: Synthetic peptide
  Seed: VLCPTYFKLW (MAGC3_HUMAN)
VWCPTYFKLF

SEQ ID NO: 100075 - protein, 9 aa, Artificial Sequence
  Description of Artificial Sequence: Synthetic peptide
  Seed: MIFRKAREF (MAGC3_HUMAN)
MMFRKAREI

SEQ ID NO: 100076 - protein, 9 aa, Artificial Sequence
  Description of Artificial Sequence: Synthetic peptide
  Seed: FPSWYMDAL (MAGC3_HUMAN)
FMSWYMDAM

SEQ ID NO: 100077 - protein, 11 aa, Artificial Sequence
  Description of Artificial Sequence: Synthetic peptide
  Seed: VINTYTGYFPM (MAGC3_HUMAN)
VVNTYTGYFPW

SEQ ID NO: 100078 - protein, 9 aa, Artificial Sequence
  Description of Artificial Sequence: Synthetic peptide
  Seed: LKYQAKEPL (MAGC3_HUMAN)
LTYQAKEPF

SEQ ID NO: 100079 - protein, 10 aa, Artificial Sequence
  Description of Artificial Sequence: Synthetic peptide
  Seed: FLSKLSSIIP (MAGC3_HUMAN)
FMSKLSSIII

SEQ ID NO: 100080 - protein, 9 aa, Artificial Sequence
  Description of Artificial Sequence: Synthetic peptide
  Seed: YFFEDTLDL (MAGC3_HUMAN)
YPFEDTLDS

SEQ ID NO: 100081 - protein, 10 aa, Artificial Sequence
  Description of Artificial Sequence: Synthetic peptide
  Seed: KVDKLVQFLL (MAGC3_HUMAN)
KMDKLVQFLL

SEQ ID NO: 100082 - protein, 10 aa, Artificial Sequence
  Description of Artificial Sequence: Synthetic peptide
  Seed: TGYFPMIFRK (MAGC3_HUMAN)
TAYFPMIFRY

SEQ ID NO: 100083 - protein, 9 aa, Artificial Sequence
  Description of Artificial Sequence: Synthetic peptide
  Seed: AIGPIQRPA (MAGC3_HUMAN)
AMGPIQRPV

SEQ ID NO: 100084 - protein, 9 aa, Artificial Sequence
  Description of Artificial Sequence: Synthetic peptide
  Seed: QAKEPLTRA (MAGC3_HUMAN)
QSKEPLTRF

SEQ ID NO: 100085 - protein, 8 aa, Artificial Sequence
  Description of Artificial Sequence: Synthetic peptide
  Seed: FADVLSRL (MAGC3_HUMAN)
FVDVLSRL

SEQ ID NO: 100086 - protein, 9 aa, Artificial Sequence
  Description of Artificial Sequence: Synthetic peptide
  Seed: RPAREVLEF (MAGC3_HUMAN)
RRAREVLEM

SEQ ID NO: 100087 - protein, 11 aa, Artificial Sequence
  Description of Artificial Sequence: Synthetic peptide
  Seed: AIGPWSALAGF (MAGC3_HUMAN)
AQGPWSALAGF

SEQ ID NO: 100088 - protein, 9 aa, Artificial Sequence
  Description of Artificial Sequence: Synthetic peptide
  Seed: TEVDPDHFY (MAGC3_HUMAN)
TAVDPDHFY

SEQ ID NO: 100089 - protein, 9 aa, Artificial Sequence
  Description of Artificial Sequence: Synthetic peptide
  Seed: REVLEFLSK (MAGC3_HUMAN)
REVLEFLST

SEQ ID NO: 100090 - protein, 9 aa, Artificial Sequence
  Description of Artificial Sequence: Synthetic peptide
  Seed: VLPPQPQPR (MAGC3_HUMAN)
VAPPQPQPA

SEQ ID NO: 100091 - protein, 9 aa, Artificial Sequence
  Description of Artificial Sequence: Synthetic peptide
  Seed: AMASASPSV (MAGC3_HUMAN)
AIASASPSI

SEQ ID NO: 100092 - protein, 10 aa, Artificial Sequence
  Description of Artificial Sequence: Synthetic peptide
  Seed: EVIWEVLNAI (MAGC3_HUMAN)
EIIWEVLNAM

SEQ ID NO: 100093 - protein, 10 aa, Artificial Sequence
  Description of Artificial Sequence: Synthetic peptide
  Seed: KKYKDYFPMI (MAGC3_HUMAN)
KTYKDYFPMW

SEQ ID NO: 100094 - protein, 11 aa, Artificial Sequence
  Description of Artificial Sequence: Synthetic peptide
  Seed: LSLPAVSPGKR (MAGC3_HUMAN)
LLLPAVSPGKR

SEQ ID NO: 100095 - protein, 9 aa, Artificial Sequence
  Description of Artificial Sequence: Synthetic peptide
  Seed: VLCPTYFKL (MAGC3_HUMAN)
VMCPTYFKY

SEQ ID NO: 100096 - protein, 10 aa, Artificial Sequence
  Description of Artificial Sequence: Synthetic peptide
  Seed: SWYMDALKDM (MAGC3_HUMAN)
STYMDALKDF

SEQ ID NO: 100097 - protein, 9 aa, Artificial Sequence
  Description of Artificial Sequence: Synthetic peptide
  Seed: LWGEKAGSL (MAGC3_HUMAN)
LVGEKAGSL

SEQ ID NO: 100098 - protein, 10 aa, Artificial Sequence
  Description of Artificial Sequence: Synthetic peptide
  Seed: LLKYQAKEPL (MAGC3_HUMAN)
LNKYQAKEPF

SEQ ID NO: 100099 - protein, 9 aa, Artificial Sequence
  Description of Artificial Sequence: Synthetic peptide
  Seed: LILILSMIF (MAGC3_HUMAN)
LTLILSMIW

SEQ ID NO: 100100 - protein, 9 aa, Artificial Sequence
  Description of Artificial Sequence: Synthetic peptide
  Seed: FLSKLSSII (MAGC3_HUMAN)
FISKLSSIV

SEQ ID NO: 100101 - protein, 10 aa, Artificial Sequence
  Description of Artificial Sequence: Synthetic peptide
  Seed: YALDEKVAEL (MAGC3_HUMAN)
YKLDEKVAEV

SEQ ID NO: 100102 - protein, 9 aa, Artificial Sequence
  Description of Artificial Sequence: Synthetic peptide
  Seed: YKDYFPMIF (MAGC3_HUMAN)
YRDYFPMIY

SEQ ID NO: 100103 - protein, 10 aa, Artificial Sequence
  Description of Artificial Sequence: Synthetic peptide
  Seed: IKKYKDYFPM (MAGC3_HUMAN)
IQKYKDYFPY

SEQ ID NO: 100104 - protein, 9 aa, Artificial Sequence
  Description of Artificial Sequence: Synthetic peptide
  Seed: ADVLSRLAL (MAGC3_HUMAN)
AEVLSRLAA

SEQ ID NO: 100105 - protein, 9 aa, Artificial Sequence
  Description of Artificial Sequence: Synthetic peptide
  Seed: KFSLRRAVS (MAGC3_HUMAN)
KFSLRRAVK

SEQ ID NO: 100106 - protein, 9 aa, Artificial Sequence
  Description of Artificial Sequence: Synthetic peptide
  Seed: MQMNVINTY (MAGC3_HUMAN)
MWMNVINTY

SEQ ID NO: 100107 - protein, 9 aa, Artificial Sequence
  Description of Artificial Sequence: Synthetic peptide
  Seed: FFEDTLDLT (MAGC3_HUMAN)
FFEDTLDLF

SEQ ID NO: 100108 - protein, 9 aa, Artificial Sequence
  Description of Artificial Sequence: Synthetic peptide
  Seed: SPQGPPQSP (MAGC3_HUMAN)
SPQGPPQSL

SEQ ID NO: 100109 - protein, 10 aa, Artificial Sequence
  Description of Artificial Sequence: Synthetic peptide
  Seed: SIIPSAFPSW (MAGC3_HUMAN)
STIPSAFPSY

SEQ ID NO: 100110 - protein, 10 aa, Artificial Sequence
  Description of Artificial Sequence: Synthetic peptide
  Seed: YTLDEKVDKL (MAGC3_HUMAN)
YALDEKVDKY

SEQ ID NO: 100111 - protein, 9 aa, Artificial Sequence
  Description of Artificial Sequence: Synthetic peptide
  Seed: MASASPSVM (MAGC3_HUMAN)
MMSASPSVW

SEQ ID NO: 100112 - protein, 10 aa, Artificial Sequence
  Description of Artificial Sequence: Synthetic peptide
  Seed: YTLDEKVDKL (MAGC3_HUMAN)
YYLDEKVDKL

SEQ ID NO: 100113 - protein, 10 aa, Artificial Sequence
  Description of Artificial Sequence: Synthetic peptide
  Seed: KLVQFLLLKY (MAGC3_HUMAN)
KTVQFLLLKY

SEQ ID NO: 100114 - protein, 9 aa, Artificial Sequence
  Description of Artificial Sequence: Synthetic peptide
  Seed: MLLPCHWVL (MAGC3_HUMAN)
MPLPCHWVC

SEQ ID NO: 100115 - protein, 10 aa, Artificial Sequence
  Description of Artificial Sequence: Synthetic peptide
  Seed: SLVLCPTYFK (MAGC3_HUMAN)
SLVLCPTYFR

SEQ ID NO: 100116 - protein, 9 aa, Artificial Sequence
  Description of Artificial Sequence: Synthetic peptide
  Seed: GSLPESEPL (MAGC3_HUMAN)
GLLPESEPI

SEQ ID NO: 100117 - protein, 9 aa, Artificial Sequence
  Description of Artificial Sequence: Synthetic peptide
  Seed: MIFRKAREF (MAGC3_HUMAN)
MLFRKAREL

SEQ ID NO: 100118 - protein, 10 aa, Artificial Sequence
  Description of Artificial Sequence: Synthetic peptide
  Seed: RSAEGSVLDL (MAGC3_HUMAN)
RQAEGSVLDV

SEQ ID NO: 100119 - protein, 10 aa, Artificial Sequence
  Description of Artificial Sequence: Synthetic peptide
  Seed: VVLPPQPQPR (MAGC3_HUMAN)
VSLPPQPQPY

SEQ ID NO: 100120 - protein, 10 aa, Artificial Sequence
  Description of Artificial Sequence: Synthetic peptide
  Seed: LVLCPTYFKL (MAGC3_HUMAN)
LTLCPTYFKK

SEQ ID NO: 100121 - protein, 10 aa, Artificial Sequence
  Description of Artificial Sequence: Synthetic peptide
  Seed: TCATYALSPV (MAGC3_HUMAN)
TMATYALSPV

SEQ ID NO: 100122 - protein, 9 aa, Artificial Sequence
  Description of Artificial Sequence: Synthetic peptide
  Seed: TGYTLSLPA (MAGC3_HUMAN)
TPYTLSLPI

SEQ ID NO: 100123 - protein, 9 aa, Artificial Sequence
  Description of Artificial Sequence: Synthetic peptide
  Seed: IPSAFPSWY (MAGC3_HUMAN)
IISAFPSWY

SEQ ID NO: 100124 - protein, 9 aa, Artificial Sequence
  Description of Artificial Sequence: Synthetic peptide
  Seed: WYMDALKDM (MAGC3_HUMAN)
WYMDALKDF

SEQ ID NO: 100125 - protein, 9 aa, Artificial Sequence
  Description of Artificial Sequence: Synthetic peptide
  Seed: VDPDHFYVF (MAGC3_HUMAN)
VTPDHFYVM

SEQ ID NO: 100126 - protein, 9 aa, Artificial Sequence
  Description of Artificial Sequence: Synthetic peptide
  Seed: FPMIFGKAH (MAGC3_HUMAN)
FSMIFGKAF

SEQ ID NO: 100127 - protein, 9 aa, Artificial Sequence
  Description of Artificial Sequence: Synthetic peptide
  Seed: YQAKEPLTR (MAGC3_HUMAN)
YLAKEPLTM

SEQ ID NO: 100128 - protein, 9 aa, Artificial Sequence
  Description of Artificial Sequence: Synthetic peptide
  Seed: FPMIFGKAH (MAGC3_HUMAN)
FVMIFGKAY

SEQ ID NO: 100129 - protein, 9 aa, Artificial Sequence
  Description of Artificial Sequence: Synthetic peptide
  Seed: VLCPTYFKL (MAGC3_HUMAN)
VQCPTYFKM

SEQ ID NO: 100130 - protein, 10 aa, Artificial Sequence
  Description of Artificial Sequence: Synthetic peptide
  Seed: SKLSSIIPSA (MAGC3_HUMAN)
SILSSIIPSL

SEQ ID NO: 100131 - protein, 9 aa, Artificial Sequence
  Description of Artificial Sequence: Synthetic peptide
  Seed: YSAFHLGHL (MAGC3_HUMAN)
YWAFHLGHM

SEQ ID NO: 100132 - protein, 9 aa, Artificial Sequence
  Description of Artificial Sequence: Synthetic peptide
  Seed: FLSKLSSII (MAGC3_HUMAN)
FFSKLSSIF

SEQ ID NO: 100133 - protein, 9 aa, Artificial Sequence
  Description of Artificial Sequence: Synthetic peptide
  Seed: VINTYTGYF (MAGC3_HUMAN)
VMNTYTGYM

SEQ ID NO: 100134 - protein, 10 aa, Artificial Sequence
  Description of Artificial Sequence: Synthetic peptide
  Seed: CASEEVIWEV (MAGC3_HUMAN)
CQSEEVIWEL

SEQ ID NO: 100135 - protein, 9 aa, Artificial Sequence
  Description of Artificial Sequence: Synthetic peptide
  Seed: EKVAELVQF (MAGC3_HUMAN)
EAVAELVQY

SEQ ID NO: 100136 - protein, 9 aa, Artificial Sequence
  Description of Artificial Sequence: Synthetic peptide
  Seed: KEPVTKAEM (MAGC3_HUMAN)
KQPVTKAEY

SEQ ID NO: 100137 - protein, 10 aa, Artificial Sequence
  Description of Artificial Sequence: Synthetic peptide
  Seed: EFLSKLSSII (MAGC3_HUMAN)
EFLSKLSSIV

SEQ ID NO: 100138 - protein, 10 aa, Artificial Sequence
  Description of Artificial Sequence: Synthetic peptide
  Seed: SKLSSIIPSA (MAGC3_HUMAN)
SCLSSIIPSA

SEQ ID NO: 100139 - protein, 11 aa, Artificial Sequence
  Description of Artificial Sequence: Synthetic peptide
  Seed: IIDTTDDATAM (MAGC3_HUMAN)
ISDTTDDATAL

SEQ ID NO: 100140 - protein, 11 aa, Artificial Sequence
  Description of Artificial Sequence: Synthetic peptide
  Seed: IIDTTDDATAM (MAGC3_HUMAN)
ILDTTDDATAI

SEQ ID NO: 100141 - protein, 9 aa, Artificial Sequence
  Description of Artificial Sequence: Synthetic peptide
  Seed: KYKDYFPMI (MAGC3_HUMAN)
KRKDYFPMM

SEQ ID NO: 100142 - protein, 10 aa, Artificial Sequence
  Description of Artificial Sequence: Synthetic peptide
  Seed: ASPSVMSTNF (MAGC3_HUMAN)
AAPSVMSTNL

SEQ ID NO: 100143 - protein, 10 aa, Artificial Sequence
  Description of Artificial Sequence: Synthetic peptide
  Seed: KLSSIIPSAF (MAGC3_HUMAN)
KDSSIIPSAF

SEQ ID NO: 100144 - protein, 11 aa, Artificial Sequence
  Description of Artificial Sequence: Synthetic peptide
  Seed: LSKLSSIIPSA (MAGC3_HUMAN)
LIKLSSIIPSL

SEQ ID NO: 100145 - protein, 9 aa, Artificial Sequence
  Description of Artificial Sequence: Synthetic peptide
  Seed: YFPMIFRKA (MAGC3_HUMAN)
YYPMIFRKL

SEQ ID NO: 100146 - protein, 9 aa, Artificial Sequence
  Description of Artificial Sequence: Synthetic peptide
  Seed: LSGSPGLQL (MAGC3_HUMAN)
LRGSPGLQF

SEQ ID NO: 100147 - protein, 10 aa, Artificial Sequence
  Description of Artificial Sequence: Synthetic peptide
  Seed: YALDEKVAEL (MAGC3_HUMAN)
YFLDEKVAEC

SEQ ID NO: 100148 - protein, 10 aa, Artificial Sequence
  Description of Artificial Sequence: Synthetic peptide
  Seed: MPAAGMPPLP (MAGC3_HUMAN)
MPAAGMPPLQ

SEQ ID NO: 100149 - protein, 10 aa, Artificial Sequence
  Description of Artificial Sequence: Synthetic peptide
  Seed: GLRSAEGSVL (MAGC3_HUMAN)
GARSAEGSVY

SEQ ID NO: 100150 - protein, 10 aa, Artificial Sequence
  Description of Artificial Sequence: Synthetic peptide
  Seed: SWYMDALKDM (MAGC3_HUMAN)
SNYMDALKDF

SEQ ID NO: 100151 - protein, 10 aa, Artificial Sequence
  Description of Artificial Sequence: Synthetic peptide
  Seed: MQMNVINTYT (MAGC3_HUMAN)
MMMNVINTYL

SEQ ID NO: 100152 - protein, 10 aa, Artificial Sequence
  Description of Artificial Sequence: Synthetic peptide
  Seed: ILFGISLTEV (MAGC3_HUMAN)
IMFGISLTEM

SEQ ID NO: 100153 - protein, 9 aa, Artificial Sequence
  Description of Artificial Sequence: Synthetic peptide
  Seed: FGSQPEGKF (MAGC3_HUMAN)
FISQPEGKL

SEQ ID NO: 100154 - protein, 10 aa, Artificial Sequence
  Description of Artificial Sequence: Synthetic peptide
  Seed: KDYFPMIFGK (MAGC3_HUMAN)
KEYFPMIFGR

SEQ ID NO: 100155 - protein, 10 aa, Artificial Sequence
  Description of Artificial Sequence: Synthetic peptide
  Seed: EVDPDHFYVF (MAGC3_HUMAN)
EIDPDHFYVY

SEQ ID NO: 100156 - protein, 10 aa, Artificial Sequence
  Description of Artificial Sequence: Synthetic peptide
  Seed: IIDTTDDATA (MAGC3_HUMAN)
IIDTTDDATL

SEQ ID NO: 100157 - protein, 9 aa, Artificial Sequence
  Description of Artificial Sequence: Synthetic peptide
  Seed: KLVQFLLLK (MAGC3_HUMAN)
KQVQFLLLK

SEQ ID NO: 100158 - protein, 9 aa, Artificial Sequence
  Description of Artificial Sequence: Synthetic peptide
  Seed: SLVLCPTYF (MAGC3_HUMAN)
SIVLCPTYV

SEQ ID NO: 100159 - protein, 9 aa, Artificial Sequence
  Description of Artificial Sequence: Synthetic peptide
  Seed: TLDEKVDKL (MAGC3_HUMAN)
TSDEKVDKW

SEQ ID NO: 100160 - protein, 10 aa, Artificial Sequence
  Description of Artificial Sequence: Synthetic peptide
  Seed: YTLDEKVDKL (MAGC3_HUMAN)
YGLDEKVDKL

SEQ ID NO: 100161 - protein, 10 aa, Artificial Sequence
  Description of Artificial Sequence: Synthetic peptide
  Seed: GLRSAEGSVL (MAGC3_HUMAN)
GQRSAEGSVY

SEQ ID NO: 100162 - protein, 9 aa, Artificial Sequence
  Description of Artificial Sequence: Synthetic peptide
  Seed: LFGISLTEV (MAGC3_HUMAN)
LYGISLTEM

SEQ ID NO: 100163 - protein, 9 aa, Artificial Sequence
  Description of Artificial Sequence: Synthetic peptide
  Seed: DGSLGQWVK (MAGC3_HUMAN)
DTSLGQWVR

SEQ ID NO: 100164 - protein, 11 aa, Artificial Sequence
  Description of Artificial Sequence: Synthetic peptide
  Seed: TTDDATAMASA (MAGC3_HUMAN)
TLDDATAMASM

SEQ ID NO: 100165 - protein, 9 aa, Artificial Sequence
  Description of Artificial Sequence: Synthetic peptide
  Seed: QGMPQNRLL (MAGC3_HUMAN)
QVMPQNRLW

SEQ ID NO: 100166 - protein, 10 aa, Artificial Sequence
  Description of Artificial Sequence: Synthetic peptide
  Seed: EMQMNVINTY (MAGC3_HUMAN)
ETQMNVINTF

SEQ ID NO: 100167 - protein, 9 aa, Artificial Sequence
  Description of Artificial Sequence: Synthetic peptide
  Seed: SESLPRYAL (MAGC3_HUMAN)
SESLPRYAA

SEQ ID NO: 100168 - protein, 11 aa, Artificial Sequence
  Description of Artificial Sequence: Synthetic peptide
  Seed: FPMIFGKAHEF (MAGC3_HUMAN)
FPMIFGKAHEL

SEQ ID NO: 100169 - protein, 10 aa, Artificial Sequence
  Description of Artificial Sequence: Synthetic peptide
  Seed: TGYFPMIFRK (MAGC3_HUMAN)
TTYFPMIFRP

SEQ ID NO: 100170 - protein, 10 aa, Artificial Sequence
  Description of Artificial Sequence: Synthetic peptide
  Seed: YALDEKVAEL (MAGC3_HUMAN)
YVLDEKVAET

SEQ ID NO: 100171 - protein, 9 aa, Artificial Sequence
  Description of Artificial Sequence: Synthetic peptide
  Seed: LSDEQGMPQ (MAGC3_HUMAN)
LLDEQGMPY

SEQ ID NO: 100172 - protein, 9 aa, Artificial Sequence
  Description of Artificial Sequence: Synthetic peptide
  Seed: AMASASPSV (MAGC3_HUMAN)
AGASASPSY

SEQ ID NO: 100173 - protein, 9 aa, Artificial Sequence
  Description of Artificial Sequence: Synthetic peptide
  Seed: TYALSPVVL (MAGC3_HUMAN)
TYALSPVVF

SEQ ID NO: 100174 - protein, 10 aa, Artificial Sequence
  Description of Artificial Sequence: Synthetic peptide
  Seed: EKVAELVQFL (MAGC3_HUMAN)
EYVAELVQFL

SEQ ID NO: 100175 - protein, 9 aa, Artificial Sequence
  Description of Artificial Sequence: Synthetic peptide
  Seed: FHLGHLREV (MAGC3_HUMAN)
FKLGHLREL

SEQ ID NO: 100176 - protein, 10 aa, Artificial Sequence
  Description of Artificial Sequence: Synthetic peptide
  Seed: FKLWRTLSGS (MAGC3_HUMAN)
FILWRTLSGV

SEQ ID NO: 100177 - protein, 10 aa, Artificial Sequence
  Description of Artificial Sequence: Synthetic peptide
  Seed: FKLWRTLSGS (MAGC3_HUMAN)
FVLWRTLSGV

SEQ ID NO: 100178 - protein, 9 aa, Artificial Sequence
  Description of Artificial Sequence: Synthetic peptide
  Seed: MPKNCLLIL (MAGC3_HUMAN)
MPKNCLLIY

SEQ ID NO: 100179 - protein, 9 aa, Artificial Sequence
  Description of Artificial Sequence: Synthetic peptide
  Seed: IIDTTDDAT (MAGC3_HUMAN)
IADTTDDAL

SEQ ID NO: 100180 - protein, 10 aa, Artificial Sequence
  Description of Artificial Sequence: Synthetic peptide
  Seed: LPRYALDEKV (MAGC3_HUMAN)
LPRYALDEKL

SEQ ID NO: 100181 - protein, 9 aa, Artificial Sequence
  Description of Artificial Sequence: Synthetic peptide
  Seed: RGTGYTLSL (MAGC3_HUMAN)
RITGYTLSI

SEQ ID NO: 100182 - protein, 9 aa, Artificial Sequence
  Description of Artificial Sequence: Synthetic peptide
  Seed: SESLPRYAL (MAGC3_HUMAN)
SDSLPRYAF

SEQ ID NO: 100183 - protein, 10 aa, Artificial Sequence
  Description of Artificial Sequence: Synthetic peptide
  Seed: MLLPCHWVLD (MAGC3_HUMAN)
MQLPCHWVLV

SEQ ID NO: 100184 - protein, 11 aa, Artificial Sequence
  Description of Artificial Sequence: Synthetic peptide
  Seed: ATAMASASPSV (MAGC3_HUMAN)
APAMASASPSV

SEQ ID NO: 100185 - protein, 11 aa, Artificial Sequence
  Description of Artificial Sequence: Synthetic peptide
  Seed: TAMASASPSVM (MAGC3_HUMAN)
TMMASASPSVF

SEQ ID NO: 100186 - protein, 9 aa, Artificial Sequence
  Description of Artificial Sequence: Synthetic peptide
  Seed: ISPQGPPQS (MAGC3_HUMAN)
ITPQGPPQM

SEQ ID NO: 100187 - protein, 9 aa, Artificial Sequence
  Description of Artificial Sequence: Synthetic peptide
  Seed: KKYKDYFPM (MAGC3_HUMAN)
KRYKDYFPF

SEQ ID NO: 100188 - protein, 10 aa, Artificial Sequence
  Description of Artificial Sequence: Synthetic peptide
  Seed: LPTWRRGTGY (MAGC3_HUMAN)
LNTWRRGTGW

SEQ ID NO: 100189 - protein, 9 aa, Artificial Sequence
  Description of Artificial Sequence: Synthetic peptide
  Seed: VINTYTGYF (MAGC3_HUMAN)
VANTYTGYF

SEQ ID NO: 100190 - protein, 9 aa, Artificial Sequence
  Description of Artificial Sequence: Synthetic peptide
  Seed: NTYTGYFPM (MAGC3_HUMAN)
NKYTGYFPY

SEQ ID NO: 100191 - protein, 9 aa, Artificial Sequence
  Description of Artificial Sequence: Synthetic peptide
  Seed: MLLPCHWVL (MAGC3_HUMAN)
MPLPCHWVS

SEQ ID NO: 100192 - protein, 10 aa, Artificial Sequence
  Description of Artificial Sequence: Synthetic peptide
  Seed: SDQRMDSLVL (MAGC3_HUMAN)
SCQRMDSLVF

SEQ ID NO: 100193 - protein, 11 aa, Artificial Sequence
  Description of Artificial Sequence: Synthetic peptide
  Seed: SSSEEEDTATW (MAGC3_HUMAN)
SESEEEDTATY

SEQ ID NO: 100194 - protein, 9 aa, Artificial Sequence
  Description of Artificial Sequence: Synthetic peptide
  Seed: WRRGTGYTL (MAGC3_HUMAN)
WWRGTGYTL

SEQ ID NO: 100195 - protein, 8 aa, Artificial Sequence
  Description of Artificial Sequence: Synthetic peptide
  Seed: AIGPWSAL (MAGC3_HUMAN)
AAGPWSAL

SEQ ID NO: 100196 - protein, 9 aa, Artificial Sequence
  Description of Artificial Sequence: Synthetic peptide
  Seed: MIFGKAHEF (MAGC3_HUMAN)
MPFGKAHET

SEQ ID NO: 100197 - protein, 9 aa, Artificial Sequence
  Description of Artificial Sequence: Synthetic peptide
  Seed: FADVLSRLA (MAGC3_HUMAN)
FDDVLSRLL

SEQ ID NO: 100198 - protein, 8 aa, Artificial Sequence
  Description of Artificial Sequence: Synthetic peptide
  Seed: MEDRAQAI (MAGC3_HUMAN)
MVDRAQAF

SEQ ID NO: 100199 - protein, 11 aa, Artificial Sequence
  Description of Artificial Sequence: Synthetic peptide
  Seed: SSSEEEDTATW (MAGC3_HUMAN)
SVSEEEDTATY

SEQ ID NO: 100200 - protein, 10 aa, Artificial Sequence
  Description of Artificial Sequence: Synthetic peptide
  Seed: REVRLFLRGG (MAGC3_HUMAN)
RNVRLFLRGV

SEQ ID NO: 100201 - protein, 9 aa, Artificial Sequence
  Description of Artificial Sequence: Synthetic peptide
  Seed: HALPESESL (MAGC3_HUMAN)
HFLPESESM

SEQ ID NO: 100202 - protein, 9 aa, Artificial Sequence
  Description of Artificial Sequence: Synthetic peptide
  Seed: EVLSAIGPI (MAGC3_HUMAN)
EILSAIGPK

SEQ ID NO: 100203 - protein, 9 aa, Artificial Sequence
  Description of Artificial Sequence: Synthetic peptide
  Seed: TEASPQQKK (MAGC3_HUMAN)
TAASPQQKK

SEQ ID NO: 100204 - protein, 11 aa, Artificial Sequence
  Description of Artificial Sequence: Synthetic peptide
  Seed: LSKLSSIIPSA (MAGC3_HUMAN)
LLKLSSIIPSV

SEQ ID NO: 100205 - protein, 11 aa, Artificial Sequence
  Description of Artificial Sequence: Synthetic peptide
  Seed: ATFSDGSLGQW (MAGC3_HUMAN)
ACFSDGSLGQW

SEQ ID NO: 100206 - protein, 9 aa, Artificial Sequence
  Description of Artificial Sequence: Synthetic peptide
  Seed: YFFEDTLDL (MAGC3_HUMAN)
YTFEDTLDM

SEQ ID NO: 100207 - protein, 8 aa, Artificial Sequence
  Description of Artificial Sequence: Synthetic peptide
  Seed: SEEVIWEV (MAGC3_HUMAN)
SEEVIWEL

SEQ ID NO: 100208 - protein, 10 aa, Artificial Sequence
  Description of Artificial Sequence: Synthetic peptide
  Seed: WVKNTCATYA (MAGC3_HUMAN)
WQKNTCATYL

SEQ ID NO: 100209 - protein, 10 aa, Artificial Sequence
  Description of Artificial Sequence: Synthetic peptide
  Seed: EKVAELVQFL (MAGC3_HUMAN)
EMVAELVQFL

SEQ ID NO: 100210 - protein, 8 aa, Artificial Sequence
  Description of Artificial Sequence: Synthetic peptide
  Seed: SGSPGLQL (MAGC3_HUMAN)
STSPGLQL

SEQ ID NO: 100211 - protein, 10 aa, Artificial Sequence
  Description of Artificial Sequence: Synthetic peptide
  Seed: SKLSSIIPSA (MAGC3_HUMAN)
SSLSSIIPSV

SEQ ID NO: 100212 - protein, 9 aa, Artificial Sequence
  Description of Artificial Sequence: Synthetic peptide
  Seed: IIDTTDDAT (MAGC3_HUMAN)
ILDTTDDAV

SEQ ID NO: 100213 - protein, 10 aa, Artificial Sequence
  Description of Artificial Sequence: Synthetic peptide
  Seed: CLLILILSMI (MAGC3_HUMAN)
CSLILILSMV

SEQ ID NO: 100214 - protein, 10 aa, Artificial Sequence
  Description of Artificial Sequence: Synthetic peptide
  Seed: RLWGEKAGSL (MAGC3_HUMAN)
RLWGEKAGSV

SEQ ID NO: 100215 - protein, 9 aa, Artificial Sequence
  Description of Artificial Sequence: Synthetic peptide
  Seed: TYTGYFPMI (MAGC3_HUMAN)
TRTGYFPMF

SEQ ID NO: 100216 - protein, 10 aa, Artificial Sequence
  Description of Artificial Sequence: Synthetic peptide
  Seed: ILILSMIFIK (MAGC3_HUMAN)
IQILSMIFIR

SEQ ID NO: 100217 - protein, 10 aa, Artificial Sequence
  Description of Artificial Sequence: Synthetic peptide
  Seed: SDQRMDSLVL (MAGC3_HUMAN)
SQQRMDSLVY

SEQ ID NO: 100218 - protein, 10 aa, Artificial Sequence
  Description of Artificial Sequence: Synthetic peptide
  Seed: ILILSVIFIK (MAGC3_HUMAN)
IMILSVIFIR

SEQ ID NO: 100219 - protein, 9 aa, Artificial Sequence
  Description of Artificial Sequence: Synthetic peptide
  Seed: QTKEPVTKA (MAGC3_HUMAN)
QVKEPVTKR

SEQ ID NO: 100220 - protein, 9 aa, Artificial Sequence
  Description of Artificial Sequence: Synthetic peptide
  Seed: LKYQAKEPL (MAGC3_HUMAN)
LIYQAKEPY

SEQ ID NO: 100221 - protein, 9 aa, Artificial Sequence
  Description of Artificial Sequence: Synthetic peptide
  Seed: VLCPTYFKL (MAGC3_HUMAN)
VACPTYFKV

SEQ ID NO: 100222 - protein, 9 aa, Artificial Sequence
  Description of Artificial Sequence: Synthetic peptide
  Seed: MASASPSVM (MAGC3_HUMAN)
MHSASPSVV

SEQ ID NO: 100223 - protein, 10 aa, Artificial Sequence
  Description of Artificial Sequence: Synthetic peptide
  Seed: MNVINTYTGY (MAGC3_HUMAN)
MAVINTYTGK

SEQ ID NO: 100224 - protein, 9 aa, Artificial Sequence
  Description of Artificial Sequence: Synthetic peptide
  Seed: FHLGHLREV (MAGC3_HUMAN)
FTLGHLREV

SEQ ID NO: 100225 - protein, 9 aa, Artificial Sequence
  Description of Artificial Sequence: Synthetic peptide
  Seed: ATDKDYSAF (MAGC3_HUMAN)
ATDKDYSAY

SEQ ID NO: 100226 - protein, 10 aa, Artificial Sequence
  Description of Artificial Sequence: Synthetic peptide
  Seed: TAMASASPSV (MAGC3_HUMAN)
TTMASASPSL

SEQ ID NO: 100227 - protein, 10 aa, Artificial Sequence
  Description of Artificial Sequence: Synthetic peptide
  Seed: SLPAVSPGKR (MAGC3_HUMAN)
STPAVSPGKR

SEQ ID NO: 100228 - protein, 9 aa, Artificial Sequence
  Description of Artificial Sequence: Synthetic peptide
  Seed: CHWVLDATF (MAGC3_HUMAN)
CQWVLDATF

SEQ ID NO: 100229 - protein, 9 aa, Artificial Sequence
  Description of Artificial Sequence: Synthetic peptide
  Seed: MASASPSVM (MAGC3_HUMAN)
MPSASPSVW

SEQ ID NO: 100230 - protein, 9 aa, Artificial Sequence
  Description of Artificial Sequence: Synthetic peptide
  Seed: MEDRAQAII (MAGC3_HUMAN)
MSDRAQAIF

SEQ ID NO: 100231 - protein, 10 aa, Artificial Sequence
  Description of Artificial Sequence: Synthetic peptide
  Seed: YALSPVVLPP (MAGC3_HUMAN)
YYLSPVVLPL

SEQ ID NO: 100232 - protein, 9 aa, Artificial Sequence
  Description of Artificial Sequence: Synthetic peptide
  Seed: KAHEFIELI (MAGC3_HUMAN)
KFHEFIELK

SEQ ID NO: 100233 - protein, 10 aa, Artificial Sequence
  Description of Artificial Sequence: Synthetic peptide
  Seed: MQMNVINTYT (MAGC3_HUMAN)
MEMNVINTYY

SEQ ID NO: 100234 - protein, 9 aa, Artificial Sequence
  Description of Artificial Sequence: Synthetic peptide
  Seed: HALPESESL (MAGC3_HUMAN)
HMLPESESY

SEQ ID NO: 100235 - protein, 10 aa, Artificial Sequence
  Description of Artificial Sequence: Synthetic peptide
  Seed: ILFGISLTEV (MAGC3_HUMAN)
IVFGISLTEI

SEQ ID NO: 100236 - protein, 10 aa, Artificial Sequence
  Description of Artificial Sequence: Synthetic peptide
  Seed: TAMASASPSV (MAGC3_HUMAN)
TMMASASPSV

SEQ ID NO: 100237 - protein, 9 aa, Artificial Sequence
  Description of Artificial Sequence: Synthetic peptide
  Seed: EVLEFLSKL (MAGC3_HUMAN)
EQLEFLSKR

SEQ ID NO: 100238 - protein, 9 aa, Artificial Sequence
  Description of Artificial Sequence: Synthetic peptide
  Seed: FSLRRAVSV (MAGC3_HUMAN)
FKLRRAVSL

SEQ ID NO: 100239 - protein, 9 aa, Artificial Sequence
  Description of Artificial Sequence: Synthetic peptide
  Seed: MLLPCHWVL (MAGC3_HUMAN)
MELPCHWVY

SEQ ID NO: 100240 - protein, 10 aa, Artificial Sequence
  Description of Artificial Sequence: Synthetic peptide
  Seed: SDQRMDSLVL (MAGC3_HUMAN)
SYQRMDSLVM

SEQ ID NO: 100241 - protein, 9 aa, Artificial Sequence
  Description of Artificial Sequence: Synthetic peptide
  Seed: FHLGHLREV (MAGC3_HUMAN)
FQLGHLREM

SEQ ID NO: 100242 - protein, 9 aa, Artificial Sequence
  Description of Artificial Sequence: Synthetic peptide
  Seed: SLPAVSPGK (MAGC3_HUMAN)
SVPAVSPGR

SEQ ID NO: 100243 - protein, 9 aa, Artificial Sequence
  Description of Artificial Sequence: Synthetic peptide
  Seed: KKYKDYFPM (MAGC3_HUMAN)
KKYKDYFPI

SEQ ID NO: 100244 - protein, 9 aa, Artificial Sequence
  Description of Artificial Sequence: Synthetic peptide
  Seed: NTYTGYFPM (MAGC3_HUMAN)
NMYTGYFPK

SEQ ID NO: 100245 - protein, 9 aa, Artificial Sequence
  Description of Artificial Sequence: Synthetic peptide
  Seed: LSSIIPSAF (MAGC3_HUMAN)
LMSIIPSAL

SEQ ID NO: 100246 - protein, 10 aa, Artificial Sequence
  Description of Artificial Sequence: Synthetic peptide
  Seed: EKVAELVQFL (MAGC3_HUMAN)
ECVAELVQFL

SEQ ID NO: 100247 - protein, 11 aa, Artificial Sequence
  Description of Artificial Sequence: Synthetic peptide
  Seed: YALDEKVAELV (MAGC3_HUMAN)
YLLDEKVAELH

SEQ ID NO: 100248 - protein, 8 aa, Artificial Sequence
  Description of Artificial Sequence: Synthetic peptide
  Seed: KVDKLVQF (MAGC3_HUMAN)
KADKLVQV

SEQ ID NO: 100249 - protein, 10 aa, Artificial Sequence
  Description of Artificial Sequence: Synthetic peptide
  Seed: TDMDPDNHSY (MAGC3_HUMAN)
TAMDPDNHSL

SEQ ID NO: 100250 - protein, 10 aa, Artificial Sequence
  Description of Artificial Sequence: Synthetic peptide
  Seed: KVAELVQFLL (MAGC3_HUMAN)
KAAELVQFLW

SEQ ID NO: 100251 - protein, 9 aa, Artificial Sequence
  Description of Artificial Sequence: Synthetic peptide
  Seed: FADVLSRLA (MAGC3_HUMAN)
FCDVLSRLI

SEQ ID NO: 100252 - protein, 9 aa, Artificial Sequence
  Description of Artificial Sequence: Synthetic peptide
  Seed: QMNVINTYT (MAGC3_HUMAN)
QINVINTYV

SEQ ID NO: 100253 - protein, 10 aa, Artificial Sequence
  Description of Artificial Sequence: Synthetic peptide
  Seed: FKLWRTLSGS (MAGC3_HUMAN)
FMLWRTLSGA

SEQ ID NO: 100254 - protein, 10 aa, Artificial Sequence
  Description of Artificial Sequence: Synthetic peptide
  Seed: KVDKLVQFLL (MAGC3_HUMAN)
KVDKLVQFLW

SEQ ID NO: 100255 - protein, 9 aa, Artificial Sequence
  Description of Artificial Sequence: Synthetic peptide
  Seed: YFFEDTLDL (MAGC3_HUMAN)
YAFEDTLDW

SEQ ID NO: 100256 - protein, 10 aa, Artificial Sequence
  Description of Artificial Sequence: Synthetic peptide
  Seed: LLKYQAKEPL (MAGC3_HUMAN)
LQKYQAKEPM

SEQ ID NO: 100257 - protein, 10 aa, Artificial Sequence
  Description of Artificial Sequence: Synthetic peptide
  Seed: MQMNVINTYT (MAGC3_HUMAN)
MNMNVINTYM

SEQ ID NO: 100258 - protein, 9 aa, Artificial Sequence
  Description of Artificial Sequence: Synthetic peptide
  Seed: HFYVFVNTL (MAGC3_HUMAN)
HKYVFVNTY

SEQ ID NO: 100259 - protein, 10 aa, Artificial Sequence
  Description of Artificial Sequence: Synthetic peptide
  Seed: RLLILILSVI (MAGC3_HUMAN)
RYLILILSVA

SEQ ID NO: 100260 - protein, 10 aa, Artificial Sequence
  Description of Artificial Sequence: Synthetic peptide
  Seed: VLSAIGPIQR (MAGC3_HUMAN)
VASAIGPIQL

SEQ ID NO: 100261 - protein, 11 aa, Artificial Sequence
  Description of Artificial Sequence: Synthetic peptide
  Seed: ALWESEGPEAF (MAGC3_HUMAN)
ARWESEGPEAL

SEQ ID NO: 100262 - protein, 9 aa, Artificial Sequence
  Description of Artificial Sequence: Synthetic peptide
  Seed: VIWEVLNAI (MAGC3_HUMAN)
VMWEVLNAC

SEQ ID NO: 100263 - protein, 10 aa, Artificial Sequence
  Description of Artificial Sequence: Synthetic peptide
  Seed: YSAFHLGHLR (MAGC3_HUMAN)
YEAFHLGHLK

SEQ ID NO: 100264 - protein, 11 aa, Artificial Sequence
  Description of Artificial Sequence: Synthetic peptide
  Seed: YTGYFPMIFRK (MAGC3_HUMAN)
YLGYFPMIFRR

SEQ ID NO: 100265 - protein, 10 aa, Artificial Sequence
  Description of Artificial Sequence: Synthetic peptide
  Seed: NAIGPWSALA (MAGC3_HUMAN)
NSIGPWSALV

SEQ ID NO: 100266 - protein, 9 aa, Artificial Sequence
  Description of Artificial Sequence: Synthetic peptide
  Seed: ASEEVIWEV (MAGC3_HUMAN)
AFEEVIWEL

SEQ ID NO: 100267 - protein, 10 aa, Artificial Sequence
  Description of Artificial Sequence: Synthetic peptide
  Seed: LSLPAVSPGK (MAGC3_HUMAN)
LILPAVSPGK

SEQ ID NO: 100268 - protein, 9 aa, Artificial Sequence
  Description of Artificial Sequence: Synthetic peptide
  Seed: QPEGKFSLR (MAGC3_HUMAN)
QTEGKFSLR

SEQ ID NO: 100269 - protein, 9 aa, Artificial Sequence
  Description of Artificial Sequence: Synthetic peptide
  Seed: TYFKLWRTL (MAGC3_HUMAN)
TFFKLWRTW

SEQ ID NO: 100270 - protein, 9 aa, Artificial Sequence
  Description of Artificial Sequence: Synthetic peptide
  Seed: VLCPTYFKL (MAGC3_HUMAN)
VICPTYFKL

SEQ ID NO: 100271 - protein, 9 aa, Artificial Sequence
  Description of Artificial Sequence: Synthetic peptide
  Seed: EDMPAAGMP (MAGC3_HUMAN)
EEMPAAGMV

SEQ ID NO: 100272 - protein, 9 aa, Artificial Sequence
  Description of Artificial Sequence: Synthetic peptide
  Seed: NTYTGYFPM (MAGC3_HUMAN)
NIYTGYFPR

SEQ ID NO: 100273 - protein, 10 aa, Artificial Sequence
  Description of Artificial Sequence: Synthetic peptide
  Seed: CSSPLLWTRL (MAGC3_HUMAN)
CASPLLWTRF

SEQ ID NO: 100274 - protein, 9 aa, Artificial Sequence
  Description of Artificial Sequence: Synthetic peptide
  Seed: AIGPWSALA (MAGC3_HUMAN)
ATGPWSALV

SEQ ID NO: 100275 - protein, 11 aa, Artificial Sequence
  Description of Artificial Sequence: Synthetic peptide
  Seed: LHFGSQPEGKF (MAGC3_HUMAN)
LQFGSQPEGKF

SEQ ID NO: 100276 - protein, 9 aa, Artificial Sequence
  Description of Artificial Sequence: Synthetic peptide
  Seed: EVDPDHFYV (MAGC3_HUMAN)
EIDPDHFYL

SEQ ID NO: 100277 - protein, 11 aa, Artificial Sequence
  Description of Artificial Sequence: Synthetic peptide
  Seed: EILFGISLTEV (MAGC3_HUMAN)
EYLFGISLTEA

SEQ ID NO: 100278 - protein, 11 aa, Artificial Sequence
  Description of Artificial Sequence: Synthetic peptide
  Seed: SLPESEPLFTY (MAGC3_HUMAN)
SIPESEPLFTV

SEQ ID NO: 100279 - protein, 10 aa, Artificial Sequence
  Description of Artificial Sequence: Synthetic peptide
  Seed: KKYKDYFPMI (MAGC3_HUMAN)
KYYKDYFPMV

SEQ ID NO: 100280 - protein, 9 aa, Artificial Sequence
  Description of Artificial Sequence: Synthetic peptide
  Seed: LIDDQGMPK (MAGC3_HUMAN)
LTDDQGMPY

SEQ ID NO: 100281 - protein, 9 aa, Artificial Sequence
  Description of Artificial Sequence: Synthetic peptide
  Seed: TLDEKVDKL (MAGC3_HUMAN)
TQDEKVDKV

SEQ ID NO: 100282 - protein, 9 aa, Artificial Sequence
  Description of Artificial Sequence: Synthetic peptide
  Seed: LHFGSQPEG (MAGC3_HUMAN)
LHFGSQPEA

SEQ ID NO: 100283 - protein, 10 aa, Artificial Sequence
  Description of Artificial Sequence: Synthetic peptide
  Seed: MDPDNHSYFF (MAGC3_HUMAN)
MYPDNHSYFY

SEQ ID NO: 100284 - protein, 9 aa, Artificial Sequence
  Description of Artificial Sequence: Synthetic peptide
  Seed: EFIELIFGI (MAGC3_HUMAN)
ELIELIFGA

SEQ ID NO: 100285 - protein, 9 aa, Artificial Sequence
  Description of Artificial Sequence: Synthetic peptide
  Seed: GFADVLSRL (MAGC3_HUMAN)
GLADVLSRI

SEQ ID NO: 100286 - protein, 10 aa, Artificial Sequence
  Description of Artificial Sequence: Synthetic peptide
  Seed: TEVDPDHFYV (MAGC3_HUMAN)
TQVDPDHFYV

SEQ ID NO: 100287 - protein, 9 aa, Artificial Sequence
  Description of Artificial Sequence: Synthetic peptide
  Seed: TEASPQQKK (MAGC3_HUMAN)
TQASPQQKW

SEQ ID NO: 100288 - protein, 9 aa, Artificial Sequence
  Description of Artificial Sequence: Synthetic peptide
  Seed: MIFGKAHEF (MAGC3_HUMAN)
MHFGKAHEF

SEQ ID NO: 100289 - protein, 11 aa, Artificial Sequence
  Description of Artificial Sequence: Synthetic peptide
  Seed: KVAELVQFLLL (MAGC3_HUMAN)
KVAELVQFLLV

SEQ ID NO: 100290 - protein, 11 aa, Artificial Sequence
  Description of Artificial Sequence: Synthetic peptide
  Seed: VVLPPQPQPRK (MAGC3_HUMAN)
VTLPPQPQPRR

SEQ ID NO: 100291 - protein, 9 aa, Artificial Sequence
  Description of Artificial Sequence: Synthetic peptide
  Seed: EVLEFLSKL (MAGC3_HUMAN)
ELLEFLSKW

SEQ ID NO: 100292 - protein, 9 aa, Artificial Sequence
  Description of Artificial Sequence: Synthetic peptide
  Seed: IELIFGIAL (MAGC3_HUMAN)
IMLIFGIAM

SEQ ID NO: 100293 - protein, 9 aa, Artificial Sequence
  Description of Artificial Sequence: Synthetic peptide
  Seed: VINTYTGYF (MAGC3_HUMAN)
VTNTYTGYW

SEQ ID NO: 100294 - protein, 11 aa, Artificial Sequence
  Description of Artificial Sequence: Synthetic peptide
  Seed: KGSCVPEEVIW (MAGC3_HUMAN)
KASCVPEEVIW

SEQ ID NO: 100295 - protein, 9 aa, Artificial Sequence
  Description of Artificial Sequence: Synthetic peptide
  Seed: RTLSGSPGL (MAGC3_HUMAN)
RLLSGSPGL

SEQ ID NO: 100296 - protein, 10 aa, Artificial Sequence
  Description of Artificial Sequence: Synthetic peptide
  Seed: SAFHLGHLRE (MAGC3_HUMAN)
STFHLGHLRA

SEQ ID NO: 100297 - protein, 11 aa, Artificial Sequence
  Description of Artificial Sequence: Synthetic peptide
  Seed: IIDTTDDATAM (MAGC3_HUMAN)
ITDTTDDATAI

SEQ ID NO: 100298 - protein, 9 aa, Artificial Sequence
  Description of Artificial Sequence: Synthetic peptide
  Seed: EVLEFLSKL (MAGC3_HUMAN)
EYLEFLSKK

SEQ ID NO: 100299 - protein, 9 aa, Artificial Sequence
  Description of Artificial Sequence: Synthetic peptide
  Seed: MASASPSVM (MAGC3_HUMAN)
MASASPSVF

SEQ ID NO: 100300 - protein, 10 aa, Artificial Sequence
  Description of Artificial Sequence: Synthetic peptide
  Seed: KYKDYFPMIF (MAGC3_HUMAN)
KYKDYFPMIW

SEQ ID NO: 100301 - protein, 11 aa, Artificial Sequence
  Description of Artificial Sequence: Synthetic peptide
  Seed: NTYTGYFPMIF (MAGC3_HUMAN)
NYYTGYFPMIF

SEQ ID NO: 100302 - protein, 9 aa, Artificial Sequence
  Description of Artificial Sequence: Synthetic peptide
  Seed: AMASASPSV (MAGC3_HUMAN)
ALASASPSY

SEQ ID NO: 100303 - protein, 10 aa, Artificial Sequence
  Description of Artificial Sequence: Synthetic peptide
  Seed: MNVINTYTGY (MAGC3_HUMAN)
MSVINTYTGF

SEQ ID NO: 100304 - protein, 11 aa, Artificial Sequence
  Description of Artificial Sequence: Synthetic peptide
  Seed: KGSCVPEEVIW (MAGC3_HUMAN)
KSSCVPEEVIF

SEQ ID NO: 100305 - protein, 11 aa, Artificial Sequence
  Description of Artificial Sequence: Synthetic peptide
  Seed: ILFGISLTEVD (MAGC3_HUMAN)
IMFGISLTEVA

SEQ ID NO: 100306 - protein, 11 aa, Artificial Sequence
  Description of Artificial Sequence: Synthetic peptide
  Seed: INTYTGYFPMI (MAGC3_HUMAN)
ISTYTGYFPMF

SEQ ID NO: 100307 - protein, 10 aa, Artificial Sequence
  Description of Artificial Sequence: Synthetic peptide
  Seed: MNVINTYTGY (MAGC3_HUMAN)
MYVINTYTGK

SEQ ID NO: 100308 - protein, 11 aa, Artificial Sequence
  Description of Artificial Sequence: Synthetic peptide
  Seed: KVAELVQFLLL (MAGC3_HUMAN)
KSAELVQFLLF

SEQ ID NO: 100309 - protein, 11 aa, Artificial Sequence
  Description of Artificial Sequence: Synthetic peptide
  Seed: AEMQMNVINTY (MAGC3_HUMAN)
ANMQMNVINTY

SEQ ID NO: 100310 - protein, 9 aa, Artificial Sequence
  Description of Artificial Sequence: Synthetic peptide
  Seed: FSLRRAVSV (MAGC3_HUMAN)
FALRRAVSF

SEQ ID NO: 100311 - protein, 9 aa, Artificial Sequence
  Description of Artificial Sequence: Synthetic peptide
  Seed: FGSQPEGKF (MAGC3_HUMAN)
FLSQPEGKY

SEQ ID NO: 100312 - protein, 9 aa, Artificial Sequence
  Description of Artificial Sequence: Synthetic peptide
  Seed: MASASPSVM (MAGC3_HUMAN)
MRSASPSVY

SEQ ID NO: 100313 - protein, 10 aa, Artificial Sequence
  Description of Artificial Sequence: Synthetic peptide
  Seed: MQMNVINTYT (MAGC3_HUMAN)
MKMNVINTYD

SEQ ID NO: 100314 - protein, 11 aa, Artificial Sequence
  Description of Artificial Sequence: Synthetic peptide
  Seed: AEMQMNVINTY (MAGC3_HUMAN)
AEMQMNVINTC

SEQ ID NO: 100315 - protein, 9 aa, Artificial Sequence
  Description of Artificial Sequence: Synthetic peptide
  Seed: GFADVLSRL (MAGC3_HUMAN)
GTADVLSRL

SEQ ID NO: 100316 - protein, 10 aa, Artificial Sequence
  Description of Artificial Sequence: Synthetic peptide
  Seed: EMQMNVINTY (MAGC3_HUMAN)
ESQMNVINTF

SEQ ID NO: 100317 - protein, 9 aa, Artificial Sequence
  Description of Artificial Sequence: Synthetic peptide
  Seed: GYFPMIFRK (MAGC3_HUMAN)
GNFPMIFRR

SEQ ID NO: 100318 - protein, 9 aa, Artificial Sequence
  Description of Artificial Sequence: Synthetic peptide
  Seed: QDWPLNEKR (MAGC3_HUMAN)
QIWPLNEKR

SEQ ID NO: 100319 - protein, 10 aa, Artificial Sequence
  Description of Artificial Sequence: Synthetic peptide
  Seed: TAMASASPSV (MAGC3_HUMAN)
TSMASASPSI

SEQ ID NO: 100320 - protein, 9 aa, Artificial Sequence
  Description of Artificial Sequence: Synthetic peptide
  Seed: FHLGHLREV (MAGC3_HUMAN)
FTLGHLREL

SEQ ID NO: 100321 - protein, 9 aa, Artificial Sequence
  Description of Artificial Sequence: Synthetic peptide
  Seed: TGYFPMIFR (MAGC3_HUMAN)
TVYFPMIFY

SEQ ID NO: 100322 - protein, 9 aa, Artificial Sequence
  Description of Artificial Sequence: Synthetic peptide
  Seed: SQPEGKFSL (MAGC3_HUMAN)
SWPEGKFSM

SEQ ID NO: 100323 - protein, 9 aa, Artificial Sequence
  Description of Artificial Sequence: Synthetic peptide
  Seed: KVAELVQFL (MAGC3_HUMAN)
KQAELVQFY

SEQ ID NO: 100324 - protein, 9 aa, Artificial Sequence
  Description of Artificial Sequence: Synthetic peptide
  Seed: IIPSAFPSW (MAGC3_HUMAN)
ISPSAFPSV

SEQ ID NO: 100325 - protein, 10 aa, Artificial Sequence
  Description of Artificial Sequence: Synthetic peptide
  Seed: MNVINTYTGY (MAGC3_HUMAN)
MEVINTYTGK

SEQ ID NO: 100326 - protein, 9 aa, Artificial Sequence
  Description of Artificial Sequence: Synthetic peptide
  Seed: VDPDHFYVF (MAGC3_HUMAN)
VLPDHFYVF

SEQ ID NO: 100327 - protein, 9 aa, Artificial Sequence
  Description of Artificial Sequence: Synthetic peptide
  Seed: FSLRRAVSV (MAGC3_HUMAN)
FQLRRAVSY

SEQ ID NO: 100328 - protein, 9 aa, Artificial Sequence
  Description of Artificial Sequence: Synthetic peptide
  Seed: EVIWEVLNA (MAGC3_HUMAN)
EVIWEVLNV

SEQ ID NO: 100329 - protein, 9 aa, Artificial Sequence
  Description of Artificial Sequence: Synthetic peptide
  Seed: LILSMIFIK (MAGC3_HUMAN)
LILSMIFIR

SEQ ID NO: 100330 - protein, 9 aa, Artificial Sequence
  Description of Artificial Sequence: Synthetic peptide
  Seed: KFSLRRAVS (MAGC3_HUMAN)
KLSLRRAVK

SEQ ID NO: 100331 - protein, 9 aa, Artificial Sequence
  Description of Artificial Sequence: Synthetic peptide
  Seed: NTYTGYFPM (MAGC3_HUMAN)
NLYTGYFPW

SEQ ID NO: 100332 - protein, 9 aa, Artificial Sequence
  Description of Artificial Sequence: Synthetic peptide
  Seed: FGSQPEGKF (MAGC3_HUMAN)
FMSQPEGKY

SEQ ID NO: 100333 - protein, 10 aa, Artificial Sequence
  Description of Artificial Sequence: Synthetic peptide
  Seed: AMASASPSVM (MAGC3_HUMAN)
AQASASPSVL

SEQ ID NO: 100334 - protein, 9 aa, Artificial Sequence
  Description of Artificial Sequence: Synthetic peptide
  Seed: MPAAGMPPL (MAGC3_HUMAN)
MEAAGMPPY

SEQ ID NO: 100335 - protein, 10 aa, Artificial Sequence
  Description of Artificial Sequence: Synthetic peptide
  Seed: FKLWRTLSGS (MAGC3_HUMAN)
FDLWRTLSGV

SEQ ID NO: 100336 - protein, 10 aa, Artificial Sequence
  Description of Artificial Sequence: Synthetic peptide
  Seed: KAEMLTTVIK (MAGC3_HUMAN)
KVEMLTTVIR

SEQ ID NO: 100337 - protein, 10 aa, Artificial Sequence
  Description of Artificial Sequence: Synthetic peptide
  Seed: MLLPCHWVLD (MAGC3_HUMAN)
MALPCHWVLV

SEQ ID NO: 100338 - protein, 9 aa, Artificial Sequence
  Description of Artificial Sequence: Synthetic peptide
  Seed: RGTGYTLSL (MAGC3_HUMAN)
RRTGYTLSM

SEQ ID NO: 100339 - protein, 10 aa, Artificial Sequence
  Description of Artificial Sequence: Synthetic peptide
  Seed: AMASASPSVM (MAGC3_HUMAN)
AQASASPSVW

SEQ ID NO: 100340 - protein, 8 aa, Artificial Sequence
  Description of Artificial Sequence: Synthetic peptide
  Seed: IFGKAHEF (MAGC3_HUMAN)
IAGKAHEF

SEQ ID NO: 100341 - protein, 9 aa, Artificial Sequence
  Description of Artificial Sequence: Synthetic peptide
  Seed: ATDKDYSAF (MAGC3_HUMAN)
ANDKDYSAL

SEQ ID NO: 100342 - protein, 11 aa, Artificial Sequence
  Description of Artificial Sequence: Synthetic peptide
  Seed: DSCSSPLLWTR (MAGC3_HUMAN)
DICSSPLLWTK

SEQ ID NO: 100343 - protein, 9 aa, Artificial Sequence
  Description of Artificial Sequence: Synthetic peptide
  Seed: LSSIIPSAF (MAGC3_HUMAN)
LHSIIPSAF

SEQ ID NO: 100344 - protein, 9 aa, Artificial Sequence
  Description of Artificial Sequence: Synthetic peptide
  Seed: ATDKDYSAF (MAGC3_HUMAN)
AIDKDYSAI

SEQ ID NO: 100345 - protein, 10 aa, Artificial Sequence
  Description of Artificial Sequence: Synthetic peptide
  Seed: KKYKDYFPMI (MAGC3_HUMAN)
KIYKDYFPMK

SEQ ID NO: 100346 - protein, 9 aa, Artificial Sequence
  Description of Artificial Sequence: Synthetic peptide
  Seed: NTYTGYFPM (MAGC3_HUMAN)
NTYTGYFPF

SEQ ID NO: 100347 - protein, 9 aa, Artificial Sequence
  Description of Artificial Sequence: Synthetic peptide
  Seed: HFYVFVNTL (MAGC3_HUMAN)
HKYVFVNTL

SEQ ID NO: 100348 - protein, 10 aa, Artificial Sequence
  Description of Artificial Sequence: Synthetic peptide
  Seed: FKLWRTLSGS (MAGC3_HUMAN)
FCLWRTLSGA

SEQ ID NO: 100349 - protein, 9 aa, Artificial Sequence
  Description of Artificial Sequence: Synthetic peptide
  Seed: SLVLCPTYF (MAGC3_HUMAN)
SMVLCPTYW

SEQ ID NO: 100350 - protein, 10 aa, Artificial Sequence
  Description of Artificial Sequence: Synthetic peptide
  Seed: KKYKDYFPMI (MAGC3_HUMAN)
KYYKDYFPMW

SEQ ID NO: 100351 - protein, 9 aa, Artificial Sequence
  Description of Artificial Sequence: Synthetic peptide
  Seed: MQMNVINTY (MAGC3_HUMAN)
MLMNVINTV

SEQ ID NO: 100352 - protein, 8 aa, Artificial Sequence
  Description of Artificial Sequence: Synthetic peptide
  Seed: SSIIPSAF (MAGC3_HUMAN)
SKIIPSAF

SEQ ID NO: 100353 - protein, 9 aa, Artificial Sequence
  Description of Artificial Sequence: Synthetic peptide
  Seed: MIFGKAHEF (MAGC3_HUMAN)
MSFGKAHEY

SEQ ID NO: 100354 - protein, 10 aa, Artificial Sequence
  Description of Artificial Sequence: Synthetic peptide
  Seed: SAIGPIQRPA (MAGC3_HUMAN)
SPIGPIQRPV

SEQ ID NO: 100355 - protein, 9 aa, Artificial Sequence
  Description of Artificial Sequence: Synthetic peptide
  Seed: GYFPMIFRK (MAGC3_HUMAN)
GMFPMIFRL

SEQ ID NO: 100356 - protein, 10 aa, Artificial Sequence
  Description of Artificial Sequence: Synthetic peptide
  Seed: KVAELVQFLL (MAGC3_HUMAN)
KAAELVQFLM

SEQ ID NO: 100357 - protein, 9 aa, Artificial Sequence
  Description of Artificial Sequence: Synthetic peptide
  Seed: YALSPVVLP (MAGC3_HUMAN)
YTLSPVVLL

SEQ ID NO: 100358 - protein, 9 aa, Artificial Sequence
  Description of Artificial Sequence: Synthetic peptide
  Seed: KAHEFIELI (MAGC3_HUMAN)
KSHEFIELK

SEQ ID NO: 100359 - protein, 10 aa, Artificial Sequence
  Description of Artificial Sequence: Synthetic peptide
  Seed: SIIPSAFPSW (MAGC3_HUMAN)
SWIPSAFPSW

SEQ ID NO: 100360 - protein, 9 aa, Artificial Sequence
  Description of Artificial Sequence: Synthetic peptide
  Seed: QTKEPVTKA (MAGC3_HUMAN)
QAKEPVTKV

SEQ ID NO: 100361 - protein, 9 aa, Artificial Sequence
  Description of Artificial Sequence: Synthetic peptide
  Seed: IQRPAREVL (MAGC3_HUMAN)
ISRPAREVY

SEQ ID NO: 100362 - protein, 10 aa, Artificial Sequence
  Description of Artificial Sequence: Synthetic peptide
  Seed: TYTGYFPMIF (MAGC3_HUMAN)
TTTGYFPMIF

SEQ ID NO: 100363 - protein, 9 aa, Artificial Sequence
  Description of Artificial Sequence: Synthetic peptide
  Seed: NAIGPWSAL (MAGC3_HUMAN)
NYIGPWSAL

SEQ ID NO: 100364 - protein, 10 aa, Artificial Sequence
  Description of Artificial Sequence: Synthetic peptide
  Seed: TFSDGSLGQW (MAGC3_HUMAN)
TYSDGSLGQY

SEQ ID NO: 100365 - protein, 9 aa, Artificial Sequence
  Description of Artificial Sequence: Synthetic peptide
  Seed: LANPQGLAG (MAGC3_HUMAN)
LVNPQGLAI

SEQ ID NO: 100366 - protein, 11 aa, Artificial Sequence
  Description of Artificial Sequence: Synthetic peptide
  Seed: SSSEEEDTATW (MAGC3_HUMAN)
SQSEEEDTATY

SEQ ID NO: 100367 - protein, 11 aa, Artificial Sequence
  Description of Artificial Sequence: Synthetic peptide
  Seed: FADVLSRLALW (MAGC3_HUMAN)
FPDVLSRLALW

SEQ ID NO: 100368 - protein, 9 aa, Artificial Sequence
  Description of Artificial Sequence: Synthetic peptide
  Seed: TGYFPMIFR (MAGC3_HUMAN)
TCYFPMIFR

SEQ ID NO: 100369 - protein, 11 aa, Artificial Sequence
  Description of Artificial Sequence: Synthetic peptide
  Seed: ATFSDGSLGQW (MAGC3_HUMAN)
AWFSDGSLGQY

SEQ ID NO: 100370 - protein, 9 aa, Artificial Sequence
  Description of Artificial Sequence: Synthetic peptide
  Seed: MQMNVINTY (MAGC3_HUMAN)
MVMNVINTL

SEQ ID NO: 100371 - protein, 9 aa, Artificial Sequence
  Description of Artificial Sequence: Synthetic peptide
  Seed: MEDRAQAII (MAGC3_HUMAN)
MIDRAQAII

SEQ ID NO: 100372 - protein, 9 aa, Artificial Sequence
  Description of Artificial Sequence: Synthetic peptide
  Seed: VDPDHFYVF (MAGC3_HUMAN)
VVPDHFYVV

SEQ ID NO: 100373 - protein, 10 aa, Artificial Sequence
  Description of Artificial Sequence: Synthetic peptide
  Seed: ADVLSRLALW (MAGC3_HUMAN)
ATVLSRLALY

SEQ ID NO: 100374 - protein, 9 aa, Artificial Sequence
  Description of Artificial Sequence: Synthetic peptide
  Seed: MIFRKAREF (MAGC3_HUMAN)
MFFRKAREL

SEQ ID NO: 100375 - protein, 10 aa, Artificial Sequence
  Description of Artificial Sequence: Synthetic peptide
  Seed: IELIFGIALT (MAGC3_HUMAN)
IYLIFGIALA

SEQ ID NO: 100376 - protein, 10 aa, Artificial Sequence
  Description of Artificial Sequence: Synthetic peptide
  Seed: SKLSSIIPSA (MAGC3_HUMAN)
SQLSSIIPSV

SEQ ID NO: 100377 - protein, 9 aa, Artificial Sequence
  Description of Artificial Sequence: Synthetic peptide
  Seed: ALDEKVAEL (MAGC3_HUMAN)
ADDEKVAEL

SEQ ID NO: 100378 - protein, 10 aa, Artificial Sequence
  Description of Artificial Sequence: Synthetic peptide
  Seed: TLDEKVDKLV (MAGC3_HUMAN)
TADEKVDKLI

SEQ ID NO: 100379 - protein, 9 aa, Artificial Sequence
  Description of Artificial Sequence: Synthetic peptide
  Seed: VIWEVLNAI (MAGC3_HUMAN)
VTWEVLNAF

SEQ ID NO: 100380 - protein, 10 aa, Artificial Sequence
  Description of Artificial Sequence: Synthetic peptide
  Seed: SKLSSIIPSA (MAGC3_HUMAN)
SGLSSIIPSL

SEQ ID NO: 100381 - protein, 9 aa, Artificial Sequence
  Description of Artificial Sequence: Synthetic peptide
  Seed: QTKEPVTKA (MAGC3_HUMAN)
QQKEPVTKF

SEQ ID NO: 100382 - protein, 9 aa, Artificial Sequence
  Description of Artificial Sequence: Synthetic peptide
  Seed: MLTTVIKKY (MAGC3_HUMAN)
MITTVIKKF

SEQ ID NO: 100383 - protein, 9 aa, Artificial Sequence
  Description of Artificial Sequence: Synthetic peptide
  Seed: FPSWYMDAL (MAGC3_HUMAN)
FMSWYMDAY

SEQ ID NO: 100384 - protein, 10 aa, Artificial Sequence
  Description of Artificial Sequence: Synthetic peptide
  Seed: TDMDPDNHSY (MAGC3_HUMAN)
THMDPDNHSF

SEQ ID NO: 100385 - protein, 9 aa, Artificial Sequence
  Description of Artificial Sequence: Synthetic peptide
  Seed: KAHEFIELI (MAGC3_HUMAN)
KFHEFIELL

SEQ ID NO: 100386 - protein, 9 aa, Artificial Sequence
  Description of Artificial Sequence: Synthetic peptide
  Seed: DMDPDNHSY (MAGC3_HUMAN)
DYDPDNHSM

SEQ ID NO: 100387 - protein, 10 aa, Artificial Sequence
  Description of Artificial Sequence: Synthetic peptide
  Seed: YTLDEKVDKL (MAGC3_HUMAN)
YTLDEKVDKW

SEQ ID NO: 100388 - protein, 9 aa, Artificial Sequence
  Description of Artificial Sequence: Synthetic peptide
  Seed: FADVLSRLA (MAGC3_HUMAN)
FCDVLSRLM

SEQ ID NO: 100389 - protein, 9 aa, Artificial Sequence
  Description of Artificial Sequence: Synthetic peptide
  Seed: IIPSAFPSW (MAGC3_HUMAN)
ITPSAFPSF

SEQ ID NO: 100390 - protein, 10 aa, Artificial Sequence
  Description of Artificial Sequence: Synthetic peptide
  Seed: FKLWRTLSGS (MAGC3_HUMAN)
FILWRTLSGI

SEQ ID NO: 100391 - protein, 9 aa, Artificial Sequence
  Description of Artificial Sequence: Synthetic peptide
  Seed: KLVQFLLLK (MAGC3_HUMAN)
KVVQFLLLV

SEQ ID NO: 100392 - protein, 10 aa, Artificial Sequence
  Description of Artificial Sequence: Synthetic peptide
  Seed: EVIWEVLNAI (MAGC3_HUMAN)
EAIWEVLNAI

SEQ ID NO: 100393 - protein, 9 aa, Artificial Sequence
  Description of Artificial Sequence: Synthetic peptide
  Seed: ELIFGIALT (MAGC3_HUMAN)
EVIFGIALT

SEQ ID NO: 100394 - protein, 10 aa, Artificial Sequence
  Description of Artificial Sequence: Synthetic peptide
  Seed: MIFRKAREFI (MAGC3_HUMAN)
MLFRKAREFI

SEQ ID NO: 100395 - protein, 9 aa, Artificial Sequence
  Description of Artificial Sequence: Synthetic peptide
  Seed: LANPQGLAG (MAGC3_HUMAN)
LANPQGLAH

SEQ ID NO: 100396 - protein, 9 aa, Artificial Sequence
  Description of Artificial Sequence: Synthetic peptide
  Seed: KVAELVQFL (MAGC3_HUMAN)
KLAELVQFF

SEQ ID NO: 100397 - protein, 9 aa, Artificial Sequence
  Description of Artificial Sequence: Synthetic peptide
  Seed: ELIFGIALT (MAGC3_HUMAN)
EMIFGIALV

SEQ ID NO: 100398 - protein, 10 aa, Artificial Sequence
  Description of Artificial Sequence: Synthetic peptide
  Seed: SKLSSIIPSA (MAGC3_HUMAN)
SCLSSIIPSL

SEQ ID NO: 100399 - protein, 9 aa, Artificial Sequence
  Description of Artificial Sequence: Synthetic peptide
  Seed: VIWEVLNAI (MAGC3_HUMAN)
VIWEVLNAV

SEQ ID NO: 100400 - protein, 8 aa, Artificial Sequence
  Description of Artificial Sequence: Synthetic peptide
  Seed: KVDKLVQF (MAGC3_HUMAN)
KGDKLVQL

SEQ ID NO: 100401 - protein, 9 aa, Artificial Sequence
  Description of Artificial Sequence: Synthetic peptide
  Seed: YTGYFPMIF (MAGC3_HUMAN)
YSGYFPMIM

SEQ ID NO: 100402 - protein, 10 aa, Artificial Sequence
  Description of Artificial Sequence: Synthetic peptide
  Seed: EMQMNVINTY (MAGC3_HUMAN)
ETQMNVINTM

SEQ ID NO: 100403 - protein, 9 aa, Artificial Sequence
  Description of Artificial Sequence: Synthetic peptide
  Seed: YALDEKVAE (MAGC3_HUMAN)
YALDEKVAY

SEQ ID NO: 100404 - protein, 9 aa, Artificial Sequence
  Description of Artificial Sequence: Synthetic peptide
  Seed: TAMASASPS (MAGC3_HUMAN)
TSMASASPY

SEQ ID NO: 100405 - protein, 10 aa, Artificial Sequence
  Description of Artificial Sequence: Synthetic peptide
  Seed: ALDEKVAELV (MAGC3_HUMAN)
AFDEKVAELL

SEQ ID NO: 100406 - protein, 10 aa, Artificial Sequence
  Description of Artificial Sequence: Synthetic peptide
  Seed: SLIDDQGMPK (MAGC3_HUMAN)
SAIDDQGMPM

SEQ ID NO: 100407 - protein, 9 aa, Artificial Sequence
  Description of Artificial Sequence: Synthetic peptide
  Seed: NAIGPWSAL (MAGC3_HUMAN)
NTIGPWSAK

SEQ ID NO: 100408 - protein, 10 aa, Artificial Sequence
  Description of Artificial Sequence: Synthetic peptide
  Seed: ALDEKVAELV (MAGC3_HUMAN)
AADEKVAELM

SEQ ID NO: 100409 - protein, 9 aa, Artificial Sequence
  Description of Artificial Sequence: Synthetic peptide
  Seed: KKYKDYFPM (MAGC3_HUMAN)
KRYKDYFPM

SEQ ID NO: 100410 - protein, 9 aa, Artificial Sequence
  Description of Artificial Sequence: Synthetic peptide
  Seed: LILSMIFIK (MAGC3_HUMAN)
LVLSMIFIK

SEQ ID NO: 100411 - protein, 10 aa, Artificial Sequence
  Description of Artificial Sequence: Synthetic peptide
  Seed: REVRLFLRGG (MAGC3_HUMAN)
RYVRLFLRGV

SEQ ID NO: 100412 - protein, 10 aa, Artificial Sequence
  Description of Artificial Sequence: Synthetic peptide
  Seed: MQMNVINTYT (MAGC3_HUMAN)
MLMNVINTYT

SEQ ID NO: 100413 - protein, 10 aa, Artificial Sequence
  Description of Artificial Sequence: Synthetic peptide
  Seed: EVIWEVLNAI (MAGC3_HUMAN)
ENIWEVLNAV

SEQ ID NO: 100414 - protein, 11 aa, Artificial Sequence
  Description of Artificial Sequence: Synthetic peptide
  Seed: FIELIFGIALT (MAGC3_HUMAN)
FIELIFGIALI

SEQ ID NO: 100415 - protein, 10 aa, Artificial Sequence
  Description of Artificial Sequence: Synthetic peptide
  Seed: LNAIGPWSAL (MAGC3_HUMAN)
LMAIGPWSAM

SEQ ID NO: 100416 - protein, 9 aa, Artificial Sequence
  Description of Artificial Sequence: Synthetic peptide
  Seed: YFFEDTLDL (MAGC3_HUMAN)
YWFEDTLDF

SEQ ID NO: 100417 - protein, 9 aa, Artificial Sequence
  Description of Artificial Sequence: Synthetic peptide
  Seed: ALDEKVAEL (MAGC3_HUMAN)
AYDEKVAEI

SEQ ID NO: 100418 - protein, 9 aa, Artificial Sequence
  Description of Artificial Sequence: Synthetic peptide
  Seed: MLLPCHWVL (MAGC3_HUMAN)
MSLPCHWVF

SEQ ID NO: 100419 - protein, 10 aa, Artificial Sequence
  Description of Artificial Sequence: Synthetic peptide
  Seed: KDYFPMIFGK (MAGC3_HUMAN)
KIYFPMIFGR

SEQ ID NO: 100420 - protein, 10 aa, Artificial Sequence
  Description of Artificial Sequence: Synthetic peptide
  Seed: REVLEFLSKL (MAGC3_HUMAN)
RYVLEFLSKV

SEQ ID NO: 100421 - protein, 10 aa, Artificial Sequence
  Description of Artificial Sequence: Synthetic peptide
  Seed: FKLWRTLSGS (MAGC3_HUMAN)
FHLWRTLSGL

SEQ ID NO: 100422 - protein, 10 aa, Artificial Sequence
  Description of Artificial Sequence: Synthetic peptide
  Seed: NTYTGYFPMI (MAGC3_HUMAN)
NAYTGYFPMV

SEQ ID NO: 100423 - protein, 9 aa, Artificial Sequence
  Description of Artificial Sequence: Synthetic peptide
  Seed: KAHEFIELI (MAGC3_HUMAN)
KYHEFIELK

SEQ ID NO: 100424 - protein, 9 aa, Artificial Sequence
  Description of Artificial Sequence: Synthetic peptide
  Seed: HSYFFEDTL (MAGC3_HUMAN)
HVYFFEDTV

SEQ ID NO: 100425 - protein, 9 aa, Artificial Sequence
  Description of Artificial Sequence: Synthetic peptide
  Seed: MASASPSVM (MAGC3_HUMAN)
MPSASPSVV

SEQ ID NO: 100426 - protein, 9 aa, Artificial Sequence
  Description of Artificial Sequence: Synthetic peptide
  Seed: SPSVMSTNF (MAGC3_HUMAN)
SHSVMSTNY

SEQ ID NO: 100427 - protein, 11 aa, Artificial Sequence
  Description of Artificial Sequence: Synthetic peptide
  Seed: TTDDATAMASA (MAGC3_HUMAN)
TADDATAMASM

SEQ ID NO: 100428 - protein, 9 aa, Artificial Sequence
  Description of Artificial Sequence: Synthetic peptide
  Seed: AELVQFLLL (MAGC3_HUMAN)
AELVQFLLI

SEQ ID NO: 100429 - protein, 9 aa, Artificial Sequence
  Description of Artificial Sequence: Synthetic peptide
  Seed: IQRPAREVL (MAGC3_HUMAN)
IIRPAREVY

SEQ ID NO: 100430 - protein, 10 aa, Artificial Sequence
  Description of Artificial Sequence: Synthetic peptide
  Seed: KDSDLPTWRR (MAGC3_HUMAN)
KFSDLPTWRR

SEQ ID NO: 100431 - protein, 10 aa, Artificial Sequence
  Description of Artificial Sequence: Synthetic peptide
  Seed: KKYKDYFPMI (MAGC3_HUMAN)
KPYKDYFPMF

SEQ ID NO: 100432 - protein, 10 aa, Artificial Sequence
  Description of Artificial Sequence: Synthetic peptide
  Seed: MIFRKAREFI (MAGC3_HUMAN)
MMFRKAREFV

SEQ ID NO: 100433 - protein, 10 aa, Artificial Sequence
  Description of Artificial Sequence: Synthetic peptide
  Seed: TLSGSPGLQL (MAGC3_HUMAN)
TLSGSPGLQF

SEQ ID NO: 100434 - protein, 9 aa, Artificial Sequence
  Description of Artificial Sequence: Synthetic peptide
  Seed: VLCPTYFKL (MAGC3_HUMAN)
VYCPTYFKF

SEQ ID NO: 100435 - protein, 10 aa, Artificial Sequence
  Description of Artificial Sequence: Synthetic peptide
  Seed: MDPDNHSYFF (MAGC3_HUMAN)
MNPDNHSYFF

SEQ ID NO: 100436 - protein, 10 aa, Artificial Sequence
  Description of Artificial Sequence: Synthetic peptide
  Seed: RPAREVLEFL (MAGC3_HUMAN)
RVAREVLEFK

SEQ ID NO: 100437 - protein, 10 aa, Artificial Sequence
  Description of Artificial Sequence: Synthetic peptide
  Seed: MDPDNHSYFF (MAGC3_HUMAN)
MFPDNHSYFF

SEQ ID NO: 100438 - protein, 10 aa, Artificial Sequence
  Description of Artificial Sequence: Synthetic peptide
  Seed: RPAREVLEFL (MAGC3_HUMAN)
RFAREVLEFK

SEQ ID NO: 100439 - protein, 10 aa, Artificial Sequence
  Description of Artificial Sequence: Synthetic peptide
  Seed: EKVAELVQFL (MAGC3_HUMAN)
EPVAELVQFY

SEQ ID NO: 100440 - protein, 9 aa, Artificial Sequence
  Description of Artificial Sequence: Synthetic peptide
  Seed: RPAREVLEF (MAGC3_HUMAN)
RLAREVLEY

SEQ ID NO: 100441 - protein, 10 aa, Artificial Sequence
  Description of Artificial Sequence: Synthetic peptide
  Seed: KAHEFIELIF (MAGC3_HUMAN)
KGHEFIELIW

SEQ ID NO: 100442 - protein, 9 aa, Artificial Sequence
  Description of Artificial Sequence: Synthetic peptide
  Seed: YTLDEKVDK (MAGC3_HUMAN)
YSLDEKVDL

SEQ ID NO: 100443 - protein, 10 aa, Artificial Sequence
  Description of Artificial Sequence: Synthetic peptide
  Seed: SPLDSCSSPL (MAGC3_HUMAN)
SNLDSCSSPV

SEQ ID NO: 100444 - protein, 10 aa, Artificial Sequence
  Description of Artificial Sequence: Synthetic peptide
  Seed: FGKAHEFIEL (MAGC3_HUMAN)
FMKAHEFIEL

SEQ ID NO: 100445 - protein, 9 aa, Artificial Sequence
  Description of Artificial Sequence: Synthetic peptide
  Seed: MPAAGMPPL (MAGC3_HUMAN)
MPAAGMPPW

SEQ ID NO: 100446 - protein, 9 aa, Artificial Sequence
  Description of Artificial Sequence: Synthetic peptide
  Seed: HSYFFEDTL (MAGC3_HUMAN)
HMYFFEDTI

SEQ ID NO: 100447 - protein, 11 aa, Artificial Sequence
  Description of Artificial Sequence: Synthetic peptide
  Seed: YALDEKVAELV (MAGC3_HUMAN)
YMLDEKVAELH

SEQ ID NO: 100448 - protein, 9 aa, Artificial Sequence
  Description of Artificial Sequence: Synthetic peptide
  Seed: MPAAGMPPL (MAGC3_HUMAN)
MFAAGMPPM

SEQ ID NO: 100449 - protein, 10 aa, Artificial Sequence
  Description of Artificial Sequence: Synthetic peptide
  Seed: VLDLANPQGL (MAGC3_HUMAN)
VLDLANPQGV

SEQ ID NO: 100450 - protein, 9 aa, Artificial Sequence
  Description of Artificial Sequence: Synthetic peptide
  Seed: TSDQRMDSL (MAGC3_HUMAN)
TFDQRMDSF

SEQ ID NO: 100451 - protein, 9 aa, Artificial Sequence
  Description of Artificial Sequence: Synthetic peptide
  Seed: MLLPCHWVL (MAGC3_HUMAN)
MILPCHWVY

SEQ ID NO: 100452 - protein, 9 aa, Artificial Sequence
  Description of Artificial Sequence: Synthetic peptide
  Seed: KYKDYFPMI (MAGC3_HUMAN)
KMKDYFPMK

SEQ ID NO: 100453 - protein, 10 aa, Artificial Sequence
  Description of Artificial Sequence: Synthetic peptide
  Seed: SWYMDALKDM (MAGC3_HUMAN)
SQYMDALKDF

SEQ ID NO: 100454 - protein, 11 aa, Artificial Sequence
  Description of Artificial Sequence: Synthetic peptide
  Seed: ATFSDGSLGQW (MAGC3_HUMAN)
AAFSDGSLGQY

SEQ ID NO: 100455 - protein, 9 aa, Artificial Sequence
  Description of Artificial Sequence: Synthetic peptide
  Seed: RPAREVLEF (MAGC3_HUMAN)
RRAREVLEV

SEQ ID NO: 100456 - protein, 9 aa, Artificial Sequence
  Description of Artificial Sequence: Synthetic peptide
  Seed: VLCPTYFKL (MAGC3_HUMAN)
VACPTYFKY

SEQ ID NO: 100457 - protein, 10 aa, Artificial Sequence
  Description of Artificial Sequence: Synthetic peptide
  Seed: EVIWEVLSAI (MAGC3_HUMAN)
EAIWEVLSAV

SEQ ID NO: 100458 - protein, 9 aa, Artificial Sequence
  Description of Artificial Sequence: Synthetic peptide
  Seed: KLWRTLSGS (MAGC3_HUMAN)
KIWRTLSGV

SEQ ID NO: 100459 - protein, 9 aa, Artificial Sequence
  Description of Artificial Sequence: Synthetic peptide
  Seed: IQRPAREVL (MAGC3_HUMAN)
IPRPAREVI

SEQ ID NO: 100460 - protein, 8 aa, Artificial Sequence
  Description of Artificial Sequence: Synthetic peptide
  Seed: IFGKAHEF (MAGC3_HUMAN)
IAGKAHEY

SEQ ID NO: 100461 - protein, 9 aa, Artificial Sequence
  Description of Artificial Sequence: Synthetic peptide
  Seed: MLLPCHWVL (MAGC3_HUMAN)
MVLPCHWVY

SEQ ID NO: 100462 - protein, 10 aa, Artificial Sequence
  Description of Artificial Sequence: Synthetic peptide
  Seed: TAMASASPSV (MAGC3_HUMAN)
TLMASASPSV

SEQ ID NO: 100463 - protein, 9 aa, Artificial Sequence
  Description of Artificial Sequence: Synthetic peptide
  Seed: EVLEFLSKL (MAGC3_HUMAN)
EALEFLSKA

SEQ ID NO: 100464 - protein, 9 aa, Artificial Sequence
  Description of Artificial Sequence: Synthetic peptide
  Seed: FSLRRAVSV (MAGC3_HUMAN)
FPLRRAVSI

SEQ ID NO: 100465 - protein, 10 aa, Artificial Sequence
  Description of Artificial Sequence: Synthetic peptide
  Seed: INTYTGYFPM (MAGC3_HUMAN)
IFTYTGYFPF

SEQ ID NO: 100466 - protein, 10 aa, Artificial Sequence
  Description of Artificial Sequence: Synthetic peptide
  Seed: KVAELVQFLL (MAGC3_HUMAN)
KSAELVQFLI

SEQ ID NO: 100467 - protein, 10 aa, Artificial Sequence
  Description of Artificial Sequence: Synthetic peptide
  Seed: NVINTYTGYF (MAGC3_HUMAN)
NMINTYTGYY

SEQ ID NO: 100468 - protein, 10 aa, Artificial Sequence
  Description of Artificial Sequence: Synthetic peptide
  Seed: ALDEKVAELV (MAGC3_HUMAN)
ALDEKVAELW

SEQ ID NO: 100469 - protein, 9 aa, Artificial Sequence
  Description of Artificial Sequence: Synthetic peptide
  Seed: SLPAVSPGK (MAGC3_HUMAN)
SSPAVSPGK

SEQ ID NO: 100470 - protein, 9 aa, Artificial Sequence
  Description of Artificial Sequence: Synthetic peptide
  Seed: LIDDQGMPK (MAGC3_HUMAN)
LLDDQGMPF

SEQ ID NO: 100471 - protein, 9 aa, Artificial Sequence
  Description of Artificial Sequence: Synthetic peptide
  Seed: KLSSIIPSA (MAGC3_HUMAN)
KMSSIIPSY

SEQ ID NO: 100472 - protein, 9 aa, Artificial Sequence
  Description of Artificial Sequence: Synthetic peptide
  Seed: ATDKDYSAF (MAGC3_HUMAN)
AMDKDYSAW

SEQ ID NO: 100473 - protein, 9 aa, Artificial Sequence
  Description of Artificial Sequence: Synthetic peptide
  Seed: FLSKLSSII (MAGC3_HUMAN)
FNSKLSSIY

SEQ ID NO: 100474 - protein, 8 aa, Artificial Sequence
  Description of Artificial Sequence: Synthetic peptide
  Seed: SAFPSWYM (MAGC3_HUMAN)
STFPSWYW

SEQ ID NO: 100475 - protein, 9 aa, Artificial Sequence
  Description of Artificial Sequence: Synthetic peptide
  Seed: ATDKDYSAF (MAGC3_HUMAN)
AGDKDYSAL

SEQ ID NO: 100476 - protein, 10 aa, Artificial Sequence
  Description of Artificial Sequence: Synthetic peptide
  Seed: SSEEEDTATW (MAGC3_HUMAN)
SIEEEDTATY

SEQ ID NO: 100477 - protein, 9 aa, Artificial Sequence
  Description of Artificial Sequence: Synthetic peptide
  Seed: AIIDTTDDA (MAGC3_HUMAN)
AIIDTTDDL

SEQ ID NO: 100478 - protein, 9 aa, Artificial Sequence
  Description of Artificial Sequence: Synthetic peptide
  Seed: KKYKDYFPM (MAGC3_HUMAN)
KMYKDYFPM

SEQ ID NO: 100479 - protein, 9 aa, Artificial Sequence
  Description of Artificial Sequence: Synthetic peptide
  Seed: KVDKLVQFL (MAGC3_HUMAN)
KIDKLVQFR

SEQ ID NO: 100480 - protein, 9 aa, Artificial Sequence
  Description of Artificial Sequence: Synthetic peptide
  Seed: SIIPSAFPS (MAGC3_HUMAN)
SQIPSAFPV

SEQ ID NO: 100481 - protein, 9 aa, Artificial Sequence
  Description of Artificial Sequence: Synthetic peptide
  Seed: MQMNVINTY (MAGC3_HUMAN)
MNMNVINTW

SEQ ID NO: 100482 - protein, 10 aa, Artificial Sequence
  Description of Artificial Sequence: Synthetic peptide
  Seed: YALSPVVLPP (MAGC3_HUMAN)
YALSPVVLPT

SEQ ID NO: 100483 - protein, 9 aa, Artificial Sequence
  Description of Artificial Sequence: Synthetic peptide
  Seed: MQMNVINTY (MAGC3_HUMAN)
MEMNVINTI

SEQ ID NO: 100484 - protein, 9 aa, Artificial Sequence
  Description of Artificial Sequence: Synthetic peptide
  Seed: MPAAGMPPL (MAGC3_HUMAN)
MIAAGMPPY

SEQ ID NO: 100485 - protein, 10 aa, Artificial Sequence
  Description of Artificial Sequence: Synthetic peptide
  Seed: KATDKDYSAF (MAGC3_HUMAN)
KMTDKDYSAW

SEQ ID NO: 100486 - protein, 10 aa, Artificial Sequence
  Description of Artificial Sequence: Synthetic peptide
  Seed: SLVLCPTYFK (MAGC3_HUMAN)
SVVLCPTYFK

SEQ ID NO: 100487 - protein, 10 aa, Artificial Sequence
  Description of Artificial Sequence: Synthetic peptide
  Seed: LWKDSDLPTW (MAGC3_HUMAN)
LAKDSDLPTW

SEQ ID NO: 100488 - protein, 11 aa, Artificial Sequence
  Description of Artificial Sequence: Synthetic peptide
  Seed: AEMQMNVINTY (MAGC3_HUMAN)
AKMQMNVINTY

SEQ ID NO: 100489 - protein, 10 aa, Artificial Sequence
  Description of Artificial Sequence: Synthetic peptide
  Seed: MIFRKAREFI (MAGC3_HUMAN)
MIFRKAREFV

SEQ ID NO: 100490 - protein, 10 aa, Artificial Sequence
  Description of Artificial Sequence: Synthetic peptide
  Seed: ALDEKVAELV (MAGC3_HUMAN)
AMDEKVAELW

SEQ ID NO: 100491 - protein, 10 aa, Artificial Sequence
  Description of Artificial Sequence: Synthetic peptide
  Seed: VLDLANPQGL (MAGC3_HUMAN)
VFDLANPQGM

SEQ ID NO: 100492 - protein, 10 aa, Artificial Sequence
  Description of Artificial Sequence: Synthetic peptide
  Seed: ATYALSPVVL (MAGC3_HUMAN)
AYYALSPVVL

SEQ ID NO: 100493 - protein, 11 aa, Artificial Sequence
  Description of Artificial Sequence: Synthetic peptide
  Seed: SLPESEPLFTY (MAGC3_HUMAN)
SMPESEPLFTI

SEQ ID NO: 100494 - protein, 10 aa, Artificial Sequence
  Description of Artificial Sequence: Synthetic peptide
  Seed: IELIFGIALT (MAGC3_HUMAN)
ITLIFGIALV

SEQ ID NO: 100495 - protein, 9 aa, Artificial Sequence
  Description of Artificial Sequence: Synthetic peptide
  Seed: IPPQGPPKI (MAGC3_HUMAN)
IFPQGPPKF

SEQ ID NO: 100496 - protein, 9 aa, Artificial Sequence
  Description of Artificial Sequence: Synthetic peptide
  Seed: QGMPKNCLL (MAGC3_HUMAN)
QAMPKNCLF

SEQ ID NO: 100497 - protein, 9 aa, Artificial Sequence
  Description of Artificial Sequence: Synthetic peptide
  Seed: SDQRMDSLV (MAGC3_HUMAN)
SEQRMDSLP

SEQ ID NO: 100498 - protein, 11 aa, Artificial Sequence
  Description of Artificial Sequence: Synthetic peptide
  Seed: TTDDATAMASA (MAGC3_HUMAN)
TIDDATAMASM

SEQ ID NO: 100499 - protein, 9 aa, Artificial Sequence
  Description of Artificial Sequence: Synthetic peptide
  Seed: TAMASASPS (MAGC3_HUMAN)
TMMASASPY

SEQ ID NO: 100500 - protein, 10 aa, Artificial Sequence
  Description of Artificial Sequence: Synthetic peptide
  Seed: AELVQFLLLK (MAGC3_HUMAN)
AALVQFLLLK

SEQ ID NO: 100501 - protein, 11 aa, Artificial Sequence
  Description of Artificial Sequence: Synthetic peptide
  Seed: TDMDPDNHSYF (MAGC3_HUMAN)
TEMDPDNHSYW

SEQ ID NO: 100502 - protein, 9 aa, Artificial Sequence
  Description of Artificial Sequence: Synthetic peptide
  Seed: KGSCVPEEV (MAGC3_HUMAN)
KVSCVPEEW

SEQ ID NO: 100503 - protein, 10 aa, Artificial Sequence
  Description of Artificial Sequence: Synthetic peptide
  Seed: SAFHLGHLRE (MAGC3_HUMAN)
SMFHLGHLRD

SEQ ID NO: 100504 - protein, 10 aa, Artificial Sequence
  Description of Artificial Sequence: Synthetic peptide
  Seed: MIFRKAREFI (MAGC3_HUMAN)
MKFRKAREFK

SEQ ID NO: 100505 - protein, 10 aa, Artificial Sequence
  Description of Artificial Sequence: Synthetic peptide
  Seed: IIDTTDDATA (MAGC3_HUMAN)
ILDTTDDATF

SEQ ID NO: 100506 - protein, 10 aa, Artificial Sequence
  Description of Artificial Sequence: Synthetic peptide
  Seed: GPPQSPPQSP (MAGC3_HUMAN)
GPPQSPPQSI

SEQ ID NO: 100507 - protein, 9 aa, Artificial Sequence
  Description of Artificial Sequence: Synthetic peptide
  Seed: SPVVLPPQP (MAGC3_HUMAN)
SPVVLPPQF

SEQ ID NO: 100508 - protein, 9 aa, Artificial Sequence
  Description of Artificial Sequence: Synthetic peptide
  Seed: LRSAEGSVL (MAGC3_HUMAN)
LTSAEGSVF

SEQ ID NO: 100509 - protein, 10 aa, Artificial Sequence
  Description of Artificial Sequence: Synthetic peptide
  Seed: EKVAELVQFL (MAGC3_HUMAN)
EKVAELVQFI

SEQ ID NO: 100510 - protein, 10 aa, Artificial Sequence
  Description of Artificial Sequence: Synthetic peptide
  Seed: KVAELVQFLL (MAGC3_HUMAN)
KLAELVQFLA

SEQ ID NO: 100511 - protein, 9 aa, Artificial Sequence
  Description of Artificial Sequence: Synthetic peptide
  Seed: VLCPTYFKL (MAGC3_HUMAN)
VTCPTYFKR

SEQ ID NO: 100512 - protein, 9 aa, Artificial Sequence
  Description of Artificial Sequence: Synthetic peptide
  Seed: RPAREVLEF (MAGC3_HUMAN)
RPAREVLEV

SEQ ID NO: 100513 - protein, 10 aa, Artificial Sequence
  Description of Artificial Sequence: Synthetic peptide
  Seed: TTDDATAMAS (MAGC3_HUMAN)
TCDDATAMAF

SEQ ID NO: 100514 - protein, 10 aa, Artificial Sequence
  Description of Artificial Sequence: Synthetic peptide
  Seed: YALDEKVAEL (MAGC3_HUMAN)
YHLDEKVAEI

SEQ ID NO: 100515 - protein, 8 aa, Artificial Sequence
  Description of Artificial Sequence: Synthetic peptide
  Seed: YTLSLPAV (MAGC3_HUMAN)
YILSLPAV

SEQ ID NO: 100516 - protein, 9 aa, Artificial Sequence
  Description of Artificial Sequence: Synthetic peptide
  Seed: SLPAVSPGK (MAGC3_HUMAN)
SMPAVSPGR

SEQ ID NO: 100517 - protein, 10 aa, Artificial Sequence
  Description of Artificial Sequence: Synthetic peptide
  Seed: YTGYFPMIFR (MAGC3_HUMAN)
YLGYFPMIFK

SEQ ID NO: 100518 - protein, 11 aa, Artificial Sequence
  Description of Artificial Sequence: Synthetic peptide
  Seed: TDMDPDNHSYF (MAGC3_HUMAN)
TMMDPDNHSYF

SEQ ID NO: 100519 - protein, 9 aa, Artificial Sequence
  Description of Artificial Sequence: Synthetic peptide
  Seed: YQAKEPLTR (MAGC3_HUMAN)
YFAKEPLTF

SEQ ID NO: 100520 - protein, 10 aa, Artificial Sequence
  Description of Artificial Sequence: Synthetic peptide
  Seed: KVAELVQFLL (MAGC3_HUMAN)
KMAELVQFLE

SEQ ID NO: 100521 - protein, 9 aa, Artificial Sequence
  Description of Artificial Sequence: Synthetic peptide
  Seed: LSSIIPSAF (MAGC3_HUMAN)
LGSIIPSAF

SEQ ID NO: 100522 - protein, 9 aa, Artificial Sequence
  Description of Artificial Sequence: Synthetic peptide
  Seed: YFFEDTLDL (MAGC3_HUMAN)
YAFEDTLDF

SEQ ID NO: 100523 - protein, 10 aa, Artificial Sequence
  Description of Artificial Sequence: Synthetic peptide
  Seed: MLTTVIKKYK (MAGC3_HUMAN)
MKTTVIKKYK

SEQ ID NO: 100524 - protein, 9 aa, Artificial Sequence
  Description of Artificial Sequence: Synthetic peptide
  Seed: KLVQFLLLK (MAGC3_HUMAN)
KMVQFLLLH

SEQ ID NO: 100525 - protein, 10 aa, Artificial Sequence
  Description of Artificial Sequence: Synthetic peptide
  Seed: FFEDTLDLTY (MAGC3_HUMAN)
FAEDTLDLTM

SEQ ID NO: 100526 - protein, 10 aa, Artificial Sequence
  Description of Artificial Sequence: Synthetic peptide
  Seed: YALSPVVLPP (MAGC3_HUMAN)
YMLSPVVLPM

SEQ ID NO: 100527 - protein, 9 aa, Artificial Sequence
  Description of Artificial Sequence: Synthetic peptide
  Seed: TSDQRMDSL (MAGC3_HUMAN)
TTDQRMDSM

SEQ ID NO: 100528 - protein, 9 aa, Artificial Sequence
  Description of Artificial Sequence: Synthetic peptide
  Seed: KAHEFIELI (MAGC3_HUMAN)
KIHEFIELF

SEQ ID NO: 100529 - protein, 10 aa, Artificial Sequence
  Description of Artificial Sequence: Synthetic peptide
  Seed: EEVIWEVLNA (MAGC3_HUMAN)
EWVIWEVLNV

SEQ ID NO: 100530 - protein, 9 aa, Artificial Sequence
  Description of Artificial Sequence: Synthetic peptide
  Seed: KLVQFLLLK (MAGC3_HUMAN)
KLVQFLLLV

SEQ ID NO: 100531 - protein, 11 aa, Artificial Sequence
  Description of Artificial Sequence: Synthetic peptide
  Seed: LSDEQGMPQNR (MAGC3_HUMAN)
LADEQGMPQNY

SEQ ID NO: 100532 - protein, 10 aa, Artificial Sequence
  Description of Artificial Sequence: Synthetic peptide
  Seed: AFPSWYMDAL (MAGC3_HUMAN)
APPSWYMDAL

SEQ ID NO: 100533 - protein, 10 aa, Artificial Sequence
  Description of Artificial Sequence: Synthetic peptide
  Seed: EVIWEVLNAI (MAGC3_HUMAN)
EFIWEVLNAI

SEQ ID NO: 100534 - protein, 9 aa, Artificial Sequence
  Description of Artificial Sequence: Synthetic peptide
  Seed: HLREVRLFL (MAGC3_HUMAN)
HLREVRLFV

SEQ ID NO: 100535 - protein, 9 aa, Artificial Sequence
  Description of Artificial Sequence: Synthetic peptide
  Seed: FVNTLDLTC (MAGC3_HUMAN)
FANTLDLTI

SEQ ID NO: 100536 - protein, 9 aa, Artificial Sequence
  Description of Artificial Sequence: Synthetic peptide
  Seed: SESLPRYAL (MAGC3_HUMAN)
SHSLPRYAA

SEQ ID NO: 100537 - protein, 10 aa, Artificial Sequence
  Description of Artificial Sequence: Synthetic peptide
  Seed: LDSCSSPLLW (MAGC3_HUMAN)
LDSCSSPLLF

SEQ ID NO: 100538 - protein, 10 aa, Artificial Sequence
  Description of Artificial Sequence: Synthetic peptide
  Seed: MQMNVINTYT (MAGC3_HUMAN)
MWMNVINTYM

SEQ ID NO: 100539 - protein, 10 aa, Artificial Sequence
  Description of Artificial Sequence: Synthetic peptide
  Seed: SLPESEPLFT (MAGC3_HUMAN)
SVPESEPLFV

SEQ ID NO: 100540 - protein, 10 aa, Artificial Sequence
  Description of Artificial Sequence: Synthetic peptide
  Seed: TEVDPDHFYV (MAGC3_HUMAN)
TLVDPDHFYV

SEQ ID NO: 100541 - protein, 10 aa, Artificial Sequence
  Description of Artificial Sequence: Synthetic peptide
  Seed: RSAEGSVLDL (MAGC3_HUMAN)
RAAEGSVLDY

SEQ ID NO: 100542 - protein, 9 aa, Artificial Sequence
  Description of Artificial Sequence: Synthetic peptide
  Seed: HLREVRLFL (MAGC3_HUMAN)
HPREVRLFM

SEQ ID NO: 100543 - protein, 9 aa, Artificial Sequence
  Description of Artificial Sequence: Synthetic peptide
  Seed: KVAELVQFL (MAGC3_HUMAN)
KMAELVQFW

SEQ ID NO: 100544 - protein, 9 aa, Artificial Sequence
  Description of Artificial Sequence: Synthetic peptide
  Seed: LKYQTKEPV (MAGC3_HUMAN)
LLYQTKEPY

SEQ ID NO: 100545 - protein, 10 aa, Artificial Sequence
  Description of Artificial Sequence: Synthetic peptide
  Seed: FPSWYMDALK (MAGC3_HUMAN)
FMSWYMDALK

SEQ ID NO: 100546 - protein, 9 aa, Artificial Sequence
  Description of Artificial Sequence: Synthetic peptide
  Seed: YFFEDTLDL (MAGC3_HUMAN)
YLFEDTLDT

SEQ ID NO: 100547 - protein, 9 aa, Artificial Sequence
  Description of Artificial Sequence: Synthetic peptide
  Seed: TTDDATAMA (MAGC3_HUMAN)
TIDDATAML

SEQ ID NO: 100548 - protein, 9 aa, Artificial Sequence
  Description of Artificial Sequence: Synthetic peptide
  Seed: ATYALSPVV (MAGC3_HUMAN)
ATYALSPVY

SEQ ID NO: 100549 - protein, 9 aa, Artificial Sequence
  Description of Artificial Sequence: Synthetic peptide
  Seed: CHWVLDATF (MAGC3_HUMAN)
CHWVLDATL

SEQ ID NO: 100550 - protein, 9 aa, Artificial Sequence
  Description of Artificial Sequence: Synthetic peptide
  Seed: TEVDPDHFY (MAGC3_HUMAN)
TAVDPDHFM

SEQ ID NO: 100551 - protein, 10 aa, Artificial Sequence
  Description of Artificial Sequence: Synthetic peptide
  Seed: TTDDATAMAS (MAGC3_HUMAN)
TTDDATAMAL

SEQ ID NO: 100552 - protein, 10 aa, Artificial Sequence
  Description of Artificial Sequence: Synthetic peptide
  Seed: IELIFGIALT (MAGC3_HUMAN)
IVLIFGIALL

SEQ ID NO: 100553 - protein, 11 aa, Artificial Sequence
  Description of Artificial Sequence: Synthetic peptide
  Seed: KKATDKDYSAF (MAGC3_HUMAN)
KQATDKDYSAF

SEQ ID NO: 100554 - protein, 9 aa, Artificial Sequence
  Description of Artificial Sequence: Synthetic peptide
  Seed: ASEEVIWEV (MAGC3_HUMAN)
ALEEVIWEM

SEQ ID NO: 100555 - protein, 9 aa, Artificial Sequence
  Description of Artificial Sequence: Synthetic peptide
  Seed: LKYQTKEPV (MAGC3_HUMAN)
LGYQTKEPF

SEQ ID NO: 100556 - protein, 11 aa, Artificial Sequence
  Description of Artificial Sequence: Synthetic peptide
  Seed: EILFGISLTEV (MAGC3_HUMAN)
ELLFGISLTEV

SEQ ID NO: 100557 - protein, 9 aa, Artificial Sequence
  Description of Artificial Sequence: Synthetic peptide
  Seed: TGYFPMIFR (MAGC3_HUMAN)
TIYFPMIFR

SEQ ID NO: 100558 - protein, 9 aa, Artificial Sequence
  Description of Artificial Sequence: Synthetic peptide
  Seed: NAIGPWSAL (MAGC3_HUMAN)
NIIGPWSAL

SEQ ID NO: 100559 - protein, 9 aa, Artificial Sequence
  Description of Artificial Sequence: Synthetic peptide
  Seed: KVAELVQFL (MAGC3_HUMAN)
KVAELVQFV

SEQ ID NO: 100560 - protein, 10 aa, Artificial Sequence
  Description of Artificial Sequence: Synthetic peptide
  Seed: TLWKDSDLPT (MAGC3_HUMAN)
TLWKDSDLPL

SEQ ID NO: 100561 - protein, 11 aa, Artificial Sequence
  Description of Artificial Sequence: Synthetic peptide
  Seed: AIIDTTDDATA (MAGC3_HUMAN)
AVIDTTDDATV

SEQ ID NO: 100562 - protein, 9 aa, Artificial Sequence
  Description of Artificial Sequence: Synthetic peptide
  Seed: DTTDDATAM (MAGC3_HUMAN)
DPTDDATAY

SEQ ID NO: 100563 - protein, 9 aa, Artificial Sequence
  Description of Artificial Sequence: Synthetic peptide
  Seed: MPAAGMPPL (MAGC3_HUMAN)
MAAAGMPPW

SEQ ID NO: 100564 - protein, 9 aa, Artificial Sequence
  Description of Artificial Sequence: Synthetic peptide
  Seed: LILSVIFIK (MAGC3_HUMAN)
LSLSVIFIR

SEQ ID NO: 100565 - protein, 10 aa, Artificial Sequence
  Description of Artificial Sequence: Synthetic peptide
  Seed: SKLSSIIPSA (MAGC3_HUMAN)
SDLSSIIPSA

SEQ ID NO: 100566 - protein, 8 aa, Artificial Sequence
  Description of Artificial Sequence: Synthetic peptide
  Seed: AEMLTTVI (MAGC3_HUMAN)
AEMLTTVF

SEQ ID NO: 100567 - protein, 11 aa, Artificial Sequence
  Description of Artificial Sequence: Synthetic peptide
  Seed: YTGYFPMIFRK (MAGC3_HUMAN)
YTGYFPMIFRR

SEQ ID NO: 100568 - protein, 9 aa, Artificial Sequence
  Description of Artificial Sequence: Synthetic peptide
  Seed: SAFHLGHLR (MAGC3_HUMAN)
SVFHLGHLF

SEQ ID NO: 100569 - protein, 9 aa, Artificial Sequence
  Description of Artificial Sequence: Synthetic peptide
  Seed: KVAELVQFL (MAGC3_HUMAN)
KLAELVQFV

SEQ ID NO: 100570 - protein, 9 aa, Artificial Sequence
  Description of Artificial Sequence: Synthetic peptide
  Seed: SLPESEPLF (MAGC3_HUMAN)
SVPESEPLV

SEQ ID NO: 100571 - protein, 9 aa, Artificial Sequence
  Description of Artificial Sequence: Synthetic peptide
  Seed: KAHEFIELI (MAGC3_HUMAN)
KHHEFIELL

SEQ ID NO: 100572 - protein, 10 aa, Artificial Sequence
  Description of Artificial Sequence: Synthetic peptide
  Seed: MQMNVINTYT (MAGC3_HUMAN)
MQMNVINTYP

SEQ ID NO: 100573 - protein, 9 aa, Artificial Sequence
  Description of Artificial Sequence: Synthetic peptide
  Seed: YQAKEPLTR (MAGC3_HUMAN)
YSAKEPLTY

SEQ ID NO: 100574 - protein, 9 aa, Artificial Sequence
  Description of Artificial Sequence: Synthetic peptide
  Seed: VDPDHFYVF (MAGC3_HUMAN)
VTPDHFYVF

SEQ ID NO: 100575 - protein, 9 aa, Artificial Sequence
  Description of Artificial Sequence: Synthetic peptide
  Seed: MIFRKAREF (MAGC3_HUMAN)
MLFRKAREM

SEQ ID NO: 100576 - protein, 9 aa, Artificial Sequence
  Description of Artificial Sequence: Synthetic peptide
  Seed: SLVLCPTYF (MAGC3_HUMAN)
SVVLCPTYR

SEQ ID NO: 100577 - protein, 9 aa, Artificial Sequence
  Description of Artificial Sequence: Synthetic peptide
  Seed: HFYVFVNTL (MAGC3_HUMAN)
HAYVFVNTI

SEQ ID NO: 100578 - protein, 9 aa, Artificial Sequence
  Description of Artificial Sequence: Synthetic peptide
  Seed: IPPQGPPKI (MAGC3_HUMAN)
IQPQGPPKL

SEQ ID NO: 100579 - protein, 10 aa, Artificial Sequence
  Description of Artificial Sequence: Synthetic peptide
  Seed: SIIPSAFPSW (MAGC3_HUMAN)
SPIPSAFPSF

SEQ ID NO: 100580 - protein, 9 aa, Artificial Sequence
  Description of Artificial Sequence: Synthetic peptide
  Seed: TEASPQQKK (MAGC3_HUMAN)
TTASPQQKL

SEQ ID NO: 100581 - protein, 11 aa, Artificial Sequence
  Description of Artificial Sequence: Synthetic peptide
  Seed: ATFSDGSLGQW (MAGC3_HUMAN)
ASFSDGSLGQF

SEQ ID NO: 100582 - protein, 9 aa, Artificial Sequence
  Description of Artificial Sequence: Synthetic peptide
  Seed: AVSPGKRLW (MAGC3_HUMAN)
ATSPGKRLM

SEQ ID NO: 100583 - protein, 9 aa, Artificial Sequence
  Description of Artificial Sequence: Synthetic peptide
  Seed: DGSLGQWVK (MAGC3_HUMAN)
DTSLGQWVK

SEQ ID NO: 100584 - protein, 9 aa, Artificial Sequence
  Description of Artificial Sequence: Synthetic peptide
  Seed: KVAELVQFL (MAGC3_HUMAN)
KNAELVQFV

SEQ ID NO: 100585 - protein, 10 aa, Artificial Sequence
  Description of Artificial Sequence: Synthetic peptide
  Seed: TDMDPDNHSY (MAGC3_HUMAN)
TQMDPDNHSM

SEQ ID NO: 100586 - protein, 9 aa, Artificial Sequence
  Description of Artificial Sequence: Synthetic peptide
  Seed: MASASPSVM (MAGC3_HUMAN)
MVSASPSVM

SEQ ID NO: 100587 - protein, 10 aa, Artificial Sequence
  Description of Artificial Sequence: Synthetic peptide
  Seed: SDQRMDSLVL (MAGC3_HUMAN)
SEQRMDSLVM

SEQ ID NO: 100588 - protein, 10 aa, Artificial Sequence
  Description of Artificial Sequence: Synthetic peptide
  Seed: SIIPSAFPSW (MAGC3_HUMAN)
SFIPSAFPSL

SEQ ID NO: 100589 - protein, 9 aa, Artificial Sequence
  Description of Artificial Sequence: Synthetic peptide
  Seed: FSDGSLGQW (MAGC3_HUMAN)
FQDGSLGQV

SEQ ID NO: 100590 - protein, 9 aa, Artificial Sequence
  Description of Artificial Sequence: Synthetic peptide
  Seed: YFFEDTLDL (MAGC3_HUMAN)
YPFEDTLDW

SEQ ID NO: 100591 - protein, 9 aa, Artificial Sequence
  Description of Artificial Sequence: Synthetic peptide
  Seed: MPAAGMPPL (MAGC3_HUMAN)
MNAAGMPPY

SEQ ID NO: 100592 - protein, 9 aa, Artificial Sequence
  Description of Artificial Sequence: Synthetic peptide
  Seed: MPAAGMPPL (MAGC3_HUMAN)
MGAAGMPPM

SEQ ID NO: 100593 - protein, 10 aa, Artificial Sequence
  Description of Artificial Sequence: Synthetic peptide
  Seed: RRGTGYTLSL (MAGC3_HUMAN)
RRGTGYTLSR

SEQ ID NO: 100594 - protein, 10 aa, Artificial Sequence
  Description of Artificial Sequence: Synthetic peptide
  Seed: FSDGSLGQWV (MAGC3_HUMAN)
FLDGSLGQWL

SEQ ID NO: 100595 - protein, 9 aa, Artificial Sequence
  Description of Artificial Sequence: Synthetic peptide
  Seed: EKVDKLVQF (MAGC3_HUMAN)
EQVDKLVQW

SEQ ID NO: 100596 - protein, 9 aa, Artificial Sequence
  Description of Artificial Sequence: Synthetic peptide
  Seed: CSSPLLWTR (MAGC3_HUMAN)
CVSPLLWTK

SEQ ID NO: 100597 - protein, 9 aa, Artificial Sequence
  Description of Artificial Sequence: Synthetic peptide
  Seed: KAHEFIELI (MAGC3_HUMAN)
KLHEFIELS

SEQ ID NO: 100598 - protein, 9 aa, Artificial Sequence
  Description of Artificial Sequence: Synthetic peptide
  Seed: ILILSMIFI (MAGC3_HUMAN)
ITILSMIFV

SEQ ID NO: 100599 - protein, 9 aa, Artificial Sequence
  Description of Artificial Sequence: Synthetic peptide
  Seed: YTGYFPMIF (MAGC3_HUMAN)
YSGYFPMIY

SEQ ID NO: 100600 - protein, 9 aa, Artificial Sequence
  Description of Artificial Sequence: Synthetic peptide
  Seed: FHLGHLREV (MAGC3_HUMAN)
FWLGHLREM

SEQ ID NO: 100601 - protein, 9 aa, Artificial Sequence
  Description of Artificial Sequence: Synthetic peptide
  Seed: GSLPESEPL (MAGC3_HUMAN)
GQLPESEPL

SEQ ID NO: 100602 - protein, 9 aa, Artificial Sequence
  Description of Artificial Sequence: Synthetic peptide
  Seed: LSAIGPIQR (MAGC3_HUMAN)
LSAIGPIQY

SEQ ID NO: 100603 - protein, 10 aa, Artificial Sequence
  Description of Artificial Sequence: Synthetic peptide
  Seed: KVAELVQFLL (MAGC3_HUMAN)
KGAELVQFLW

SEQ ID NO: 100604 - protein, 10 aa, Artificial Sequence
  Description of Artificial Sequence: Synthetic peptide
  Seed: SPLDSCSSPL (MAGC3_HUMAN)
SFLDSCSSPV

SEQ ID NO: 100605 - protein, 9 aa, Artificial Sequence
  Description of Artificial Sequence: Synthetic peptide
  Seed: KATDKDYSA (MAGC3_HUMAN)
KATDKDYSF

SEQ ID NO: 100606 - protein, 9 aa, Artificial Sequence
  Description of Artificial Sequence: Synthetic peptide
  Seed: LSSIIPSAF (MAGC3_HUMAN)
LGSIIPSAW

SEQ ID NO: 100607 - protein, 9 aa, Artificial Sequence
  Description of Artificial Sequence: Synthetic peptide
  Seed: LILILSMIF (MAGC3_HUMAN)
LQLILSMIM

SEQ ID NO: 100608 - protein, 9 aa, Artificial Sequence
  Description of Artificial Sequence: Synthetic peptide
  Seed: WVKNTCATY (MAGC3_HUMAN)
WEKNTCATF

SEQ ID NO: 100609 - protein, 9 aa, Artificial Sequence
  Description of Artificial Sequence: Synthetic peptide
  Seed: RPAREVLEF (MAGC3_HUMAN)
RAAREVLEY

SEQ ID NO: 100610 - protein, 10 aa, Artificial Sequence
  Description of Artificial Sequence: Synthetic peptide
  Seed: RSAEGSVLDL (MAGC3_HUMAN)
RTAEGSVLDF

SEQ ID NO: 100611 - protein, 9 aa, Artificial Sequence
  Description of Artificial Sequence: Synthetic peptide
  Seed: MPAAGMPPL (MAGC3_HUMAN)
MTAAGMPPV

SEQ ID NO: 100612 - protein, 9 aa, Artificial Sequence
  Description of Artificial Sequence: Synthetic peptide
  Seed: SASPSVMST (MAGC3_HUMAN)
STSPSVMSI

SEQ ID NO: 100613 - protein, 9 aa, Artificial Sequence
  Description of Artificial Sequence: Synthetic peptide
  Seed: TGYFPMIFR (MAGC3_HUMAN)
TSYFPMIFY

SEQ ID NO: 100614 - protein, 10 aa, Artificial Sequence
  Description of Artificial Sequence: Synthetic peptide
  Seed: FKLWRTLSGS (MAGC3_HUMAN)
FGLWRTLSGA

SEQ ID NO: 100615 - protein, 10 aa, Artificial Sequence
  Description of Artificial Sequence: Synthetic peptide
  Seed: LLKYQAKEPL (MAGC3_HUMAN)
LPKYQAKEPY

SEQ ID NO: 100616 - protein, 9 aa, Artificial Sequence
  Description of Artificial Sequence: Synthetic peptide
  Seed: RGTGYTLSL (MAGC3_HUMAN)
RGTGYTLSF

SEQ ID NO: 100617 - protein, 9 aa, Artificial Sequence
  Description of Artificial Sequence: Synthetic peptide
  Seed: MPKNCLLIL (MAGC3_HUMAN)
MPKNCLLIA

SEQ ID NO: 100618 - protein, 9 aa, Artificial Sequence
  Description of Artificial Sequence: Synthetic peptide
  Seed: NPQGLAGHR (MAGC3_HUMAN)
NMQGLAGHR

SEQ ID NO: 100619 - protein, 10 aa, Artificial Sequence
  Description of Artificial Sequence: Synthetic peptide
  Seed: SKLSSIIPSA (MAGC3_HUMAN)
SQLSSIIPSL

SEQ ID NO: 100620 - protein, 9 aa, Artificial Sequence
  Description of Artificial Sequence: Synthetic peptide
  Seed: LSSIIPSAF (MAGC3_HUMAN)
LSSIIPSAM

SEQ ID NO: 100621 - protein, 9 aa, Artificial Sequence
  Description of Artificial Sequence: Synthetic peptide
  Seed: SEEEDTATW (MAGC3_HUMAN)
SSEEDTATW

SEQ ID NO: 100622 - protein, 10 aa, Artificial Sequence
  Description of Artificial Sequence: Synthetic peptide
  Seed: SDQRMDSLVL (MAGC3_HUMAN)
SDQRMDSLVM

SEQ ID NO: 100623 - protein, 9 aa, Artificial Sequence
  Description of Artificial Sequence: Synthetic peptide
  Seed: TKAEMLTTV (MAGC3_HUMAN)
TVAEMLTTV

SEQ ID NO: 100624 - protein, 10 aa, Artificial Sequence
  Description of Artificial Sequence: Synthetic peptide
  Seed: LDLANPQGLA (MAGC3_HUMAN)
LRLANPQGLV

SEQ ID NO: 100625 - protein, 10 aa, Artificial Sequence
  Description of Artificial Sequence: Synthetic peptide
  Seed: REVLEFLSKL (MAGC3_HUMAN)
RMVLEFLSKL

SEQ ID NO: 100626 - protein, 10 aa, Artificial Sequence
  Description of Artificial Sequence: Synthetic peptide
  Seed: LPTWRRGTGY (MAGC3_HUMAN)
LCTWRRGTGF

SEQ ID NO: 100627 - protein, 10 aa, Artificial Sequence
  Description of Artificial Sequence: Synthetic peptide
  Seed: TGYFPMIFRK (MAGC3_HUMAN)
TVYFPMIFRW

SEQ ID NO: 100628 - protein, 10 aa, Artificial Sequence
  Description of Artificial Sequence: Synthetic peptide
  Seed: VLSAIGPIQR (MAGC3_HUMAN)
VLSAIGPIQK

SEQ ID NO: 100629 - protein, 9 aa, Artificial Sequence
  Description of Artificial Sequence: Synthetic peptide
  Seed: TTDDATAMA (MAGC3_HUMAN)
TLDDATAMM

SEQ ID NO: 100630 - protein, 9 aa, Artificial Sequence
  Description of Artificial Sequence: Synthetic peptide
  Seed: MLLPCHWVL (MAGC3_HUMAN)
MHLPCHWVY

SEQ ID NO: 100631 - protein, 10 aa, Artificial Sequence
  Description of Artificial Sequence: Synthetic peptide
  Seed: MLTTVIKKYK (MAGC3_HUMAN)
MPTTVIKKYK

SEQ ID NO: 100632 - protein, 9 aa, Artificial Sequence
  Description of Artificial Sequence: Synthetic peptide
  Seed: IPPQGPPKI (MAGC3_HUMAN)
IGPQGPPKV

SEQ ID NO: 100633 - protein, 9 aa, Artificial Sequence
  Description of Artificial Sequence: Synthetic peptide
  Seed: LLILILSMI (MAGC3_HUMAN)
LQILILSMI

SEQ ID NO: 100634 - protein, 10 aa, Artificial Sequence
  Description of Artificial Sequence: Synthetic peptide
  Seed: MQMNVINTYT (MAGC3_HUMAN)
MCMNVINTYF

SEQ ID NO: 100635 - protein, 9 aa, Artificial Sequence
  Description of Artificial Sequence: Synthetic peptide
  Seed: HSYFFEDTL (MAGC3_HUMAN)
HHYFFEDTM

SEQ ID NO: 100636 - protein, 9 aa, Artificial Sequence
  Description of Artificial Sequence: Synthetic peptide
  Seed: MPAAGMPPL (MAGC3_HUMAN)
MMAAGMPPF

SEQ ID NO: 100637 - protein, 10 aa, Artificial Sequence
  Description of Artificial Sequence: Synthetic peptide
  Seed: MLLPCHWVLD (MAGC3_HUMAN)
MNLPCHWVLV

SEQ ID NO: 100638 - protein, 9 aa, Artificial Sequence
  Description of Artificial Sequence: Synthetic peptide
  Seed: GFADVLSRL (MAGC3_HUMAN)
GTADVLSRV

SEQ ID NO: 100639 - protein, 9 aa, Artificial Sequence
  Description of Artificial Sequence: Synthetic peptide
  Seed: ALSPVVLPP (MAGC3_HUMAN)
ATSPVVLPV

SEQ ID NO: 100640 - protein, 9 aa, Artificial Sequence
  Description of Artificial Sequence: Synthetic peptide
  Seed: EVIWEVLSA (MAGC3_HUMAN)
ETIWEVLSK

SEQ ID NO: 100641 - protein, 10 aa, Artificial Sequence
  Description of Artificial Sequence: Synthetic peptide
  Seed: MQMNVINTYT (MAGC3_HUMAN)
MNMNVINTYI

SEQ ID NO: 100642 - protein, 10 aa, Artificial Sequence
  Description of Artificial Sequence: Synthetic peptide
  Seed: IELIFGIALT (MAGC3_HUMAN)
IVLIFGIALI

SEQ ID NO: 100643 - protein, 9 aa, Artificial Sequence
  Description of Artificial Sequence: Synthetic peptide
  Seed: KVDKLVQFL (MAGC3_HUMAN)
KADKLVQFW

SEQ ID NO: 100644 - protein, 9 aa, Artificial Sequence
  Description of Artificial Sequence: Synthetic peptide
  Seed: REVRLFLRG (MAGC3_HUMAN)
REVRLFLRF

SEQ ID NO: 100645 - protein, 9 aa, Artificial Sequence
  Description of Artificial Sequence: Synthetic peptide
  Seed: MIFIKGSCV (MAGC3_HUMAN)
MMFIKGSCI

SEQ ID NO: 100646 - protein, 9 aa, Artificial Sequence
  Description of Artificial Sequence: Synthetic peptide
  Seed: EVIWEVLSA (MAGC3_HUMAN)
ESIWEVLSK

SEQ ID NO: 100647 - protein, 9 aa, Artificial Sequence
  Description of Artificial Sequence: Synthetic peptide
  Seed: VINTYTGYF (MAGC3_HUMAN)
VYNTYTGYM

SEQ ID NO: 100648 - protein, 9 aa, Artificial Sequence
  Description of Artificial Sequence: Synthetic peptide
  Seed: NAIGPWSAL (MAGC3_HUMAN)
NRIGPWSAF

SEQ ID NO: 100649 - protein, 10 aa, Artificial Sequence
  Description of Artificial Sequence: Synthetic peptide
  Seed: EVIWEVLSAI (MAGC3_HUMAN)
EAIWEVLSAF

SEQ ID NO: 100650 - protein, 9 aa, Artificial Sequence
  Description of Artificial Sequence: Synthetic peptide
  Seed: HLREVRLFL (MAGC3_HUMAN)
HFREVRLFA

SEQ ID NO: 100651 - protein, 11 aa, Artificial Sequence
  Description of Artificial Sequence: Synthetic peptide
  Seed: KFSLRRAVSVK (MAGC3_HUMAN)
KSSLRRAVSVK

SEQ ID NO: 100652 - protein, 9 aa, Artificial Sequence
  Description of Artificial Sequence: Synthetic peptide
  Seed: EVDPDHFYV (MAGC3_HUMAN)
EVDPDHFYL

SEQ ID NO: 100653 - protein, 10 aa, Artificial Sequence
  Description of Artificial Sequence: Synthetic peptide
  Seed: KLVQFLLLKY (MAGC3_HUMAN)
KYVQFLLLKY

SEQ ID NO: 100654 - protein, 10 aa, Artificial Sequence
  Description of Artificial Sequence: Synthetic peptide
  Seed: MIFRKAREFI (MAGC3_HUMAN)
MTFRKAREFI

SEQ ID NO: 100655 - protein, 9 aa, Artificial Sequence
  Description of Artificial Sequence: Synthetic peptide
  Seed: SASPSVMST (MAGC3_HUMAN)
SHSPSVMSL

SEQ ID NO: 100656 - protein, 9 aa, Artificial Sequence
  Description of Artificial Sequence: Synthetic peptide
  Seed: SQPEGKFSL (MAGC3_HUMAN)
SEPEGKFST

SEQ ID NO: 100657 - protein, 9 aa, Artificial Sequence
  Description of Artificial Sequence: Synthetic peptide
  Seed: MPAAGMPPL (MAGC3_HUMAN)
MAAAGMPPI

SEQ ID NO: 100658 - protein, 9 aa, Artificial Sequence
  Description of Artificial Sequence: Synthetic peptide
  Seed: RTLSGSPGL (MAGC3_HUMAN)
RLLSGSPGI

SEQ ID NO: 100659 - protein, 10 aa, Artificial Sequence
  Description of Artificial Sequence: Synthetic peptide
  Seed: REVRLFLRGG (MAGC3_HUMAN)
RSVRLFLRGS

SEQ ID NO: 100660 - protein, 10 aa, Artificial Sequence
  Description of Artificial Sequence: Synthetic peptide
  Seed: TDMDPDNHSY (MAGC3_HUMAN)
TMMDPDNHSY

SEQ ID NO: 100661 - protein, 9 aa, Artificial Sequence
  Description of Artificial Sequence: Synthetic peptide
  Seed: KAEMLTTVI (MAGC3_HUMAN)
KTEMLTTVW

SEQ ID NO: 100662 - protein, 9 aa, Artificial Sequence
  Description of Artificial Sequence: Synthetic peptide
  Seed: CATYALSPV (MAGC3_HUMAN)
CMTYALSPL

SEQ ID NO: 100663 - protein, 11 aa, Artificial Sequence
  Description of Artificial Sequence: Synthetic peptide
  Seed: LSKLSSIIPSA (MAGC3_HUMAN)
LSKLSSIIPSL

SEQ ID NO: 100664 - protein, 10 aa, Artificial Sequence
  Description of Artificial Sequence: Synthetic peptide
  Seed: SLIDDQGMPK (MAGC3_HUMAN)
SVIDDQGMPK

SEQ ID NO: 100665 - protein, 9 aa, Artificial Sequence
  Description of Artificial Sequence: Synthetic peptide
  Seed: HALPESESL (MAGC3_HUMAN)
HILPESESL

SEQ ID NO: 100666 - protein, 11 aa, Artificial Sequence
  Description of Artificial Sequence: Synthetic peptide
  Seed: TTDDATAMASA (MAGC3_HUMAN)
TIDDATAMASF

SEQ ID NO: 100667 - protein, 9 aa, Artificial Sequence
  Description of Artificial Sequence: Synthetic peptide
  Seed: NTYTGYFPM (MAGC3_HUMAN)
NMYTGYFPM

SEQ ID NO: 100668 - protein, 9 aa, Artificial Sequence
  Description of Artificial Sequence: Synthetic peptide
  Seed: KEPLTRAEM (MAGC3_HUMAN)
KQPLTRAEF

SEQ ID NO: 100669 - protein, 9 aa, Artificial Sequence
  Description of Artificial Sequence: Synthetic peptide
  Seed: VIWEVLNAI (MAGC3_HUMAN)
VVWEVLNAF

SEQ ID NO: 100670 - protein, 9 aa, Artificial Sequence
  Description of Artificial Sequence: Synthetic peptide
  Seed: MEDRAQAII (MAGC3_HUMAN)
MEDRAQAIW

SEQ ID NO: 100671 - protein, 10 aa, Artificial Sequence
  Description of Artificial Sequence: Synthetic peptide
  Seed: RLWGEKAGSL (MAGC3_HUMAN)
RVWGEKAGSY

SEQ ID NO: 100672 - protein, 10 aa, Artificial Sequence
  Description of Artificial Sequence: Synthetic peptide
  Seed: TTDDATAMAS (MAGC3_HUMAN)
TYDDATAMAL

SEQ ID NO: 100673 - protein, 10 aa, Artificial Sequence
  Description of Artificial Sequence: Synthetic peptide
  Seed: TGYFPMIFRK (MAGC3_HUMAN)
TVYFPMIFRG

SEQ ID NO: 100674 - protein, 9 aa, Artificial Sequence
  Description of Artificial Sequence: Synthetic peptide
  Seed: QTKEPVTKA (MAGC3_HUMAN)
QQKEPVTKM

SEQ ID NO: 100675 - protein, 9 aa, Artificial Sequence
  Description of Artificial Sequence: Synthetic peptide
  Seed: KAHEFIELI (MAGC3_HUMAN)
KMHEFIELK

SEQ ID NO: 100676 - protein, 9 aa, Artificial Sequence
  Description of Artificial Sequence: Synthetic peptide
  Seed: VIWEVLSAI (MAGC3_HUMAN)
VIWEVLSAM

SEQ ID NO: 100677 - protein, 9 aa, Artificial Sequence
  Description of Artificial Sequence: Synthetic peptide
  Seed: TEVDPDHFY (MAGC3_HUMAN)
TMVDPDHFY

SEQ ID NO: 100678 - protein, 9 aa, Artificial Sequence
  Description of Artificial Sequence: Synthetic peptide
  Seed: KVAELVQFL (MAGC3_HUMAN)
KAAELVQFV

SEQ ID NO: 100679 - protein, 10 aa, Artificial Sequence
  Description of Artificial Sequence: Synthetic peptide
  Seed: TWRRGTGYTL (MAGC3_HUMAN)
TYRRGTGYTW

SEQ ID NO: 100680 - protein, 9 aa, Artificial Sequence
  Description of Artificial Sequence: Synthetic peptide
  Seed: AGFADVLSR (MAGC3_HUMAN)
ATFADVLSK

SEQ ID NO: 100681 - protein, 9 aa, Artificial Sequence
  Description of Artificial Sequence: Synthetic peptide
  Seed: KATDKDYSA (MAGC3_HUMAN)
KSTDKDYSM

SEQ ID NO: 100682 - protein, 9 aa, Artificial Sequence
  Description of Artificial Sequence: Synthetic peptide
  Seed: TTDDATAMA (MAGC3_HUMAN)
TADDATAML

SEQ ID NO: 100683 - protein, 10 aa, Artificial Sequence
  Description of Artificial Sequence: Synthetic peptide
  Seed: KDYFPMIFGK (MAGC3_HUMAN)
KTYFPMIFGK

SEQ ID NO: 100684 - protein, 9 aa, Artificial Sequence
  Description of Artificial Sequence: Synthetic peptide
  Seed: VDPDHFYVF (MAGC3_HUMAN)
VLPDHFYVL

SEQ ID NO: 100685 - protein, 10 aa, Artificial Sequence
  Description of Artificial Sequence: Synthetic peptide
  Seed: MQMNVINTYT (MAGC3_HUMAN)
MTMNVINTYM

SEQ ID NO: 100686 - protein, 8 aa, Artificial Sequence
  Description of Artificial Sequence: Synthetic peptide
  Seed: ALPESESL (MAGC3_HUMAN)
AAPESESL

SEQ ID NO: 100687 - protein, 9 aa, Artificial Sequence
  Description of Artificial Sequence: Synthetic peptide
  Seed: SLVLCPTYF (MAGC3_HUMAN)
STVLCPTYW

SEQ ID NO: 100688 - protein, 9 aa, Artificial Sequence
  Description of Artificial Sequence: Synthetic peptide
  Seed: VIWEVLSAI (MAGC3_HUMAN)
VFWEVLSAV

SEQ ID NO: 100689 - protein, 10 aa, Artificial Sequence
  Description of Artificial Sequence: Synthetic peptide
  Seed: KAEMLTTVIK (MAGC3_HUMAN)
KTEMLTTVIK

SEQ ID NO: 100690 - protein, 9 aa, Artificial Sequence
  Description of Artificial Sequence: Synthetic peptide
  Seed: KAHEFIELI (MAGC3_HUMAN)
KRHEFIELV

SEQ ID NO: 100691 - protein, 10 aa, Artificial Sequence
  Description of Artificial Sequence: Synthetic peptide
  Seed: ALDEKVAELV (MAGC3_HUMAN)
AYDEKVAELL

SEQ ID NO: 100692 - protein, 9 aa, Artificial Sequence
  Description of Artificial Sequence: Synthetic peptide
  Seed: DGSLGQWVK (MAGC3_HUMAN)
DSSLGQWVR

SEQ ID NO: 100693 - protein, 9 aa, Artificial Sequence
  Description of Artificial Sequence: Synthetic peptide
  Seed: MIFGKAHEF (MAGC3_HUMAN)
MLFGKAHEF

SEQ ID NO: 100694 - protein, 10 aa, Artificial Sequence
  Description of Artificial Sequence: Synthetic peptide
  Seed: IELIFGIALT (MAGC3_HUMAN)
IALIFGIALA

SEQ ID NO: 100695 - protein, 10 aa, Artificial Sequence
  Description of Artificial Sequence: Synthetic peptide
  Seed: YALSPVVLPP (MAGC3_HUMAN)
YDLSPVVLPM

SEQ ID NO: 100696 - protein, 9 aa, Artificial Sequence
  Description of Artificial Sequence: Synthetic peptide
  Seed: ASEEVIWEV (MAGC3_HUMAN)
ALEEVIWEW

SEQ ID NO: 100697 - protein, 9 aa, Artificial Sequence
  Description of Artificial Sequence: Synthetic peptide
  Seed: QAKEPLTRA (MAGC3_HUMAN)
QIKEPLTRF

SEQ ID NO: 100698 - protein, 11 aa, Artificial Sequence
  Description of Artificial Sequence: Synthetic peptide
  Seed: DMDPDNHSYFF (MAGC3_HUMAN)
DSDPDNHSYFY

SEQ ID NO: 100699 - protein, 9 aa, Artificial Sequence
  Description of Artificial Sequence: Synthetic peptide
  Seed: KYKDYFPMI (MAGC3_HUMAN)
KSKDYFPMV

SEQ ID NO: 100700 - protein, 10 aa, Artificial Sequence
  Description of Artificial Sequence: Synthetic peptide
  Seed: YALSPVVLPP (MAGC3_HUMAN)
YCLSPVVLPL

SEQ ID NO: 100701 - protein, 9 aa, Artificial Sequence
  Description of Artificial Sequence: Synthetic peptide
  Seed: KLVQFLLLK (MAGC3_HUMAN)
KQVQFLLLL

SEQ ID NO: 100702 - protein, 9 aa, Artificial Sequence
  Description of Artificial Sequence: Synthetic peptide
  Seed: TLDEKVDKL (MAGC3_HUMAN)
TQDEKVDKI

SEQ ID NO: 100703 - protein, 9 aa, Artificial Sequence
  Description of Artificial Sequence: Synthetic peptide
  Seed: SQPEGKFSL (MAGC3_HUMAN)
SNPEGKFSL

SEQ ID NO: 100704 - protein, 9 aa, Artificial Sequence
  Description of Artificial Sequence: Synthetic peptide
  Seed: SLVLCPTYF (MAGC3_HUMAN)
SRVLCPTYY

SEQ ID NO: 100705 - protein, 10 aa, Artificial Sequence
  Description of Artificial Sequence: Synthetic peptide
  Seed: EVIWEVLNAI (MAGC3_HUMAN)
EAIWEVLNAW

SEQ ID NO: 100706 - protein, 11 aa, Artificial Sequence
  Description of Artificial Sequence: Synthetic peptide
  Seed: TDMDPDNHSYF (MAGC3_HUMAN)
TEMDPDNHSYF

SEQ ID NO: 100707 - protein, 9 aa, Artificial Sequence
  Description of Artificial Sequence: Synthetic peptide
  Seed: LILSVIFIK (MAGC3_HUMAN)
LTLSVIFIR

SEQ ID NO: 100708 - protein, 10 aa, Artificial Sequence
  Description of Artificial Sequence: Synthetic peptide
  Seed: REVRLFLRGG (MAGC3_HUMAN)
RFVRLFLRGK

SEQ ID NO: 100709 - protein, 10 aa, Artificial Sequence
  Description of Artificial Sequence: Synthetic peptide
  Seed: SWYMDALKDM (MAGC3_HUMAN)
SWYMDALKDF

SEQ ID NO: 100710 - protein, 11 aa, Artificial Sequence
  Description of Artificial Sequence: Synthetic peptide
  Seed: AEMQMNVINTY (MAGC3_HUMAN)
AYMQMNVINTY

SEQ ID NO: 100711 - protein, 9 aa, Artificial Sequence
  Description of Artificial Sequence: Synthetic peptide
  Seed: AHEFIELIF (MAGC3_HUMAN)
AHEFIELIL

SEQ ID NO: 100712 - protein, 10 aa, Artificial Sequence
  Description of Artificial Sequence: Synthetic peptide
  Seed: TCATYALSPV (MAGC3_HUMAN)
TLATYALSPV

SEQ ID NO: 100713 - protein, 9 aa, Artificial Sequence
  Description of Artificial Sequence: Synthetic peptide
  Seed: KAHEFIELI (MAGC3_HUMAN)
KYHEFIELF

SEQ ID NO: 100714 - protein, 9 aa, Artificial Sequence
  Description of Artificial Sequence: Synthetic peptide
  Seed: FSLRRAVSV (MAGC3_HUMAN)
FVLRRAVSI

SEQ ID NO: 100715 - protein, 10 aa, Artificial Sequence
  Description of Artificial Sequence: Synthetic peptide
  Seed: TTDDATAMAS (MAGC3_HUMAN)
TLDDATAMAF

SEQ ID NO: 100716 - protein, 9 aa, Artificial Sequence
  Description of Artificial Sequence: Synthetic peptide
  Seed: MQMNVINTY (MAGC3_HUMAN)
MLMNVINTI

SEQ ID NO: 100717 - protein, 9 aa, Artificial Sequence
  Description of Artificial Sequence: Synthetic peptide
  Seed: MPAAGMPPL (MAGC3_HUMAN)
MVAAGMPPL

SEQ ID NO: 100718 - protein, 10 aa, Artificial Sequence
  Description of Artificial Sequence: Synthetic peptide
  Seed: EVIWEVLNAI (MAGC3_HUMAN)
EVIWEVLNAV

SEQ ID NO: 100719 - protein, 10 aa, Artificial Sequence
  Description of Artificial Sequence: Synthetic peptide
  Seed: YSAFHLGHLR (MAGC3_HUMAN)
YHAFHLGHLR

SEQ ID NO: 100720 - protein, 9 aa, Artificial Sequence
  Description of Artificial Sequence: Synthetic peptide
  Seed: SLPESEPLF (MAGC3_HUMAN)
SLPESEPLI

SEQ ID NO: 100721 - protein, 10 aa, Artificial Sequence
  Description of Artificial Sequence: Synthetic peptide
  Seed: INTYTGYFPM (MAGC3_HUMAN)
IWTYTGYFPF

SEQ ID NO: 100722 - protein, 10 aa, Artificial Sequence
  Description of Artificial Sequence: Synthetic peptide
  Seed: MQMNVINTYT (MAGC3_HUMAN)
MTMNVINTYI

SEQ ID NO: 100723 - protein, 9 aa, Artificial Sequence
  Description of Artificial Sequence: Synthetic peptide
  Seed: FLSKLSSII (MAGC3_HUMAN)
FSSKLSSIF

SEQ ID NO: 100724 - protein, 10 aa, Artificial Sequence
  Description of Artificial Sequence: Synthetic peptide
  Seed: IKKYKDYFPM (MAGC3_HUMAN)
IQKYKDYFPF

SEQ ID NO: 100725 - protein, 9 aa, Artificial Sequence
  Description of Artificial Sequence: Synthetic peptide
  Seed: SEEEDTATW (MAGC3_HUMAN)
SEEEDTATM

SEQ ID NO: 100726 - protein, 10 aa, Artificial Sequence
  Description of Artificial Sequence: Synthetic peptide
  Seed: LILILSVIFI (MAGC3_HUMAN)
LHLILSVIFV

SEQ ID NO: 100727 - protein, 10 aa, Artificial Sequence
  Description of Artificial Sequence: Synthetic peptide
  Seed: KLVQFLLLKY (MAGC3_HUMAN)
KLVQFLLLKW

SEQ ID NO: 100728 - protein, 9 aa, Artificial Sequence
  Description of Artificial Sequence: Synthetic peptide
  Seed: YTGYFPMIF (MAGC3_HUMAN)
YRGYFPMIM

SEQ ID NO: 100729 - protein, 10 aa, Artificial Sequence
  Description of Artificial Sequence: Synthetic peptide
  Seed: YALDEKVAEL (MAGC3_HUMAN)
YALDEKVAET

SEQ ID NO: 100730 - protein, 9 aa, Artificial Sequence
  Description of Artificial Sequence: Synthetic peptide
  Seed: QAKEPLTRA (MAGC3_HUMAN)
QVKEPLTRF

SEQ ID NO: 100731 - protein, 9 aa, Artificial Sequence
  Description of Artificial Sequence: Synthetic peptide
  Seed: LILSVIFIK (MAGC3_HUMAN)
LMLSVIFIR

SEQ ID NO: 100732 - protein, 10 aa, Artificial Sequence
  Description of Artificial Sequence: Synthetic peptide
  Seed: YTLDEKVDKL (MAGC3_HUMAN)
YKLDEKVDKL

SEQ ID NO: 100733 - protein, 9 aa, Artificial Sequence
  Description of Artificial Sequence: Synthetic peptide
  Seed: LIDDQGMPK (MAGC3_HUMAN)
LADDQGMPV

SEQ ID NO: 100734 - protein, 9 aa, Artificial Sequence
  Description of Artificial Sequence: Synthetic peptide
  Seed: VLCPTYFKL (MAGC3_HUMAN)
VMCPTYFKR

SEQ ID NO: 100735 - protein, 9 aa, Artificial Sequence
  Description of Artificial Sequence: Synthetic peptide
  Seed: CATYALSPV (MAGC3_HUMAN)
CVTYALSPI

SEQ ID NO: 100736 - protein, 10 aa, Artificial Sequence
  Description of Artificial Sequence: Synthetic peptide
  Seed: MNVINTYTGY (MAGC3_HUMAN)
MCVINTYTGY

SEQ ID NO: 100737 - protein, 9 aa, Artificial Sequence
  Description of Artificial Sequence: Synthetic peptide
  Seed: AAGMPPLPQ (MAGC3_HUMAN)
AAGMPPLPY

SEQ ID NO: 100738 - protein, 9 aa, Artificial Sequence
  Description of Artificial Sequence: Synthetic peptide
  Seed: HFYVFVNTL (MAGC3_HUMAN)
HEYVFVNTV

SEQ ID NO: 100739 - protein, 10 aa, Artificial Sequence
  Description of Artificial Sequence: Synthetic peptide
  Seed: MDPDNHSYFF (MAGC3_HUMAN)
MKPDNHSYFM

SEQ ID NO: 100740 - protein, 9 aa, Artificial Sequence
  Description of Artificial Sequence: Synthetic peptide
  Seed: YSAFHLGHL (MAGC3_HUMAN)
YAAFHLGHI

SEQ ID NO: 100741 - protein, 9 aa, Artificial Sequence
  Description of Artificial Sequence: Synthetic peptide
  Seed: AVSPGKRLW (MAGC3_HUMAN)
AASPGKRLF

SEQ ID NO: 100742 - protein, 9 aa, Artificial Sequence
  Description of Artificial Sequence: Synthetic peptide
  Seed: YFFEDTLDL (MAGC3_HUMAN)
YRFEDTLDI

SEQ ID NO: 100743 - protein, 9 aa, Artificial Sequence
  Description of Artificial Sequence: Synthetic peptide
  Seed: TAMASASPS (MAGC3_HUMAN)
TCMASASPY

SEQ ID NO: 100744 - protein, 9 aa, Artificial Sequence
  Description of Artificial Sequence: Synthetic peptide
  Seed: VIKKYKDYF (MAGC3_HUMAN)
VTKKYKDYW

SEQ ID NO: 100745 - protein, 8 aa, Artificial Sequence
  Description of Artificial Sequence: Synthetic peptide
  Seed: FADVLSRL (MAGC3_HUMAN)
FSDVLSRV

SEQ ID NO: 100746 - protein, 10 aa, Artificial Sequence
  Description of Artificial Sequence: Synthetic peptide
  Seed: FGKAHEFIEL (MAGC3_HUMAN)
FAKAHEFIEY

SEQ ID NO: 100747 - protein, 9 aa, Artificial Sequence
  Description of Artificial Sequence: Synthetic peptide
  Seed: GSLPESEPL (MAGC3_HUMAN)
GQLPESEPW

SEQ ID NO: 100748 - protein, 9 aa, Artificial Sequence
  Description of Artificial Sequence: Synthetic peptide
  Seed: EVLNAIGPW (MAGC3_HUMAN)
EVLNAIGPM

SEQ ID NO: 100749 - protein, 9 aa, Artificial Sequence
  Description of Artificial Sequence: Synthetic peptide
  Seed: FSDGSLGQW (MAGC3_HUMAN)
FNDGSLGQL

SEQ ID NO: 100750 - protein, 10 aa, Artificial Sequence
  Description of Artificial Sequence: Synthetic peptide
  Seed: MDPDNHSYFF (MAGC3_HUMAN)
MLPDNHSYFM

SEQ ID NO: 100751 - protein, 9 aa, Artificial Sequence
  Description of Artificial Sequence: Synthetic peptide
  Seed: ATDKDYSAF (MAGC3_HUMAN)
ALDKDYSAL

SEQ ID NO: 100752 - protein, 9 aa, Artificial Sequence
  Description of Artificial Sequence: Synthetic peptide
  Seed: ALDEKVAEL (MAGC3_HUMAN)
ANDEKVAEF

SEQ ID NO: 100753 - protein, 9 aa, Artificial Sequence
  Description of Artificial Sequence: Synthetic peptide
  Seed: ATDKDYSAF (MAGC3_HUMAN)
AADKDYSAF

SEQ ID NO: 100754 - protein, 10 aa, Artificial Sequence
  Description of Artificial Sequence: Synthetic peptide
  Seed: HLREVRLFLR (MAGC3_HUMAN)
HFREVRLFLK

SEQ ID NO: 100755 - protein, 9 aa, Artificial Sequence
  Description of Artificial Sequence: Synthetic peptide
  Seed: IIPSAFPSW (MAGC3_HUMAN)
ISPSAFPSW

SEQ ID NO: 100756 - protein, 9 aa, Artificial Sequence
  Description of Artificial Sequence: Synthetic peptide
  Seed: SLRRAVSVK (MAGC3_HUMAN)
SSRRAVSVV

SEQ ID NO: 100757 - protein, 10 aa, Artificial Sequence
  Description of Artificial Sequence: Synthetic peptide
  Seed: AELVQFLLLK (MAGC3_HUMAN)
ALLVQFLLLK

SEQ ID NO: 100758 - protein, 9 aa, Artificial Sequence
  Description of Artificial Sequence: Synthetic peptide
  Seed: QTKEPVTKA (MAGC3_HUMAN)
QTKEPVTKR

SEQ ID NO: 100759 - protein, 10 aa, Artificial Sequence
  Description of Artificial Sequence: Synthetic peptide
  Seed: YTLDEKVDKL (MAGC3_HUMAN)
YTLDEKVDKI

SEQ ID NO: 100760 - protein, 9 aa, Artificial Sequence
  Description of Artificial Sequence: Synthetic peptide
  Seed: VLCPTYFKL (MAGC3_HUMAN)
VACPTYFKI

SEQ ID NO: 100761 - protein, 10 aa, Artificial Sequence
  Description of Artificial Sequence: Synthetic peptide
  Seed: LVLCPTYFKL (MAGC3_HUMAN)
LELCPTYFKV

SEQ ID NO: 100762 - protein, 9 aa, Artificial Sequence
  Description of Artificial Sequence: Synthetic peptide
  Seed: ALDEKVAEL (MAGC3_HUMAN)
ARDEKVAEL

SEQ ID NO: 100763 - protein, 9 aa, Artificial Sequence
  Description of Artificial Sequence: Synthetic peptide
  Seed: HALPESESL (MAGC3_HUMAN)
HVLPESESV

SEQ ID NO: 100764 - protein, 9 aa, Artificial Sequence
  Description of Artificial Sequence: Synthetic peptide
  Seed: SIIPSAFPS (MAGC3_HUMAN)
SIIPSAFPA

SEQ ID NO: 100765 - protein, 9 aa, Artificial Sequence
  Description of Artificial Sequence: Synthetic peptide
  Seed: KLSSIIPSA (MAGC3_HUMAN)
KLSSIIPSF

SEQ ID NO: 100766 - protein, 9 aa, Artificial Sequence
  Description of Artificial Sequence: Synthetic peptide
  Seed: SAFHLGHLR (MAGC3_HUMAN)
SGFHLGHLK

SEQ ID NO: 100767 - protein, 10 aa, Artificial Sequence
  Description of Artificial Sequence: Synthetic peptide
  Seed: LLPCHWVLDA (MAGC3_HUMAN)
LMPCHWVLDV

SEQ ID NO: 100768 - protein, 10 aa, Artificial Sequence
  Description of Artificial Sequence: Synthetic peptide
  Seed: SYFFEDTLDL (MAGC3_HUMAN)
SWFFEDTLDF

SEQ ID NO: 100769 - protein, 10 aa, Artificial Sequence
  Description of Artificial Sequence: Synthetic peptide
  Seed: HLREVRLFLR (MAGC3_HUMAN)
HYREVRLFLK

SEQ ID NO: 100770 - protein, 10 aa, Artificial Sequence
  Description of Artificial Sequence: Synthetic peptide
  Seed: KLVQFLLLKY (MAGC3_HUMAN)
KFVQFLLLKY

SEQ ID NO: 100771 - protein, 10 aa, Artificial Sequence
  Description of Artificial Sequence: Synthetic peptide
  Seed: SAFHLGHLRE (MAGC3_HUMAN)
STFHLGHLRD

SEQ ID NO: 100772 - protein, 9 aa, Artificial Sequence
  Description of Artificial Sequence: Synthetic peptide
  Seed: EVLEFLSKL (MAGC3_HUMAN)
EMLEFLSKA

SEQ ID NO: 100773 - protein, 10 aa, Artificial Sequence
  Description of Artificial Sequence: Synthetic peptide
  Seed: SKLSSIIPSA (MAGC3_HUMAN)
SNLSSIIPSA

SEQ ID NO: 100774 - protein, 9 aa, Artificial Sequence
  Description of Artificial Sequence: Synthetic peptide
  Seed: YFFEDTLDL (MAGC3_HUMAN)
YPFEDTLDF

SEQ ID NO: 100775 - protein, 10 aa, Artificial Sequence
  Description of Artificial Sequence: Synthetic peptide
  Seed: HLREVRLFLR (MAGC3_HUMAN)
HMREVRLFLK

SEQ ID NO: 100776 - protein, 9 aa, Artificial Sequence
  Description of Artificial Sequence: Synthetic peptide
  Seed: YTLDEKVDK (MAGC3_HUMAN)
YVLDEKVDR

SEQ ID NO: 100777 - protein, 9 aa, Artificial Sequence
  Description of Artificial Sequence: Synthetic peptide
  Seed: KNCLLILIL (MAGC3_HUMAN)
KTCLLILIV

SEQ ID NO: 100778 - protein, 10 aa, Artificial Sequence
  Description of Artificial Sequence: Synthetic peptide
  Seed: YTGYFPMIFR (MAGC3_HUMAN)
YPGYFPMIFK

SEQ ID NO: 100779 - protein, 10 aa, Artificial Sequence
  Description of Artificial Sequence: Synthetic peptide
  Seed: FFEDTLDLTY (MAGC3_HUMAN)
FTEDTLDLTF

SEQ ID NO: 100780 - protein, 9 aa, Artificial Sequence
  Description of Artificial Sequence: Synthetic peptide
  Seed: LIDDQGMPK (MAGC3_HUMAN)
LCDDQGMPV

SEQ ID NO: 100781 - protein, 9 aa, Artificial Sequence
  Description of Artificial Sequence: Synthetic peptide
  Seed: TYALSPVVL (MAGC3_HUMAN)
TTALSPVVL

SEQ ID NO: 100782 - protein, 10 aa, Artificial Sequence
  Description of Artificial Sequence: Synthetic peptide
  Seed: AMASASPSVM (MAGC3_HUMAN)
AMASASPSVI

SEQ ID NO: 100783 - protein, 10 aa, Artificial Sequence
  Description of Artificial Sequence: Synthetic peptide
  Seed: YALDEKVAEL (MAGC3_HUMAN)
YYLDEKVAEV

SEQ ID NO: 100784 - protein, 9 aa, Artificial Sequence
  Description of Artificial Sequence: Synthetic peptide
  Seed: TLDEKVDKL (MAGC3_HUMAN)
TSDEKVDKV

SEQ ID NO: 100785 - protein, 9 aa, Artificial Sequence
  Description of Artificial Sequence: Synthetic peptide
  Seed: DMDPDNHSY (MAGC3_HUMAN)
DPDPDNHSY

SEQ ID NO: 100786 - protein, 11 aa, Artificial Sequence
  Description of Artificial Sequence: Synthetic peptide
  Seed: ESLPRYALDEK (MAGC3_HUMAN)
ETLPRYALDER

SEQ ID NO: 100787 - protein, 9 aa, Artificial Sequence
  Description of Artificial Sequence: Synthetic peptide
  Seed: VIWEVLSAI (MAGC3_HUMAN)
VSWEVLSAA

SEQ ID NO: 100788 - protein, 10 aa, Artificial Sequence
  Description of Artificial Sequence: Synthetic peptide
  Seed: MDSLVLCPTY (MAGC3_HUMAN)
MLSLVLCPTY

SEQ ID NO: 100789 - protein, 9 aa, Artificial Sequence
  Description of Artificial Sequence: Synthetic peptide
  Seed: IIPSAFPSW (MAGC3_HUMAN)
IYPSAFPSF

SEQ ID NO: 100790 - protein, 10 aa, Artificial Sequence
  Description of Artificial Sequence: Synthetic peptide
  Seed: KVAELVQFLL (MAGC3_HUMAN)
KRAELVQFLW

SEQ ID NO: 100791 - protein, 9 aa, Artificial Sequence
  Description of Artificial Sequence: Synthetic peptide
  Seed: RPAREVLEF (MAGC3_HUMAN)
RAAREVLEF

SEQ ID NO: 100792 - protein, 9 aa, Artificial Sequence
  Description of Artificial Sequence: Synthetic peptide
  Seed: VLPPQPQPR (MAGC3_HUMAN)
VTPPQPQPL

SEQ ID NO: 100793 - protein, 9 aa, Artificial Sequence
  Description of Artificial Sequence: Synthetic peptide
  Seed: MIFGKAHEF (MAGC3_HUMAN)
MTFGKAHEI

SEQ ID NO: 100794 - protein, 10 aa, Artificial Sequence
  Description of Artificial Sequence: Synthetic peptide
  Seed: TFSDGSLGQW (MAGC3_HUMAN)
TVSDGSLGQW

SEQ ID NO: 100795 - protein, 9 aa, Artificial Sequence
  Description of Artificial Sequence: Synthetic peptide
  Seed: AGFADVLSR (MAGC3_HUMAN)
AYFADVLSR

SEQ ID NO: 100796 - protein, 10 aa, Artificial Sequence
  Description of Artificial Sequence: Synthetic peptide
  Seed: NAIGPWSALA (MAGC3_HUMAN)
NAIGPWSALI

SEQ ID NO: 100797 - protein, 10 aa, Artificial Sequence
  Description of Artificial Sequence: Synthetic peptide
  Seed: MIFRKAREFI (MAGC3_HUMAN)
MLFRKAREFV

SEQ ID NO: 100798 - protein, 9 aa, Artificial Sequence
  Description of Artificial Sequence: Synthetic peptide
  Seed: RGTGYTLSL (MAGC3_HUMAN)
RVTGYTLSW

SEQ ID NO: 100799 - protein, 10 aa, Artificial Sequence
  Description of Artificial Sequence: Synthetic peptide
  Seed: RLLILILSVI (MAGC3_HUMAN)
RNLILILSVV

SEQ ID NO: 100800 - protein, 10 aa, Artificial Sequence
  Description of Artificial Sequence: Synthetic peptide
  Seed: MDPDNHSYFF (MAGC3_HUMAN)
MWPDNHSYFF

SEQ ID NO: 100801 - protein, 10 aa, Artificial Sequence
  Description of Artificial Sequence: Synthetic peptide
  Seed: YTLDEKVDKL (MAGC3_HUMAN)
YVLDEKVDKA

SEQ ID NO: 100802 - protein, 9 aa, Artificial Sequence
  Description of Artificial Sequence: Synthetic peptide
  Seed: HSYFFEDTL (MAGC3_HUMAN)
HGYFFEDTW

SEQ ID NO: 100803 - protein, 9 aa, Artificial Sequence
  Description of Artificial Sequence: Synthetic peptide
  Seed: EFIELIFGI (MAGC3_HUMAN)
ESIELIFGI

SEQ ID NO: 100804 - protein, 10 aa, Artificial Sequence
  Description of Artificial Sequence: Synthetic peptide
  Seed: MNVINTYTGY (MAGC3_HUMAN)
MTVINTYTGM

SEQ ID NO: 100805 - protein, 9 aa, Artificial Sequence
  Description of Artificial Sequence: Synthetic peptide
  Seed: SLRRAVSVK (MAGC3_HUMAN)
STRRAVSVG

SEQ ID NO: 100806 - protein, 9 aa, Artificial Sequence
  Description of Artificial Sequence: Synthetic peptide
  Seed: KYKDYFPMI (MAGC3_HUMAN)
KFKDYFPMF

SEQ ID NO: 100807 - protein, 9 aa, Artificial Sequence
  Description of Artificial Sequence: Synthetic peptide
  Seed: EVLSAIGPI (MAGC3_HUMAN)
ESLSAIGPR

SEQ ID NO: 100808 - protein, 9 aa, Artificial Sequence
  Description of Artificial Sequence: Synthetic peptide
  Seed: MIFGKAHEF (MAGC3_HUMAN)
MYFGKAHEM

SEQ ID NO: 100809 - protein, 10 aa, Artificial Sequence
  Description of Artificial Sequence: Synthetic peptide
  Seed: MLLPCHWVLD (MAGC3_HUMAN)
MLLPCHWVLM

SEQ ID NO: 100810 - protein, 9 aa, Artificial Sequence
  Description of Artificial Sequence: Synthetic peptide
  Seed: ATYALSPVV (MAGC3_HUMAN)
ALYALSPVL

SEQ ID NO: 100811 - protein, 9 aa, Artificial Sequence
  Description of Artificial Sequence: Synthetic peptide
  Seed: EVIWEVLSA (MAGC3_HUMAN)
ETIWEVLSA

SEQ ID NO: 100812 - protein, 10 aa, Artificial Sequence
  Description of Artificial Sequence: Synthetic peptide
  Seed: EKVAELVQFL (MAGC3_HUMAN)
EVVAELVQFA

SEQ ID NO: 100813 - protein, 9 aa, Artificial Sequence
  Description of Artificial Sequence: Synthetic peptide
  Seed: HFYVFVNTL (MAGC3_HUMAN)
HVYVFVNTF

SEQ ID NO: 100814 - protein, 10 aa, Artificial Sequence
  Description of Artificial Sequence: Synthetic peptide
  Seed: MIFGKAHEFI (MAGC3_HUMAN)
MTFGKAHEFA

SEQ ID NO: 100815 - protein, 9 aa, Artificial Sequence
  Description of Artificial Sequence: Synthetic peptide
  Seed: SLPESEPLF (MAGC3_HUMAN)
SFPESEPLY

SEQ ID NO: 100816 - protein, 9 aa, Artificial Sequence
  Description of Artificial Sequence: Synthetic peptide
  Seed: TTDDATAMA (MAGC3_HUMAN)
TYDDATAML

SEQ ID NO: 100817 - protein, 9 aa, Artificial Sequence
  Description of Artificial Sequence: Synthetic peptide
  Seed: YSAFHLGHL (MAGC3_HUMAN)
YWAFHLGHY

SEQ ID NO: 100818 - protein, 9 aa, Artificial Sequence
  Description of Artificial Sequence: Synthetic peptide
  Seed: AMASASPSV (MAGC3_HUMAN)
AMASASPSA

SEQ ID NO: 100819 - protein, 10 aa, Artificial Sequence
  Description of Artificial Sequence: Synthetic peptide
  Seed: FGKAHEFIEL (MAGC3_HUMAN)
FLKAHEFIEL

SEQ ID NO: 100820 - protein, 9 aa, Artificial Sequence
  Description of Artificial Sequence: Synthetic peptide
  Seed: EVLEFLSKL (MAGC3_HUMAN)
ESLEFLSKV

SEQ ID NO: 100821 - protein, 11 aa, Artificial Sequence
  Description of Artificial Sequence: Synthetic peptide
  Seed: LDSCSSPLLWT (MAGC3_HUMAN)
LISCSSPLLWW

SEQ ID NO: 100822 - protein, 9 aa, Artificial Sequence
  Description of Artificial Sequence: Synthetic peptide
  Seed: LSGSPGLQL (MAGC3_HUMAN)
LSGSPGLQI

SEQ ID NO: 100823 - protein, 9 aa, Artificial Sequence
  Description of Artificial Sequence: Synthetic peptide
  Seed: CSSPLLWTR (MAGC3_HUMAN)
CTSPLLWTR

SEQ ID NO: 100824 - protein, 10 aa, Artificial Sequence
  Description of Artificial Sequence: Synthetic peptide
  Seed: YALDEKVAEL (MAGC3_HUMAN)
YALDEKVAEF

SEQ ID NO: 100825 - protein, 9 aa, Artificial Sequence
  Description of Artificial Sequence: Synthetic peptide
  Seed: ISPQGPPQS (MAGC3_HUMAN)
IMPQGPPQF

SEQ ID NO: 100826 - protein, 9 aa, Artificial Sequence
  Description of Artificial Sequence: Synthetic peptide
  Seed: ISPQGPPQS (MAGC3_HUMAN)
ITPQGPPQV

SEQ ID NO: 100827 - protein, 10 aa, Artificial Sequence
  Description of Artificial Sequence: Synthetic peptide
  Seed: YALDEKVAEL (MAGC3_HUMAN)
YPLDEKVAEM

SEQ ID NO: 100828 - protein, 9 aa, Artificial Sequence
  Description of Artificial Sequence: Synthetic peptide
  Seed: EVDPDHFYV (MAGC3_HUMAN)
EADPDHFYY

SEQ ID NO: 100829 - protein, 10 aa, Artificial Sequence
  Description of Artificial Sequence: Synthetic peptide
  Seed: VLNAIGPWSA (MAGC3_HUMAN)
VLNAIGPWSV

SEQ ID NO: 100830 - protein, 9 aa, Artificial Sequence
  Description of Artificial Sequence: Synthetic peptide
  Seed: KYKDYFPMI (MAGC3_HUMAN)
KIKDYFPMM

SEQ ID NO: 100831 - protein, 10 aa, Artificial Sequence
  Description of Artificial Sequence: Synthetic peptide
  Seed: MDPDNHSYFF (MAGC3_HUMAN)
MAPDNHSYFY

SEQ ID NO: 100832 - protein, 9 aa, Artificial Sequence
  Description of Artificial Sequence: Synthetic peptide
  Seed: SLVLCPTYF (MAGC3_HUMAN)
SLVLCPTYY

SEQ ID NO: 100833 - protein, 11 aa, Artificial Sequence
  Description of Artificial Sequence: Synthetic peptide
  Seed: INTYTGYFPMI (MAGC3_HUMAN)
IYTYTGYFPMF

SEQ ID NO: 100834 - protein, 11 aa, Artificial Sequence
  Description of Artificial Sequence: Synthetic peptide
  Seed: KVAELVQFLLL (MAGC3_HUMAN)
KLAELVQFLLW

SEQ ID NO: 100835 - protein, 8 aa, Artificial Sequence
  Description of Artificial Sequence: Synthetic peptide
  Seed: SSIIPSAF (MAGC3_HUMAN)
SMIIPSAY

SEQ ID NO: 100836 - protein, 9 aa, Artificial Sequence
  Description of Artificial Sequence: Synthetic peptide
  Seed: IIPSAFPSW (MAGC3_HUMAN)
IMPSAFPSF

SEQ ID NO: 100837 - protein, 11 aa, Artificial Sequence
  Description of Artificial Sequence: Synthetic peptide
  Seed: SKLSSIIPSAF (MAGC3_HUMAN)
SKLSSIIPSAY

SEQ ID NO: 100838 - protein, 9 aa, Artificial Sequence
  Description of Artificial Sequence: Synthetic peptide
  Seed: EFIELIFGI (MAGC3_HUMAN)
ETIELIFGI

SEQ ID NO: 100839 - protein, 9 aa, Artificial Sequence
  Description of Artificial Sequence: Synthetic peptide
  Seed: SPSVMSTNF (MAGC3_HUMAN)
SPSVMSTNL

SEQ ID NO: 100840 - protein, 9 aa, Artificial Sequence
  Description of Artificial Sequence: Synthetic peptide
  Seed: FSDGSLGQW (MAGC3_HUMAN)
FPDGSLGQL

SEQ ID NO: 100841 - protein, 10 aa, Artificial Sequence
  Description of Artificial Sequence: Synthetic peptide
  Seed: LVLCPTYFKL (MAGC3_HUMAN)
LMLCPTYFKL

SEQ ID NO: 100842 - protein, 9 aa, Artificial Sequence
  Description of Artificial Sequence: Synthetic peptide
  Seed: MIFIKGSCV (MAGC3_HUMAN)
MLFIKGSCI

SEQ ID NO: 100843 - protein, 9 aa, Artificial Sequence
  Description of Artificial Sequence: Synthetic peptide
  Seed: VIWEVLSAI (MAGC3_HUMAN)
VLWEVLSAS

SEQ ID NO: 100844 - protein, 9 aa, Artificial Sequence
  Description of Artificial Sequence: Synthetic peptide
  Seed: VLPPQPQPR (MAGC3_HUMAN)
VLPPQPQPV

SEQ ID NO: 100845 - protein, 9 aa, Artificial Sequence
  Description of Artificial Sequence: Synthetic peptide
  Seed: FADVLSRLA (MAGC3_HUMAN)
FADVLSRLM

SEQ ID NO: 100846 - protein, 9 aa, Artificial Sequence
  Description of Artificial Sequence: Synthetic peptide
  Seed: NTYTGYFPM (MAGC3_HUMAN)
NSYTGYFPK

SEQ ID NO: 100847 - protein, 9 aa, Artificial Sequence
  Description of Artificial Sequence: Synthetic peptide
  Seed: ILILSVIFI (MAGC3_HUMAN)
IMILSVIFM

SEQ ID NO: 100848 - protein, 9 aa, Artificial Sequence
  Description of Artificial Sequence: Synthetic peptide
  Seed: TYFKLWRTL (MAGC3_HUMAN)
TSFKLWRTY

SEQ ID NO: 100849 - protein, 10 aa, Artificial Sequence
  Description of Artificial Sequence: Synthetic peptide
  Seed: IKKYKDYFPM (MAGC3_HUMAN)
ICKYKDYFPF

SEQ ID NO: 100850 - protein, 10 aa, Artificial Sequence
  Description of Artificial Sequence: Synthetic peptide
  Seed: YALDEKVAEL (MAGC3_HUMAN)
YALDEKVAEI

SEQ ID NO: 100851 - protein, 10 aa, Artificial Sequence
  Description of Artificial Sequence: Synthetic peptide
  Seed: MQMNVINTYT (MAGC3_HUMAN)
MNMNVINTYY

SEQ ID NO: 100852 - protein, 9 aa, Artificial Sequence
  Description of Artificial Sequence: Synthetic peptide
  Seed: FHLGHLREV (MAGC3_HUMAN)
FHLGHLREA

SEQ ID NO: 100853 - protein, 9 aa, Artificial Sequence
  Description of Artificial Sequence: Synthetic peptide
  Seed: RGTGYTLSL (MAGC3_HUMAN)
RKTGYTLSI

SEQ ID NO: 100854 - protein, 11 aa, Artificial Sequence
  Description of Artificial Sequence: Synthetic peptide
  Seed: KVAELVQFLLL (MAGC3_HUMAN)
KMAELVQFLLG

SEQ ID NO: 100855 - protein, 9 aa, Artificial Sequence
  Description of Artificial Sequence: Synthetic peptide
  Seed: EFIELIFGI (MAGC3_HUMAN)
ETIELIFGV

SEQ ID NO: 100856 - protein, 9 aa, Artificial Sequence
  Description of Artificial Sequence: Synthetic peptide
  Seed: FSDGSLGQW (MAGC3_HUMAN)
FFDGSLGQV

SEQ ID NO: 100857 - protein, 10 aa, Artificial Sequence
  Description of Artificial Sequence: Synthetic peptide
  Seed: REVLEFLSKL (MAGC3_HUMAN)
RLVLEFLSKI

SEQ ID NO: 100858 - protein, 10 aa, Artificial Sequence
  Description of Artificial Sequence: Synthetic peptide
  Seed: MNVINTYTGY (MAGC3_HUMAN)
MFVINTYTGK

SEQ ID NO: 100859 - protein, 9 aa, Artificial Sequence
  Description of Artificial Sequence: Synthetic peptide
  Seed: AIGPWSALA (MAGC3_HUMAN)
AMGPWSALT

SEQ ID NO: 100860 - protein, 8 aa, Artificial Sequence
  Description of Artificial Sequence: Synthetic peptide
  Seed: KVDKLVQF (MAGC3_HUMAN)
KIDKLVQL

SEQ ID NO: 100861 - protein, 9 aa, Artificial Sequence
  Description of Artificial Sequence: Synthetic peptide
  Seed: KVDKLVQFL (MAGC3_HUMAN)
KLDKLVQFY

SEQ ID NO: 100862 - protein, 9 aa, Artificial Sequence
  Description of Artificial Sequence: Synthetic peptide
  Seed: ATYALSPVV (MAGC3_HUMAN)
ATYALSPVM

SEQ ID NO: 100863 - protein, 10 aa, Artificial Sequence
  Description of Artificial Sequence: Synthetic peptide
  Seed: LPTWRRGTGY (MAGC3_HUMAN)
LETWRRGTGW

SEQ ID NO: 100864 - protein, 9 aa, Artificial Sequence
  Description of Artificial Sequence: Synthetic peptide
  Seed: FPSWYMDAL (MAGC3_HUMAN)
FQSWYMDAL

SEQ ID NO: 100865 - protein, 10 aa, Artificial Sequence
  Description of Artificial Sequence: Synthetic peptide
  Seed: REVRLFLRGG (MAGC3_HUMAN)
RTVRLFLRGA

SEQ ID NO: 100866 - protein, 10 aa, Artificial Sequence
  Description of Artificial Sequence: Synthetic peptide
  Seed: YALDEKVAEL (MAGC3_HUMAN)
YHLDEKVAEL

SEQ ID NO: 100867 - protein, 10 aa, Artificial Sequence
  Description of Artificial Sequence: Synthetic peptide
  Seed: MQMNVINTYT (MAGC3_HUMAN)
MMMNVINTYD

SEQ ID NO: 100868 - protein, 8 aa, Artificial Sequence
  Description of Artificial Sequence: Synthetic peptide
  Seed: ILILSMIF (MAGC3_HUMAN)
IQILSMIY

SEQ ID NO: 100869 - protein, 10 aa, Artificial Sequence
  Description of Artificial Sequence: Synthetic peptide
  Seed: SIIPSAFPSW (MAGC3_HUMAN)
SVIPSAFPSW

SEQ ID NO: 100870 - protein, 10 aa, Artificial Sequence
  Description of Artificial Sequence: Synthetic peptide
  Seed: SLVLCPTYFK (MAGC3_HUMAN)
SKVLCPTYFR

SEQ ID NO: 100871 - protein, 11 aa, Artificial Sequence
  Description of Artificial Sequence: Synthetic peptide
  Seed: LTDMDPDNHSY (MAGC3_HUMAN)
LMDMDPDNHSY

SEQ ID NO: 100872 - protein, 10 aa, Artificial Sequence
  Description of Artificial Sequence: Synthetic peptide
  Seed: LILILSMIFI (MAGC3_HUMAN)
LLLILSMIFV

SEQ ID NO: 100873 - protein, 10 aa, Artificial Sequence
  Description of Artificial Sequence: Synthetic peptide
  Seed: YSAFHLGHLR (MAGC3_HUMAN)
YQAFHLGHLR

SEQ ID NO: 100874 - protein, 10 aa, Artificial Sequence
  Description of Artificial Sequence: Synthetic peptide
  Seed: SAFHLGHLRE (MAGC3_HUMAN)
SSFHLGHLRK

SEQ ID NO: 100875 - protein, 10 aa, Artificial Sequence
  Description of Artificial Sequence: Synthetic peptide
  Seed: TAMASASPSV (MAGC3_HUMAN)
TIMASASPSL

SEQ ID NO: 100876 - protein, 10 aa, Artificial Sequence
  Description of Artificial Sequence: Synthetic peptide
  Seed: MDSLVLCPTY (MAGC3_HUMAN)
MTSLVLCPTF

SEQ ID NO: 100877 - protein, 9 aa, Artificial Sequence
  Description of Artificial Sequence: Synthetic peptide
  Seed: SLRRAVSVK (MAGC3_HUMAN)
SSRRAVSVR

SEQ ID NO: 100878 - protein, 10 aa, Artificial Sequence
  Description of Artificial Sequence: Synthetic peptide
  Seed: KAHEFIELIF (MAGC3_HUMAN)
KQHEFIELIM

SEQ ID NO: 100879 - protein, 9 aa, Artificial Sequence
  Description of Artificial Sequence: Synthetic peptide
  Seed: FSLRRAVSV (MAGC3_HUMAN)
FALRRAVSA

SEQ ID NO: 100880 - protein, 9 aa, Artificial Sequence
  Description of Artificial Sequence: Synthetic peptide
  Seed: WESEGPEAF (MAGC3_HUMAN)
WQSEGPEAF

SEQ ID NO: 100881 - protein, 9 aa, Artificial Sequence
  Description of Artificial Sequence: Synthetic peptide
  Seed: MLLPCHWVL (MAGC3_HUMAN)
MILPCHWVV

SEQ ID NO: 100882 - protein, 10 aa, Artificial Sequence
  Description of Artificial Sequence: Synthetic peptide
  Seed: EPQDWPLNEK (MAGC3_HUMAN)
ESQDWPLNER

SEQ ID NO: 100883 - protein, 9 aa, Artificial Sequence
  Description of Artificial Sequence: Synthetic peptide
  Seed: IIPSAFPSW (MAGC3_HUMAN)
IIPSAFPSI

SEQ ID NO: 100884 - protein, 9 aa, Artificial Sequence
  Description of Artificial Sequence: Synthetic peptide
  Seed: MEDRAQAII (MAGC3_HUMAN)
MSDRAQAIM

SEQ ID NO: 100885 - protein, 9 aa, Artificial Sequence
  Description of Artificial Sequence: Synthetic peptide
  Seed: GFADVLSRL (MAGC3_HUMAN)
GVADVLSRA

SEQ ID NO: 100886 - protein, 10 aa, Artificial Sequence
  Description of Artificial Sequence: Synthetic peptide
  Seed: CASEEVIWEV (MAGC3_HUMAN)
CTSEEVIWEV

SEQ ID NO: 100887 - protein, 10 aa, Artificial Sequence
  Description of Artificial Sequence: Synthetic peptide
  Seed: ILILSMIFIK (MAGC3_HUMAN)
ISILSMIFIR

SEQ ID NO: 100888 - protein, 9 aa, Artificial Sequence
  Description of Artificial Sequence: Synthetic peptide
  Seed: MDPDNHSYF (MAGC3_HUMAN)
MYPDNHSYL

SEQ ID NO: 100889 - protein, 9 aa, Artificial Sequence
  Description of Artificial Sequence: Synthetic peptide
  Seed: KLSSIIPSA (MAGC3_HUMAN)
KSSSIIPSI

SEQ ID NO: 100890 - protein, 9 aa, Artificial Sequence
  Description of Artificial Sequence: Synthetic peptide
  Seed: FHLGHLREV (MAGC3_HUMAN)
FFLGHLREI

SEQ ID NO: 100891 - protein, 9 aa, Artificial Sequence
  Description of Artificial Sequence: Synthetic peptide
  Seed: SLPAVSPGK (MAGC3_HUMAN)
SAPAVSPGM

SEQ ID NO: 100892 - protein, 10 aa, Artificial Sequence
  Description of Artificial Sequence: Synthetic peptide
  Seed: SIIPSAFPSW (MAGC3_HUMAN)
SLIPSAFPSY

SEQ ID NO: 100893 - protein, 10 aa, Artificial Sequence
  Description of Artificial Sequence: Synthetic peptide
  Seed: IKKYKDYFPM (MAGC3_HUMAN)
IGKYKDYFPF

SEQ ID NO: 100894 - protein, 9 aa, Artificial Sequence
  Description of Artificial Sequence: Synthetic peptide
  Seed: VINTYTGYF (MAGC3_HUMAN)
VNNTYTGYY

SEQ ID NO: 100895 - protein, 9 aa, Artificial Sequence
  Description of Artificial Sequence: Synthetic peptide
  Seed: YQTKEPVTK (MAGC3_HUMAN)
YMTKEPVTR

SEQ ID NO: 100896 - protein, 10 aa, Artificial Sequence
  Description of Artificial Sequence: Synthetic peptide
  Seed: KVDKLVQFLL (MAGC3_HUMAN)
KLDKLVQFLM

SEQ ID NO: 100897 - protein, 9 aa, Artificial Sequence
  Description of Artificial Sequence: Synthetic peptide
  Seed: YKDYFPMIF (MAGC3_HUMAN)
YKDYFPMIL

SEQ ID NO: 100898 - protein, 9 aa, Artificial Sequence
  Description of Artificial Sequence: Synthetic peptide
  Seed: FHLGHLREV (MAGC3_HUMAN)
FYLGHLREI

SEQ ID NO: 100899 - protein, 9 aa, Artificial Sequence
  Description of Artificial Sequence: Synthetic peptide
  Seed: LSGSPGLQL (MAGC3_HUMAN)
LTGSPGLQW

SEQ ID NO: 100900 - protein, 8 aa, Artificial Sequence
  Description of Artificial Sequence: Synthetic peptide
  Seed: MEDRAQAI (MAGC3_HUMAN)
MTDRAQAF

SEQ ID NO: 100901 - protein, 9 aa, Artificial Sequence
  Description of Artificial Sequence: Synthetic peptide
  Seed: GSLPESEPL (MAGC3_HUMAN)
GILPESEPY

SEQ ID NO: 100902 - protein, 10 aa, Artificial Sequence
  Description of Artificial Sequence: Synthetic peptide
  Seed: MDPDNHSYFF (MAGC3_HUMAN)
MYPDNHSYFL

SEQ ID NO: 100903 - protein, 8 aa, Artificial Sequence
  Description of Artificial Sequence: Synthetic peptide
  Seed: TTDDATAM (MAGC3_HUMAN)
TSDDATAI

SEQ ID NO: 100904 - protein, 10 aa, Artificial Sequence
  Description of Artificial Sequence: Synthetic peptide
  Seed: AFPSWYMDAL (MAGC3_HUMAN)
AMPSWYMDAM

SEQ ID NO: 100905 - protein, 8 aa, Artificial Sequence
  Description of Artificial Sequence: Synthetic peptide
  Seed: AEMLTTVI (MAGC3_HUMAN)
AQMLTTVL

SEQ ID NO: 100906 - protein, 10 aa, Artificial Sequence
  Description of Artificial Sequence: Synthetic peptide
  Seed: YALSPVVLPP (MAGC3_HUMAN)
YTLSPVVLPT

SEQ ID NO: 100907 - protein, 9 aa, Artificial Sequence
  Description of Artificial Sequence: Synthetic peptide
  Seed: AGFADVLSR (MAGC3_HUMAN)
AVFADVLSF

SEQ ID NO: 100908 - protein, 11 aa, Artificial Sequence
  Description of Artificial Sequence: Synthetic peptide
  Seed: FIELIFGIALT (MAGC3_HUMAN)
FCELIFGIALI

SEQ ID NO: 100909 - protein, 10 aa, Artificial Sequence
  Description of Artificial Sequence: Synthetic peptide
  Seed: IELIFGIALT (MAGC3_HUMAN)
IRLIFGIALA

SEQ ID NO: 100910 - protein, 9 aa, Artificial Sequence
  Description of Artificial Sequence: Synthetic peptide
  Seed: TGYFPMIFR (MAGC3_HUMAN)
TFYFPMIFR

SEQ ID NO: 100911 - protein, 10 aa, Artificial Sequence
  Description of Artificial Sequence: Synthetic peptide
  Seed: DMDPDNHSYF (MAGC3_HUMAN)
DSDPDNHSYY

SEQ ID NO: 100912 - protein, 10 aa, Artificial Sequence
  Description of Artificial Sequence: Synthetic peptide
  Seed: MQMNVINTYT (MAGC3_HUMAN)
MQMNVINTYF

SEQ ID NO: 100913 - protein, 10 aa, Artificial Sequence
  Description of Artificial Sequence: Synthetic peptide
  Seed: ALAGFADVLS (MAGC3_HUMAN)
AMAGFADVLI

SEQ ID NO: 100914 - protein, 9 aa, Artificial Sequence
  Description of Artificial Sequence: Synthetic peptide
  Seed: SLPAVSPGK (MAGC3_HUMAN)
STPAVSPGK

SEQ ID NO: 100915 - protein, 9 aa, Artificial Sequence
  Description of Artificial Sequence: Synthetic peptide
  Seed: MDPDNHSYF (MAGC3_HUMAN)
MRPDNHSYM

SEQ ID NO: 100916 - protein, 10 aa, Artificial Sequence
  Description of Artificial Sequence: Synthetic peptide
  Seed: SKLSSIIPSA (MAGC3_HUMAN)
SFLSSIIPSV

SEQ ID NO: 100917 - protein, 10 aa, Artificial Sequence
  Description of Artificial Sequence: Synthetic peptide
  Seed: LLKYQAKEPL (MAGC3_HUMAN)
LTKYQAKEPF

SEQ ID NO: 100918 - protein, 9 aa, Artificial Sequence
  Description of Artificial Sequence: Synthetic peptide
  Seed: LLILILSMI (MAGC3_HUMAN)
LIILILSMV

SEQ ID NO: 100919 - protein, 9 aa, Artificial Sequence
  Description of Artificial Sequence: Synthetic peptide
  Seed: YTGYFPMIF (MAGC3_HUMAN)
YPGYFPMIF

SEQ ID NO: 100920 - protein, 9 aa, Artificial Sequence
  Description of Artificial Sequence: Synthetic peptide
  Seed: ALDEKVAEL (MAGC3_HUMAN)
AIDEKVAEY

SEQ ID NO: 100921 - protein, 9 aa, Artificial Sequence
  Description of Artificial Sequence: Synthetic peptide
  Seed: VIWEVLSAI (MAGC3_HUMAN)
VLWEVLSAR

SEQ ID NO: 100922 - protein, 10 aa, Artificial Sequence
  Description of Artificial Sequence: Synthetic peptide
  Seed: EEVIWEVLNA (MAGC3_HUMAN)
EYVIWEVLNV

SEQ ID NO: 100923 - protein, 9 aa, Artificial Sequence
  Description of Artificial Sequence: Synthetic peptide
  Seed: EVIWEVLNA (MAGC3_HUMAN)
EAIWEVLNK

SEQ ID NO: 100924 - protein, 10 aa, Artificial Sequence
  Description of Artificial Sequence: Synthetic peptide
  Seed: REVRLFLRGG (MAGC3_HUMAN)
RDVRLFLRGA

SEQ ID NO: 100925 - protein, 9 aa, Artificial Sequence
  Description of Artificial Sequence: Synthetic peptide
  Seed: QTKEPVTKA (MAGC3_HUMAN)
QAKEPVTKK

SEQ ID NO: 100926 - protein, 9 aa, Artificial Sequence
  Description of Artificial Sequence: Synthetic peptide
  Seed: ALAGFADVL (MAGC3_HUMAN)
ALAGFADVV

SEQ ID NO: 100927 - protein, 9 aa, Artificial Sequence
  Description of Artificial Sequence: Synthetic peptide
  Seed: NTYTGYFPM (MAGC3_HUMAN)
NAYTGYFPR

SEQ ID NO: 100928 - protein, 9 aa, Artificial Sequence
  Description of Artificial Sequence: Synthetic peptide
  Seed: YQAKEPLTR (MAGC3_HUMAN)
YVAKEPLTY

SEQ ID NO: 100929 - protein, 10 aa, Artificial Sequence
  Description of Artificial Sequence: Synthetic peptide
  Seed: EVIWEVLNAI (MAGC3_HUMAN)
EYIWEVLNAL

SEQ ID NO: 100930 - protein, 10 aa, Artificial Sequence
  Description of Artificial Sequence: Synthetic peptide
  Seed: VLDLANPQGL (MAGC3_HUMAN)
VYDLANPQGL

SEQ ID NO: 100931 - protein, 10 aa, Artificial Sequence
  Description of Artificial Sequence: Synthetic peptide
  Seed: KYKDYFPMIF (MAGC3_HUMAN)
KAKDYFPMIY

SEQ ID NO: 100932 - protein, 9 aa, Artificial Sequence
  Description of Artificial Sequence: Synthetic peptide
  Seed: LIDDQGMPK (MAGC3_HUMAN)
LWDDQGMPL

SEQ ID NO: 100933 - protein, 9 aa, Artificial Sequence
  Description of Artificial Sequence: Synthetic peptide
  Seed: LDSCSSPLL (MAGC3_HUMAN)
LESCSSPLL

SEQ ID NO: 100934 - protein, 9 aa, Artificial Sequence
  Description of Artificial Sequence: Synthetic peptide
  Seed: TLDEKVDKL (MAGC3_HUMAN)
TLDEKVDKY

SEQ ID NO: 100935 - protein, 10 aa, Artificial Sequence
  Description of Artificial Sequence: Synthetic peptide
  Seed: ATYALSPVVL (MAGC3_HUMAN)
ASYALSPVVM

SEQ ID NO: 100936 - protein, 11 aa, Artificial Sequence
  Description of Artificial Sequence: Synthetic peptide
  Seed: FADVLSRLALW (MAGC3_HUMAN)
FSDVLSRLALW

SEQ ID NO: 100937 - protein, 9 aa, Artificial Sequence
  Description of Artificial Sequence: Synthetic peptide
  Seed: MPAAGMPPL (MAGC3_HUMAN)
MPAAGMPPT

SEQ ID NO: 100938 - protein, 9 aa, Artificial Sequence
  Description of Artificial Sequence: Synthetic peptide
  Seed: MQMNVINTY (MAGC3_HUMAN)
MVMNVINTY

SEQ ID NO: 100939 - protein, 9 aa, Artificial Sequence
  Description of Artificial Sequence: Synthetic peptide
  Seed: EKVDKLVQF (MAGC3_HUMAN)
ERVDKLVQM

SEQ ID NO: 100940 - protein, 8 aa, Artificial Sequence
  Description of Artificial Sequence: Synthetic peptide
  Seed: MEDRAQAI (MAGC3_HUMAN)
MTDRAQAL

SEQ ID NO: 100941 - protein, 9 aa, Artificial Sequence
  Description of Artificial Sequence: Synthetic peptide
  Seed: TTDDATAMA (MAGC3_HUMAN)
TMDDATAMI

SEQ ID NO: 100942 - protein, 9 aa, Artificial Sequence
  Description of Artificial Sequence: Synthetic peptide
  Seed: VLPPQPQPR (MAGC3_HUMAN)
VFPPQPQPF

SEQ ID NO: 100943 - protein, 11 aa, Artificial Sequence
  Description of Artificial Sequence: Synthetic peptide
  Seed: TYTGYFPMIFR (MAGC3_HUMAN)
TVTGYFPMIFR

SEQ ID NO: 100944 - protein, 9 aa, Artificial Sequence
  Description of Artificial Sequence: Synthetic peptide
  Seed: KGSCVPEEV (MAGC3_HUMAN)
KLSCVPEEL

SEQ ID NO: 100945 - protein, 10 aa, Artificial Sequence
  Description of Artificial Sequence: Synthetic peptide
  Seed: RPAREVLEFL (MAGC3_HUMAN)
RSAREVLEFK

SEQ ID NO: 100946 - protein, 10 aa, Artificial Sequence
  Description of Artificial Sequence: Synthetic peptide
  Seed: FFEDTLDLTY (MAGC3_HUMAN)
FMEDTLDLTM

SEQ ID NO: 100947 - protein, 9 aa, Artificial Sequence
  Description of Artificial Sequence: Synthetic peptide
  Seed: SQPEGKFSL (MAGC3_HUMAN)
SLPEGKFSI

SEQ ID NO: 100948 - protein, 9 aa, Artificial Sequence
  Description of Artificial Sequence: Synthetic peptide
  Seed: FPSWYMDAL (MAGC3_HUMAN)
FASWYMDAV

SEQ ID NO: 100949 - protein, 9 aa, Artificial Sequence
  Description of Artificial Sequence: Synthetic peptide
  Seed: SLVLCPTYF (MAGC3_HUMAN)
SSVLCPTYL

SEQ ID NO: 100950 - protein, 9 aa, Artificial Sequence
  Description of Artificial Sequence: Synthetic peptide
  Seed: SASPSVMST (MAGC3_HUMAN)
SVSPSVMSL

SEQ ID NO: 100951 - protein, 11 aa, Artificial Sequence
  Description of Artificial Sequence: Synthetic peptide
  Seed: RTLSGSPGLQL (MAGC3_HUMAN)
RSLSGSPGLQW

SEQ ID NO: 100952 - protein, 9 aa, Artificial Sequence
  Description of Artificial Sequence: Synthetic peptide
  Seed: MIFRKAREF (MAGC3_HUMAN)
MVFRKAREM

SEQ ID NO: 100953 - protein, 9 aa, Artificial Sequence
  Description of Artificial Sequence: Synthetic peptide
  Seed: MPAAGMPPL (MAGC3_HUMAN)
MVAAGMPPY

SEQ ID NO: 100954 - protein, 9 aa, Artificial Sequence
  Description of Artificial Sequence: Synthetic peptide
  Seed: ALDEKVAEL (MAGC3_HUMAN)
ALDEKVAEW

SEQ ID NO: 100955 - protein, 9 aa, Artificial Sequence
  Description of Artificial Sequence: Synthetic peptide
  Seed: ELVQFLLLK (MAGC3_HUMAN)
EYVQFLLLK

SEQ ID NO: 100956 - protein, 9 aa, Artificial Sequence
  Description of Artificial Sequence: Synthetic peptide
  Seed: DTTDDATAM (MAGC3_HUMAN)
DITDDATAR

SEQ ID NO: 100957 - protein, 9 aa, Artificial Sequence
  Description of Artificial Sequence: Synthetic peptide
  Seed: YTGYFPMIF (MAGC3_HUMAN)
YSGYFPMIV

SEQ ID NO: 100958 - protein, 9 aa, Artificial Sequence
  Description of Artificial Sequence: Synthetic peptide
  Seed: EVLEFLSKL (MAGC3_HUMAN)
EILEFLSKL

SEQ ID NO: 100959 - protein, 10 aa, Artificial Sequence
  Description of Artificial Sequence: Synthetic peptide
  Seed: LIFGIALTDM (MAGC3_HUMAN)
LVFGIALTDI

SEQ ID NO: 100960 - protein, 9 aa, Artificial Sequence
  Description of Artificial Sequence: Synthetic peptide
  Seed: VINTYTGYF (MAGC3_HUMAN)
VYNTYTGYL

SEQ ID NO: 100961 - protein, 9 aa, Artificial Sequence
  Description of Artificial Sequence: Synthetic peptide
  Seed: MPKNCLLIL (MAGC3_HUMAN)
MPKNCLLIV

SEQ ID NO: 100962 - protein, 9 aa, Artificial Sequence
  Description of Artificial Sequence: Synthetic peptide
  Seed: QGMPQNRLL (MAGC3_HUMAN)
QGMPQNRLW

SEQ ID NO: 100963 - protein, 9 aa, Artificial Sequence
  Description of Artificial Sequence: Synthetic peptide
  Seed: IQRPAREVL (MAGC3_HUMAN)
IARPAREVF

SEQ ID NO: 100964 - protein, 9 aa, Artificial Sequence
  Description of Artificial Sequence: Synthetic peptide
  Seed: LIDDQGMPK (MAGC3_HUMAN)
LSDDQGMPM

SEQ ID NO: 100965 - protein, 9 aa, Artificial Sequence
  Description of Artificial Sequence: Synthetic peptide
  Seed: LTEASPQQK (MAGC3_HUMAN)
LTEASPQQY

SEQ ID NO: 100966 - protein, 10 aa, Artificial Sequence
  Description of Artificial Sequence: Synthetic peptide
  Seed: MNVINTYTGY (MAGC3_HUMAN)
MNVINTYTGF

SEQ ID NO: 100967 - protein, 11 aa, Artificial Sequence
  Description of Artificial Sequence: Synthetic peptide
  Seed: RYALDEKVAEL (MAGC3_HUMAN)
RCALDEKVAEV

SEQ ID NO: 100968 - protein, 9 aa, Artificial Sequence
  Description of Artificial Sequence: Synthetic peptide
  Seed: YTGYFPMIF (MAGC3_HUMAN)
YYGYFPMIV

SEQ ID NO: 100969 - protein, 9 aa, Artificial Sequence
  Description of Artificial Sequence: Synthetic peptide
  Seed: WRRGTGYTL (MAGC3_HUMAN)
WARGTGYTM

SEQ ID NO: 100970 - protein, 9 aa, Artificial Sequence
  Description of Artificial Sequence: Synthetic peptide
  Seed: MIFRKAREF (MAGC3_HUMAN)
MPFRKAREF

SEQ ID NO: 100971 - protein, 9 aa, Artificial Sequence
  Description of Artificial Sequence: Synthetic peptide
  Seed: QGMPKNCLL (MAGC3_HUMAN)
QLMPKNCLW

SEQ ID NO: 100972 - protein, 11 aa, Artificial Sequence
  Description of Artificial Sequence: Synthetic peptide
  Seed: LTEVDPDHFYV (MAGC3_HUMAN)
LLEVDPDHFYV

SEQ ID NO: 100973 - protein, 9 aa, Artificial Sequence
  Description of Artificial Sequence: Synthetic peptide
  Seed: MIFGKAHEF (MAGC3_HUMAN)
MSFGKAHEV

SEQ ID NO: 100974 - protein, 10 aa, Artificial Sequence
  Description of Artificial Sequence: Synthetic peptide
  Seed: TEVDPDHFYV (MAGC3_HUMAN)
TLVDPDHFYI

SEQ ID NO: 100975 - protein, 9 aa, Artificial Sequence
  Description of Artificial Sequence: Synthetic peptide
  Seed: FHLGHLREV (MAGC3_HUMAN)
FILGHLREV

SEQ ID NO: 100976 - protein, 10 aa, Artificial Sequence
  Description of Artificial Sequence: Synthetic peptide
  Seed: KYKDYFPMIF (MAGC3_HUMAN)
KVKDYFPMIY

SEQ ID NO: 100977 - protein, 10 aa, Artificial Sequence
  Description of Artificial Sequence: Synthetic peptide
  Seed: ELVQFLLLKY (MAGC3_HUMAN)
ESVQFLLLKK

SEQ ID NO: 100978 - protein, 9 aa, Artificial Sequence
  Description of Artificial Sequence: Synthetic peptide
  Seed: TTDDATAMA (MAGC3_HUMAN)
TTDDATAMM

SEQ ID NO: 100979 - protein, 9 aa, Artificial Sequence
  Description of Artificial Sequence: Synthetic peptide
  Seed: YQAKEPLTR (MAGC3_HUMAN)
YVAKEPLTL

SEQ ID NO: 100980 - protein, 9 aa, Artificial Sequence
  Description of Artificial Sequence: Synthetic peptide
  Seed: QMNVINTYT (MAGC3_HUMAN)
QINVINTYI

SEQ ID NO: 100981 - protein, 10 aa, Artificial Sequence
  Description of Artificial Sequence: Synthetic peptide
  Seed: MNVINTYTGY (MAGC3_HUMAN)
MVVINTYTGK

SEQ ID NO: 100982 - protein, 9 aa, Artificial Sequence
  Description of Artificial Sequence: Synthetic peptide
  Seed: KFSLRRAVS (MAGC3_HUMAN)
KVSLRRAVA

SEQ ID NO: 100983 - protein, 9 aa, Artificial Sequence
  Description of Artificial Sequence: Synthetic peptide
  Seed: MQMNVINTY (MAGC3_HUMAN)
MFMNVINTL

SEQ ID NO: 100984 - protein, 9 aa, Artificial Sequence
  Description of Artificial Sequence: Synthetic peptide
  Seed: SAFHLGHLR (MAGC3_HUMAN)
SQFHLGHLR

SEQ ID NO: 100985 - protein, 10 aa, Artificial Sequence
  Description of Artificial Sequence: Synthetic peptide
  Seed: LTRAEMQMNV (MAGC3_HUMAN)
LMRAEMQMNL

SEQ ID NO: 100986 - protein, 9 aa, Artificial Sequence
  Description of Artificial Sequence: Synthetic peptide
  Seed: YSAFHLGHL (MAGC3_HUMAN)
YMAFHLGHF

SEQ ID NO: 100987 - protein, 10 aa, Artificial Sequence
  Description of Artificial Sequence: Synthetic peptide
  Seed: KLSSIIPSAF (MAGC3_HUMAN)
KMSSIIPSAK

SEQ ID NO: 100988 - protein, 9 aa, Artificial Sequence
  Description of Artificial Sequence: Synthetic peptide
  Seed: FADVLSRLA (MAGC3_HUMAN)
FVDVLSRLV

SEQ ID NO: 100989 - protein, 9 aa, Artificial Sequence
  Description of Artificial Sequence: Synthetic peptide
  Seed: EVDPDHFYV (MAGC3_HUMAN)
EFDPDHFYL

SEQ ID NO: 100990 - protein, 10 aa, Artificial Sequence
  Description of Artificial Sequence: Synthetic peptide
  Seed: MQMNVINTYT (MAGC3_HUMAN)
MAMNVINTYI

SEQ ID NO: 100991 - protein, 9 aa, Artificial Sequence
  Description of Artificial Sequence: Synthetic peptide
  Seed: IDTTDDATA (MAGC3_HUMAN)
IETTDDATA

SEQ ID NO: 100992 - protein, 8 aa, Artificial Sequence
  Description of Artificial Sequence: Synthetic peptide
  Seed: TTDDATAM (MAGC3_HUMAN)
TIDDATAI

SEQ ID NO: 100993 - protein, 9 aa, Artificial Sequence
  Description of Artificial Sequence: Synthetic peptide
  Seed: AIGPWSALA (MAGC3_HUMAN)
ALGPWSALC

SEQ ID NO: 100994 - protein, 9 aa, Artificial Sequence
  Description of Artificial Sequence: Synthetic peptide
  Seed: KLSSIIPSA (MAGC3_HUMAN)
KLSSIIPSK

SEQ ID NO: 100995 - protein, 10 aa, Artificial Sequence
  Description of Artificial Sequence: Synthetic peptide
  Seed: MDPDNHSYFF (MAGC3_HUMAN)
MFPDNHSYFM

SEQ ID NO: 100996 - protein, 9 aa, Artificial Sequence
  Description of Artificial Sequence: Synthetic peptide
  Seed: MLLPCHWVL (MAGC3_HUMAN)
MVLPCHWVW

SEQ ID NO: 100997 - protein, 9 aa, Artificial Sequence
  Description of Artificial Sequence: Synthetic peptide
  Seed: IIPSAFPSW (MAGC3_HUMAN)
IMPSAFPSM

SEQ ID NO: 100998 - protein, 11 aa, Artificial Sequence
  Description of Artificial Sequence: Synthetic peptide
  Seed: FLSKLSSIIPS (MAGC3_HUMAN)
FQSKLSSIIPA

SEQ ID NO: 100999 - protein, 9 aa, Artificial Sequence
  Description of Artificial Sequence: Synthetic peptide
  Seed: KYKDYFPMI (MAGC3_HUMAN)
KVKDYFPMA

SEQ ID NO: 101000 - protein, 10 aa, Artificial Sequence
  Description of Artificial Sequence: Synthetic peptide
  Seed: KLSSIIPSAF (MAGC3_HUMAN)
KMSSIIPSAV

SEQ ID NO: 101001 - protein, 10 aa, Artificial Sequence
  Description of Artificial Sequence: Synthetic peptide
  Seed: SIIPSAFPSW (MAGC3_HUMAN)
SFIPSAFPSY

SEQ ID NO: 101002 - protein, 10 aa, Artificial Sequence
  Description of Artificial Sequence: Synthetic peptide
  Seed: SKLSSIIPSA (MAGC3_HUMAN)
SPLSSIIPSI

SEQ ID NO: 101003 - protein, 11 aa, Artificial Sequence
  Description of Artificial Sequence: Synthetic peptide
  Seed: ATAMASASPSV (MAGC3_HUMAN)
AHAMASASPSV

SEQ ID NO: 101004 - protein, 11 aa, Artificial Sequence
  Description of Artificial Sequence: Synthetic peptide
  Seed: TDMDPDNHSYF (MAGC3_HUMAN)
TQMDPDNHSYY

SEQ ID NO: 101005 - protein, 9 aa, Artificial Sequence
  Description of Artificial Sequence: Synthetic peptide
  Seed: IELIFGIAL (MAGC3_HUMAN)
IQLIFGIAM

SEQ ID NO: 101006 - protein, 9 aa, Artificial Sequence
  Description of Artificial Sequence: Synthetic peptide
  Seed: IPPQGPPKI (MAGC3_HUMAN)
IAPQGPPKI

SEQ ID NO: 101007 - protein, 9 aa, Artificial Sequence
  Description of Artificial Sequence: Synthetic peptide
  Seed: HLREVRLFL (MAGC3_HUMAN)
HTREVRLFS

SEQ ID NO: 101008 - protein, 11 aa, Artificial Sequence
  Description of Artificial Sequence: Synthetic peptide
  Seed: TSDQRMDSLVL (MAGC3_HUMAN)
TRDQRMDSLVY

SEQ ID NO: 101009 - protein, 10 aa, Artificial Sequence
  Description of Artificial Sequence: Synthetic peptide
  Seed: TGYFPMIFRK (MAGC3_HUMAN)
TAYFPMIFRK

SEQ ID NO: 101010 - protein, 9 aa, Artificial Sequence
  Description of Artificial Sequence: Synthetic peptide
  Seed: QPEGKFSLR (MAGC3_HUMAN)
QFEGKFSLR

SEQ ID NO: 101011 - protein, 9 aa, Artificial Sequence
  Description of Artificial Sequence: Synthetic peptide
  Seed: MLLPCHWVL (MAGC3_HUMAN)
MMLPCHWVF

SEQ ID NO: 101012 - protein, 10 aa, Artificial Sequence
  Description of Artificial Sequence: Synthetic peptide
  Seed: KVAELVQFLL (MAGC3_HUMAN)
KAAELVQFLV

SEQ ID NO: 101013 - protein, 10 aa, Artificial Sequence
  Description of Artificial Sequence: Synthetic peptide
  Seed: SDQRMDSLVL (MAGC3_HUMAN)
SMQRMDSLVM

SEQ ID NO: 101014 - protein, 9 aa, Artificial Sequence
  Description of Artificial Sequence: Synthetic peptide
  Seed: MDPDNHSYF (MAGC3_HUMAN)
MPPDNHSYF

SEQ ID NO: 101015 - protein, 9 aa, Artificial Sequence
  Description of Artificial Sequence: Synthetic peptide
  Seed: SLVLCPTYF (MAGC3_HUMAN)
SQVLCPTYL

SEQ ID NO: 101016 - protein, 9 aa, Artificial Sequence
  Description of Artificial Sequence: Synthetic peptide
  Seed: HALPESESL (MAGC3_HUMAN)
HHLPESEST

SEQ ID NO: 101017 - protein, 9 aa, Artificial Sequence
  Description of Artificial Sequence: Synthetic peptide
  Seed: FPSWYMDAL (MAGC3_HUMAN)
FRSWYMDAI

SEQ ID NO: 101018 - protein, 9 aa, Artificial Sequence
  Description of Artificial Sequence: Synthetic peptide
  Seed: LSGSPGLQL (MAGC3_HUMAN)
LYGSPGLQF

SEQ ID NO: 101019 - protein, 9 aa, Artificial Sequence
  Description of Artificial Sequence: Synthetic peptide
  Seed: MEDRAQAII (MAGC3_HUMAN)
MQDRAQAIL

SEQ ID NO: 101020 - protein, 9 aa, Artificial Sequence
  Description of Artificial Sequence: Synthetic peptide
  Seed: LSDLHFGSQ (MAGC3_HUMAN)
LMDLHFGSY

SEQ ID NO: 101021 - protein, 10 aa, Artificial Sequence
  Description of Artificial Sequence: Synthetic peptide
  Seed: RLLILILSVI (MAGC3_HUMAN)
RWLILILSVV

SEQ ID NO: 101022 - protein, 9 aa, Artificial Sequence
  Description of Artificial Sequence: Synthetic peptide
  Seed: KVDKLVQFL (MAGC3_HUMAN)
KTDKLVQFI

SEQ ID NO: 101023 - protein, 8 aa, Artificial Sequence
  Description of Artificial Sequence: Synthetic peptide
  Seed: TTDDATAM (MAGC3_HUMAN)
TGDDATAV

SEQ ID NO: 101024 - protein, 11 aa, Artificial Sequence
  Description of Artificial Sequence: Synthetic peptide
  Seed: SVLDLANPQGL (MAGC3_HUMAN)
SMLDLANPQGR

SEQ ID NO: 101025 - protein, 10 aa, Artificial Sequence
  Description of Artificial Sequence: Synthetic peptide
  Seed: MQMNVINTYT (MAGC3_HUMAN)
MWMNVINTYA

SEQ ID NO: 101026 - protein, 9 aa, Artificial Sequence
  Description of Artificial Sequence: Synthetic peptide
  Seed: KVDKLVQFL (MAGC3_HUMAN)
KWDKLVQFI

SEQ ID NO: 101027 - protein, 9 aa, Artificial Sequence
  Description of Artificial Sequence: Synthetic peptide
  Seed: QMNVINTYT (MAGC3_HUMAN)
QLNVINTYI

SEQ ID NO: 101028 - protein, 9 aa, Artificial Sequence
  Description of Artificial Sequence: Synthetic peptide
  Seed: KLVQFLLLK (MAGC3_HUMAN)
KIVQFLLLV

SEQ ID NO: 101029 - protein, 9 aa, Artificial Sequence
  Description of Artificial Sequence: Synthetic peptide
  Seed: MQMNVINTY (MAGC3_HUMAN)
MSMNVINTK

SEQ ID NO: 101030 - protein, 9 aa, Artificial Sequence
  Description of Artificial Sequence: Synthetic peptide
  Seed: SLGQWVKNT (MAGC3_HUMAN)
SMGQWVKNV

SEQ ID NO: 101031 - protein, 9 aa, Artificial Sequence
  Description of Artificial Sequence: Synthetic peptide
  Seed: YALDEKVAE (MAGC3_HUMAN)
YILDEKVAY

SEQ ID NO: 101032 - protein, 9 aa, Artificial Sequence
  Description of Artificial Sequence: Synthetic peptide
  Seed: AEMLTTVIK (MAGC3_HUMAN)
AEMLTTVIC

SEQ ID NO: 101033 - protein, 9 aa, Artificial Sequence
  Description of Artificial Sequence: Synthetic peptide
  Seed: HLREVRLFL (MAGC3_HUMAN)
HHREVRLFK

SEQ ID NO: 101034 - protein, 9 aa, Artificial Sequence
  Description of Artificial Sequence: Synthetic peptide
  Seed: FSLRRAVSV (MAGC3_HUMAN)
FTLRRAVSI

SEQ ID NO: 101035 - protein, 9 aa, Artificial Sequence
  Description of Artificial Sequence: Synthetic peptide
  Seed: YFFEDTLDL (MAGC3_HUMAN)
YIFEDTLDM

SEQ ID NO: 101036 - protein, 11 aa, Artificial Sequence
  Description of Artificial Sequence: Synthetic peptide
  Seed: HALPESESLPR (MAGC3_HUMAN)
HALPESESLPK

SEQ ID NO: 101037 - protein, 10 aa, Artificial Sequence
  Description of Artificial Sequence: Synthetic peptide
  Seed: SPLDSCSSPL (MAGC3_HUMAN)
SLLDSCSSPV

SEQ ID NO: 101038 - protein, 9 aa, Artificial Sequence
  Description of Artificial Sequence: Synthetic peptide
  Seed: VIWEVLNAI (MAGC3_HUMAN)
VTWEVLNAR

SEQ ID NO: 101039 - protein, 9 aa, Artificial Sequence
  Description of Artificial Sequence: Synthetic peptide
  Seed: EFIELIFGI (MAGC3_HUMAN)
EVIELIFGL

SEQ ID NO: 101040 - protein, 9 aa, Artificial Sequence
  Description of Artificial Sequence: Synthetic peptide
  Seed: HLREVRLFL (MAGC3_HUMAN)
HSREVRLFK

SEQ ID NO: 101041 - protein, 9 aa, Artificial Sequence
  Description of Artificial Sequence: Synthetic peptide
  Seed: ALAGFADVL (MAGC3_HUMAN)
AVAGFADVL

SEQ ID NO: 101042 - protein, 10 aa, Artificial Sequence
  Description of Artificial Sequence: Synthetic peptide
  Seed: YALSPVVLPP (MAGC3_HUMAN)
YHLSPVVLPV

SEQ ID NO: 101043 - protein, 10 aa, Artificial Sequence
  Description of Artificial Sequence: Synthetic peptide
  Seed: MQMNVINTYT (MAGC3_HUMAN)
MYMNVINTYL

SEQ ID NO: 101044 - protein, 10 aa, Artificial Sequence
  Description of Artificial Sequence: Synthetic peptide
  Seed: REVRLFLRGG (MAGC3_HUMAN)
RQVRLFLRGV

SEQ ID NO: 101045 - protein, 10 aa, Artificial Sequence
  Description of Artificial Sequence: Synthetic peptide
  Seed: IPSAFPSWYM (MAGC3_HUMAN)
ISSAFPSWYF

SEQ ID NO: 101046 - protein, 9 aa, Artificial Sequence
  Description of Artificial Sequence: Synthetic peptide
  Seed: LLILILSVI (MAGC3_HUMAN)
LQILILSVV

SEQ ID NO: 101047 - protein, 10 aa, Artificial Sequence
  Description of Artificial Sequence: Synthetic peptide
  Seed: YALDEKVAEL (MAGC3_HUMAN)
YDLDEKVAEC

SEQ ID NO: 101048 - protein, 11 aa, Artificial Sequence
  Description of Artificial Sequence: Synthetic peptide
  Seed: RGLTEASPQQK (MAGC3_HUMAN)
RILTEASPQQR

SEQ ID NO: 101049 - protein, 9 aa, Artificial Sequence
  Description of Artificial Sequence: Synthetic peptide
  Seed: VIWEVLSAI (MAGC3_HUMAN)
VLWEVLSAW

SEQ ID NO: 101050 - protein, 10 aa, Artificial Sequence
  Description of Artificial Sequence: Synthetic peptide
  Seed: YTLDEKVDKL (MAGC3_HUMAN)
YWLDEKVDKL

SEQ ID NO: 101051 - protein, 9 aa, Artificial Sequence
  Description of Artificial Sequence: Synthetic peptide
  Seed: FADVLSRLA (MAGC3_HUMAN)
FCDVLSRLV

SEQ ID NO: 101052 - protein, 9 aa, Artificial Sequence
  Description of Artificial Sequence: Synthetic peptide
  Seed: MIFRKAREF (MAGC3_HUMAN)
MQFRKAREI

SEQ ID NO: 101053 - protein, 11 aa, Artificial Sequence
  Description of Artificial Sequence: Synthetic peptide
  Seed: TTDDATAMASA (MAGC3_HUMAN)
TMDDATAMASI

SEQ ID NO: 101054 - protein, 9 aa, Artificial Sequence
  Description of Artificial Sequence: Synthetic peptide
  Seed: SQPEGKFSL (MAGC3_HUMAN)
SIPEGKFSV

SEQ ID NO: 101055 - protein, 9 aa, Artificial Sequence
  Description of Artificial Sequence: Synthetic peptide
  Seed: EVIWEVLNA (MAGC3_HUMAN)
ETIWEVLNA

SEQ ID NO: 101056 - protein, 10 aa, Artificial Sequence
  Description of Artificial Sequence: Synthetic peptide
  Seed: RSAEGSVLDL (MAGC3_HUMAN)
RCAEGSVLDW

SEQ ID NO: 101057 - protein, 9 aa, Artificial Sequence
  Description of Artificial Sequence: Synthetic peptide
  Seed: YFFEDTLDL (MAGC3_HUMAN)
YQFEDTLDY

SEQ ID NO: 101058 - protein, 9 aa, Artificial Sequence
  Description of Artificial Sequence: Synthetic peptide
  Seed: KYKDYFPMI (MAGC3_HUMAN)
KWKDYFPMW

SEQ ID NO: 101059 - protein, 9 aa, Artificial Sequence
  Description of Artificial Sequence: Synthetic peptide
  Seed: EVLEFLSKL (MAGC3_HUMAN)
EHLEFLSKR

SEQ ID NO: 101060 - protein, 9 aa, Artificial Sequence
  Description of Artificial Sequence: Synthetic peptide
  Seed: LSGSPGLQL (MAGC3_HUMAN)
LTGSPGLQV

SEQ ID NO: 101061 - protein, 10 aa, Artificial Sequence
  Description of Artificial Sequence: Synthetic peptide
  Seed: KVAELVQFLL (MAGC3_HUMAN)
KLAELVQFLC

SEQ ID NO: 101062 - protein, 11 aa, Artificial Sequence
  Description of Artificial Sequence: Synthetic peptide
  Seed: FLSKLSSIIPS (MAGC3_HUMAN)
FSSKLSSIIPV

SEQ ID NO: 101063 - protein, 9 aa, Artificial Sequence
  Description of Artificial Sequence: Synthetic peptide
  Seed: WVKNTCATY (MAGC3_HUMAN)
WVKNTCATF

SEQ ID NO: 101064 - protein, 10 aa, Artificial Sequence
  Description of Artificial Sequence: Synthetic peptide
  Seed: FFEDTLDLTY (MAGC3_HUMAN)
FSEDTLDLTY

SEQ ID NO: 101065 - protein, 10 aa, Artificial Sequence
  Description of Artificial Sequence: Synthetic peptide
  Seed: KYQAKEPLTR (MAGC3_HUMAN)
KMQAKEPLTR

SEQ ID NO: 101066 - protein, 10 aa, Artificial Sequence
  Description of Artificial Sequence: Synthetic peptide
  Seed: MQMNVINTYT (MAGC3_HUMAN)
MNMNVINTYA

SEQ ID NO: 101067 - protein, 9 aa, Artificial Sequence
  Description of Artificial Sequence: Synthetic peptide
  Seed: KNCLLILIL (MAGC3_HUMAN)
KACLLILIL

SEQ ID NO: 101068 - protein, 9 aa, Artificial Sequence
  Description of Artificial Sequence: Synthetic peptide
  Seed: TYALSPVVL (MAGC3_HUMAN)
TAALSPVVF

SEQ ID NO: 101069 - protein, 9 aa, Artificial Sequence
  Description of Artificial Sequence: Synthetic peptide
  Seed: HSYFFEDTL (MAGC3_HUMAN)
HEYFFEDTF

SEQ ID NO: 101070 - protein, 10 aa, Artificial Sequence
  Description of Artificial Sequence: Synthetic peptide
  Seed: YALDEKVAEL (MAGC3_HUMAN)
YSLDEKVAEV

SEQ ID NO: 101071 - protein, 10 aa, Artificial Sequence
  Description of Artificial Sequence: Synthetic peptide
  Seed: MQMNVINTYT (MAGC3_HUMAN)
MKMNVINTYA

SEQ ID NO: 101072 - protein, 9 aa, Artificial Sequence
  Description of Artificial Sequence: Synthetic peptide
  Seed: MPAAGMPPL (MAGC3_HUMAN)
MPAAGMPPE

SEQ ID NO: 101073 - protein, 9 aa, Artificial Sequence
  Description of Artificial Sequence: Synthetic peptide
  Seed: VLPPQPQPR (MAGC3_HUMAN)
VVPPQPQPF

SEQ ID NO: 101074 - protein, 9 aa, Artificial Sequence
  Description of Artificial Sequence: Synthetic peptide
  Seed: EVIWEVLNA (MAGC3_HUMAN)
ETIWEVLNL

SEQ ID NO: 101075 - protein, 9 aa, Artificial Sequence
  Description of Artificial Sequence: Synthetic peptide
  Seed: SPPEIPPQG (MAGC3_HUMAN)
SPPEIPPQT

SEQ ID NO: 101076 - protein, 11 aa, Artificial Sequence
  Description of Artificial Sequence: Synthetic peptide
  Seed: TEVDPDHFYVF (MAGC3_HUMAN)
TEVDPDHFYVL

SEQ ID NO: 101077 - protein, 10 aa, Artificial Sequence
  Description of Artificial Sequence: Synthetic peptide
  Seed: ASPSVMSTNF (MAGC3_HUMAN)
ATPSVMSTNW

SEQ ID NO: 101078 - protein, 10 aa, Artificial Sequence
  Description of Artificial Sequence: Synthetic peptide
  Seed: QWVKNTCATY (MAGC3_HUMAN)
QMVKNTCATF

SEQ ID NO: 101079 - protein, 10 aa, Artificial Sequence
  Description of Artificial Sequence: Synthetic peptide
  Seed: LLKYQAKEPL (MAGC3_HUMAN)
LAKYQAKEPY

SEQ ID NO: 101080 - protein, 11 aa, Artificial Sequence
  Description of Artificial Sequence: Synthetic peptide
  Seed: ATFSDGSLGQW (MAGC3_HUMAN)
AQFSDGSLGQL

SEQ ID NO: 101081 - protein, 8 aa, Artificial Sequence
  Description of Artificial Sequence: Synthetic peptide
  Seed: MEDRAQAI (MAGC3_HUMAN)
MADRAQAI

SEQ ID NO: 101082 - protein, 11 aa, Artificial Sequence
  Description of Artificial Sequence: Synthetic peptide
  Seed: DLANPQGLAGH (MAGC3_HUMAN)
DVANPQGLAGK

SEQ ID NO: 101083 - protein, 10 aa, Artificial Sequence
  Description of Artificial Sequence: Synthetic peptide
  Seed: RLLILILSVI (MAGC3_HUMAN)
RHLILILSVV

SEQ ID NO: 101084 - protein, 10 aa, Artificial Sequence
  Description of Artificial Sequence: Synthetic peptide
  Seed: EKVAELVQFL (MAGC3_HUMAN)
EVVAELVQFL

SEQ ID NO: 101085 - protein, 11 aa, Artificial Sequence
  Description of Artificial Sequence: Synthetic peptide
  Seed: ALWESEGPEAF (MAGC3_HUMAN)
AIWESEGPEAV

SEQ ID NO: 101086 - protein, 10 aa, Artificial Sequence
  Description of Artificial Sequence: Synthetic peptide
  Seed: LDSCSSPLLW (MAGC3_HUMAN)
LESCSSPLLW

SEQ ID NO: 101087 - protein, 10 aa, Artificial Sequence
  Description of Artificial Sequence: Synthetic peptide
  Seed: VLSAIGPIQR (MAGC3_HUMAN)
VVSAIGPIQR

SEQ ID NO: 101088 - protein, 9 aa, Artificial Sequence
  Description of Artificial Sequence: Synthetic peptide
  Seed: EVLSAIGPI (MAGC3_HUMAN)
ETLSAIGPK

SEQ ID NO: 101089 - protein, 9 aa, Artificial Sequence
  Description of Artificial Sequence: Synthetic peptide
  Seed: YSAFHLGHL (MAGC3_HUMAN)
YVAFHLGHI

SEQ ID NO: 101090 - protein, 10 aa, Artificial Sequence
  Description of Artificial Sequence: Synthetic peptide
  Seed: LSLPAVSPGK (MAGC3_HUMAN)
LFLPAVSPGR

SEQ ID NO: 101091 - protein, 9 aa, Artificial Sequence
  Description of Artificial Sequence: Synthetic peptide
  Seed: SEEEDTATW (MAGC3_HUMAN)
STEEDTATW

SEQ ID NO: 101092 - protein, 9 aa, Artificial Sequence
  Description of Artificial Sequence: Synthetic peptide
  Seed: SSPLLWTRL (MAGC3_HUMAN)
SAPLLWTRL

SEQ ID NO: 101093 - protein, 9 aa, Artificial Sequence
  Description of Artificial Sequence: Synthetic peptide
  Seed: LSGSPGLQL (MAGC3_HUMAN)
LMGSPGLQF

SEQ ID NO: 101094 - protein, 9 aa, Artificial Sequence
  Description of Artificial Sequence: Synthetic peptide
  Seed: EFIELIFGI (MAGC3_HUMAN)
ESIELIFGT

SEQ ID NO: 101095 - protein, 10 aa, Artificial Sequence
  Description of Artificial Sequence: Synthetic peptide
  Seed: EEVIWEVLNA (MAGC3_HUMAN)
EEVIWEVLNV

SEQ ID NO: 101096 - protein, 9 aa, Artificial Sequence
  Description of Artificial Sequence: Synthetic peptide
  Seed: EFIELIFGI (MAGC3_HUMAN)
EGIELIFGI

SEQ ID NO: 101097 - protein, 10 aa, Artificial Sequence
  Description of Artificial Sequence: Synthetic peptide
  Seed: MPAAGMPPLP (MAGC3_HUMAN)
MEAAGMPPLY

SEQ ID NO: 101098 - protein, 10 aa, Artificial Sequence
  Description of Artificial Sequence: Synthetic peptide
  Seed: VKNTCATYAL (MAGC3_HUMAN)
VKNTCATYAM

SEQ ID NO: 101099 - protein, 9 aa, Artificial Sequence
  Description of Artificial Sequence: Synthetic peptide
  Seed: SALAGFADV (MAGC3_HUMAN)
SLLAGFADV

SEQ ID NO: 101100 - protein, 9 aa, Artificial Sequence
  Description of Artificial Sequence: Synthetic peptide
  Seed: YSAFHLGHL (MAGC3_HUMAN)
YSAFHLGHM

SEQ ID NO: 101101 - protein, 9 aa, Artificial Sequence
  Description of Artificial Sequence: Synthetic peptide
  Seed: EFLSKLSSI (MAGC3_HUMAN)
ELLSKLSSM

SEQ ID NO: 101102 - protein, 10 aa, Artificial Sequence
  Description of Artificial Sequence: Synthetic peptide
  Seed: LNAIGPWSAL (MAGC3_HUMAN)
LGAIGPWSAY

SEQ ID NO: 101103 - protein, 9 aa, Artificial Sequence
  Description of Artificial Sequence: Synthetic peptide
  Seed: HLGHLREVR (MAGC3_HUMAN)
HVGHLREVR

SEQ ID NO: 101104 - protein, 10 aa, Artificial Sequence
  Description of Artificial Sequence: Synthetic peptide
  Seed: YTLDEKVDKL (MAGC3_HUMAN)
YMLDEKVDKI

SEQ ID NO: 101105 - protein, 9 aa, Artificial Sequence
  Description of Artificial Sequence: Synthetic peptide
  Seed: AIGPIQRPA (MAGC3_HUMAN)
AIGPIQRPV

SEQ ID NO: 101106 - protein, 10 aa, Artificial Sequence
  Description of Artificial Sequence: Synthetic peptide
  Seed: SPQGPPQSPP (MAGC3_HUMAN)
SPQGPPQSPM

SEQ ID NO: 101107 - protein, 8 aa, Artificial Sequence
  Description of Artificial Sequence: Synthetic peptide
  Seed: FADVLSRL (MAGC3_HUMAN)
FVDVLSRM

SEQ ID NO: 101108 - protein, 10 aa, Artificial Sequence
  Description of Artificial Sequence: Synthetic peptide
  Seed: LPTWRRGTGY (MAGC3_HUMAN)
LRTWRRGTGW

SEQ ID NO: 101109 - protein, 10 aa, Artificial Sequence
  Description of Artificial Sequence: Synthetic peptide
  Seed: ILILSMIFIK (MAGC3_HUMAN)
ISILSMIFIK

SEQ ID NO: 101110 - protein, 10 aa, Artificial Sequence
  Description of Artificial Sequence: Synthetic peptide
  Seed: INTYTGYFPM (MAGC3_HUMAN)
IETYTGYFPW

SEQ ID NO: 101111 - protein, 11 aa, Artificial Sequence
  Description of Artificial Sequence: Synthetic peptide
  Seed: ATFSDGSLGQW (MAGC3_HUMAN)
ATFSDGSLGQK

SEQ ID NO: 101112 - protein, 10 aa, Artificial Sequence
  Description of Artificial Sequence: Synthetic peptide
  Seed: SQPEGKFSLR (MAGC3_HUMAN)
SFPEGKFSLR

SEQ ID NO: 101113 - protein, 10 aa, Artificial Sequence
  Description of Artificial Sequence: Synthetic peptide
  Seed: MLTTVIKKYK (MAGC3_HUMAN)
MCTTVIKKYR

SEQ ID NO: 101114 - protein, 9 aa, Artificial Sequence
  Description of Artificial Sequence: Synthetic peptide
  Seed: ALDEKVAEL (MAGC3_HUMAN)
ALDEKVAEI

SEQ ID NO: 101115 - protein, 9 aa, Artificial Sequence
  Description of Artificial Sequence: Synthetic peptide
  Seed: HALPESESL (MAGC3_HUMAN)
HYLPESESL

SEQ ID NO: 101116 - protein, 9 aa, Artificial Sequence
  Description of Artificial Sequence: Synthetic peptide
  Seed: GYFPMIFRK (MAGC3_HUMAN)
GYFPMIFRY

SEQ ID NO: 101117 - protein, 10 aa, Artificial Sequence
  Description of Artificial Sequence: Synthetic peptide
  Seed: MLLPCHWVLD (MAGC3_HUMAN)
MQLPCHWVLI

SEQ ID NO: 101118 - protein, 9 aa, Artificial Sequence
  Description of Artificial Sequence: Synthetic peptide
  Seed: ATDKDYSAF (MAGC3_HUMAN)
AADKDYSAI

SEQ ID NO: 101119 - protein, 9 aa, Artificial Sequence
  Description of Artificial Sequence: Synthetic peptide
  Seed: LIDDQGMPK (MAGC3_HUMAN)
LADDQGMPM

SEQ ID NO: 101120 - protein, 9 aa, Artificial Sequence
  Description of Artificial Sequence: Synthetic peptide
  Seed: VLCPTYFKL (MAGC3_HUMAN)
VQCPTYFKV

SEQ ID NO: 101121 - protein, 11 aa, Artificial Sequence
  Description of Artificial Sequence: Synthetic peptide
  Seed: SASPSVMSTNF (MAGC3_HUMAN)
STSPSVMSTNF

SEQ ID NO: 101122 - protein, 10 aa, Artificial Sequence
  Description of Artificial Sequence: Synthetic peptide
  Seed: LLKYQTKEPV (MAGC3_HUMAN)
LMKYQTKEPV

SEQ ID NO: 101123 - protein, 9 aa, Artificial Sequence
  Description of Artificial Sequence: Synthetic peptide
  Seed: REVRLFLRG (MAGC3_HUMAN)
REVRLFLRL

SEQ ID NO: 101124 - protein, 11 aa, Artificial Sequence
  Description of Artificial Sequence: Synthetic peptide
  Seed: TSDQRMDSLVL (MAGC3_HUMAN)
TGDQRMDSLVY

SEQ ID NO: 101125 - protein, 9 aa, Artificial Sequence
  Description of Artificial Sequence: Synthetic peptide
  Seed: NAIGPWSAL (MAGC3_HUMAN)
NMIGPWSAR

SEQ ID NO: 101126 - protein, 10 aa, Artificial Sequence
  Description of Artificial Sequence: Synthetic peptide
  Seed: KDMEDRAQAI (MAGC3_HUMAN)
KEMEDRAQAC

SEQ ID NO: 101127 - protein, 10 aa, Artificial Sequence
  Description of Artificial Sequence: Synthetic peptide
  Seed: ILILSMIFIK (MAGC3_HUMAN)
IAILSMIFIK

SEQ ID NO: 101128 - protein, 9 aa, Artificial Sequence
  Description of Artificial Sequence: Synthetic peptide
  Seed: MDPDNHSYF (MAGC3_HUMAN)
MSPDNHSYF

SEQ ID NO: 101129 - protein, 10 aa, Artificial Sequence
  Description of Artificial Sequence: Synthetic peptide
  Seed: LILILSVIFI (MAGC3_HUMAN)
LDLILSVIFV

SEQ ID NO: 101130 - protein, 9 aa, Artificial Sequence
  Description of Artificial Sequence: Synthetic peptide
  Seed: SDQRMDSLV (MAGC3_HUMAN)
SEQRMDSLV

SEQ ID NO: 101131 - protein, 9 aa, Artificial Sequence
  Description of Artificial Sequence: Synthetic peptide
  Seed: VLPPQPQPR (MAGC3_HUMAN)
VNPPQPQPM

SEQ ID NO: 101132 - protein, 9 aa, Artificial Sequence
  Description of Artificial Sequence: Synthetic peptide
  Seed: LKYQTKEPV (MAGC3_HUMAN)
LAYQTKEPF

SEQ ID NO: 101133 - protein, 9 aa, Artificial Sequence
  Description of Artificial Sequence: Synthetic peptide
  Seed: WVKNTCATY (MAGC3_HUMAN)
WEKNTCATY

SEQ ID NO: 101134 - protein, 10 aa, Artificial Sequence
  Description of Artificial Sequence: Synthetic peptide
  Seed: LNAIGPWSAL (MAGC3_HUMAN)
LTAIGPWSAL

SEQ ID NO: 101135 - protein, 9 aa, Artificial Sequence
  Description of Artificial Sequence: Synthetic peptide
  Seed: SAFHLGHLR (MAGC3_HUMAN)
SGFHLGHLR

SEQ ID NO: 101136 - protein, 8 aa, Artificial Sequence
  Description of Artificial Sequence: Synthetic peptide
  Seed: RSAEGSVL (MAGC3_HUMAN)
RAAEGSVL

SEQ ID NO: 101137 - protein, 11 aa, Artificial Sequence
  Description of Artificial Sequence: Synthetic peptide
  Seed: LIDDQGMPKNC (MAGC3_HUMAN)
LSDDQGMPKNL

SEQ ID NO: 101138 - protein, 9 aa, Artificial Sequence
  Description of Artificial Sequence: Synthetic peptide
  Seed: LSDEQGMPQ (MAGC3_HUMAN)
LIDEQGMPM

SEQ ID NO: 101139 - protein, 9 aa, Artificial Sequence
  Description of Artificial Sequence: Synthetic peptide
  Seed: HLREVRLFL (MAGC3_HUMAN)
HTREVRLFF

SEQ ID NO: 101140 - protein, 9 aa, Artificial Sequence
  Description of Artificial Sequence: Synthetic peptide
  Seed: AVSPGKRLW (MAGC3_HUMAN)
AVSPGKRLL

SEQ ID NO: 101141 - protein, 9 aa, Artificial Sequence
  Description of Artificial Sequence: Synthetic peptide
  Seed: KYKDYFPMI (MAGC3_HUMAN)
KTKDYFPMP

SEQ ID NO: 101142 - protein, 9 aa, Artificial Sequence
  Description of Artificial Sequence: Synthetic peptide
  Seed: WYMDALKDM (MAGC3_HUMAN)
WYMDALKDI

SEQ ID NO: 101143 - protein, 10 aa, Artificial Sequence
  Description of Artificial Sequence: Synthetic peptide
  Seed: TTDDATAMAS (MAGC3_HUMAN)
TFDDATAMAL

SEQ ID NO: 101144 - protein, 9 aa, Artificial Sequence
  Description of Artificial Sequence: Synthetic peptide
  Seed: KLSSIIPSA (MAGC3_HUMAN)
KISSIIPSI

SEQ ID NO: 101145 - protein, 9 aa, Artificial Sequence
  Description of Artificial Sequence: Synthetic peptide
  Seed: MLLPCHWVL (MAGC3_HUMAN)
MQLPCHWVA

SEQ ID NO: 101146 - protein, 9 aa, Artificial Sequence
  Description of Artificial Sequence: Synthetic peptide
  Seed: KAHEFIELI (MAGC3_HUMAN)
KSHEFIELY

SEQ ID NO: 101147 - protein, 9 aa, Artificial Sequence
  Description of Artificial Sequence: Synthetic peptide
  Seed: AGFADVLSR (MAGC3_HUMAN)
ALFADVLSR

SEQ ID NO: 101148 - protein, 9 aa, Artificial Sequence
  Description of Artificial Sequence: Synthetic peptide
  Seed: FKLWRTLSG (MAGC3_HUMAN)
FVLWRTLSF

SEQ ID NO: 101149 - protein, 10 aa, Artificial Sequence
  Description of Artificial Sequence: Synthetic peptide
  Seed: LILILSMIFI (MAGC3_HUMAN)
LNLILSMIFV

SEQ ID NO: 101150 - protein, 10 aa, Artificial Sequence
  Description of Artificial Sequence: Synthetic peptide
  Seed: SKLSSIIPSA (MAGC3_HUMAN)
SMLSSIIPSM

SEQ ID NO: 101151 - protein, 9 aa, Artificial Sequence
  Description of Artificial Sequence: Synthetic peptide
  Seed: HALPESESL (MAGC3_HUMAN)
HVLPESESW

SEQ ID NO: 101152 - protein, 9 aa, Artificial Sequence
  Description of Artificial Sequence: Synthetic peptide
  Seed: TAMASASPS (MAGC3_HUMAN)
TGMASASPY

SEQ ID NO: 101153 - protein, 10 aa, Artificial Sequence
  Description of Artificial Sequence: Synthetic peptide
  Seed: TGYFPMIFRK (MAGC3_HUMAN)
TVYFPMIFRK

SEQ ID NO: 101154 - protein, 10 aa, Artificial Sequence
  Description of Artificial Sequence: Synthetic peptide
  Seed: YFPMIFGKAH (MAGC3_HUMAN)
YYPMIFGKAF

SEQ ID NO: 101155 - protein, 10 aa, Artificial Sequence
  Description of Artificial Sequence: Synthetic peptide
  Seed: SCSSPLLWTR (MAGC3_HUMAN)
SRSSPLLWTK

SEQ ID NO: 101156 - protein, 10 aa, Artificial Sequence
  Description of Artificial Sequence: Synthetic peptide
  Seed: KVAELVQFLL (MAGC3_HUMAN)
KLAELVQFLP

SEQ ID NO: 101157 - protein, 10 aa, Artificial Sequence
  Description of Artificial Sequence: Synthetic peptide
  Seed: TGYFPMIFRK (MAGC3_HUMAN)
TTYFPMIFRL

SEQ ID NO: 101158 - protein, 9 aa, Artificial Sequence
  Description of Artificial Sequence: Synthetic peptide
  Seed: TYALSPVVL (MAGC3_HUMAN)
TRALSPVVY

SEQ ID NO: 101159 - protein, 11 aa, Artificial Sequence
  Description of Artificial Sequence: Synthetic peptide
  Seed: KVAELVQFLLL (MAGC3_HUMAN)
KLAELVQFLLF

SEQ ID NO: 101160 - protein, 9 aa, Artificial Sequence
  Description of Artificial Sequence: Synthetic peptide
  Seed: KAHEFIELI (MAGC3_HUMAN)
KMHEFIELF

SEQ ID NO: 101161 - protein, 9 aa, Artificial Sequence
  Description of Artificial Sequence: Synthetic peptide
  Seed: LFGISLTEV (MAGC3_HUMAN)
LYGISLTEF

SEQ ID NO: 101162 - protein, 9 aa, Artificial Sequence
  Description of Artificial Sequence: Synthetic peptide
  Seed: FSLRRAVSV (MAGC3_HUMAN)
FDLRRAVSL

SEQ ID NO: 101163 - protein, 10 aa, Artificial Sequence
  Description of Artificial Sequence: Synthetic peptide
  Seed: EMQMNVINTY (MAGC3_HUMAN)
EQQMNVINTF

SEQ ID NO: 101164 - protein, 9 aa, Artificial Sequence
  Description of Artificial Sequence: Synthetic peptide
  Seed: ALDEKVAEL (MAGC3_HUMAN)
AHDEKVAEI

SEQ ID NO: 101165 - protein, 10 aa, Artificial Sequence
  Description of Artificial Sequence: Synthetic peptide
  Seed: SAFHLGHLRE (MAGC3_HUMAN)
STFHLGHLRS

SEQ ID NO: 101166 - protein, 10 aa, Artificial Sequence
  Description of Artificial Sequence: Synthetic peptide
  Seed: SLVLCPTYFK (MAGC3_HUMAN)
SQVLCPTYFK

SEQ ID NO: 101167 - protein, 10 aa, Artificial Sequence
  Description of Artificial Sequence: Synthetic peptide
  Seed: VLSAIGPIQR (MAGC3_HUMAN)
VSSAIGPIQY

SEQ ID NO: 101168 - protein, 9 aa, Artificial Sequence
  Description of Artificial Sequence: Synthetic peptide
  Seed: MQMNVINTY (MAGC3_HUMAN)
MMMNVINTK

SEQ ID NO: 101169 - protein, 10 aa, Artificial Sequence
  Description of Artificial Sequence: Synthetic peptide
  Seed: FSDGSLGQWV (MAGC3_HUMAN)
FMDGSLGQWI

SEQ ID NO: 101170 - protein, 10 aa, Artificial Sequence
  Description of Artificial Sequence: Synthetic peptide
  Seed: LNAIGPWSAL (MAGC3_HUMAN)
LPAIGPWSAF

SEQ ID NO: 101171 - protein, 11 aa, Artificial Sequence
  Description of Artificial Sequence: Synthetic peptide
  Seed: AEMQMNVINTY (MAGC3_HUMAN)
AHMQMNVINTY

SEQ ID NO: 101172 - protein, 11 aa, Artificial Sequence
  Description of Artificial Sequence: Synthetic peptide
  Seed: EILFGISLTEV (MAGC3_HUMAN)
EKLFGISLTEL

SEQ ID NO: 101173 - protein, 9 aa, Artificial Sequence
  Description of Artificial Sequence: Synthetic peptide
  Seed: SIIPSAFPS (MAGC3_HUMAN)
SIIPSAFPL

SEQ ID NO: 101174 - protein, 10 aa, Artificial Sequence
  Description of Artificial Sequence: Synthetic peptide
  Seed: KATDKDYSAF (MAGC3_HUMAN)
KSTDKDYSAW

SEQ ID NO: 101175 - protein, 10 aa, Artificial Sequence
  Description of Artificial Sequence: Synthetic peptide
  Seed: MLTTVIKKYK (MAGC3_HUMAN)
MHTTVIKKYK

SEQ ID NO: 101176 - protein, 10 aa, Artificial Sequence
  Description of Artificial Sequence: Synthetic peptide
  Seed: LPTWRRGTGY (MAGC3_HUMAN)
LQTWRRGTGF

SEQ ID NO: 101177 - protein, 10 aa, Artificial Sequence
  Description of Artificial Sequence: Synthetic peptide
  Seed: KLVQFLLLKY (MAGC3_HUMAN)
KVVQFLLLKK

SEQ ID NO: 101178 - protein, 10 aa, Artificial Sequence
  Description of Artificial Sequence: Synthetic peptide
  Seed: VPEEVIWEVL (MAGC3_HUMAN)
VEEEVIWEVL

SEQ ID NO: 101179 - protein, 10 aa, Artificial Sequence
  Description of Artificial Sequence: Synthetic peptide
  Seed: YALSPVVLPP (MAGC3_HUMAN)
YFLSPVVLPT

SEQ ID NO: 101180 - protein, 9 aa, Artificial Sequence
  Description of Artificial Sequence: Synthetic peptide
  Seed: QAKEPLTRA (MAGC3_HUMAN)
QSKEPLTRY

SEQ ID NO: 101181 - protein, 9 aa, Artificial Sequence
  Description of Artificial Sequence: Synthetic peptide
  Seed: QTKEPVTKA (MAGC3_HUMAN)
QTKEPVTKL

SEQ ID NO: 101182 - protein, 10 aa, Artificial Sequence
  Description of Artificial Sequence: Synthetic peptide
  Seed: LIFGIALTDM (MAGC3_HUMAN)
LMFGIALTDL

SEQ ID NO: 101183 - protein, 11 aa, Artificial Sequence
  Description of Artificial Sequence: Synthetic peptide
  Seed: SSEEEDTATWH (MAGC3_HUMAN)
STEEEDTATWY

SEQ ID NO: 101184 - protein, 9 aa, Artificial Sequence
  Description of Artificial Sequence: Synthetic peptide
  Seed: SIIPSAFPS (MAGC3_HUMAN)
SVIPSAFPT

SEQ ID NO: 101185 - protein, 10 aa, Artificial Sequence
  Description of Artificial Sequence: Synthetic peptide
  Seed: TGYFPMIFRK (MAGC3_HUMAN)
TMYFPMIFRI

SEQ ID NO: 101186 - protein, 9 aa, Artificial Sequence
  Description of Artificial Sequence: Synthetic peptide
  Seed: ALAGFADVL (MAGC3_HUMAN)
AIAGFADVA

SEQ ID NO: 101187 - protein, 9 aa, Artificial Sequence
  Description of Artificial Sequence: Synthetic peptide
  Seed: FLSKLSSII (MAGC3_HUMAN)
FVSKLSSIL

SEQ ID NO: 101188 - protein, 9 aa, Artificial Sequence
  Description of Artificial Sequence: Synthetic peptide
  Seed: ADVLSRLAL (MAGC3_HUMAN)
AEVLSRLAY

SEQ ID NO: 101189 - protein, 9 aa, Artificial Sequence
  Description of Artificial Sequence: Synthetic peptide
  Seed: SESLPRYAL (MAGC3_HUMAN)
SRSLPRYAL

SEQ ID NO: 101190 - protein, 9 aa, Artificial Sequence
  Description of Artificial Sequence: Synthetic peptide
  Seed: YKDYFPMIF (MAGC3_HUMAN)
YGDYFPMIL

SEQ ID NO: 101191 - protein, 10 aa, Artificial Sequence
  Description of Artificial Sequence: Synthetic peptide
  Seed: FPSWYMDALK (MAGC3_HUMAN)
FPSWYMDALM

SEQ ID NO: 101192 - protein, 9 aa, Artificial Sequence
  Description of Artificial Sequence: Synthetic peptide
  Seed: FLSKLSSII (MAGC3_HUMAN)
FQSKLSSIH

SEQ ID NO: 101193 - protein, 9 aa, Artificial Sequence
  Description of Artificial Sequence: Synthetic peptide
  Seed: KLVQFLLLK (MAGC3_HUMAN)
KVVQFLLLY

SEQ ID NO: 101194 - protein, 9 aa, Artificial Sequence
  Description of Artificial Sequence: Synthetic peptide
  Seed: KLSSIIPSA (MAGC3_HUMAN)
KASSIIPSL

SEQ ID NO: 101195 - protein, 9 aa, Artificial Sequence
  Description of Artificial Sequence: Synthetic peptide
  Seed: MQMNVINTY (MAGC3_HUMAN)
MIMNVINTR

SEQ ID NO: 101196 - protein, 9 aa, Artificial Sequence
  Description of Artificial Sequence: Synthetic peptide
  Seed: VIWEVLSAI (MAGC3_HUMAN)
VAWEVLSAY

SEQ ID NO: 101197 - protein, 9 aa, Artificial Sequence
  Description of Artificial Sequence: Synthetic peptide
  Seed: SLPAVSPGK (MAGC3_HUMAN)
SMPAVSPGK

SEQ ID NO: 101198 - protein, 9 aa, Artificial Sequence
  Description of Artificial Sequence: Synthetic peptide
  Seed: KLSSIIPSA (MAGC3_HUMAN)
KQSSIIPSR

SEQ ID NO: 101199 - protein, 10 aa, Artificial Sequence
  Description of Artificial Sequence: Synthetic peptide
  Seed: HLREVRLFLR (MAGC3_HUMAN)
HAREVRLFLR

SEQ ID NO: 101200 - protein, 8 aa, Artificial Sequence
  Description of Artificial Sequence: Synthetic peptide
  Seed: FLSKLSSI (MAGC3_HUMAN)
FLSKLSSL

SEQ ID NO: 101201 - protein, 9 aa, Artificial Sequence
  Description of Artificial Sequence: Synthetic peptide
  Seed: MASASPSVM (MAGC3_HUMAN)
MQSASPSVL

SEQ ID NO: 101202 - protein, 9 aa, Artificial Sequence
  Description of Artificial Sequence: Synthetic peptide
  Seed: YQAKEPLTR (MAGC3_HUMAN)
YTAKEPLTI

SEQ ID NO: 101203 - protein, 9 aa, Artificial Sequence
  Description of Artificial Sequence: Synthetic peptide
  Seed: IPPQGPPKI (MAGC3_HUMAN)
ILPQGPPKM

SEQ ID NO: 101204 - protein, 9 aa, Artificial Sequence
  Description of Artificial Sequence: Synthetic peptide
  Seed: DTTDDATAM (MAGC3_HUMAN)
DMTDDATAR

SEQ ID NO: 101205 - protein, 9 aa, Artificial Sequence
  Description of Artificial Sequence: Synthetic peptide
  Seed: IELIFGIAL (MAGC3_HUMAN)
IQLIFGIAI

SEQ ID NO: 101206 - protein, 9 aa, Artificial Sequence
  Description of Artificial Sequence: Synthetic peptide
  Seed: TYTGYFPMI (MAGC3_HUMAN)
TYTGYFPMF

SEQ ID NO: 101207 - protein, 9 aa, Artificial Sequence
  Description of Artificial Sequence: Synthetic peptide
  Seed: WRRGTGYTL (MAGC3_HUMAN)
WFRGTGYTI

SEQ ID NO: 101208 - protein, 10 aa, Artificial Sequence
  Description of Artificial Sequence: Synthetic peptide
  Seed: LDSCSSPLLW (MAGC3_HUMAN)
LVSCSSPLLF

SEQ ID NO: 101209 - protein, 9 aa, Artificial Sequence
  Description of Artificial Sequence: Synthetic peptide
  Seed: LSRLALWES (MAGC3_HUMAN)
LARLALWEK

SEQ ID NO: 101210 - protein, 10 aa, Artificial Sequence
  Description of Artificial Sequence: Synthetic peptide
  Seed: AMASASPSVM (MAGC3_HUMAN)
AKASASPSVY

SEQ ID NO: 101211 - protein, 11 aa, Artificial Sequence
  Description of Artificial Sequence: Synthetic peptide
  Seed: TAMASASPSVM (MAGC3_HUMAN)
TLMASASPSVF

SEQ ID NO: 101212 - protein, 9 aa, Artificial Sequence
  Description of Artificial Sequence: Synthetic peptide
  Seed: MLLPCHWVL (MAGC3_HUMAN)
MSLPCHWVY

SEQ ID NO: 101213 - protein, 11 aa, Artificial Sequence
  Description of Artificial Sequence: Synthetic peptide
  Seed: NTLDLTCEGSL (MAGC3_HUMAN)
NALDLTCEGSW

SEQ ID NO: 101214 - protein, 9 aa, Artificial Sequence
  Description of Artificial Sequence: Synthetic peptide
  Seed: EVDPDHFYV (MAGC3_HUMAN)
EYDPDHFYL

SEQ ID NO: 101215 - protein, 9 aa, Artificial Sequence
  Description of Artificial Sequence: Synthetic peptide
  Seed: YFFEDTLDL (MAGC3_HUMAN)
YAFEDTLDI

SEQ ID NO: 101216 - protein, 10 aa, Artificial Sequence
  Description of Artificial Sequence: Synthetic peptide
  Seed: YALSPVVLPP (MAGC3_HUMAN)
YPLSPVVLPA

SEQ ID NO: 101217 - protein, 9 aa, Artificial Sequence
  Description of Artificial Sequence: Synthetic peptide
  Seed: MQMNVINTY (MAGC3_HUMAN)
MVMNVINTV

SEQ ID NO: 101218 - protein, 10 aa, Artificial Sequence
  Description of Artificial Sequence: Synthetic peptide
  Seed: KDMEDRAQAI (MAGC3_HUMAN)
KEMEDRAQAA

SEQ ID NO: 101219 - protein, 10 aa, Artificial Sequence
  Description of Artificial Sequence: Synthetic peptide
  Seed: LPTWRRGTGY (MAGC3_HUMAN)
LKTWRRGTGW

SEQ ID NO: 101220 - protein, 10 aa, Artificial Sequence
  Description of Artificial Sequence: Synthetic peptide
  Seed: MDSLVLCPTY (MAGC3_HUMAN)
MRSLVLCPTW

SEQ ID NO: 101221 - protein, 9 aa, Artificial Sequence
  Description of Artificial Sequence: Synthetic peptide
  Seed: EVDPDHFYV (MAGC3_HUMAN)
EGDPDHFYL

SEQ ID NO: 101222 - protein, 9 aa, Artificial Sequence
  Description of Artificial Sequence: Synthetic peptide
  Seed: EFIELIFGI (MAGC3_HUMAN)
ESIELIFGA

SEQ ID NO: 101223 - protein, 9 aa, Artificial Sequence
  Description of Artificial Sequence: Synthetic peptide
  Seed: DSDLPTWRR (MAGC3_HUMAN)
DTDLPTWRY

SEQ ID NO: 101224 - protein, 11 aa, Artificial Sequence
  Description of Artificial Sequence: Synthetic peptide
  Seed: KVAELVQFLLL (MAGC3_HUMAN)
KMAELVQFLLM

SEQ ID NO: 101225 - protein, 10 aa, Artificial Sequence
  Description of Artificial Sequence: Synthetic peptide
  Seed: ILILSVIFIK (MAGC3_HUMAN)
IQILSVIFIR

SEQ ID NO: 101226 - protein, 10 aa, Artificial Sequence
  Description of Artificial Sequence: Synthetic peptide
  Seed: LSLPAVSPGK (MAGC3_HUMAN)
LALPAVSPGK

SEQ ID NO: 101227 - protein, 10 aa, Artificial Sequence
  Description of Artificial Sequence: Synthetic peptide
  Seed: TTDDATAMAS (MAGC3_HUMAN)
TNDDATAMAI

SEQ ID NO: 101228 - protein, 10 aa, Artificial Sequence
  Description of Artificial Sequence: Synthetic peptide
  Seed: TLSGSPGLQL (MAGC3_HUMAN)
TASGSPGLQL

SEQ ID NO: 101229 - protein, 10 aa, Artificial Sequence
  Description of Artificial Sequence: Synthetic peptide
  Seed: IPSAFPSWYM (MAGC3_HUMAN)
ISSAFPSWYY

SEQ ID NO: 101230 - protein, 9 aa, Artificial Sequence
  Description of Artificial Sequence: Synthetic peptide
  Seed: SLVLCPTYF (MAGC3_HUMAN)
SMVLCPTYK

SEQ ID NO: 101231 - protein, 10 aa, Artificial Sequence
  Description of Artificial Sequence: Synthetic peptide
  Seed: SKLSSIIPSA (MAGC3_HUMAN)
SHLSSIIPSL

SEQ ID NO: 101232 - protein, 11 aa, Artificial Sequence
  Description of Artificial Sequence: Synthetic peptide
  Seed: AEMQMNVINTY (MAGC3_HUMAN)
AQMQMNVINTY

SEQ ID NO: 101233 - protein, 11 aa, Artificial Sequence
  Description of Artificial Sequence: Synthetic peptide
  Seed: HALPESESLPR (MAGC3_HUMAN)
HVLPESESLPR

SEQ ID NO: 101234 - protein, 9 aa, Artificial Sequence
  Description of Artificial Sequence: Synthetic peptide
  Seed: LILILSMIF (MAGC3_HUMAN)
LMLILSMIF

SEQ ID NO: 101235 - protein, 9 aa, Artificial Sequence
  Description of Artificial Sequence: Synthetic peptide
  Seed: WRRGTGYTL (MAGC3_HUMAN)
WTRGTGYTF

SEQ ID NO: 101236 - protein, 11 aa, Artificial Sequence
  Description of Artificial Sequence: Synthetic peptide
  Seed: LPCHWVLDATF (MAGC3_HUMAN)
LPCHWVLDATW

SEQ ID NO: 101237 - protein, 11 aa, Artificial Sequence
  Description of Artificial Sequence: Synthetic peptide
  Seed: RTLSGSPGLQL (MAGC3_HUMAN)
RSLSGSPGLQY

SEQ ID NO: 101238 - protein, 9 aa, Artificial Sequence
  Description of Artificial Sequence: Synthetic peptide
  Seed: EFIELIFGI (MAGC3_HUMAN)
EMIELIFGI

SEQ ID NO: 101239 - protein, 9 aa, Artificial Sequence
  Description of Artificial Sequence: Synthetic peptide
  Seed: KYKDYFPMI (MAGC3_HUMAN)
KSKDYFPMA

SEQ ID NO: 101240 - protein, 11 aa, Artificial Sequence
  Description of Artificial Sequence: Synthetic peptide
  Seed: SSSEEEDTATW (MAGC3_HUMAN)
SLSEEEDTATM

SEQ ID NO: 101241 - protein, 10 aa, Artificial Sequence
  Description of Artificial Sequence: Synthetic peptide
  Seed: TGYFPMIFRK (MAGC3_HUMAN)
TAYFPMIFRM

SEQ ID NO: 101242 - protein, 10 aa, Artificial Sequence
  Description of Artificial Sequence: Synthetic peptide
  Seed: MNVINTYTGY (MAGC3_HUMAN)
MSVINTYTGK

SEQ ID NO: 101243 - protein, 9 aa, Artificial Sequence
  Description of Artificial Sequence: Synthetic peptide
  Seed: RGTGYTLSL (MAGC3_HUMAN)
RKTGYTLSL

SEQ ID NO: 101244 - protein, 10 aa, Artificial Sequence
  Description of Artificial Sequence: Synthetic peptide
  Seed: TGYFPMIFRK (MAGC3_HUMAN)
TLYFPMIFRK

SEQ ID NO: 101245 - protein, 9 aa, Artificial Sequence
  Description of Artificial Sequence: Synthetic peptide
  Seed: YTGYFPMIF (MAGC3_HUMAN)
YWGYFPMIF

SEQ ID NO: 101246 - protein, 11 aa, Artificial Sequence
  Description of Artificial Sequence: Synthetic peptide
  Seed: ATFSDGSLGQW (MAGC3_HUMAN)
ALFSDGSLGQR

SEQ ID NO: 101247 - protein, 9 aa, Artificial Sequence
  Description of Artificial Sequence: Synthetic peptide
  Seed: TEASPQQKK (MAGC3_HUMAN)
TAASPQQKR

SEQ ID NO: 101248 - protein, 9 aa, Artificial Sequence
  Description of Artificial Sequence: Synthetic peptide
  Seed: KYKDYFPMI (MAGC3_HUMAN)
KIKDYFPMI

SEQ ID NO: 101249 - protein, 10 aa, Artificial Sequence
  Description of Artificial Sequence: Synthetic peptide
  Seed: YALDEKVAEL (MAGC3_HUMAN)
YFLDEKVAEI

SEQ ID NO: 101250 - protein, 9 aa, Artificial Sequence
  Description of Artificial Sequence: Synthetic peptide
  Seed: WVKNTCATY (MAGC3_HUMAN)
WWKNTCATF

SEQ ID NO: 101251 - protein, 9 aa, Artificial Sequence
  Description of Artificial Sequence: Synthetic peptide
  Seed: IPPQGPPKI (MAGC3_HUMAN)
ILPQGPPKY

SEQ ID NO: 101252 - protein, 9 aa, Artificial Sequence
  Description of Artificial Sequence: Synthetic peptide
  Seed: GFADVLSRL (MAGC3_HUMAN)
GSADVLSRA

SEQ ID NO: 101253 - protein, 11 aa, Artificial Sequence
  Description of Artificial Sequence: Synthetic peptide
  Seed: AEMQMNVINTY (MAGC3_HUMAN)
AEMQMNVINTT

SEQ ID NO: 101254 - protein, 10 aa, Artificial Sequence
  Description of Artificial Sequence: Synthetic peptide
  Seed: KYQTKEPVTK (MAGC3_HUMAN)
KVQTKEPVTK

SEQ ID NO: 101255 - protein, 9 aa, Artificial Sequence
  Description of Artificial Sequence: Synthetic peptide
  Seed: MDPDNHSYF (MAGC3_HUMAN)
MFPDNHSYF

SEQ ID NO: 101256 - protein, 8 aa, Artificial Sequence
  Description of Artificial Sequence: Synthetic peptide
  Seed: AEMQMNVI (MAGC3_HUMAN)
AEMQMNVA

SEQ ID NO: 101257 - protein, 9 aa, Artificial Sequence
  Description of Artificial Sequence: Synthetic peptide
  Seed: IPPQGPPKI (MAGC3_HUMAN)
IGPQGPPKL

SEQ ID NO: 101258 - protein, 11 aa, Artificial Sequence
  Description of Artificial Sequence: Synthetic peptide
  Seed: RTLSGSPGLQL (MAGC3_HUMAN)
RQLSGSPGLQR

SEQ ID NO: 101259 - protein, 9 aa, Artificial Sequence
  Description of Artificial Sequence: Synthetic peptide
  Seed: FSLRRAVSV (MAGC3_HUMAN)
FVLRRAVSA

SEQ ID NO: 101260 - protein, 9 aa, Artificial Sequence
  Description of Artificial Sequence: Synthetic peptide
  Seed: YQAKEPLTR (MAGC3_HUMAN)
YGAKEPLTY

SEQ ID NO: 101261 - protein, 9 aa, Artificial Sequence
  Description of Artificial Sequence: Synthetic peptide
  Seed: KEPVTKAEM (MAGC3_HUMAN)
KAPVTKAEL

SEQ ID NO: 101262 - protein, 10 aa, Artificial Sequence
  Description of Artificial Sequence: Synthetic peptide
  Seed: TGYFPMIFRK (MAGC3_HUMAN)
TYYFPMIFRK

SEQ ID NO: 101263 - protein, 9 aa, Artificial Sequence
  Description of Artificial Sequence: Synthetic peptide
  Seed: YSAFHLGHL (MAGC3_HUMAN)
YFAFHLGHM

SEQ ID NO: 101264 - protein, 9 aa, Artificial Sequence
  Description of Artificial Sequence: Synthetic peptide
  Seed: TGYFPMIFR (MAGC3_HUMAN)
TTYFPMIFR

SEQ ID NO: 101265 - protein, 11 aa, Artificial Sequence
  Description of Artificial Sequence: Synthetic peptide
  Seed: LSKLSSIIPSA (MAGC3_HUMAN)
LHKLSSIIPSI

SEQ ID NO: 101266 - protein, 9 aa, Artificial Sequence
  Description of Artificial Sequence: Synthetic peptide
  Seed: EFIELIFGI (MAGC3_HUMAN)
ELIELIFGI

SEQ ID NO: 101267 - protein, 10 aa, Artificial Sequence
  Description of Artificial Sequence: Synthetic peptide
  Seed: SKLSSIIPSA (MAGC3_HUMAN)
SDLSSIIPSL

SEQ ID NO: 101268 - protein, 9 aa, Artificial Sequence
  Description of Artificial Sequence: Synthetic peptide
  Seed: WVKNTCATY (MAGC3_HUMAN)
WAKNTCATM

SEQ ID NO: 101269 - protein, 9 aa, Artificial Sequence
  Description of Artificial Sequence: Synthetic peptide
  Seed: FSDGSLGQW (MAGC3_HUMAN)
FADGSLGQC

SEQ ID NO: 101270 - protein, 9 aa, Artificial Sequence
  Description of Artificial Sequence: Synthetic peptide
  Seed: WESEGPEAF (MAGC3_HUMAN)
WESEGPEAM

SEQ ID NO: 101271 - protein, 9 aa, Artificial Sequence
  Description of Artificial Sequence: Synthetic peptide
  Seed: EIPPQGPPK (MAGC3_HUMAN)
EFPPQGPPR

SEQ ID NO: 101272 - protein, 9 aa, Artificial Sequence
  Description of Artificial Sequence: Synthetic peptide
  Seed: PLPQSPPEI (MAGC3_HUMAN)
PVPQSPPEL

SEQ ID NO: 101273 - protein, 10 aa, Artificial Sequence
  Description of Artificial Sequence: Synthetic peptide
  Seed: LVLCPTYFKL (MAGC3_HUMAN)
LCLCPTYFKV

SEQ ID NO: 101274 - protein, 9 aa, Artificial Sequence
  Description of Artificial Sequence: Synthetic peptide
  Seed: FPSWYMDAL (MAGC3_HUMAN)
FMSWYMDAF

SEQ ID NO: 101275 - protein, 10 aa, Artificial Sequence
  Description of Artificial Sequence: Synthetic peptide
  Seed: NTYTGYFPMI (MAGC3_HUMAN)
NLYTGYFPMF

SEQ ID NO: 101276 - protein, 9 aa, Artificial Sequence
  Description of Artificial Sequence: Synthetic peptide
  Seed: MQMNVINTY (MAGC3_HUMAN)
MQMNVINTS

SEQ ID NO: 101277 - protein, 9 aa, Artificial Sequence
  Description of Artificial Sequence: Synthetic peptide
  Seed: FEDTLDLTY (MAGC3_HUMAN)
FPDTLDLTF

SEQ ID NO: 101278 - protein, 10 aa, Artificial Sequence
  Description of Artificial Sequence: Synthetic peptide
  Seed: ILILSMIFIK (MAGC3_HUMAN)
IVILSMIFIK

SEQ ID NO: 101279 - protein, 10 aa, Artificial Sequence
  Description of Artificial Sequence: Synthetic peptide
  Seed: RMDSLVLCPT (MAGC3_HUMAN)
RMDSLVLCPV

SEQ ID NO: 101280 - protein, 9 aa, Artificial Sequence
  Description of Artificial Sequence: Synthetic peptide
  Seed: IPPQGPPKI (MAGC3_HUMAN)
IAPQGPPKL

SEQ ID NO: 101281 - protein, 8 aa, Artificial Sequence
  Description of Artificial Sequence: Synthetic peptide
  Seed: YTLSLPAV (MAGC3_HUMAN)
YQLSLPAV

SEQ ID NO: 101282 - protein, 10 aa, Artificial Sequence
  Description of Artificial Sequence: Synthetic peptide
  Seed: FSDGSLGQWV (MAGC3_HUMAN)
FTDGSLGQWY

SEQ ID NO: 101283 - protein, 9 aa, Artificial Sequence
  Description of Artificial Sequence: Synthetic peptide
  Seed: IPPQGPPKI (MAGC3_HUMAN)
IQPQGPPKV

SEQ ID NO: 101284 - protein, 11 aa, Artificial Sequence
  Description of Artificial Sequence: Synthetic peptide
  Seed: AEMQMNVINTY (MAGC3_HUMAN)
AGMQMNVINTY

SEQ ID NO: 101285 - protein, 10 aa, Artificial Sequence
  Description of Artificial Sequence: Synthetic peptide
  Seed: INTYTGYFPM (MAGC3_HUMAN)
IGTYTGYFPF

SEQ ID NO: 101286 - protein, 10 aa, Artificial Sequence
  Description of Artificial Sequence: Synthetic peptide
  Seed: AMASASPSVM (MAGC3_HUMAN)
AMASASPSVV

SEQ ID NO: 101287 - protein, 9 aa, Artificial Sequence
  Description of Artificial Sequence: Synthetic peptide
  Seed: HLREVRLFL (MAGC3_HUMAN)
HAREVRLFK

SEQ ID NO: 101288 - protein, 9 aa, Artificial Sequence
  Description of Artificial Sequence: Synthetic peptide
  Seed: RPAREVLEF (MAGC3_HUMAN)
RAAREVLEM

SEQ ID NO: 101289 - protein, 9 aa, Artificial Sequence
  Description of Artificial Sequence: Synthetic peptide
  Seed: MQMNVINTY (MAGC3_HUMAN)
MAMNVINTY

SEQ ID NO: 101290 - protein, 10 aa, Artificial Sequence
  Description of Artificial Sequence: Synthetic peptide
  Seed: SKLSSIIPSA (MAGC3_HUMAN)
SGLSSIIPSI

SEQ ID NO: 101291 - protein, 9 aa, Artificial Sequence
  Description of Artificial Sequence: Synthetic peptide
  Seed: ALDEKVAEL (MAGC3_HUMAN)
ATDEKVAEI

SEQ ID NO: 101292 - protein, 9 aa, Artificial Sequence
  Description of Artificial Sequence: Synthetic peptide
  Seed: SAFHLGHLR (MAGC3_HUMAN)
STFHLGHLY

SEQ ID NO: 101293 - protein, 10 aa, Artificial Sequence
  Description of Artificial Sequence: Synthetic peptide
  Seed: REVLEFLSKL (MAGC3_HUMAN)
REVLEFLSKF

SEQ ID NO: 101294 - protein, 9 aa, Artificial Sequence
  Description of Artificial Sequence: Synthetic peptide
  Seed: MIFIKGSCV (MAGC3_HUMAN)
MSFIKGSCY

SEQ ID NO: 101295 - protein, 9 aa, Artificial Sequence
  Description of Artificial Sequence: Synthetic peptide
  Seed: YFFEDTLDL (MAGC3_HUMAN)
YTFEDTLDF

SEQ ID NO: 101296 - protein, 9 aa, Artificial Sequence
  Description of Artificial Sequence: Synthetic peptide
  Seed: MIFGKAHEF (MAGC3_HUMAN)
MDFGKAHEY

SEQ ID NO: 101297 - protein, 9 aa, Artificial Sequence
  Description of Artificial Sequence: Synthetic peptide
  Seed: GQWVKNTCA (MAGC3_HUMAN)
GEWVKNTCA

SEQ ID NO: 101298 - protein, 9 aa, Artificial Sequence
  Description of Artificial Sequence: Synthetic peptide
  Seed: KKYKDYFPM (MAGC3_HUMAN)
KTYKDYFPF

SEQ ID NO: 101299 - protein, 11 aa, Artificial Sequence
  Description of Artificial Sequence: Synthetic peptide
  Seed: KVAELVQFLLL (MAGC3_HUMAN)
KMAELVQFLLL

SEQ ID NO: 101300 - protein, 9 aa, Artificial Sequence
  Description of Artificial Sequence: Synthetic peptide
  Seed: ALDEKVAEL (MAGC3_HUMAN)
ARDEKVAEM

SEQ ID NO: 101301 - protein, 11 aa, Artificial Sequence
  Description of Artificial Sequence: Synthetic peptide
  Seed: SLPESEPLFTY (MAGC3_HUMAN)
SMPESEPLFTL

SEQ ID NO: 101302 - protein, 9 aa, Artificial Sequence
  Description of Artificial Sequence: Synthetic peptide
  Seed: DVLSRLALW (MAGC3_HUMAN)
DVLSRLALF

SEQ ID NO: 101303 - protein, 9 aa, Artificial Sequence
  Description of Artificial Sequence: Synthetic peptide
  Seed: VLPPQPQPR (MAGC3_HUMAN)
VCPPQPQPM

SEQ ID NO: 101304 - protein, 9 aa, Artificial Sequence
  Description of Artificial Sequence: Synthetic peptide
  Seed: KYKDYFPMI (MAGC3_HUMAN)
KMKDYFPMR

SEQ ID NO: 101305 - protein, 9 aa, Artificial Sequence
  Description of Artificial Sequence: Synthetic peptide
  Seed: KYKDYFPMI (MAGC3_HUMAN)
KTKDYFPMR

SEQ ID NO: 101306 - protein, 9 aa, Artificial Sequence
  Description of Artificial Sequence: Synthetic peptide
  Seed: FSDGSLGQW (MAGC3_HUMAN)
FWDGSLGQM

SEQ ID NO: 101307 - protein, 10 aa, Artificial Sequence
  Description of Artificial Sequence: Synthetic peptide
  Seed: ATYALSPVVL (MAGC3_HUMAN)
ATYALSPVVW

SEQ ID NO: 101308 - protein, 9 aa, Artificial Sequence
  Description of Artificial Sequence: Synthetic peptide
  Seed: YQTKEPVTK (MAGC3_HUMAN)
YSTKEPVTF

SEQ ID NO: 101309 - protein, 9 aa, Artificial Sequence
  Description of Artificial Sequence: Synthetic peptide
  Seed: IQRPAREVL (MAGC3_HUMAN)
IMRPAREVM

SEQ ID NO: 101310 - protein, 9 aa, Artificial Sequence
  Description of Artificial Sequence: Synthetic peptide
  Seed: HFYVFVNTL (MAGC3_HUMAN)
HPYVFVNTY

SEQ ID NO: 101311 - protein, 11 aa, Artificial Sequence
  Description of Artificial Sequence: Synthetic peptide
  Seed: RGLTEASPQQK (MAGC3_HUMAN)
RLLTEASPQQK

SEQ ID NO: 101312 - protein, 10 aa, Artificial Sequence
  Description of Artificial Sequence: Synthetic peptide
  Seed: EVIWEVLNAI (MAGC3_HUMAN)
ESIWEVLNAA

SEQ ID NO: 101313 - protein, 9 aa, Artificial Sequence
  Description of Artificial Sequence: Synthetic peptide
  Seed: MQMNVINTY (MAGC3_HUMAN)
MYMNVINTA

SEQ ID NO: 101314 - protein, 10 aa, Artificial Sequence
  Description of Artificial Sequence: Synthetic peptide
  Seed: LVLCPTYFKL (MAGC3_HUMAN)
LSLCPTYFKV

SEQ ID NO: 101315 - protein, 9 aa, Artificial Sequence
  Description of Artificial Sequence: Synthetic peptide
  Seed: MEDRAQAII (MAGC3_HUMAN)
MEDRAQAIV

SEQ ID NO: 101316 - protein, 9 aa, Artificial Sequence
  Description of Artificial Sequence: Synthetic peptide
  Seed: QGMPQNRLL (MAGC3_HUMAN)
QAMPQNRLW

SEQ ID NO: 101317 - protein, 9 aa, Artificial Sequence
  Description of Artificial Sequence: Synthetic peptide
  Seed: SEEEDTATW (MAGC3_HUMAN)
SVEEDTATF

SEQ ID NO: 101318 - protein, 9 aa, Artificial Sequence
  Description of Artificial Sequence: Synthetic peptide
  Seed: QPQPRKKAT (MAGC3_HUMAN)
QLQPRKKAL

SEQ ID NO: 101319 - protein, 10 aa, Artificial Sequence
  Description of Artificial Sequence: Synthetic peptide
  Seed: AFPSWYMDAL (MAGC3_HUMAN)
AYPSWYMDAF

SEQ ID NO: 101320 - protein, 10 aa, Artificial Sequence
  Description of Artificial Sequence: Synthetic peptide
  Seed: KLVQFLLLKY (MAGC3_HUMAN)
KQVQFLLLKF

SEQ ID NO: 101321 - protein, 9 aa, Artificial Sequence
  Description of Artificial Sequence: Synthetic peptide
  Seed: DYSAFHLGH (MAGC3_HUMAN)
DTSAFHLGR

SEQ ID NO: 101322 - protein, 9 aa, Artificial Sequence
  Description of Artificial Sequence: Synthetic peptide
  Seed: SASPSVMST (MAGC3_HUMAN)
SISPSVMSI

SEQ ID NO: 101323 - protein, 9 aa, Artificial Sequence
  Description of Artificial Sequence: Synthetic peptide
  Seed: LSSIIPSAF (MAGC3_HUMAN)
LISIIPSAM

SEQ ID NO: 101324 - protein, 10 aa, Artificial Sequence
  Description of Artificial Sequence: Synthetic peptide
  Seed: TYTGYFPMIF (MAGC3_HUMAN)
TWTGYFPMIY

SEQ ID NO: 101325 - protein, 9 aa, Artificial Sequence
  Description of Artificial Sequence: Synthetic peptide
  Seed: ALDEKVAEL (MAGC3_HUMAN)
ACDEKVAEF

SEQ ID NO: 101326 - protein, 9 aa, Artificial Sequence
  Description of Artificial Sequence: Synthetic peptide
  Seed: AMASASPSV (MAGC3_HUMAN)
ASASASPSM

SEQ ID NO: 101327 - protein, 9 aa, Artificial Sequence
  Description of Artificial Sequence: Synthetic peptide
  Seed: DMDPDNHSY (MAGC3_HUMAN)
DIDPDNHSV

SEQ ID NO: 101328 - protein, 9 aa, Artificial Sequence
  Description of Artificial Sequence: Synthetic peptide
  Seed: FHLGHLREV (MAGC3_HUMAN)
FNLGHLREI

SEQ ID NO: 101329 - protein, 9 aa, Artificial Sequence
  Description of Artificial Sequence: Synthetic peptide
  Seed: RPAREVLEF (MAGC3_HUMAN)
RHAREVLEY

SEQ ID NO: 101330 - protein, 10 aa, Artificial Sequence
  Description of Artificial Sequence: Synthetic peptide
  Seed: IKKYKDYFPM (MAGC3_HUMAN)
IHKYKDYFPY

SEQ ID NO: 101331 - protein, 10 aa, Artificial Sequence
  Description of Artificial Sequence: Synthetic peptide
  Seed: ELVQFLLLKY (MAGC3_HUMAN)
ETVQFLLLKK

SEQ ID NO: 101332 - protein, 10 aa, Artificial Sequence
  Description of Artificial Sequence: Synthetic peptide
  Seed: GEKAGSLPES (MAGC3_HUMAN)
GEKAGSLPEA

SEQ ID NO: 101333 - protein, 10 aa, Artificial Sequence
  Description of Artificial Sequence: Synthetic peptide
  Seed: IIDTTDDATA (MAGC3_HUMAN)
IVDTTDDATM

SEQ ID NO: 101334 - protein, 9 aa, Artificial Sequence
  Description of Artificial Sequence: Synthetic peptide
  Seed: TLDEKVDKL (MAGC3_HUMAN)
TFDEKVDKV

SEQ ID NO: 101335 - protein, 9 aa, Artificial Sequence
  Description of Artificial Sequence: Synthetic peptide
  Seed: HLREVRLFL (MAGC3_HUMAN)
HPREVRLFA

SEQ ID NO: 101336 - protein, 9 aa, Artificial Sequence
  Description of Artificial Sequence: Synthetic peptide
  Seed: MPAAGMPPL (MAGC3_HUMAN)
MQAAGMPPM

SEQ ID NO: 101337 - protein, 10 aa, Artificial Sequence
  Description of Artificial Sequence: Synthetic peptide
  Seed: AMASASPSVM (MAGC3_HUMAN)
AMASASPSVW

SEQ ID NO: 101338 - protein, 10 aa, Artificial Sequence
  Description of Artificial Sequence: Synthetic peptide
  Seed: TGYFPMIFRK (MAGC3_HUMAN)
TWYFPMIFRR

SEQ ID NO: 101339 - protein, 11 aa, Artificial Sequence
  Description of Artificial Sequence: Synthetic peptide
  Seed: ATFSDGSLGQW (MAGC3_HUMAN)
AVFSDGSLGQR

SEQ ID NO: 101340 - protein, 10 aa, Artificial Sequence
  Description of Artificial Sequence: Synthetic peptide
  Seed: IPSAFPSWYM (MAGC3_HUMAN)
IHSAFPSWYW

SEQ ID NO: 101341 - protein, 10 aa, Artificial Sequence
  Description of Artificial Sequence: Synthetic peptide
  Seed: LLKYQAKEPL (MAGC3_HUMAN)
LWKYQAKEPF

SEQ ID NO: 101342 - protein, 11 aa, Artificial Sequence
  Description of Artificial Sequence: Synthetic peptide
  Seed: FPMIFGKAHEF (MAGC3_HUMAN)
FAMIFGKAHEM

SEQ ID NO: 101343 - protein, 9 aa, Artificial Sequence
  Description of Artificial Sequence: Synthetic peptide
  Seed: LSSIIPSAF (MAGC3_HUMAN)
LHSIIPSAM

SEQ ID NO: 101344 - protein, 9 aa, Artificial Sequence
  Description of Artificial Sequence: Synthetic peptide
  Seed: MPAAGMPPL (MAGC3_HUMAN)
MSAAGMPPI

SEQ ID NO: 101345 - protein, 10 aa, Artificial Sequence
  Description of Artificial Sequence: Synthetic peptide
  Seed: YFPMIFGKAH (MAGC3_HUMAN)
YWPMIFGKAM

SEQ ID NO: 101346 - protein, 10 aa, Artificial Sequence
  Description of Artificial Sequence: Synthetic peptide
  Seed: SIIPSAFPSW (MAGC3_HUMAN)
SQIPSAFPSI

SEQ ID NO: 101347 - protein, 9 aa, Artificial Sequence
  Description of Artificial Sequence: Synthetic peptide
  Seed: IIPSAFPSW (MAGC3_HUMAN)
ILPSAFPSM

SEQ ID NO: 101348 - protein, 10 aa, Artificial Sequence
  Description of Artificial Sequence: Synthetic peptide
  Seed: MDPDNHSYFF (MAGC3_HUMAN)
MNPDNHSYFY

SEQ ID NO: 101349 - protein, 10 aa, Artificial Sequence
  Description of Artificial Sequence: Synthetic peptide
  Seed: EEVIWEVLNA (MAGC3_HUMAN)
EAVIWEVLNV

SEQ ID NO: 101350 - protein, 9 aa, Artificial Sequence
  Description of Artificial Sequence: Synthetic peptide
  Seed: NTYTGYFPM (MAGC3_HUMAN)
NMYTGYFPV

SEQ ID NO: 101351 - protein, 11 aa, Artificial Sequence
  Description of Artificial Sequence: Synthetic peptide
  Seed: YTGYFPMIFRK (MAGC3_HUMAN)
YMGYFPMIFRR

SEQ ID NO: 101352 - protein, 9 aa, Artificial Sequence
  Description of Artificial Sequence: Synthetic peptide
  Seed: CPTYFKLWR (MAGC3_HUMAN)
CYTYFKLWR

SEQ ID NO: 101353 - protein, 11 aa, Artificial Sequence
  Description of Artificial Sequence: Synthetic peptide
  Seed: FIELIFGIALT (MAGC3_HUMAN)
FDELIFGIALI

SEQ ID NO: 101354 - protein, 10 aa, Artificial Sequence
  Description of Artificial Sequence: Synthetic peptide
  Seed: ILILSVIFIK (MAGC3_HUMAN)
IIILSVIFIK

SEQ ID NO: 101355 - protein, 9 aa, Artificial Sequence
  Description of Artificial Sequence: Synthetic peptide
  Seed: LANPQGLAG (MAGC3_HUMAN)
LVNPQGLAV

SEQ ID NO: 101356 - protein, 10 aa, Artificial Sequence
  Description of Artificial Sequence: Synthetic peptide
  Seed: TTDDATAMAS (MAGC3_HUMAN)
TADDATAMAL

SEQ ID NO: 101357 - protein, 10 aa, Artificial Sequence
  Description of Artificial Sequence: Synthetic peptide
  Seed: MNVINTYTGY (MAGC3_HUMAN)
MVVINTYTGW

SEQ ID NO: 101358 - protein, 11 aa, Artificial Sequence
  Description of Artificial Sequence: Synthetic peptide
  Seed: KQREEPQDWPL (MAGC3_HUMAN)
KQREEPQDWPY

SEQ ID NO: 101359 - protein, 10 aa, Artificial Sequence
  Description of Artificial Sequence: Synthetic peptide
  Seed: YALSPVVLPP (MAGC3_HUMAN)
YKLSPVVLPT

SEQ ID NO: 101360 - protein, 10 aa, Artificial Sequence
  Description of Artificial Sequence: Synthetic peptide
  Seed: IPSAFPSWYM (MAGC3_HUMAN)
ISSAFPSWYM

SEQ ID NO: 101361 - protein, 10 aa, Artificial Sequence
  Description of Artificial Sequence: Synthetic peptide
  Seed: TGYFPMIFRK (MAGC3_HUMAN)
TAYFPMIFRW

SEQ ID NO: 101362 - protein, 9 aa, Artificial Sequence
  Description of Artificial Sequence: Synthetic peptide
  Seed: LSDEQGMPQ (MAGC3_HUMAN)
LNDEQGMPM

SEQ ID NO: 101363 - protein, 9 aa, Artificial Sequence
  Description of Artificial Sequence: Synthetic peptide
  Seed: AVSPGKRLW (MAGC3_HUMAN)
AASPGKRLL

SEQ ID NO: 101364 - protein, 9 aa, Artificial Sequence
  Description of Artificial Sequence: Synthetic peptide
  Seed: CHWVLDATF (MAGC3_HUMAN)
CKWVLDATM

SEQ ID NO: 101365 - protein, 9 aa, Artificial Sequence
  Description of Artificial Sequence: Synthetic peptide
  Seed: YSAFHLGHL (MAGC3_HUMAN)
YLAFHLGHA

SEQ ID NO: 101366 - protein, 9 aa, Artificial Sequence
  Description of Artificial Sequence: Synthetic peptide
  Seed: SPQGPPQSP (MAGC3_HUMAN)
SPQGPPQSI

SEQ ID NO: 101367 - protein, 10 aa, Artificial Sequence
  Description of Artificial Sequence: Synthetic peptide
  Seed: TTDDATAMAS (MAGC3_HUMAN)
TMDDATAMAY

SEQ ID NO: 101368 - protein, 9 aa, Artificial Sequence
  Description of Artificial Sequence: Synthetic peptide
  Seed: RGTGYTLSL (MAGC3_HUMAN)
RSTGYTLSF

SEQ ID NO: 101369 - protein, 10 aa, Artificial Sequence
  Description of Artificial Sequence: Synthetic peptide
  Seed: YTLDEKVDKL (MAGC3_HUMAN)
YLLDEKVDKV

SEQ ID NO: 101370 - protein, 9 aa, Artificial Sequence
  Description of Artificial Sequence: Synthetic peptide
  Seed: EIPPQGPPK (MAGC3_HUMAN)
ESPPQGPPK

SEQ ID NO: 101371 - protein, 9 aa, Artificial Sequence
  Description of Artificial Sequence: Synthetic peptide
  Seed: YQAKEPLTR (MAGC3_HUMAN)
YSAKEPLTV

SEQ ID NO: 101372 - protein, 9 aa, Artificial Sequence
  Description of Artificial Sequence: Synthetic peptide
  Seed: YFFEDTLDL (MAGC3_HUMAN)
YKFEDTLDM

SEQ ID NO: 101373 - protein, 10 aa, Artificial Sequence
  Description of Artificial Sequence: Synthetic peptide
  Seed: SAFHLGHLRE (MAGC3_HUMAN)
SMFHLGHLRV

SEQ ID NO: 101374 - protein, 10 aa, Artificial Sequence
  Description of Artificial Sequence: Synthetic peptide
  Seed: YTLDEKVDKL (MAGC3_HUMAN)
YDLDEKVDKL

SEQ ID NO: 101375 - protein, 9 aa, Artificial Sequence
  Description of Artificial Sequence: Synthetic peptide
  Seed: FSDGSLGQW (MAGC3_HUMAN)
FADGSLGQL

SEQ ID NO: 101376 - protein, 10 aa, Artificial Sequence
  Description of Artificial Sequence: Synthetic peptide
  Seed: KLSSIIPSAF (MAGC3_HUMAN)
KMSSIIPSAY

SEQ ID NO: 101377 - protein, 10 aa, Artificial Sequence
  Description of Artificial Sequence: Synthetic peptide
  Seed: REVRLFLRGG (MAGC3_HUMAN)
RVVRLFLRGK

SEQ ID NO: 101378 - protein, 9 aa, Artificial Sequence
  Description of Artificial Sequence: Synthetic peptide
  Seed: MASASPSVM (MAGC3_HUMAN)
MGSASPSVM

SEQ ID NO: 101379 - protein, 10 aa, Artificial Sequence
  Description of Artificial Sequence: Synthetic peptide
  Seed: EKVAELVQFL (MAGC3_HUMAN)
EWVAELVQFL

SEQ ID NO: 101380 - protein, 9 aa, Artificial Sequence
  Description of Artificial Sequence: Synthetic peptide
  Seed: ADVLSRLAL (MAGC3_HUMAN)
AEVLSRLAW

SEQ ID NO: 101381 - protein, 10 aa, Artificial Sequence
  Description of Artificial Sequence: Synthetic peptide
  Seed: DMPAAGMPPL (MAGC3_HUMAN)
DMPAAGMPPF

SEQ ID NO: 101382 - protein, 9 aa, Artificial Sequence
  Description of Artificial Sequence: Synthetic peptide
  Seed: FKLWRTLSG (MAGC3_HUMAN)
FNLWRTLSY

SEQ ID NO: 101383 - protein, 10 aa, Artificial Sequence
  Description of Artificial Sequence: Synthetic peptide
  Seed: SCSSPLLWTR (MAGC3_HUMAN)
SLSSPLLWTK

SEQ ID NO: 101384 - protein, 9 aa, Artificial Sequence
  Description of Artificial Sequence: Synthetic peptide
  Seed: FSDGSLGQW (MAGC3_HUMAN)
FSDGSLGQM

SEQ ID NO: 101385 - protein, 9 aa, Artificial Sequence
  Description of Artificial Sequence: Synthetic peptide
  Seed: AIGPIQRPA (MAGC3_HUMAN)
AMGPIQRPA

SEQ ID NO: 101386 - protein, 9 aa, Artificial Sequence
  Description of Artificial Sequence: Synthetic peptide
  Seed: NVINTYTGY (MAGC3_HUMAN)
NLINTYTGR

SEQ ID NO: 101387 - protein, 9 aa, Artificial Sequence
  Description of Artificial Sequence: Synthetic peptide
  Seed: GFADVLSRL (MAGC3_HUMAN)
GTADVLSRA

SEQ ID NO: 101388 - protein, 11 aa, Artificial Sequence
  Description of Artificial Sequence: Synthetic peptide
  Seed: IIDTTDDATAM (MAGC3_HUMAN)
IIDTTDDATAI

SEQ ID NO: 101389 - protein, 10 aa, Artificial Sequence
  Description of Artificial Sequence: Synthetic peptide
  Seed: TEVDPDHFYV (MAGC3_HUMAN)
TLVDPDHFYM

SEQ ID NO: 101390 - protein, 9 aa, Artificial Sequence
  Description of Artificial Sequence: Synthetic peptide
  Seed: YTGYFPMIF (MAGC3_HUMAN)
YYGYFPMIL

SEQ ID NO: 101391 - protein, 9 aa, Artificial Sequence
  Description of Artificial Sequence: Synthetic peptide
  Seed: KVAELVQFL (MAGC3_HUMAN)
KMAELVQFY

SEQ ID NO: 101392 - protein, 11 aa, Artificial Sequence
  Description of Artificial Sequence: Synthetic peptide
  Seed: KFSLRRAVSVK (MAGC3_HUMAN)
KMSLRRAVSVR

SEQ ID NO: 101393 - protein, 9 aa, Artificial Sequence
  Description of Artificial Sequence: Synthetic peptide
  Seed: YQTKEPVTK (MAGC3_HUMAN)
YITKEPVTF

SEQ ID NO: 101394 - protein, 9 aa, Artificial Sequence
  Description of Artificial Sequence: Synthetic peptide
  Seed: VINTYTGYF (MAGC3_HUMAN)
VKNTYTGYM

SEQ ID NO: 101395 - protein, 10 aa, Artificial Sequence
  Description of Artificial Sequence: Synthetic peptide
  Seed: KVAELVQFLL (MAGC3_HUMAN)
KLAELVQFLS

SEQ ID NO: 101396 - protein, 9 aa, Artificial Sequence
  Description of Artificial Sequence: Synthetic peptide
  Seed: ASEEVIWEV (MAGC3_HUMAN)
ALEEVIWEI

SEQ ID NO: 101397 - protein, 9 aa, Artificial Sequence
  Description of Artificial Sequence: Synthetic peptide
  Seed: NAIGPWSAL (MAGC3_HUMAN)
NHIGPWSAV

SEQ ID NO: 101398 - protein, 10 aa, Artificial Sequence
  Description of Artificial Sequence: Synthetic peptide
  Seed: LILILSMIFI (MAGC3_HUMAN)
LMLILSMIFV

SEQ ID NO: 101399 - protein, 9 aa, Artificial Sequence
  Description of Artificial Sequence: Synthetic peptide
  Seed: TTDDATAMA (MAGC3_HUMAN)
TADDATAMM

SEQ ID NO: 101400 - protein, 10 aa, Artificial Sequence
  Description of Artificial Sequence: Synthetic peptide
  Seed: SLRRAVSVKQ (MAGC3_HUMAN)
SMRRAVSVKK

SEQ ID NO: 101401 - protein, 9 aa, Artificial Sequence
  Description of Artificial Sequence: Synthetic peptide
  Seed: TSDQRMDSL (MAGC3_HUMAN)
TWDQRMDSI

SEQ ID NO: 101402 - protein, 9 aa, Artificial Sequence
  Description of Artificial Sequence: Synthetic peptide
  Seed: KEPVTKAEM (MAGC3_HUMAN)
KMPVTKAEY

SEQ ID NO: 101403 - protein, 11 aa, Artificial Sequence
  Description of Artificial Sequence: Synthetic peptide
  Seed: TAMASASPSVM (MAGC3_HUMAN)
TLMASASPSVY

SEQ ID NO: 101404 - protein, 9 aa, Artificial Sequence
  Description of Artificial Sequence: Synthetic peptide
  Seed: AGFADVLSR (MAGC3_HUMAN)
AMFADVLSL

SEQ ID NO: 101405 - protein, 8 aa, Artificial Sequence
  Description of Artificial Sequence: Synthetic peptide
  Seed: SGSPGLQL (MAGC3_HUMAN)
SASPGLQL

SEQ ID NO: 101406 - protein, 10 aa, Artificial Sequence
  Description of Artificial Sequence: Synthetic peptide
  Seed: LTEVDPDHFY (MAGC3_HUMAN)
LLEVDPDHFY

SEQ ID NO: 101407 - protein, 11 aa, Artificial Sequence
  Description of Artificial Sequence: Synthetic peptide
  Seed: ILFGISLTEVD (MAGC3_HUMAN)
IMFGISLTEVD

SEQ ID NO: 101408 - protein, 11 aa, Artificial Sequence
  Description of Artificial Sequence: Synthetic peptide
  Seed: FIELIFGIALT (MAGC3_HUMAN)
FWELIFGIALL

SEQ ID NO: 101409 - protein, 9 aa, Artificial Sequence
  Description of Artificial Sequence: Synthetic peptide
  Seed: IFGIALTDM (MAGC3_HUMAN)
IYGIALTDM

SEQ ID NO: 101410 - protein, 9 aa, Artificial Sequence
  Description of Artificial Sequence: Synthetic peptide
  Seed: YQTKEPVTK (MAGC3_HUMAN)
YITKEPVTM

SEQ ID NO: 101411 - protein, 9 aa, Artificial Sequence
  Description of Artificial Sequence: Synthetic peptide
  Seed: KLVQFLLLK (MAGC3_HUMAN)
KTVQFLLLL

SEQ ID NO: 101412 - protein, 9 aa, Artificial Sequence
  Description of Artificial Sequence: Synthetic peptide
  Seed: MDPDNHSYF (MAGC3_HUMAN)
MLPDNHSYM

SEQ ID NO: 101413 - protein, 10 aa, Artificial Sequence
  Description of Artificial Sequence: Synthetic peptide
  Seed: RPAREVLEFL (MAGC3_HUMAN)
RIAREVLEFK

SEQ ID NO: 101414 - protein, 9 aa, Artificial Sequence
  Description of Artificial Sequence: Synthetic peptide
  Seed: ALAGFADVL (MAGC3_HUMAN)
ATAGFADVY

SEQ ID NO: 101415 - protein, 11 aa, Artificial Sequence
  Description of Artificial Sequence: Synthetic peptide
  Seed: FPMIFRKAREF (MAGC3_HUMAN)
FPMIFRKAREI

SEQ ID NO: 101416 - protein, 9 aa, Artificial Sequence
  Description of Artificial Sequence: Synthetic peptide
  Seed: TKAEMLTTV (MAGC3_HUMAN)
TRAEMLTTA

SEQ ID NO: 101417 - protein, 10 aa, Artificial Sequence
  Description of Artificial Sequence: Synthetic peptide
  Seed: YSAFHLGHLR (MAGC3_HUMAN)
YTAFHLGHLK

SEQ ID NO: 101418 - protein, 9 aa, Artificial Sequence
  Description of Artificial Sequence: Synthetic peptide
  Seed: ATYALSPVV (MAGC3_HUMAN)
ATYALSPVR

SEQ ID NO: 101419 - protein, 11 aa, Artificial Sequence
  Description of Artificial Sequence: Synthetic peptide
  Seed: TEVDPDHFYVF (MAGC3_HUMAN)
TEVDPDHFYVA

SEQ ID NO: 101420 - protein, 9 aa, Artificial Sequence
  Description of Artificial Sequence: Synthetic peptide
  Seed: IIDTTDDAT (MAGC3_HUMAN)
ILDTTDDAI

SEQ ID NO: 101421 - protein, 10 aa, Artificial Sequence
  Description of Artificial Sequence: Synthetic peptide
  Seed: MDPDNHSYFF (MAGC3_HUMAN)
MMPDNHSYFM

SEQ ID NO: 101422 - protein, 9 aa, Artificial Sequence
  Description of Artificial Sequence: Synthetic peptide
  Seed: FGSQPEGKF (MAGC3_HUMAN)
FSSQPEGKL

SEQ ID NO: 101423 - protein, 9 aa, Artificial Sequence
  Description of Artificial Sequence: Synthetic peptide
  Seed: FSLRRAVSV (MAGC3_HUMAN)
FHLRRAVSL

SEQ ID NO: 101424 - protein, 9 aa, Artificial Sequence
  Description of Artificial Sequence: Synthetic peptide
  Seed: IPPQGPPKI (MAGC3_HUMAN)
IWPQGPPKL

SEQ ID NO: 101425 - protein, 9 aa, Artificial Sequence
  Description of Artificial Sequence: Synthetic peptide
  Seed: YFFEDTLDL (MAGC3_HUMAN)
YRFEDTLDV

SEQ ID NO: 101426 - protein, 10 aa, Artificial Sequence
  Description of Artificial Sequence: Synthetic peptide
  Seed: MLTTVIKKYK (MAGC3_HUMAN)
MATTVIKKYR

SEQ ID NO: 101427 - protein, 9 aa, Artificial Sequence
  Description of Artificial Sequence: Synthetic peptide
  Seed: KATDKDYSA (MAGC3_HUMAN)
KTTDKDYSL

SEQ ID NO: 101428 - protein, 9 aa, Artificial Sequence
  Description of Artificial Sequence: Synthetic peptide
  Seed: GFADVLSRL (MAGC3_HUMAN)
GFADVLSRF

SEQ ID NO: 101429 - protein, 9 aa, Artificial Sequence
  Description of Artificial Sequence: Synthetic peptide
  Seed: DMDPDNHSY (MAGC3_HUMAN)
DFDPDNHSF

SEQ ID NO: 101430 - protein, 10 aa, Artificial Sequence
  Description of Artificial Sequence: Synthetic peptide
  Seed: EMLTTVIKKY (MAGC3_HUMAN)
EALTTVIKKK

SEQ ID NO: 101431 - protein, 10 aa, Artificial Sequence
  Description of Artificial Sequence: Synthetic peptide
  Seed: MLTTVIKKYK (MAGC3_HUMAN)
MCTTVIKKYK

SEQ ID NO: 101432 - protein, 10 aa, Artificial Sequence
  Description of Artificial Sequence: Synthetic peptide
  Seed: MPKNCLLILI (MAGC3_HUMAN)
MPKNCLLILM

SEQ ID NO: 101433 - protein, 10 aa, Artificial Sequence
  Description of Artificial Sequence: Synthetic peptide
  Seed: MQMNVINTYT (MAGC3_HUMAN)
MQMNVINTYW

SEQ ID NO: 101434 - protein, 9 aa, Artificial Sequence
  Description of Artificial Sequence: Synthetic peptide
  Seed: LSSIIPSAF (MAGC3_HUMAN)
LRSIIPSAY

SEQ ID NO: 101435 - protein, 9 aa, Artificial Sequence
  Description of Artificial Sequence: Synthetic peptide
  Seed: EVLEFLSKL (MAGC3_HUMAN)
ELLEFLSKA

SEQ ID NO: 101436 - protein, 11 aa, Artificial Sequence
  Description of Artificial Sequence: Synthetic peptide
  Seed: TTDDATAMASA (MAGC3_HUMAN)
TLDDATAMASI

SEQ ID NO: 101437 - protein, 10 aa, Artificial Sequence
  Description of Artificial Sequence: Synthetic peptide
  Seed: YALDEKVAEL (MAGC3_HUMAN)
YILDEKVAET

SEQ ID NO: 101438 - protein, 10 aa, Artificial Sequence
  Description of Artificial Sequence: Synthetic peptide
  Seed: KVAELVQFLL (MAGC3_HUMAN)
KAAELVQFLI

SEQ ID NO: 101439 - protein, 10 aa, Artificial Sequence
  Description of Artificial Sequence: Synthetic peptide
  Seed: ATYALSPVVL (MAGC3_HUMAN)
AHYALSPVVF

SEQ ID NO: 101440 - protein, 11 aa, Artificial Sequence
  Description of Artificial Sequence: Synthetic peptide
  Seed: LLLKYQAKEPL (MAGC3_HUMAN)
LLLKYQAKEPV

SEQ ID NO: 101441 - protein, 9 aa, Artificial Sequence
  Description of Artificial Sequence: Synthetic peptide
  Seed: SPLDSCSSP (MAGC3_HUMAN)
SPLDSCSSM

SEQ ID NO: 101442 - protein, 9 aa, Artificial Sequence
  Description of Artificial Sequence: Synthetic peptide
  Seed: AVSPGKRLW (MAGC3_HUMAN)
AQSPGKRLI

SEQ ID NO: 101443 - protein, 9 aa, Artificial Sequence
  Description of Artificial Sequence: Synthetic peptide
  Seed: DYFPMIFGK (MAGC3_HUMAN)
DCFPMIFGR

SEQ ID NO: 101444 - protein, 9 aa, Artificial Sequence
  Description of Artificial Sequence: Synthetic peptide
  Seed: GSLPESEPL (MAGC3_HUMAN)
GSLPESEPY

SEQ ID NO: 101445 - protein, 9 aa, Artificial Sequence
  Description of Artificial Sequence: Synthetic peptide
  Seed: LILSVIFIK (MAGC3_HUMAN)
LALSVIFIR

SEQ ID NO: 101446 - protein, 11 aa, Artificial Sequence
  Description of Artificial Sequence: Synthetic peptide
  Seed: YFFEDTLDLTY (MAGC3_HUMAN)
YIFEDTLDLTY

SEQ ID NO: 101447 - protein, 9 aa, Artificial Sequence
  Description of Artificial Sequence: Synthetic peptide
  Seed: KVAELVQFL (MAGC3_HUMAN)
KGAELVQFL

SEQ ID NO: 101448 - protein, 10 aa, Artificial Sequence
  Description of Artificial Sequence: Synthetic peptide
  Seed: ILFGISLTEV (MAGC3_HUMAN)
ITFGISLTEV

SEQ ID NO: 101449 - protein, 9 aa, Artificial Sequence
  Description of Artificial Sequence: Synthetic peptide
  Seed: LSDEQGMPQ (MAGC3_HUMAN)
LMDEQGMPY

SEQ ID NO: 101450 - protein, 9 aa, Artificial Sequence
  Description of Artificial Sequence: Synthetic peptide
  Seed: SQPEGKFSL (MAGC3_HUMAN)
SWPEGKFSF

SEQ ID NO: 101451 - protein, 9 aa, Artificial Sequence
  Description of Artificial Sequence: Synthetic peptide
  Seed: MIFGKAHEF (MAGC3_HUMAN)
MPFGKAHEC

SEQ ID NO: 101452 - protein, 9 aa, Artificial Sequence
  Description of Artificial Sequence: Synthetic peptide
  Seed: YFFEDTLDL (MAGC3_HUMAN)
YFFEDTLDY

SEQ ID NO: 101453 - protein, 10 aa, Artificial Sequence
  Description of Artificial Sequence: Synthetic peptide
  Seed: IELIFGIALT (MAGC3_HUMAN)
IVLIFGIALA

SEQ ID NO: 101454 - protein, 10 aa, Artificial Sequence
  Description of Artificial Sequence: Synthetic peptide
  Seed: YALSPVVLPP (MAGC3_HUMAN)
YPLSPVVLPV

SEQ ID NO: 101455 - protein, 9 aa, Artificial Sequence
  Description of Artificial Sequence: Synthetic peptide
  Seed: MQMNVINTY (MAGC3_HUMAN)
MKMNVINTI

SEQ ID NO: 101456 - protein, 10 aa, Artificial Sequence
  Description of Artificial Sequence: Synthetic peptide
  Seed: MIFGKAHEFI (MAGC3_HUMAN)
MVFGKAHEFV

SEQ ID NO: 101457 - protein, 9 aa, Artificial Sequence
  Description of Artificial Sequence: Synthetic peptide
  Seed: MQMNVINTY (MAGC3_HUMAN)
MMMNVINTY

SEQ ID NO: 101458 - protein, 8 aa, Artificial Sequence
  Description of Artificial Sequence: Synthetic peptide
  Seed: FADVLSRL (MAGC3_HUMAN)
FMDVLSRL

SEQ ID NO: 101459 - protein, 10 aa, Artificial Sequence
  Description of Artificial Sequence: Synthetic peptide
  Seed: TAMASASPSV (MAGC3_HUMAN)
TMMASASPSM

SEQ ID NO: 101460 - protein, 9 aa, Artificial Sequence
  Description of Artificial Sequence: Synthetic peptide
  Seed: YTGYFPMIF (MAGC3_HUMAN)
YMGYFPMIL

SEQ ID NO: 101461 - protein, 10 aa, Artificial Sequence
  Description of Artificial Sequence: Synthetic peptide
  Seed: LNAIGPWSAL (MAGC3_HUMAN)
LAAIGPWSAF

SEQ ID NO: 101462 - protein, 9 aa, Artificial Sequence
  Description of Artificial Sequence: Synthetic peptide
  Seed: SLRRAVSVK (MAGC3_HUMAN)
STRRAVSVK

SEQ ID NO: 101463 - protein, 11 aa, Artificial Sequence
  Description of Artificial Sequence: Synthetic peptide
  Seed: ALWESEGPEAF (MAGC3_HUMAN)
AKWESEGPEAY

SEQ ID NO: 101464 - protein, 9 aa, Artificial Sequence
  Description of Artificial Sequence: Synthetic peptide
  Seed: ASEEVIWEV (MAGC3_HUMAN)
AVEEVIWEM

SEQ ID NO: 101465 - protein, 10 aa, Artificial Sequence
  Description of Artificial Sequence: Synthetic peptide
  Seed: RLLILILSVI (MAGC3_HUMAN)
RSLILILSVA

SEQ ID NO: 101466 - protein, 9 aa, Artificial Sequence
  Description of Artificial Sequence: Synthetic peptide
  Seed: MQMNVINTY (MAGC3_HUMAN)
MQMNVINTG

SEQ ID NO: 101467 - protein, 11 aa, Artificial Sequence
  Description of Artificial Sequence: Synthetic peptide
  Seed: TAMASASPSVM (MAGC3_HUMAN)
TAMASASPSVF

SEQ ID NO: 101468 - protein, 9 aa, Artificial Sequence
  Description of Artificial Sequence: Synthetic peptide
  Seed: KGSCVPEEV (MAGC3_HUMAN)
KTSCVPEEL

SEQ ID NO: 101469 - protein, 9 aa, Artificial Sequence
  Description of Artificial Sequence: Synthetic peptide
  Seed: LPTWRRGTG (MAGC3_HUMAN)
LPTWRRGTL

SEQ ID NO: 101470 - protein, 9 aa, Artificial Sequence
  Description of Artificial Sequence: Synthetic peptide
  Seed: SASPSVMST (MAGC3_HUMAN)
STSPSVMSY

SEQ ID NO: 101471 - protein, 10 aa, Artificial Sequence
  Description of Artificial Sequence: Synthetic peptide
  Seed: SLVLCPTYFK (MAGC3_HUMAN)
SVVLCPTYFR

SEQ ID NO: 101472 - protein, 10 aa, Artificial Sequence
  Description of Artificial Sequence: Synthetic peptide
  Seed: LIFGIALTDM (MAGC3_HUMAN)
LTFGIALTDY

SEQ ID NO: 101473 - protein, 10 aa, Artificial Sequence
  Description of Artificial Sequence: Synthetic peptide
  Seed: MQMNVINTYT (MAGC3_HUMAN)
MSMNVINTYY

SEQ ID NO: 101474 - protein, 8 aa, Artificial Sequence
  Description of Artificial Sequence: Synthetic peptide
  Seed: FADVLSRL (MAGC3_HUMAN)
FGDVLSRF

SEQ ID NO: 101475 - protein, 10 aa, Artificial Sequence
  Description of Artificial Sequence: Synthetic peptide
  Seed: TEVDPDHFYV (MAGC3_HUMAN)
TFVDPDHFYV

SEQ ID NO: 101476 - protein, 9 aa, Artificial Sequence
  Description of Artificial Sequence: Synthetic peptide
  Seed: LWGEKAGSL (MAGC3_HUMAN)
LFGEKAGSY

SEQ ID NO: 101477 - protein, 10 aa, Artificial Sequence
  Description of Artificial Sequence: Synthetic peptide
  Seed: MQMNVINTYT (MAGC3_HUMAN)
MEMNVINTYV

SEQ ID NO: 101478 - protein, 9 aa, Artificial Sequence
  Description of Artificial Sequence: Synthetic peptide
  Seed: SASPSVMST (MAGC3_HUMAN)
SISPSVMSY

SEQ ID NO: 101479 - protein, 9 aa, Artificial Sequence
  Description of Artificial Sequence: Synthetic peptide
  Seed: GYFPMIFRK (MAGC3_HUMAN)
GWFPMIFRR

SEQ ID NO: 101480 - protein, 9 aa, Artificial Sequence
  Description of Artificial Sequence: Synthetic peptide
  Seed: YSAFHLGHL (MAGC3_HUMAN)
YRAFHLGHL

SEQ ID NO: 101481 - protein, 11 aa, Artificial Sequence
  Description of Artificial Sequence: Synthetic peptide
  Seed: ALAGFADVLSR (MAGC3_HUMAN)
AVAGFADVLSR

SEQ ID NO: 101482 - protein, 9 aa, Artificial Sequence
  Description of Artificial Sequence: Synthetic peptide
  Seed: EVLSAIGPI (MAGC3_HUMAN)
EILSAIGPI

SEQ ID NO: 101483 - protein, 10 aa, Artificial Sequence
  Description of Artificial Sequence: Synthetic peptide
  Seed: WVKNTCATYA (MAGC3_HUMAN)
WAKNTCATYY

SEQ ID NO: 101484 - protein, 9 aa, Artificial Sequence
  Description of Artificial Sequence: Synthetic peptide
  Seed: KVAELVQFL (MAGC3_HUMAN)
KVAELVQFK

SEQ ID NO: 101485 - protein, 10 aa, Artificial Sequence
  Description of Artificial Sequence: Synthetic peptide
  Seed: EMQMNVINTY (MAGC3_HUMAN)
ELQMNVINTY

SEQ ID NO: 101486 - protein, 9 aa, Artificial Sequence
  Description of Artificial Sequence: Synthetic peptide
  Seed: GFADVLSRL (MAGC3_HUMAN)
GMADVLSRA

SEQ ID NO: 101487 - protein, 9 aa, Artificial Sequence
  Description of Artificial Sequence: Synthetic peptide
  Seed: KYKDYFPMI (MAGC3_HUMAN)
KYKDYFPMA

SEQ ID NO: 101488 - protein, 9 aa, Artificial Sequence
  Description of Artificial Sequence: Synthetic peptide
  Seed: EVIWEVLSA (MAGC3_HUMAN)
ETIWEVLSY

SEQ ID NO: 101489 - protein, 10 aa, Artificial Sequence
  Description of Artificial Sequence: Synthetic peptide
  Seed: MQMNVINTYT (MAGC3_HUMAN)
MDMNVINTYI

SEQ ID NO: 101490 - protein, 9 aa, Artificial Sequence
  Description of Artificial Sequence: Synthetic peptide
  Seed: SLRRAVSVK (MAGC3_HUMAN)
SMRRAVSVY

SEQ ID NO: 101491 - protein, 11 aa, Artificial Sequence
  Description of Artificial Sequence: Synthetic peptide
  Seed: ALWESEGPEAF (MAGC3_HUMAN)
AIWESEGPEAF

SEQ ID NO: 101492 - protein, 9 aa, Artificial Sequence
  Description of Artificial Sequence: Synthetic peptide
  Seed: TGYFPMIFR (MAGC3_HUMAN)
TQYFPMIFK

SEQ ID NO: 101493 - protein, 9 aa, Artificial Sequence
  Description of Artificial Sequence: Synthetic peptide
  Seed: QDWPLNEKR (MAGC3_HUMAN)
QMWPLNEKR

SEQ ID NO: 101494 - protein, 9 aa, Artificial Sequence
  Description of Artificial Sequence: Synthetic peptide
  Seed: RTLSGSPGL (MAGC3_HUMAN)
RSLSGSPGW

SEQ ID NO: 101495 - protein, 9 aa, Artificial Sequence
  Description of Artificial Sequence: Synthetic peptide
  Seed: KYKDYFPMI (MAGC3_HUMAN)
KQKDYFPMK

SEQ ID NO: 101496 - protein, 9 aa, Artificial Sequence
  Description of Artificial Sequence: Synthetic peptide
  Seed: EVLEFLSKL (MAGC3_HUMAN)
EALEFLSKF

SEQ ID NO: 101497 - protein, 9 aa, Artificial Sequence
  Description of Artificial Sequence: Synthetic peptide
  Seed: TTDDATAMA (MAGC3_HUMAN)
TLDDATAMI

SEQ ID NO: 101498 - protein, 9 aa, Artificial Sequence
  Description of Artificial Sequence: Synthetic peptide
  Seed: KLVQFLLLK (MAGC3_HUMAN)
KLVQFLLLF

SEQ ID NO: 101499 - protein, 9 aa, Artificial Sequence
  Description of Artificial Sequence: Synthetic peptide
  Seed: ATDKDYSAF (MAGC3_HUMAN)
AQDKDYSAL

SEQ ID NO: 101500 - protein, 9 aa, Artificial Sequence
  Description of Artificial Sequence: Synthetic peptide
  Seed: LSDEQGMPQ (MAGC3_HUMAN)
LTDEQGMPF

SEQ ID NO: 101501 - protein, 11 aa, Artificial Sequence
  Description of Artificial Sequence: Synthetic peptide
  Seed: FPMIFGKAHEF (MAGC3_HUMAN)
FAMIFGKAHEF

SEQ ID NO: 101502 - protein, 10 aa, Artificial Sequence
  Description of Artificial Sequence: Synthetic peptide
  Seed: MNVINTYTGY (MAGC3_HUMAN)
MKVINTYTGF

SEQ ID NO: 101503 - protein, 9 aa, Artificial Sequence
  Description of Artificial Sequence: Synthetic peptide
  Seed: GSLPESEPL (MAGC3_HUMAN)
GALPESEPL

SEQ ID NO: 101504 - protein, 9 aa, Artificial Sequence
  Description of Artificial Sequence: Synthetic peptide
  Seed: ILILSMIFI (MAGC3_HUMAN)
IAILSMIFV

SEQ ID NO: 101505 - protein, 9 aa, Artificial Sequence
  Description of Artificial Sequence: Synthetic peptide
  Seed: MEDRAQAII (MAGC3_HUMAN)
MTDRAQAIV

SEQ ID NO: 101506 - protein, 9 aa, Artificial Sequence
  Description of Artificial Sequence: Synthetic peptide
  Seed: QGMPQNRLL (MAGC3_HUMAN)
QMMPQNRLW

SEQ ID NO: 101507 - protein, 9 aa, Artificial Sequence
  Description of Artificial Sequence: Synthetic peptide
  Seed: LRSAEGSVL (MAGC3_HUMAN)
LMSAEGSVY

SEQ ID NO: 101508 - protein, 10 aa, Artificial Sequence
  Description of Artificial Sequence: Synthetic peptide
  Seed: MIFRKAREFI (MAGC3_HUMAN)
MSFRKAREFK

SEQ ID NO: 101509 - protein, 9 aa, Artificial Sequence
  Description of Artificial Sequence: Synthetic peptide
  Seed: EFIELIFGI (MAGC3_HUMAN)
ENIELIFGV

SEQ ID NO: 101510 - protein, 9 aa, Artificial Sequence
  Description of Artificial Sequence: Synthetic peptide
  Seed: LSGSPGLQL (MAGC3_HUMAN)
LQGSPGLQY

SEQ ID NO: 101511 - protein, 9 aa, Artificial Sequence
  Description of Artificial Sequence: Synthetic peptide
  Seed: MLLPCHWVL (MAGC3_HUMAN)
MKLPCHWVF

SEQ ID NO: 101512 - protein, 9 aa, Artificial Sequence
  Description of Artificial Sequence: Synthetic peptide
  Seed: VLPPQPQPR (MAGC3_HUMAN)
VYPPQPQPM

SEQ ID NO: 101513 - protein, 10 aa, Artificial Sequence
  Description of Artificial Sequence: Synthetic peptide
  Seed: EKVAELVQFL (MAGC3_HUMAN)
EHVAELVQFY

SEQ ID NO: 101514 - protein, 11 aa, Artificial Sequence
  Description of Artificial Sequence: Synthetic peptide
  Seed: TAMASASPSVM (MAGC3_HUMAN)
TYMASASPSVF

SEQ ID NO: 101515 - protein, 9 aa, Artificial Sequence
  Description of Artificial Sequence: Synthetic peptide
  Seed: AIGPIQRPA (MAGC3_HUMAN)
ALGPIQRPL

SEQ ID NO: 101516 - protein, 10 aa, Artificial Sequence
  Description of Artificial Sequence: Synthetic peptide
  Seed: KLVQFLLLKY (MAGC3_HUMAN)
KQVQFLLLKY

SEQ ID NO: 101517 - protein, 10 aa, Artificial Sequence
  Description of Artificial Sequence: Synthetic peptide
  Seed: YALDEKVAEL (MAGC3_HUMAN)
YLLDEKVAEF

SEQ ID NO: 101518 - protein, 10 aa, Artificial Sequence
  Description of Artificial Sequence: Synthetic peptide
  Seed: LILILSVIFI (MAGC3_HUMAN)
LVLILSVIFV

SEQ ID NO: 101519 - protein, 10 aa, Artificial Sequence
  Description of Artificial Sequence: Synthetic peptide
  Seed: MDPDNHSYFF (MAGC3_HUMAN)
MWPDNHSYFW

SEQ ID NO: 101520 - protein, 9 aa, Artificial Sequence
  Description of Artificial Sequence: Synthetic peptide
  Seed: LTTVIKKYK (MAGC3_HUMAN)
LFTVIKKYR

SEQ ID NO: 101521 - protein, 9 aa, Artificial Sequence
  Description of Artificial Sequence: Synthetic peptide
  Seed: HALPESESL (MAGC3_HUMAN)
HVLPESESI

SEQ ID NO: 101522 - protein, 10 aa, Artificial Sequence
  Description of Artificial Sequence: Synthetic peptide
  Seed: EKVAELVQFL (MAGC3_HUMAN)
EYVAELVQFV

SEQ ID NO: 101523 - protein, 8 aa, Artificial Sequence
  Description of Artificial Sequence: Synthetic peptide
  Seed: TTDDATAM (MAGC3_HUMAN)
TGDDATAM

SEQ ID NO: 101524 - protein, 9 aa, Artificial Sequence
  Description of Artificial Sequence: Synthetic peptide
  Seed: TEASPQQKK (MAGC3_HUMAN)
TEASPQQKL

SEQ ID NO: 101525 - protein, 8 aa, Artificial Sequence
  Description of Artificial Sequence: Synthetic peptide
  Seed: AEMQMNVI (MAGC3_HUMAN)
AEMQMNVV

SEQ ID NO: 101526 - protein, 9 aa, Artificial Sequence
  Description of Artificial Sequence: Synthetic peptide
  Seed: MIFRKAREF (MAGC3_HUMAN)
MAFRKAREL

SEQ ID NO: 101527 - protein, 10 aa, Artificial Sequence
  Description of Artificial Sequence: Synthetic peptide
  Seed: LDSCSSPLLW (MAGC3_HUMAN)
LSSCSSPLLY

SEQ ID NO: 101528 - protein, 9 aa, Artificial Sequence
  Description of Artificial Sequence: Synthetic peptide
  Seed: MIFRKAREF (MAGC3_HUMAN)
MAFRKAREY

SEQ ID NO: 101529 - protein, 9 aa, Artificial Sequence
  Description of Artificial Sequence: Synthetic peptide
  Seed: HALPESESL (MAGC3_HUMAN)
HFLPESESL

SEQ ID NO: 101530 - protein, 9 aa, Artificial Sequence
  Description of Artificial Sequence: Synthetic peptide
  Seed: KVDKLVQFL (MAGC3_HUMAN)
KYDKLVQFY

SEQ ID NO: 101531 - protein, 10 aa, Artificial Sequence
  Description of Artificial Sequence: Synthetic peptide
  Seed: KVAELVQFLL (MAGC3_HUMAN)
KMAELVQFLS

SEQ ID NO: 101532 - protein, 9 aa, Artificial Sequence
  Description of Artificial Sequence: Synthetic peptide
  Seed: YQAKEPLTR (MAGC3_HUMAN)
YIAKEPLTF

SEQ ID NO: 101533 - protein, 10 aa, Artificial Sequence
  Description of Artificial Sequence: Synthetic peptide
  Seed: SPLDSCSSPL (MAGC3_HUMAN)
SMLDSCSSPL

SEQ ID NO: 101534 - protein, 8 aa, Artificial Sequence
  Description of Artificial Sequence: Synthetic peptide
  Seed: YALSPVVL (MAGC3_HUMAN)
YSLSPVVY

SEQ ID NO: 101535 - protein, 9 aa, Artificial Sequence
  Description of Artificial Sequence: Synthetic peptide
  Seed: KAHEFIELI (MAGC3_HUMAN)
KWHEFIELM

SEQ ID NO: 101536 - protein, 9 aa, Artificial Sequence
  Description of Artificial Sequence: Synthetic peptide
  Seed: EVIWEVLNA (MAGC3_HUMAN)
EAIWEVLNR

SEQ ID NO: 101537 - protein, 11 aa, Artificial Sequence
  Description of Artificial Sequence: Synthetic peptide
  Seed: ALAGFADVLSR (MAGC3_HUMAN)
AIAGFADVLSK

SEQ ID NO: 101538 - protein, 9 aa, Artificial Sequence
  Description of Artificial Sequence: Synthetic peptide
  Seed: TGYTLSLPA (MAGC3_HUMAN)
TPYTLSLPT

SEQ ID NO: 101539 - protein, 8 aa, Artificial Sequence
  Description of Artificial Sequence: Synthetic peptide
  Seed: SSIIPSAF (MAGC3_HUMAN)
SQIIPSAM

SEQ ID NO: 101540 - protein, 9 aa, Artificial Sequence
  Description of Artificial Sequence: Synthetic peptide
  Seed: DTTDDATAM (MAGC3_HUMAN)
DATDDATAF

SEQ ID NO: 101541 - protein, 10 aa, Artificial Sequence
  Description of Artificial Sequence: Synthetic peptide
  Seed: MQMNVINTYT (MAGC3_HUMAN)
MMMNVINTYF

SEQ ID NO: 101542 - protein, 9 aa, Artificial Sequence
  Description of Artificial Sequence: Synthetic peptide
  Seed: KDSDLPTWR (MAGC3_HUMAN)
KMSDLPTWR

SEQ ID NO: 101543 - protein, 9 aa, Artificial Sequence
  Description of Artificial Sequence: Synthetic peptide
  Seed: GYFPMIFRK (MAGC3_HUMAN)
GVFPMIFRK

SEQ ID NO: 101544 - protein, 9 aa, Artificial Sequence
  Description of Artificial Sequence: Synthetic peptide
  Seed: NTYTGYFPM (MAGC3_HUMAN)
NFYTGYFPI

SEQ ID NO: 101545 - protein, 10 aa, Artificial Sequence
  Description of Artificial Sequence: Synthetic peptide
  Seed: LSKLSSIIPS (MAGC3_HUMAN)
LVKLSSIIPK

SEQ ID NO: 101546 - protein, 9 aa, Artificial Sequence
  Description of Artificial Sequence: Synthetic peptide
  Seed: MDPDNHSYF (MAGC3_HUMAN)
MIPDNHSYM

SEQ ID NO: 101547 - protein, 9 aa, Artificial Sequence
  Description of Artificial Sequence: Synthetic peptide
  Seed: SAIGPIQRP (MAGC3_HUMAN)
SLIGPIQRY

SEQ ID NO: 101548 - protein, 9 aa, Artificial Sequence
  Description of Artificial Sequence: Synthetic peptide
  Seed: VLCPTYFKL (MAGC3_HUMAN)
VWCPTYFKI

SEQ ID NO: 101549 - protein, 9 aa, Artificial Sequence
  Description of Artificial Sequence: Synthetic peptide
  Seed: SLVLCPTYF (MAGC3_HUMAN)
SLVLCPTYM

SEQ ID NO: 101550 - protein, 9 aa, Artificial Sequence
  Description of Artificial Sequence: Synthetic peptide
  Seed: IIDTTDDAT (MAGC3_HUMAN)
ICDTTDDAL

SEQ ID NO: 101551 - protein, 10 aa, Artificial Sequence
  Description of Artificial Sequence: Synthetic peptide
  Seed: KLVQFLLLKY (MAGC3_HUMAN)
KEVQFLLLKY

SEQ ID NO: 101552 - protein, 9 aa, Artificial Sequence
  Description of Artificial Sequence: Synthetic peptide
  Seed: AIGPWSALA (MAGC3_HUMAN)
AVGPWSALA

SEQ ID NO: 101553 - protein, 9 aa, Artificial Sequence
  Description of Artificial Sequence: Synthetic peptide
  Seed: ILILSVIFI (MAGC3_HUMAN)
IQILSVIFI

SEQ ID NO: 101554 - protein, 10 aa, Artificial Sequence
  Description of Artificial Sequence: Synthetic peptide
  Seed: KDYFPMIFGK (MAGC3_HUMAN)
KWYFPMIFGR

SEQ ID NO: 101555 - protein, 9 aa, Artificial Sequence
  Description of Artificial Sequence: Synthetic peptide
  Seed: LSSIIPSAF (MAGC3_HUMAN)
LQSIIPSAI

SEQ ID NO: 101556 - protein, 9 aa, Artificial Sequence
  Description of Artificial Sequence: Synthetic peptide
  Seed: HALPESESL (MAGC3_HUMAN)
HLLPESESF

SEQ ID NO: 101557 - protein, 10 aa, Artificial Sequence
  Description of Artificial Sequence: Synthetic peptide
  Seed: KLSSIIPSAF (MAGC3_HUMAN)
KHSSIIPSAW

SEQ ID NO: 101558 - protein, 10 aa, Artificial Sequence
  Description of Artificial Sequence: Synthetic peptide
  Seed: SAFHLGHLRE (MAGC3_HUMAN)
STFHLGHLRV

SEQ ID NO: 101559 - protein, 9 aa, Artificial Sequence
  Description of Artificial Sequence: Synthetic peptide
  Seed: RTLSGSPGL (MAGC3_HUMAN)
RMLSGSPGR

SEQ ID NO: 101560 - protein, 9 aa, Artificial Sequence
  Description of Artificial Sequence: Synthetic peptide
  Seed: MIFGKAHEF (MAGC3_HUMAN)
MGFGKAHEM

SEQ ID NO: 101561 - protein, 11 aa, Artificial Sequence
  Description of Artificial Sequence: Synthetic peptide
  Seed: TSDQRMDSLVL (MAGC3_HUMAN)
THDQRMDSLVF

SEQ ID NO: 101562 - protein, 10 aa, Artificial Sequence
  Description of Artificial Sequence: Synthetic peptide
  Seed: FKLWRTLSGS (MAGC3_HUMAN)
FELWRTLSGV

SEQ ID NO: 101563 - protein, 9 aa, Artificial Sequence
  Description of Artificial Sequence: Synthetic peptide
  Seed: EVDPDHFYV (MAGC3_HUMAN)
EFDPDHFYM

SEQ ID NO: 101564 - protein, 9 aa, Artificial Sequence
  Description of Artificial Sequence: Synthetic peptide
  Seed: HFYVFVNTL (MAGC3_HUMAN)
HIYVFVNTL

SEQ ID NO: 101565 - protein, 9 aa, Artificial Sequence
  Description of Artificial Sequence: Synthetic peptide
  Seed: AEMQMNVIN (MAGC3_HUMAN)
AEMQMNVIP

SEQ ID NO: 101566 - protein, 9 aa, Artificial Sequence
  Description of Artificial Sequence: Synthetic peptide
  Seed: SVLDLANPQ (MAGC3_HUMAN)
SALDLANPR

SEQ ID NO: 101567 - protein, 9 aa, Artificial Sequence
  Description of Artificial Sequence: Synthetic peptide
  Seed: SASPSVMST (MAGC3_HUMAN)
SFSPSVMSM

SEQ ID NO: 101568 - protein, 9 aa, Artificial Sequence
  Description of Artificial Sequence: Synthetic peptide
  Seed: TTDDATAMA (MAGC3_HUMAN)
TSDDATAMI

SEQ ID NO: 101569 - protein, 9 aa, Artificial Sequence
  Description of Artificial Sequence: Synthetic peptide
  Seed: KKYKDYFPM (MAGC3_HUMAN)
KAYKDYFPM

SEQ ID NO: 101570 - protein, 10 aa, Artificial Sequence
  Description of Artificial Sequence: Synthetic peptide
  Seed: MNVINTYTGY (MAGC3_HUMAN)
MQVINTYTGR

SEQ ID NO: 101571 - protein, 9 aa, Artificial Sequence
  Description of Artificial Sequence: Synthetic peptide
  Seed: KGSCVPEEV (MAGC3_HUMAN)
KQSCVPEEW

SEQ ID NO: 101572 - protein, 10 aa, Artificial Sequence
  Description of Artificial Sequence: Synthetic peptide
  Seed: LNAIGPWSAL (MAGC3_HUMAN)
LTAIGPWSAY

SEQ ID NO: 101573 - protein, 9 aa, Artificial Sequence
  Description of Artificial Sequence: Synthetic peptide
  Seed: RGTGYTLSL (MAGC3_HUMAN)
RQTGYTLSL

SEQ ID NO: 101574 - protein, 11 aa, Artificial Sequence
  Description of Artificial Sequence: Synthetic peptide
  Seed: TTDDATAMASA (MAGC3_HUMAN)
TGDDATAMASV

SEQ ID NO: 101575 - protein, 10 aa, Artificial Sequence
  Description of Artificial Sequence: Synthetic peptide
  Seed: LDSCSSPLLW (MAGC3_HUMAN)
LASCSSPLLF

SEQ ID NO: 101576 - protein, 9 aa, Artificial Sequence
  Description of Artificial Sequence: Synthetic peptide
  Seed: EKVDKLVQF (MAGC3_HUMAN)
EAVDKLVQL

SEQ ID NO: 101577 - protein, 10 aa, Artificial Sequence
  Description of Artificial Sequence: Synthetic peptide
  Seed: FYVFVNTLDL (MAGC3_HUMAN)
FYVFVNTLDY

SEQ ID NO: 101578 - protein, 10 aa, Artificial Sequence
  Description of Artificial Sequence: Synthetic peptide
  Seed: REVRLFLRGG (MAGC3_HUMAN)
RCVRLFLRGK

SEQ ID NO: 101579 - protein, 9 aa, Artificial Sequence
  Description of Artificial Sequence: Synthetic peptide
  Seed: EVLSAIGPI (MAGC3_HUMAN)
EMLSAIGPK

SEQ ID NO: 101580 - protein, 9 aa, Artificial Sequence
  Description of Artificial Sequence: Synthetic peptide
  Seed: IQRPAREVL (MAGC3_HUMAN)
IPRPAREVM

SEQ ID NO: 101581 - protein, 9 aa, Artificial Sequence
  Description of Artificial Sequence: Synthetic peptide
  Seed: KAHEFIELI (MAGC3_HUMAN)
KIHEFIELM

SEQ ID NO: 101582 - protein, 10 aa, Artificial Sequence
  Description of Artificial Sequence: Synthetic peptide
  Seed: MQMNVINTYT (MAGC3_HUMAN)
MYMNVINTYI

SEQ ID NO: 101583 - protein, 10 aa, Artificial Sequence
  Description of Artificial Sequence: Synthetic peptide
  Seed: YALDEKVAEL (MAGC3_HUMAN)
YQLDEKVAEM

SEQ ID NO: 101584 - protein, 9 aa, Artificial Sequence
  Description of Artificial Sequence: Synthetic peptide
  Seed: MIFGKAHEF (MAGC3_HUMAN)
MFFGKAHEW

SEQ ID NO: 101585 - protein, 9 aa, Artificial Sequence
  Description of Artificial Sequence: Synthetic peptide
  Seed: TYTGYFPMI (MAGC3_HUMAN)
TWTGYFPMW

SEQ ID NO: 101586 - protein, 10 aa, Artificial Sequence
  Description of Artificial Sequence: Synthetic peptide
  Seed: FSDGSLGQWV (MAGC3_HUMAN)
FVDGSLGQWV

SEQ ID NO: 101587 - protein, 9 aa, Artificial Sequence
  Description of Artificial Sequence: Synthetic peptide
  Seed: SLRRAVSVK (MAGC3_HUMAN)
SLRRAVSVA

SEQ ID NO: 101588 - protein, 9 aa, Artificial Sequence
  Description of Artificial Sequence: Synthetic peptide
  Seed: EVLSAIGPI (MAGC3_HUMAN)
EALSAIGPF

SEQ ID NO: 101589 - protein, 9 aa, Artificial Sequence
  Description of Artificial Sequence: Synthetic peptide
  Seed: ELVQFLLLK (MAGC3_HUMAN)
ESVQFLLLR

SEQ ID NO: 101590 - protein, 10 aa, Artificial Sequence
  Description of Artificial Sequence: Synthetic peptide
  Seed: MNVINTYTGY (MAGC3_HUMAN)
MEVINTYTGY

SEQ ID NO: 101591 - protein, 10 aa, Artificial Sequence
  Description of Artificial Sequence: Synthetic peptide
  Seed: INTYTGYFPM (MAGC3_HUMAN)
ITTYTGYFPF

SEQ ID NO: 101592 - protein, 9 aa, Artificial Sequence
  Description of Artificial Sequence: Synthetic peptide
  Seed: TSDQRMDSL (MAGC3_HUMAN)
TLDQRMDSM

SEQ ID NO: 101593 - protein, 10 aa, Artificial Sequence
  Description of Artificial Sequence: Synthetic peptide
  Seed: VLDLANPQGL (MAGC3_HUMAN)
VTDLANPQGL

SEQ ID NO: 101594 - protein, 9 aa, Artificial Sequence
  Description of Artificial Sequence: Synthetic peptide
  Seed: FPMIFGKAH (MAGC3_HUMAN)
FPMIFGKAL

SEQ ID NO: 101595 - protein, 9 aa, Artificial Sequence
  Description of Artificial Sequence: Synthetic peptide
  Seed: GFADVLSRL (MAGC3_HUMAN)
GRADVLSRM

SEQ ID NO: 101596 - protein, 9 aa, Artificial Sequence
  Description of Artificial Sequence: Synthetic peptide
  Seed: ISPQGPPQS (MAGC3_HUMAN)
IIPQGPPQF

SEQ ID NO: 101597 - protein, 10 aa, Artificial Sequence
  Description of Artificial Sequence: Synthetic peptide
  Seed: KVAELVQFLL (MAGC3_HUMAN)
KHAELVQFLW

SEQ ID NO: 101598 - protein, 9 aa, Artificial Sequence
  Description of Artificial Sequence: Synthetic peptide
  Seed: KAHEFIELI (MAGC3_HUMAN)
KSHEFIELI

SEQ ID NO: 101599 - protein, 9 aa, Artificial Sequence
  Description of Artificial Sequence: Synthetic peptide
  Seed: AVSPGKRLW (MAGC3_HUMAN)
ATSPGKRLY

SEQ ID NO: 101600 - protein, 9 aa, Artificial Sequence
  Description of Artificial Sequence: Synthetic peptide
  Seed: TLDEKVDKL (MAGC3_HUMAN)
TGDEKVDKL

SEQ ID NO: 101601 - protein, 9 aa, Artificial Sequence
  Description of Artificial Sequence: Synthetic peptide
  Seed: ISPQGPPQS (MAGC3_HUMAN)
ILPQGPPQV

SEQ ID NO: 101602 - protein, 9 aa, Artificial Sequence
  Description of Artificial Sequence: Synthetic peptide
  Seed: LSSIIPSAF (MAGC3_HUMAN)
LQSIIPSAM

SEQ ID NO: 101603 - protein, 11 aa, Artificial Sequence
  Description of Artificial Sequence: Synthetic peptide
  Seed: KVAELVQFLLL (MAGC3_HUMAN)
KMAELVQFLLV

SEQ ID NO: 101604 - protein, 11 aa, Artificial Sequence
  Description of Artificial Sequence: Synthetic peptide
  Seed: RYALDEKVAEL (MAGC3_HUMAN)
RKALDEKVAEV

SEQ ID NO: 101605 - protein, 8 aa, Artificial Sequence
  Description of Artificial Sequence: Synthetic peptide
  Seed: YMDALKDM (MAGC3_HUMAN)
YYDALKDL

SEQ ID NO: 101606 - protein, 9 aa, Artificial Sequence
  Description of Artificial Sequence: Synthetic peptide
  Seed: HSYFFEDTL (MAGC3_HUMAN)
HLYFFEDTW

SEQ ID NO: 101607 - protein, 10 aa, Artificial Sequence
  Description of Artificial Sequence: Synthetic peptide
  Seed: WVKNTCATYA (MAGC3_HUMAN)
WSKNTCATYY

SEQ ID NO: 101608 - protein, 11 aa, Artificial Sequence
  Description of Artificial Sequence: Synthetic peptide
  Seed: ALWESEGPEAF (MAGC3_HUMAN)
AMWESEGPEAI

SEQ ID NO: 101609 - protein, 9 aa, Artificial Sequence
  Description of Artificial Sequence: Synthetic peptide
  Seed: FSDGSLGQW (MAGC3_HUMAN)
FMDGSLGQI

SEQ ID NO: 101610 - protein, 9 aa, Artificial Sequence
  Description of Artificial Sequence: Synthetic peptide
  Seed: RGTGYTLSL (MAGC3_HUMAN)
RITGYTLSW

SEQ ID NO: 101611 - protein, 10 aa, Artificial Sequence
  Description of Artificial Sequence: Synthetic peptide
  Seed: MDPDNHSYFF (MAGC3_HUMAN)
MVPDNHSYFF

SEQ ID NO: 101612 - protein, 9 aa, Artificial Sequence
  Description of Artificial Sequence: Synthetic peptide
  Seed: YQAKEPLTR (MAGC3_HUMAN)
YVAKEPLTR

SEQ ID NO: 101613 - protein, 11 aa, Artificial Sequence
  Description of Artificial Sequence: Synthetic peptide
  Seed: MPPLPQSPPEI (MAGC3_HUMAN)
MPPLPQSPPEA

SEQ ID NO: 101614 - protein, 10 aa, Artificial Sequence
  Description of Artificial Sequence: Synthetic peptide
  Seed: TAMASASPSV (MAGC3_HUMAN)
TCMASASPSL

SEQ ID NO: 101615 - protein, 9 aa, Artificial Sequence
  Description of Artificial Sequence: Synthetic peptide
  Seed: EIPPQGPPK (MAGC3_HUMAN)
EMPPQGPPR

SEQ ID NO: 101616 - protein, 10 aa, Artificial Sequence
  Description of Artificial Sequence: Synthetic peptide
  Seed: KAEMLTTVIK (MAGC3_HUMAN)
KSEMLTTVIK

SEQ ID NO: 101617 - protein, 8 aa, Artificial Sequence
  Description of Artificial Sequence: Synthetic peptide
  Seed: FADVLSRL (MAGC3_HUMAN)
FLDVLSRI

SEQ ID NO: 101618 - protein, 11 aa, Artificial Sequence
  Description of Artificial Sequence: Synthetic peptide
  Seed: EVLSAIGPIQR (MAGC3_HUMAN)
EMLSAIGPIQK

SEQ ID NO: 101619 - protein, 9 aa, Artificial Sequence
  Description of Artificial Sequence: Synthetic peptide
  Seed: LPTWRRGTG (MAGC3_HUMAN)
LPTWRRGTF

SEQ ID NO: 101620 - protein, 9 aa, Artificial Sequence
  Description of Artificial Sequence: Synthetic peptide
  Seed: TLDEKVDKL (MAGC3_HUMAN)
TIDEKVDKV

SEQ ID NO: 101621 - protein, 9 aa, Artificial Sequence
  Description of Artificial Sequence: Synthetic peptide
  Seed: GSLPESEPL (MAGC3_HUMAN)
GLLPESEPY

SEQ ID NO: 101622 - protein, 9 aa, Artificial Sequence
  Description of Artificial Sequence: Synthetic peptide
  Seed: CATYALSPV (MAGC3_HUMAN)
CATYALSPY

SEQ ID NO: 101623 - protein, 10 aa, Artificial Sequence
  Description of Artificial Sequence: Synthetic peptide
  Seed: TGYFPMIFRK (MAGC3_HUMAN)
TFYFPMIFRR

SEQ ID NO: 101624 - protein, 8 aa, Artificial Sequence
  Description of Artificial Sequence: Synthetic peptide
  Seed: YFKLWRTL (MAGC3_HUMAN)
YMKLWRTL

SEQ ID NO: 101625 - protein, 10 aa, Artificial Sequence
  Description of Artificial Sequence: Synthetic peptide
  Seed: INTYTGYFPM (MAGC3_HUMAN)
IHTYTGYFPY

SEQ ID NO: 101626 - protein, 10 aa, Artificial Sequence
  Description of Artificial Sequence: Synthetic peptide
  Seed: SSEEEDTATW (MAGC3_HUMAN)
SAEEEDTATY

SEQ ID NO: 101627 - protein, 9 aa, Artificial Sequence
  Description of Artificial Sequence: Synthetic peptide
  Seed: EVDPDHFYV (MAGC3_HUMAN)
EIDPDHFYV

SEQ ID NO: 101628 - protein, 9 aa, Artificial Sequence
  Description of Artificial Sequence: Synthetic peptide
  Seed: MLLPCHWVL (MAGC3_HUMAN)
MFLPCHWVY

SEQ ID NO: 101629 - protein, 10 aa, Artificial Sequence
  Description of Artificial Sequence: Synthetic peptide
  Seed: MPQNRLLILI (MAGC3_HUMAN)
MPQNRLLILL

SEQ ID NO: 101630 - protein, 9 aa, Artificial Sequence
  Description of Artificial Sequence: Synthetic peptide
  Seed: HLREVRLFL (MAGC3_HUMAN)
HVREVRLFK

SEQ ID NO: 101631 - protein, 9 aa, Artificial Sequence
  Description of Artificial Sequence: Synthetic peptide
  Seed: LANPQGLAG (MAGC3_HUMAN)
LSNPQGLAY

SEQ ID NO: 101632 - protein, 9 aa, Artificial Sequence
  Description of Artificial Sequence: Synthetic peptide
  Seed: LIDDQGMPK (MAGC3_HUMAN)
LVDDQGMPM

SEQ ID NO: 101633 - protein, 11 aa, Artificial Sequence
  Description of Artificial Sequence: Synthetic peptide
  Seed: LDSCSSPLLWT (MAGC3_HUMAN)
LVSCSSPLLWW

SEQ ID NO: 101634 - protein, 11 aa, Artificial Sequence
  Description of Artificial Sequence: Synthetic peptide
  Seed: KFSLRRAVSVK (MAGC3_HUMAN)
KISLRRAVSVK

SEQ ID NO: 101635 - protein, 9 aa, Artificial Sequence
  Description of Artificial Sequence: Synthetic peptide
  Seed: MDPDNHSYF (MAGC3_HUMAN)
MAPDNHSYY

SEQ ID NO: 101636 - protein, 9 aa, Artificial Sequence
  Description of Artificial Sequence: Synthetic peptide
  Seed: YQAKEPLTR (MAGC3_HUMAN)
YTAKEPLTF

SEQ ID NO: 101637 - protein, 9 aa, Artificial Sequence
  Description of Artificial Sequence: Synthetic peptide
  Seed: KVAELVQFL (MAGC3_HUMAN)
KTAELVQFL

SEQ ID NO: 101638 - protein, 9 aa, Artificial Sequence
  Description of Artificial Sequence: Synthetic peptide
  Seed: IPPQGPPKI (MAGC3_HUMAN)
IMPQGPPKV

SEQ ID NO: 101639 - protein, 9 aa, Artificial Sequence
  Description of Artificial Sequence: Synthetic peptide
  Seed: HALPESESL (MAGC3_HUMAN)
HTLPESESI

SEQ ID NO: 101640 - protein, 11 aa, Artificial Sequence
  Description of Artificial Sequence: Synthetic peptide
  Seed: EILFGISLTEV (MAGC3_HUMAN)
EVLFGISLTEV

SEQ ID NO: 101641 - protein, 10 aa, Artificial Sequence
  Description of Artificial Sequence: Synthetic peptide
  Seed: KLVQFLLLKY (MAGC3_HUMAN)
KMVQFLLLKW

SEQ ID NO: 101642 - protein, 8 aa, Artificial Sequence
  Description of Artificial Sequence: Synthetic peptide
  Seed: LTYEGSLI (MAGC3_HUMAN)
LQYEGSLV

SEQ ID NO: 101643 - protein, 9 aa, Artificial Sequence
  Description of Artificial Sequence: Synthetic peptide
  Seed: LVQFLLLKY (MAGC3_HUMAN)
LLQFLLLKY

SEQ ID NO: 101644 - protein, 9 aa, Artificial Sequence
  Description of Artificial Sequence: Synthetic peptide
  Seed: TYFKLWRTL (MAGC3_HUMAN)
TWFKLWRTL

SEQ ID NO: 101645 - protein, 10 aa, Artificial Sequence
  Description of Artificial Sequence: Synthetic peptide
  Seed: SIIPSAFPSW (MAGC3_HUMAN)
SPIPSAFPSY

SEQ ID NO: 101646 - protein, 9 aa, Artificial Sequence
  Description of Artificial Sequence: Synthetic peptide
  Seed: IIPSAFPSW (MAGC3_HUMAN)
IGPSAFPSI

SEQ ID NO: 101647 - protein, 9 aa, Artificial Sequence
  Description of Artificial Sequence: Synthetic peptide
  Seed: YTGYFPMIF (MAGC3_HUMAN)
YFGYFPMII

SEQ ID NO: 101648 - protein, 9 aa, Artificial Sequence
  Description of Artificial Sequence: Synthetic peptide
  Seed: AIGPWSALA (MAGC3_HUMAN)
AAGPWSALV

SEQ ID NO: 101649 - protein, 9 aa, Artificial Sequence
  Description of Artificial Sequence: Synthetic peptide
  Seed: DMDPDNHSY (MAGC3_HUMAN)
DMDPDNHSF

SEQ ID NO: 101650 - protein, 9 aa, Artificial Sequence
  Description of Artificial Sequence: Synthetic peptide
  Seed: MIFGKAHEF (MAGC3_HUMAN)
MPFGKAHEW

SEQ ID NO: 101651 - protein, 9 aa, Artificial Sequence
  Description of Artificial Sequence: Synthetic peptide
  Seed: VDPDHFYVF (MAGC3_HUMAN)
VTPDHFYVL

SEQ ID NO: 101652 - protein, 9 aa, Artificial Sequence
  Description of Artificial Sequence: Synthetic peptide
  Seed: HALPESESL (MAGC3_HUMAN)
HRLPESESM

SEQ ID NO: 101653 - protein, 9 aa, Artificial Sequence
  Description of Artificial Sequence: Synthetic peptide
  Seed: WVKNTCATY (MAGC3_HUMAN)
WPKNTCATM

SEQ ID NO: 101654 - protein, 9 aa, Artificial Sequence
  Description of Artificial Sequence: Synthetic peptide
  Seed: ALDEKVAEL (MAGC3_HUMAN)
ACDEKVAEI

SEQ ID NO: 101655 - protein, 9 aa, Artificial Sequence
  Description of Artificial Sequence: Synthetic peptide
  Seed: FADVLSRLA (MAGC3_HUMAN)
FIDVLSRLM

SEQ ID NO: 101656 - protein, 10 aa, Artificial Sequence
  Description of Artificial Sequence: Synthetic peptide
  Seed: FKLWRTLSGS (MAGC3_HUMAN)
FSLWRTLSGA

SEQ ID NO: 101657 - protein, 10 aa, Artificial Sequence
  Description of Artificial Sequence: Synthetic peptide
  Seed: YTLDEKVDKL (MAGC3_HUMAN)
YGLDEKVDKV

SEQ ID NO: 101658 - protein, 10 aa, Artificial Sequence
  Description of Artificial Sequence: Synthetic peptide
  Seed: YTGYFPMIFR (MAGC3_HUMAN)
YIGYFPMIFK

SEQ ID NO: 101659 - protein, 9 aa, Artificial Sequence
  Description of Artificial Sequence: Synthetic peptide
  Seed: WRRGTGYTL (MAGC3_HUMAN)
WERGTGYTM

SEQ ID NO: 101660 - protein, 10 aa, Artificial Sequence
  Description of Artificial Sequence: Synthetic peptide
  Seed: KAHEFIELIF (MAGC3_HUMAN)
KLHEFIELIF

SEQ ID NO: 101661 - protein, 9 aa, Artificial Sequence
  Description of Artificial Sequence: Synthetic peptide
  Seed: LPTWRRGTG (MAGC3_HUMAN)
LPTWRRGTA

SEQ ID NO: 101662 - protein, 9 aa, Artificial Sequence
  Description of Artificial Sequence: Synthetic peptide
  Seed: NTYTGYFPM (MAGC3_HUMAN)
NTYTGYFPW

SEQ ID NO: 101663 - protein, 10 aa, Artificial Sequence
  Description of Artificial Sequence: Synthetic peptide
  Seed: GHLREVRLFL (MAGC3_HUMAN)
GMLREVRLFL

SEQ ID NO: 101664 - protein, 10 aa, Artificial Sequence
  Description of Artificial Sequence: Synthetic peptide
  Seed: EVIWEVLNAI (MAGC3_HUMAN)
EKIWEVLNAV

SEQ ID NO: 101665 - protein, 9 aa, Artificial Sequence
  Description of Artificial Sequence: Synthetic peptide
  Seed: EVLSAIGPI (MAGC3_HUMAN)
ETLSAIGPL

SEQ ID NO: 101666 - protein, 10 aa, Artificial Sequence
  Description of Artificial Sequence: Synthetic peptide
  Seed: SAFPSWYMDA (MAGC3_HUMAN)
STFPSWYMDV

SEQ ID NO: 101667 - protein, 9 aa, Artificial Sequence
  Description of Artificial Sequence: Synthetic peptide
  Seed: CSSPLLWTR (MAGC3_HUMAN)
CLSPLLWTR

SEQ ID NO: 101668 - protein, 10 aa, Artificial Sequence
  Description of Artificial Sequence: Synthetic peptide
  Seed: FKLWRTLSGS (MAGC3_HUMAN)
FFLWRTLSGM

SEQ ID NO: 101669 - protein, 9 aa, Artificial Sequence
  Description of Artificial Sequence: Synthetic peptide
  Seed: KNCLLILIL (MAGC3_HUMAN)
KSCLLILIF

SEQ ID NO: 101670 - protein, 10 aa, Artificial Sequence
  Description of Artificial Sequence: Synthetic peptide
  Seed: IKKYKDYFPM (MAGC3_HUMAN)
IIKYKDYFPF

SEQ ID NO: 101671 - protein, 9 aa, Artificial Sequence
  Description of Artificial Sequence: Synthetic peptide
  Seed: AELVQFLLL (MAGC3_HUMAN)
AQLVQFLLF

SEQ ID NO: 101672 - protein, 9 aa, Artificial Sequence
  Description of Artificial Sequence: Synthetic peptide
  Seed: WVKNTCATY (MAGC3_HUMAN)
WMKNTCATM

SEQ ID NO: 101673 - protein, 9 aa, Artificial Sequence
  Description of Artificial Sequence: Synthetic peptide
  Seed: MLLPCHWVL (MAGC3_HUMAN)
MELPCHWVF

SEQ ID NO: 101674 - protein, 9 aa, Artificial Sequence
  Description of Artificial Sequence: Synthetic peptide
  Seed: AEMLTTVIK (MAGC3_HUMAN)
AEMLTTVIW

SEQ ID NO: 101675 - protein, 9 aa, Artificial Sequence
  Description of Artificial Sequence: Synthetic peptide
  Seed: ALDEKVAEL (MAGC3_HUMAN)
AQDEKVAEF

SEQ ID NO: 101676 - protein, 10 aa, Artificial Sequence
  Description of Artificial Sequence: Synthetic peptide
  Seed: DMPAAGMPPL (MAGC3_HUMAN)
DFPAAGMPPM

SEQ ID NO: 101677 - protein, 10 aa, Artificial Sequence
  Description of Artificial Sequence: Synthetic peptide
  Seed: ELVQFLLLKY (MAGC3_HUMAN)
EVVQFLLLKK

SEQ ID NO: 101678 - protein, 9 aa, Artificial Sequence
  Description of Artificial Sequence: Synthetic peptide
  Seed: FPMIFRKAR (MAGC3_HUMAN)
FVMIFRKAR

SEQ ID NO: 101679 - protein, 10 aa, Artificial Sequence
  Description of Artificial Sequence: Synthetic peptide
  Seed: KYKDYFPMIF (MAGC3_HUMAN)
KWKDYFPMIF

SEQ ID NO: 101680 - protein, 9 aa, Artificial Sequence
  Description of Artificial Sequence: Synthetic peptide
  Seed: MIFRKAREF (MAGC3_HUMAN)
MTFRKAREL

SEQ ID NO: 101681 - protein, 9 aa, Artificial Sequence
  Description of Artificial Sequence: Synthetic peptide
  Seed: TEASPQQKK (MAGC3_HUMAN)
TAASPQQKI

SEQ ID NO: 101682 - protein, 10 aa, Artificial Sequence
  Description of Artificial Sequence: Synthetic peptide
  Seed: GSLPESEPLF (MAGC3_HUMAN)
GALPESEPLW

SEQ ID NO: 101683 - protein, 11 aa, Artificial Sequence
  Description of Artificial Sequence: Synthetic peptide
  Seed: YFFEDTLDLTY (MAGC3_HUMAN)
YAFEDTLDLTM

SEQ ID NO: 101684 - protein, 10 aa, Artificial Sequence
  Description of Artificial Sequence: Synthetic peptide
  Seed: YFPMIFGKAH (MAGC3_HUMAN)
YFPMIFGKAY

SEQ ID NO: 101685 - protein, 9 aa, Artificial Sequence
  Description of Artificial Sequence: Synthetic peptide
  Seed: KVDKLVQFL (MAGC3_HUMAN)
KWDKLVQFM

SEQ ID NO: 101686 - protein, 10 aa, Artificial Sequence
  Description of Artificial Sequence: Synthetic peptide
  Seed: KKYKDYFPMI (MAGC3_HUMAN)
KFYKDYFPML

SEQ ID NO: 101687 - protein, 10 aa, Artificial Sequence
  Description of Artificial Sequence: Synthetic peptide
  Seed: KKYKDYFPMI (MAGC3_HUMAN)
KYYKDYFPML

SEQ ID NO: 101688 - protein, 9 aa, Artificial Sequence
  Description of Artificial Sequence: Synthetic peptide
  Seed: RRAVSVKQR (MAGC3_HUMAN)
RRAVSVKQL

SEQ ID NO: 101689 - protein, 9 aa, Artificial Sequence
  Description of Artificial Sequence: Synthetic peptide
  Seed: HFYVFVNTL (MAGC3_HUMAN)
HDYVFVNTY

SEQ ID NO: 101690 - protein, 10 aa, Artificial Sequence
  Description of Artificial Sequence: Synthetic peptide
  Seed: VLDLANPQGL (MAGC3_HUMAN)
VWDLANPQGL

SEQ ID NO: 101691 - protein, 10 aa, Artificial Sequence
  Description of Artificial Sequence: Synthetic peptide
  Seed: EVIWEVLNAI (MAGC3_HUMAN)
EIIWEVLNAY

SEQ ID NO: 101692 - protein, 10 aa, Artificial Sequence
  Description of Artificial Sequence: Synthetic peptide
  Seed: MQMNVINTYT (MAGC3_HUMAN)
MMMNVINTYG

SEQ ID NO: 101693 - protein, 9 aa, Artificial Sequence
  Description of Artificial Sequence: Synthetic peptide
  Seed: HFYVFVNTL (MAGC3_HUMAN)
HEYVFVNTI

SEQ ID NO: 101694 - protein, 10 aa, Artificial Sequence
  Description of Artificial Sequence: Synthetic peptide
  Seed: TLSGSPGLQL (MAGC3_HUMAN)
TMSGSPGLQY

SEQ ID NO: 101695 - protein, 9 aa, Artificial Sequence
  Description of Artificial Sequence: Synthetic peptide
  Seed: KVDKLVQFL (MAGC3_HUMAN)
KMDKLVQFF

SEQ ID NO: 101696 - protein, 9 aa, Artificial Sequence
  Description of Artificial Sequence: Synthetic peptide
  Seed: IPSAFPSWY (MAGC3_HUMAN)
IWSAFPSWY

SEQ ID NO: 101697 - protein, 10 aa, Artificial Sequence
  Description of Artificial Sequence: Synthetic peptide
  Seed: YALSPVVLPP (MAGC3_HUMAN)
YILSPVVLPI

SEQ ID NO: 101698 - protein, 10 aa, Artificial Sequence
  Description of Artificial Sequence: Synthetic peptide
  Seed: MLLPCHWVLD (MAGC3_HUMAN)
MFLPCHWVLV

SEQ ID NO: 101699 - protein, 9 aa, Artificial Sequence
  Description of Artificial Sequence: Synthetic peptide
  Seed: HSYFFEDTL (MAGC3_HUMAN)
HKYFFEDTF

SEQ ID NO: 101700 - protein, 9 aa, Artificial Sequence
  Description of Artificial Sequence: Synthetic peptide
  Seed: MIFRKAREF (MAGC3_HUMAN)
MPFRKAREV

SEQ ID NO: 101701 - protein, 9 aa, Artificial Sequence
  Description of Artificial Sequence: Synthetic peptide
  Seed: EFIELIFGI (MAGC3_HUMAN)
ETIELIFGT

SEQ ID NO: 101702 - protein, 10 aa, Artificial Sequence
  Description of Artificial Sequence: Synthetic peptide
  Seed: WVKNTCATYA (MAGC3_HUMAN)
WQKNTCATYY

SEQ ID NO: 101703 - protein, 10 aa, Artificial Sequence
  Description of Artificial Sequence: Synthetic peptide
  Seed: YALDEKVAEL (MAGC3_HUMAN)
YPLDEKVAEV

SEQ ID NO: 101704 - protein, 9 aa, Artificial Sequence
  Description of Artificial Sequence: Synthetic peptide
  Seed: ASEEVIWEV (MAGC3_HUMAN)
AREEVIWEM

SEQ ID NO: 101705 - protein, 10 aa, Artificial Sequence
  Description of Artificial Sequence: Synthetic peptide
  Seed: EPQDWPLNEK (MAGC3_HUMAN)
ELQDWPLNER

SEQ ID NO: 101706 - protein, 9 aa, Artificial Sequence
  Description of Artificial Sequence: Synthetic peptide
  Seed: LIDDQGMPK (MAGC3_HUMAN)
LSDDQGMPI

SEQ ID NO: 101707 - protein, 10 aa, Artificial Sequence
  Description of Artificial Sequence: Synthetic peptide
  Seed: EEVIWEVLNA (MAGC3_HUMAN)
EGVIWEVLNV

SEQ ID NO: 101708 - protein, 11 aa, Artificial Sequence
  Description of Artificial Sequence: Synthetic peptide
  Seed: FADVLSRLALW (MAGC3_HUMAN)
FTDVLSRLALW

SEQ ID NO: 101709 - protein, 10 aa, Artificial Sequence
  Description of Artificial Sequence: Synthetic peptide
  Seed: MNVINTYTGY (MAGC3_HUMAN)
MMVINTYTGY

SEQ ID NO: 101710 - protein, 9 aa, Artificial Sequence
  Description of Artificial Sequence: Synthetic peptide
  Seed: LVQFLLLKY (MAGC3_HUMAN)
LMQFLLLKR

SEQ ID NO: 101711 - protein, 9 aa, Artificial Sequence
  Description of Artificial Sequence: Synthetic peptide
  Seed: SLGQWVKNT (MAGC3_HUMAN)
SMGQWVKNA

SEQ ID NO: 101712 - protein, 9 aa, Artificial Sequence
  Description of Artificial Sequence: Synthetic peptide
  Seed: ATDKDYSAF (MAGC3_HUMAN)
ASDKDYSAW

SEQ ID NO: 101713 - protein, 10 aa, Artificial Sequence
  Description of Artificial Sequence: Synthetic peptide
  Seed: SDQRMDSLVL (MAGC3_HUMAN)
STQRMDSLVY

SEQ ID NO: 101714 - protein, 9 aa, Artificial Sequence
  Description of Artificial Sequence: Synthetic peptide
  Seed: KKYKDYFPM (MAGC3_HUMAN)
KMYKDYFPW

SEQ ID NO: 101715 - protein, 10 aa, Artificial Sequence
  Description of Artificial Sequence: Synthetic peptide
  Seed: INTYTGYFPM (MAGC3_HUMAN)
IRTYTGYFPY

SEQ ID NO: 101716 - protein, 10 aa, Artificial Sequence
  Description of Artificial Sequence: Synthetic peptide
  Seed: MDPDNHSYFF (MAGC3_HUMAN)
MKPDNHSYFW

SEQ ID NO: 101717 - protein, 10 aa, Artificial Sequence
  Description of Artificial Sequence: Synthetic peptide
  Seed: SDQRMDSLVL (MAGC3_HUMAN)
SVQRMDSLVM

SEQ ID NO: 101718 - protein, 10 aa, Artificial Sequence
  Description of Artificial Sequence: Synthetic peptide
  Seed: AEMLTTVIKK (MAGC3_HUMAN)
AIMLTTVIKK

SEQ ID NO: 101719 - protein, 9 aa, Artificial Sequence
  Description of Artificial Sequence: Synthetic peptide
  Seed: ILILSVIFI (MAGC3_HUMAN)
IMILSVIFL

SEQ ID NO: 101720 - protein, 10 aa, Artificial Sequence
  Description of Artificial Sequence: Synthetic peptide
  Seed: WVKNTCATYA (MAGC3_HUMAN)
WQKNTCATYM

SEQ ID NO: 101721 - protein, 9 aa, Artificial Sequence
  Description of Artificial Sequence: Synthetic peptide
  Seed: YTGYFPMIF (MAGC3_HUMAN)
YIGYFPMIF

SEQ ID NO: 101722 - protein, 9 aa, Artificial Sequence
  Description of Artificial Sequence: Synthetic peptide
  Seed: VTKAEMLTT (MAGC3_HUMAN)
VTKAEMLTK

SEQ ID NO: 101723 - protein, 9 aa, Artificial Sequence
  Description of Artificial Sequence: Synthetic peptide
  Seed: YQAKEPLTR (MAGC3_HUMAN)
YYAKEPLTR

SEQ ID NO: 101724 - protein, 10 aa, Artificial Sequence
  Description of Artificial Sequence: Synthetic peptide
  Seed: EVIWEVLSAI (MAGC3_HUMAN)
ESIWEVLSAR

SEQ ID NO: 101725 - protein, 9 aa, Artificial Sequence
  Description of Artificial Sequence: Synthetic peptide
  Seed: VDPDHFYVF (MAGC3_HUMAN)
VYPDHFYVF

SEQ ID NO: 101726 - protein, 10 aa, Artificial Sequence
  Description of Artificial Sequence: Synthetic peptide
  Seed: FKLWRTLSGS (MAGC3_HUMAN)
FMLWRTLSGM

SEQ ID NO: 101727 - protein, 9 aa, Artificial Sequence
  Description of Artificial Sequence: Synthetic peptide
  Seed: ELIFGIALT (MAGC3_HUMAN)
EAIFGIALV

SEQ ID NO: 101728 - protein, 9 aa, Artificial Sequence
  Description of Artificial Sequence: Synthetic peptide
  Seed: TTDDATAMA (MAGC3_HUMAN)
TCDDATAMI

SEQ ID NO: 101729 - protein, 10 aa, Artificial Sequence
  Description of Artificial Sequence: Synthetic peptide
  Seed: EMQMNVINTY (MAGC3_HUMAN)
EYQMNVINTY

SEQ ID NO: 101730 - protein, 9 aa, Artificial Sequence
  Description of Artificial Sequence: Synthetic peptide
  Seed: ALSPVVLPP (MAGC3_HUMAN)
AQSPVVLPI

SEQ ID NO: 101731 - protein, 9 aa, Artificial Sequence
  Description of Artificial Sequence: Synthetic peptide
  Seed: EVIWEVLSA (MAGC3_HUMAN)
ESIWEVLSR

SEQ ID NO: 101732 - protein, 10 aa, Artificial Sequence
  Description of Artificial Sequence: Synthetic peptide
  Seed: AFPSWYMDAL (MAGC3_HUMAN)
AYPSWYMDAY

SEQ ID NO: 101733 - protein, 10 aa, Artificial Sequence
  Description of Artificial Sequence: Synthetic peptide
  Seed: YALDEKVAEL (MAGC3_HUMAN)
YALDEKVAEM

SEQ ID NO: 101734 - protein, 9 aa, Artificial Sequence
  Description of Artificial Sequence: Synthetic peptide
  Seed: KAHEFIELI (MAGC3_HUMAN)
KHHEFIELM

SEQ ID NO: 101735 - protein, 9 aa, Artificial Sequence
  Description of Artificial Sequence: Synthetic peptide
  Seed: MIFRKAREF (MAGC3_HUMAN)
MIFRKAREL

SEQ ID NO: 101736 - protein, 9 aa, Artificial Sequence
  Description of Artificial Sequence: Synthetic peptide
  Seed: VIWEVLNAI (MAGC3_HUMAN)
VIWEVLNAM

SEQ ID NO: 101737 - protein, 9 aa, Artificial Sequence
  Description of Artificial Sequence: Synthetic peptide
  Seed: MPAAGMPPL (MAGC3_HUMAN)
MIAAGMPPA

SEQ ID NO: 101738 - protein, 9 aa, Artificial Sequence
  Description of Artificial Sequence: Synthetic peptide
  Seed: ATYALSPVV (MAGC3_HUMAN)
AMYALSPVT

SEQ ID NO: 101739 - protein, 9 aa, Artificial Sequence
  Description of Artificial Sequence: Synthetic peptide
  Seed: SASPSVMST (MAGC3_HUMAN)
SGSPSVMSF

SEQ ID NO: 101740 - protein, 10 aa, Artificial Sequence
  Description of Artificial Sequence: Synthetic peptide
  Seed: MLLPCHWVLD (MAGC3_HUMAN)
MTLPCHWVLL

SEQ ID NO: 101741 - protein, 10 aa, Artificial Sequence
  Description of Artificial Sequence: Synthetic peptide
  Seed: RPAREVLEFL (MAGC3_HUMAN)
RPAREVLEFM

SEQ ID NO: 101742 - protein, 9 aa, Artificial Sequence
  Description of Artificial Sequence: Synthetic peptide
  Seed: TAMASASPS (MAGC3_HUMAN)
TAMASASPF

SEQ ID NO: 101743 - protein, 10 aa, Artificial Sequence
  Description of Artificial Sequence: Synthetic peptide
  Seed: MQMNVINTYT (MAGC3_HUMAN)
MPMNVINTYI

SEQ ID NO: 101744 - protein, 9 aa, Artificial Sequence
  Description of Artificial Sequence: Synthetic peptide
  Seed: HLREVRLFL (MAGC3_HUMAN)
HVREVRLFA

SEQ ID NO: 101745 - protein, 10 aa, Artificial Sequence
  Description of Artificial Sequence: Synthetic peptide
  Seed: VLCPTYFKLW (MAGC3_HUMAN)
VYCPTYFKLL

SEQ ID NO: 101746 - protein, 10 aa, Artificial Sequence
  Description of Artificial Sequence: Synthetic peptide
  Seed: YALDEKVAEL (MAGC3_HUMAN)
YDLDEKVAET

SEQ ID NO: 101747 - protein, 8 aa, Artificial Sequence
  Description of Artificial Sequence: Synthetic peptide
  Seed: MEDRAQAI (MAGC3_HUMAN)
MADRAQAL

SEQ ID NO: 101748 - protein, 10 aa, Artificial Sequence
  Description of Artificial Sequence: Synthetic peptide
  Seed: TTDDATAMAS (MAGC3_HUMAN)
TLDDATAMAI

SEQ ID NO: 101749 - protein, 11 aa, Artificial Sequence
  Description of Artificial Sequence: Synthetic peptide
  Seed: RTLSGSPGLQL (MAGC3_HUMAN)
RVLSGSPGLQY

SEQ ID NO: 101750 - protein, 9 aa, Artificial Sequence
  Description of Artificial Sequence: Synthetic peptide
  Seed: LSGSPGLQL (MAGC3_HUMAN)
LRGSPGLQM

SEQ ID NO: 101751 - protein, 9 aa, Artificial Sequence
  Description of Artificial Sequence: Synthetic peptide
  Seed: VLPPQPQPR (MAGC3_HUMAN)
VVPPQPQPK

SEQ ID NO: 101752 - protein, 9 aa, Artificial Sequence
  Description of Artificial Sequence: Synthetic peptide
  Seed: EFIELIFGI (MAGC3_HUMAN)
EAIELIFGV

SEQ ID NO: 101753 - protein, 9 aa, Artificial Sequence
  Description of Artificial Sequence: Synthetic peptide
  Seed: YSAFHLGHL (MAGC3_HUMAN)
YGAFHLGHW

SEQ ID NO: 101754 - protein, 9 aa, Artificial Sequence
  Description of Artificial Sequence: Synthetic peptide
  Seed: MASASPSVM (MAGC3_HUMAN)
MYSASPSVL

SEQ ID NO: 101755 - protein, 10 aa, Artificial Sequence
  Description of Artificial Sequence: Synthetic peptide
  Seed: SKLSSIIPSA (MAGC3_HUMAN)
SRLSSIIPSI

SEQ ID NO: 101756 - protein, 9 aa, Artificial Sequence
  Description of Artificial Sequence: Synthetic peptide
  Seed: GFADVLSRL (MAGC3_HUMAN)
GSADVLSRL

SEQ ID NO: 101757 - protein, 9 aa, Artificial Sequence
  Description of Artificial Sequence: Synthetic peptide
  Seed: MASASPSVM (MAGC3_HUMAN)
MASASPSVI

SEQ ID NO: 101758 - protein, 9 aa, Artificial Sequence
  Description of Artificial Sequence: Synthetic peptide
  Seed: FSDGSLGQW (MAGC3_HUMAN)
FTDGSLGQI

SEQ ID NO: 101759 - protein, 9 aa, Artificial Sequence
  Description of Artificial Sequence: Synthetic peptide
  Seed: AGFADVLSR (MAGC3_HUMAN)
AIFADVLSY

SEQ ID NO: 101760 - protein, 11 aa, Artificial Sequence
  Description of Artificial Sequence: Synthetic peptide
  Seed: TTDDATAMASA (MAGC3_HUMAN)
TADDATAMASV

SEQ ID NO: 101761 - protein, 11 aa, Artificial Sequence
  Description of Artificial Sequence: Synthetic peptide
  Seed: ATFSDGSLGQW (MAGC3_HUMAN)
AGFSDGSLGQY

SEQ ID NO: 101762 - protein, 9 aa, Artificial Sequence
  Description of Artificial Sequence: Synthetic peptide
  Seed: HALPESESL (MAGC3_HUMAN)
HILPESESV

SEQ ID NO: 101763 - protein, 9 aa, Artificial Sequence
  Description of Artificial Sequence: Synthetic peptide
  Seed: IPPQGPPKI (MAGC3_HUMAN)
ITPQGPPKM

SEQ ID NO: 101764 - protein, 10 aa, Artificial Sequence
  Description of Artificial Sequence: Synthetic peptide
  Seed: IELIFGIALT (MAGC3_HUMAN)
IGLIFGIALL

SEQ ID NO: 101765 - protein, 9 aa, Artificial Sequence
  Description of Artificial Sequence: Synthetic peptide
  Seed: MASASPSVM (MAGC3_HUMAN)
MLSASPSVM

SEQ ID NO: 101766 - protein, 11 aa, Artificial Sequence
  Description of Artificial Sequence: Synthetic peptide
  Seed: KVAELVQFLLL (MAGC3_HUMAN)
KLAELVQFLLQ

SEQ ID NO: 101767 - protein, 10 aa, Artificial Sequence
  Description of Artificial Sequence: Synthetic peptide
  Seed: ATFSDGSLGQ (MAGC3_HUMAN)
AAFSDGSLGK

SEQ ID NO: 101768 - protein, 9 aa, Artificial Sequence
  Description of Artificial Sequence: Synthetic peptide
  Seed: LSDEQGMPQ (MAGC3_HUMAN)
LQDEQGMPI

SEQ ID NO: 101769 - protein, 9 aa, Artificial Sequence
  Description of Artificial Sequence: Synthetic peptide
  Seed: FSDGSLGQW (MAGC3_HUMAN)
FLDGSLGQM

SEQ ID NO: 101770 - protein, 9 aa, Artificial Sequence
  Description of Artificial Sequence: Synthetic peptide
  Seed: TSDQRMDSL (MAGC3_HUMAN)
TWDQRMDSM

SEQ ID NO: 101771 - protein, 10 aa, Artificial Sequence
  Description of Artificial Sequence: Synthetic peptide
  Seed: NTYTGYFPMI (MAGC3_HUMAN)
NVYTGYFPMF

SEQ ID NO: 101772 - protein, 11 aa, Artificial Sequence
  Description of Artificial Sequence: Synthetic peptide
  Seed: ALWESEGPEAF (MAGC3_HUMAN)
AQWESEGPEAV

SEQ ID NO: 101773 - protein, 9 aa, Artificial Sequence
  Description of Artificial Sequence: Synthetic peptide
  Seed: VLPPQPQPR (MAGC3_HUMAN)
VFPPQPQPI

SEQ ID NO: 101774 - protein, 9 aa, Artificial Sequence
  Description of Artificial Sequence: Synthetic peptide
  Seed: KVAELVQFL (MAGC3_HUMAN)
KAAELVQFA

SEQ ID NO: 101775 - protein, 9 aa, Artificial Sequence
  Description of Artificial Sequence: Synthetic peptide
  Seed: LSAIGPIQR (MAGC3_HUMAN)
LAAIGPIQR

SEQ ID NO: 101776 - protein, 9 aa, Artificial Sequence
  Description of Artificial Sequence: Synthetic peptide
  Seed: SLVLCPTYF (MAGC3_HUMAN)
SSVLCPTYY

SEQ ID NO: 101777 - protein, 11 aa, Artificial Sequence
  Description of Artificial Sequence: Synthetic peptide
  Seed: TSDQRMDSLVL (MAGC3_HUMAN)
TMDQRMDSLVF

SEQ ID NO: 101778 - protein, 10 aa, Artificial Sequence
  Description of Artificial Sequence: Synthetic peptide
  Seed: ALDEKVAELV (MAGC3_HUMAN)
AMDEKVAELL

SEQ ID NO: 101779 - protein, 10 aa, Artificial Sequence
  Description of Artificial Sequence: Synthetic peptide
  Seed: WEVLSAIGPI (MAGC3_HUMAN)
WLVLSAIGPL

SEQ ID NO: 101780 - protein, 11 aa, Artificial Sequence
  Description of Artificial Sequence: Synthetic peptide
  Seed: FIKGSCVPEEV (MAGC3_HUMAN)
FMKGSCVPEEI

SEQ ID NO: 101781 - protein, 10 aa, Artificial Sequence
  Description of Artificial Sequence: Synthetic peptide
  Seed: SIIPSAFPSW (MAGC3_HUMAN)
SAIPSAFPSW

SEQ ID NO: 101782 - protein, 10 aa, Artificial Sequence
  Description of Artificial Sequence: Synthetic peptide
  Seed: VLCPTYFKLW (MAGC3_HUMAN)
VMCPTYFKLF

SEQ ID NO: 101783 - protein, 10 aa, Artificial Sequence
  Description of Artificial Sequence: Synthetic peptide
  Seed: TEVDPDHFYV (MAGC3_HUMAN)
TLVDPDHFYA

SEQ ID NO: 101784 - protein, 9 aa, Artificial Sequence
  Description of Artificial Sequence: Synthetic peptide
  Seed: TTDDATAMA (MAGC3_HUMAN)
TDDDATAML

SEQ ID NO: 101785 - protein, 9 aa, Artificial Sequence
  Description of Artificial Sequence: Synthetic peptide
  Seed: TEASPQQKK (MAGC3_HUMAN)
TAASPQQKF

SEQ ID NO: 101786 - protein, 9 aa, Artificial Sequence
  Description of Artificial Sequence: Synthetic peptide
  Seed: HALPESESL (MAGC3_HUMAN)
HALPESESY

SEQ ID NO: 101787 - protein, 10 aa, Artificial Sequence
  Description of Artificial Sequence: Synthetic peptide
  Seed: SIIPSAFPSW (MAGC3_HUMAN)
STIPSAFPSW

SEQ ID NO: 101788 - protein, 11 aa, Artificial Sequence
  Description of Artificial Sequence: Synthetic peptide
  Seed: FIKGSCVPEEV (MAGC3_HUMAN)
FMKGSCVPEEL

SEQ ID NO: 101789 - protein, 10 aa, Artificial Sequence
  Description of Artificial Sequence: Synthetic peptide
  Seed: SPLDSCSSPL (MAGC3_HUMAN)
SPLDSCSSPI

SEQ ID NO: 101790 - protein, 9 aa, Artificial Sequence
  Description of Artificial Sequence: Synthetic peptide
  Seed: ATYALSPVV (MAGC3_HUMAN)
AAYALSPVY

SEQ ID NO: 101791 - protein, 10 aa, Artificial Sequence
  Description of Artificial Sequence: Synthetic peptide
  Seed: KAEMLTTVIK (MAGC3_HUMAN)
KMEMLTTVIK

SEQ ID NO: 101792 - protein, 9 aa, Artificial Sequence
  Description of Artificial Sequence: Synthetic peptide
  Seed: EFIELIFGI (MAGC3_HUMAN)
EIIELIFGT

SEQ ID NO: 101793 - protein, 10 aa, Artificial Sequence
  Description of Artificial Sequence: Synthetic peptide
  Seed: YALSPVVLPP (MAGC3_HUMAN)
YHLSPVVLPT

SEQ ID NO: 101794 - protein, 9 aa, Artificial Sequence
  Description of Artificial Sequence: Synthetic peptide
  Seed: IIDTTDDAT (MAGC3_HUMAN)
IIDTTDDAL

SEQ ID NO: 101795 - protein, 10 aa, Artificial Sequence
  Description of Artificial Sequence: Synthetic peptide
  Seed: LPTWRRGTGY (MAGC3_HUMAN)
LKTWRRGTGF

SEQ ID NO: 101796 - protein, 10 aa, Artificial Sequence
  Description of Artificial Sequence: Synthetic peptide
  Seed: SALAGFADVL (MAGC3_HUMAN)
SMLAGFADVI

SEQ ID NO: 101797 - protein, 10 aa, Artificial Sequence
  Description of Artificial Sequence: Synthetic peptide
  Seed: TAMASASPSV (MAGC3_HUMAN)
TLMASASPSI

SEQ ID NO: 101798 - protein, 11 aa, Artificial Sequence
  Description of Artificial Sequence: Synthetic peptide
  Seed: RGLTEASPQQK (MAGC3_HUMAN)
RVLTEASPQQK

SEQ ID NO: 101799 - protein, 9 aa, Artificial Sequence
  Description of Artificial Sequence: Synthetic peptide
  Seed: SQPEGKFSL (MAGC3_HUMAN)
SIPEGKFSY

SEQ ID NO: 101800 - protein, 9 aa, Artificial Sequence
  Description of Artificial Sequence: Synthetic peptide
  Seed: MLLPCHWVL (MAGC3_HUMAN)
MCLPCHWVW

SEQ ID NO: 101801 - protein, 10 aa, Artificial Sequence
  Description of Artificial Sequence: Synthetic peptide
  Seed: EVIWEVLSAI (MAGC3_HUMAN)
ERIWEVLSAV

SEQ ID NO: 101802 - protein, 9 aa, Artificial Sequence
  Description of Artificial Sequence: Synthetic peptide
  Seed: SLRRAVSVK (MAGC3_HUMAN)
SVRRAVSVM

SEQ ID NO: 101803 - protein, 10 aa, Artificial Sequence
  Description of Artificial Sequence: Synthetic peptide
  Seed: RMDSLVLCPT (MAGC3_HUMAN)
RLDSLVLCPA

SEQ ID NO: 101804 - protein, 9 aa, Artificial Sequence
  Description of Artificial Sequence: Synthetic peptide
  Seed: KYKDYFPMI (MAGC3_HUMAN)
KMKDYFPMF

SEQ ID NO: 101805 - protein, 10 aa, Artificial Sequence
  Description of Artificial Sequence: Synthetic peptide
  Seed: FPSWYMDALK (MAGC3_HUMAN)
FTSWYMDALK

SEQ ID NO: 101806 - protein, 11 aa, Artificial Sequence
  Description of Artificial Sequence: Synthetic peptide
  Seed: SLVLCPTYFKL (MAGC3_HUMAN)
SMVLCPTYFKV

SEQ ID NO: 101807 - protein, 9 aa, Artificial Sequence
  Description of Artificial Sequence: Synthetic peptide
  Seed: MLTTVIKKY (MAGC3_HUMAN)
MVTTVIKKL

SEQ ID NO: 101808 - protein, 9 aa, Artificial Sequence
  Description of Artificial Sequence: Synthetic peptide
  Seed: QTKEPVTKA (MAGC3_HUMAN)
QVKEPVTKF

SEQ ID NO: 101809 - protein, 9 aa, Artificial Sequence
  Description of Artificial Sequence: Synthetic peptide
  Seed: RTLSGSPGL (MAGC3_HUMAN)
RGLSGSPGY

SEQ ID NO: 101810 - protein, 9 aa, Artificial Sequence
  Description of Artificial Sequence: Synthetic peptide
  Seed: YSAFHLGHL (MAGC3_HUMAN)
YQAFHLGHF

SEQ ID NO: 101811 - protein, 9 aa, Artificial Sequence
  Description of Artificial Sequence: Synthetic peptide
  Seed: AGFADVLSR (MAGC3_HUMAN)
AIFADVLSK

SEQ ID NO: 101812 - protein, 10 aa, Artificial Sequence
  Description of Artificial Sequence: Synthetic peptide
  Seed: DMPAAGMPPL (MAGC3_HUMAN)
DMPAAGMPPY

SEQ ID NO: 101813 - protein, 8 aa, Artificial Sequence
  Description of Artificial Sequence: Synthetic peptide
  Seed: MPKNCLLI (MAGC3_HUMAN)
MPKNCLLL

SEQ ID NO: 101814 - protein, 9 aa, Artificial Sequence
  Description of Artificial Sequence: Synthetic peptide
  Seed: TLDEKVDKL (MAGC3_HUMAN)
TADEKVDKM

SEQ ID NO: 101815 - protein, 9 aa, Artificial Sequence
  Description of Artificial Sequence: Synthetic peptide
  Seed: FADVLSRLA (MAGC3_HUMAN)
FVDVLSRLL

SEQ ID NO: 101816 - protein, 10 aa, Artificial Sequence
  Description of Artificial Sequence: Synthetic peptide
  Seed: TTDDATAMAS (MAGC3_HUMAN)
TLDDATAMAM

SEQ ID NO: 101817 - protein, 9 aa, Artificial Sequence
  Description of Artificial Sequence: Synthetic peptide
  Seed: WRRGTGYTL (MAGC3_HUMAN)
WYRGTGYTM

SEQ ID NO: 101818 - protein, 10 aa, Artificial Sequence
  Description of Artificial Sequence: Synthetic peptide
  Seed: TGYFPMIFRK (MAGC3_HUMAN)
TMYFPMIFRF

SEQ ID NO: 101819 - protein, 8 aa, Artificial Sequence
  Description of Artificial Sequence: Synthetic peptide
  Seed: MEDRAQAI (MAGC3_HUMAN)
MVDRAQAV

SEQ ID NO: 101820 - protein, 9 aa, Artificial Sequence
  Description of Artificial Sequence: Synthetic peptide
  Seed: SPPEIPPQG (MAGC3_HUMAN)
SPPEIPPQL

SEQ ID NO: 101821 - protein, 9 aa, Artificial Sequence
  Description of Artificial Sequence: Synthetic peptide
  Seed: AELVQFLLL (MAGC3_HUMAN)
AELVQFLLP

SEQ ID NO: 101822 - protein, 10 aa, Artificial Sequence
  Description of Artificial Sequence: Synthetic peptide
  Seed: SDQRMDSLVL (MAGC3_HUMAN)
SDQRMDSLVF

SEQ ID NO: 101823 - protein, 9 aa, Artificial Sequence
  Description of Artificial Sequence: Synthetic peptide
  Seed: KVAELVQFL (MAGC3_HUMAN)
KMAELVQFC

SEQ ID NO: 101824 - protein, 9 aa, Artificial Sequence
  Description of Artificial Sequence: Synthetic peptide
  Seed: NTYTGYFPM (MAGC3_HUMAN)
NAYTGYFPA

SEQ ID NO: 101825 - protein, 9 aa, Artificial Sequence
  Description of Artificial Sequence: Synthetic peptide
  Seed: SASPSVMST (MAGC3_HUMAN)
SSSPSVMSY

SEQ ID NO: 101826 - protein, 9 aa, Artificial Sequence
  Description of Artificial Sequence: Synthetic peptide
  Seed: MEDRAQAII (MAGC3_HUMAN)
MIDRAQAIF

SEQ ID NO: 101827 - protein, 10 aa, Artificial Sequence
  Description of Artificial Sequence: Synthetic peptide
  Seed: FKLWRTLSGS (MAGC3_HUMAN)
FQLWRTLSGL

SEQ ID NO: 101828 - protein, 11 aa, Artificial Sequence
  Description of Artificial Sequence: Synthetic peptide
  Seed: GYFPMIFRKAR (MAGC3_HUMAN)
GTFPMIFRKAR

SEQ ID NO: 101829 - protein, 11 aa, Artificial Sequence
  Description of Artificial Sequence: Synthetic peptide
  Seed: KRLWGEKAGSL (MAGC3_HUMAN)
KRLWGEKAGSF

SEQ ID NO: 101830 - protein, 9 aa, Artificial Sequence
  Description of Artificial Sequence: Synthetic peptide
  Seed: VLPPQPQPR (MAGC3_HUMAN)
VSPPQPQPV

SEQ ID NO: 101831 - protein, 9 aa, Artificial Sequence
  Description of Artificial Sequence: Synthetic peptide
  Seed: WESEGPEAF (MAGC3_HUMAN)
WVSEGPEAY

SEQ ID NO: 101832 - protein, 10 aa, Artificial Sequence
  Description of Artificial Sequence: Synthetic peptide
  Seed: INTYTGYFPM (MAGC3_HUMAN)
IETYTGYFPF

SEQ ID NO: 101833 - protein, 9 aa, Artificial Sequence
  Description of Artificial Sequence: Synthetic peptide
  Seed: NAIGPWSAL (MAGC3_HUMAN)
NMIGPWSAM

SEQ ID NO: 101834 - protein, 10 aa, Artificial Sequence
  Description of Artificial Sequence: Synthetic peptide
  Seed: MLLPCHWVLD (MAGC3_HUMAN)
MGLPCHWVLV

SEQ ID NO: 101835 - protein, 10 aa, Artificial Sequence
  Description of Artificial Sequence: Synthetic peptide
  Seed: MDSLVLCPTY (MAGC3_HUMAN)
MDSLVLCPTW

SEQ ID NO: 101836 - protein, 10 aa, Artificial Sequence
  Description of Artificial Sequence: Synthetic peptide
  Seed: LWKDSDLPTW (MAGC3_HUMAN)
LGKDSDLPTW

SEQ ID NO: 101837 - protein, 9 aa, Artificial Sequence
  Description of Artificial Sequence: Synthetic peptide
  Seed: LSDEQGMPQ (MAGC3_HUMAN)
LSDEQGMPY

SEQ ID NO: 101838 - protein, 9 aa, Artificial Sequence
  Description of Artificial Sequence: Synthetic peptide
  Seed: ALDEKVAEL (MAGC3_HUMAN)
APDEKVAEV

SEQ ID NO: 101839 - protein, 9 aa, Artificial Sequence
  Description of Artificial Sequence: Synthetic peptide
  Seed: GKAHEFIEL (MAGC3_HUMAN)
GRAHEFIEL

SEQ ID NO: 101840 - protein, 10 aa, Artificial Sequence
  Description of Artificial Sequence: Synthetic peptide
  Seed: KKYKDYFPMI (MAGC3_HUMAN)
KEYKDYFPMK

SEQ ID NO: 101841 - protein, 9 aa, Artificial Sequence
  Description of Artificial Sequence: Synthetic peptide
  Seed: SLVLCPTYF (MAGC3_HUMAN)
SYVLCPTYI

SEQ ID NO: 101842 - protein, 10 aa, Artificial Sequence
  Description of Artificial Sequence: Synthetic peptide
  Seed: NTYTGYFPMI (MAGC3_HUMAN)
NTYTGYFPMV

SEQ ID NO: 101843 - protein, 11 aa, Artificial Sequence
  Description of Artificial Sequence: Synthetic peptide
  Seed: LSKLSSIIPSA (MAGC3_HUMAN)
LTKLSSIIPSV

SEQ ID NO: 101844 - protein, 10 aa, Artificial Sequence
  Description of Artificial Sequence: Synthetic peptide
  Seed: YFPMIFGKAH (MAGC3_HUMAN)
YYPMIFGKAM

SEQ ID NO: 101845 - protein, 10 aa, Artificial Sequence
  Description of Artificial Sequence: Synthetic peptide
  Seed: KLSSIIPSAF (MAGC3_HUMAN)
KCSSIIPSAW

SEQ ID NO: 101846 - protein, 10 aa, Artificial Sequence
  Description of Artificial Sequence: Synthetic peptide
  Seed: MDSLVLCPTY (MAGC3_HUMAN)
MFSLVLCPTY

SEQ ID NO: 101847 - protein, 10 aa, Artificial Sequence
  Description of Artificial Sequence: Synthetic peptide
  Seed: EVIWEVLSAI (MAGC3_HUMAN)
ETIWEVLSAF

SEQ ID NO: 101848 - protein, 11 aa, Artificial Sequence
  Description of Artificial Sequence: Synthetic peptide
  Seed: SIIPSAFPSWY (MAGC3_HUMAN)
SVIPSAFPSWK

SEQ ID NO: 101849 - protein, 10 aa, Artificial Sequence
  Description of Artificial Sequence: Synthetic peptide
  Seed: AEMLTTVIKK (MAGC3_HUMAN)
AVMLTTVIKK

SEQ ID NO: 101850 - protein, 9 aa, Artificial Sequence
  Description of Artificial Sequence: Synthetic peptide
  Seed: LILSVIFIK (MAGC3_HUMAN)
LFLSVIFIR

SEQ ID NO: 101851 - protein, 9 aa, Artificial Sequence
  Description of Artificial Sequence: Synthetic peptide
  Seed: MIFRKAREF (MAGC3_HUMAN)
MSFRKAREI

SEQ ID NO: 101852 - protein, 11 aa, Artificial Sequence
  Description of Artificial Sequence: Synthetic peptide
  Seed: KGSCVPEEVIW (MAGC3_HUMAN)
KMSCVPEEVIW

SEQ ID NO: 101853 - protein, 10 aa, Artificial Sequence
  Description of Artificial Sequence: Synthetic peptide
  Seed: MQMNVINTYT (MAGC3_HUMAN)
MLMNVINTYW

SEQ ID NO: 101854 - protein, 9 aa, Artificial Sequence
  Description of Artificial Sequence: Synthetic peptide
  Seed: GKFSLRRAV (MAGC3_HUMAN)
GKFSLRRAF

SEQ ID NO: 101855 - protein, 11 aa, Artificial Sequence
  Description of Artificial Sequence: Synthetic peptide
  Seed: YALDEKVAELV (MAGC3_HUMAN)
YLLDEKVAELM

SEQ ID NO: 101856 - protein, 9 aa, Artificial Sequence
  Description of Artificial Sequence: Synthetic peptide
  Seed: RPAREVLEF (MAGC3_HUMAN)
RKAREVLEL

SEQ ID NO: 101857 - protein, 10 aa, Artificial Sequence
  Description of Artificial Sequence: Synthetic peptide
  Seed: KDYFPMIFGK (MAGC3_HUMAN)
KQYFPMIFGR

SEQ ID NO: 101858 - protein, 9 aa, Artificial Sequence
  Description of Artificial Sequence: Synthetic peptide
  Seed: TYFKLWRTL (MAGC3_HUMAN)
TRFKLWRTM

SEQ ID NO: 101859 - protein, 9 aa, Artificial Sequence
  Description of Artificial Sequence: Synthetic peptide
  Seed: TAMASASPS (MAGC3_HUMAN)
TPMASASPH

SEQ ID NO: 101860 - protein, 10 aa, Artificial Sequence
  Description of Artificial Sequence: Synthetic peptide
  Seed: TAMASASPSV (MAGC3_HUMAN)
TLMASASPSM

SEQ ID NO: 101861 - protein, 9 aa, Artificial Sequence
  Description of Artificial Sequence: Synthetic peptide
  Seed: ELIFGIALT (MAGC3_HUMAN)
EVIFGIALV

SEQ ID NO: 101862 - protein, 9 aa, Artificial Sequence
  Description of Artificial Sequence: Synthetic peptide
  Seed: KAHEFIELI (MAGC3_HUMAN)
KLHEFIELV

SEQ ID NO: 101863 - protein, 9 aa, Artificial Sequence
  Description of Artificial Sequence: Synthetic peptide
  Seed: IFGKAHEFI (MAGC3_HUMAN)
IYGKAHEFY

SEQ ID NO: 101864 - protein, 9 aa, Artificial Sequence
  Description of Artificial Sequence: Synthetic peptide
  Seed: QDWPLNEKR (MAGC3_HUMAN)
QLWPLNEKR

SEQ ID NO: 101865 - protein, 10 aa, Artificial Sequence
  Description of Artificial Sequence: Synthetic peptide
  Seed: TTDDATAMAS (MAGC3_HUMAN)
TSDDATAMAF

SEQ ID NO: 101866 - protein, 9 aa, Artificial Sequence
  Description of Artificial Sequence: Synthetic peptide
  Seed: SLRRAVSVK (MAGC3_HUMAN)
SSRRAVSVI

SEQ ID NO: 101867 - protein, 11 aa, Artificial Sequence
  Description of Artificial Sequence: Synthetic peptide
  Seed: FLSKLSSIIPS (MAGC3_HUMAN)
FLSKLSSIIPL

SEQ ID NO: 101868 - protein, 8 aa, Artificial Sequence
  Description of Artificial Sequence: Synthetic peptide
  Seed: YFKLWRTL (MAGC3_HUMAN)
YLKLWRTL

SEQ ID NO: 101869 - protein, 9 aa, Artificial Sequence
  Description of Artificial Sequence: Synthetic peptide
  Seed: ALSPVVLPP (MAGC3_HUMAN)
ASSPVVLPV

SEQ ID NO: 101870 - protein, 9 aa, Artificial Sequence
  Description of Artificial Sequence: Synthetic peptide
  Seed: SDQRMDSLV (MAGC3_HUMAN)
SEQRMDSLI

SEQ ID NO: 101871 - protein, 9 aa, Artificial Sequence
  Description of Artificial Sequence: Synthetic peptide
  Seed: SAIGPIQRP (MAGC3_HUMAN)
STIGPIQRM

SEQ ID NO: 101872 - protein, 10 aa, Artificial Sequence
  Description of Artificial Sequence: Synthetic peptide
  Seed: SPVVLPPQPQ (MAGC3_HUMAN)
SPVVLPPQPV

SEQ ID NO: 101873 - protein, 10 aa, Artificial Sequence
  Description of Artificial Sequence: Synthetic peptide
  Seed: INTYTGYFPM (MAGC3_HUMAN)
IQTYTGYFPW

SEQ ID NO: 101874 - protein, 10 aa, Artificial Sequence
  Description of Artificial Sequence: Synthetic peptide
  Seed: FKLWRTLSGS (MAGC3_HUMAN)
FWLWRTLSGA

SEQ ID NO: 101875 - protein, 9 aa, Artificial Sequence
  Description of Artificial Sequence: Synthetic peptide
  Seed: NTYTGYFPM (MAGC3_HUMAN)
NVYTGYFPF

SEQ ID NO: 101876 - protein, 11 aa, Artificial Sequence
  Description of Artificial Sequence: Synthetic peptide
  Seed: YALDEKVAELV (MAGC3_HUMAN)
YYLDEKVAELV

SEQ ID NO: 101877 - protein, 10 aa, Artificial Sequence
  Description of Artificial Sequence: Synthetic peptide
  Seed: LDSCSSPLLW (MAGC3_HUMAN)
LASCSSPLLW

SEQ ID NO: 101878 - protein, 10 aa, Artificial Sequence
  Description of Artificial Sequence: Synthetic peptide
  Seed: ILILSVIFIK (MAGC3_HUMAN)
IQILSVIFIK

SEQ ID NO: 101879 - protein, 10 aa, Artificial Sequence
  Description of Artificial Sequence: Synthetic peptide
  Seed: SLPAVSPGKR (MAGC3_HUMAN)
SIPAVSPGKK

SEQ ID NO: 101880 - protein, 9 aa, Artificial Sequence
  Description of Artificial Sequence: Synthetic peptide
  Seed: KLWRTLSGS (MAGC3_HUMAN)
KIWRTLSGI

SEQ ID NO: 101881 - protein, 11 aa, Artificial Sequence
  Description of Artificial Sequence: Synthetic peptide
  Seed: INTYTGYFPMI (MAGC3_HUMAN)
IMTYTGYFPMF

SEQ ID NO: 101882 - protein, 9 aa, Artificial Sequence
  Description of Artificial Sequence: Synthetic peptide
  Seed: FPMIFRKAR (MAGC3_HUMAN)
FIMIFRKAR

SEQ ID NO: 101883 - protein, 11 aa, Artificial Sequence
  Description of Artificial Sequence: Synthetic peptide
  Seed: LSKLSSIIPSA (MAGC3_HUMAN)
LHKLSSIIPSV

SEQ ID NO: 101884 - protein, 10 aa, Artificial Sequence
  Description of Artificial Sequence: Synthetic peptide
  Seed: RRGTGYTLSL (MAGC3_HUMAN)
RRGTGYTLSI

SEQ ID NO: 101885 - protein, 9 aa, Artificial Sequence
  Description of Artificial Sequence: Synthetic peptide
  Seed: WRRGTGYTL (MAGC3_HUMAN)
WQRGTGYTW

SEQ ID NO: 101886 - protein, 9 aa, Artificial Sequence
  Description of Artificial Sequence: Synthetic peptide
  Seed: LSDEQGMPQ (MAGC3_HUMAN)
LLDEQGMPM

SEQ ID NO: 101887 - protein, 9 aa, Artificial Sequence
  Description of Artificial Sequence: Synthetic peptide
  Seed: MLLPCHWVL (MAGC3_HUMAN)
MMLPCHWVR

SEQ ID NO: 101888 - protein, 10 aa, Artificial Sequence
  Description of Artificial Sequence: Synthetic peptide
  Seed: MDPDNHSYFF (MAGC3_HUMAN)
MVPDNHSYFW

SEQ ID NO: 101889 - protein, 9 aa, Artificial Sequence
  Description of Artificial Sequence: Synthetic peptide
  Seed: ATYALSPVV (MAGC3_HUMAN)
AIYALSPVI

SEQ ID NO: 101890 - protein, 9 aa, Artificial Sequence
  Description of Artificial Sequence: Synthetic peptide
  Seed: GPWSALAGF (MAGC3_HUMAN)
GLWSALAGY

SEQ ID NO: 101891 - protein, 10 aa, Artificial Sequence
  Description of Artificial Sequence: Synthetic peptide
  Seed: MNVINTYTGY (MAGC3_HUMAN)
MGVINTYTGR

SEQ ID NO: 101892 - protein, 10 aa, Artificial Sequence
  Description of Artificial Sequence: Synthetic peptide
  Seed: LNAIGPWSAL (MAGC3_HUMAN)
LGAIGPWSAM

SEQ ID NO: 101893 - protein, 9 aa, Artificial Sequence
  Description of Artificial Sequence: Synthetic peptide
  Seed: REVRLFLRG (MAGC3_HUMAN)
REVRLFLRI

SEQ ID NO: 101894 - protein, 10 aa, Artificial Sequence
  Description of Artificial Sequence: Synthetic peptide
  Seed: REVRLFLRGG (MAGC3_HUMAN)
RMVRLFLRGV

SEQ ID NO: 101895 - protein, 9 aa, Artificial Sequence
  Description of Artificial Sequence: Synthetic peptide
  Seed: EKVAELVQF (MAGC3_HUMAN)
EMVAELVQY

SEQ ID NO: 101896 - protein, 11 aa, Artificial Sequence
  Description of Artificial Sequence: Synthetic peptide
  Seed: AEMQMNVINTY (MAGC3_HUMAN)
AEMQMNVINTV

SEQ ID NO: 101897 - protein, 9 aa, Artificial Sequence
  Description of Artificial Sequence: Synthetic peptide
  Seed: CATYALSPV (MAGC3_HUMAN)
CSTYALSPM

SEQ ID NO: 101898 - protein, 8 aa, Artificial Sequence
  Description of Artificial Sequence: Synthetic peptide
  Seed: TTDDATAM (MAGC3_HUMAN)
TTDDATAV

SEQ ID NO: 101899 - protein, 10 aa, Artificial Sequence
  Description of Artificial Sequence: Synthetic peptide
  Seed: FLSKLSSIIP (MAGC3_HUMAN)
FMSKLSSIIL

SEQ ID NO: 101900 - protein, 9 aa, Artificial Sequence
  Description of Artificial Sequence: Synthetic peptide
  Seed: MPPLPQSPP (MAGC3_HUMAN)
MPPLPQSPT

SEQ ID NO: 101901 - protein, 9 aa, Artificial Sequence
  Description of Artificial Sequence: Synthetic peptide
  Seed: CPTYFKLWR (MAGC3_HUMAN)
CFTYFKLWR

SEQ ID NO: 101902 - protein, 9 aa, Artificial Sequence
  Description of Artificial Sequence: Synthetic peptide
  Seed: LSRLALWES (MAGC3_HUMAN)
LMRLALWEK

SEQ ID NO: 101903 - protein, 9 aa, Artificial Sequence
  Description of Artificial Sequence: Synthetic peptide
  Seed: LSSIIPSAF (MAGC3_HUMAN)
LPSIIPSAF

SEQ ID NO: 101904 - protein, 9 aa, Artificial Sequence
  Description of Artificial Sequence: Synthetic peptide
  Seed: RGTGYTLSL (MAGC3_HUMAN)
RATGYTLSI

SEQ ID NO: 101905 - protein, 9 aa, Artificial Sequence
  Description of Artificial Sequence: Synthetic peptide
  Seed: TGYFPMIFR (MAGC3_HUMAN)
TYYFPMIFR

SEQ ID NO: 101906 - protein, 9 aa, Artificial Sequence
  Description of Artificial Sequence: Synthetic peptide
  Seed: LSAIGPIQR (MAGC3_HUMAN)
LAAIGPIQV

SEQ ID NO: 101907 - protein, 9 aa, Artificial Sequence
  Description of Artificial Sequence: Synthetic peptide
  Seed: LILILSVIF (MAGC3_HUMAN)
LSLILSVIW

SEQ ID NO: 101908 - protein, 9 aa, Artificial Sequence
  Description of Artificial Sequence: Synthetic peptide
  Seed: QAKEPLTRA (MAGC3_HUMAN)
QAKEPLTRY

SEQ ID NO: 101909 - protein, 10 aa, Artificial Sequence
  Description of Artificial Sequence: Synthetic peptide
  Seed: SALAGFADVL (MAGC3_HUMAN)
STLAGFADVV

SEQ ID NO: 101910 - protein, 9 aa, Artificial Sequence
  Description of Artificial Sequence: Synthetic peptide
  Seed: VLCPTYFKL (MAGC3_HUMAN)
VVCPTYFKL

SEQ ID NO: 101911 - protein, 10 aa, Artificial Sequence
  Description of Artificial Sequence: Synthetic peptide
  Seed: YALDEKVAEL (MAGC3_HUMAN)
YYLDEKVAEC

SEQ ID NO: 101912 - protein, 9 aa, Artificial Sequence
  Description of Artificial Sequence: Synthetic peptide
  Seed: MPAAGMPPL (MAGC3_HUMAN)
MPAAGMPPH

SEQ ID NO: 101913 - protein, 9 aa, Artificial Sequence
  Description of Artificial Sequence: Synthetic peptide
  Seed: HALPESESL (MAGC3_HUMAN)
HQLPESESM

SEQ ID NO: 101914 - protein, 10 aa, Artificial Sequence
  Description of Artificial Sequence: Synthetic peptide
  Seed: FGKAHEFIEL (MAGC3_HUMAN)
FPKAHEFIEL

SEQ ID NO: 101915 - protein, 10 aa, Artificial Sequence
  Description of Artificial Sequence: Synthetic peptide
  Seed: FKLWRTLSGS (MAGC3_HUMAN)
FWLWRTLSGI

SEQ ID NO: 101916 - protein, 10 aa, Artificial Sequence
  Description of Artificial Sequence: Synthetic peptide
  Seed: TDDATAMASA (MAGC3_HUMAN)
TEDATAMASL

SEQ ID NO: 101917 - protein, 10 aa, Artificial Sequence
  Description of Artificial Sequence: Synthetic peptide
  Seed: TGYFPMIFRK (MAGC3_HUMAN)
TAYFPMIFRI

SEQ ID NO: 101918 - protein, 9 aa, Artificial Sequence
  Description of Artificial Sequence: Synthetic peptide
  Seed: KYKDYFPMI (MAGC3_HUMAN)
KVKDYFPML

SEQ ID NO: 101919 - protein, 11 aa, Artificial Sequence
  Description of Artificial Sequence: Synthetic peptide
  Seed: HALPESESLPR (MAGC3_HUMAN)
HLLPESESLPR

SEQ ID NO: 101920 - protein, 9 aa, Artificial Sequence
  Description of Artificial Sequence: Synthetic peptide
  Seed: FPMIFGKAH (MAGC3_HUMAN)
FAMIFGKAF

SEQ ID NO: 101921 - protein, 9 aa, Artificial Sequence
  Description of Artificial Sequence: Synthetic peptide
  Seed: FPSWYMDAL (MAGC3_HUMAN)
FQSWYMDAM

SEQ ID NO: 101922 - protein, 9 aa, Artificial Sequence
  Description of Artificial Sequence: Synthetic peptide
  Seed: LRSAEGSVL (MAGC3_HUMAN)
LHSAEGSVY

SEQ ID NO: 101923 - protein, 9 aa, Artificial Sequence
  Description of Artificial Sequence: Synthetic peptide
  Seed: MASASPSVM (MAGC3_HUMAN)
MWSASPSVL

SEQ ID NO: 101924 - protein, 9 aa, Artificial Sequence
  Description of Artificial Sequence: Synthetic peptide
  Seed: EEDTATWHA (MAGC3_HUMAN)
EEDTATWHV

SEQ ID NO: 101925 - protein, 9 aa, Artificial Sequence
  Description of Artificial Sequence: Synthetic peptide
  Seed: WRRGTGYTL (MAGC3_HUMAN)
WERGTGYTY

SEQ ID NO: 101926 - protein, 10 aa, Artificial Sequence
  Description of Artificial Sequence: Synthetic peptide
  Seed: YTGYFPMIFR (MAGC3_HUMAN)
YQGYFPMIFR

SEQ ID NO: 101927 - protein, 10 aa, Artificial Sequence
  Description of Artificial Sequence: Synthetic peptide
  Seed: KLSSIIPSAF (MAGC3_HUMAN)
KLSSIIPSAW

SEQ ID NO: 101928 - protein, 9 aa, Artificial Sequence
  Description of Artificial Sequence: Synthetic peptide
  Seed: MPAAGMPPL (MAGC3_HUMAN)
MSAAGMPPA

SEQ ID NO: 101929 - protein, 10 aa, Artificial Sequence
  Description of Artificial Sequence: Synthetic peptide
  Seed: ALDEKVAELV (MAGC3_HUMAN)
AYDEKVAELF

SEQ ID NO: 101930 - protein, 9 aa, Artificial Sequence
  Description of Artificial Sequence: Synthetic peptide
  Seed: LIDDQGMPK (MAGC3_HUMAN)
LGDDQGMPF

SEQ ID NO: 101931 - protein, 9 aa, Artificial Sequence
  Description of Artificial Sequence: Synthetic peptide
  Seed: LIDDQGMPK (MAGC3_HUMAN)
LVDDQGMPL

SEQ ID NO: 101932 - protein, 10 aa, Artificial Sequence
  Description of Artificial Sequence: Synthetic peptide
  Seed: REVRLFLRGG (MAGC3_HUMAN)
RIVRLFLRGV

SEQ ID NO: 101933 - protein, 9 aa, Artificial Sequence
  Description of Artificial Sequence: Synthetic peptide
  Seed: FLSKLSSII (MAGC3_HUMAN)
FVSKLSSIY

SEQ ID NO: 101934 - protein, 9 aa, Artificial Sequence
  Description of Artificial Sequence: Synthetic peptide
  Seed: RGTGYTLSL (MAGC3_HUMAN)
RTTGYTLSL

SEQ ID NO: 101935 - protein, 9 aa, Artificial Sequence
  Description of Artificial Sequence: Synthetic peptide
  Seed: TLDEKVDKL (MAGC3_HUMAN)
TVDEKVDKM

SEQ ID NO: 101936 - protein, 11 aa, Artificial Sequence
  Description of Artificial Sequence: Synthetic peptide
  Seed: GQWVKNTCATY (MAGC3_HUMAN)
GMWVKNTCATY

SEQ ID NO: 101937 - protein, 10 aa, Artificial Sequence
  Description of Artificial Sequence: Synthetic peptide
  Seed: RMDSLVLCPT (MAGC3_HUMAN)
RLDSLVLCPI

SEQ ID NO: 101938 - protein, 9 aa, Artificial Sequence
  Description of Artificial Sequence: Synthetic peptide
  Seed: YFFEDTLDL (MAGC3_HUMAN)
YFFEDTLDF

SEQ ID NO: 101939 - protein, 9 aa, Artificial Sequence
  Description of Artificial Sequence: Synthetic peptide
  Seed: VLCPTYFKL (MAGC3_HUMAN)
VQCPTYFKW

SEQ ID NO: 101940 - protein, 10 aa, Artificial Sequence
  Description of Artificial Sequence: Synthetic peptide
  Seed: PTYFKLWRTL (MAGC3_HUMAN)
PMYFKLWRTF

SEQ ID NO: 101941 - protein, 10 aa, Artificial Sequence
  Description of Artificial Sequence: Synthetic peptide
  Seed: VLCPTYFKLW (MAGC3_HUMAN)
VTCPTYFKLF

SEQ ID NO: 101942 - protein, 11 aa, Artificial Sequence
  Description of Artificial Sequence: Synthetic peptide
  Seed: AEMQMNVINTY (MAGC3_HUMAN)
ARMQMNVINTY

SEQ ID NO: 101943 - protein, 11 aa, Artificial Sequence
  Description of Artificial Sequence: Synthetic peptide
  Seed: SSIIPSAFPSW (MAGC3_HUMAN)
STIIPSAFPSF

SEQ ID NO: 101944 - protein, 10 aa, Artificial Sequence
  Description of Artificial Sequence: Synthetic peptide
  Seed: SLVLCPTYFK (MAGC3_HUMAN)
SRVLCPTYFR

SEQ ID NO: 101945 - protein, 10 aa, Artificial Sequence
  Description of Artificial Sequence: Synthetic peptide
  Seed: LDLANPQGLA (MAGC3_HUMAN)
LILANPQGLV

SEQ ID NO: 101946 - protein, 9 aa, Artificial Sequence
  Description of Artificial Sequence: Synthetic peptide
  Seed: MIFIKGSCV (MAGC3_HUMAN)
MVFIKGSCV

SEQ ID NO: 101947 - protein, 9 aa, Artificial Sequence
  Description of Artificial Sequence: Synthetic peptide
  Seed: MQMNVINTY (MAGC3_HUMAN)
MPMNVINTV

SEQ ID NO: 101948 - protein, 9 aa, Artificial Sequence
  Description of Artificial Sequence: Synthetic peptide
  Seed: EFIELIFGI (MAGC3_HUMAN)
ENIELIFGI

SEQ ID NO: 101949 - protein, 9 aa, Artificial Sequence
  Description of Artificial Sequence: Synthetic peptide
  Seed: RGTGYTLSL (MAGC3_HUMAN)
RQTGYTLSF

SEQ ID NO: 101950 - protein, 9 aa, Artificial Sequence
  Description of Artificial Sequence: Synthetic peptide
  Seed: FKLWRTLSG (MAGC3_HUMAN)
FELWRTLSM

SEQ ID NO: 101951 - protein, 10 aa, Artificial Sequence
  Description of Artificial Sequence: Synthetic peptide
  Seed: KDMEDRAQAI (MAGC3_HUMAN)
KEMEDRAQAT

SEQ ID NO: 101952 - protein, 10 aa, Artificial Sequence
  Description of Artificial Sequence: Synthetic peptide
  Seed: YALSPVVLPP (MAGC3_HUMAN)
YELSPVVLPA

SEQ ID NO: 101953 - protein, 9 aa, Artificial Sequence
  Description of Artificial Sequence: Synthetic peptide
  Seed: IPSAFPSWY (MAGC3_HUMAN)
IFSAFPSWY

SEQ ID NO: 101954 - protein, 10 aa, Artificial Sequence
  Description of Artificial Sequence: Synthetic peptide
  Seed: LPTWRRGTGY (MAGC3_HUMAN)
LDTWRRGTGW

SEQ ID NO: 101955 - protein, 10 aa, Artificial Sequence
  Description of Artificial Sequence: Synthetic peptide
  Seed: MQMNVINTYT (MAGC3_HUMAN)
MYMNVINTYY

SEQ ID NO: 101956 - protein, 10 aa, Artificial Sequence
  Description of Artificial Sequence: Synthetic peptide
  Seed: KVAELVQFLL (MAGC3_HUMAN)
KMAELVQFLK

SEQ ID NO: 101957 - protein, 9 aa, Artificial Sequence
  Description of Artificial Sequence: Synthetic peptide
  Seed: EVIWEVLNA (MAGC3_HUMAN)
EVIWEVLNR

SEQ ID NO: 101958 - protein, 10 aa, Artificial Sequence
  Description of Artificial Sequence: Synthetic peptide
  Seed: KDYFPMIFGK (MAGC3_HUMAN)
KFYFPMIFGR

SEQ ID NO: 101959 - protein, 10 aa, Artificial Sequence
  Description of Artificial Sequence: Synthetic peptide
  Seed: SPQGPPQSPP (MAGC3_HUMAN)
SPQGPPQSPL

SEQ ID NO: 101960 - protein, 11 aa, Artificial Sequence
  Description of Artificial Sequence: Synthetic peptide
  Seed: TSDQRMDSLVL (MAGC3_HUMAN)
TFDQRMDSLVY

SEQ ID NO: 101961 - protein, 8 aa, Artificial Sequence
  Description of Artificial Sequence: Synthetic peptide
  Seed: FADVLSRL (MAGC3_HUMAN)
FQDVLSRI

SEQ ID NO: 101962 - protein, 9 aa, Artificial Sequence
  Description of Artificial Sequence: Synthetic peptide
  Seed: IIPSAFPSW (MAGC3_HUMAN)
ILPSAFPSY

SEQ ID NO: 101963 - protein, 9 aa, Artificial Sequence
  Description of Artificial Sequence: Synthetic peptide
  Seed: ALAGFADVL (MAGC3_HUMAN)
AQAGFADVY

SEQ ID NO: 101964 - protein, 9 aa, Artificial Sequence
  Description of Artificial Sequence: Synthetic peptide
  Seed: SLPESEPLF (MAGC3_HUMAN)
STPESEPLF

SEQ ID NO: 101965 - protein, 9 aa, Artificial Sequence
  Description of Artificial Sequence: Synthetic peptide
  Seed: ELIFGIALT (MAGC3_HUMAN)
EVIFGIALL

SEQ ID NO: 101966 - protein, 9 aa, Artificial Sequence
  Description of Artificial Sequence: Synthetic peptide
  Seed: TLDEKVDKL (MAGC3_HUMAN)
TWDEKVDKF

SEQ ID NO: 101967 - protein, 9 aa, Artificial Sequence
  Description of Artificial Sequence: Synthetic peptide
  Seed: VLCPTYFKL (MAGC3_HUMAN)
VMCPTYFKW

SEQ ID NO: 101968 - protein, 9 aa, Artificial Sequence
  Description of Artificial Sequence: Synthetic peptide
  Seed: KYKDYFPMI (MAGC3_HUMAN)
KMKDYFPML

SEQ ID NO: 101969 - protein, 11 aa, Artificial Sequence
  Description of Artificial Sequence: Synthetic peptide
  Seed: SPVVLPPQPQP (MAGC3_HUMAN)
SPVVLPPQPQA

SEQ ID NO: 101970 - protein, 10 aa, Artificial Sequence
  Description of Artificial Sequence: Synthetic peptide
  Seed: YALDEKVAEL (MAGC3_HUMAN)
YWLDEKVAEA

SEQ ID NO: 101971 - protein, 9 aa, Artificial Sequence
  Description of Artificial Sequence: Synthetic peptide
  Seed: ATDKDYSAF (MAGC3_HUMAN)
AFDKDYSAL

SEQ ID NO: 101972 - protein, 9 aa, Artificial Sequence
  Description of Artificial Sequence: Synthetic peptide
  Seed: EVIWEVLNA (MAGC3_HUMAN)
ELIWEVLNV

SEQ ID NO: 101973 - protein, 9 aa, Artificial Sequence
  Description of Artificial Sequence: Synthetic peptide
  Seed: MIFGKAHEF (MAGC3_HUMAN)
MIFGKAHEW

SEQ ID NO: 101974 - protein, 9 aa, Artificial Sequence
  Description of Artificial Sequence: Synthetic peptide
  Seed: SIIPSAFPS (MAGC3_HUMAN)
SVIPSAFPM

SEQ ID NO: 101975 - protein, 9 aa, Artificial Sequence
  Description of Artificial Sequence: Synthetic peptide
  Seed: YQAKEPLTR (MAGC3_HUMAN)
YAAKEPLTV

SEQ ID NO: 101976 - protein, 9 aa, Artificial Sequence
  Description of Artificial Sequence: Synthetic peptide
  Seed: MLLPCHWVL (MAGC3_HUMAN)
MQLPCHWVM

SEQ ID NO: 101977 - protein, 9 aa, Artificial Sequence
  Description of Artificial Sequence: Synthetic peptide
  Seed: GPWSALAGF (MAGC3_HUMAN)
GLWSALAGF

SEQ ID NO: 101978 - protein, 9 aa, Artificial Sequence
  Description of Artificial Sequence: Synthetic peptide
  Seed: WEVLSAIGP (MAGC3_HUMAN)
WEVLSAIGF

SEQ ID NO: 101979 - protein, 9 aa, Artificial Sequence
  Description of Artificial Sequence: Synthetic peptide
  Seed: IIDTTDDAT (MAGC3_HUMAN)
IMDTTDDAV

SEQ ID NO: 101980 - protein, 9 aa, Artificial Sequence
  Description of Artificial Sequence: Synthetic peptide
  Seed: FHLGHLREV (MAGC3_HUMAN)
FWLGHLREF

SEQ ID NO: 101981 - protein, 11 aa, Artificial Sequence
  Description of Artificial Sequence: Synthetic peptide
  Seed: FLSKLSSIIPS (MAGC3_HUMAN)
FLSKLSSIIPV

SEQ ID NO: 101982 - protein, 10 aa, Artificial Sequence
  Description of Artificial Sequence: Synthetic peptide
  Seed: SLVLCPTYFK (MAGC3_HUMAN)
SCVLCPTYFR

SEQ ID NO: 101983 - protein, 9 aa, Artificial Sequence
  Description of Artificial Sequence: Synthetic peptide
  Seed: IIPSAFPSW (MAGC3_HUMAN)
IIPSAFPSF

SEQ ID NO: 101984 - protein, 10 aa, Artificial Sequence
  Description of Artificial Sequence: Synthetic peptide
  Seed: HLREVRLFLR (MAGC3_HUMAN)
HTREVRLFLR

SEQ ID NO: 101985 - protein, 10 aa, Artificial Sequence
  Description of Artificial Sequence: Synthetic peptide
  Seed: MNVINTYTGY (MAGC3_HUMAN)
MQVINTYTGL

SEQ ID NO: 101986 - protein, 9 aa, Artificial Sequence
  Description of Artificial Sequence: Synthetic peptide
  Seed: QRMDSLVLC (MAGC3_HUMAN)
QRMDSLVLL

SEQ ID NO: 101987 - protein, 9 aa, Artificial Sequence
  Description of Artificial Sequence: Synthetic peptide
  Seed: LSSIIPSAF (MAGC3_HUMAN)
LTSIIPSAL

SEQ ID NO: 101988 - protein, 11 aa, Artificial Sequence
  Description of Artificial Sequence: Synthetic peptide
  Seed: ILFGISLTEVD (MAGC3_HUMAN)
ILFGISLTEVR

SEQ ID NO: 101989 - protein, 9 aa, Artificial Sequence
  Description of Artificial Sequence: Synthetic peptide
  Seed: KLSSIIPSA (MAGC3_HUMAN)
KISSIIPSM

SEQ ID NO: 101990 - protein, 9 aa, Artificial Sequence
  Description of Artificial Sequence: Synthetic peptide
  Seed: NVINTYTGY (MAGC3_HUMAN)
NVINTYTGK

SEQ ID NO: 101991 - protein, 10 aa, Artificial Sequence
  Description of Artificial Sequence: Synthetic peptide
  Seed: MNVINTYTGY (MAGC3_HUMAN)
MLVINTYTGK

SEQ ID NO: 101992 - protein, 10 aa, Artificial Sequence
  Description of Artificial Sequence: Synthetic peptide
  Seed: TYTGYFPMIF (MAGC3_HUMAN)
TVTGYFPMIY

SEQ ID NO: 101993 - protein, 9 aa, Artificial Sequence
  Description of Artificial Sequence: Synthetic peptide
  Seed: ATYALSPVV (MAGC3_HUMAN)
AYYALSPVK

SEQ ID NO: 101994 - protein, 10 aa, Artificial Sequence
  Description of Artificial Sequence: Synthetic peptide
  Seed: VLCPTYFKLW (MAGC3_HUMAN)
VVCPTYFKLW

SEQ ID NO: 101995 - protein, 9 aa, Artificial Sequence
  Description of Artificial Sequence: Synthetic peptide
  Seed: FPSWYMDAL (MAGC3_HUMAN)
FHSWYMDAM

SEQ ID NO: 101996 - protein, 10 aa, Artificial Sequence
  Description of Artificial Sequence: Synthetic peptide
  Seed: NAIGPWSALA (MAGC3_HUMAN)
NTIGPWSALA

SEQ ID NO: 101997 - protein, 9 aa, Artificial Sequence
  Description of Artificial Sequence: Synthetic peptide
  Seed: FLSKLSSII (MAGC3_HUMAN)
FASKLSSIL

SEQ ID NO: 101998 - protein, 9 aa, Artificial Sequence
  Description of Artificial Sequence: Synthetic peptide
  Seed: HFYVFVNTL (MAGC3_HUMAN)
HEYVFVNTY

SEQ ID NO: 101999 - protein, 9 aa, Artificial Sequence
  Description of Artificial Sequence: Synthetic peptide
  Seed: YALSPVVLP (MAGC3_HUMAN)
YVLSPVVLY

SEQ ID NO: 102000 - protein, 11 aa, Artificial Sequence
  Description of Artificial Sequence: Synthetic peptide
  Seed: RMDSLVLCPTY (MAGC3_HUMAN)
RQDSLVLCPTY

SEQ ID NO: 102001 - protein, 9 aa, Artificial Sequence
  Description of Artificial Sequence: Synthetic peptide
  Seed: LSAIGPIQR (MAGC3_HUMAN)
LVAIGPIQK

SEQ ID NO: 102002 - protein, 9 aa, Artificial Sequence
  Description of Artificial Sequence: Synthetic peptide
  Seed: AMASASPSV (MAGC3_HUMAN)
AEASASPSM

SEQ ID NO: 102003 - protein, 9 aa, Artificial Sequence
  Description of Artificial Sequence: Synthetic peptide
  Seed: SLPESEPLF (MAGC3_HUMAN)
SAPESEPLF

SEQ ID NO: 102004 - protein, 9 aa, Artificial Sequence
  Description of Artificial Sequence: Synthetic peptide
  Seed: SQPEGKFSL (MAGC3_HUMAN)
SWPEGKFSY

SEQ ID NO: 102005 - protein, 9 aa, Artificial Sequence
  Description of Artificial Sequence: Synthetic peptide
  Seed: DYFPMIFGK (MAGC3_HUMAN)
DWFPMIFGR

SEQ ID NO: 102006 - protein, 9 aa, Artificial Sequence
  Description of Artificial Sequence: Synthetic peptide
  Seed: HLREVRLFL (MAGC3_HUMAN)
HMREVRLFM

SEQ ID NO: 102007 - protein, 10 aa, Artificial Sequence
  Description of Artificial Sequence: Synthetic peptide
  Seed: GLRSAEGSVL (MAGC3_HUMAN)
GVRSAEGSVY

SEQ ID NO: 102008 - protein, 9 aa, Artificial Sequence
  Description of Artificial Sequence: Synthetic peptide
  Seed: MIFGKAHEF (MAGC3_HUMAN)
MPFGKAHEV

SEQ ID NO: 102009 - protein, 9 aa, Artificial Sequence
  Description of Artificial Sequence: Synthetic peptide
  Seed: QPQPRKKAT (MAGC3_HUMAN)
QMQPRKKAI

SEQ ID NO: 102010 - protein, 9 aa, Artificial Sequence
  Description of Artificial Sequence: Synthetic peptide
  Seed: MQMNVINTY (MAGC3_HUMAN)
MQMNVINTV

SEQ ID NO: 102011 - protein, 9 aa, Artificial Sequence
  Description of Artificial Sequence: Synthetic peptide
  Seed: TTDDATAMA (MAGC3_HUMAN)
TMDDATAMF

SEQ ID NO: 102012 - protein, 8 aa, Artificial Sequence
  Description of Artificial Sequence: Synthetic peptide
  Seed: MPQNRLLI (MAGC3_HUMAN)
MMQNRLLM

SEQ ID NO: 102013 - protein, 9 aa, Artificial Sequence
  Description of Artificial Sequence: Synthetic peptide
  Seed: MIFGKAHEF (MAGC3_HUMAN)
MMFGKAHET

SEQ ID NO: 102014 - protein, 11 aa, Artificial Sequence
  Description of Artificial Sequence: Synthetic peptide
  Seed: GSQPEGKFSLR (MAGC3_HUMAN)
GSQPEGKFSLY

SEQ ID NO: 102015 - protein, 10 aa, Artificial Sequence
  Description of Artificial Sequence: Synthetic peptide
  Seed: KLSSIIPSAF (MAGC3_HUMAN)
KVSSIIPSAF

SEQ ID NO: 102016 - protein, 9 aa, Artificial Sequence
  Description of Artificial Sequence: Synthetic peptide
  Seed: YKDYFPMIF (MAGC3_HUMAN)
YQDYFPMIL

SEQ ID NO: 102017 - protein, 9 aa, Artificial Sequence
  Description of Artificial Sequence: Synthetic peptide
  Seed: LANPQGLAG (MAGC3_HUMAN)
LVNPQGLAY

SEQ ID NO: 102018 - protein, 10 aa, Artificial Sequence
  Description of Artificial Sequence: Synthetic peptide
  Seed: LTRAEMQMNV (MAGC3_HUMAN)
LTRAEMQMNK

SEQ ID NO: 102019 - protein, 11 aa, Artificial Sequence
  Description of Artificial Sequence: Synthetic peptide
  Seed: ATFSDGSLGQW (MAGC3_HUMAN)
AYFSDGSLGQY

SEQ ID NO: 102020 - protein, 11 aa, Artificial Sequence
  Description of Artificial Sequence: Synthetic peptide
  Seed: TAMASASPSVM (MAGC3_HUMAN)
TPMASASPSVM

SEQ ID NO: 102021 - protein, 9 aa, Artificial Sequence
  Description of Artificial Sequence: Synthetic peptide
  Seed: IIPSAFPSW (MAGC3_HUMAN)
IAPSAFPSV

SEQ ID NO: 102022 - protein, 10 aa, Artificial Sequence
  Description of Artificial Sequence: Synthetic peptide
  Seed: FKLWRTLSGS (MAGC3_HUMAN)
FSLWRTLSGI

SEQ ID NO: 102023 - protein, 10 aa, Artificial Sequence
  Description of Artificial Sequence: Synthetic peptide
  Seed: SDQRMDSLVL (MAGC3_HUMAN)
SVQRMDSLVL

SEQ ID NO: 102024 - protein, 9 aa, Artificial Sequence
  Description of Artificial Sequence: Synthetic peptide
  Seed: HLREVRLFL (MAGC3_HUMAN)
HTREVRLFA

SEQ ID NO: 102025 - protein, 9 aa, Artificial Sequence
  Description of Artificial Sequence: Synthetic peptide
  Seed: FEDTLDLTY (MAGC3_HUMAN)
FPDTLDLTL

SEQ ID NO: 102026 - protein, 11 aa, Artificial Sequence
  Description of Artificial Sequence: Synthetic peptide
  Seed: IIDTTDDATAM (MAGC3_HUMAN)
IWDTTDDATAF

SEQ ID NO: 102027 - protein, 10 aa, Artificial Sequence
  Description of Artificial Sequence: Synthetic peptide
  Seed: KVAELVQFLL (MAGC3_HUMAN)
KLAELVQFLV

SEQ ID NO: 102028 - protein, 9 aa, Artificial Sequence
  Description of Artificial Sequence: Synthetic peptide
  Seed: MIFGKAHEF (MAGC3_HUMAN)
MQFGKAHEF

SEQ ID NO: 102029 - protein, 9 aa, Artificial Sequence
  Description of Artificial Sequence: Synthetic peptide
  Seed: MPAAGMPPL (MAGC3_HUMAN)
MSAAGMPPL

SEQ ID NO: 102030 - protein, 9 aa, Artificial Sequence
  Description of Artificial Sequence: Synthetic peptide
  Seed: QRMDSLVLC (MAGC3_HUMAN)
QRMDSLVLV

SEQ ID NO: 102031 - protein, 9 aa, Artificial Sequence
  Description of Artificial Sequence: Synthetic peptide
  Seed: DVLSRLALW (MAGC3_HUMAN)
DVLSRLALY

SEQ ID NO: 102032 - protein, 9 aa, Artificial Sequence
  Description of Artificial Sequence: Synthetic peptide
  Seed: QTKEPVTKA (MAGC3_HUMAN)
QSKEPVTKK

SEQ ID NO: 102033 - protein, 10 aa, Artificial Sequence
  Description of Artificial Sequence: Synthetic peptide
  Seed: KKYKDYFPMI (MAGC3_HUMAN)
KNYKDYFPMW

SEQ ID NO: 102034 - protein, 9 aa, Artificial Sequence
  Description of Artificial Sequence: Synthetic peptide
  Seed: RGTGYTLSL (MAGC3_HUMAN)
RFTGYTLSY

SEQ ID NO: 102035 - protein, 10 aa, Artificial Sequence
  Description of Artificial Sequence: Synthetic peptide
  Seed: INTYTGYFPM (MAGC3_HUMAN)
ITTYTGYFPY

SEQ ID NO: 102036 - protein, 9 aa, Artificial Sequence
  Description of Artificial Sequence: Synthetic peptide
  Seed: MEDRAQAII (MAGC3_HUMAN)
MGDRAQAIV

SEQ ID NO: 102037 - protein, 9 aa, Artificial Sequence
  Description of Artificial Sequence: Synthetic peptide
  Seed: MPAAGMPPL (MAGC3_HUMAN)
MYAAGMPPW

SEQ ID NO: 102038 - protein, 10 aa, Artificial Sequence
  Description of Artificial Sequence: Synthetic peptide
  Seed: YSAFHLGHLR (MAGC3_HUMAN)
YLAFHLGHLR

SEQ ID NO: 102039 - protein, 10 aa, Artificial Sequence
  Description of Artificial Sequence: Synthetic peptide
  Seed: SKLSSIIPSA (MAGC3_HUMAN)
SLLSSIIPSM

SEQ ID NO: 102040 - protein, 10 aa, Artificial Sequence
  Description of Artificial Sequence: Synthetic peptide
  Seed: TGYFPMIFRK (MAGC3_HUMAN)
TTYFPMIFRI

SEQ ID NO: 102041 - protein, 9 aa, Artificial Sequence
  Description of Artificial Sequence: Synthetic peptide
  Seed: AELVQFLLL (MAGC3_HUMAN)
AELVQFLLA

SEQ ID NO: 102042 - protein, 9 aa, Artificial Sequence
  Description of Artificial Sequence: Synthetic peptide
  Seed: KAHEFIELI (MAGC3_HUMAN)
KNHEFIELW

SEQ ID NO: 102043 - protein, 10 aa, Artificial Sequence
  Description of Artificial Sequence: Synthetic peptide
  Seed: TCATYALSPV (MAGC3_HUMAN)
TTATYALSPA

SEQ ID NO: 102044 - protein, 9 aa, Artificial Sequence
  Description of Artificial Sequence: Synthetic peptide
  Seed: KEPVTKAEM (MAGC3_HUMAN)
KEPVTKAEL

SEQ ID NO: 102045 - protein, 9 aa, Artificial Sequence
  Description of Artificial Sequence: Synthetic peptide
  Seed: LSDEQGMPQ (MAGC3_HUMAN)
LCDEQGMPI

SEQ ID NO: 102046 - protein, 9 aa, Artificial Sequence
  Description of Artificial Sequence: Synthetic peptide
  Seed: VLCPTYFKL (MAGC3_HUMAN)
VSCPTYFKL

SEQ ID NO: 102047 - protein, 10 aa, Artificial Sequence
  Description of Artificial Sequence: Synthetic peptide
  Seed: AMASASPSVM (MAGC3_HUMAN)
AQASASPSVF

SEQ ID NO: 102048 - protein, 10 aa, Artificial Sequence
  Description of Artificial Sequence: Synthetic peptide
  Seed: AMASASPSVM (MAGC3_HUMAN)
AMASASPSVF

SEQ ID NO: 102049 - protein, 9 aa, Artificial Sequence
  Description of Artificial Sequence: Synthetic peptide
  Seed: IIPSAFPSW (MAGC3_HUMAN)
INPSAFPSL

SEQ ID NO: 102050 - protein, 10 aa, Artificial Sequence
  Description of Artificial Sequence: Synthetic peptide
  Seed: IKKYKDYFPM (MAGC3_HUMAN)
IFKYKDYFPF

SEQ ID NO: 102051 - protein, 9 aa, Artificial Sequence
  Description of Artificial Sequence: Synthetic peptide
  Seed: AGFADVLSR (MAGC3_HUMAN)
ASFADVLSL

SEQ ID NO: 102052 - protein, 9 aa, Artificial Sequence
  Description of Artificial Sequence: Synthetic peptide
  Seed: KAHEFIELI (MAGC3_HUMAN)
KLHEFIELM

SEQ ID NO: 102053 - protein, 9 aa, Artificial Sequence
  Description of Artificial Sequence: Synthetic peptide
  Seed: TAMASASPS (MAGC3_HUMAN)
TPMASASPF

SEQ ID NO: 102054 - protein, 10 aa, Artificial Sequence
  Description of Artificial Sequence: Synthetic peptide
  Seed: TGYFPMIFRK (MAGC3_HUMAN)
TQYFPMIFRK

SEQ ID NO: 102055 - protein, 10 aa, Artificial Sequence
  Description of Artificial Sequence: Synthetic peptide
  Seed: TTDDATAMAS (MAGC3_HUMAN)
TADDATAMAV

SEQ ID NO: 102056 - protein, 9 aa, Artificial Sequence
  Description of Artificial Sequence: Synthetic peptide
  Seed: GMPKNCLLI (MAGC3_HUMAN)
GMPKNCLLV

SEQ ID NO: 102057 - protein, 9 aa, Artificial Sequence
  Description of Artificial Sequence: Synthetic peptide
  Seed: AEMQMNVIN (MAGC3_HUMAN)
AEMQMNVIV

SEQ ID NO: 102058 - protein, 10 aa, Artificial Sequence
  Description of Artificial Sequence: Synthetic peptide
  Seed: YFPMIFGKAH (MAGC3_HUMAN)
YYPMIFGKAV

SEQ ID NO: 102059 - protein, 8 aa, Artificial Sequence
  Description of Artificial Sequence: Synthetic peptide
  Seed: SSIIPSAF (MAGC3_HUMAN)
SAIIPSAL

SEQ ID NO: 102060 - protein, 8 aa, Artificial Sequence
  Description of Artificial Sequence: Synthetic peptide
  Seed: SGSPGLQL (MAGC3_HUMAN)
SSSPGLQL

SEQ ID NO: 102061 - protein, 9 aa, Artificial Sequence
  Description of Artificial Sequence: Synthetic peptide
  Seed: WRRGTGYTL (MAGC3_HUMAN)
WQRGTGYTM

SEQ ID NO: 102062 - protein, 9 aa, Artificial Sequence
  Description of Artificial Sequence: Synthetic peptide
  Seed: MQMNVINTY (MAGC3_HUMAN)
MPMNVINTA

SEQ ID NO: 102063 - protein, 9 aa, Artificial Sequence
  Description of Artificial Sequence: Synthetic peptide
  Seed: YFFEDTLDL (MAGC3_HUMAN)
YMFEDTLDI

SEQ ID NO: 102064 - protein, 8 aa, Artificial Sequence
  Description of Artificial Sequence: Synthetic peptide
  Seed: TTDDATAM (MAGC3_HUMAN)
TGDDATAI

SEQ ID NO: 102065 - protein, 9 aa, Artificial Sequence
  Description of Artificial Sequence: Synthetic peptide
  Seed: VAELVQFLL (MAGC3_HUMAN)
VTELVQFLF

SEQ ID NO: 102066 - protein, 9 aa, Artificial Sequence
  Description of Artificial Sequence: Synthetic peptide
  Seed: WESEGPEAF (MAGC3_HUMAN)
WSSEGPEAY

SEQ ID NO: 102067 - protein, 9 aa, Artificial Sequence
  Description of Artificial Sequence: Synthetic peptide
  Seed: YFFEDTLDL (MAGC3_HUMAN)
YPFEDTLDI

SEQ ID NO: 102068 - protein, 10 aa, Artificial Sequence
  Description of Artificial Sequence: Synthetic peptide
  Seed: SKLSSIIPSA (MAGC3_HUMAN)
SRLSSIIPSA

SEQ ID NO: 102069 - protein, 9 aa, Artificial Sequence
  Description of Artificial Sequence: Synthetic peptide
  Seed: KFSLRRAVS (MAGC3_HUMAN)
KMSLRRAVK

SEQ ID NO: 102070 - protein, 9 aa, Artificial Sequence
  Description of Artificial Sequence: Synthetic peptide
  Seed: HFYVFVNTL (MAGC3_HUMAN)
HAYVFVNTF

SEQ ID NO: 102071 - protein, 8 aa, Artificial Sequence
  Description of Artificial Sequence: Synthetic peptide
  Seed: KAHEFIEL (MAGC3_HUMAN)
KQHEFIEV

SEQ ID NO: 102072 - protein, 9 aa, Artificial Sequence
  Description of Artificial Sequence: Synthetic peptide
  Seed: NAIGPWSAL (MAGC3_HUMAN)
NYIGPWSAM

SEQ ID NO: 102073 - protein, 10 aa, Artificial Sequence
  Description of Artificial Sequence: Synthetic peptide
  Seed: ALDEKVAELV (MAGC3_HUMAN)
ASDEKVAELI

SEQ ID NO: 102074 - protein, 9 aa, Artificial Sequence
  Description of Artificial Sequence: Synthetic peptide
  Seed: KYKDYFPMI (MAGC3_HUMAN)
KSKDYFPMT

SEQ ID NO: 102075 - protein, 10 aa, Artificial Sequence
  Description of Artificial Sequence: Synthetic peptide
  Seed: MIFRKAREFI (MAGC3_HUMAN)
MRFRKAREFK

SEQ ID NO: 102076 - protein, 11 aa, Artificial Sequence
  Description of Artificial Sequence: Synthetic peptide
  Seed: ALWESEGPEAF (MAGC3_HUMAN)
ATWESEGPEAW

SEQ ID NO: 102077 - protein, 9 aa, Artificial Sequence
  Description of Artificial Sequence: Synthetic peptide
  Seed: LIDDQGMPK (MAGC3_HUMAN)
LMDDQGMPL

SEQ ID NO: 102078 - protein, 9 aa, Artificial Sequence
  Description of Artificial Sequence: Synthetic peptide
  Seed: ISPQGPPQS (MAGC3_HUMAN)
IFPQGPPQM

SEQ ID NO: 102079 - protein, 9 aa, Artificial Sequence
  Description of Artificial Sequence: Synthetic peptide
  Seed: KLSSIIPSA (MAGC3_HUMAN)
KISSIIPSK

SEQ ID NO: 102080 - protein, 10 aa, Artificial Sequence
  Description of Artificial Sequence: Synthetic peptide
  Seed: LIFGIALTDM (MAGC3_HUMAN)
LMFGIALTDI

SEQ ID NO: 102081 - protein, 9 aa, Artificial Sequence
  Description of Artificial Sequence: Synthetic peptide
  Seed: YALSPVVLP (MAGC3_HUMAN)
YALSPVVLV

SEQ ID NO: 102082 - protein, 10 aa, Artificial Sequence
  Description of Artificial Sequence: Synthetic peptide
  Seed: MNVINTYTGY (MAGC3_HUMAN)
MVVINTYTGR

SEQ ID NO: 102083 - protein, 11 aa, Artificial Sequence
  Description of Artificial Sequence: Synthetic peptide
  Seed: SSSEEEDTATW (MAGC3_HUMAN)
SLSEEEDTATL

SEQ ID NO: 102084 - protein, 11 aa, Artificial Sequence
  Description of Artificial Sequence: Synthetic peptide
  Seed: ISLTEVDPDHF (MAGC3_HUMAN)
ITLTEVDPDHF

SEQ ID NO: 102085 - protein, 9 aa, Artificial Sequence
  Description of Artificial Sequence: Synthetic peptide
  Seed: SASPSVMST (MAGC3_HUMAN)
SVSPSVMSF

SEQ ID NO: 102086 - protein, 9 aa, Artificial Sequence
  Description of Artificial Sequence: Synthetic peptide
  Seed: KAHEFIELI (MAGC3_HUMAN)
KTHEFIELF

SEQ ID NO: 102087 - protein, 9 aa, Artificial Sequence
  Description of Artificial Sequence: Synthetic peptide
  Seed: FLSKLSSII (MAGC3_HUMAN)
FQSKLSSIM

SEQ ID NO: 102088 - protein, 10 aa, Artificial Sequence
  Description of Artificial Sequence: Synthetic peptide
  Seed: REVLEFLSKL (MAGC3_HUMAN)
RMVLEFLSKW

SEQ ID NO: 102089 - protein, 10 aa, Artificial Sequence
  Description of Artificial Sequence: Synthetic peptide
  Seed: LDLANPQGLA (MAGC3_HUMAN)
LSLANPQGLV

SEQ ID NO: 102090 - protein, 8 aa, Artificial Sequence
  Description of Artificial Sequence: Synthetic peptide
  Seed: LTYEGSLI (MAGC3_HUMAN)
LQYEGSLL

SEQ ID NO: 102091 - protein, 10 aa, Artificial Sequence
  Description of Artificial Sequence: Synthetic peptide
  Seed: SLIDDQGMPK (MAGC3_HUMAN)
SSIDDQGMPY

SEQ ID NO: 102092 - protein, 9 aa, Artificial Sequence
  Description of Artificial Sequence: Synthetic peptide
  Seed: KVAELVQFL (MAGC3_HUMAN)
KAAELVQFY

SEQ ID NO: 102093 - protein, 10 aa, Artificial Sequence
  Description of Artificial Sequence: Synthetic peptide
  Seed: REVLEFLSKL (MAGC3_HUMAN)
RMVLEFLSKF

SEQ ID NO: 102094 - protein, 9 aa, Artificial Sequence
  Description of Artificial Sequence: Synthetic peptide
  Seed: EIPPQGPPK (MAGC3_HUMAN)
EIPPQGPPR

SEQ ID NO: 102095 - protein, 11 aa, Artificial Sequence
  Description of Artificial Sequence: Synthetic peptide
  Seed: TTDDATAMASA (MAGC3_HUMAN)
TVDDATAMASM

SEQ ID NO: 102096 - protein, 9 aa, Artificial Sequence
  Description of Artificial Sequence: Synthetic peptide
  Seed: VIWEVLNAI (MAGC3_HUMAN)
VVWEVLNAR

SEQ ID NO: 102097 - protein, 9 aa, Artificial Sequence
  Description of Artificial Sequence: Synthetic peptide
  Seed: HFYVFVNTL (MAGC3_HUMAN)
HMYVFVNTI

SEQ ID NO: 102098 - protein, 9 aa, Artificial Sequence
  Description of Artificial Sequence: Synthetic peptide
  Seed: LSDEQGMPQ (MAGC3_HUMAN)
LFDEQGMPV

SEQ ID NO: 102099 - protein, 9 aa, Artificial Sequence
  Description of Artificial Sequence: Synthetic peptide
  Seed: FHLGHLREV (MAGC3_HUMAN)
FHLGHLREY

SEQ ID NO: 102100 - protein, 11 aa, Artificial Sequence
  Description of Artificial Sequence: Synthetic peptide
  Seed: MPAAGMPPLPQ (MAGC3_HUMAN)
MPAAGMPPLPV

SEQ ID NO: 102101 - protein, 9 aa, Artificial Sequence
  Description of Artificial Sequence: Synthetic peptide
  Seed: FKLWRTLSG (MAGC3_HUMAN)
FMLWRTLSW

SEQ ID NO: 102102 - protein, 10 aa, Artificial Sequence
  Description of Artificial Sequence: Synthetic peptide
  Seed: EIPPQGPPKI (MAGC3_HUMAN)
ELPPQGPPKL

SEQ ID NO: 102103 - protein, 9 aa, Artificial Sequence
  Description of Artificial Sequence: Synthetic peptide
  Seed: MLLPCHWVL (MAGC3_HUMAN)
MTLPCHWVW

SEQ ID NO: 102104 - protein, 9 aa, Artificial Sequence
  Description of Artificial Sequence: Synthetic peptide
  Seed: HLREVRLFL (MAGC3_HUMAN)
HGREVRLFV

SEQ ID NO: 102105 - protein, 9 aa, Artificial Sequence
  Description of Artificial Sequence: Synthetic peptide
  Seed: KLSSIIPSA (MAGC3_HUMAN)
KISSIIPSV

SEQ ID NO: 102106 - protein, 9 aa, Artificial Sequence
  Description of Artificial Sequence: Synthetic peptide
  Seed: NVINTYTGY (MAGC3_HUMAN)
NAINTYTGF

SEQ ID NO: 102107 - protein, 9 aa, Artificial Sequence
  Description of Artificial Sequence: Synthetic peptide
  Seed: NTYTGYFPM (MAGC3_HUMAN)
NYYTGYFPM

SEQ ID NO: 102108 - protein, 9 aa, Artificial Sequence
  Description of Artificial Sequence: Synthetic peptide
  Seed: MASASPSVM (MAGC3_HUMAN)
MQSASPSVV

SEQ ID NO: 102109 - protein, 10 aa, Artificial Sequence
  Description of Artificial Sequence: Synthetic peptide
  Seed: SIIPSAFPSW (MAGC3_HUMAN)
SVIPSAFPSY

SEQ ID NO: 102110 - protein, 10 aa, Artificial Sequence
  Description of Artificial Sequence: Synthetic peptide
  Seed: IIDTTDDATA (MAGC3_HUMAN)
ITDTTDDATM

SEQ ID NO: 102111 - protein, 10 aa, Artificial Sequence
  Description of Artificial Sequence: Synthetic peptide
  Seed: FPSWYMDALK (MAGC3_HUMAN)
FPSWYMDALL

SEQ ID NO: 102112 - protein, 10 aa, Artificial Sequence
  Description of Artificial Sequence: Synthetic peptide
  Seed: KVDKLVQFLL (MAGC3_HUMAN)
KLDKLVQFLL

SEQ ID NO: 102113 - protein, 10 aa, Artificial Sequence
  Description of Artificial Sequence: Synthetic peptide
  Seed: FKLWRTLSGS (MAGC3_HUMAN)
FDLWRTLSGI

SEQ ID NO: 102114 - protein, 9 aa, Artificial Sequence
  Description of Artificial Sequence: Synthetic peptide
  Seed: FLSKLSSII (MAGC3_HUMAN)
FTSKLSSIY

SEQ ID NO: 102115 - protein, 10 aa, Artificial Sequence
  Description of Artificial Sequence: Synthetic peptide
  Seed: VTKAEMLTTV (MAGC3_HUMAN)
VMKAEMLTTI

SEQ ID NO: 102116 - protein, 9 aa, Artificial Sequence
  Description of Artificial Sequence: Synthetic peptide
  Seed: HLREVRLFL (MAGC3_HUMAN)
HMREVRLFF

SEQ ID NO: 102117 - protein, 10 aa, Artificial Sequence
  Description of Artificial Sequence: Synthetic peptide
  Seed: FFEDTLDLTY (MAGC3_HUMAN)
FVEDTLDLTF

SEQ ID NO: 102118 - protein, 10 aa, Artificial Sequence
  Description of Artificial Sequence: Synthetic peptide
  Seed: IIDTTDDATA (MAGC3_HUMAN)
IADTTDDATI

SEQ ID NO: 102119 - protein, 10 aa, Artificial Sequence
  Description of Artificial Sequence: Synthetic peptide
  Seed: KDYFPMIFGK (MAGC3_HUMAN)
KYYFPMIFGR

SEQ ID NO: 102120 - protein, 9 aa, Artificial Sequence
  Description of Artificial Sequence: Synthetic peptide
  Seed: LIDDQGMPK (MAGC3_HUMAN)
LCDDQGMPF

SEQ ID NO: 102121 - protein, 10 aa, Artificial Sequence
  Description of Artificial Sequence: Synthetic peptide
  Seed: ILILSVIFIK (MAGC3_HUMAN)
IRILSVIFIR

SEQ ID NO: 102122 - protein, 10 aa, Artificial Sequence
  Description of Artificial Sequence: Synthetic peptide
  Seed: LPCHWVLDAT (MAGC3_HUMAN)
LPCHWVLDAV

SEQ ID NO: 102123 - protein, 9 aa, Artificial Sequence
  Description of Artificial Sequence: Synthetic peptide
  Seed: SLPESEPLF (MAGC3_HUMAN)
SRPESEPLL

SEQ ID NO: 102124 - protein, 10 aa, Artificial Sequence
  Description of Artificial Sequence: Synthetic peptide
  Seed: FFEDTLDLTY (MAGC3_HUMAN)
FIEDTLDLTF

SEQ ID NO: 102125 - protein, 9 aa, Artificial Sequence
  Description of Artificial Sequence: Synthetic peptide
  Seed: IQRPAREVL (MAGC3_HUMAN)
IERPAREVL

SEQ ID NO: 102126 - protein, 10 aa, Artificial Sequence
  Description of Artificial Sequence: Synthetic peptide
  Seed: SPLDSCSSPL (MAGC3_HUMAN)
SPLDSCSSPM

SEQ ID NO: 102127 - protein, 10 aa, Artificial Sequence
  Description of Artificial Sequence: Synthetic peptide
  Seed: ELVQFLLLKY (MAGC3_HUMAN)
EIVQFLLLKK

SEQ ID NO: 102128 - protein, 9 aa, Artificial Sequence
  Description of Artificial Sequence: Synthetic peptide
  Seed: LILSVIFIK (MAGC3_HUMAN)
LILSVIFIR

SEQ ID NO: 102129 - protein, 10 aa, Artificial Sequence
  Description of Artificial Sequence: Synthetic peptide
  Seed: INTYTGYFPM (MAGC3_HUMAN)
ISTYTGYFPY

SEQ ID NO: 102130 - protein, 9 aa, Artificial Sequence
  Description of Artificial Sequence: Synthetic peptide
  Seed: AIIDTTDDA (MAGC3_HUMAN)
ATIDTTDDV

SEQ ID NO: 102131 - protein, 11 aa, Artificial Sequence
  Description of Artificial Sequence: Synthetic peptide
  Seed: GSQPEGKFSLR (MAGC3_HUMAN)
GMQPEGKFSLR

SEQ ID NO: 102132 - protein, 9 aa, Artificial Sequence
  Description of Artificial Sequence: Synthetic peptide
  Seed: VIWEVLNAI (MAGC3_HUMAN)
VMWEVLNAI

SEQ ID NO: 102133 - protein, 9 aa, Artificial Sequence
  Description of Artificial Sequence: Synthetic peptide
  Seed: NTYTGYFPM (MAGC3_HUMAN)
NNYTGYFPF

SEQ ID NO: 102134 - protein, 9 aa, Artificial Sequence
  Description of Artificial Sequence: Synthetic peptide
  Seed: MEDRAQAII (MAGC3_HUMAN)
MSDRAQAIV

SEQ ID NO: 102135 - protein, 10 aa, Artificial Sequence
  Description of Artificial Sequence: Synthetic peptide
  Seed: CVPEEVIWEV (MAGC3_HUMAN)
CMPEEVIWEV

SEQ ID NO: 102136 - protein, 10 aa, Artificial Sequence
  Description of Artificial Sequence: Synthetic peptide
  Seed: AEMLTTVIKK (MAGC3_HUMAN)
ARMLTTVIKK

SEQ ID NO: 102137 - protein, 10 aa, Artificial Sequence
  Description of Artificial Sequence: Synthetic peptide
  Seed: AEMLTTVIKK (MAGC3_HUMAN)
AQMLTTVIKK

SEQ ID NO: 102138 - protein, 9 aa, Artificial Sequence
  Description of Artificial Sequence: Synthetic peptide
  Seed: KAHEFIELI (MAGC3_HUMAN)
KVHEFIELA

SEQ ID NO: 102139 - protein, 10 aa, Artificial Sequence
  Description of Artificial Sequence: Synthetic peptide
  Seed: SDQRMDSLVL (MAGC3_HUMAN)
SHQRMDSLVM

SEQ ID NO: 102140 - protein, 9 aa, Artificial Sequence
  Description of Artificial Sequence: Synthetic peptide
  Seed: FSDGSLGQW (MAGC3_HUMAN)
FSDGSLGQV

SEQ ID NO: 102141 - protein, 10 aa, Artificial Sequence
  Description of Artificial Sequence: Synthetic peptide
  Seed: ILFGISLTEV (MAGC3_HUMAN)
IQFGISLTEV

SEQ ID NO: 102142 - protein, 10 aa, Artificial Sequence
  Description of Artificial Sequence: Synthetic peptide
  Seed: LNAIGPWSAL (MAGC3_HUMAN)
LSAIGPWSAY

SEQ ID NO: 102143 - protein, 10 aa, Artificial Sequence
  Description of Artificial Sequence: Synthetic peptide
  Seed: SAFHLGHLRE (MAGC3_HUMAN)
SYFHLGHLRR

SEQ ID NO: 102144 - protein, 9 aa, Artificial Sequence
  Description of Artificial Sequence: Synthetic peptide
  Seed: IIPSAFPSW (MAGC3_HUMAN)
ISPSAFPSY

SEQ ID NO: 102145 - protein, 9 aa, Artificial Sequence
  Description of Artificial Sequence: Synthetic peptide
  Seed: ALSPVVLPP (MAGC3_HUMAN)
AMSPVVLPA

SEQ ID NO: 102146 - protein, 10 aa, Artificial Sequence
  Description of Artificial Sequence: Synthetic peptide
  Seed: GSQPEGKFSL (MAGC3_HUMAN)
GTQPEGKFSW

SEQ ID NO: 102147 - protein, 9 aa, Artificial Sequence
  Description of Artificial Sequence: Synthetic peptide
  Seed: SPSVMSTNF (MAGC3_HUMAN)
SLSVMSTNF

SEQ ID NO: 102148 - protein, 9 aa, Artificial Sequence
  Description of Artificial Sequence: Synthetic peptide
  Seed: WYMDALKDM (MAGC3_HUMAN)
WYMDALKDL

SEQ ID NO: 102149 - protein, 9 aa, Artificial Sequence
  Description of Artificial Sequence: Synthetic peptide
  Seed: MDPDNHSYF (MAGC3_HUMAN)
MTPDNHSYY

SEQ ID NO: 102150 - protein, 9 aa, Artificial Sequence
  Description of Artificial Sequence: Synthetic peptide
  Seed: FVNTLDLTC (MAGC3_HUMAN)
FSNTLDLTV

SEQ ID NO: 102151 - protein, 9 aa, Artificial Sequence
  Description of Artificial Sequence: Synthetic peptide
  Seed: WRRGTGYTL (MAGC3_HUMAN)
WRRGTGYTF

SEQ ID NO: 102152 - protein, 9 aa, Artificial Sequence
  Description of Artificial Sequence: Synthetic peptide
  Seed: VLPPQPQPR (MAGC3_HUMAN)
VVPPQPQPY

SEQ ID NO: 102153 - protein, 9 aa, Artificial Sequence
  Description of Artificial Sequence: Synthetic peptide
  Seed: KVAELVQFL (MAGC3_HUMAN)
KFAELVQFY

SEQ ID NO: 102154 - protein, 10 aa, Artificial Sequence
  Description of Artificial Sequence: Synthetic peptide
  Seed: IELIFGIALT (MAGC3_HUMAN)
IFLIFGIALL

SEQ ID NO: 102155 - protein, 9 aa, Artificial Sequence
  Description of Artificial Sequence: Synthetic peptide
  Seed: DYFPMIFGK (MAGC3_HUMAN)
DIFPMIFGR

SEQ ID NO: 102156 - protein, 10 aa, Artificial Sequence
  Description of Artificial Sequence: Synthetic peptide
  Seed: SIIPSAFPSW (MAGC3_HUMAN)
SCIPSAFPSW

SEQ ID NO: 102157 - protein, 9 aa, Artificial Sequence
  Description of Artificial Sequence: Synthetic peptide
  Seed: FHLGHLREV (MAGC3_HUMAN)
FVLGHLREV

SEQ ID NO: 102158 - protein, 10 aa, Artificial Sequence
  Description of Artificial Sequence: Synthetic peptide
  Seed: MLTTVIKKYK (MAGC3_HUMAN)
MMTTVIKKYK

SEQ ID NO: 102159 - protein, 9 aa, Artificial Sequence
  Description of Artificial Sequence: Synthetic peptide
  Seed: MASASPSVM (MAGC3_HUMAN)
MVSASPSVL

SEQ ID NO: 102160 - protein, 9 aa, Artificial Sequence
  Description of Artificial Sequence: Synthetic peptide
  Seed: YTGYFPMIF (MAGC3_HUMAN)
YAGYFPMIV

SEQ ID NO: 102161 - protein, 9 aa, Artificial Sequence
  Description of Artificial Sequence: Synthetic peptide
  Seed: YFFEDTLDL (MAGC3_HUMAN)
YKFEDTLDF

SEQ ID NO: 102162 - protein, 9 aa, Artificial Sequence
  Description of Artificial Sequence: Synthetic peptide
  Seed: ATYALSPVV (MAGC3_HUMAN)
ASYALSPVF

SEQ ID NO: 102163 - protein, 11 aa, Artificial Sequence
  Description of Artificial Sequence: Synthetic peptide
  Seed: KVAELVQFLLL (MAGC3_HUMAN)
KMAELVQFLLN

SEQ ID NO: 102164 - protein, 10 aa, Artificial Sequence
  Description of Artificial Sequence: Synthetic peptide
  Seed: LVLCPTYFKL (MAGC3_HUMAN)
LLLCPTYFKV

SEQ ID NO: 102165 - protein, 11 aa, Artificial Sequence
  Description of Artificial Sequence: Synthetic peptide
  Seed: SPQGPPQSPPQ (MAGC3_HUMAN)
SPQGPPQSPPF

SEQ ID NO: 102166 - protein, 9 aa, Artificial Sequence
  Description of Artificial Sequence: Synthetic peptide
  Seed: CATYALSPV (MAGC3_HUMAN)
CQTYALSPL

SEQ ID NO: 102167 - protein, 10 aa, Artificial Sequence
  Description of Artificial Sequence: Synthetic peptide
  Seed: TGYFPMIFRK (MAGC3_HUMAN)
TAYFPMIFRA

SEQ ID NO: 102168 - protein, 9 aa, Artificial Sequence
  Description of Artificial Sequence: Synthetic peptide
  Seed: FEDTLDLTY (MAGC3_HUMAN)
FEDTLDLTI

SEQ ID NO: 102169 - protein, 9 aa, Artificial Sequence
  Description of Artificial Sequence: Synthetic peptide
  Seed: KLVQFLLLK (MAGC3_HUMAN)
KSVQFLLLV

SEQ ID NO: 102170 - protein, 9 aa, Artificial Sequence
  Description of Artificial Sequence: Synthetic peptide
  Seed: KLSSIIPSA (MAGC3_HUMAN)
KASSIIPSK

SEQ ID NO: 102171 - protein, 10 aa, Artificial Sequence
  Description of Artificial Sequence: Synthetic peptide
  Seed: INTYTGYFPM (MAGC3_HUMAN)
IWTYTGYFPY

SEQ ID NO: 102172 - protein, 9 aa, Artificial Sequence
  Description of Artificial Sequence: Synthetic peptide
  Seed: KAHEFIELI (MAGC3_HUMAN)
KAHEFIELH

SEQ ID NO: 102173 - protein, 11 aa, Artificial Sequence
  Description of Artificial Sequence: Synthetic peptide
  Seed: TDMDPDNHSYF (MAGC3_HUMAN)
TEMDPDNHSYM

SEQ ID NO: 102174 - protein, 10 aa, Artificial Sequence
  Description of Artificial Sequence: Synthetic peptide
  Seed: SKLSSIIPSA (MAGC3_HUMAN)
STLSSIIPSI

SEQ ID NO: 102175 - protein, 9 aa, Artificial Sequence
  Description of Artificial Sequence: Synthetic peptide
  Seed: MQMNVINTY (MAGC3_HUMAN)
MEMNVINTY

SEQ ID NO: 102176 - protein, 9 aa, Artificial Sequence
  Description of Artificial Sequence: Synthetic peptide
  Seed: SQPEGKFSL (MAGC3_HUMAN)
SMPEGKFSM

SEQ ID NO: 102177 - protein, 10 aa, Artificial Sequence
  Description of Artificial Sequence: Synthetic peptide
  Seed: YALDEKVAEL (MAGC3_HUMAN)
YILDEKVAEL

SEQ ID NO: 102178 - protein, 10 aa, Artificial Sequence
  Description of Artificial Sequence: Synthetic peptide
  Seed: ALWESEGPEA (MAGC3_HUMAN)
ALWESEGPEV

SEQ ID NO: 102179 - protein, 10 aa, Artificial Sequence
  Description of Artificial Sequence: Synthetic peptide
  Seed: ATYALSPVVL (MAGC3_HUMAN)
AGYALSPVVF

SEQ ID NO: 102180 - protein, 9 aa, Artificial Sequence
  Description of Artificial Sequence: Synthetic peptide
  Seed: TLDEKVDKL (MAGC3_HUMAN)
TFDEKVDKC

SEQ ID NO: 102181 - protein, 9 aa, Artificial Sequence
  Description of Artificial Sequence: Synthetic peptide
  Seed: LSSIIPSAF (MAGC3_HUMAN)
LKSIIPSAM

SEQ ID NO: 102182 - protein, 10 aa, Artificial Sequence
  Description of Artificial Sequence: Synthetic peptide
  Seed: SKLSSIIPSA (MAGC3_HUMAN)
SILSSIIPSI

SEQ ID NO: 102183 - protein, 10 aa, Artificial Sequence
  Description of Artificial Sequence: Synthetic peptide
  Seed: SIIPSAFPSW (MAGC3_HUMAN)
SYIPSAFPSF

SEQ ID NO: 102184 - protein, 10 aa, Artificial Sequence
  Description of Artificial Sequence: Synthetic peptide
  Seed: SDQRMDSLVL (MAGC3_HUMAN)
SKQRMDSLVM

SEQ ID NO: 102185 - protein, 10 aa, Artificial Sequence
  Description of Artificial Sequence: Synthetic peptide
  Seed: HLREVRLFLR (MAGC3_HUMAN)
HYREVRLFLR

SEQ ID NO: 102186 - protein, 9 aa, Artificial Sequence
  Description of Artificial Sequence: Synthetic peptide
  Seed: LKYQTKEPV (MAGC3_HUMAN)
LKYQTKEPL

SEQ ID NO: 102187 - protein, 9 aa, Artificial Sequence
  Description of Artificial Sequence: Synthetic peptide
  Seed: MLLPCHWVL (MAGC3_HUMAN)
MVLPCHWVL

SEQ ID NO: 102188 - protein, 9 aa, Artificial Sequence
  Description of Artificial Sequence: Synthetic peptide
  Seed: IQRPAREVL (MAGC3_HUMAN)
IPRPAREVF

SEQ ID NO: 102189 - protein, 10 aa, Artificial Sequence
  Description of Artificial Sequence: Synthetic peptide
  Seed: KLSSIIPSAF (MAGC3_HUMAN)
KHSSIIPSAF

SEQ ID NO: 102190 - protein, 11 aa, Artificial Sequence
  Description of Artificial Sequence: Synthetic peptide
  Seed: KYKDYFPMIFG (MAGC3_HUMAN)
KYKDYFPMIFW

SEQ ID NO: 102191 - protein, 9 aa, Artificial Sequence
  Description of Artificial Sequence: Synthetic peptide
  Seed: WRRGTGYTL (MAGC3_HUMAN)
WIRGTGYTF

SEQ ID NO: 102192 - protein, 8 aa, Artificial Sequence
  Description of Artificial Sequence: Synthetic peptide
  Seed: IFGKAHEF (MAGC3_HUMAN)
IAGKAHEM

SEQ ID NO: 102193 - protein, 10 aa, Artificial Sequence
  Description of Artificial Sequence: Synthetic peptide
  Seed: NTYTGYFPMI (MAGC3_HUMAN)
NSYTGYFPMF

SEQ ID NO: 102194 - protein, 9 aa, Artificial Sequence
  Description of Artificial Sequence: Synthetic peptide
  Seed: SAEGSVLDL (MAGC3_HUMAN)
SSEGSVLDM

SEQ ID NO: 102195 - protein, 11 aa, Artificial Sequence
  Description of Artificial Sequence: Synthetic peptide
  Seed: YKDYFPMIFGK (MAGC3_HUMAN)
YLDYFPMIFGR

SEQ ID NO: 102196 - protein, 9 aa, Artificial Sequence
  Description of Artificial Sequence: Synthetic peptide
  Seed: FADVLSRLA (MAGC3_HUMAN)
FMDVLSRLI

SEQ ID NO: 102197 - protein, 8 aa, Artificial Sequence
  Description of Artificial Sequence: Synthetic peptide
  Seed: VKNTCATY (MAGC3_HUMAN)
VQNTCATF

SEQ ID NO: 102198 - protein, 10 aa, Artificial Sequence
  Description of Artificial Sequence: Synthetic peptide
  Seed: RLWGEKAGSL (MAGC3_HUMAN)
RLWGEKAGSW

SEQ ID NO: 102199 - protein, 9 aa, Artificial Sequence
  Description of Artificial Sequence: Synthetic peptide
  Seed: TLDEKVDKL (MAGC3_HUMAN)
TWDEKVDKL

SEQ ID NO: 102200 - protein, 9 aa, Artificial Sequence
  Description of Artificial Sequence: Synthetic peptide
  Seed: SPPEIPPQG (MAGC3_HUMAN)
SAPEIPPQI

SEQ ID NO: 102201 - protein, 11 aa, Artificial Sequence
  Description of Artificial Sequence: Synthetic peptide
  Seed: ILFGISLTEVD (MAGC3_HUMAN)
IMFGISLTEVP

SEQ ID NO: 102202 - protein, 9 aa, Artificial Sequence
  Description of Artificial Sequence: Synthetic peptide
  Seed: MEDRAQAII (MAGC3_HUMAN)
MGDRAQAIM

SEQ ID NO: 102203 - protein, 9 aa, Artificial Sequence
  Description of Artificial Sequence: Synthetic peptide
  Seed: QGMPQNRLL (MAGC3_HUMAN)
QTMPQNRLL

SEQ ID NO: 102204 - protein, 10 aa, Artificial Sequence
  Description of Artificial Sequence: Synthetic peptide
  Seed: EKVAELVQFL (MAGC3_HUMAN)
ELVAELVQFL

SEQ ID NO: 102205 - protein, 10 aa, Artificial Sequence
  Description of Artificial Sequence: Synthetic peptide
  Seed: FKLWRTLSGS (MAGC3_HUMAN)
FDLWRTLSGM

SEQ ID NO: 102206 - protein, 9 aa, Artificial Sequence
  Description of Artificial Sequence: Synthetic peptide
  Seed: AGFADVLSR (MAGC3_HUMAN)
AAFADVLSY

SEQ ID NO: 102207 - protein, 11 aa, Artificial Sequence
  Description of Artificial Sequence: Synthetic peptide
  Seed: EVLSAIGPIQR (MAGC3_HUMAN)
EFLSAIGPIQR

SEQ ID NO: 102208 - protein, 9 aa, Artificial Sequence
  Description of Artificial Sequence: Synthetic peptide
  Seed: LVQFLLLKY (MAGC3_HUMAN)
LMQFLLLKY

SEQ ID NO: 102209 - protein, 11 aa, Artificial Sequence
  Description of Artificial Sequence: Synthetic peptide
  Seed: RYALDEKVAEL (MAGC3_HUMAN)
RMALDEKVAEV

SEQ ID NO: 102210 - protein, 10 aa, Artificial Sequence
  Description of Artificial Sequence: Synthetic peptide
  Seed: KVDKLVQFLL (MAGC3_HUMAN)
KTDKLVQFLW

SEQ ID NO: 102211 - protein, 9 aa, Artificial Sequence
  Description of Artificial Sequence: Synthetic peptide
  Seed: KYKDYFPMI (MAGC3_HUMAN)
KFKDYFPMM

SEQ ID NO: 102212 - protein, 9 aa, Artificial Sequence
  Description of Artificial Sequence: Synthetic peptide
  Seed: KEPLTRAEM (MAGC3_HUMAN)
KIPLTRAEY

SEQ ID NO: 102213 - protein, 9 aa, Artificial Sequence
  Description of Artificial Sequence: Synthetic peptide
  Seed: YSAFHLGHL (MAGC3_HUMAN)
YTAFHLGHW

SEQ ID NO: 102214 - protein, 10 aa, Artificial Sequence
  Description of Artificial Sequence: Synthetic peptide
  Seed: REVRLFLRGG (MAGC3_HUMAN)
RRVRLFLRGV

SEQ ID NO: 102215 - protein, 10 aa, Artificial Sequence
  Description of Artificial Sequence: Synthetic peptide
  Seed: SPLDSCSSPL (MAGC3_HUMAN)
SLLDSCSSPL

SEQ ID NO: 102216 - protein, 9 aa, Artificial Sequence
  Description of Artificial Sequence: Synthetic peptide
  Seed: FLSKLSSII (MAGC3_HUMAN)
FISKLSSIY

SEQ ID NO: 102217 - protein, 9 aa, Artificial Sequence
  Description of Artificial Sequence: Synthetic peptide
  Seed: FSDGSLGQW (MAGC3_HUMAN)
FTDGSLGQV

SEQ ID NO: 102218 - protein, 9 aa, Artificial Sequence
  Description of Artificial Sequence: Synthetic peptide
  Seed: ALDEKVAEL (MAGC3_HUMAN)
ASDEKVAEA

SEQ ID NO: 102219 - protein, 11 aa, Artificial Sequence
  Description of Artificial Sequence: Synthetic peptide
  Seed: KVAELVQFLLL (MAGC3_HUMAN)
KLAELVQFLLC

SEQ ID NO: 102220 - protein, 9 aa, Artificial Sequence
  Description of Artificial Sequence: Synthetic peptide
  Seed: SASPSVMST (MAGC3_HUMAN)
SASPSVMSH

SEQ ID NO: 102221 - protein, 9 aa, Artificial Sequence
  Description of Artificial Sequence: Synthetic peptide
  Seed: EVLNAIGPW (MAGC3_HUMAN)
ETLNAIGPF

SEQ ID NO: 102222 - protein, 9 aa, Artificial Sequence
  Description of Artificial Sequence: Synthetic peptide
  Seed: VINTYTGYF (MAGC3_HUMAN)
VYNTYTGYY

SEQ ID NO: 102223 - protein, 9 aa, Artificial Sequence
  Description of Artificial Sequence: Synthetic peptide
  Seed: SLPESEPLF (MAGC3_HUMAN)
SIPESEPLY

SEQ ID NO: 102224 - protein, 10 aa, Artificial Sequence
  Description of Artificial Sequence: Synthetic peptide
  Seed: MLTTVIKKYK (MAGC3_HUMAN)
MATTVIKKYK

SEQ ID NO: 102225 - protein, 9 aa, Artificial Sequence
  Description of Artificial Sequence: Synthetic peptide
  Seed: NTYTGYFPM (MAGC3_HUMAN)
NFYTGYFPY

SEQ ID NO: 102226 - protein, 9 aa, Artificial Sequence
  Description of Artificial Sequence: Synthetic peptide
  Seed: NTYTGYFPM (MAGC3_HUMAN)
NCYTGYFPY

SEQ ID NO: 102227 - protein, 10 aa, Artificial Sequence
  Description of Artificial Sequence: Synthetic peptide
  Seed: SWYMDALKDM (MAGC3_HUMAN)
SHYMDALKDF

SEQ ID NO: 102228 - protein, 10 aa, Artificial Sequence
  Description of Artificial Sequence: Synthetic peptide
  Seed: REVRLFLRGG (MAGC3_HUMAN)
RHVRLFLRGK

SEQ ID NO: 102229 - protein, 10 aa, Artificial Sequence
  Description of Artificial Sequence: Synthetic peptide
  Seed: LLKYQAKEPL (MAGC3_HUMAN)
LPKYQAKEPF

SEQ ID NO: 102230 - protein, 9 aa, Artificial Sequence
  Description of Artificial Sequence: Synthetic peptide
  Seed: WVKNTCATY (MAGC3_HUMAN)
WYKNTCATY

SEQ ID NO: 102231 - protein, 9 aa, Artificial Sequence
  Description of Artificial Sequence: Synthetic peptide
  Seed: YQAKEPLTR (MAGC3_HUMAN)
YGAKEPLTM

SEQ ID NO: 102232 - protein, 10 aa, Artificial Sequence
  Description of Artificial Sequence: Synthetic peptide
  Seed: TGYFPMIFRK (MAGC3_HUMAN)
TTYFPMIFRQ

SEQ ID NO: 102233 - protein, 9 aa, Artificial Sequence
  Description of Artificial Sequence: Synthetic peptide
  Seed: FKLWRTLSG (MAGC3_HUMAN)
FILWRTLSF

SEQ ID NO: 102234 - protein, 10 aa, Artificial Sequence
  Description of Artificial Sequence: Synthetic peptide
  Seed: TCATYALSPV (MAGC3_HUMAN)
TTATYALSPL

SEQ ID NO: 102235 - protein, 9 aa, Artificial Sequence
  Description of Artificial Sequence: Synthetic peptide
  Seed: YKDYFPMIF (MAGC3_HUMAN)
YWDYFPMIV

SEQ ID NO: 102236 - protein, 9 aa, Artificial Sequence
  Description of Artificial Sequence: Synthetic peptide
  Seed: QGMPKNCLL (MAGC3_HUMAN)
QSMPKNCLW

SEQ ID NO: 102237 - protein, 10 aa, Artificial Sequence
  Description of Artificial Sequence: Synthetic peptide
  Seed: FKLWRTLSGS (MAGC3_HUMAN)
FKLWRTLSGV

SEQ ID NO: 102238 - protein, 9 aa, Artificial Sequence
  Description of Artificial Sequence: Synthetic peptide
  Seed: LKYQAKEPL (MAGC3_HUMAN)
LEYQAKEPM

SEQ ID NO: 102239 - protein, 9 aa, Artificial Sequence
  Description of Artificial Sequence: Synthetic peptide
  Seed: FKLWRTLSG (MAGC3_HUMAN)
FNLWRTLSF

SEQ ID NO: 102240 - protein, 9 aa, Artificial Sequence
  Description of Artificial Sequence: Synthetic peptide
  Seed: MPAAGMPPL (MAGC3_HUMAN)
MRAAGMPPV

SEQ ID NO: 102241 - protein, 9 aa, Artificial Sequence
  Description of Artificial Sequence: Synthetic peptide
  Seed: NPQGLAGHR (MAGC3_HUMAN)
NAQGLAGHR

SEQ ID NO: 102242 - protein, 9 aa, Artificial Sequence
  Description of Artificial Sequence: Synthetic peptide
  Seed: DMDPDNHSY (MAGC3_HUMAN)
DLDPDNHSM

SEQ ID NO: 102243 - protein, 10 aa, Artificial Sequence
  Description of Artificial Sequence: Synthetic peptide
  Seed: SPLDSCSSPL (MAGC3_HUMAN)
SMLDSCSSPA

SEQ ID NO: 102244 - protein, 10 aa, Artificial Sequence
  Description of Artificial Sequence: Synthetic peptide
  Seed: INTYTGYFPM (MAGC3_HUMAN)
IQTYTGYFPF

SEQ ID NO: 102245 - protein, 11 aa, Artificial Sequence
  Description of Artificial Sequence: Synthetic peptide
  Seed: TAMASASPSVM (MAGC3_HUMAN)
THMASASPSVY

SEQ ID NO: 102246 - protein, 10 aa, Artificial Sequence
  Description of Artificial Sequence: Synthetic peptide
  Seed: LLKYQAKEPL (MAGC3_HUMAN)
LDKYQAKEPF

SEQ ID NO: 102247 - protein, 11 aa, Artificial Sequence
  Description of Artificial Sequence: Synthetic peptide
  Seed: SSSEEEDTATW (MAGC3_HUMAN)
SISEEEDTATY

SEQ ID NO: 102248 - protein, 9 aa, Artificial Sequence
  Description of Artificial Sequence: Synthetic peptide
  Seed: YQAKEPLTR (MAGC3_HUMAN)
YSAKEPLTL

SEQ ID NO: 102249 - protein, 9 aa, Artificial Sequence
  Description of Artificial Sequence: Synthetic peptide
  Seed: EMLTTVIKK (MAGC3_HUMAN)
ELLTTVIKR

SEQ ID NO: 102250 - protein, 9 aa, Artificial Sequence
  Description of Artificial Sequence: Synthetic peptide
  Seed: KYKDYFPMI (MAGC3_HUMAN)
KIKDYFPMG

SEQ ID NO: 102251 - protein, 9 aa, Artificial Sequence
  Description of Artificial Sequence: Synthetic peptide
  Seed: EFIELIFGI (MAGC3_HUMAN)
EAIELIFGM

SEQ ID NO: 102252 - protein, 9 aa, Artificial Sequence
  Description of Artificial Sequence: Synthetic peptide
  Seed: CSSPLLWTR (MAGC3_HUMAN)
CFSPLLWTR

SEQ ID NO: 102253 - protein, 10 aa, Artificial Sequence
  Description of Artificial Sequence: Synthetic peptide
  Seed: SALAGFADVL (MAGC3_HUMAN)
SCLAGFADVL

SEQ ID NO: 102254 - protein, 9 aa, Artificial Sequence
  Description of Artificial Sequence: Synthetic peptide
  Seed: TLDEKVDKL (MAGC3_HUMAN)
TADEKVDKI

SEQ ID NO: 102255 - protein, 9 aa, Artificial Sequence
  Description of Artificial Sequence: Synthetic peptide
  Seed: MQMNVINTY (MAGC3_HUMAN)
MCMNVINTY

SEQ ID NO: 102256 - protein, 10 aa, Artificial Sequence
  Description of Artificial Sequence: Synthetic peptide
  Seed: SDQRMDSLVL (MAGC3_HUMAN)
SKQRMDSLVF

SEQ ID NO: 102257 - protein, 10 aa, Artificial Sequence
  Description of Artificial Sequence: Synthetic peptide
  Seed: SIIPSAFPSW (MAGC3_HUMAN)
STIPSAFPSF

SEQ ID NO: 102258 - protein, 10 aa, Artificial Sequence
  Description of Artificial Sequence: Synthetic peptide
  Seed: FKLWRTLSGS (MAGC3_HUMAN)
FFLWRTLSGA

SEQ ID NO: 102259 - protein, 9 aa, Artificial Sequence
  Description of Artificial Sequence: Synthetic peptide
  Seed: ALAGFADVL (MAGC3_HUMAN)
AVAGFADVI

SEQ ID NO: 102260 - protein, 9 aa, Artificial Sequence
  Description of Artificial Sequence: Synthetic peptide
  Seed: SLVLCPTYF (MAGC3_HUMAN)
SLVLCPTYA

SEQ ID NO: 102261 - protein, 9 aa, Artificial Sequence
  Description of Artificial Sequence: Synthetic peptide
  Seed: YSAFHLGHL (MAGC3_HUMAN)
YLAFHLGHS

SEQ ID NO: 102262 - protein, 11 aa, Artificial Sequence
  Description of Artificial Sequence: Synthetic peptide
  Seed: YFFEDTLDLTY (MAGC3_HUMAN)
YRFEDTLDLTY

SEQ ID NO: 102263 - protein, 10 aa, Artificial Sequence
  Description of Artificial Sequence: Synthetic peptide
  Seed: REVLEFLSKL (MAGC3_HUMAN)
RIVLEFLSKV

SEQ ID NO: 102264 - protein, 9 aa, Artificial Sequence
  Description of Artificial Sequence: Synthetic peptide
  Seed: CPTYFKLWR (MAGC3_HUMAN)
CVTYFKLWR

SEQ ID NO: 102265 - protein, 10 aa, Artificial Sequence
  Description of Artificial Sequence: Synthetic peptide
  Seed: TGYFPMIFRK (MAGC3_HUMAN)
TVYFPMIFRI

SEQ ID NO: 102266 - protein, 9 aa, Artificial Sequence
  Description of Artificial Sequence: Synthetic peptide
  Seed: EAFCEESGL (MAGC3_HUMAN)
ETFCEESGA

SEQ ID NO: 102267 - protein, 9 aa, Artificial Sequence
  Description of Artificial Sequence: Synthetic peptide
  Seed: MEDRAQAII (MAGC3_HUMAN)
MEDRAQAIM

SEQ ID NO: 102268 - protein, 9 aa, Artificial Sequence
  Description of Artificial Sequence: Synthetic peptide
  Seed: ALAGFADVL (MAGC3_HUMAN)
AVAGFADVF

SEQ ID NO: 102269 - protein, 9 aa, Artificial Sequence
  Description of Artificial Sequence: Synthetic peptide
  Seed: ATYALSPVV (MAGC3_HUMAN)
AIYALSPVL

SEQ ID NO: 102270 - protein, 9 aa, Artificial Sequence
  Description of Artificial Sequence: Synthetic peptide
  Seed: VINTYTGYF (MAGC3_HUMAN)
VTNTYTGYY

SEQ ID NO: 102271 - protein, 10 aa, Artificial Sequence
  Description of Artificial Sequence: Synthetic peptide
  Seed: MNVINTYTGY (MAGC3_HUMAN)
MYVINTYTGR

SEQ ID NO: 102272 - protein, 9 aa, Artificial Sequence
  Description of Artificial Sequence: Synthetic peptide
  Seed: IIDTTDDAT (MAGC3_HUMAN)
IIDTTDDAI

SEQ ID NO: 102273 - protein, 11 aa, Artificial Sequence
  Description of Artificial Sequence: Synthetic peptide
  Seed: FLSKLSSIIPS (MAGC3_HUMAN)
FASKLSSIIPV

SEQ ID NO: 102274 - protein, 8 aa, Artificial Sequence
  Description of Artificial Sequence: Synthetic peptide
  Seed: FADVLSRL (MAGC3_HUMAN)
FQDVLSRL

SEQ ID NO: 102275 - protein, 9 aa, Artificial Sequence
  Description of Artificial Sequence: Synthetic peptide
  Seed: LLILILSVI (MAGC3_HUMAN)
LLILILSVA

SEQ ID NO: 102276 - protein, 9 aa, Artificial Sequence
  Description of Artificial Sequence: Synthetic peptide
  Seed: YKDYFPMIF (MAGC3_HUMAN)
YLDYFPMIF

SEQ ID NO: 102277 - protein, 11 aa, Artificial Sequence
  Description of Artificial Sequence: Synthetic peptide
  Seed: FIELIFGIALT (MAGC3_HUMAN)
FKELIFGIALV

SEQ ID NO: 102278 - protein, 11 aa, Artificial Sequence
  Description of Artificial Sequence: Synthetic peptide
  Seed: SLPESEPLFTY (MAGC3_HUMAN)
SMPESEPLFTM

SEQ ID NO: 102279 - protein, 9 aa, Artificial Sequence
  Description of Artificial Sequence: Synthetic peptide
  Seed: SLPESEPLF (MAGC3_HUMAN)
SAPESEPLV

SEQ ID NO: 102280 - protein, 9 aa, Artificial Sequence
  Description of Artificial Sequence: Synthetic peptide
  Seed: WYMDALKDM (MAGC3_HUMAN)
WYMDALKDV

SEQ ID NO: 102281 - protein, 10 aa, Artificial Sequence
  Description of Artificial Sequence: Synthetic peptide
  Seed: IGPWSALAGF (MAGC3_HUMAN)
IPPWSALAGY

SEQ ID NO: 102282 - protein, 9 aa, Artificial Sequence
  Description of Artificial Sequence: Synthetic peptide
  Seed: YQTKEPVTK (MAGC3_HUMAN)
YRTKEPVTV

SEQ ID NO: 102283 - protein, 8 aa, Artificial Sequence
  Description of Artificial Sequence: Synthetic peptide
  Seed: FADVLSRL (MAGC3_HUMAN)
FYDVLSRL

SEQ ID NO: 102284 - protein, 9 aa, Artificial Sequence
  Description of Artificial Sequence: Synthetic peptide
  Seed: FSLRRAVSV (MAGC3_HUMAN)
FPLRRAVSL

SEQ ID NO: 102285 - protein, 11 aa, Artificial Sequence
  Description of Artificial Sequence: Synthetic peptide
  Seed: KVAELVQFLLL (MAGC3_HUMAN)
KMAELVQFLLE

SEQ ID NO: 102286 - protein, 10 aa, Artificial Sequence
  Description of Artificial Sequence: Synthetic peptide
  Seed: LTRAEMQMNV (MAGC3_HUMAN)
LQRAEMQMNV

SEQ ID NO: 102287 - protein, 9 aa, Artificial Sequence
  Description of Artificial Sequence: Synthetic peptide
  Seed: KVDKLVQFL (MAGC3_HUMAN)
KMDKLVQFR

SEQ ID NO: 102288 - protein, 9 aa, Artificial Sequence
  Description of Artificial Sequence: Synthetic peptide
  Seed: MLLPCHWVL (MAGC3_HUMAN)
MPLPCHWVI

SEQ ID NO: 102289 - protein, 9 aa, Artificial Sequence
  Description of Artificial Sequence: Synthetic peptide
  Seed: VLPPQPQPR (MAGC3_HUMAN)
VCPPQPQPI

SEQ ID NO: 102290 - protein, 9 aa, Artificial Sequence
  Description of Artificial Sequence: Synthetic peptide
  Seed: KKYKDYFPM (MAGC3_HUMAN)
KVYKDYFPM

SEQ ID NO: 102291 - protein, 9 aa, Artificial Sequence
  Description of Artificial Sequence: Synthetic peptide
  Seed: ATDKDYSAF (MAGC3_HUMAN)
ATDKDYSAI

SEQ ID NO: 102292 - protein, 9 aa, Artificial Sequence
  Description of Artificial Sequence: Synthetic peptide
  Seed: KKYKDYFPM (MAGC3_HUMAN)
KQYKDYFPF

SEQ ID NO: 102293 - protein, 9 aa, Artificial Sequence
  Description of Artificial Sequence: Synthetic peptide
  Seed: WVKNTCATY (MAGC3_HUMAN)
WIKNTCATY

SEQ ID NO: 102294 - protein, 10 aa, Artificial Sequence
  Description of Artificial Sequence: Synthetic peptide
  Seed: TLDEKVDKLV (MAGC3_HUMAN)
TSDEKVDKLM

SEQ ID NO: 102295 - protein, 9 aa, Artificial Sequence
  Description of Artificial Sequence: Synthetic peptide
  Seed: ALSPVVLPP (MAGC3_HUMAN)
AMSPVVLPI

SEQ ID NO: 102296 - protein, 9 aa, Artificial Sequence
  Description of Artificial Sequence: Synthetic peptide
  Seed: MIFGKAHEF (MAGC3_HUMAN)
MLFGKAHEM

SEQ ID NO: 102297 - protein, 9 aa, Artificial Sequence
  Description of Artificial Sequence: Synthetic peptide
  Seed: EFIELIFGI (MAGC3_HUMAN)
EIIELIFGA

SEQ ID NO: 102298 - protein, 9 aa, Artificial Sequence
  Description of Artificial Sequence: Synthetic peptide
  Seed: YQTKEPVTK (MAGC3_HUMAN)
YYTKEPVTM

SEQ ID NO: 102299 - protein, 10 aa, Artificial Sequence
  Description of Artificial Sequence: Synthetic peptide
  Seed: IIDTTDDATA (MAGC3_HUMAN)
IMDTTDDATM

SEQ ID NO: 102300 - protein, 9 aa, Artificial Sequence
  Description of Artificial Sequence: Synthetic peptide
  Seed: SQPEGKFSL (MAGC3_HUMAN)
SRPEGKFSV

SEQ ID NO: 102301 - protein, 9 aa, Artificial Sequence
  Description of Artificial Sequence: Synthetic peptide
  Seed: KLWRTLSGS (MAGC3_HUMAN)
KMWRTLSGV

SEQ ID NO: 102302 - protein, 9 aa, Artificial Sequence
  Description of Artificial Sequence: Synthetic peptide
  Seed: ATYALSPVV (MAGC3_HUMAN)
AQYALSPVL

SEQ ID NO: 102303 - protein, 9 aa, Artificial Sequence
  Description of Artificial Sequence: Synthetic peptide
  Seed: VPEEVIWEV (MAGC3_HUMAN)
VLEEVIWEL

SEQ ID NO: 102304 - protein, 9 aa, Artificial Sequence
  Description of Artificial Sequence: Synthetic peptide
  Seed: QLSDLHFGS (MAGC3_HUMAN)
QLSDLHFGA

SEQ ID NO: 102305 - protein, 9 aa, Artificial Sequence
  Description of Artificial Sequence: Synthetic peptide
  Seed: VIWEVLSAI (MAGC3_HUMAN)
VTWEVLSAR

SEQ ID NO: 102306 - protein, 9 aa, Artificial Sequence
  Description of Artificial Sequence: Synthetic peptide
  Seed: SPVVLPPQP (MAGC3_HUMAN)
SPVVLPPQL

SEQ ID NO: 102307 - protein, 9 aa, Artificial Sequence
  Description of Artificial Sequence: Synthetic peptide
  Seed: FEDTLDLTY (MAGC3_HUMAN)
FMDTLDLTF

SEQ ID NO: 102308 - protein, 9 aa, Artificial Sequence
  Description of Artificial Sequence: Synthetic peptide
  Seed: KLSSIIPSA (MAGC3_HUMAN)
KISSIIPST

SEQ ID NO: 102309 - protein, 11 aa, Artificial Sequence
  Description of Artificial Sequence: Synthetic peptide
  Seed: RYALDEKVAEL (MAGC3_HUMAN)
RVALDEKVAEV

SEQ ID NO: 102310 - protein, 9 aa, Artificial Sequence
  Description of Artificial Sequence: Synthetic peptide
  Seed: FSLRRAVSV (MAGC3_HUMAN)
FTLRRAVSM

SEQ ID NO: 102311 - protein, 9 aa, Artificial Sequence
  Description of Artificial Sequence: Synthetic peptide
  Seed: VLCPTYFKL (MAGC3_HUMAN)
VACPTYFKF

SEQ ID NO: 102312 - protein, 10 aa, Artificial Sequence
  Description of Artificial Sequence: Synthetic peptide
  Seed: LNAIGPWSAL (MAGC3_HUMAN)
LEAIGPWSAM

SEQ ID NO: 102313 - protein, 9 aa, Artificial Sequence
  Description of Artificial Sequence: Synthetic peptide
  Seed: EVLEFLSKL (MAGC3_HUMAN)
EALEFLSKM

SEQ ID NO: 102314 - protein, 9 aa, Artificial Sequence
  Description of Artificial Sequence: Synthetic peptide
  Seed: KAHEFIELI (MAGC3_HUMAN)
KNHEFIELI

SEQ ID NO: 102315 - protein, 10 aa, Artificial Sequence
  Description of Artificial Sequence: Synthetic peptide
  Seed: EVIWEVLNAI (MAGC3_HUMAN)
ELIWEVLNAV

SEQ ID NO: 102316 - protein, 9 aa, Artificial Sequence
  Description of Artificial Sequence: Synthetic peptide
  Seed: SLRRAVSVK (MAGC3_HUMAN)
SGRRAVSVK

SEQ ID NO: 102317 - protein, 11 aa, Artificial Sequence
  Description of Artificial Sequence: Synthetic peptide
  Seed: FLSKLSSIIPS (MAGC3_HUMAN)
FTSKLSSIIPV

SEQ ID NO: 102318 - protein, 9 aa, Artificial Sequence
  Description of Artificial Sequence: Synthetic peptide
  Seed: ALDEKVAEL (MAGC3_HUMAN)
ALDEKVAEM

SEQ ID NO: 102319 - protein, 9 aa, Artificial Sequence
  Description of Artificial Sequence: Synthetic peptide
  Seed: CSSPLLWTR (MAGC3_HUMAN)
CTSPLLWTK

SEQ ID NO: 102320 - protein, 10 aa, Artificial Sequence
  Description of Artificial Sequence: Synthetic peptide
  Seed: MDPDNHSYFF (MAGC3_HUMAN)
MQPDNHSYFL

SEQ ID NO: 102321 - protein, 10 aa, Artificial Sequence
  Description of Artificial Sequence: Synthetic peptide
  Seed: KDMEDRAQAI (MAGC3_HUMAN)
KEMEDRAQAP

SEQ ID NO: 102322 - protein, 9 aa, Artificial Sequence
  Description of Artificial Sequence: Synthetic peptide
  Seed: KVDKLVQFL (MAGC3_HUMAN)
KTDKLVQFV

SEQ ID NO: 102323 - protein, 9 aa, Artificial Sequence
  Description of Artificial Sequence: Synthetic peptide
  Seed: TTDDATAMA (MAGC3_HUMAN)
TWDDATAMF

SEQ ID NO: 102324 - protein, 9 aa, Artificial Sequence
  Description of Artificial Sequence: Synthetic peptide
  Seed: GFADVLSRL (MAGC3_HUMAN)
GQADVLSRL

SEQ ID NO: 102325 - protein, 10 aa, Artificial Sequence
  Description of Artificial Sequence: Synthetic peptide
  Seed: IPSAFPSWYM (MAGC3_HUMAN)
IKSAFPSWYW

SEQ ID NO: 102326 - protein, 9 aa, Artificial Sequence
  Description of Artificial Sequence: Synthetic peptide
  Seed: MASASPSVM (MAGC3_HUMAN)
MTSASPSVY

SEQ ID NO: 102327 - protein, 10 aa, Artificial Sequence
  Description of Artificial Sequence: Synthetic peptide
  Seed: YTLDEKVDKL (MAGC3_HUMAN)
YLLDEKVDKA

SEQ ID NO: 102328 - protein, 9 aa, Artificial Sequence
  Description of Artificial Sequence: Synthetic peptide
  Seed: LFGISLTEV (MAGC3_HUMAN)
LFGISLTEM

SEQ ID NO: 102329 - protein, 9 aa, Artificial Sequence
  Description of Artificial Sequence: Synthetic peptide
  Seed: QDWPLNEKR (MAGC3_HUMAN)
QIWPLNEKK

SEQ ID NO: 102330 - protein, 9 aa, Artificial Sequence
  Description of Artificial Sequence: Synthetic peptide
  Seed: TKAEMLTTV (MAGC3_HUMAN)
THAEMLTTT

SEQ ID NO: 102331 - protein, 9 aa, Artificial Sequence
  Description of Artificial Sequence: Synthetic peptide
  Seed: TSDQRMDSL (MAGC3_HUMAN)
TVDQRMDSL

SEQ ID NO: 102332 - protein, 8 aa, Artificial Sequence
  Description of Artificial Sequence: Synthetic peptide
  Seed: YMDALKDM (MAGC3_HUMAN)
YADALKDF

SEQ ID NO: 102333 - protein, 10 aa, Artificial Sequence
  Description of Artificial Sequence: Synthetic peptide
  Seed: ILILSVIFIK (MAGC3_HUMAN)
IMILSVIFIK

SEQ ID NO: 102334 - protein, 11 aa, Artificial Sequence
  Description of Artificial Sequence: Synthetic peptide
  Seed: LIDDQGMPKNC (MAGC3_HUMAN)
LLDDQGMPKNL

SEQ ID NO: 102335 - protein, 9 aa, Artificial Sequence
  Description of Artificial Sequence: Synthetic peptide
  Seed: IQRPAREVL (MAGC3_HUMAN)
IFRPAREVF

SEQ ID NO: 102336 - protein, 10 aa, Artificial Sequence
  Description of Artificial Sequence: Synthetic peptide
  Seed: MLTTVIKKYK (MAGC3_HUMAN)
MFTTVIKKYR

SEQ ID NO: 102337 - protein, 11 aa, Artificial Sequence
  Description of Artificial Sequence: Synthetic peptide
  Seed: KVAELVQFLLL (MAGC3_HUMAN)
KMAELVQFLLK

SEQ ID NO: 102338 - protein, 11 aa, Artificial Sequence
  Description of Artificial Sequence: Synthetic peptide
  Seed: GSLIDDQGMPK (MAGC3_HUMAN)
GTLIDDQGMPK

SEQ ID NO: 102339 - protein, 10 aa, Artificial Sequence
  Description of Artificial Sequence: Synthetic peptide
  Seed: SKLSSIIPSA (MAGC3_HUMAN)
SALSSIIPSV

SEQ ID NO: 102340 - protein, 9 aa, Artificial Sequence
  Description of Artificial Sequence: Synthetic peptide
  Seed: MIFGKAHEF (MAGC3_HUMAN)
MEFGKAHEM

SEQ ID NO: 102341 - protein, 10 aa, Artificial Sequence
  Description of Artificial Sequence: Synthetic peptide
  Seed: SQPEGKFSLR (MAGC3_HUMAN)
SLPEGKFSLK

SEQ ID NO: 102342 - protein, 9 aa, Artificial Sequence
  Description of Artificial Sequence: Synthetic peptide
  Seed: VLCPTYFKL (MAGC3_HUMAN)
VTCPTYFKF

SEQ ID NO: 102343 - protein, 8 aa, Artificial Sequence
  Description of Artificial Sequence: Synthetic peptide
  Seed: IQRPAREV (MAGC3_HUMAN)
IARPAREL

SEQ ID NO: 102344 - protein, 10 aa, Artificial Sequence
  Description of Artificial Sequence: Synthetic peptide
  Seed: MDPDNHSYFF (MAGC3_HUMAN)
MVPDNHSYFL

SEQ ID NO: 102345 - protein, 9 aa, Artificial Sequence
  Description of Artificial Sequence: Synthetic peptide
  Seed: SPPEIPPQG (MAGC3_HUMAN)
SPPEIPPQV

SEQ ID NO: 102346 - protein, 10 aa, Artificial Sequence
  Description of Artificial Sequence: Synthetic peptide
  Seed: YTLDEKVDKL (MAGC3_HUMAN)
YMLDEKVDKF

SEQ ID NO: 102347 - protein, 9 aa, Artificial Sequence
  Description of Artificial Sequence: Synthetic peptide
  Seed: GFADVLSRL (MAGC3_HUMAN)
GIADVLSRM

SEQ ID NO: 102348 - protein, 10 aa, Artificial Sequence
  Description of Artificial Sequence: Synthetic peptide
  Seed: LVLCPTYFKL (MAGC3_HUMAN)
LVLCPTYFKV

SEQ ID NO: 102349 - protein, 10 aa, Artificial Sequence
  Description of Artificial Sequence: Synthetic peptide
  Seed: SWYMDALKDM (MAGC3_HUMAN)
SYYMDALKDY

SEQ ID NO: 102350 - protein, 10 aa, Artificial Sequence
  Description of Artificial Sequence: Synthetic peptide
  Seed: MQMNVINTYT (MAGC3_HUMAN)
MKMNVINTYM

SEQ ID NO: 102351 - protein, 9 aa, Artificial Sequence
  Description of Artificial Sequence: Synthetic peptide
  Seed: HLREVRLFL (MAGC3_HUMAN)
HYREVRLFM

SEQ ID NO: 102352 - protein, 10 aa, Artificial Sequence
  Description of Artificial Sequence: Synthetic peptide
  Seed: TAMASASPSV (MAGC3_HUMAN)
TFMASASPSM

SEQ ID NO: 102353 - protein, 10 aa, Artificial Sequence
  Description of Artificial Sequence: Synthetic peptide
  Seed: VLNAIGPWSA (MAGC3_HUMAN)
VMNAIGPWSI

SEQ ID NO: 102354 - protein, 9 aa, Artificial Sequence
  Description of Artificial Sequence: Synthetic peptide
  Seed: SEEEDTATW (MAGC3_HUMAN)
SIEEDTATY

SEQ ID NO: 102355 - protein, 10 aa, Artificial Sequence
  Description of Artificial Sequence: Synthetic peptide
  Seed: PTYFKLWRTL (MAGC3_HUMAN)
PQYFKLWRTF

SEQ ID NO: 102356 - protein, 10 aa, Artificial Sequence
  Description of Artificial Sequence: Synthetic peptide
  Seed: INTYTGYFPM (MAGC3_HUMAN)
ILTYTGYFPW

SEQ ID NO: 102357 - protein, 10 aa, Artificial Sequence
  Description of Artificial Sequence: Synthetic peptide
  Seed: MDSLVLCPTY (MAGC3_HUMAN)
MLSLVLCPTF

SEQ ID NO: 102358 - protein, 10 aa, Artificial Sequence
  Description of Artificial Sequence: Synthetic peptide
  Seed: REVRLFLRGG (MAGC3_HUMAN)
RTVRLFLRGL

SEQ ID NO: 102359 - protein, 9 aa, Artificial Sequence
  Description of Artificial Sequence: Synthetic peptide
  Seed: ASEEVIWEV (MAGC3_HUMAN)
AQEEVIWEV

SEQ ID NO: 102360 - protein, 9 aa, Artificial Sequence
  Description of Artificial Sequence: Synthetic peptide
  Seed: CATYALSPV (MAGC3_HUMAN)
CQTYALSPV

SEQ ID NO: 102361 - protein, 9 aa, Artificial Sequence
  Description of Artificial Sequence: Synthetic peptide
  Seed: HFYVFVNTL (MAGC3_HUMAN)
HRYVFVNTL

SEQ ID NO: 102362 - protein, 9 aa, Artificial Sequence
  Description of Artificial Sequence: Synthetic peptide
  Seed: YTGYFPMIF (MAGC3_HUMAN)
YRGYFPMIF

SEQ ID NO: 102363 - protein, 9 aa, Artificial Sequence
  Description of Artificial Sequence: Synthetic peptide
  Seed: SQPEGKFSL (MAGC3_HUMAN)
SVPEGKFSY

SEQ ID NO: 102364 - protein, 9 aa, Artificial Sequence
  Description of Artificial Sequence: Synthetic peptide
  Seed: EVIWEVLSA (MAGC3_HUMAN)
ETIWEVLSF

SEQ ID NO: 102365 - protein, 9 aa, Artificial Sequence
  Description of Artificial Sequence: Synthetic peptide
  Seed: IIDTTDDAT (MAGC3_HUMAN)
ISDTTDDAL

SEQ ID NO: 102366 - protein, 10 aa, Artificial Sequence
  Description of Artificial Sequence: Synthetic peptide
  Seed: TGYFPMIFRK (MAGC3_HUMAN)
TTYFPMIFRS

SEQ ID NO: 102367 - protein, 9 aa, Artificial Sequence
  Description of Artificial Sequence: Synthetic peptide
  Seed: KLVQFLLLK (MAGC3_HUMAN)
KAVQFLLLL

SEQ ID NO: 102368 - protein, 9 aa, Artificial Sequence
  Description of Artificial Sequence: Synthetic peptide
  Seed: TYALSPVVL (MAGC3_HUMAN)
THALSPVVL

SEQ ID NO: 102369 - protein, 9 aa, Artificial Sequence
  Description of Artificial Sequence: Synthetic peptide
  Seed: VLPPQPQPR (MAGC3_HUMAN)
VTPPQPQPK

SEQ ID NO: 102370 - protein, 9 aa, Artificial Sequence
  Description of Artificial Sequence: Synthetic peptide
  Seed: AIGPIQRPA (MAGC3_HUMAN)
APGPIQRPA

SEQ ID NO: 102371 - protein, 9 aa, Artificial Sequence
  Description of Artificial Sequence: Synthetic peptide
  Seed: EDTATWHAL (MAGC3_HUMAN)
EETATWHAL

SEQ ID NO: 102372 - protein, 10 aa, Artificial Sequence
  Description of Artificial Sequence: Synthetic peptide
  Seed: TTDDATAMAS (MAGC3_HUMAN)
TGDDATAMAI

SEQ ID NO: 102373 - protein, 10 aa, Artificial Sequence
  Description of Artificial Sequence: Synthetic peptide
  Seed: TAMASASPSV (MAGC3_HUMAN)
THMASASPSV

SEQ ID NO: 102374 - protein, 10 aa, Artificial Sequence
  Description of Artificial Sequence: Synthetic peptide
  Seed: CVPEEVIWEV (MAGC3_HUMAN)
CLPEEVIWEM

SEQ ID NO: 102375 - protein, 9 aa, Artificial Sequence
  Description of Artificial Sequence: Synthetic peptide
  Seed: SCVPEEVIW (MAGC3_HUMAN)
SPVPEEVIY

SEQ ID NO: 102376 - protein, 9 aa, Artificial Sequence
  Description of Artificial Sequence: Synthetic peptide
  Seed: SQPEGKFSL (MAGC3_HUMAN)
SAPEGKFSV

SEQ ID NO: 102377 - protein, 9 aa, Artificial Sequence
  Description of Artificial Sequence: Synthetic peptide
  Seed: ALAGFADVL (MAGC3_HUMAN)
ASAGFADVY

SEQ ID NO: 102378 - protein, 9 aa, Artificial Sequence
  Description of Artificial Sequence: Synthetic peptide
  Seed: FKLWRTLSG (MAGC3_HUMAN)
FMLWRTLSI

SEQ ID NO: 102379 - protein, 11 aa, Artificial Sequence
  Description of Artificial Sequence: Synthetic peptide
  Seed: AFPSWYMDALK (MAGC3_HUMAN)
AFPSWYMDALR

SEQ ID NO: 102380 - protein, 10 aa, Artificial Sequence
  Description of Artificial Sequence: Synthetic peptide
  Seed: MIFGKAHEFI (MAGC3_HUMAN)
MLFGKAHEFA

SEQ ID NO: 102381 - protein, 9 aa, Artificial Sequence
  Description of Artificial Sequence: Synthetic peptide
  Seed: MASASPSVM (MAGC3_HUMAN)
MGSASPSVF

SEQ ID NO: 102382 - protein, 9 aa, Artificial Sequence
  Description of Artificial Sequence: Synthetic peptide
  Seed: EVIWEVLSA (MAGC3_HUMAN)
EIIWEVLSV

SEQ ID NO: 102383 - protein, 9 aa, Artificial Sequence
  Description of Artificial Sequence: Synthetic peptide
  Seed: GFADVLSRL (MAGC3_HUMAN)
GYADVLSRM

SEQ ID NO: 102384 - protein, 9 aa, Artificial Sequence
  Description of Artificial Sequence: Synthetic peptide
  Seed: FPMIFGKAH (MAGC3_HUMAN)
FSMIFGKAY

SEQ ID NO: 102385 - protein, 10 aa, Artificial Sequence
  Description of Artificial Sequence: Synthetic peptide
  Seed: IELIFGIALT (MAGC3_HUMAN)
IWLIFGIALV

SEQ ID NO: 102386 - protein, 11 aa, Artificial Sequence
  Description of Artificial Sequence: Synthetic peptide
  Seed: YFFEDTLDLTY (MAGC3_HUMAN)
YQFEDTLDLTY

SEQ ID NO: 102387 - protein, 9 aa, Artificial Sequence
  Description of Artificial Sequence: Synthetic peptide
  Seed: KYKDYFPMI (MAGC3_HUMAN)
KSKDYFPMS

SEQ ID NO: 102388 - protein, 10 aa, Artificial Sequence
  Description of Artificial Sequence: Synthetic peptide
  Seed: MDSLVLCPTY (MAGC3_HUMAN)
MYSLVLCPTW

SEQ ID NO: 102389 - protein, 9 aa, Artificial Sequence
  Description of Artificial Sequence: Synthetic peptide
  Seed: HALPESESL (MAGC3_HUMAN)
HILPESESY

SEQ ID NO: 102390 - protein, 9 aa, Artificial Sequence
  Description of Artificial Sequence: Synthetic peptide
  Seed: KAHEFIELI (MAGC3_HUMAN)
KRHEFIELY

SEQ ID NO: 102391 - protein, 9 aa, Artificial Sequence
  Description of Artificial Sequence: Synthetic peptide
  Seed: TLDEKVDKL (MAGC3_HUMAN)
TCDEKVDKV

SEQ ID NO: 102392 - protein, 10 aa, Artificial Sequence
  Description of Artificial Sequence: Synthetic peptide
  Seed: MQMNVINTYT (MAGC3_HUMAN)
MPMNVINTYL

SEQ ID NO: 102393 - protein, 10 aa, Artificial Sequence
  Description of Artificial Sequence: Synthetic peptide
  Seed: YALSPVVLPP (MAGC3_HUMAN)
YDLSPVVLPA

SEQ ID NO: 102394 - protein, 9 aa, Artificial Sequence
  Description of Artificial Sequence: Synthetic peptide
  Seed: MIFGKAHEF (MAGC3_HUMAN)
MQFGKAHEV

SEQ ID NO: 102395 - protein, 9 aa, Artificial Sequence
  Description of Artificial Sequence: Synthetic peptide
  Seed: WVKNTCATY (MAGC3_HUMAN)
WSKNTCATF

SEQ ID NO: 102396 - protein, 11 aa, Artificial Sequence
  Description of Artificial Sequence: Synthetic peptide
  Seed: ATFSDGSLGQW (MAGC3_HUMAN)
AQFSDGSLGQI

SEQ ID NO: 102397 - protein, 9 aa, Artificial Sequence
  Description of Artificial Sequence: Synthetic peptide
  Seed: LANPQGLAG (MAGC3_HUMAN)
LSNPQGLAV

SEQ ID NO: 102398 - protein, 10 aa, Artificial Sequence
  Description of Artificial Sequence: Synthetic peptide
  Seed: FKLWRTLSGS (MAGC3_HUMAN)
FRLWRTLSGM

SEQ ID NO: 102399 - protein, 9 aa, Artificial Sequence
  Description of Artificial Sequence: Synthetic peptide
  Seed: YFFEDTLDL (MAGC3_HUMAN)
YAFEDTLDA

SEQ ID NO: 102400 - protein, 9 aa, Artificial Sequence
  Description of Artificial Sequence: Synthetic peptide
  Seed: LSSIIPSAF (MAGC3_HUMAN)
LLSIIPSAF

SEQ ID NO: 102401 - protein, 9 aa, Artificial Sequence
  Description of Artificial Sequence: Synthetic peptide
  Seed: SASPSVMST (MAGC3_HUMAN)
SGSPSVMSM

SEQ ID NO: 102402 - protein, 9 aa, Artificial Sequence
  Description of Artificial Sequence: Synthetic peptide
  Seed: RPAREVLEF (MAGC3_HUMAN)
RPAREVLEM

SEQ ID NO: 102403 - protein, 10 aa, Artificial Sequence
  Description of Artificial Sequence: Synthetic peptide
  Seed: REVRLFLRGG (MAGC3_HUMAN)
RCVRLFLRGV

SEQ ID NO: 102404 - protein, 9 aa, Artificial Sequence
  Description of Artificial Sequence: Synthetic peptide
  Seed: TGYFPMIFR (MAGC3_HUMAN)
TTYFPMIFK

SEQ ID NO: 102405 - protein, 10 aa, Artificial Sequence
  Description of Artificial Sequence: Synthetic peptide
  Seed: KVAELVQFLL (MAGC3_HUMAN)
KIAELVQFLL

SEQ ID NO: 102406 - protein, 10 aa, Artificial Sequence
  Description of Artificial Sequence: Synthetic peptide
  Seed: SLVLCPTYFK (MAGC3_HUMAN)
SRVLCPTYFK

SEQ ID NO: 102407 - protein, 9 aa, Artificial Sequence
  Description of Artificial Sequence: Synthetic peptide
  Seed: DYFPMIFGK (MAGC3_HUMAN)
DTFPMIFGR

SEQ ID NO: 102408 - protein, 10 aa, Artificial Sequence
  Description of Artificial Sequence: Synthetic peptide
  Seed: EKVAELVQFL (MAGC3_HUMAN)
EPVAELVQFI

SEQ ID NO: 102409 - protein, 9 aa, Artificial Sequence
  Description of Artificial Sequence: Synthetic peptide
  Seed: MASASPSVM (MAGC3_HUMAN)
MMSASPSVF

SEQ ID NO: 102410 - protein, 9 aa, Artificial Sequence
  Description of Artificial Sequence: Synthetic peptide
  Seed: DYSAFHLGH (MAGC3_HUMAN)
DWSAFHLGR

SEQ ID NO: 102411 - protein, 9 aa, Artificial Sequence
  Description of Artificial Sequence: Synthetic peptide
  Seed: YFFEDTLDL (MAGC3_HUMAN)
YLFEDTLDM

SEQ ID NO: 102412 - protein, 9 aa, Artificial Sequence
  Description of Artificial Sequence: Synthetic peptide
  Seed: KLWRTLSGS (MAGC3_HUMAN)
KQWRTLSGV

SEQ ID NO: 102413 - protein, 9 aa, Artificial Sequence
  Description of Artificial Sequence: Synthetic peptide
  Seed: EKVDKLVQF (MAGC3_HUMAN)
EDVDKLVQL

SEQ ID NO: 102414 - protein, 9 aa, Artificial Sequence
  Description of Artificial Sequence: Synthetic peptide
  Seed: EVIWEVLNA (MAGC3_HUMAN)
ELIWEVLNR

SEQ ID NO: 102415 - protein, 10 aa, Artificial Sequence
  Description of Artificial Sequence: Synthetic peptide
  Seed: ELVQFLLLKY (MAGC3_HUMAN)
ETVQFLLLKR

SEQ ID NO: 102416 - protein, 10 aa, Artificial Sequence
  Description of Artificial Sequence: Synthetic peptide
  Seed: KLSSIIPSAF (MAGC3_HUMAN)
KGSSIIPSAY

SEQ ID NO: 102417 - protein, 9 aa, Artificial Sequence
  Description of Artificial Sequence: Synthetic peptide
  Seed: WVKNTCATY (MAGC3_HUMAN)
WSKNTCATM

SEQ ID NO: 102418 - protein, 9 aa, Artificial Sequence
  Description of Artificial Sequence: Synthetic peptide
  Seed: VLPPQPQPR (MAGC3_HUMAN)
VMPPQPQPI

SEQ ID NO: 102419 - protein, 9 aa, Artificial Sequence
  Description of Artificial Sequence: Synthetic peptide
  Seed: TSDQRMDSL (MAGC3_HUMAN)
TWDQRMDSF

SEQ ID NO: 102420 - protein, 10 aa, Artificial Sequence
  Description of Artificial Sequence: Synthetic peptide
  Seed: CASEEVIWEV (MAGC3_HUMAN)
CLSEEVIWEV

SEQ ID NO: 102421 - protein, 11 aa, Artificial Sequence
  Description of Artificial Sequence: Synthetic peptide
  Seed: FLSKLSSIIPS (MAGC3_HUMAN)
FISKLSSIIPV

SEQ ID NO: 102422 - protein, 10 aa, Artificial Sequence
  Description of Artificial Sequence: Synthetic peptide
  Seed: AMASASPSVM (MAGC3_HUMAN)
ATASASPSVY

SEQ ID NO: 102423 - protein, 9 aa, Artificial Sequence
  Description of Artificial Sequence: Synthetic peptide
  Seed: LKYQTKEPV (MAGC3_HUMAN)
LVYQTKEPY

SEQ ID NO: 102424 - protein, 9 aa, Artificial Sequence
  Description of Artificial Sequence: Synthetic peptide
  Seed: HALPESESL (MAGC3_HUMAN)
HALPESESW

SEQ ID NO: 102425 - protein, 11 aa, Artificial Sequence
  Description of Artificial Sequence: Synthetic peptide
  Seed: EILFGISLTEV (MAGC3_HUMAN)
EYLFGISLTEI

SEQ ID NO: 102426 - protein, 9 aa, Artificial Sequence
  Description of Artificial Sequence: Synthetic peptide
  Seed: EFLSKLSSI (MAGC3_HUMAN)
ELLSKLSSL

SEQ ID NO: 102427 - protein, 10 aa, Artificial Sequence
  Description of Artificial Sequence: Synthetic peptide
  Seed: HEFIELIFGI (MAGC3_HUMAN)
HEFIELIFGL

SEQ ID NO: 102428 - protein, 9 aa, Artificial Sequence
  Description of Artificial Sequence: Synthetic peptide
  Seed: SASPSVMST (MAGC3_HUMAN)
SLSPSVMSI

SEQ ID NO: 102429 - protein, 9 aa, Artificial Sequence
  Description of Artificial Sequence: Synthetic peptide
  Seed: ASEEVIWEV (MAGC3_HUMAN)
AIEEVIWEL

SEQ ID NO: 102430 - protein, 10 aa, Artificial Sequence
  Description of Artificial Sequence: Synthetic peptide
  Seed: AEMQMNVINT (MAGC3_HUMAN)
AEMQMNVINY

SEQ ID NO: 102431 - protein, 8 aa, Artificial Sequence
  Description of Artificial Sequence: Synthetic peptide
  Seed: LTYEGSLI (MAGC3_HUMAN)
LQYEGSLI

SEQ ID NO: 102432 - protein, 9 aa, Artificial Sequence
  Description of Artificial Sequence: Synthetic peptide
  Seed: QLSDLHFGS (MAGC3_HUMAN)
QISDLHFGV

SEQ ID NO: 102433 - protein, 9 aa, Artificial Sequence
  Description of Artificial Sequence: Synthetic peptide
  Seed: MASASPSVM (MAGC3_HUMAN)
MSSASPSVY

SEQ ID NO: 102434 - protein, 11 aa, Artificial Sequence
  Description of Artificial Sequence: Synthetic peptide
  Seed: AEMQMNVINTY (MAGC3_HUMAN)
ATMQMNVINTY

SEQ ID NO: 102435 - protein, 10 aa, Artificial Sequence
  Description of Artificial Sequence: Synthetic peptide
  Seed: YALSPVVLPP (MAGC3_HUMAN)
YTLSPVVLPA

SEQ ID NO: 102436 - protein, 9 aa, Artificial Sequence
  Description of Artificial Sequence: Synthetic peptide
  Seed: EVLEFLSKL (MAGC3_HUMAN)
EVLEFLSKY

SEQ ID NO: 102437 - protein, 10 aa, Artificial Sequence
  Description of Artificial Sequence: Synthetic peptide
  Seed: FKLWRTLSGS (MAGC3_HUMAN)
FLLWRTLSGL

SEQ ID NO: 102438 - protein, 9 aa, Artificial Sequence
  Description of Artificial Sequence: Synthetic peptide
  Seed: IPPQGPPKI (MAGC3_HUMAN)
IPPQGPPKM

SEQ ID NO: 102439 - protein, 11 aa, Artificial Sequence
  Description of Artificial Sequence: Synthetic peptide
  Seed: KGNCASEEVIW (MAGC3_HUMAN)
KTNCASEEVIW

SEQ ID NO: 102440 - protein, 10 aa, Artificial Sequence
  Description of Artificial Sequence: Synthetic peptide
  Seed: YALDEKVAEL (MAGC3_HUMAN)
YCLDEKVAEM

SEQ ID NO: 102441 - protein, 9 aa, Artificial Sequence
  Description of Artificial Sequence: Synthetic peptide
  Seed: VIWEVLSAI (MAGC3_HUMAN)
VGWEVLSAY

SEQ ID NO: 102442 - protein, 9 aa, Artificial Sequence
  Description of Artificial Sequence: Synthetic peptide
  Seed: FKLWRTLSG (MAGC3_HUMAN)
FKLWRTLSF

SEQ ID NO: 102443 - protein, 9 aa, Artificial Sequence
  Description of Artificial Sequence: Synthetic peptide
  Seed: GFADVLSRL (MAGC3_HUMAN)
GLADVLSRA

SEQ ID NO: 102444 - protein, 9 aa, Artificial Sequence
  Description of Artificial Sequence: Synthetic peptide
  Seed: KFSLRRAVS (MAGC3_HUMAN)
KTSLRRAVK

SEQ ID NO: 102445 - protein, 9 aa, Artificial Sequence
  Description of Artificial Sequence: Synthetic peptide
  Seed: ATDKDYSAF (MAGC3_HUMAN)
ALDKDYSAF

SEQ ID NO: 102446 - protein, 9 aa, Artificial Sequence
  Description of Artificial Sequence: Synthetic peptide
  Seed: MASASPSVM (MAGC3_HUMAN)
MNSASPSVW

SEQ ID NO: 102447 - protein, 10 aa, Artificial Sequence
  Description of Artificial Sequence: Synthetic peptide
  Seed: IELIFGIALT (MAGC3_HUMAN)
IMLIFGIALI

SEQ ID NO: 102448 - protein, 10 aa, Artificial Sequence
  Description of Artificial Sequence: Synthetic peptide
  Seed: IPSAFPSWYM (MAGC3_HUMAN)
IVSAFPSWYF

SEQ ID NO: 102449 - protein, 10 aa, Artificial Sequence
  Description of Artificial Sequence: Synthetic peptide
  Seed: MIFGKAHEFI (MAGC3_HUMAN)
MAFGKAHEFL

SEQ ID NO: 102450 - protein, 11 aa, Artificial Sequence
  Description of Artificial Sequence: Synthetic peptide
  Seed: YALDEKVAELV (MAGC3_HUMAN)
YLLDEKVAELE

SEQ ID NO: 102451 - protein, 10 aa, Artificial Sequence
  Description of Artificial Sequence: Synthetic peptide
  Seed: CVPEEVIWEV (MAGC3_HUMAN)
CLPEEVIWEI

SEQ ID NO: 102452 - protein, 9 aa, Artificial Sequence
  Description of Artificial Sequence: Synthetic peptide
  Seed: YQAKEPLTR (MAGC3_HUMAN)
YMAKEPLTR

SEQ ID NO: 102453 - protein, 9 aa, Artificial Sequence
  Description of Artificial Sequence: Synthetic peptide
  Seed: AEMQMNVIN (MAGC3_HUMAN)
AEMQMNVIS

SEQ ID NO: 102454 - protein, 9 aa, Artificial Sequence
  Description of Artificial Sequence: Synthetic peptide
  Seed: LANPQGLAG (MAGC3_HUMAN)
LMNPQGLAL

SEQ ID NO: 102455 - protein, 9 aa, Artificial Sequence
  Description of Artificial Sequence: Synthetic peptide
  Seed: NAIGPWSAL (MAGC3_HUMAN)
NPIGPWSAM

SEQ ID NO: 102456 - protein, 9 aa, Artificial Sequence
  Description of Artificial Sequence: Synthetic peptide
  Seed: NTYTGYFPM (MAGC3_HUMAN)
NVYTGYFPK

SEQ ID NO: 102457 - protein, 9 aa, Artificial Sequence
  Description of Artificial Sequence: Synthetic peptide
  Seed: KYKDYFPMI (MAGC3_HUMAN)
KAKDYFPMM

SEQ ID NO: 102458 - protein, 9 aa, Artificial Sequence
  Description of Artificial Sequence: Synthetic peptide
  Seed: SLPESEPLF (MAGC3_HUMAN)
SRPESEPLM

SEQ ID NO: 102459 - protein, 9 aa, Artificial Sequence
  Description of Artificial Sequence: Synthetic peptide
  Seed: TYFKLWRTL (MAGC3_HUMAN)
TMFKLWRTF

SEQ ID NO: 102460 - protein, 9 aa, Artificial Sequence
  Description of Artificial Sequence: Synthetic peptide
  Seed: MLLPCHWVL (MAGC3_HUMAN)
MYLPCHWVM

SEQ ID NO: 102461 - protein, 9 aa, Artificial Sequence
  Description of Artificial Sequence: Synthetic peptide
  Seed: YFFEDTLDL (MAGC3_HUMAN)
YWFEDTLDW

SEQ ID NO: 102462 - protein, 9 aa, Artificial Sequence
  Description of Artificial Sequence: Synthetic peptide
  Seed: ALDEKVAEL (MAGC3_HUMAN)
AQDEKVAEI

SEQ ID NO: 102463 - protein, 10 aa, Artificial Sequence
  Description of Artificial Sequence: Synthetic peptide
  Seed: KVDKLVQFLL (MAGC3_HUMAN)
KSDKLVQFLK

SEQ ID NO: 102464 - protein, 9 aa, Artificial Sequence
  Description of Artificial Sequence: Synthetic peptide
  Seed: MLLPCHWVL (MAGC3_HUMAN)
MRLPCHWVL

SEQ ID NO: 102465 - protein, 10 aa, Artificial Sequence
  Description of Artificial Sequence: Synthetic peptide
  Seed: MIFRKAREFI (MAGC3_HUMAN)
MVFRKAREFK

SEQ ID NO: 102466 - protein, 9 aa, Artificial Sequence
  Description of Artificial Sequence: Synthetic peptide
  Seed: MLLPCHWVL (MAGC3_HUMAN)
MWLPCHWVV

SEQ ID NO: 102467 - protein, 9 aa, Artificial Sequence
  Description of Artificial Sequence: Synthetic peptide
  Seed: ATDKDYSAF (MAGC3_HUMAN)
AVDKDYSAM

SEQ ID NO: 102468 - protein, 11 aa, Artificial Sequence
  Description of Artificial Sequence: Synthetic peptide
  Seed: VLDATFSDGSL (MAGC3_HUMAN)
VSDATFSDGSL

SEQ ID NO: 102469 - protein, 9 aa, Artificial Sequence
  Description of Artificial Sequence: Synthetic peptide
  Seed: ATDKDYSAF (MAGC3_HUMAN)
AGDKDYSAF

SEQ ID NO: 102470 - protein, 9 aa, Artificial Sequence
  Description of Artificial Sequence: Synthetic peptide
  Seed: FPSWYMDAL (MAGC3_HUMAN)
FTSWYMDAF

SEQ ID NO: 102471 - protein, 10 aa, Artificial Sequence
  Description of Artificial Sequence: Synthetic peptide
  Seed: REVRLFLRGG (MAGC3_HUMAN)
RVVRLFLRGV

SEQ ID NO: 102472 - protein, 10 aa, Artificial Sequence
  Description of Artificial Sequence: Synthetic peptide
  Seed: EMQMNVINTY (MAGC3_HUMAN)
ERQMNVINTY

SEQ ID NO: 102473 - protein, 10 aa, Artificial Sequence
  Description of Artificial Sequence: Synthetic peptide
  Seed: IELIFGIALT (MAGC3_HUMAN)
IRLIFGIALV

SEQ ID NO: 102474 - protein, 10 aa, Artificial Sequence
  Description of Artificial Sequence: Synthetic peptide
  Seed: EEVIWEVLSA (MAGC3_HUMAN)
EFVIWEVLSV

SEQ ID NO: 102475 - protein, 10 aa, Artificial Sequence
  Description of Artificial Sequence: Synthetic peptide
  Seed: TAMASASPSV (MAGC3_HUMAN)
TQMASASPSI

SEQ ID NO: 102476 - protein, 9 aa, Artificial Sequence
  Description of Artificial Sequence: Synthetic peptide
  Seed: LSGSPGLQL (MAGC3_HUMAN)
LVGSPGLQF

SEQ ID NO: 102477 - protein, 9 aa, Artificial Sequence
  Description of Artificial Sequence: Synthetic peptide
  Seed: QLSDLHFGS (MAGC3_HUMAN)
QVSDLHFGL

SEQ ID NO: 102478 - protein, 9 aa, Artificial Sequence
  Description of Artificial Sequence: Synthetic peptide
  Seed: VIWEVLNAI (MAGC3_HUMAN)
VVWEVLNAI

SEQ ID NO: 102479 - protein, 9 aa, Artificial Sequence
  Description of Artificial Sequence: Synthetic peptide
  Seed: ELIFGIALT (MAGC3_HUMAN)
ETIFGIALS

SEQ ID NO: 102480 - protein, 10 aa, Artificial Sequence
  Description of Artificial Sequence: Synthetic peptide
  Seed: SKLSSIIPSA (MAGC3_HUMAN)
SFLSSIIPSA

SEQ ID NO: 102481 - protein, 9 aa, Artificial Sequence
  Description of Artificial Sequence: Synthetic peptide
  Seed: LIDDQGMPK (MAGC3_HUMAN)
LQDDQGMPL

SEQ ID NO: 102482 - protein, 9 aa, Artificial Sequence
  Description of Artificial Sequence: Synthetic peptide
  Seed: IIPSAFPSW (MAGC3_HUMAN)
IGPSAFPSV

SEQ ID NO: 102483 - protein, 10 aa, Artificial Sequence
  Description of Artificial Sequence: Synthetic peptide
  Seed: MIFGKAHEFI (MAGC3_HUMAN)
MVFGKAHEFL

SEQ ID NO: 102484 - protein, 9 aa, Artificial Sequence
  Description of Artificial Sequence: Synthetic peptide
  Seed: FLSKLSSII (MAGC3_HUMAN)
FLSKLSSIA

SEQ ID NO: 102485 - protein, 10 aa, Artificial Sequence
  Description of Artificial Sequence: Synthetic peptide
  Seed: MLLPCHWVLD (MAGC3_HUMAN)
MDLPCHWVLV

SEQ ID NO: 102486 - protein, 10 aa, Artificial Sequence
  Description of Artificial Sequence: Synthetic peptide
  Seed: REVLEFLSKL (MAGC3_HUMAN)
RSVLEFLSKV

SEQ ID NO: 102487 - protein, 10 aa, Artificial Sequence
  Description of Artificial Sequence: Synthetic peptide
  Seed: YSAFHLGHLR (MAGC3_HUMAN)
YKAFHLGHLR

SEQ ID NO: 102488 - protein, 9 aa, Artificial Sequence
  Description of Artificial Sequence: Synthetic peptide
  Seed: KDMEDRAQA (MAGC3_HUMAN)
KEMEDRAQI

SEQ ID NO: 102489 - protein, 10 aa, Artificial Sequence
  Description of Artificial Sequence: Synthetic peptide
  Seed: TTDDATAMAS (MAGC3_HUMAN)
TVDDATAMAL

SEQ ID NO: 102490 - protein, 9 aa, Artificial Sequence
  Description of Artificial Sequence: Synthetic peptide
  Seed: FKLWRTLSG (MAGC3_HUMAN)
FQLWRTLSA

SEQ ID NO: 102491 - protein, 11 aa, Artificial Sequence
  Description of Artificial Sequence: Synthetic peptide
  Seed: ALWESEGPEAF (MAGC3_HUMAN)
AVWESEGPEAW

SEQ ID NO: 102492 - protein, 9 aa, Artificial Sequence
  Description of Artificial Sequence: Synthetic peptide
  Seed: MDPDNHSYF (MAGC3_HUMAN)
MRPDNHSYL

SEQ ID NO: 102493 - protein, 10 aa, Artificial Sequence
  Description of Artificial Sequence: Synthetic peptide
  Seed: YTGYFPMIFR (MAGC3_HUMAN)
YYGYFPMIFR

SEQ ID NO: 102494 - protein, 10 aa, Artificial Sequence
  Description of Artificial Sequence: Synthetic peptide
  Seed: MDSLVLCPTY (MAGC3_HUMAN)
MQSLVLCPTF

SEQ ID NO: 102495 - protein, 9 aa, Artificial Sequence
  Description of Artificial Sequence: Synthetic peptide
  Seed: NTYTGYFPM (MAGC3_HUMAN)
NVYTGYFPW

SEQ ID NO: 102496 - protein, 9 aa, Artificial Sequence
  Description of Artificial Sequence: Synthetic peptide
  Seed: SASPSVMST (MAGC3_HUMAN)
SESPSVMSL

SEQ ID NO: 102497 - protein, 11 aa, Artificial Sequence
  Description of Artificial Sequence: Synthetic peptide
  Seed: TSDQRMDSLVL (MAGC3_HUMAN)
TFDQRMDSLVF

SEQ ID NO: 102498 - protein, 9 aa, Artificial Sequence
  Description of Artificial Sequence: Synthetic peptide
  Seed: KVAELVQFL (MAGC3_HUMAN)
KGAELVQFW

SEQ ID NO: 102499 - protein, 9 aa, Artificial Sequence
  Description of Artificial Sequence: Synthetic peptide
  Seed: NTYTGYFPM (MAGC3_HUMAN)
NGYTGYFPF

SEQ ID NO: 102500 - protein, 10 aa, Artificial Sequence
  Description of Artificial Sequence: Synthetic peptide
  Seed: IGPWSALAGF (MAGC3_HUMAN)
IMPWSALAGY

SEQ ID NO: 102501 - protein, 9 aa, Artificial Sequence
  Description of Artificial Sequence: Synthetic peptide
  Seed: YFFEDTLDL (MAGC3_HUMAN)
YPFEDTLDQ

SEQ ID NO: 102502 - protein, 8 aa, Artificial Sequence
  Description of Artificial Sequence: Synthetic peptide
  Seed: FADVLSRL (MAGC3_HUMAN)
FFDVLSRF

SEQ ID NO: 102503 - protein, 9 aa, Artificial Sequence
  Description of Artificial Sequence: Synthetic peptide
  Seed: LILSMIFIK (MAGC3_HUMAN)
LWLSMIFIR

SEQ ID NO: 102504 - protein, 10 aa, Artificial Sequence
  Description of Artificial Sequence: Synthetic peptide
  Seed: EKVAELVQFL (MAGC3_HUMAN)
EQVAELVQFY

SEQ ID NO: 102505 - protein, 10 aa, Artificial Sequence
  Description of Artificial Sequence: Synthetic peptide
  Seed: INTYTGYFPM (MAGC3_HUMAN)
IDTYTGYFPW

SEQ ID NO: 102506 - protein, 9 aa, Artificial Sequence
  Description of Artificial Sequence: Synthetic peptide
  Seed: TYFKLWRTL (MAGC3_HUMAN)
TWFKLWRTW

SEQ ID NO: 102507 - protein, 9 aa, Artificial Sequence
  Description of Artificial Sequence: Synthetic peptide
  Seed: VINTYTGYF (MAGC3_HUMAN)
VLNTYTGYF

SEQ ID NO: 102508 - protein, 9 aa, Artificial Sequence
  Description of Artificial Sequence: Synthetic peptide
  Seed: KYKDYFPMI (MAGC3_HUMAN)
KTKDYFPMG

SEQ ID NO: 102509 - protein, 9 aa, Artificial Sequence
  Description of Artificial Sequence: Synthetic peptide
  Seed: ATYALSPVV (MAGC3_HUMAN)
AEYALSPVI

SEQ ID NO: 102510 - protein, 11 aa, Artificial Sequence
  Description of Artificial Sequence: Synthetic peptide
  Seed: EVLSAIGPIQR (MAGC3_HUMAN)
EVLSAIGPIQK

SEQ ID NO: 102511 - protein, 10 aa, Artificial Sequence
  Description of Artificial Sequence: Synthetic peptide
  Seed: SPLDSCSSPL (MAGC3_HUMAN)
SILDSCSSPV

SEQ ID NO: 102512 - protein, 9 aa, Artificial Sequence
  Description of Artificial Sequence: Synthetic peptide
  Seed: HALPESESL (MAGC3_HUMAN)
HELPESESV

SEQ ID NO: 102513 - protein, 9 aa, Artificial Sequence
  Description of Artificial Sequence: Synthetic peptide
  Seed: MASASPSVM (MAGC3_HUMAN)
MPSASPSVT

SEQ ID NO: 102514 - protein, 11 aa, Artificial Sequence
  Description of Artificial Sequence: Synthetic peptide
  Seed: TYTGYFPMIFR (MAGC3_HUMAN)
TTTGYFPMIFR

SEQ ID NO: 102515 - protein, 10 aa, Artificial Sequence
  Description of Artificial Sequence: Synthetic peptide
  Seed: EKVAELVQFL (MAGC3_HUMAN)
EGVAELVQFI

SEQ ID NO: 102516 - protein, 10 aa, Artificial Sequence
  Description of Artificial Sequence: Synthetic peptide
  Seed: IELIFGIALT (MAGC3_HUMAN)
IKLIFGIALI

SEQ ID NO: 102517 - protein, 10 aa, Artificial Sequence
  Description of Artificial Sequence: Synthetic peptide
  Seed: KKYKDYFPMI (MAGC3_HUMAN)
KFYKDYFPMK

SEQ ID NO: 102518 - protein, 9 aa, Artificial Sequence
  Description of Artificial Sequence: Synthetic peptide
  Seed: MIFGKAHEF (MAGC3_HUMAN)
MPFGKAHEA

SEQ ID NO: 102519 - protein, 9 aa, Artificial Sequence
  Description of Artificial Sequence: Synthetic peptide
  Seed: LRSAEGSVL (MAGC3_HUMAN)
LLSAEGSVF

SEQ ID NO: 102520 - protein, 11 aa, Artificial Sequence
  Description of Artificial Sequence: Synthetic peptide
  Seed: TSDQRMDSLVL (MAGC3_HUMAN)
TKDQRMDSLVY

SEQ ID NO: 102521 - protein, 9 aa, Artificial Sequence
  Description of Artificial Sequence: Synthetic peptide
  Seed: MLTTVIKKY (MAGC3_HUMAN)
MATTVIKKY

SEQ ID NO: 102522 - protein, 9 aa, Artificial Sequence
  Description of Artificial Sequence: Synthetic peptide
  Seed: KDMEDRAQA (MAGC3_HUMAN)
KDMEDRAQF

SEQ ID NO: 102523 - protein, 9 aa, Artificial Sequence
  Description of Artificial Sequence: Synthetic peptide
  Seed: QGMPQNRLL (MAGC3_HUMAN)
QAMPQNRLM

SEQ ID NO: 102524 - protein, 9 aa, Artificial Sequence
  Description of Artificial Sequence: Synthetic peptide
  Seed: FGSQPEGKF (MAGC3_HUMAN)
FVSQPEGKF

SEQ ID NO: 102525 - protein, 10 aa, Artificial Sequence
  Description of Artificial Sequence: Synthetic peptide
  Seed: EVIWEVLNAI (MAGC3_HUMAN)
EMIWEVLNAV

SEQ ID NO: 102526 - protein, 10 aa, Artificial Sequence
  Description of Artificial Sequence: Synthetic peptide
  Seed: IPSAFPSWYM (MAGC3_HUMAN)
IRSAFPSWYW

SEQ ID NO: 102527 - protein, 10 aa, Artificial Sequence
  Description of Artificial Sequence: Synthetic peptide
  Seed: MDSLVLCPTY (MAGC3_HUMAN)
MHSLVLCPTF

SEQ ID NO: 102528 - protein, 8 aa, Artificial Sequence
  Description of Artificial Sequence: Synthetic peptide
  Seed: YTLSLPAV (MAGC3_HUMAN)
YLLSLPAV

SEQ ID NO: 102529 - protein, 10 aa, Artificial Sequence
  Description of Artificial Sequence: Synthetic peptide
  Seed: RLLILILSVI (MAGC3_HUMAN)
RRLILILSVV

SEQ ID NO: 102530 - protein, 9 aa, Artificial Sequence
  Description of Artificial Sequence: Synthetic peptide
  Seed: HFYVFVNTL (MAGC3_HUMAN)
HLYVFVNTM

SEQ ID NO: 102531 - protein, 9 aa, Artificial Sequence
  Description of Artificial Sequence: Synthetic peptide
  Seed: SAIGPIQRP (MAGC3_HUMAN)
SAIGPIQRI

SEQ ID NO: 102532 - protein, 10 aa, Artificial Sequence
  Description of Artificial Sequence: Synthetic peptide
  Seed: TTDDATAMAS (MAGC3_HUMAN)
TLDDATAMAL

SEQ ID NO: 102533 - protein, 10 aa, Artificial Sequence
  Description of Artificial Sequence: Synthetic peptide
  Seed: YSAFHLGHLR (MAGC3_HUMAN)
YCAFHLGHLR

SEQ ID NO: 102534 - protein, 10 aa, Artificial Sequence
  Description of Artificial Sequence: Synthetic peptide
  Seed: YALSPVVLPP (MAGC3_HUMAN)
YLLSPVVLPL

SEQ ID NO: 102535 - protein, 10 aa, Artificial Sequence
  Description of Artificial Sequence: Synthetic peptide
  Seed: KDSDLPTWRR (MAGC3_HUMAN)
KMSDLPTWRK

SEQ ID NO: 102536 - protein, 9 aa, Artificial Sequence
  Description of Artificial Sequence: Synthetic peptide
  Seed: AMASASPSV (MAGC3_HUMAN)
AVASASPSF

SEQ ID NO: 102537 - protein, 10 aa, Artificial Sequence
  Description of Artificial Sequence: Synthetic peptide
  Seed: KVAELVQFLL (MAGC3_HUMAN)
KLAELVQFLI

SEQ ID NO: 102538 - protein, 10 aa, Artificial Sequence
  Description of Artificial Sequence: Synthetic peptide
  Seed: REVRLFLRGG (MAGC3_HUMAN)
RFVRLFLRGA

SEQ ID NO: 102539 - protein, 9 aa, Artificial Sequence
  Description of Artificial Sequence: Synthetic peptide
  Seed: RGTGYTLSL (MAGC3_HUMAN)
RTTGYTLSW

SEQ ID NO: 102540 - protein, 10 aa, Artificial Sequence
  Description of Artificial Sequence: Synthetic peptide
  Seed: INTYTGYFPM (MAGC3_HUMAN)
ICTYTGYFPW

SEQ ID NO: 102541 - protein, 9 aa, Artificial Sequence
  Description of Artificial Sequence: Synthetic peptide
  Seed: SASPSVMST (MAGC3_HUMAN)
SASPSVMSI

SEQ ID NO: 102542 - protein, 9 aa, Artificial Sequence
  Description of Artificial Sequence: Synthetic peptide
  Seed: HFYVFVNTL (MAGC3_HUMAN)
HQYVFVNTV

SEQ ID NO: 102543 - protein, 9 aa, Artificial Sequence
  Description of Artificial Sequence: Synthetic peptide
  Seed: SLVLCPTYF (MAGC3_HUMAN)
SYVLCPTYW

SEQ ID NO: 102544 - protein, 9 aa, Artificial Sequence
  Description of Artificial Sequence: Synthetic peptide
  Seed: LSSIIPSAF (MAGC3_HUMAN)
LLSIIPSAW

SEQ ID NO: 102545 - protein, 9 aa, Artificial Sequence
  Description of Artificial Sequence: Synthetic peptide
  Seed: MIFRKAREF (MAGC3_HUMAN)
MAFRKAREW

SEQ ID NO: 102546 - protein, 10 aa, Artificial Sequence
  Description of Artificial Sequence: Synthetic peptide
  Seed: MPAAGMPPLP (MAGC3_HUMAN)
MPAAGMPPLK

SEQ ID NO: 102547 - protein, 9 aa, Artificial Sequence
  Description of Artificial Sequence: Synthetic peptide
  Seed: NAIGPWSAL (MAGC3_HUMAN)
NLIGPWSAM

SEQ ID NO: 102548 - protein, 9 aa, Artificial Sequence
  Description of Artificial Sequence: Synthetic peptide
  Seed: ALDEKVAEL (MAGC3_HUMAN)
ATDEKVAEA

SEQ ID NO: 102549 - protein, 9 aa, Artificial Sequence
  Description of Artificial Sequence: Synthetic peptide
  Seed: TEASPQQKK (MAGC3_HUMAN)
TVASPQQKK

SEQ ID NO: 102550 - protein, 9 aa, Artificial Sequence
  Description of Artificial Sequence: Synthetic peptide
  Seed: MLLPCHWVL (MAGC3_HUMAN)
MFLPCHWVF

SEQ ID NO: 102551 - protein, 9 aa, Artificial Sequence
  Description of Artificial Sequence: Synthetic peptide
  Seed: ELVQFLLLK (MAGC3_HUMAN)
EVVQFLLLK

SEQ ID NO: 102552 - protein, 10 aa, Artificial Sequence
  Description of Artificial Sequence: Synthetic peptide
  Seed: IELIFGIALT (MAGC3_HUMAN)
IFLIFGIALV

SEQ ID NO: 102553 - protein, 8 aa, Artificial Sequence
  Description of Artificial Sequence: Synthetic peptide
  Seed: SCSSPLLW (MAGC3_HUMAN)
SMSSPLLW

SEQ ID NO: 102554 - protein, 10 aa, Artificial Sequence
  Description of Artificial Sequence: Synthetic peptide
  Seed: VVLPPQPQPR (MAGC3_HUMAN)
VTLPPQPQPK

SEQ ID NO: 102555 - protein, 10 aa, Artificial Sequence
  Description of Artificial Sequence: Synthetic peptide
  Seed: LIFGIALTDM (MAGC3_HUMAN)
LIFGIALTDV

SEQ ID NO: 102556 - protein, 9 aa, Artificial Sequence
  Description of Artificial Sequence: Synthetic peptide
  Seed: SQPEGKFSL (MAGC3_HUMAN)
SYPEGKFSV

SEQ ID NO: 102557 - protein, 9 aa, Artificial Sequence
  Description of Artificial Sequence: Synthetic peptide
  Seed: WEVLSAIGP (MAGC3_HUMAN)
WEVLSAIGI

SEQ ID NO: 102558 - protein, 10 aa, Artificial Sequence
  Description of Artificial Sequence: Synthetic peptide
  Seed: KYKDYFPMIF (MAGC3_HUMAN)
KYKDYFPMII

SEQ ID NO: 102559 - protein, 10 aa, Artificial Sequence
  Description of Artificial Sequence: Synthetic peptide
  Seed: MQMNVINTYT (MAGC3_HUMAN)
MCMNVINTYA

SEQ ID NO: 102560 - protein, 10 aa, Artificial Sequence
  Description of Artificial Sequence: Synthetic peptide
  Seed: FSDGSLGQWV (MAGC3_HUMAN)
FSDGSLGQWF

SEQ ID NO: 102561 - protein, 9 aa, Artificial Sequence
  Description of Artificial Sequence: Synthetic peptide
  Seed: IQRPAREVL (MAGC3_HUMAN)
IIRPAREVM

SEQ ID NO: 102562 - protein, 9 aa, Artificial Sequence
  Description of Artificial Sequence: Synthetic peptide
  Seed: ELIFGIALT (MAGC3_HUMAN)
ETIFGIALM

SEQ ID NO: 102563 - protein, 10 aa, Artificial Sequence
  Description of Artificial Sequence: Synthetic peptide
  Seed: KVAELVQFLL (MAGC3_HUMAN)
KQAELVQFLV

SEQ ID NO: 102564 - protein, 9 aa, Artificial Sequence
  Description of Artificial Sequence: Synthetic peptide
  Seed: HFYVFVNTL (MAGC3_HUMAN)
HQYVFVNTY

SEQ ID NO: 102565 - protein, 10 aa, Artificial Sequence
  Description of Artificial Sequence: Synthetic peptide
  Seed: KVAELVQFLL (MAGC3_HUMAN)
KEAELVQFLW

SEQ ID NO: 102566 - protein, 10 aa, Artificial Sequence
  Description of Artificial Sequence: Synthetic peptide
  Seed: KLSSIIPSAF (MAGC3_HUMAN)
KMSSIIPSAI

SEQ ID NO: 102567 - protein, 9 aa, Artificial Sequence
  Description of Artificial Sequence: Synthetic peptide
  Seed: LRSAEGSVL (MAGC3_HUMAN)
LVSAEGSVY

SEQ ID NO: 102568 - protein, 10 aa, Artificial Sequence
  Description of Artificial Sequence: Synthetic peptide
  Seed: VVLPPQPQPR (MAGC3_HUMAN)
VSLPPQPQPM

SEQ ID NO: 102569 - protein, 10 aa, Artificial Sequence
  Description of Artificial Sequence: Synthetic peptide
  Seed: TTDDATAMAS (MAGC3_HUMAN)
TIDDATAMAL

SEQ ID NO: 102570 - protein, 9 aa, Artificial Sequence
  Description of Artificial Sequence: Synthetic peptide
  Seed: HFYVFVNTL (MAGC3_HUMAN)
HDYVFVNTV

SEQ ID NO: 102571 - protein, 9 aa, Artificial Sequence
  Description of Artificial Sequence: Synthetic peptide
  Seed: AMASASPSV (MAGC3_HUMAN)
AQASASPSM

SEQ ID NO: 102572 - protein, 10 aa, Artificial Sequence
  Description of Artificial Sequence: Synthetic peptide
  Seed: MLTTVIKKYK (MAGC3_HUMAN)
MHTTVIKKYR

SEQ ID NO: 102573 - protein, 9 aa, Artificial Sequence
  Description of Artificial Sequence: Synthetic peptide
  Seed: SLRRAVSVK (MAGC3_HUMAN)
STRRAVSVS

SEQ ID NO: 102574 - protein, 9 aa, Artificial Sequence
  Description of Artificial Sequence: Synthetic peptide
  Seed: FLLLKYQAK (MAGC3_HUMAN)
FTLLKYQAK

SEQ ID NO: 102575 - protein, 9 aa, Artificial Sequence
  Description of Artificial Sequence: Synthetic peptide
  Seed: HALPESESL (MAGC3_HUMAN)
HELPESESM

SEQ ID NO: 102576 - protein, 11 aa, Artificial Sequence
  Description of Artificial Sequence: Synthetic peptide
  Seed: AEMQMNVINTY (MAGC3_HUMAN)
AIMQMNVINTF

SEQ ID NO: 102577 - protein, 9 aa, Artificial Sequence
  Description of Artificial Sequence: Synthetic peptide
  Seed: KGSCVPEEV (MAGC3_HUMAN)
KQSCVPEEV

SEQ ID NO: 102578 - protein, 9 aa, Artificial Sequence
  Description of Artificial Sequence: Synthetic peptide
  Seed: LSSIIPSAF (MAGC3_HUMAN)
LPSIIPSAI

SEQ ID NO: 102579 - protein, 11 aa, Artificial Sequence
  Description of Artificial Sequence: Synthetic peptide
  Seed: YALDEKVAELV (MAGC3_HUMAN)
YMLDEKVAELR

SEQ ID NO: 102580 - protein, 9 aa, Artificial Sequence
  Description of Artificial Sequence: Synthetic peptide
  Seed: VDPDHFYVF (MAGC3_HUMAN)
VCPDHFYVL

SEQ ID NO: 102581 - protein, 9 aa, Artificial Sequence
  Description of Artificial Sequence: Synthetic peptide
  Seed: SLRRAVSVK (MAGC3_HUMAN)
SIRRAVSVL

SEQ ID NO: 102582 - protein, 9 aa, Artificial Sequence
  Description of Artificial Sequence: Synthetic peptide
  Seed: HSYFFEDTL (MAGC3_HUMAN)
HEYFFEDTL

SEQ ID NO: 102583 - protein, 9 aa, Artificial Sequence
  Description of Artificial Sequence: Synthetic peptide
  Seed: KVDKLVQFL (MAGC3_HUMAN)
KLDKLVQFR

SEQ ID NO: 102584 - protein, 9 aa, Artificial Sequence
  Description of Artificial Sequence: Synthetic peptide
  Seed: NAIGPWSAL (MAGC3_HUMAN)
NLIGPWSAF

SEQ ID NO: 102585 - protein, 9 aa, Artificial Sequence
  Description of Artificial Sequence: Synthetic peptide
  Seed: MASASPSVM (MAGC3_HUMAN)
MFSASPSVL

SEQ ID NO: 102586 - protein, 9 aa, Artificial Sequence
  Description of Artificial Sequence: Synthetic peptide
  Seed: KLVQFLLLK (MAGC3_HUMAN)
KLVQFLLLM

SEQ ID NO: 102587 - protein, 9 aa, Artificial Sequence
  Description of Artificial Sequence: Synthetic peptide
  Seed: QGMPQNRLL (MAGC3_HUMAN)
QAMPQNRLY

SEQ ID NO: 102588 - protein, 9 aa, Artificial Sequence
  Description of Artificial Sequence: Synthetic peptide
  Seed: KVDKLVQFL (MAGC3_HUMAN)
KRDKLVQFF

SEQ ID NO: 102589 - protein, 9 aa, Artificial Sequence
  Description of Artificial Sequence: Synthetic peptide
  Seed: VDPDHFYVF (MAGC3_HUMAN)
VFPDHFYVM

SEQ ID NO: 102590 - protein, 9 aa, Artificial Sequence
  Description of Artificial Sequence: Synthetic peptide
  Seed: KLVQFLLLK (MAGC3_HUMAN)
KFVQFLLLR

SEQ ID NO: 102591 - protein, 9 aa, Artificial Sequence
  Description of Artificial Sequence: Synthetic peptide
  Seed: NTYTGYFPM (MAGC3_HUMAN)
NGYTGYFPK

SEQ ID NO: 102592 - protein, 11 aa, Artificial Sequence
  Description of Artificial Sequence: Synthetic peptide
  Seed: SASPSVMSTNF (MAGC3_HUMAN)
SQSPSVMSTNY

SEQ ID NO: 102593 - protein, 9 aa, Artificial Sequence
  Description of Artificial Sequence: Synthetic peptide
  Seed: DTTDDATAM (MAGC3_HUMAN)
DATDDATAR

SEQ ID NO: 102594 - protein, 9 aa, Artificial Sequence
  Description of Artificial Sequence: Synthetic peptide
  Seed: MQMNVINTY (MAGC3_HUMAN)
MSMNVINTR

SEQ ID NO: 102595 - protein, 9 aa, Artificial Sequence
  Description of Artificial Sequence: Synthetic peptide
  Seed: RTLSGSPGL (MAGC3_HUMAN)
RMLSGSPGM

SEQ ID NO: 102596 - protein, 9 aa, Artificial Sequence
  Description of Artificial Sequence: Synthetic peptide
  Seed: LSSIIPSAF (MAGC3_HUMAN)
LASIIPSAW

SEQ ID NO: 102597 - protein, 9 aa, Artificial Sequence
  Description of Artificial Sequence: Synthetic peptide
  Seed: RGTGYTLSL (MAGC3_HUMAN)
RKTGYTLSF

SEQ ID NO: 102598 - protein, 9 aa, Artificial Sequence
  Description of Artificial Sequence: Synthetic peptide
  Seed: VINTYTGYF (MAGC3_HUMAN)
VFNTYTGYF

SEQ ID NO: 102599 - protein, 10 aa, Artificial Sequence
  Description of Artificial Sequence: Synthetic peptide
  Seed: MDPDNHSYFF (MAGC3_HUMAN)
MTPDNHSYFW

SEQ ID NO: 102600 - protein, 10 aa, Artificial Sequence
  Description of Artificial Sequence: Synthetic peptide
  Seed: RLLILILSVI (MAGC3_HUMAN)
RLLILILSVV

SEQ ID NO: 102601 - protein, 9 aa, Artificial Sequence
  Description of Artificial Sequence: Synthetic peptide
  Seed: MIFGKAHEF (MAGC3_HUMAN)
MLFGKAHEC

SEQ ID NO: 102602 - protein, 10 aa, Artificial Sequence
  Description of Artificial Sequence: Synthetic peptide
  Seed: SIIPSAFPSW (MAGC3_HUMAN)
SEIPSAFPSY

SEQ ID NO: 102603 - protein, 10 aa, Artificial Sequence
  Description of Artificial Sequence: Synthetic peptide
  Seed: YALDEKVAEL (MAGC3_HUMAN)
YCLDEKVAEV

SEQ ID NO: 102604 - protein, 9 aa, Artificial Sequence
  Description of Artificial Sequence: Synthetic peptide
  Seed: LSGSPGLQL (MAGC3_HUMAN)
LQGSPGLQM

SEQ ID NO: 102605 - protein, 9 aa, Artificial Sequence
  Description of Artificial Sequence: Synthetic peptide
  Seed: ILILSMIFI (MAGC3_HUMAN)
ISILSMIFV

SEQ ID NO: 102606 - protein, 9 aa, Artificial Sequence
  Description of Artificial Sequence: Synthetic peptide
  Seed: LILSMIFIK (MAGC3_HUMAN)
LTLSMIFIK

SEQ ID NO: 102607 - protein, 9 aa, Artificial Sequence
  Description of Artificial Sequence: Synthetic peptide
  Seed: SCVPEEVIW (MAGC3_HUMAN)
SPVPEEVIW

SEQ ID NO: 102608 - protein, 10 aa, Artificial Sequence
  Description of Artificial Sequence: Synthetic peptide
  Seed: TGYFPMIFRK (MAGC3_HUMAN)
TTYFPMIFRY

SEQ ID NO: 102609 - protein, 9 aa, Artificial Sequence
  Description of Artificial Sequence: Synthetic peptide
  Seed: MPAAGMPPL (MAGC3_HUMAN)
MNAAGMPPV

SEQ ID NO: 102610 - protein, 9 aa, Artificial Sequence
  Description of Artificial Sequence: Synthetic peptide
  Seed: MPAAGMPPL (MAGC3_HUMAN)
MYAAGMPPL

SEQ ID NO: 102611 - protein, 9 aa, Artificial Sequence
  Description of Artificial Sequence: Synthetic peptide
  Seed: RTLSGSPGL (MAGC3_HUMAN)
RSLSGSPGM

SEQ ID NO: 102612 - protein, 9 aa, Artificial Sequence
  Description of Artificial Sequence: Synthetic peptide
  Seed: IIPSAFPSW (MAGC3_HUMAN)
ISPSAFPSM

SEQ ID NO: 102613 - protein, 9 aa, Artificial Sequence
  Description of Artificial Sequence: Synthetic peptide
  Seed: QTKEPVTKA (MAGC3_HUMAN)
QLKEPVTKM

SEQ ID NO: 102614 - protein, 9 aa, Artificial Sequence
  Description of Artificial Sequence: Synthetic peptide
  Seed: YFFEDTLDL (MAGC3_HUMAN)
YAFEDTLDY

SEQ ID NO: 102615 - protein, 10 aa, Artificial Sequence
  Description of Artificial Sequence: Synthetic peptide
  Seed: TGYFPMIFRK (MAGC3_HUMAN)
TAYFPMIFRR

SEQ ID NO: 102616 - protein, 9 aa, Artificial Sequence
  Description of Artificial Sequence: Synthetic peptide
  Seed: MQMNVINTY (MAGC3_HUMAN)
MAMNVINTH

SEQ ID NO: 102617 - protein, 9 aa, Artificial Sequence
  Description of Artificial Sequence: Synthetic peptide
  Seed: SQPEGKFSL (MAGC3_HUMAN)
SMPEGKFSR

SEQ ID NO: 102618 - protein, 11 aa, Artificial Sequence
  Description of Artificial Sequence: Synthetic peptide
  Seed: LTDMDPDNHSY (MAGC3_HUMAN)
LIDMDPDNHSM

SEQ ID NO: 102619 - protein, 9 aa, Artificial Sequence
  Description of Artificial Sequence: Synthetic peptide
  Seed: KEPVTKAEM (MAGC3_HUMAN)
KRPVTKAEY

SEQ ID NO: 102620 - protein, 9 aa, Artificial Sequence
  Description of Artificial Sequence: Synthetic peptide
  Seed: SAFHLGHLR (MAGC3_HUMAN)
SSFHLGHLR

SEQ ID NO: 102621 - protein, 9 aa, Artificial Sequence
  Description of Artificial Sequence: Synthetic peptide
  Seed: WESEGPEAF (MAGC3_HUMAN)
WASEGPEAY

SEQ ID NO: 102622 - protein, 9 aa, Artificial Sequence
  Description of Artificial Sequence: Synthetic peptide
  Seed: GYFPMIFRK (MAGC3_HUMAN)
GGFPMIFRR

SEQ ID NO: 102623 - protein, 9 aa, Artificial Sequence
  Description of Artificial Sequence: Synthetic peptide
  Seed: YSAFHLGHL (MAGC3_HUMAN)
YMAFHLGHM

SEQ ID NO: 102624 - protein, 9 aa, Artificial Sequence
  Description of Artificial Sequence: Synthetic peptide
  Seed: FSLRRAVSV (MAGC3_HUMAN)
FLLRRAVSF

SEQ ID NO: 102625 - protein, 9 aa, Artificial Sequence
  Description of Artificial Sequence: Synthetic peptide
  Seed: HFYVFVNTL (MAGC3_HUMAN)
HYYVFVNTF

SEQ ID NO: 102626 - protein, 9 aa, Artificial Sequence
  Description of Artificial Sequence: Synthetic peptide
  Seed: AAGMPPLPQ (MAGC3_HUMAN)
AAGMPPLPL

SEQ ID NO: 102627 - protein, 8 aa, Artificial Sequence
  Description of Artificial Sequence: Synthetic peptide
  Seed: FADVLSRL (MAGC3_HUMAN)
FTDVLSRV

SEQ ID NO: 102628 - protein, 9 aa, Artificial Sequence
  Description of Artificial Sequence: Synthetic peptide
  Seed: ATDKDYSAF (MAGC3_HUMAN)
ACDKDYSAL

SEQ ID NO: 102629 - protein, 10 aa, Artificial Sequence
  Description of Artificial Sequence: Synthetic peptide
  Seed: RSAEGSVLDL (MAGC3_HUMAN)
RMAEGSVLDF

SEQ ID NO: 102630 - protein, 9 aa, Artificial Sequence
  Description of Artificial Sequence: Synthetic peptide
  Seed: RGTGYTLSL (MAGC3_HUMAN)
RYTGYTLSY

SEQ ID NO: 102631 - protein, 9 aa, Artificial Sequence
  Description of Artificial Sequence: Synthetic peptide
  Seed: KVAELVQFL (MAGC3_HUMAN)
KMAELVQFA

SEQ ID NO: 102632 - protein, 10 aa, Artificial Sequence
  Description of Artificial Sequence: Synthetic peptide
  Seed: LDSCSSPLLW (MAGC3_HUMAN)
LHSCSSPLLW

SEQ ID NO: 102633 - protein, 10 aa, Artificial Sequence
  Description of Artificial Sequence: Synthetic peptide
  Seed: RLWGEKAGSL (MAGC3_HUMAN)
RQWGEKAGSF

SEQ ID NO: 102634 - protein, 9 aa, Artificial Sequence
  Description of Artificial Sequence: Synthetic peptide
  Seed: YTGYFPMIF (MAGC3_HUMAN)
YWGYFPMIL

SEQ ID NO: 102635 - protein, 9 aa, Artificial Sequence
  Description of Artificial Sequence: Synthetic peptide
  Seed: PESEPLFTY (MAGC3_HUMAN)
PMSEPLFTY

SEQ ID NO: 102636 - protein, 10 aa, Artificial Sequence
  Description of Artificial Sequence: Synthetic peptide
  Seed: TCATYALSPV (MAGC3_HUMAN)
TIATYALSPV

SEQ ID NO: 102637 - protein, 9 aa, Artificial Sequence
  Description of Artificial Sequence: Synthetic peptide
  Seed: KEPLTRAEM (MAGC3_HUMAN)
KEPLTRAEL

SEQ ID NO: 102638 - protein, 10 aa, Artificial Sequence
  Description of Artificial Sequence: Synthetic peptide
  Seed: YALDEKVAEL (MAGC3_HUMAN)
YALDEKVAEC

SEQ ID NO: 102639 - protein, 10 aa, Artificial Sequence
  Description of Artificial Sequence: Synthetic peptide
  Seed: FGKAHEFIEL (MAGC3_HUMAN)
FMKAHEFIEM

SEQ ID NO: 102640 - protein, 10 aa, Artificial Sequence
  Description of Artificial Sequence: Synthetic peptide
  Seed: FSDGSLGQWV (MAGC3_HUMAN)
FMDGSLGQWY

SEQ ID NO: 102641 - protein, 9 aa, Artificial Sequence
  Description of Artificial Sequence: Synthetic peptide
  Seed: SAIGPIQRP (MAGC3_HUMAN)
SQIGPIQRF

SEQ ID NO: 102642 - protein, 10 aa, Artificial Sequence
  Description of Artificial Sequence: Synthetic peptide
  Seed: TTDDATAMAS (MAGC3_HUMAN)
TIDDATAMAY

SEQ ID NO: 102643 - protein, 9 aa, Artificial Sequence
  Description of Artificial Sequence: Synthetic peptide
  Seed: FPSWYMDAL (MAGC3_HUMAN)
FPSWYMDAY

SEQ ID NO: 102644 - protein, 9 aa, Artificial Sequence
  Description of Artificial Sequence: Synthetic peptide
  Seed: YSAFHLGHL (MAGC3_HUMAN)
YAAFHLGHV

SEQ ID NO: 102645 - protein, 10 aa, Artificial Sequence
  Description of Artificial Sequence: Synthetic peptide
  Seed: IPSAFPSWYM (MAGC3_HUMAN)
IESAFPSWYF

SEQ ID NO: 102646 - protein, 9 aa, Artificial Sequence
  Description of Artificial Sequence: Synthetic peptide
  Seed: SASPSVMST (MAGC3_HUMAN)
SGSPSVMSY

SEQ ID NO: 102647 - protein, 10 aa, Artificial Sequence
  Description of Artificial Sequence: Synthetic peptide
  Seed: MDSLVLCPTY (MAGC3_HUMAN)
MVSLVLCPTW

SEQ ID NO: 102648 - protein, 9 aa, Artificial Sequence
  Description of Artificial Sequence: Synthetic peptide
  Seed: VLCPTYFKL (MAGC3_HUMAN)
VSCPTYFKM

SEQ ID NO: 102649 - protein, 9 aa, Artificial Sequence
  Description of Artificial Sequence: Synthetic peptide
  Seed: MPAAGMPPL (MAGC3_HUMAN)
MAAAGMPPM

SEQ ID NO: 102650 - protein, 10 aa, Artificial Sequence
  Description of Artificial Sequence: Synthetic peptide
  Seed: SCSSPLLWTR (MAGC3_HUMAN)
SFSSPLLWTK

SEQ ID NO: 102651 - protein, 10 aa, Artificial Sequence
  Description of Artificial Sequence: Synthetic peptide
  Seed: SDQRMDSLVL (MAGC3_HUMAN)
SSQRMDSLVM

SEQ ID NO: 102652 - protein, 9 aa, Artificial Sequence
  Description of Artificial Sequence: Synthetic peptide
  Seed: QPQPRKKAT (MAGC3_HUMAN)
QPQPRKKAF

SEQ ID NO: 102653 - protein, 9 aa, Artificial Sequence
  Description of Artificial Sequence: Synthetic peptide
  Seed: TAMASASPS (MAGC3_HUMAN)
TVMASASPM

SEQ ID NO: 102654 - protein, 9 aa, Artificial Sequence
  Description of Artificial Sequence: Synthetic peptide
  Seed: DYFPMIFGK (MAGC3_HUMAN)
DYFPMIFGR

SEQ ID NO: 102655 - protein, 11 aa, Artificial Sequence
  Description of Artificial Sequence: Synthetic peptide
  Seed: FIELIFGIALT (MAGC3_HUMAN)
FIELIFGIALV

SEQ ID NO: 102656 - protein, 10 aa, Artificial Sequence
  Description of Artificial Sequence: Synthetic peptide
  Seed: YALDEKVAEL (MAGC3_HUMAN)
YMLDEKVAEL

SEQ ID NO: 102657 - protein, 9 aa, Artificial Sequence
  Description of Artificial Sequence: Synthetic peptide
  Seed: SQPEGKFSL (MAGC3_HUMAN)
SQPEGKFSY

SEQ ID NO: 102658 - protein, 9 aa, Artificial Sequence
  Description of Artificial Sequence: Synthetic peptide
  Seed: ELIFGIALT (MAGC3_HUMAN)
EIIFGIALL

SEQ ID NO: 102659 - protein, 9 aa, Artificial Sequence
  Description of Artificial Sequence: Synthetic peptide
  Seed: MIFRKAREF (MAGC3_HUMAN)
MEFRKAREF

SEQ ID NO: 102660 - protein, 9 aa, Artificial Sequence
  Description of Artificial Sequence: Synthetic peptide
  Seed: HSYFFEDTL (MAGC3_HUMAN)
HHYFFEDTI

SEQ ID NO: 102661 - protein, 10 aa, Artificial Sequence
  Description of Artificial Sequence: Synthetic peptide
  Seed: LPESEPLFTY (MAGC3_HUMAN)
LPESEPLFTW

SEQ ID NO: 102662 - protein, 9 aa, Artificial Sequence
  Description of Artificial Sequence: Synthetic peptide
  Seed: CLLILILSM (MAGC3_HUMAN)
CLLILILSV

SEQ ID NO: 102663 - protein, 9 aa, Artificial Sequence
  Description of Artificial Sequence: Synthetic peptide
  Seed: GYFPMIFRK (MAGC3_HUMAN)
GLFPMIFRV

SEQ ID NO: 102664 - protein, 9 aa, Artificial Sequence
  Description of Artificial Sequence: Synthetic peptide
  Seed: TSDQRMDSL (MAGC3_HUMAN)
TVDQRMDSV

SEQ ID NO: 102665 - protein, 9 aa, Artificial Sequence
  Description of Artificial Sequence: Synthetic peptide
  Seed: KAHEFIELI (MAGC3_HUMAN)
KTHEFIELA

SEQ ID NO: 102666 - protein, 10 aa, Artificial Sequence
  Description of Artificial Sequence: Synthetic peptide
  Seed: EEVIWEVLSA (MAGC3_HUMAN)
ELVIWEVLSV

SEQ ID NO: 102667 - protein, 9 aa, Artificial Sequence
  Description of Artificial Sequence: Synthetic peptide
  Seed: IELIFGIAL (MAGC3_HUMAN)
IQLIFGIAF

SEQ ID NO: 102668 - protein, 10 aa, Artificial Sequence
  Description of Artificial Sequence: Synthetic peptide
  Seed: WEVLSAIGPI (MAGC3_HUMAN)
WLVLSAIGPA

SEQ ID NO: 102669 - protein, 9 aa, Artificial Sequence
  Description of Artificial Sequence: Synthetic peptide
  Seed: MPAAGMPPL (MAGC3_HUMAN)
MWAAGMPPY

SEQ ID NO: 102670 - protein, 10 aa, Artificial Sequence
  Description of Artificial Sequence: Synthetic peptide
  Seed: YSAFHLGHLR (MAGC3_HUMAN)
YNAFHLGHLR

SEQ ID NO: 102671 - protein, 9 aa, Artificial Sequence
  Description of Artificial Sequence: Synthetic peptide
  Seed: HLREVRLFL (MAGC3_HUMAN)
HFREVRLFY

SEQ ID NO: 102672 - protein, 9 aa, Artificial Sequence
  Description of Artificial Sequence: Synthetic peptide
  Seed: LSDEQGMPQ (MAGC3_HUMAN)
LTDEQGMPV

SEQ ID NO: 102673 - protein, 9 aa, Artificial Sequence
  Description of Artificial Sequence: Synthetic peptide
  Seed: YTLDEKVDK (MAGC3_HUMAN)
YTLDEKVDY

SEQ ID NO: 102674 - protein, 9 aa, Artificial Sequence
  Description of Artificial Sequence: Synthetic peptide
  Seed: ILILSMIFI (MAGC3_HUMAN)
IQILSMIFV

SEQ ID NO: 102675 - protein, 9 aa, Artificial Sequence
  Description of Artificial Sequence: Synthetic peptide
  Seed: SASPSVMST (MAGC3_HUMAN)
SSSPSVMSM

SEQ ID NO: 102676 - protein, 8 aa, Artificial Sequence
  Description of Artificial Sequence: Synthetic peptide
  Seed: KAHEFIEL (MAGC3_HUMAN)
KAHEFIEM

SEQ ID NO: 102677 - protein, 9 aa, Artificial Sequence
  Description of Artificial Sequence: Synthetic peptide
  Seed: LILILSVIF (MAGC3_HUMAN)
LTLILSVIF

SEQ ID NO: 102678 - protein, 10 aa, Artificial Sequence
  Description of Artificial Sequence: Synthetic peptide
  Seed: EVIWEVLNAI (MAGC3_HUMAN)
EFIWEVLNAL

SEQ ID NO: 102679 - protein, 10 aa, Artificial Sequence
  Description of Artificial Sequence: Synthetic peptide
  Seed: WEVLSAIGPI (MAGC3_HUMAN)
WMVLSAIGPV

SEQ ID NO: 102680 - protein, 11 aa, Artificial Sequence
  Description of Artificial Sequence: Synthetic peptide
  Seed: FIELIFGIALT (MAGC3_HUMAN)
FNELIFGIALV

SEQ ID NO: 102681 - protein, 9 aa, Artificial Sequence
  Description of Artificial Sequence: Synthetic peptide
  Seed: VIWEVLSAI (MAGC3_HUMAN)
VVWEVLSAV

SEQ ID NO: 102682 - protein, 9 aa, Artificial Sequence
  Description of Artificial Sequence: Synthetic peptide
  Seed: MQMNVINTY (MAGC3_HUMAN)
MMMNVINTT

SEQ ID NO: 102683 - protein, 10 aa, Artificial Sequence
  Description of Artificial Sequence: Synthetic peptide
  Seed: SLTEVDPDHF (MAGC3_HUMAN)
SQTEVDPDHF

SEQ ID NO: 102684 - protein, 9 aa, Artificial Sequence
  Description of Artificial Sequence: Synthetic peptide
  Seed: LKYQAKEPL (MAGC3_HUMAN)
LTYQAKEPY

SEQ ID NO: 102685 - protein, 9 aa, Artificial Sequence
  Description of Artificial Sequence: Synthetic peptide
  Seed: IIDTTDDAT (MAGC3_HUMAN)
ILDTTDDAM

SEQ ID NO: 102686 - protein, 11 aa, Artificial Sequence
  Description of Artificial Sequence: Synthetic peptide
  Seed: IIDTTDDATAM (MAGC3_HUMAN)
ILDTTDDATAF

SEQ ID NO: 102687 - protein, 11 aa, Artificial Sequence
  Description of Artificial Sequence: Synthetic peptide
  Seed: IIDTTDDATAM (MAGC3_HUMAN)
IMDTTDDATAV

SEQ ID NO: 102688 - protein, 9 aa, Artificial Sequence
  Description of Artificial Sequence: Synthetic peptide
  Seed: ALDEKVAEL (MAGC3_HUMAN)
AHDEKVAEL

SEQ ID NO: 102689 - protein, 9 aa, Artificial Sequence
  Description of Artificial Sequence: Synthetic peptide
  Seed: VIWEVLNAI (MAGC3_HUMAN)
VTWEVLNAM

SEQ ID NO: 102690 - protein, 10 aa, Artificial Sequence
  Description of Artificial Sequence: Synthetic peptide
  Seed: IELIFGIALT (MAGC3_HUMAN)
IELIFGIALL

SEQ ID NO: 102691 - protein, 10 aa, Artificial Sequence
  Description of Artificial Sequence: Synthetic peptide
  Seed: SKLSSIIPSA (MAGC3_HUMAN)
SELSSIIPSI

SEQ ID NO: 102692 - protein, 8 aa, Artificial Sequence
  Description of Artificial Sequence: Synthetic peptide
  Seed: AEMLTTVI (MAGC3_HUMAN)
AEMLTTVY

SEQ ID NO: 102693 - protein, 9 aa, Artificial Sequence
  Description of Artificial Sequence: Synthetic peptide
  Seed: YKDYFPMIF (MAGC3_HUMAN)
YRDYFPMIF

SEQ ID NO: 102694 - protein, 10 aa, Artificial Sequence
  Description of Artificial Sequence: Synthetic peptide
  Seed: EKVAELVQFL (MAGC3_HUMAN)
EQVAELVQFI

SEQ ID NO: 102695 - protein, 10 aa, Artificial Sequence
  Description of Artificial Sequence: Synthetic peptide
  Seed: RLLILILSVI (MAGC3_HUMAN)
RKLILILSVV

SEQ ID NO: 102696 - protein, 9 aa, Artificial Sequence
  Description of Artificial Sequence: Synthetic peptide
  Seed: DALKDMEDR (MAGC3_HUMAN)
DVLKDMEDR

SEQ ID NO: 102697 - protein, 10 aa, Artificial Sequence
  Description of Artificial Sequence: Synthetic peptide
  Seed: MQMNVINTYT (MAGC3_HUMAN)
MWMNVINTYY

SEQ ID NO: 102698 - protein, 9 aa, Artificial Sequence
  Description of Artificial Sequence: Synthetic peptide
  Seed: AMASASPSV (MAGC3_HUMAN)
ALASASPSL

SEQ ID NO: 102699 - protein, 9 aa, Artificial Sequence
  Description of Artificial Sequence: Synthetic peptide
  Seed: SIIPSAFPS (MAGC3_HUMAN)
SMIPSAFPA

SEQ ID NO: 102700 - protein, 9 aa, Artificial Sequence
  Description of Artificial Sequence: Synthetic peptide
  Seed: QTKEPVTKA (MAGC3_HUMAN)
QIKEPVTKK

SEQ ID NO: 102701 - protein, 9 aa, Artificial Sequence
  Description of Artificial Sequence: Synthetic peptide
  Seed: LSDEQGMPQ (MAGC3_HUMAN)
LVDEQGMPF

SEQ ID NO: 102702 - protein, 9 aa, Artificial Sequence
  Description of Artificial Sequence: Synthetic peptide
  Seed: MPAAGMPPL (MAGC3_HUMAN)
MSAAGMPPF

SEQ ID NO: 102703 - protein, 9 aa, Artificial Sequence
  Description of Artificial Sequence: Synthetic peptide
  Seed: HLREVRLFL (MAGC3_HUMAN)
HAREVRLFA

SEQ ID NO: 102704 - protein, 9 aa, Artificial Sequence
  Description of Artificial Sequence: Synthetic peptide
  Seed: GFADVLSRL (MAGC3_HUMAN)
GLADVLSRT

SEQ ID NO: 102705 - protein, 10 aa, Artificial Sequence
  Description of Artificial Sequence: Synthetic peptide
  Seed: TTDDATAMAS (MAGC3_HUMAN)
TSDDATAMAI

SEQ ID NO: 102706 - protein, 9 aa, Artificial Sequence
  Description of Artificial Sequence: Synthetic peptide
  Seed: LPTWRRGTG (MAGC3_HUMAN)
LPTWRRGTI

SEQ ID NO: 102707 - protein, 10 aa, Artificial Sequence
  Description of Artificial Sequence: Synthetic peptide
  Seed: YALDEKVAEL (MAGC3_HUMAN)
YYLDEKVAEM

SEQ ID NO: 102708 - protein, 9 aa, Artificial Sequence
  Description of Artificial Sequence: Synthetic peptide
  Seed: VLCPTYFKL (MAGC3_HUMAN)
VLCPTYFKK

SEQ ID NO: 102709 - protein, 9 aa, Artificial Sequence
  Description of Artificial Sequence: Synthetic peptide
  Seed: KAHEFIELI (MAGC3_HUMAN)
KLHEFIELL

SEQ ID NO: 102710 - protein, 9 aa, Artificial Sequence
  Description of Artificial Sequence: Synthetic peptide
  Seed: HFYVFVNTL (MAGC3_HUMAN)
HGYVFVNTF

SEQ ID NO: 102711 - protein, 9 aa, Artificial Sequence
  Description of Artificial Sequence: Synthetic peptide
  Seed: KVDKLVQFL (MAGC3_HUMAN)
KQDKLVQFM

SEQ ID NO: 102712 - protein, 10 aa, Artificial Sequence
  Description of Artificial Sequence: Synthetic peptide
  Seed: YSAFHLGHLR (MAGC3_HUMAN)
YMAFHLGHLK

SEQ ID NO: 102713 - protein, 9 aa, Artificial Sequence
  Description of Artificial Sequence: Synthetic peptide
  Seed: FADVLSRLA (MAGC3_HUMAN)
FADVLSRLF

SEQ ID NO: 102714 - protein, 9 aa, Artificial Sequence
  Description of Artificial Sequence: Synthetic peptide
  Seed: ALSPVVLPP (MAGC3_HUMAN)
AISPVVLPV

SEQ ID NO: 102715 - protein, 10 aa, Artificial Sequence
  Description of Artificial Sequence: Synthetic peptide
  Seed: EKVAELVQFL (MAGC3_HUMAN)
ELVAELVQFI

SEQ ID NO: 102716 - protein, 9 aa, Artificial Sequence
  Description of Artificial Sequence: Synthetic peptide
  Seed: ATYALSPVV (MAGC3_HUMAN)
AEYALSPVV

SEQ ID NO: 102717 - protein, 10 aa, Artificial Sequence
  Description of Artificial Sequence: Synthetic peptide
  Seed: LPTWRRGTGY (MAGC3_HUMAN)
LDTWRRGTGF

SEQ ID NO: 102718 - protein, 9 aa, Artificial Sequence
  Description of Artificial Sequence: Synthetic peptide
  Seed: QTKEPVTKA (MAGC3_HUMAN)
QVKEPVTKK

SEQ ID NO: 102719 - protein, 9 aa, Artificial Sequence
  Description of Artificial Sequence: Synthetic peptide
  Seed: QMNVINTYT (MAGC3_HUMAN)
QMNVINTYA

SEQ ID NO: 102720 - protein, 10 aa, Artificial Sequence
  Description of Artificial Sequence: Synthetic peptide
  Seed: EKVAELVQFL (MAGC3_HUMAN)
ECVAELVQFV

SEQ ID NO: 102721 - protein, 9 aa, Artificial Sequence
  Description of Artificial Sequence: Synthetic peptide
  Seed: ASEEVIWEV (MAGC3_HUMAN)
AGEEVIWEL

SEQ ID NO: 102722 - protein, 11 aa, Artificial Sequence
  Description of Artificial Sequence: Synthetic peptide
  Seed: LDSCSSPLLWT (MAGC3_HUMAN)
LSSCSSPLLWC

SEQ ID NO: 102723 - protein, 10 aa, Artificial Sequence
  Description of Artificial Sequence: Synthetic peptide
  Seed: EVIWEVLSAI (MAGC3_HUMAN)
EAIWEVLSAL

SEQ ID NO: 102724 - protein, 9 aa, Artificial Sequence
  Description of Artificial Sequence: Synthetic peptide
  Seed: NVINTYTGY (MAGC3_HUMAN)
NMINTYTGF

SEQ ID NO: 102725 - protein, 9 aa, Artificial Sequence
  Description of Artificial Sequence: Synthetic peptide
  Seed: ALAGFADVL (MAGC3_HUMAN)
AVAGFADVV

SEQ ID NO: 102726 - protein, 9 aa, Artificial Sequence
  Description of Artificial Sequence: Synthetic peptide
  Seed: WRRGTGYTL (MAGC3_HUMAN)
WRRGTGYTI

SEQ ID NO: 102727 - protein, 9 aa, Artificial Sequence
  Description of Artificial Sequence: Synthetic peptide
  Seed: KAHEFIELI (MAGC3_HUMAN)
KDHEFIELM

SEQ ID NO: 102728 - protein, 10 aa, Artificial Sequence
  Description of Artificial Sequence: Synthetic peptide
  Seed: YALSPVVLPP (MAGC3_HUMAN)
YQLSPVVLPI

SEQ ID NO: 102729 - protein, 10 aa, Artificial Sequence
  Description of Artificial Sequence: Synthetic peptide
  Seed: FFEDTLDLTY (MAGC3_HUMAN)
FSEDTLDLTW

SEQ ID NO: 102730 - protein, 11 aa, Artificial Sequence
  Description of Artificial Sequence: Synthetic peptide
  Seed: YALDEKVAELV (MAGC3_HUMAN)
YLLDEKVAELN

SEQ ID NO: 102731 - protein, 8 aa, Artificial Sequence
  Description of Artificial Sequence: Synthetic peptide
  Seed: KVDKLVQF (MAGC3_HUMAN)
KVDKLVQI

SEQ ID NO: 102732 - protein, 11 aa, Artificial Sequence
  Description of Artificial Sequence: Synthetic peptide
  Seed: SSSEEEDTATW (MAGC3_HUMAN)
SMSEEEDTATF

SEQ ID NO: 102733 - protein, 11 aa, Artificial Sequence
  Description of Artificial Sequence: Synthetic peptide
  Seed: IWEVLNAIGPW (MAGC3_HUMAN)
IYEVLNAIGPF

SEQ ID NO: 102734 - protein, 9 aa, Artificial Sequence
  Description of Artificial Sequence: Synthetic peptide
  Seed: LSSIIPSAF (MAGC3_HUMAN)
LPSIIPSAW

SEQ ID NO: 102735 - protein, 10 aa, Artificial Sequence
  Description of Artificial Sequence: Synthetic peptide
  Seed: EEVIWEVLNA (MAGC3_HUMAN)
ENVIWEVLNV

SEQ ID NO: 102736 - protein, 11 aa, Artificial Sequence
  Description of Artificial Sequence: Synthetic peptide
  Seed: HALPESESLPR (MAGC3_HUMAN)
HSLPESESLPK

SEQ ID NO: 102737 - protein, 10 aa, Artificial Sequence
  Description of Artificial Sequence: Synthetic peptide
  Seed: SQPEGKFSLR (MAGC3_HUMAN)
STPEGKFSLY

SEQ ID NO: 102738 - protein, 9 aa, Artificial Sequence
  Description of Artificial Sequence: Synthetic peptide
  Seed: MIFGKAHEF (MAGC3_HUMAN)
MMFGKAHEM

SEQ ID NO: 102739 - protein, 10 aa, Artificial Sequence
  Description of Artificial Sequence: Synthetic peptide
  Seed: LSKLSSIIPS (MAGC3_HUMAN)
LTKLSSIIPK

SEQ ID NO: 102740 - protein, 10 aa, Artificial Sequence
  Description of Artificial Sequence: Synthetic peptide
  Seed: MQMNVINTYT (MAGC3_HUMAN)
MSMNVINTYI

SEQ ID NO: 102741 - protein, 11 aa, Artificial Sequence
  Description of Artificial Sequence: Synthetic peptide
  Seed: TTDDATAMASA (MAGC3_HUMAN)
TNDDATAMASL

SEQ ID NO: 102742 - protein, 10 aa, Artificial Sequence
  Description of Artificial Sequence: Synthetic peptide
  Seed: YALDEKVAEL (MAGC3_HUMAN)
YELDEKVAEI

SEQ ID NO: 102743 - protein, 9 aa, Artificial Sequence
  Description of Artificial Sequence: Synthetic peptide
  Seed: NAIGPWSAL (MAGC3_HUMAN)
NSIGPWSAI

SEQ ID NO: 102744 - protein, 9 aa, Artificial Sequence
  Description of Artificial Sequence: Synthetic peptide
  Seed: IELIFGIAL (MAGC3_HUMAN)
IELIFGIAF

SEQ ID NO: 102745 - protein, 10 aa, Artificial Sequence
  Description of Artificial Sequence: Synthetic peptide
  Seed: MNVINTYTGY (MAGC3_HUMAN)
MWVINTYTGF

SEQ ID NO: 102746 - protein, 10 aa, Artificial Sequence
  Description of Artificial Sequence: Synthetic peptide
  Seed: KKYKDYFPMI (MAGC3_HUMAN)
KRYKDYFPMI

SEQ ID NO: 102747 - protein, 10 aa, Artificial Sequence
  Description of Artificial Sequence: Synthetic peptide
  Seed: KLVQFLLLKY (MAGC3_HUMAN)
KVVQFLLLKW

SEQ ID NO: 102748 - protein, 9 aa, Artificial Sequence
  Description of Artificial Sequence: Synthetic peptide
  Seed: NTYTGYFPM (MAGC3_HUMAN)
NAYTGYFPV

SEQ ID NO: 102749 - protein, 10 aa, Artificial Sequence
  Description of Artificial Sequence: Synthetic peptide
  Seed: EMQMNVINTY (MAGC3_HUMAN)
EIQMNVINTY

SEQ ID NO: 102750 - protein, 9 aa, Artificial Sequence
  Description of Artificial Sequence: Synthetic peptide
  Seed: RGTGYTLSL (MAGC3_HUMAN)
RLTGYTLSM

SEQ ID NO: 102751 - protein, 10 aa, Artificial Sequence
  Description of Artificial Sequence: Synthetic peptide
  Seed: MLLPCHWVLD (MAGC3_HUMAN)
MMLPCHWVLM

SEQ ID NO: 102752 - protein, 10 aa, Artificial Sequence
  Description of Artificial Sequence: Synthetic peptide
  Seed: RSAEGSVLDL (MAGC3_HUMAN)
RSAEGSVLDW

SEQ ID NO: 102753 - protein, 10 aa, Artificial Sequence
  Description of Artificial Sequence: Synthetic peptide
  Seed: REVRLFLRGG (MAGC3_HUMAN)
RVVRLFLRGA

SEQ ID NO: 102754 - protein, 9 aa, Artificial Sequence
  Description of Artificial Sequence: Synthetic peptide
  Seed: SASPSVMST (MAGC3_HUMAN)
SQSPSVMSI

SEQ ID NO: 102755 - protein, 10 aa, Artificial Sequence
  Description of Artificial Sequence: Synthetic peptide
  Seed: YALSPVVLPP (MAGC3_HUMAN)
YCLSPVVLPI

SEQ ID NO: 102756 - protein, 9 aa, Artificial Sequence
  Description of Artificial Sequence: Synthetic peptide
  Seed: EVIWEVLNA (MAGC3_HUMAN)
ESIWEVLNR

SEQ ID NO: 102757 - protein, 9 aa, Artificial Sequence
  Description of Artificial Sequence: Synthetic peptide
  Seed: ALDEKVAEL (MAGC3_HUMAN)
ARDEKVAEY

SEQ ID NO: 102758 - protein, 11 aa, Artificial Sequence
  Description of Artificial Sequence: Synthetic peptide
  Seed: LSKLSSIIPSA (MAGC3_HUMAN)
LKKLSSIIPSI

SEQ ID NO: 102759 - protein, 9 aa, Artificial Sequence
  Description of Artificial Sequence: Synthetic peptide
  Seed: SALAGFADV (MAGC3_HUMAN)
SQLAGFADV

SEQ ID NO: 102760 - protein, 10 aa, Artificial Sequence
  Description of Artificial Sequence: Synthetic peptide
  Seed: MQMNVINTYT (MAGC3_HUMAN)
MCMNVINTYM

SEQ ID NO: 102761 - protein, 11 aa, Artificial Sequence
  Description of Artificial Sequence: Synthetic peptide
  Seed: FIELIFGIALT (MAGC3_HUMAN)
FRELIFGIALI

SEQ ID NO: 102762 - protein, 9 aa, Artificial Sequence
  Description of Artificial Sequence: Synthetic peptide
  Seed: GSLPESEPL (MAGC3_HUMAN)
GVLPESEPL

SEQ ID NO: 102763 - protein, 11 aa, Artificial Sequence
  Description of Artificial Sequence: Synthetic peptide
  Seed: RTLSGSPGLQL (MAGC3_HUMAN)
RCLSGSPGLQW

SEQ ID NO: 102764 - protein, 10 aa, Artificial Sequence
  Description of Artificial Sequence: Synthetic peptide
  Seed: VLDLANPQGL (MAGC3_HUMAN)
VMDLANPQGM

SEQ ID NO: 102765 - protein, 10 aa, Artificial Sequence
  Description of Artificial Sequence: Synthetic peptide
  Seed: TDMDPDNHSY (MAGC3_HUMAN)
TLMDPDNHSY

SEQ ID NO: 102766 - protein, 9 aa, Artificial Sequence
  Description of Artificial Sequence: Synthetic peptide
  Seed: LSSIIPSAF (MAGC3_HUMAN)
LSSIIPSAW

SEQ ID NO: 102767 - protein, 9 aa, Artificial Sequence
  Description of Artificial Sequence: Synthetic peptide
  Seed: ALKDMEDRA (MAGC3_HUMAN)
ALKDMEDRL

SEQ ID NO: 102768 - protein, 11 aa, Artificial Sequence
  Description of Artificial Sequence: Synthetic peptide
  Seed: ILFGISLTEVD (MAGC3_HUMAN)
ILFGISLTEVH

SEQ ID NO: 102769 - protein, 9 aa, Artificial Sequence
  Description of Artificial Sequence: Synthetic peptide
  Seed: ALDEKVAEL (MAGC3_HUMAN)
AWDEKVAEL

SEQ ID NO: 102770 - protein, 11 aa, Artificial Sequence
  Description of Artificial Sequence: Synthetic peptide
  Seed: LSKLSSIIPSA (MAGC3_HUMAN)
LLKLSSIIPSL

SEQ ID NO: 102771 - protein, 9 aa, Artificial Sequence
  Description of Artificial Sequence: Synthetic peptide
  Seed: FPMIFRKAR (MAGC3_HUMAN)
FMMIFRKAR

SEQ ID NO: 102772 - protein, 9 aa, Artificial Sequence
  Description of Artificial Sequence: Synthetic peptide
  Seed: QAKEPLTRA (MAGC3_HUMAN)
QQKEPLTRY

SEQ ID NO: 102773 - protein, 11 aa, Artificial Sequence
  Description of Artificial Sequence: Synthetic peptide
  Seed: KQREEPQDWPL (MAGC3_HUMAN)
KQREEPQDWPF

SEQ ID NO: 102774 - protein, 10 aa, Artificial Sequence
  Description of Artificial Sequence: Synthetic peptide
  Seed: NAIGPWSALA (MAGC3_HUMAN)
NVIGPWSALI

SEQ ID NO: 102775 - protein, 9 aa, Artificial Sequence
  Description of Artificial Sequence: Synthetic peptide
  Seed: FADVLSRLA (MAGC3_HUMAN)
FHDVLSRLL

SEQ ID NO: 102776 - protein, 9 aa, Artificial Sequence
  Description of Artificial Sequence: Synthetic peptide
  Seed: WHALPESES (MAGC3_HUMAN)
WHALPESEA

SEQ ID NO: 102777 - protein, 10 aa, Artificial Sequence
  Description of Artificial Sequence: Synthetic peptide
  Seed: NTYTGYFPMI (MAGC3_HUMAN)
NYYTGYFPMF

SEQ ID NO: 102778 - protein, 9 aa, Artificial Sequence
  Description of Artificial Sequence: Synthetic peptide
  Seed: ATYALSPVV (MAGC3_HUMAN)
AIYALSPVY

SEQ ID NO: 102779 - protein, 8 aa, Artificial Sequence
  Description of Artificial Sequence: Synthetic peptide
  Seed: MPQNRLLI (MAGC3_HUMAN)
MPQNRLLM

SEQ ID NO: 102780 - protein, 9 aa, Artificial Sequence
  Description of Artificial Sequence: Synthetic peptide
  Seed: AMASASPSV (MAGC3_HUMAN)
ALASASPSA

SEQ ID NO: 102781 - protein, 9 aa, Artificial Sequence
  Description of Artificial Sequence: Synthetic peptide
  Seed: DMDPDNHSY (MAGC3_HUMAN)
DTDPDNHSY

SEQ ID NO: 102782 - protein, 9 aa, Artificial Sequence
  Description of Artificial Sequence: Synthetic peptide
  Seed: QMNVINTYT (MAGC3_HUMAN)
QMNVINTYI

SEQ ID NO: 102783 - protein, 9 aa, Artificial Sequence
  Description of Artificial Sequence: Synthetic peptide
  Seed: GKFSLRRAV (MAGC3_HUMAN)
GQFSLRRAF

SEQ ID NO: 102784 - protein, 10 aa, Artificial Sequence
  Description of Artificial Sequence: Synthetic peptide
  Seed: MIFGKAHEFI (MAGC3_HUMAN)
MVFGKAHEFA

SEQ ID NO: 102785 - protein, 11 aa, Artificial Sequence
  Description of Artificial Sequence: Synthetic peptide
  Seed: ILFGISLTEVD (MAGC3_HUMAN)
IMFGISLTEVT

SEQ ID NO: 102786 - protein, 9 aa, Artificial Sequence
  Description of Artificial Sequence: Synthetic peptide
  Seed: MQMNVINTY (MAGC3_HUMAN)
MNMNVINTF

SEQ ID NO: 102787 - protein, 10 aa, Artificial Sequence
  Description of Artificial Sequence: Synthetic peptide
  Seed: LLKYQAKEPL (MAGC3_HUMAN)
LSKYQAKEPF

SEQ ID NO: 102788 - protein, 9 aa, Artificial Sequence
  Description of Artificial Sequence: Synthetic peptide
  Seed: QTKEPVTKA (MAGC3_HUMAN)
QLKEPVTKF

SEQ ID NO: 102789 - protein, 10 aa, Artificial Sequence
  Description of Artificial Sequence: Synthetic peptide
  Seed: YALSPVVLPP (MAGC3_HUMAN)
YTLSPVVLPV

SEQ ID NO: 102790 - protein, 9 aa, Artificial Sequence
  Description of Artificial Sequence: Synthetic peptide
  Seed: YTGYFPMIF (MAGC3_HUMAN)
YWGYFPMIY

SEQ ID NO: 102791 - protein, 9 aa, Artificial Sequence
  Description of Artificial Sequence: Synthetic peptide
  Seed: VIKKYKDYF (MAGC3_HUMAN)
VQKKYKDYY

SEQ ID NO: 102792 - protein, 10 aa, Artificial Sequence
  Description of Artificial Sequence: Synthetic peptide
  Seed: KLSSIIPSAF (MAGC3_HUMAN)
KESSIIPSAF

SEQ ID NO: 102793 - protein, 11 aa, Artificial Sequence
  Description of Artificial Sequence: Synthetic peptide
  Seed: GPPQSPPQSPL (MAGC3_HUMAN)
GRPQSPPQSPM

SEQ ID NO: 102794 - protein, 9 aa, Artificial Sequence
  Description of Artificial Sequence: Synthetic peptide
  Seed: SLPESEPLF (MAGC3_HUMAN)
SGPESEPLM

SEQ ID NO: 102795 - protein, 10 aa, Artificial Sequence
  Description of Artificial Sequence: Synthetic peptide
  Seed: SCSSPLLWTR (MAGC3_HUMAN)
SQSSPLLWTK

SEQ ID NO: 102796 - protein, 9 aa, Artificial Sequence
  Description of Artificial Sequence: Synthetic peptide
  Seed: VIWEVLNAI (MAGC3_HUMAN)
VQWEVLNAM

SEQ ID NO: 102797 - protein, 9 aa, Artificial Sequence
  Description of Artificial Sequence: Synthetic peptide
  Seed: KLVQFLLLK (MAGC3_HUMAN)
KMVQFLLLA

SEQ ID NO: 102798 - protein, 8 aa, Artificial Sequence
  Description of Artificial Sequence: Synthetic peptide
  Seed: KAHEFIEL (MAGC3_HUMAN)
KYHEFIEF

SEQ ID NO: 102799 - protein, 9 aa, Artificial Sequence
  Description of Artificial Sequence: Synthetic peptide
  Seed: ALDEKVAEL (MAGC3_HUMAN)
AIDEKVAEF

SEQ ID NO: 102800 - protein, 10 aa, Artificial Sequence
  Description of Artificial Sequence: Synthetic peptide
  Seed: VKNTCATYAL (MAGC3_HUMAN)
VQNTCATYAM

SEQ ID NO: 102801 - protein, 9 aa, Artificial Sequence
  Description of Artificial Sequence: Synthetic peptide
  Seed: ATYALSPVV (MAGC3_HUMAN)
AMYALSPVM

SEQ ID NO: 102802 - protein, 8 aa, Artificial Sequence
  Description of Artificial Sequence: Synthetic peptide
  Seed: MASASPSV (MAGC3_HUMAN)
MASASPSM

SEQ ID NO: 102803 - protein, 9 aa, Artificial Sequence
  Description of Artificial Sequence: Synthetic peptide
  Seed: AAGMPPLPQ (MAGC3_HUMAN)
ASGMPPLPY

SEQ ID NO: 102804 - protein, 9 aa, Artificial Sequence
  Description of Artificial Sequence: Synthetic peptide
  Seed: KVAELVQFL (MAGC3_HUMAN)
KAAELVQFH

SEQ ID NO: 102805 - protein, 9 aa, Artificial Sequence
  Description of Artificial Sequence: Synthetic peptide
  Seed: TTDDATAMA (MAGC3_HUMAN)
TFDDATAMI

SEQ ID NO: 102806 - protein, 10 aa, Artificial Sequence
  Description of Artificial Sequence: Synthetic peptide
  Seed: ADVLSRLALW (MAGC3_HUMAN)
ASVLSRLALW

SEQ ID NO: 102807 - protein, 10 aa, Artificial Sequence
  Description of Artificial Sequence: Synthetic peptide
  Seed: TEVDPDHFYV (MAGC3_HUMAN)
TMVDPDHFYI

SEQ ID NO: 102808 - protein, 9 aa, Artificial Sequence
  Description of Artificial Sequence: Synthetic peptide
  Seed: AMASASPSV (MAGC3_HUMAN)
ATASASPSV

SEQ ID NO: 102809 - protein, 9 aa, Artificial Sequence
  Description of Artificial Sequence: Synthetic peptide
  Seed: FSDGSLGQW (MAGC3_HUMAN)
FSDGSLGQI

SEQ ID NO: 102810 - protein, 9 aa, Artificial Sequence
  Description of Artificial Sequence: Synthetic peptide
  Seed: EFIELIFGI (MAGC3_HUMAN)
EMIELIFGM

SEQ ID NO: 102811 - protein, 11 aa, Artificial Sequence
  Description of Artificial Sequence: Synthetic peptide
  Seed: KVAELVQFLLL (MAGC3_HUMAN)
KLAELVQFLLR

SEQ ID NO: 102812 - protein, 10 aa, Artificial Sequence
  Description of Artificial Sequence: Synthetic peptide
  Seed: KDYFPMIFGK (MAGC3_HUMAN)
KRYFPMIFGR

SEQ ID NO: 102813 - protein, 11 aa, Artificial Sequence
  Description of Artificial Sequence: Synthetic peptide
  Seed: RTLSGSPGLQL (MAGC3_HUMAN)
RMLSGSPGLQL

SEQ ID NO: 102814 - protein, 10 aa, Artificial Sequence
  Description of Artificial Sequence: Synthetic peptide
  Seed: MQMNVINTYT (MAGC3_HUMAN)
MIMNVINTYA

SEQ ID NO: 102815 - protein, 10 aa, Artificial Sequence
  Description of Artificial Sequence: Synthetic peptide
  Seed: MNVINTYTGY (MAGC3_HUMAN)
MTVINTYTGW

SEQ ID NO: 102816 - protein, 10 aa, Artificial Sequence
  Description of Artificial Sequence: Synthetic peptide
  Seed: TFSDGSLGQW (MAGC3_HUMAN)
TASDGSLGQW

SEQ ID NO: 102817 - protein, 9 aa, Artificial Sequence
  Description of Artificial Sequence: Synthetic peptide
  Seed: LTTVIKKYK (MAGC3_HUMAN)
LLTVIKKYR

SEQ ID NO: 102818 - protein, 10 aa, Artificial Sequence
  Description of Artificial Sequence: Synthetic peptide
  Seed: SCSSPLLWTR (MAGC3_HUMAN)
SHSSPLLWTK

SEQ ID NO: 102819 - protein, 10 aa, Artificial Sequence
  Description of Artificial Sequence: Synthetic peptide
  Seed: SALAGFADVL (MAGC3_HUMAN)
SRLAGFADVL

SEQ ID NO: 102820 - protein, 8 aa, Artificial Sequence
  Description of Artificial Sequence: Synthetic peptide
  Seed: TTDDATAM (MAGC3_HUMAN)
TIDDATAL

SEQ ID NO: 102821 - protein, 9 aa, Artificial Sequence
  Description of Artificial Sequence: Synthetic peptide
  Seed: VDPDHFYVF (MAGC3_HUMAN)
VMPDHFYVM

SEQ ID NO: 102822 - protein, 9 aa, Artificial Sequence
  Description of Artificial Sequence: Synthetic peptide
  Seed: YKDYFPMIF (MAGC3_HUMAN)
YFDYFPMII

SEQ ID NO: 102823 - protein, 11 aa, Artificial Sequence
  Description of Artificial Sequence: Synthetic peptide
  Seed: LDSCSSPLLWT (MAGC3_HUMAN)
LMSCSSPLLWW

SEQ ID NO: 102824 - protein, 9 aa, Artificial Sequence
  Description of Artificial Sequence: Synthetic peptide
  Seed: TEASPQQKK (MAGC3_HUMAN)
TIASPQQKY

SEQ ID NO: 102825 - protein, 11 aa, Artificial Sequence
  Description of Artificial Sequence: Synthetic peptide
  Seed: LTDMDPDNHSY (MAGC3_HUMAN)
LGDMDPDNHSL

SEQ ID NO: 102826 - protein, 10 aa, Artificial Sequence
  Description of Artificial Sequence: Synthetic peptide
  Seed: KATDKDYSAF (MAGC3_HUMAN)
KTTDKDYSAF

SEQ ID NO: 102827 - protein, 9 aa, Artificial Sequence
  Description of Artificial Sequence: Synthetic peptide
  Seed: SLRRAVSVK (MAGC3_HUMAN)
SIRRAVSVR

SEQ ID NO: 102828 - protein, 9 aa, Artificial Sequence
  Description of Artificial Sequence: Synthetic peptide
  Seed: KEPVTKAEM (MAGC3_HUMAN)
KEPVTKAEA

SEQ ID NO: 102829 - protein, 10 aa, Artificial Sequence
  Description of Artificial Sequence: Synthetic peptide
  Seed: SPLDSCSSPL (MAGC3_HUMAN)
SYLDSCSSPV

SEQ ID NO: 102830 - protein, 9 aa, Artificial Sequence
  Description of Artificial Sequence: Synthetic peptide
  Seed: KVDKLVQFL (MAGC3_HUMAN)
KTDKLVQFM

SEQ ID NO: 102831 - protein, 9 aa, Artificial Sequence
  Description of Artificial Sequence: Synthetic peptide
  Seed: IQRPAREVL (MAGC3_HUMAN)
IERPAREVV

SEQ ID NO: 102832 - protein, 9 aa, Artificial Sequence
  Description of Artificial Sequence: Synthetic peptide
  Seed: FPMIFRKAR (MAGC3_HUMAN)
FPMIFRKAP

SEQ ID NO: 102833 - protein, 10 aa, Artificial Sequence
  Description of Artificial Sequence: Synthetic peptide
  Seed: QWVKNTCATY (MAGC3_HUMAN)
QIVKNTCATY

SEQ ID NO: 102834 - protein, 10 aa, Artificial Sequence
  Description of Artificial Sequence: Synthetic peptide
  Seed: EKVAELVQFL (MAGC3_HUMAN)
EYVAELVQFY

SEQ ID NO: 102835 - protein, 11 aa, Artificial Sequence
  Description of Artificial Sequence: Synthetic peptide
  Seed: LSKLSSIIPSA (MAGC3_HUMAN)
LKKLSSIIPSV

SEQ ID NO: 102836 - protein, 9 aa, Artificial Sequence
  Description of Artificial Sequence: Synthetic peptide
  Seed: VIWEVLNAI (MAGC3_HUMAN)
VQWEVLNAV

SEQ ID NO: 102837 - protein, 10 aa, Artificial Sequence
  Description of Artificial Sequence: Synthetic peptide
  Seed: YALDEKVAEL (MAGC3_HUMAN)
YSLDEKVAEW

SEQ ID NO: 102838 - protein, 9 aa, Artificial Sequence
  Description of Artificial Sequence: Synthetic peptide
  Seed: LKYQTKEPV (MAGC3_HUMAN)
LMYQTKEPY

SEQ ID NO: 102839 - protein, 10 aa, Artificial Sequence
  Description of Artificial Sequence: Synthetic peptide
  Seed: SIIPSAFPSW (MAGC3_HUMAN)
SYIPSAFPSY

SEQ ID NO: 102840 - protein, 10 aa, Artificial Sequence
  Description of Artificial Sequence: Synthetic peptide
  Seed: YALSPVVLPP (MAGC3_HUMAN)
YMLSPVVLPT

SEQ ID NO: 102841 - protein, 9 aa, Artificial Sequence
  Description of Artificial Sequence: Synthetic peptide
  Seed: MIFGKAHEF (MAGC3_HUMAN)
MIFGKAHEA

SEQ ID NO: 102842 - protein, 9 aa, Artificial Sequence
  Description of Artificial Sequence: Synthetic peptide
  Seed: VPEEVIWEV (MAGC3_HUMAN)
VGEEVIWEL

SEQ ID NO: 102843 - protein, 11 aa, Artificial Sequence
  Description of Artificial Sequence: Synthetic peptide
  Seed: AEMQMNVINTY (MAGC3_HUMAN)
APMQMNVINTY

SEQ ID NO: 102844 - protein, 9 aa, Artificial Sequence
  Description of Artificial Sequence: Synthetic peptide
  Seed: SLPESEPLF (MAGC3_HUMAN)
SMPESEPLV

SEQ ID NO: 102845 - protein, 11 aa, Artificial Sequence
  Description of Artificial Sequence: Synthetic peptide
  Seed: SKLSSIIPSAF (MAGC3_HUMAN)
STLSSIIPSAF

SEQ ID NO: 102846 - protein, 9 aa, Artificial Sequence
  Description of Artificial Sequence: Synthetic peptide
  Seed: QAKEPLTRA (MAGC3_HUMAN)
QPKEPLTRL

SEQ ID NO: 102847 - protein, 9 aa, Artificial Sequence
  Description of Artificial Sequence: Synthetic peptide
  Seed: TYALSPVVL (MAGC3_HUMAN)
THALSPVVI

SEQ ID NO: 102848 - protein, 9 aa, Artificial Sequence
  Description of Artificial Sequence: Synthetic peptide
  Seed: EMLTTVIKK (MAGC3_HUMAN)
EILTTVIKK

SEQ ID NO: 102849 - protein, 9 aa, Artificial Sequence
  Description of Artificial Sequence: Synthetic peptide
  Seed: YQAKEPLTR (MAGC3_HUMAN)
YRAKEPLTM

SEQ ID NO: 102850 - protein, 9 aa, Artificial Sequence
  Description of Artificial Sequence: Synthetic peptide
  Seed: MPAAGMPPL (MAGC3_HUMAN)
MPAAGMPPY

SEQ ID NO: 102851 - protein, 9 aa, Artificial Sequence
  Description of Artificial Sequence: Synthetic peptide
  Seed: RGTGYTLSL (MAGC3_HUMAN)
RMTGYTLSM

SEQ ID NO: 102852 - protein, 9 aa, Artificial Sequence
  Description of Artificial Sequence: Synthetic peptide
  Seed: KEPVTKAEM (MAGC3_HUMAN)
KLPVTKAEY

SEQ ID NO: 102853 - protein, 9 aa, Artificial Sequence
  Description of Artificial Sequence: Synthetic peptide
  Seed: TLDEKVDKL (MAGC3_HUMAN)
TQDEKVDKF

SEQ ID NO: 102854 - protein, 9 aa, Artificial Sequence
  Description of Artificial Sequence: Synthetic peptide
  Seed: YQAKEPLTR (MAGC3_HUMAN)
YYAKEPLTM

SEQ ID NO: 102855 - protein, 9 aa, Artificial Sequence
  Description of Artificial Sequence: Synthetic peptide
  Seed: VTKAEMLTT (MAGC3_HUMAN)
VMKAEMLTK

SEQ ID NO: 102856 - protein, 11 aa, Artificial Sequence
  Description of Artificial Sequence: Synthetic peptide
  Seed: ALWESEGPEAF (MAGC3_HUMAN)
ASWESEGPEAW

SEQ ID NO: 102857 - protein, 10 aa, Artificial Sequence
  Description of Artificial Sequence: Synthetic peptide
  Seed: IPSAFPSWYM (MAGC3_HUMAN)
IQSAFPSWYW

SEQ ID NO: 102858 - protein, 10 aa, Artificial Sequence
  Description of Artificial Sequence: Synthetic peptide
  Seed: MIFRKAREFI (MAGC3_HUMAN)
MAFRKAREFV

SEQ ID NO: 102859 - protein, 9 aa, Artificial Sequence
  Description of Artificial Sequence: Synthetic peptide
  Seed: EVLEFLSKL (MAGC3_HUMAN)
ETLEFLSKA

SEQ ID NO: 102860 - protein, 11 aa, Artificial Sequence
  Description of Artificial Sequence: Synthetic peptide
  Seed: RTLSGSPGLQL (MAGC3_HUMAN)
RLLSGSPGLQY

SEQ ID NO: 102861 - protein, 9 aa, Artificial Sequence
  Description of Artificial Sequence: Synthetic peptide
  Seed: MEDRAQAII (MAGC3_HUMAN)
MMDRAQAIV

SEQ ID NO: 102862 - protein, 11 aa, Artificial Sequence
  Description of Artificial Sequence: Synthetic peptide
  Seed: RTLSGSPGLQL (MAGC3_HUMAN)
RQLSGSPGLQL

SEQ ID NO: 102863 - protein, 9 aa, Artificial Sequence
  Description of Artificial Sequence: Synthetic peptide
  Seed: LSSIIPSAF (MAGC3_HUMAN)
LQSIIPSAW

SEQ ID NO: 102864 - protein, 10 aa, Artificial Sequence
  Description of Artificial Sequence: Synthetic peptide
  Seed: MPAAGMPPLP (MAGC3_HUMAN)
MAAAGMPPLM

SEQ ID NO: 102865 - protein, 11 aa, Artificial Sequence
  Description of Artificial Sequence: Synthetic peptide
  Seed: SSSEEEDTATW (MAGC3_HUMAN)
SISEEEDTATL

SEQ ID NO: 102866 - protein, 9 aa, Artificial Sequence
  Description of Artificial Sequence: Synthetic peptide
  Seed: FHLGHLREV (MAGC3_HUMAN)
FGLGHLREM

SEQ ID NO: 102867 - protein, 9 aa, Artificial Sequence
  Description of Artificial Sequence: Synthetic peptide
  Seed: LANPQGLAG (MAGC3_HUMAN)
LQNPQGLAY

SEQ ID NO: 102868 - protein, 9 aa, Artificial Sequence
  Description of Artificial Sequence: Synthetic peptide
  Seed: LKYQAKEPL (MAGC3_HUMAN)
LQYQAKEPA

SEQ ID NO: 102869 - protein, 9 aa, Artificial Sequence
  Description of Artificial Sequence: Synthetic peptide
  Seed: LILILSMIF (MAGC3_HUMAN)
LKLILSMIF

SEQ ID NO: 102870 - protein, 10 aa, Artificial Sequence
  Description of Artificial Sequence: Synthetic peptide
  Seed: SIIPSAFPSW (MAGC3_HUMAN)
SWIPSAFPSY

SEQ ID NO: 102871 - protein, 9 aa, Artificial Sequence
  Description of Artificial Sequence: Synthetic peptide
  Seed: KGSCVPEEV (MAGC3_HUMAN)
KMSCVPEEV

SEQ ID NO: 102872 - protein, 9 aa, Artificial Sequence
  Description of Artificial Sequence: Synthetic peptide
  Seed: HLREVRLFL (MAGC3_HUMAN)
HTREVRLFL

SEQ ID NO: 102873 - protein, 9 aa, Artificial Sequence
  Description of Artificial Sequence: Synthetic peptide
  Seed: WRRGTGYTL (MAGC3_HUMAN)
WMRGTGYTM

SEQ ID NO: 102874 - protein, 10 aa, Artificial Sequence
  Description of Artificial Sequence: Synthetic peptide
  Seed: KLSSIIPSAF (MAGC3_HUMAN)
KPSSIIPSAF

SEQ ID NO: 102875 - protein, 9 aa, Artificial Sequence
  Description of Artificial Sequence: Synthetic peptide
  Seed: KYKDYFPMI (MAGC3_HUMAN)
KVKDYFPMS

SEQ ID NO: 102876 - protein, 9 aa, Artificial Sequence
  Description of Artificial Sequence: Synthetic peptide
  Seed: DYFPMIFGK (MAGC3_HUMAN)
DSFPMIFGK

SEQ ID NO: 102877 - protein, 9 aa, Artificial Sequence
  Description of Artificial Sequence: Synthetic peptide
  Seed: AMASASPSV (MAGC3_HUMAN)
AQASASPSF

SEQ ID NO: 102878 - protein, 9 aa, Artificial Sequence
  Description of Artificial Sequence: Synthetic peptide
  Seed: LSSIIPSAF (MAGC3_HUMAN)
LASIIPSAI

SEQ ID NO: 102879 - protein, 9 aa, Artificial Sequence
  Description of Artificial Sequence: Synthetic peptide
  Seed: MQMNVINTY (MAGC3_HUMAN)
MVMNVINTM

SEQ ID NO: 102880 - protein, 9 aa, Artificial Sequence
  Description of Artificial Sequence: Synthetic peptide
  Seed: AGFADVLSR (MAGC3_HUMAN)
ARFADVLSM

SEQ ID NO: 102881 - protein, 9 aa, Artificial Sequence
  Description of Artificial Sequence: Synthetic peptide
  Seed: HALPESESL (MAGC3_HUMAN)
HSLPESESL

SEQ ID NO: 102882 - protein, 10 aa, Artificial Sequence
  Description of Artificial Sequence: Synthetic peptide
  Seed: FKLWRTLSGS (MAGC3_HUMAN)
FLLWRTLSGM

SEQ ID NO: 102883 - protein, 9 aa, Artificial Sequence
  Description of Artificial Sequence: Synthetic peptide
  Seed: FKLWRTLSG (MAGC3_HUMAN)
FQLWRTLSY

SEQ ID NO: 102884 - protein, 9 aa, Artificial Sequence
  Description of Artificial Sequence: Synthetic peptide
  Seed: FEDTLDLTY (MAGC3_HUMAN)
FTDTLDLTM

SEQ ID NO: 102885 - protein, 10 aa, Artificial Sequence
  Description of Artificial Sequence: Synthetic peptide
  Seed: KLVQFLLLKY (MAGC3_HUMAN)
KPVQFLLLKK

SEQ ID NO: 102886 - protein, 10 aa, Artificial Sequence
  Description of Artificial Sequence: Synthetic peptide
  Seed: MQMNVINTYT (MAGC3_HUMAN)
MKMNVINTYQ

SEQ ID NO: 102887 - protein, 9 aa, Artificial Sequence
  Description of Artificial Sequence: Synthetic peptide
  Seed: AMASASPSV (MAGC3_HUMAN)
ATASASPSI

SEQ ID NO: 102888 - protein, 9 aa, Artificial Sequence
  Description of Artificial Sequence: Synthetic peptide
  Seed: MIFRKAREF (MAGC3_HUMAN)
MIFRKAREW

SEQ ID NO: 102889 - protein, 11 aa, Artificial Sequence
  Description of Artificial Sequence: Synthetic peptide
  Seed: LTDMDPDNHSY (MAGC3_HUMAN)
LADMDPDNHSY

SEQ ID NO: 102890 - protein, 9 aa, Artificial Sequence
  Description of Artificial Sequence: Synthetic peptide
  Seed: SAIGPIQRP (MAGC3_HUMAN)
SIIGPIQRF

SEQ ID NO: 102891 - protein, 9 aa, Artificial Sequence
  Description of Artificial Sequence: Synthetic peptide
  Seed: KLSSIIPSA (MAGC3_HUMAN)
KSSSIIPSV

SEQ ID NO: 102892 - protein, 9 aa, Artificial Sequence
  Description of Artificial Sequence: Synthetic peptide
  Seed: LDLANPQGL (MAGC3_HUMAN)
LELANPQGI

SEQ ID NO: 102893 - protein, 9 aa, Artificial Sequence
  Description of Artificial Sequence: Synthetic peptide
  Seed: KLSSIIPSA (MAGC3_HUMAN)
KVSSIIPSK

SEQ ID NO: 102894 - protein, 11 aa, Artificial Sequence
  Description of Artificial Sequence: Synthetic peptide
  Seed: LDSCSSPLLWT (MAGC3_HUMAN)
LYSCSSPLLWW

SEQ ID NO: 102895 - protein, 10 aa, Artificial Sequence
  Description of Artificial Sequence: Synthetic peptide
  Seed: LILILSVIFI (MAGC3_HUMAN)
LSLILSVIFV

SEQ ID NO: 102896 - protein, 10 aa, Artificial Sequence
  Description of Artificial Sequence: Synthetic peptide
  Seed: YTLDEKVDKL (MAGC3_HUMAN)
YVLDEKVDKL

SEQ ID NO: 102897 - protein, 9 aa, Artificial Sequence
  Description of Artificial Sequence: Synthetic peptide
  Seed: AVSPGKRLW (MAGC3_HUMAN)
AQSPGKRLL

SEQ ID NO: 102898 - protein, 11 aa, Artificial Sequence
  Description of Artificial Sequence: Synthetic peptide
  Seed: ALWESEGPEAF (MAGC3_HUMAN)
ASWESEGPEAF

SEQ ID NO: 102899 - protein, 9 aa, Artificial Sequence
  Description of Artificial Sequence: Synthetic peptide
  Seed: FADVLSRLA (MAGC3_HUMAN)
FNDVLSRLI

SEQ ID NO: 102900 - protein, 9 aa, Artificial Sequence
  Description of Artificial Sequence: Synthetic peptide
  Seed: GFADVLSRL (MAGC3_HUMAN)
GIADVLSRI

SEQ ID NO: 102901 - protein, 9 aa, Artificial Sequence
  Description of Artificial Sequence: Synthetic peptide
  Seed: LVQFLLLKY (MAGC3_HUMAN)
LMQFLLLKF

SEQ ID NO: 102902 - protein, 9 aa, Artificial Sequence
  Description of Artificial Sequence: Synthetic peptide
  Seed: LLILILSMI (MAGC3_HUMAN)
LLILILSMA

SEQ ID NO: 102903 - protein, 9 aa, Artificial Sequence
  Description of Artificial Sequence: Synthetic peptide
  Seed: NVINTYTGY (MAGC3_HUMAN)
NFINTYTGY

SEQ ID NO: 102904 - protein, 10 aa, Artificial Sequence
  Description of Artificial Sequence: Synthetic peptide
  Seed: IKKYKDYFPM (MAGC3_HUMAN)
IAKYKDYFPY

SEQ ID NO: 102905 - protein, 9 aa, Artificial Sequence
  Description of Artificial Sequence: Synthetic peptide
  Seed: KLVQFLLLK (MAGC3_HUMAN)
KQVQFLLLR

SEQ ID NO: 102906 - protein, 9 aa, Artificial Sequence
  Description of Artificial Sequence: Synthetic peptide
  Seed: RTLSGSPGL (MAGC3_HUMAN)
RTLSGSPGM

SEQ ID NO: 102907 - protein, 10 aa, Artificial Sequence
  Description of Artificial Sequence: Synthetic peptide
  Seed: FKLWRTLSGS (MAGC3_HUMAN)
FCLWRTLSGM

SEQ ID NO: 102908 - protein, 10 aa, Artificial Sequence
  Description of Artificial Sequence: Synthetic peptide
  Seed: IPPQGPPKIS (MAGC3_HUMAN)
IPPQGPPKIA

SEQ ID NO: 102909 - protein, 9 aa, Artificial Sequence
  Description of Artificial Sequence: Synthetic peptide
  Seed: LVLCPTYFK (MAGC3_HUMAN)
LILCPTYFR

SEQ ID NO: 102910 - protein, 9 aa, Artificial Sequence
  Description of Artificial Sequence: Synthetic peptide
  Seed: KLVQFLLLK (MAGC3_HUMAN)
KQVQFLLLI

SEQ ID NO: 102911 - protein, 9 aa, Artificial Sequence
  Description of Artificial Sequence: Synthetic peptide
  Seed: IIDTTDDAT (MAGC3_HUMAN)
IFDTTDDAL

SEQ ID NO: 102912 - protein, 9 aa, Artificial Sequence
  Description of Artificial Sequence: Synthetic peptide
  Seed: LVQFLLLKY (MAGC3_HUMAN)
LTQFLLLKF

SEQ ID NO: 102913 - protein, 9 aa, Artificial Sequence
  Description of Artificial Sequence: Synthetic peptide
  Seed: FADVLSRLA (MAGC3_HUMAN)
FFDVLSRLI

SEQ ID NO: 102914 - protein, 10 aa, Artificial Sequence
  Description of Artificial Sequence: Synthetic peptide
  Seed: KKYKDYFPMI (MAGC3_HUMAN)
KCYKDYFPMF

SEQ ID NO: 102915 - protein, 10 aa, Artificial Sequence
  Description of Artificial Sequence: Synthetic peptide
  Seed: EKVAELVQFL (MAGC3_HUMAN)
EIVAELVQFL

SEQ ID NO: 102916 - protein, 9 aa, Artificial Sequence
  Description of Artificial Sequence: Synthetic peptide
  Seed: KGSCVPEEV (MAGC3_HUMAN)
KSSCVPEEL

SEQ ID NO: 102917 - protein, 10 aa, Artificial Sequence
  Description of Artificial Sequence: Synthetic peptide
  Seed: LLKYQAKEPL (MAGC3_HUMAN)
LIKYQAKEPY

SEQ ID NO: 102918 - protein, 11 aa, Artificial Sequence
  Description of Artificial Sequence: Synthetic peptide
  Seed: KVAELVQFLLL (MAGC3_HUMAN)
KLAELVQFLLG

SEQ ID NO: 102919 - protein, 11 aa, Artificial Sequence
  Description of Artificial Sequence: Synthetic peptide
  Seed: TSDQRMDSLVL (MAGC3_HUMAN)
TCDQRMDSLVF

SEQ ID NO: 102920 - protein, 8 aa, Artificial Sequence
  Description of Artificial Sequence: Synthetic peptide
  Seed: SLPESEPL (MAGC3_HUMAN)
SAPESEPL

SEQ ID NO: 102921 - protein, 11 aa, Artificial Sequence
  Description of Artificial Sequence: Synthetic peptide
  Seed: SASPSVMSTNF (MAGC3_HUMAN)
SVSPSVMSTNY

SEQ ID NO: 102922 - protein, 9 aa, Artificial Sequence
  Description of Artificial Sequence: Synthetic peptide
  Seed: TEASPQQKK (MAGC3_HUMAN)
TSASPQQKY

SEQ ID NO: 102923 - protein, 9 aa, Artificial Sequence
  Description of Artificial Sequence: Synthetic peptide
  Seed: EIPPQGPPK (MAGC3_HUMAN)
EMPPQGPPK

SEQ ID NO: 102924 - protein, 9 aa, Artificial Sequence
  Description of Artificial Sequence: Synthetic peptide
  Seed: YQTKEPVTK (MAGC3_HUMAN)
YATKEPVTF

SEQ ID NO: 102925 - protein, 9 aa, Artificial Sequence
  Description of Artificial Sequence: Synthetic peptide
  Seed: DYFPMIFGK (MAGC3_HUMAN)
DNFPMIFGR

SEQ ID NO: 102926 - protein, 9 aa, Artificial Sequence
  Description of Artificial Sequence: Synthetic peptide
  Seed: RKKATDKDY (MAGC3_HUMAN)
RQKATDKDM

SEQ ID NO: 102927 - protein, 9 aa, Artificial Sequence
  Description of Artificial Sequence: Synthetic peptide
  Seed: WRRGTGYTL (MAGC3_HUMAN)
WIRGTGYTY

SEQ ID NO: 102928 - protein, 9 aa, Artificial Sequence
  Description of Artificial Sequence: Synthetic peptide
  Seed: ALDEKVAEL (MAGC3_HUMAN)
AGDEKVAEV

SEQ ID NO: 102929 - protein, 10 aa, Artificial Sequence
  Description of Artificial Sequence: Synthetic peptide
  Seed: SDQRMDSLVL (MAGC3_HUMAN)
SMQRMDSLVF

SEQ ID NO: 102930 - protein, 11 aa, Artificial Sequence
  Description of Artificial Sequence: Synthetic peptide
  Seed: TLWKDSDLPTW (MAGC3_HUMAN)
TTWKDSDLPTF

SEQ ID NO: 102931 - protein, 9 aa, Artificial Sequence
  Description of Artificial Sequence: Synthetic peptide
  Seed: LSGSPGLQL (MAGC3_HUMAN)
LSGSPGLQF

SEQ ID NO: 102932 - protein, 9 aa, Artificial Sequence
  Description of Artificial Sequence: Synthetic peptide
  Seed: AIGPWSALA (MAGC3_HUMAN)
ALGPWSALM

SEQ ID NO: 102933 - protein, 9 aa, Artificial Sequence
  Description of Artificial Sequence: Synthetic peptide
  Seed: ELVQFLLLK (MAGC3_HUMAN)
EMVQFLLLR

SEQ ID NO: 102934 - protein, 9 aa, Artificial Sequence
  Description of Artificial Sequence: Synthetic peptide
  Seed: SPQGPPQSP (MAGC3_HUMAN)
SPQGPPQSM

SEQ ID NO: 102935 - protein, 9 aa, Artificial Sequence
  Description of Artificial Sequence: Synthetic peptide
  Seed: TLDEKVDKL (MAGC3_HUMAN)
TYDEKVDKY

SEQ ID NO: 102936 - protein, 9 aa, Artificial Sequence
  Description of Artificial Sequence: Synthetic peptide
  Seed: MASASPSVM (MAGC3_HUMAN)
MMSASPSVY

SEQ ID NO: 102937 - protein, 10 aa, Artificial Sequence
  Description of Artificial Sequence: Synthetic peptide
  Seed: YALDEKVAEL (MAGC3_HUMAN)
YGLDEKVAEM

SEQ ID NO: 102938 - protein, 11 aa, Artificial Sequence
  Description of Artificial Sequence: Synthetic peptide
  Seed: SSSEEEDTATW (MAGC3_HUMAN)
SISEEEDTATW

SEQ ID NO: 102939 - protein, 9 aa, Artificial Sequence
  Description of Artificial Sequence: Synthetic peptide
  Seed: VPEEVIWEV (MAGC3_HUMAN)
VSEEVIWEL

SEQ ID NO: 102940 - protein, 10 aa, Artificial Sequence
  Description of Artificial Sequence: Synthetic peptide
  Seed: YALDEKVAEL (MAGC3_HUMAN)
YVLDEKVAEF

SEQ ID NO: 102941 - protein, 10 aa, Artificial Sequence
  Description of Artificial Sequence: Synthetic peptide
  Seed: KKYKDYFPMI (MAGC3_HUMAN)
KWYKDYFPMI

SEQ ID NO: 102942 - protein, 10 aa, Artificial Sequence
  Description of Artificial Sequence: Synthetic peptide
  Seed: YALDEKVAEL (MAGC3_HUMAN)
YLLDEKVAEM

SEQ ID NO: 102943 - protein, 9 aa, Artificial Sequence
  Description of Artificial Sequence: Synthetic peptide
  Seed: LKYQAKEPL (MAGC3_HUMAN)
LSYQAKEPM

SEQ ID NO: 102944 - protein, 9 aa, Artificial Sequence
  Description of Artificial Sequence: Synthetic peptide
  Seed: AGFADVLSR (MAGC3_HUMAN)
ASFADVLSF

SEQ ID NO: 102945 - protein, 9 aa, Artificial Sequence
  Description of Artificial Sequence: Synthetic peptide
  Seed: FADVLSRLA (MAGC3_HUMAN)
FLDVLSRLV

SEQ ID NO: 102946 - protein, 10 aa, Artificial Sequence
  Description of Artificial Sequence: Synthetic peptide
  Seed: REVLEFLSKL (MAGC3_HUMAN)
REVLEFLSKY

SEQ ID NO: 102947 - protein, 9 aa, Artificial Sequence
  Description of Artificial Sequence: Synthetic peptide
  Seed: QTKEPVTKA (MAGC3_HUMAN)
QMKEPVTKK

SEQ ID NO: 102948 - protein, 9 aa, Artificial Sequence
  Description of Artificial Sequence: Synthetic peptide
  Seed: LVQFLLLKY (MAGC3_HUMAN)
LTQFLLLKK

SEQ ID NO: 102949 - protein, 10 aa, Artificial Sequence
  Description of Artificial Sequence: Synthetic peptide
  Seed: INTYTGYFPM (MAGC3_HUMAN)
IITYTGYFPF

SEQ ID NO: 102950 - protein, 9 aa, Artificial Sequence
  Description of Artificial Sequence: Synthetic peptide
  Seed: SLVLCPTYF (MAGC3_HUMAN)
SMVLCPTYL

SEQ ID NO: 102951 - protein, 9 aa, Artificial Sequence
  Description of Artificial Sequence: Synthetic peptide
  Seed: ATYALSPVV (MAGC3_HUMAN)
ALYALSPVW

SEQ ID NO: 102952 - protein, 10 aa, Artificial Sequence
  Description of Artificial Sequence: Synthetic peptide
  Seed: SKLSSIIPSA (MAGC3_HUMAN)
SWLSSIIPSI

SEQ ID NO: 102953 - protein, 9 aa, Artificial Sequence
  Description of Artificial Sequence: Synthetic peptide
  Seed: QTKEPVTKA (MAGC3_HUMAN)
QMKEPVTKM

SEQ ID NO: 102954 - protein, 9 aa, Artificial Sequence
  Description of Artificial Sequence: Synthetic peptide
  Seed: HLREVRLFL (MAGC3_HUMAN)
HSREVRLFL

SEQ ID NO: 102955 - protein, 9 aa, Artificial Sequence
  Description of Artificial Sequence: Synthetic peptide
  Seed: SAFHLGHLR (MAGC3_HUMAN)
SSFHLGHLM

SEQ ID NO: 102956 - protein, 8 aa, Artificial Sequence
  Description of Artificial Sequence: Synthetic peptide
  Seed: MEDRAQAI (MAGC3_HUMAN)
MMDRAQAL

SEQ ID NO: 102957 - protein, 10 aa, Artificial Sequence
  Description of Artificial Sequence: Synthetic peptide
  Seed: TGYFPMIFRK (MAGC3_HUMAN)
TAYFPMIFRP

SEQ ID NO: 102958 - protein, 9 aa, Artificial Sequence
  Description of Artificial Sequence: Synthetic peptide
  Seed: RPAREVLEF (MAGC3_HUMAN)
RSAREVLEL

SEQ ID NO: 102959 - protein, 9 aa, Artificial Sequence
  Description of Artificial Sequence: Synthetic peptide
  Seed: FPSWYMDAL (MAGC3_HUMAN)
FPSWYMDAW

SEQ ID NO: 102960 - protein, 9 aa, Artificial Sequence
  Description of Artificial Sequence: Synthetic peptide
  Seed: LANPQGLAG (MAGC3_HUMAN)
LINPQGLAF

SEQ ID NO: 102961 - protein, 9 aa, Artificial Sequence
  Description of Artificial Sequence: Synthetic peptide
  Seed: HLREVRLFL (MAGC3_HUMAN)
HIREVRLFL

SEQ ID NO: 102962 - protein, 11 aa, Artificial Sequence
  Description of Artificial Sequence: Synthetic peptide
  Seed: LSKLSSIIPSA (MAGC3_HUMAN)
LEKLSSIIPSI

SEQ ID NO: 102963 - protein, 11 aa, Artificial Sequence
  Description of Artificial Sequence: Synthetic peptide
  Seed: SIIPSAFPSWY (MAGC3_HUMAN)
SQIPSAFPSWF

SEQ ID NO: 102964 - protein, 9 aa, Artificial Sequence
  Description of Artificial Sequence: Synthetic peptide
  Seed: SQPEGKFSL (MAGC3_HUMAN)
SIPEGKFSI

SEQ ID NO: 102965 - protein, 9 aa, Artificial Sequence
  Description of Artificial Sequence: Synthetic peptide
  Seed: KAHEFIELI (MAGC3_HUMAN)
KYHEFIELY

SEQ ID NO: 102966 - protein, 9 aa, Artificial Sequence
  Description of Artificial Sequence: Synthetic peptide
  Seed: WRRGTGYTL (MAGC3_HUMAN)
WVRGTGYTF

SEQ ID NO: 102967 - protein, 9 aa, Artificial Sequence
  Description of Artificial Sequence: Synthetic peptide
  Seed: KYKDYFPMI (MAGC3_HUMAN)
KSKDYFPMK

SEQ ID NO: 102968 - protein, 9 aa, Artificial Sequence
  Description of Artificial Sequence: Synthetic peptide
  Seed: LILILSVIF (MAGC3_HUMAN)
LQLILSVIF

SEQ ID NO: 102969 - protein, 9 aa, Artificial Sequence
  Description of Artificial Sequence: Synthetic peptide
  Seed: DSCSSPLLW (MAGC3_HUMAN)
DPCSSPLLW

SEQ ID NO: 102970 - protein, 9 aa, Artificial Sequence
  Description of Artificial Sequence: Synthetic peptide
  Seed: SAFHLGHLR (MAGC3_HUMAN)
SMFHLGHLY

SEQ ID NO: 102971 - protein, 9 aa, Artificial Sequence
  Description of Artificial Sequence: Synthetic peptide
  Seed: MQMNVINTY (MAGC3_HUMAN)
MCMNVINTF

SEQ ID NO: 102972 - protein, 10 aa, Artificial Sequence
  Description of Artificial Sequence: Synthetic peptide
  Seed: INTYTGYFPM (MAGC3_HUMAN)
IMTYTGYFPF

SEQ ID NO: 102973 - protein, 9 aa, Artificial Sequence
  Description of Artificial Sequence: Synthetic peptide
  Seed: DMDPDNHSY (MAGC3_HUMAN)
DMDPDNHSV

SEQ ID NO: 102974 - protein, 10 aa, Artificial Sequence
  Description of Artificial Sequence: Synthetic peptide
  Seed: FLSKLSSIIP (MAGC3_HUMAN)
FLSKLSSIIA

SEQ ID NO: 102975 - protein, 9 aa, Artificial Sequence
  Description of Artificial Sequence: Synthetic peptide
  Seed: NTYTGYFPM (MAGC3_HUMAN)
NYYTGYFPF

SEQ ID NO: 102976 - protein, 9 aa, Artificial Sequence
  Description of Artificial Sequence: Synthetic peptide
  Seed: GFADVLSRL (MAGC3_HUMAN)
GMADVLSRI

SEQ ID NO: 102977 - protein, 9 aa, Artificial Sequence
  Description of Artificial Sequence: Synthetic peptide
  Seed: GYFPMIFRK (MAGC3_HUMAN)
GMFPMIFRY

SEQ ID NO: 102978 - protein, 10 aa, Artificial Sequence
  Description of Artificial Sequence: Synthetic peptide
  Seed: TGYFPMIFRK (MAGC3_HUMAN)
TTYFPMIFRE

SEQ ID NO: 102979 - protein, 10 aa, Artificial Sequence
  Description of Artificial Sequence: Synthetic peptide
  Seed: KLVQFLLLKY (MAGC3_HUMAN)
KKVQFLLLKK

SEQ ID NO: 102980 - protein, 10 aa, Artificial Sequence
  Description of Artificial Sequence: Synthetic peptide
  Seed: MIFGKAHEFI (MAGC3_HUMAN)
MSFGKAHEFI

SEQ ID NO: 102981 - protein, 9 aa, Artificial Sequence
  Description of Artificial Sequence: Synthetic peptide
  Seed: VIKKYKDYF (MAGC3_HUMAN)
VTKKYKDYF

SEQ ID NO: 102982 - protein, 10 aa, Artificial Sequence
  Description of Artificial Sequence: Synthetic peptide
  Seed: LVLCPTYFKL (MAGC3_HUMAN)
LQLCPTYFKI

SEQ ID NO: 102983 - protein, 9 aa, Artificial Sequence
  Description of Artificial Sequence: Synthetic peptide
  Seed: DMDPDNHSY (MAGC3_HUMAN)
DFDPDNHSI

SEQ ID NO: 102984 - protein, 11 aa, Artificial Sequence
  Description of Artificial Sequence: Synthetic peptide
  Seed: FLSKLSSIIPS (MAGC3_HUMAN)
FVSKLSSIIPL

SEQ ID NO: 102985 - protein, 10 aa, Artificial Sequence
  Description of Artificial Sequence: Synthetic peptide
  Seed: TAMASASPSV (MAGC3_HUMAN)
TMMASASPSA

SEQ ID NO: 102986 - protein, 10 aa, Artificial Sequence
  Description of Artificial Sequence: Synthetic peptide
  Seed: RPAREVLEFL (MAGC3_HUMAN)
RTAREVLEFV

SEQ ID NO: 102987 - protein, 9 aa, Artificial Sequence
  Description of Artificial Sequence: Synthetic peptide
  Seed: KYKDYFPMI (MAGC3_HUMAN)
KSKDYFPMM

SEQ ID NO: 102988 - protein, 9 aa, Artificial Sequence
  Description of Artificial Sequence: Synthetic peptide
  Seed: MLTTVIKKY (MAGC3_HUMAN)
MTTTVIKKL

SEQ ID NO: 102989 - protein, 9 aa, Artificial Sequence
  Description of Artificial Sequence: Synthetic peptide
  Seed: FKLWRTLSG (MAGC3_HUMAN)
FQLWRTLSM

SEQ ID NO: 102990 - protein, 9 aa, Artificial Sequence
  Description of Artificial Sequence: Synthetic peptide
  Seed: VIWEVLSAI (MAGC3_HUMAN)
VAWEVLSAI

SEQ ID NO: 102991 - protein, 10 aa, Artificial Sequence
  Description of Artificial Sequence: Synthetic peptide
  Seed: TYTGYFPMIF (MAGC3_HUMAN)
TSTGYFPMIF

SEQ ID NO: 102992 - protein, 9 aa, Artificial Sequence
  Description of Artificial Sequence: Synthetic peptide
  Seed: MQMNVINTY (MAGC3_HUMAN)
MWMNVINTI

SEQ ID NO: 102993 - protein, 9 aa, Artificial Sequence
  Description of Artificial Sequence: Synthetic peptide
  Seed: ALDEKVAEL (MAGC3_HUMAN)
AMDEKVAEA

SEQ ID NO: 102994 - protein, 10 aa, Artificial Sequence
  Description of Artificial Sequence: Synthetic peptide
  Seed: LIFGIALTDM (MAGC3_HUMAN)
LMFGIALTDY

SEQ ID NO: 102995 - protein, 10 aa, Artificial Sequence
  Description of Artificial Sequence: Synthetic peptide
  Seed: IKKYKDYFPM (MAGC3_HUMAN)
ISKYKDYFPY

SEQ ID NO: 102996 - protein, 10 aa, Artificial Sequence
  Description of Artificial Sequence: Synthetic peptide
  Seed: KLSSIIPSAF (MAGC3_HUMAN)
KLSSIIPSAL

SEQ ID NO: 102997 - protein, 9 aa, Artificial Sequence
  Description of Artificial Sequence: Synthetic peptide
  Seed: ALDEKVAEL (MAGC3_HUMAN)
ADDEKVAEM

SEQ ID NO: 102998 - protein, 9 aa, Artificial Sequence
  Description of Artificial Sequence: Synthetic peptide
  Seed: YTGYFPMIF (MAGC3_HUMAN)
YQGYFPMIF

SEQ ID NO: 102999 - protein, 9 aa, Artificial Sequence
  Description of Artificial Sequence: Synthetic peptide
  Seed: FVNTLDLTC (MAGC3_HUMAN)
FVNTLDLTM

SEQ ID NO: 103000 - protein, 10 aa, Artificial Sequence
  Description of Artificial Sequence: Synthetic peptide
  Seed: IPPQGPPKIS (MAGC3_HUMAN)
IPPQGPPKIL

SEQ ID NO: 103001 - protein, 9 aa, Artificial Sequence
  Description of Artificial Sequence: Synthetic peptide
  Seed: KVAELVQFL (MAGC3_HUMAN)
KAAELVQFK

SEQ ID NO: 103002 - protein, 9 aa, Artificial Sequence
  Description of Artificial Sequence: Synthetic peptide
  Seed: FLSKLSSII (MAGC3_HUMAN)
FASKLSSII

SEQ ID NO: 103003 - protein, 11 aa, Artificial Sequence
  Description of Artificial Sequence: Synthetic peptide
  Seed: SPQGPPQSPPQ (MAGC3_HUMAN)
SPQGPPQSPPA

SEQ ID NO: 103004 - protein, 9 aa, Artificial Sequence
  Description of Artificial Sequence: Synthetic peptide
  Seed: MPQNRLLIL (MAGC3_HUMAN)
MPQNRLLIW

SEQ ID NO: 103005 - protein, 9 aa, Artificial Sequence
  Description of Artificial Sequence: Synthetic peptide
  Seed: MASASPSVM (MAGC3_HUMAN)
MGSASPSVW

SEQ ID NO: 103006 - protein, 9 aa, Artificial Sequence
  Description of Artificial Sequence: Synthetic peptide
  Seed: LILILSMIF (MAGC3_HUMAN)
LHLILSMIF

SEQ ID NO: 103007 - protein, 9 aa, Artificial Sequence
  Description of Artificial Sequence: Synthetic peptide
  Seed: MLLPCHWVL (MAGC3_HUMAN)
MVLPCHWVR

SEQ ID NO: 103008 - protein, 9 aa, Artificial Sequence
  Description of Artificial Sequence: Synthetic peptide
  Seed: QTKEPVTKA (MAGC3_HUMAN)
QYKEPVTKK

SEQ ID NO: 103009 - protein, 9 aa, Artificial Sequence
  Description of Artificial Sequence: Synthetic peptide
  Seed: KVAELVQFL (MAGC3_HUMAN)
KVAELVQFY

SEQ ID NO: 103010 - protein, 10 aa, Artificial Sequence
  Description of Artificial Sequence: Synthetic peptide
  Seed: SIIPSAFPSW (MAGC3_HUMAN)
SMIPSAFPSW

SEQ ID NO: 103011 - protein, 9 aa, Artificial Sequence
  Description of Artificial Sequence: Synthetic peptide
  Seed: CLLILILSM (MAGC3_HUMAN)
CQLILILSF

SEQ ID NO: 103012 - protein, 9 aa, Artificial Sequence
  Description of Artificial Sequence: Synthetic peptide
  Seed: RTLSGSPGL (MAGC3_HUMAN)
RSLSGSPGR

SEQ ID NO: 103013 - protein, 9 aa, Artificial Sequence
  Description of Artificial Sequence: Synthetic peptide
  Seed: LANPQGLAG (MAGC3_HUMAN)
LTNPQGLAY

SEQ ID NO: 103014 - protein, 11 aa, Artificial Sequence
  Description of Artificial Sequence: Synthetic peptide
  Seed: TDMDPDNHSYF (MAGC3_HUMAN)
TVMDPDNHSYF

SEQ ID NO: 103015 - protein, 9 aa, Artificial Sequence
  Description of Artificial Sequence: Synthetic peptide
  Seed: NVINTYTGY (MAGC3_HUMAN)
NMINTYTGR

SEQ ID NO: 103016 - protein, 8 aa, Artificial Sequence
  Description of Artificial Sequence: Synthetic peptide
  Seed: LTYEGSLI (MAGC3_HUMAN)
LSYEGSLW

SEQ ID NO: 103017 - protein, 9 aa, Artificial Sequence
  Description of Artificial Sequence: Synthetic peptide
  Seed: IIPSAFPSW (MAGC3_HUMAN)
IWPSAFPSW

SEQ ID NO: 103018 - protein, 11 aa, Artificial Sequence
  Description of Artificial Sequence: Synthetic peptide
  Seed: AIIDTTDDATA (MAGC3_HUMAN)
AVIDTTDDATL

SEQ ID NO: 103019 - protein, 10 aa, Artificial Sequence
  Description of Artificial Sequence: Synthetic peptide
  Seed: AEMLTTVIKK (MAGC3_HUMAN)
ALMLTTVIKK

SEQ ID NO: 103020 - protein, 10 aa, Artificial Sequence
  Description of Artificial Sequence: Synthetic peptide
  Seed: YALSPVVLPP (MAGC3_HUMAN)
YLLSPVVLPM

SEQ ID NO: 103021 - protein, 10 aa, Artificial Sequence
  Description of Artificial Sequence: Synthetic peptide
  Seed: YTGYFPMIFR (MAGC3_HUMAN)
YNGYFPMIFK

SEQ ID NO: 103022 - protein, 9 aa, Artificial Sequence
  Description of Artificial Sequence: Synthetic peptide
  Seed: RGTGYTLSL (MAGC3_HUMAN)
RSTGYTLSV

SEQ ID NO: 103023 - protein, 10 aa, Artificial Sequence
  Description of Artificial Sequence: Synthetic peptide
  Seed: MQMNVINTYT (MAGC3_HUMAN)
MIMNVINTYM

SEQ ID NO: 103024 - protein, 8 aa, Artificial Sequence
  Description of Artificial Sequence: Synthetic peptide
  Seed: KAHEFIEL (MAGC3_HUMAN)
KQHEFIEL

SEQ ID NO: 103025 - protein, 9 aa, Artificial Sequence
  Description of Artificial Sequence: Synthetic peptide
  Seed: EVDPDHFYV (MAGC3_HUMAN)
ELDPDHFYV

SEQ ID NO: 103026 - protein, 9 aa, Artificial Sequence
  Description of Artificial Sequence: Synthetic peptide
  Seed: VLCPTYFKL (MAGC3_HUMAN)
VICPTYFKF

SEQ ID NO: 103027 - protein, 10 aa, Artificial Sequence
  Description of Artificial Sequence: Synthetic peptide
  Seed: YALDEKVAEL (MAGC3_HUMAN)
YVLDEKVAEC

SEQ ID NO: 103028 - protein, 11 aa, Artificial Sequence
  Description of Artificial Sequence: Synthetic peptide
  Seed: SSSEEEDTATW (MAGC3_HUMAN)
STSEEEDTATY

SEQ ID NO: 103029 - protein, 11 aa, Artificial Sequence
  Description of Artificial Sequence: Synthetic peptide
  Seed: SPQGPPQSPPQ (MAGC3_HUMAN)
SPQGPPQSPPM

SEQ ID NO: 103030 - protein, 9 aa, Artificial Sequence
  Description of Artificial Sequence: Synthetic peptide
  Seed: LILILSMIF (MAGC3_HUMAN)
LMLILSMIM

SEQ ID NO: 103031 - protein, 11 aa, Artificial Sequence
  Description of Artificial Sequence: Synthetic peptide
  Seed: AEMQMNVINTY (MAGC3_HUMAN)
AFMQMNVINTF

SEQ ID NO: 103032 - protein, 9 aa, Artificial Sequence
  Description of Artificial Sequence: Synthetic peptide
  Seed: YQAKEPLTR (MAGC3_HUMAN)
YLAKEPLTY

SEQ ID NO: 103033 - protein, 9 aa, Artificial Sequence
  Description of Artificial Sequence: Synthetic peptide
  Seed: KGSCVPEEV (MAGC3_HUMAN)
KLSCVPEEW

SEQ ID NO: 103034 - protein, 10 aa, Artificial Sequence
  Description of Artificial Sequence: Synthetic peptide
  Seed: SIIPSAFPSW (MAGC3_HUMAN)
SSIPSAFPSL

SEQ ID NO: 103035 - protein, 10 aa, Artificial Sequence
  Description of Artificial Sequence: Synthetic peptide
  Seed: IPSAFPSWYM (MAGC3_HUMAN)
IPSAFPSWYW

SEQ ID NO: 103036 - protein, 10 aa, Artificial Sequence
  Description of Artificial Sequence: Synthetic peptide
  Seed: SKLSSIIPSA (MAGC3_HUMAN)
SQLSSIIPSA

SEQ ID NO: 103037 - protein, 10 aa, Artificial Sequence
  Description of Artificial Sequence: Synthetic peptide
  Seed: YSAFHLGHLR (MAGC3_HUMAN)
YRAFHLGHLK

SEQ ID NO: 103038 - protein, 9 aa, Artificial Sequence
  Description of Artificial Sequence: Synthetic peptide
  Seed: ALDEKVAEL (MAGC3_HUMAN)
AQDEKVAEW

SEQ ID NO: 103039 - protein, 9 aa, Artificial Sequence
  Description of Artificial Sequence: Synthetic peptide
  Seed: LKYQAKEPL (MAGC3_HUMAN)
LKYQAKEPM

SEQ ID NO: 103040 - protein, 9 aa, Artificial Sequence
  Description of Artificial Sequence: Synthetic peptide
  Seed: EVLEFLSKL (MAGC3_HUMAN)
ESLEFLSKW

SEQ ID NO: 103041 - protein, 10 aa, Artificial Sequence
  Description of Artificial Sequence: Synthetic peptide
  Seed: FFEDTLDLTY (MAGC3_HUMAN)
FWEDTLDLTF

SEQ ID NO: 103042 - protein, 9 aa, Artificial Sequence
  Description of Artificial Sequence: Synthetic peptide
  Seed: FHLGHLREV (MAGC3_HUMAN)
FYLGHLREV

SEQ ID NO: 103043 - protein, 9 aa, Artificial Sequence
  Description of Artificial Sequence: Synthetic peptide
  Seed: EVIWEVLNA (MAGC3_HUMAN)
EMIWEVLNR

SEQ ID NO: 103044 - protein, 10 aa, Artificial Sequence
  Description of Artificial Sequence: Synthetic peptide
  Seed: IELIFGIALT (MAGC3_HUMAN)
IWLIFGIALI

SEQ ID NO: 103045 - protein, 9 aa, Artificial Sequence
  Description of Artificial Sequence: Synthetic peptide
  Seed: KDSDLPTWR (MAGC3_HUMAN)
KTSDLPTWR

SEQ ID NO: 103046 - protein, 9 aa, Artificial Sequence
  Description of Artificial Sequence: Synthetic peptide
  Seed: MIFGKAHEF (MAGC3_HUMAN)
MVFGKAHEV

SEQ ID NO: 103047 - protein, 9 aa, Artificial Sequence
  Description of Artificial Sequence: Synthetic peptide
  Seed: NAIGPWSAL (MAGC3_HUMAN)
NSIGPWSAY

SEQ ID NO: 103048 - protein, 10 aa, Artificial Sequence
  Description of Artificial Sequence: Synthetic peptide
  Seed: IGPWSALAGF (MAGC3_HUMAN)
IFPWSALAGW

SEQ ID NO: 103049 - protein, 10 aa, Artificial Sequence
  Description of Artificial Sequence: Synthetic peptide
  Seed: FKLWRTLSGS (MAGC3_HUMAN)
FALWRTLSGV

SEQ ID NO: 103050 - protein, 9 aa, Artificial Sequence
  Description of Artificial Sequence: Synthetic peptide
  Seed: KGSCVPEEV (MAGC3_HUMAN)
KLSCVPEEV

SEQ ID NO: 103051 - protein, 11 aa, Artificial Sequence
  Description of Artificial Sequence: Synthetic peptide
  Seed: KFSLRRAVSVK (MAGC3_HUMAN)
KVSLRRAVSVK

SEQ ID NO: 103052 - protein, 9 aa, Artificial Sequence
  Description of Artificial Sequence: Synthetic peptide
  Seed: RTLSGSPGL (MAGC3_HUMAN)
RVLSGSPGF

SEQ ID NO: 103053 - protein, 10 aa, Artificial Sequence
  Description of Artificial Sequence: Synthetic peptide
  Seed: MPAAGMPPLP (MAGC3_HUMAN)
MPAAGMPPLR

SEQ ID NO: 103054 - protein, 9 aa, Artificial Sequence
  Description of Artificial Sequence: Synthetic peptide
  Seed: WRRGTGYTL (MAGC3_HUMAN)
WARGTGYTF

SEQ ID NO: 103055 - protein, 9 aa, Artificial Sequence
  Description of Artificial Sequence: Synthetic peptide
  Seed: ASEEVIWEV (MAGC3_HUMAN)
AIEEVIWEF

SEQ ID NO: 103056 - protein, 9 aa, Artificial Sequence
  Description of Artificial Sequence: Synthetic peptide
  Seed: GQWVKNTCA (MAGC3_HUMAN)
GEWVKNTCT

SEQ ID NO: 103057 - protein, 9 aa, Artificial Sequence
  Description of Artificial Sequence: Synthetic peptide
  Seed: SASPSVMST (MAGC3_HUMAN)
SLSPSVMSF

SEQ ID NO: 103058 - protein, 10 aa, Artificial Sequence
  Description of Artificial Sequence: Synthetic peptide
  Seed: FLSKLSSIIP (MAGC3_HUMAN)
FLSKLSSIII

SEQ ID NO: 103059 - protein, 9 aa, Artificial Sequence
  Description of Artificial Sequence: Synthetic peptide
  Seed: MLLPCHWVL (MAGC3_HUMAN)
MILPCHWVW

SEQ ID NO: 103060 - protein, 9 aa, Artificial Sequence
  Description of Artificial Sequence: Synthetic peptide
  Seed: TYALSPVVL (MAGC3_HUMAN)
THALSPVVV

SEQ ID NO: 103061 - protein, 11 aa, Artificial Sequence
  Description of Artificial Sequence: Synthetic peptide
  Seed: TTDDATAMASA (MAGC3_HUMAN)
TLDDATAMASV

SEQ ID NO: 103062 - protein, 9 aa, Artificial Sequence
  Description of Artificial Sequence: Synthetic peptide
  Seed: TSDQRMDSL (MAGC3_HUMAN)
TTDQRMDSF

SEQ ID NO: 103063 - protein, 9 aa, Artificial Sequence
  Description of Artificial Sequence: Synthetic peptide
  Seed: FGSQPEGKF (MAGC3_HUMAN)
FQSQPEGKF

SEQ ID NO: 103064 - protein, 9 aa, Artificial Sequence
  Description of Artificial Sequence: Synthetic peptide
  Seed: RPAREVLEF (MAGC3_HUMAN)
RKAREVLEF

SEQ ID NO: 103065 - protein, 9 aa, Artificial Sequence
  Description of Artificial Sequence: Synthetic peptide
  Seed: VIWEVLSAI (MAGC3_HUMAN)
VLWEVLSAI

SEQ ID NO: 103066 - protein, 10 aa, Artificial Sequence
  Description of Artificial Sequence: Synthetic peptide
  Seed: MNVINTYTGY (MAGC3_HUMAN)
MPVINTYTGF

SEQ ID NO: 103067 - protein, 10 aa, Artificial Sequence
  Description of Artificial Sequence: Synthetic peptide
  Seed: MIFRKAREFI (MAGC3_HUMAN)
MQFRKAREFK

SEQ ID NO: 103068 - protein, 9 aa, Artificial Sequence
  Description of Artificial Sequence: Synthetic peptide
  Seed: FLSKLSSII (MAGC3_HUMAN)
FISKLSSIL

SEQ ID NO: 103069 - protein, 10 aa, Artificial Sequence
  Description of Artificial Sequence: Synthetic peptide
  Seed: KAHEFIELIF (MAGC3_HUMAN)
KTHEFIELIW

SEQ ID NO: 103070 - protein, 10 aa, Artificial Sequence
  Description of Artificial Sequence: Synthetic peptide
  Seed: EEVIWEVLNA (MAGC3_HUMAN)
ETVIWEVLNA

SEQ ID NO: 103071 - protein, 10 aa, Artificial Sequence
  Description of Artificial Sequence: Synthetic peptide
  Seed: KVDKLVQFLL (MAGC3_HUMAN)
KMDKLVQFLI

SEQ ID NO: 103072 - protein, 9 aa, Artificial Sequence
  Description of Artificial Sequence: Synthetic peptide
  Seed: HFYVFVNTL (MAGC3_HUMAN)
HSYVFVNTL

SEQ ID NO: 103073 - protein, 9 aa, Artificial Sequence
  Description of Artificial Sequence: Synthetic peptide
  Seed: DPDNHSYFF (MAGC3_HUMAN)
DPDNHSYFW

SEQ ID NO: 103074 - protein, 9 aa, Artificial Sequence
  Description of Artificial Sequence: Synthetic peptide
  Seed: REVLEFLSK (MAGC3_HUMAN)
REVLEFLSW

SEQ ID NO: 103075 - protein, 10 aa, Artificial Sequence
  Description of Artificial Sequence: Synthetic peptide
  Seed: SESLPRYALD (MAGC3_HUMAN)
SESLPRYALI

SEQ ID NO: 103076 - protein, 9 aa, Artificial Sequence
  Description of Artificial Sequence: Synthetic peptide
  Seed: YTGYFPMIF (MAGC3_HUMAN)
YQGYFPMIM

SEQ ID NO: 103077 - protein, 10 aa, Artificial Sequence
  Description of Artificial Sequence: Synthetic peptide
  Seed: EEVIWEVLSA (MAGC3_HUMAN)
EMVIWEVLSV

SEQ ID NO: 103078 - protein, 10 aa, Artificial Sequence
  Description of Artificial Sequence: Synthetic peptide
  Seed: RRGTGYTLSL (MAGC3_HUMAN)
RRGTGYTLSF

SEQ ID NO: 103079 - protein, 9 aa, Artificial Sequence
  Description of Artificial Sequence: Synthetic peptide
  Seed: MQMNVINTY (MAGC3_HUMAN)
MRMNVINTI

SEQ ID NO: 103080 - protein, 9 aa, Artificial Sequence
  Description of Artificial Sequence: Synthetic peptide
  Seed: SPQGPPQSP (MAGC3_HUMAN)
SPQGPPQSY

SEQ ID NO: 103081 - protein, 10 aa, Artificial Sequence
  Description of Artificial Sequence: Synthetic peptide
  Seed: LLKYQAKEPL (MAGC3_HUMAN)
LMKYQAKEPM

SEQ ID NO: 103082 - protein, 9 aa, Artificial Sequence
  Description of Artificial Sequence: Synthetic peptide
  Seed: HLREVRLFL (MAGC3_HUMAN)
HMREVRLFR

SEQ ID NO: 103083 - protein, 10 aa, Artificial Sequence
  Description of Artificial Sequence: Synthetic peptide
  Seed: MIFRKAREFI (MAGC3_HUMAN)
MMFRKAREFL

SEQ ID NO: 103084 - protein, 11 aa, Artificial Sequence
  Description of Artificial Sequence: Synthetic peptide
  Seed: MPPLPQSPPEI (MAGC3_HUMAN)
MPPLPQSPPEM

SEQ ID NO: 103085 - protein, 9 aa, Artificial Sequence
  Description of Artificial Sequence: Synthetic peptide
  Seed: YQAKEPLTR (MAGC3_HUMAN)
YGAKEPLTF

SEQ ID NO: 103086 - protein, 10 aa, Artificial Sequence
  Description of Artificial Sequence: Synthetic peptide
  Seed: TEVDPDHFYV (MAGC3_HUMAN)
TAVDPDHFYV

SEQ ID NO: 103087 - protein, 9 aa, Artificial Sequence
  Description of Artificial Sequence: Synthetic peptide
  Seed: YTGYFPMIF (MAGC3_HUMAN)
YYGYFPMII

SEQ ID NO: 103088 - protein, 10 aa, Artificial Sequence
  Description of Artificial Sequence: Synthetic peptide
  Seed: SAFHLGHLRE (MAGC3_HUMAN)
SMFHLGHLRA

SEQ ID NO: 103089 - protein, 10 aa, Artificial Sequence
  Description of Artificial Sequence: Synthetic peptide
  Seed: FFEDTLDLTY (MAGC3_HUMAN)
FVEDTLDLTM

SEQ ID NO: 103090 - protein, 9 aa, Artificial Sequence
  Description of Artificial Sequence: Synthetic peptide
  Seed: TKAEMLTTV (MAGC3_HUMAN)
THAEMLTTF

SEQ ID NO: 103091 - protein, 10 aa, Artificial Sequence
  Description of Artificial Sequence: Synthetic peptide
  Seed: YALDEKVAEL (MAGC3_HUMAN)
YMLDEKVAES

SEQ ID NO: 103092 - protein, 9 aa, Artificial Sequence
  Description of Artificial Sequence: Synthetic peptide
  Seed: KYKDYFPMI (MAGC3_HUMAN)
KMKDYFPMY

SEQ ID NO: 103093 - protein, 9 aa, Artificial Sequence
  Description of Artificial Sequence: Synthetic peptide
  Seed: LKYQTKEPV (MAGC3_HUMAN)
LMYQTKEPF

SEQ ID NO: 103094 - protein, 10 aa, Artificial Sequence
  Description of Artificial Sequence: Synthetic peptide
  Seed: KDMEDRAQAI (MAGC3_HUMAN)
KEMEDRAQAF

SEQ ID NO: 103095 - protein, 9 aa, Artificial Sequence
  Description of Artificial Sequence: Synthetic peptide
  Seed: SLPESEPLF (MAGC3_HUMAN)
SLPESEPLY

SEQ ID NO: 103096 - protein, 9 aa, Artificial Sequence
  Description of Artificial Sequence: Synthetic peptide
  Seed: HALPESESL (MAGC3_HUMAN)
HTLPESESW

SEQ ID NO: 103097 - protein, 10 aa, Artificial Sequence
  Description of Artificial Sequence: Synthetic peptide
  Seed: EKVAELVQFL (MAGC3_HUMAN)
EPVAELVQFL

SEQ ID NO: 103098 - protein, 9 aa, Artificial Sequence
  Description of Artificial Sequence: Synthetic peptide
  Seed: SPSVMSTNF (MAGC3_HUMAN)
SQSVMSTNM

SEQ ID NO: 103099 - protein, 9 aa, Artificial Sequence
  Description of Artificial Sequence: Synthetic peptide
  Seed: DMEDRAQAI (MAGC3_HUMAN)
DREDRAQAL

SEQ ID NO: 103100 - protein, 9 aa, Artificial Sequence
  Description of Artificial Sequence: Synthetic peptide
  Seed: VIKKYKDYF (MAGC3_HUMAN)
VLKKYKDYY

SEQ ID NO: 103101 - protein, 9 aa, Artificial Sequence
  Description of Artificial Sequence: Synthetic peptide
  Seed: AGFADVLSR (MAGC3_HUMAN)
AWFADVLSR

SEQ ID NO: 103102 - protein, 10 aa, Artificial Sequence
  Description of Artificial Sequence: Synthetic peptide
  Seed: REVRLFLRGG (MAGC3_HUMAN)
RKVRLFLRGV

SEQ ID NO: 103103 - protein, 9 aa, Artificial Sequence
  Description of Artificial Sequence: Synthetic peptide
  Seed: LIDDQGMPK (MAGC3_HUMAN)
LFDDQGMPI

SEQ ID NO: 103104 - protein, 10 aa, Artificial Sequence
  Description of Artificial Sequence: Synthetic peptide
  Seed: SSEEEDTATW (MAGC3_HUMAN)
SEEEEDTATY

SEQ ID NO: 103105 - protein, 9 aa, Artificial Sequence
  Description of Artificial Sequence: Synthetic peptide
  Seed: NAIGPWSAL (MAGC3_HUMAN)
NWIGPWSAL

SEQ ID NO: 103106 - protein, 9 aa, Artificial Sequence
  Description of Artificial Sequence: Synthetic peptide
  Seed: MIFIKGSCV (MAGC3_HUMAN)
MLFIKGSCV

SEQ ID NO: 103107 - protein, 9 aa, Artificial Sequence
  Description of Artificial Sequence: Synthetic peptide
  Seed: AGFADVLSR (MAGC3_HUMAN)
AMFADVLSK

SEQ ID NO: 103108 - protein, 8 aa, Artificial Sequence
  Description of Artificial Sequence: Synthetic peptide
  Seed: FADVLSRL (MAGC3_HUMAN)
FADVLSRI

SEQ ID NO: 103109 - protein, 9 aa, Artificial Sequence
  Description of Artificial Sequence: Synthetic peptide
  Seed: VLCPTYFKL (MAGC3_HUMAN)
VGCPTYFKF

SEQ ID NO: 103110 - protein, 9 aa, Artificial Sequence
  Description of Artificial Sequence: Synthetic peptide
  Seed: HLREVRLFL (MAGC3_HUMAN)
HNREVRLFK

SEQ ID NO: 103111 - protein, 9 aa, Artificial Sequence
  Description of Artificial Sequence: Synthetic peptide
  Seed: FLSKLSSII (MAGC3_HUMAN)
FQSKLSSIW

SEQ ID NO: 103112 - protein, 11 aa, Artificial Sequence
  Description of Artificial Sequence: Synthetic peptide
  Seed: LSKLSSIIPSA (MAGC3_HUMAN)
LSKLSSIIPSV

SEQ ID NO: 103113 - protein, 10 aa, Artificial Sequence
  Description of Artificial Sequence: Synthetic peptide
  Seed: SLRRAVSVKQ (MAGC3_HUMAN)
SIRRAVSVKK

SEQ ID NO: 103114 - protein, 10 aa, Artificial Sequence
  Description of Artificial Sequence: Synthetic peptide
  Seed: YALDEKVAEL (MAGC3_HUMAN)
YLLDEKVAET

SEQ ID NO: 103115 - protein, 10 aa, Artificial Sequence
  Description of Artificial Sequence: Synthetic peptide
  Seed: MIFRKAREFI (MAGC3_HUMAN)
MLFRKAREFL

SEQ ID NO: 103116 - protein, 10 aa, Artificial Sequence
  Description of Artificial Sequence: Synthetic peptide
  Seed: YALDEKVAEL (MAGC3_HUMAN)
YSLDEKVAEI

SEQ ID NO: 103117 - protein, 10 aa, Artificial Sequence
  Description of Artificial Sequence: Synthetic peptide
  Seed: IKKYKDYFPM (MAGC3_HUMAN)
ITKYKDYFPF

SEQ ID NO: 103118 - protein, 9 aa, Artificial Sequence
  Description of Artificial Sequence: Synthetic peptide
  Seed: MQMNVINTY (MAGC3_HUMAN)
MQMNVINTR

SEQ ID NO: 103119 - protein, 9 aa, Artificial Sequence
  Description of Artificial Sequence: Synthetic peptide
  Seed: FSLRRAVSV (MAGC3_HUMAN)
FPLRRAVSA

SEQ ID NO: 103120 - protein, 10 aa, Artificial Sequence
  Description of Artificial Sequence: Synthetic peptide
  Seed: IKKYKDYFPM (MAGC3_HUMAN)
IWKYKDYFPF

SEQ ID NO: 103121 - protein, 10 aa, Artificial Sequence
  Description of Artificial Sequence: Synthetic peptide
  Seed: LPTWRRGTGY (MAGC3_HUMAN)
LTTWRRGTGF

SEQ ID NO: 103122 - protein, 9 aa, Artificial Sequence
  Description of Artificial Sequence: Synthetic peptide
  Seed: DMDPDNHSY (MAGC3_HUMAN)
DIDPDNHSI

SEQ ID NO: 103123 - protein, 10 aa, Artificial Sequence
  Description of Artificial Sequence: Synthetic peptide
  Seed: TGYFPMIFRK (MAGC3_HUMAN)
TMYFPMIFRS

SEQ ID NO: 103124 - protein, 9 aa, Artificial Sequence
  Description of Artificial Sequence: Synthetic peptide
  Seed: FSDGSLGQW (MAGC3_HUMAN)
FGDGSLGQI

SEQ ID NO: 103125 - protein, 8 aa, Artificial Sequence
  Description of Artificial Sequence: Synthetic peptide
  Seed: VLCPTYFK (MAGC3_HUMAN)
VFCPTYFR

SEQ ID NO: 103126 - protein, 9 aa, Artificial Sequence
  Description of Artificial Sequence: Synthetic peptide
  Seed: ALDEKVAEL (MAGC3_HUMAN)
AFDEKVAEY

SEQ ID NO: 103127 - protein, 9 aa, Artificial Sequence
  Description of Artificial Sequence: Synthetic peptide
  Seed: EMLTTVIKK (MAGC3_HUMAN)
EALTTVIKK

SEQ ID NO: 103128 - protein, 10 aa, Artificial Sequence
  Description of Artificial Sequence: Synthetic peptide
  Seed: KLSSIIPSAF (MAGC3_HUMAN)
KISSIIPSAV

SEQ ID NO: 103129 - protein, 9 aa, Artificial Sequence
  Description of Artificial Sequence: Synthetic peptide
  Seed: MLLPCHWVL (MAGC3_HUMAN)
MYLPCHWVF

SEQ ID NO: 103130 - protein, 9 aa, Artificial Sequence
  Description of Artificial Sequence: Synthetic peptide
  Seed: YFPMIFRKA (MAGC3_HUMAN)
YFPMIFRKL

SEQ ID NO: 103131 - protein, 9 aa, Artificial Sequence
  Description of Artificial Sequence: Synthetic peptide
  Seed: KLVQFLLLK (MAGC3_HUMAN)
KMVQFLLLM

SEQ ID NO: 103132 - protein, 10 aa, Artificial Sequence
  Description of Artificial Sequence: Synthetic peptide
  Seed: EVIWEVLSAI (MAGC3_HUMAN)
ETIWEVLSAS

SEQ ID NO: 103133 - protein, 10 aa, Artificial Sequence
  Description of Artificial Sequence: Synthetic peptide
  Seed: MQMNVINTYT (MAGC3_HUMAN)
MKMNVINTYN

SEQ ID NO: 103134 - protein, 10 aa, Artificial Sequence
  Description of Artificial Sequence: Synthetic peptide
  Seed: IKKYKDYFPM (MAGC3_HUMAN)
ICKYKDYFPY

SEQ ID NO: 103135 - protein, 9 aa, Artificial Sequence
  Description of Artificial Sequence: Synthetic peptide
  Seed: HALPESESL (MAGC3_HUMAN)
HLLPESESA

SEQ ID NO: 103136 - protein, 11 aa, Artificial Sequence
  Description of Artificial Sequence: Synthetic peptide
  Seed: IIDTTDDATAM (MAGC3_HUMAN)
IVDTTDDATAF

SEQ ID NO: 103137 - protein, 10 aa, Artificial Sequence
  Description of Artificial Sequence: Synthetic peptide
  Seed: KLSSIIPSAF (MAGC3_HUMAN)
KFSSIIPSAY

SEQ ID NO: 103138 - protein, 10 aa, Artificial Sequence
  Description of Artificial Sequence: Synthetic peptide
  Seed: KLVQFLLLKY (MAGC3_HUMAN)
KMVQFLLLKY

SEQ ID NO: 103139 - protein, 9 aa, Artificial Sequence
  Description of Artificial Sequence: Synthetic peptide
  Seed: MQMNVINTY (MAGC3_HUMAN)
MFMNVINTM

SEQ ID NO: 103140 - protein, 9 aa, Artificial Sequence
  Description of Artificial Sequence: Synthetic peptide
  Seed: WVKNTCATY (MAGC3_HUMAN)
WSKNTCATW

SEQ ID NO: 103141 - protein, 10 aa, Artificial Sequence
  Description of Artificial Sequence: Synthetic peptide
  Seed: FPSWYMDALK (MAGC3_HUMAN)
FPSWYMDALF

SEQ ID NO: 103142 - protein, 9 aa, Artificial Sequence
  Description of Artificial Sequence: Synthetic peptide
  Seed: FLSKLSSII (MAGC3_HUMAN)
FTSKLSSIA

SEQ ID NO: 103143 - protein, 9 aa, Artificial Sequence
  Description of Artificial Sequence: Synthetic peptide
  Seed: KVAELVQFL (MAGC3_HUMAN)
KSAELVQFV

SEQ ID NO: 103144 - protein, 10 aa, Artificial Sequence
  Description of Artificial Sequence: Synthetic peptide
  Seed: LILILSMIFI (MAGC3_HUMAN)
LILILSMIFV

SEQ ID NO: 103145 - protein, 10 aa, Artificial Sequence
  Description of Artificial Sequence: Synthetic peptide
  Seed: MDSLVLCPTY (MAGC3_HUMAN)
MWSLVLCPTW

SEQ ID NO: 103146 - protein, 10 aa, Artificial Sequence
  Description of Artificial Sequence: Synthetic peptide
  Seed: FSDGSLGQWV (MAGC3_HUMAN)
FVDGSLGQWF

SEQ ID NO: 103147 - protein, 9 aa, Artificial Sequence
  Description of Artificial Sequence: Synthetic peptide
  Seed: EVLNAIGPW (MAGC3_HUMAN)
EALNAIGPY

SEQ ID NO: 103148 - protein, 9 aa, Artificial Sequence
  Description of Artificial Sequence: Synthetic peptide
  Seed: YKDYFPMIF (MAGC3_HUMAN)
YPDYFPMIL

SEQ ID NO: 103149 - protein, 10 aa, Artificial Sequence
  Description of Artificial Sequence: Synthetic peptide
  Seed: INTYTGYFPM (MAGC3_HUMAN)
IPTYTGYFPF

SEQ ID NO: 103150 - protein, 9 aa, Artificial Sequence
  Description of Artificial Sequence: Synthetic peptide
  Seed: KAHEFIELI (MAGC3_HUMAN)
KEHEFIELM

SEQ ID NO: 103151 - protein, 9 aa, Artificial Sequence
  Description of Artificial Sequence: Synthetic peptide
  Seed: LIDDQGMPK (MAGC3_HUMAN)
LMDDQGMPF

SEQ ID NO: 103152 - protein, 10 aa, Artificial Sequence
  Description of Artificial Sequence: Synthetic peptide
  Seed: YTGYFPMIFR (MAGC3_HUMAN)
YQGYFPMIFK

SEQ ID NO: 103153 - protein, 9 aa, Artificial Sequence
  Description of Artificial Sequence: Synthetic peptide
  Seed: LVLCPTYFK (MAGC3_HUMAN)
LILCPTYFK

SEQ ID NO: 103154 - protein, 11 aa, Artificial Sequence
  Description of Artificial Sequence: Synthetic peptide
  Seed: LSDEQGMPQNR (MAGC3_HUMAN)
LVDEQGMPQNY

SEQ ID NO: 103155 - protein, 8 aa, Artificial Sequence
  Description of Artificial Sequence: Synthetic peptide
  Seed: MEDRAQAI (MAGC3_HUMAN)
MIDRAQAF

SEQ ID NO: 103156 - protein, 10 aa, Artificial Sequence
  Description of Artificial Sequence: Synthetic peptide
  Seed: ILILSVIFIK (MAGC3_HUMAN)
IAILSVIFIK

SEQ ID NO: 103157 - protein, 9 aa, Artificial Sequence
  Description of Artificial Sequence: Synthetic peptide
  Seed: ISPQGPPQS (MAGC3_HUMAN)
IPPQGPPQL

SEQ ID NO: 103158 - protein, 10 aa, Artificial Sequence
  Description of Artificial Sequence: Synthetic peptide
  Seed: YQAKEPLTRA (MAGC3_HUMAN)
YTAKEPLTRV

SEQ ID NO: 103159 - protein, 8 aa, Artificial Sequence
  Description of Artificial Sequence: Synthetic peptide
  Seed: IFGKAHEF (MAGC3_HUMAN)
IAGKAHEV

SEQ ID NO: 103160 - protein, 9 aa, Artificial Sequence
  Description of Artificial Sequence: Synthetic peptide
  Seed: MIFGKAHEF (MAGC3_HUMAN)
MYFGKAHEA

SEQ ID NO: 103161 - protein, 11 aa, Artificial Sequence
  Description of Artificial Sequence: Synthetic peptide
  Seed: SVLDLANPQGL (MAGC3_HUMAN)
SLLDLANPQGV

SEQ ID NO: 103162 - protein, 10 aa, Artificial Sequence
  Description of Artificial Sequence: Synthetic peptide
  Seed: MQMNVINTYT (MAGC3_HUMAN)
MRMNVINTYL

SEQ ID NO: 103163 - protein, 10 aa, Artificial Sequence
  Description of Artificial Sequence: Synthetic peptide
  Seed: YALDEKVAEL (MAGC3_HUMAN)
YWLDEKVAEV

SEQ ID NO: 103164 - protein, 10 aa, Artificial Sequence
  Description of Artificial Sequence: Synthetic peptide
  Seed: TTDDATAMAS (MAGC3_HUMAN)
TGDDATAMAF

SEQ ID NO: 103165 - protein, 9 aa, Artificial Sequence
  Description of Artificial Sequence: Synthetic peptide
  Seed: FSDGSLGQW (MAGC3_HUMAN)
FSDGSLGQL

SEQ ID NO: 103166 - protein, 11 aa, Artificial Sequence
  Description of Artificial Sequence: Synthetic peptide
  Seed: RTLSGSPGLQL (MAGC3_HUMAN)
RGLSGSPGLQY

SEQ ID NO: 103167 - protein, 10 aa, Artificial Sequence
  Description of Artificial Sequence: Synthetic peptide
  Seed: KKYKDYFPMI (MAGC3_HUMAN)
KNYKDYFPMF

SEQ ID NO: 103168 - protein, 10 aa, Artificial Sequence
  Description of Artificial Sequence: Synthetic peptide
  Seed: RPAREVLEFL (MAGC3_HUMAN)
RPAREVLEFK

SEQ ID NO: 103169 - protein, 10 aa, Artificial Sequence
  Description of Artificial Sequence: Synthetic peptide
  Seed: VLDLANPQGL (MAGC3_HUMAN)
VADLANPQGM

SEQ ID NO: 103170 - protein, 10 aa, Artificial Sequence
  Description of Artificial Sequence: Synthetic peptide
  Seed: ALDEKVAELV (MAGC3_HUMAN)
ATDEKVAELI

SEQ ID NO: 103171 - protein, 10 aa, Artificial Sequence
  Description of Artificial Sequence: Synthetic peptide
  Seed: YALDEKVAEL (MAGC3_HUMAN)
YFLDEKVAEL

SEQ ID NO: 103172 - protein, 9 aa, Artificial Sequence
  Description of Artificial Sequence: Synthetic peptide
  Seed: NAIGPWSAL (MAGC3_HUMAN)
NAIGPWSAH

SEQ ID NO: 103173 - protein, 9 aa, Artificial Sequence
  Description of Artificial Sequence: Synthetic peptide
  Seed: YQAKEPLTR (MAGC3_HUMAN)
YVAKEPLTI

SEQ ID NO: 103174 - protein, 9 aa, Artificial Sequence
  Description of Artificial Sequence: Synthetic peptide
  Seed: TEVDPDHFY (MAGC3_HUMAN)
TWVDPDHFY

SEQ ID NO: 103175 - protein, 9 aa, Artificial Sequence
  Description of Artificial Sequence: Synthetic peptide
  Seed: FEDTLDLTY (MAGC3_HUMAN)
FADTLDLTM

SEQ ID NO: 103176 - protein, 9 aa, Artificial Sequence
  Description of Artificial Sequence: Synthetic peptide
  Seed: TSDQRMDSL (MAGC3_HUMAN)
TWDQRMDSL

SEQ ID NO: 103177 - protein, 9 aa, Artificial Sequence
  Description of Artificial Sequence: Synthetic peptide
  Seed: IQRPAREVL (MAGC3_HUMAN)
IFRPAREVY

SEQ ID NO: 103178 - protein, 10 aa, Artificial Sequence
  Description of Artificial Sequence: Synthetic peptide
  Seed: YFPMIFGKAH (MAGC3_HUMAN)
YYPMIFGKAY

SEQ ID NO: 103179 - protein, 9 aa, Artificial Sequence
  Description of Artificial Sequence: Synthetic peptide
  Seed: LSSIIPSAF (MAGC3_HUMAN)
LTSIIPSAM

SEQ ID NO: 103180 - protein, 11 aa, Artificial Sequence
  Description of Artificial Sequence: Synthetic peptide
  Seed: RYALDEKVAEL (MAGC3_HUMAN)
RGALDEKVAEV

SEQ ID NO: 103181 - protein, 9 aa, Artificial Sequence
  Description of Artificial Sequence: Synthetic peptide
  Seed: FFEDTLDLT (MAGC3_HUMAN)
FFEDTLDLI

SEQ ID NO: 103182 - protein, 9 aa, Artificial Sequence
  Description of Artificial Sequence: Synthetic peptide
  Seed: TEASPQQKK (MAGC3_HUMAN)
TSASPQQKF

SEQ ID NO: 103183 - protein, 9 aa, Artificial Sequence
  Description of Artificial Sequence: Synthetic peptide
  Seed: KAHEFIELI (MAGC3_HUMAN)
KGHEFIELW

SEQ ID NO: 103184 - protein, 10 aa, Artificial Sequence
  Description of Artificial Sequence: Synthetic peptide
  Seed: MIFGKAHEFI (MAGC3_HUMAN)
MVFGKAHEFI

SEQ ID NO: 103185 - protein, 10 aa, Artificial Sequence
  Description of Artificial Sequence: Synthetic peptide
  Seed: LNAIGPWSAL (MAGC3_HUMAN)
LKAIGPWSAY

SEQ ID NO: 103186 - protein, 10 aa, Artificial Sequence
  Description of Artificial Sequence: Synthetic peptide
  Seed: MNVINTYTGY (MAGC3_HUMAN)
MDVINTYTGK

SEQ ID NO: 103187 - protein, 9 aa, Artificial Sequence
  Description of Artificial Sequence: Synthetic peptide
  Seed: RRAVSVKQR (MAGC3_HUMAN)
RRAVSVKQY

SEQ ID NO: 103188 - protein, 11 aa, Artificial Sequence
  Description of Artificial Sequence: Synthetic peptide
  Seed: ILFGISLTEVD (MAGC3_HUMAN)
ILFGISLTEVE

SEQ ID NO: 103189 - protein, 9 aa, Artificial Sequence
  Description of Artificial Sequence: Synthetic peptide
  Seed: KVAELVQFL (MAGC3_HUMAN)
KIAELVQFV

SEQ ID NO: 103190 - protein, 10 aa, Artificial Sequence
  Description of Artificial Sequence: Synthetic peptide
  Seed: LDLANPQGLA (MAGC3_HUMAN)
LHLANPQGLV

SEQ ID NO: 103191 - protein, 10 aa, Artificial Sequence
  Description of Artificial Sequence: Synthetic peptide
  Seed: EKVAELVQFL (MAGC3_HUMAN)
ELVAELVQFY

SEQ ID NO: 103192 - protein, 9 aa, Artificial Sequence
  Description of Artificial Sequence: Synthetic peptide
  Seed: ELVQFLLLK (MAGC3_HUMAN)
ESVQFLLLK

SEQ ID NO: 103193 - protein, 11 aa, Artificial Sequence
  Description of Artificial Sequence: Synthetic peptide
  Seed: FIELIFGIALT (MAGC3_HUMAN)
FQELIFGIALL

SEQ ID NO: 103194 - protein, 11 aa, Artificial Sequence
  Description of Artificial Sequence: Synthetic peptide
  Seed: IIDTTDDATAM (MAGC3_HUMAN)
IYDTTDDATAI

SEQ ID NO: 103195 - protein, 10 aa, Artificial Sequence
  Description of Artificial Sequence: Synthetic peptide
  Seed: MLLPCHWVLD (MAGC3_HUMAN)
MPLPCHWVLV

SEQ ID NO: 103196 - protein, 10 aa, Artificial Sequence
  Description of Artificial Sequence: Synthetic peptide
  Seed: GLRSAEGSVL (MAGC3_HUMAN)
GQRSAEGSVF

SEQ ID NO: 103197 - protein, 9 aa, Artificial Sequence
  Description of Artificial Sequence: Synthetic peptide
  Seed: TEASPQQKK (MAGC3_HUMAN)
TEASPQQKF

SEQ ID NO: 103198 - protein, 9 aa, Artificial Sequence
  Description of Artificial Sequence: Synthetic peptide
  Seed: MLLPCHWVL (MAGC3_HUMAN)
MSLPCHWVR

SEQ ID NO: 103199 - protein, 9 aa, Artificial Sequence
  Description of Artificial Sequence: Synthetic peptide
  Seed: QPQPRKKAT (MAGC3_HUMAN)
QPQPRKKAL

SEQ ID NO: 103200 - protein, 9 aa, Artificial Sequence
  Description of Artificial Sequence: Synthetic peptide
  Seed: RGTGYTLSL (MAGC3_HUMAN)
RETGYTLSF

SEQ ID NO: 103201 - protein, 9 aa, Artificial Sequence
  Description of Artificial Sequence: Synthetic peptide
  Seed: VLCPTYFKL (MAGC3_HUMAN)
VTCPTYFKI

SEQ ID NO: 103202 - protein, 9 aa, Artificial Sequence
  Description of Artificial Sequence: Synthetic peptide
  Seed: FKLWRTLSG (MAGC3_HUMAN)
FSLWRTLSY

SEQ ID NO: 103203 - protein, 9 aa, Artificial Sequence
  Description of Artificial Sequence: Synthetic peptide
  Seed: VIWEVLSAI (MAGC3_HUMAN)
VQWEVLSAI

SEQ ID NO: 103204 - protein, 10 aa, Artificial Sequence
  Description of Artificial Sequence: Synthetic peptide
  Seed: MQMNVINTYT (MAGC3_HUMAN)
MIMNVINTYF

SEQ ID NO: 103205 - protein, 10 aa, Artificial Sequence
  Description of Artificial Sequence: Synthetic peptide
  Seed: KKYKDYFPMI (MAGC3_HUMAN)
KNYKDYFPMK

SEQ ID NO: 103206 - protein, 10 aa, Artificial Sequence
  Description of Artificial Sequence: Synthetic peptide
  Seed: MLLPCHWVLD (MAGC3_HUMAN)
MSLPCHWVLV

SEQ ID NO: 103207 - protein, 11 aa, Artificial Sequence
  Description of Artificial Sequence: Synthetic peptide
  Seed: TTDDATAMASA (MAGC3_HUMAN)
TVDDATAMASF

SEQ ID NO: 103208 - protein, 9 aa, Artificial Sequence
  Description of Artificial Sequence: Synthetic peptide
  Seed: MIFGKAHEF (MAGC3_HUMAN)
MIFGKAHEV

SEQ ID NO: 103209 - protein, 9 aa, Artificial Sequence
  Description of Artificial Sequence: Synthetic peptide
  Seed: RTLSGSPGL (MAGC3_HUMAN)
RLLSGSPGV

SEQ ID NO: 103210 - protein, 9 aa, Artificial Sequence
  Description of Artificial Sequence: Synthetic peptide
  Seed: AVSPGKRLW (MAGC3_HUMAN)
ASSPGKRLF

SEQ ID NO: 103211 - protein, 9 aa, Artificial Sequence
  Description of Artificial Sequence: Synthetic peptide
  Seed: MIFGKAHEF (MAGC3_HUMAN)
MFFGKAHEV

SEQ ID NO: 103212 - protein, 9 aa, Artificial Sequence
  Description of Artificial Sequence: Synthetic peptide
  Seed: SIIPSAFPS (MAGC3_HUMAN)
STIPSAFPI

SEQ ID NO: 103213 - protein, 10 aa, Artificial Sequence
  Description of Artificial Sequence: Synthetic peptide
  Seed: KKYKDYFPMI (MAGC3_HUMAN)
KLYKDYFPMF

SEQ ID NO: 103214 - protein, 9 aa, Artificial Sequence
  Description of Artificial Sequence: Synthetic peptide
  Seed: KLSSIIPSA (MAGC3_HUMAN)
KQSSIIPSI

SEQ ID NO: 103215 - protein, 10 aa, Artificial Sequence
  Description of Artificial Sequence: Synthetic peptide
  Seed: YTLDEKVDKL (MAGC3_HUMAN)
YQLDEKVDKF

SEQ ID NO: 103216 - protein, 11 aa, Artificial Sequence
  Description of Artificial Sequence: Synthetic peptide
  Seed: VLNAIGPWSAL (MAGC3_HUMAN)
VLNAIGPWSAV

SEQ ID NO: 103217 - protein, 9 aa, Artificial Sequence
  Description of Artificial Sequence: Synthetic peptide
  Seed: EVLSAIGPI (MAGC3_HUMAN)
EILSAIGPM

SEQ ID NO: 103218 - protein, 9 aa, Artificial Sequence
  Description of Artificial Sequence: Synthetic peptide
  Seed: MLLPCHWVL (MAGC3_HUMAN)
MPLPCHWVY

SEQ ID NO: 103219 - protein, 11 aa, Artificial Sequence
  Description of Artificial Sequence: Synthetic peptide
  Seed: SSSEEEDTATW (MAGC3_HUMAN)
SQSEEEDTATW

SEQ ID NO: 103220 - protein, 9 aa, Artificial Sequence
  Description of Artificial Sequence: Synthetic peptide
  Seed: IQRPAREVL (MAGC3_HUMAN)
IKRPAREVY

SEQ ID NO: 103221 - protein, 10 aa, Artificial Sequence
  Description of Artificial Sequence: Synthetic peptide
  Seed: FKLWRTLSGS (MAGC3_HUMAN)
FNLWRTLSGA

SEQ ID NO: 103222 - protein, 9 aa, Artificial Sequence
  Description of Artificial Sequence: Synthetic peptide
  Seed: MIFRKAREF (MAGC3_HUMAN)
MAFRKAREA

SEQ ID NO: 103223 - protein, 11 aa, Artificial Sequence
  Description of Artificial Sequence: Synthetic peptide
  Seed: SAFPSWYMDAL (MAGC3_HUMAN)
SPFPSWYMDAM

SEQ ID NO: 103224 - protein, 9 aa, Artificial Sequence
  Description of Artificial Sequence: Synthetic peptide
  Seed: ALDEKVAEL (MAGC3_HUMAN)
AMDEKVAEV

SEQ ID NO: 103225 - protein, 9 aa, Artificial Sequence
  Description of Artificial Sequence: Synthetic peptide
  Seed: YKDYFPMIF (MAGC3_HUMAN)
YKDYFPMIY

SEQ ID NO: 103226 - protein, 8 aa, Artificial Sequence
  Description of Artificial Sequence: Synthetic peptide
  Seed: TTDDATAM (MAGC3_HUMAN)
TADDATAF

SEQ ID NO: 103227 - protein, 9 aa, Artificial Sequence
  Description of Artificial Sequence: Synthetic peptide
  Seed: MQMNVINTY (MAGC3_HUMAN)
MDMNVINTY

SEQ ID NO: 103228 - protein, 9 aa, Artificial Sequence
  Description of Artificial Sequence: Synthetic peptide
  Seed: LKYQAKEPL (MAGC3_HUMAN)
LQYQAKEPY

SEQ ID NO: 103229 - protein, 10 aa, Artificial Sequence
  Description of Artificial Sequence: Synthetic peptide
  Seed: EKVAELVQFL (MAGC3_HUMAN)
ENVAELVQFI

SEQ ID NO: 103230 - protein, 11 aa, Artificial Sequence
  Description of Artificial Sequence: Synthetic peptide
  Seed: FIELIFGIALT (MAGC3_HUMAN)
FLELIFGIALV

SEQ ID NO: 103231 - protein, 10 aa, Artificial Sequence
  Description of Artificial Sequence: Synthetic peptide
  Seed: SKLSSIIPSA (MAGC3_HUMAN)
SPLSSIIPSV

SEQ ID NO: 103232 - protein, 10 aa, Artificial Sequence
  Description of Artificial Sequence: Synthetic peptide
  Seed: ATFSDGSLGQ (MAGC3_HUMAN)
ATFSDGSLGK

SEQ ID NO: 103233 - protein, 11 aa, Artificial Sequence
  Description of Artificial Sequence: Synthetic peptide
  Seed: TAMASASPSVM (MAGC3_HUMAN)
TVMASASPSVF

SEQ ID NO: 103234 - protein, 9 aa, Artificial Sequence
  Description of Artificial Sequence: Synthetic peptide
  Seed: WVKNTCATY (MAGC3_HUMAN)
WFKNTCATL

SEQ ID NO: 103235 - protein, 9 aa, Artificial Sequence
  Description of Artificial Sequence: Synthetic peptide
  Seed: ILILSMIFI (MAGC3_HUMAN)
ILILSMIFA

SEQ ID NO: 103236 - protein, 9 aa, Artificial Sequence
  Description of Artificial Sequence: Synthetic peptide
  Seed: YQAKEPLTR (MAGC3_HUMAN)
YEAKEPLTY

SEQ ID NO: 103237 - protein, 9 aa, Artificial Sequence
  Description of Artificial Sequence: Synthetic peptide
  Seed: SLGQWVKNT (MAGC3_HUMAN)
SLGQWVKNL

SEQ ID NO: 103238 - protein, 10 aa, Artificial Sequence
  Description of Artificial Sequence: Synthetic peptide
  Seed: GSLPESEPLF (MAGC3_HUMAN)
GQLPESEPLL

SEQ ID NO: 103239 - protein, 10 aa, Artificial Sequence
  Description of Artificial Sequence: Synthetic peptide
  Seed: EEDTATWHAL (MAGC3_HUMAN)
EEDTATWHAY

SEQ ID NO: 103240 - protein, 10 aa, Artificial Sequence
  Description of Artificial Sequence: Synthetic peptide
  Seed: SDQRMDSLVL (MAGC3_HUMAN)
SYQRMDSLVY

SEQ ID NO: 103241 - protein, 9 aa, Artificial Sequence
  Description of Artificial Sequence: Synthetic peptide
  Seed: KVDKLVQFL (MAGC3_HUMAN)
KEDKLVQFM

SEQ ID NO: 103242 - protein, 8 aa, Artificial Sequence
  Description of Artificial Sequence: Synthetic peptide
  Seed: IQRPAREV (MAGC3_HUMAN)
IARPAREY

SEQ ID NO: 103243 - protein, 10 aa, Artificial Sequence
  Description of Artificial Sequence: Synthetic peptide
  Seed: IPSAFPSWYM (MAGC3_HUMAN)
IGSAFPSWYW

SEQ ID NO: 103244 - protein, 10 aa, Artificial Sequence
  Description of Artificial Sequence: Synthetic peptide
  Seed: SAFHLGHLRE (MAGC3_HUMAN)
SIFHLGHLRR

SEQ ID NO: 103245 - protein, 9 aa, Artificial Sequence
  Description of Artificial Sequence: Synthetic peptide
  Seed: WRRGTGYTL (MAGC3_HUMAN)
WSRGTGYTY

SEQ ID NO: 103246 - protein, 9 aa, Artificial Sequence
  Description of Artificial Sequence: Synthetic peptide
  Seed: MPAAGMPPL (MAGC3_HUMAN)
MLAAGMPPM

SEQ ID NO: 103247 - protein, 10 aa, Artificial Sequence
  Description of Artificial Sequence: Synthetic peptide
  Seed: FPSWYMDALK (MAGC3_HUMAN)
FPSWYMDALI

SEQ ID NO: 103248 - protein, 9 aa, Artificial Sequence
  Description of Artificial Sequence: Synthetic peptide
  Seed: MPAAGMPPL (MAGC3_HUMAN)
MHAAGMPPL

SEQ ID NO: 103249 - protein, 11 aa, Artificial Sequence
  Description of Artificial Sequence: Synthetic peptide
  Seed: TAMASASPSVM (MAGC3_HUMAN)
TIMASASPSVY

SEQ ID NO: 103250 - protein, 9 aa, Artificial Sequence
  Description of Artificial Sequence: Synthetic peptide
  Seed: ISPQGPPQS (MAGC3_HUMAN)
ILPQGPPQF

SEQ ID NO: 103251 - protein, 9 aa, Artificial Sequence
  Description of Artificial Sequence: Synthetic peptide
  Seed: LSDEQGMPQ (MAGC3_HUMAN)
LADEQGMPV

SEQ ID NO: 103252 - protein, 8 aa, Artificial Sequence
  Description of Artificial Sequence: Synthetic peptide
  Seed: FLSKLSSI (MAGC3_HUMAN)
FLSKLSSV

SEQ ID NO: 103253 - protein, 9 aa, Artificial Sequence
  Description of Artificial Sequence: Synthetic peptide
  Seed: LCPTYFKLW (MAGC3_HUMAN)
LTPTYFKLW

SEQ ID NO: 103254 - protein, 10 aa, Artificial Sequence
  Description of Artificial Sequence: Synthetic peptide
  Seed: TTDDATAMAS (MAGC3_HUMAN)
TQDDATAMAY

SEQ ID NO: 103255 - protein, 9 aa, Artificial Sequence
  Description of Artificial Sequence: Synthetic peptide
  Seed: YSAFHLGHL (MAGC3_HUMAN)
YAAFHLGHM

SEQ ID NO: 103256 - protein, 9 aa, Artificial Sequence
  Description of Artificial Sequence: Synthetic peptide
  Seed: TEASPQQKK (MAGC3_HUMAN)
TSASPQQKL

SEQ ID NO: 103257 - protein, 9 aa, Artificial Sequence
  Description of Artificial Sequence: Synthetic peptide
  Seed: FHLGHLREV (MAGC3_HUMAN)
FYLGHLREM

SEQ ID NO: 103258 - protein, 11 aa, Artificial Sequence
  Description of Artificial Sequence: Synthetic peptide
  Seed: DLANPQGLAGH (MAGC3_HUMAN)
DAANPQGLAGR

SEQ ID NO: 103259 - protein, 9 aa, Artificial Sequence
  Description of Artificial Sequence: Synthetic peptide
  Seed: QMNVINTYT (MAGC3_HUMAN)
QLNVINTYL

SEQ ID NO: 103260 - protein, 9 aa, Artificial Sequence
  Description of Artificial Sequence: Synthetic peptide
  Seed: EVIWEVLSA (MAGC3_HUMAN)
EQIWEVLSV

SEQ ID NO: 103261 - protein, 9 aa, Artificial Sequence
  Description of Artificial Sequence: Synthetic peptide
  Seed: SAFHLGHLR (MAGC3_HUMAN)
SAFHLGHLI

SEQ ID NO: 103262 - protein, 10 aa, Artificial Sequence
  Description of Artificial Sequence: Synthetic peptide
  Seed: MQMNVINTYT (MAGC3_HUMAN)
MMMNVINTYS

SEQ ID NO: 103263 - protein, 9 aa, Artificial Sequence
  Description of Artificial Sequence: Synthetic peptide
  Seed: IPPQGPPKI (MAGC3_HUMAN)
IPPQGPPKV

SEQ ID NO: 103264 - protein, 11 aa, Artificial Sequence
  Description of Artificial Sequence: Synthetic peptide
  Seed: TTDDATAMASA (MAGC3_HUMAN)
TSDDATAMASI

SEQ ID NO: 103265 - protein, 9 aa, Artificial Sequence
  Description of Artificial Sequence: Synthetic peptide
  Seed: YKDYFPMIF (MAGC3_HUMAN)
YHDYFPMIV

SEQ ID NO: 103266 - protein, 9 aa, Artificial Sequence
  Description of Artificial Sequence: Synthetic peptide
  Seed: LSGSPGLQL (MAGC3_HUMAN)
LIGSPGLQL

SEQ ID NO: 103267 - protein, 11 aa, Artificial Sequence
  Description of Artificial Sequence: Synthetic peptide
  Seed: DLANPQGLAGH (MAGC3_HUMAN)
DIANPQGLAGK

SEQ ID NO: 103268 - protein, 10 aa, Artificial Sequence
  Description of Artificial Sequence: Synthetic peptide
  Seed: EAFCEESGLR (MAGC3_HUMAN)
ELFCEESGLR

SEQ ID NO: 103269 - protein, 9 aa, Artificial Sequence
  Description of Artificial Sequence: Synthetic peptide
  Seed: WYMDALKDM (MAGC3_HUMAN)
WYMDALKDY

SEQ ID NO: 103270 - protein, 9 aa, Artificial Sequence
  Description of Artificial Sequence: Synthetic peptide
  Seed: FSLRRAVSV (MAGC3_HUMAN)
FRLRRAVSM

SEQ ID NO: 103271 - protein, 9 aa, Artificial Sequence
  Description of Artificial Sequence: Synthetic peptide
  Seed: MPAAGMPPL (MAGC3_HUMAN)
MFAAGMPPL

SEQ ID NO: 103272 - protein, 9 aa, Artificial Sequence
  Description of Artificial Sequence: Synthetic peptide
  Seed: YFFEDTLDL (MAGC3_HUMAN)
YKFEDTLDL

SEQ ID NO: 103273 - protein, 9 aa, Artificial Sequence
  Description of Artificial Sequence: Synthetic peptide
  Seed: KYKDYFPMI (MAGC3_HUMAN)
KIKDYFPMY

SEQ ID NO: 103274 - protein, 10 aa, Artificial Sequence
  Description of Artificial Sequence: Synthetic peptide
  Seed: SLVLCPTYFK (MAGC3_HUMAN)
SNVLCPTYFR

SEQ ID NO: 103275 - protein, 9 aa, Artificial Sequence
  Description of Artificial Sequence: Synthetic peptide
  Seed: EVLSAIGPI (MAGC3_HUMAN)
ETLSAIGPI

SEQ ID NO: 103276 - protein, 9 aa, Artificial Sequence
  Description of Artificial Sequence: Synthetic peptide
  Seed: IPPQGPPKI (MAGC3_HUMAN)
IAPQGPPKV

SEQ ID NO: 103277 - protein, 10 aa, Artificial Sequence
  Description of Artificial Sequence: Synthetic peptide
  Seed: REVRLFLRGG (MAGC3_HUMAN)
RTVRLFLRGV

SEQ ID NO: 103278 - protein, 11 aa, Artificial Sequence
  Description of Artificial Sequence: Synthetic peptide
  Seed: SIIPSAFPSWY (MAGC3_HUMAN)
SSIPSAFPSWK

SEQ ID NO: 103279 - protein, 9 aa, Artificial Sequence
  Description of Artificial Sequence: Synthetic peptide
  Seed: MPAAGMPPL (MAGC3_HUMAN)
MCAAGMPPY

SEQ ID NO: 103280 - protein, 9 aa, Artificial Sequence
  Description of Artificial Sequence: Synthetic peptide
  Seed: LRSAEGSVL (MAGC3_HUMAN)
LRSAEGSVF

SEQ ID NO: 103281 - protein, 10 aa, Artificial Sequence
  Description of Artificial Sequence: Synthetic peptide
  Seed: YALSPVVLPP (MAGC3_HUMAN)
YVLSPVVLPI

SEQ ID NO: 103282 - protein, 9 aa, Artificial Sequence
  Description of Artificial Sequence: Synthetic peptide
  Seed: LDEKVAELV (MAGC3_HUMAN)
LEEKVAELL

SEQ ID NO: 103283 - protein, 11 aa, Artificial Sequence
  Description of Artificial Sequence: Synthetic peptide
  Seed: EVLSAIGPIQR (MAGC3_HUMAN)
ETLSAIGPIQK

SEQ ID NO: 103284 - protein, 9 aa, Artificial Sequence
  Description of Artificial Sequence: Synthetic peptide
  Seed: REVLEFLSK (MAGC3_HUMAN)
REVLEFLSV

SEQ ID NO: 103285 - protein, 9 aa, Artificial Sequence
  Description of Artificial Sequence: Synthetic peptide
  Seed: FSDGSLGQW (MAGC3_HUMAN)
FTDGSLGQW

SEQ ID NO: 103286 - protein, 9 aa, Artificial Sequence
  Description of Artificial Sequence: Synthetic peptide
  Seed: MIFGKAHEF (MAGC3_HUMAN)
MVFGKAHEA

SEQ ID NO: 103287 - protein, 9 aa, Artificial Sequence
  Description of Artificial Sequence: Synthetic peptide
  Seed: AIGPWSALA (MAGC3_HUMAN)
ALGPWSALA

SEQ ID NO: 103288 - protein, 9 aa, Artificial Sequence
  Description of Artificial Sequence: Synthetic peptide
  Seed: HLREVRLFL (MAGC3_HUMAN)
HFREVRLFV

SEQ ID NO: 103289 - protein, 9 aa, Artificial Sequence
  Description of Artificial Sequence: Synthetic peptide
  Seed: RTLSGSPGL (MAGC3_HUMAN)
RALSGSPGK

SEQ ID NO: 103290 - protein, 11 aa, Artificial Sequence
  Description of Artificial Sequence: Synthetic peptide
  Seed: TDMDPDNHSYF (MAGC3_HUMAN)
TQMDPDNHSYF

SEQ ID NO: 103291 - protein, 9 aa, Artificial Sequence
  Description of Artificial Sequence: Synthetic peptide
  Seed: TEASPQQKK (MAGC3_HUMAN)
TTASPQQKM

SEQ ID NO: 103292 - protein, 9 aa, Artificial Sequence
  Description of Artificial Sequence: Synthetic peptide
  Seed: CSSPLLWTR (MAGC3_HUMAN)
CQSPLLWTK

SEQ ID NO: 103293 - protein, 10 aa, Artificial Sequence
  Description of Artificial Sequence: Synthetic peptide
  Seed: FKLWRTLSGS (MAGC3_HUMAN)
FRLWRTLSGV

SEQ ID NO: 103294 - protein, 10 aa, Artificial Sequence
  Description of Artificial Sequence: Synthetic peptide
  Seed: MDPDNHSYFF (MAGC3_HUMAN)
MKPDNHSYFF

SEQ ID NO: 103295 - protein, 10 aa, Artificial Sequence
  Description of Artificial Sequence: Synthetic peptide
  Seed: MPQNRLLILI (MAGC3_HUMAN)
MPQNRLLILV

SEQ ID NO: 103296 - protein, 9 aa, Artificial Sequence
  Description of Artificial Sequence: Synthetic peptide
  Seed: KAHEFIELI (MAGC3_HUMAN)
KVHEFIELY

SEQ ID NO: 103297 - protein, 9 aa, Artificial Sequence
  Description of Artificial Sequence: Synthetic peptide
  Seed: SLRRAVSVK (MAGC3_HUMAN)
SIRRAVSVK

SEQ ID NO: 103298 - protein, 11 aa, Artificial Sequence
  Description of Artificial Sequence: Synthetic peptide
  Seed: TSDQRMDSLVL (MAGC3_HUMAN)
TQDQRMDSLVF

SEQ ID NO: 103299 - protein, 9 aa, Artificial Sequence
  Description of Artificial Sequence: Synthetic peptide
  Seed: SIIPSAFPS (MAGC3_HUMAN)
SMIPSAFPM

SEQ ID NO: 103300 - protein, 10 aa, Artificial Sequence
  Description of Artificial Sequence: Synthetic peptide
  Seed: YALSPVVLPP (MAGC3_HUMAN)
YKLSPVVLPM

SEQ ID NO: 103301 - protein, 10 aa, Artificial Sequence
  Description of Artificial Sequence: Synthetic peptide
  Seed: YALSPVVLPP (MAGC3_HUMAN)
YILSPVVLPM

SEQ ID NO: 103302 - protein, 9 aa, Artificial Sequence
  Description of Artificial Sequence: Synthetic peptide
  Seed: QTKEPVTKA (MAGC3_HUMAN)
QIKEPVTKY

SEQ ID NO: 103303 - protein, 9 aa, Artificial Sequence
  Description of Artificial Sequence: Synthetic peptide
  Seed: HALPESESL (MAGC3_HUMAN)
HYLPESESY

SEQ ID NO: 103304 - protein, 9 aa, Artificial Sequence
  Description of Artificial Sequence: Synthetic peptide
  Seed: ISPQGPPQS (MAGC3_HUMAN)
IVPQGPPQI

SEQ ID NO: 103305 - protein, 9 aa, Artificial Sequence
  Description of Artificial Sequence: Synthetic peptide
  Seed: FFEDTLDLT (MAGC3_HUMAN)
FYEDTLDLV

SEQ ID NO: 103306 - protein, 9 aa, Artificial Sequence
  Description of Artificial Sequence: Synthetic peptide
  Seed: NPQGLAGHR (MAGC3_HUMAN)
NTQGLAGHR

SEQ ID NO: 103307 - protein, 9 aa, Artificial Sequence
  Description of Artificial Sequence: Synthetic peptide
  Seed: LVLCPTYFK (MAGC3_HUMAN)
LWLCPTYFK

SEQ ID NO: 103308 - protein, 9 aa, Artificial Sequence
  Description of Artificial Sequence: Synthetic peptide
  Seed: ALDEKVAEL (MAGC3_HUMAN)
AQDEKVAEY

SEQ ID NO: 103309 - protein, 9 aa, Artificial Sequence
  Description of Artificial Sequence: Synthetic peptide
  Seed: TYALSPVVL (MAGC3_HUMAN)
TRALSPVVM

SEQ ID NO: 103310 - protein, 11 aa, Artificial Sequence
  Description of Artificial Sequence: Synthetic peptide
  Seed: MPQNRLLILIL (MAGC3_HUMAN)
MPQNRLLILIW

SEQ ID NO: 103311 - protein, 10 aa, Artificial Sequence
  Description of Artificial Sequence: Synthetic peptide
  Seed: FPSWYMDALK (MAGC3_HUMAN)
FVSWYMDALR

SEQ ID NO: 103312 - protein, 11 aa, Artificial Sequence
  Description of Artificial Sequence: Synthetic peptide
  Seed: TTDDATAMASA (MAGC3_HUMAN)
TADDATAMASL

SEQ ID NO: 103313 - protein, 10 aa, Artificial Sequence
  Description of Artificial Sequence: Synthetic peptide
  Seed: YALDEKVAEL (MAGC3_HUMAN)
YNLDEKVAEV

SEQ ID NO: 103314 - protein, 9 aa, Artificial Sequence
  Description of Artificial Sequence: Synthetic peptide
  Seed: KYKDYFPMI (MAGC3_HUMAN)
KVKDYFPMR

SEQ ID NO: 103315 - protein, 10 aa, Artificial Sequence
  Description of Artificial Sequence: Synthetic peptide
  Seed: TLSGSPGLQL (MAGC3_HUMAN)
TASGSPGLQY

SEQ ID NO: 103316 - protein, 10 aa, Artificial Sequence
  Description of Artificial Sequence: Synthetic peptide
  Seed: KLSSIIPSAF (MAGC3_HUMAN)
KDSSIIPSAW

SEQ ID NO: 103317 - protein, 10 aa, Artificial Sequence
  Description of Artificial Sequence: Synthetic peptide
  Seed: KKYKDYFPMI (MAGC3_HUMAN)
KSYKDYFPMA

SEQ ID NO: 103318 - protein, 9 aa, Artificial Sequence
  Description of Artificial Sequence: Synthetic peptide
  Seed: DMDPDNHSY (MAGC3_HUMAN)
DSDPDNHSM

SEQ ID NO: 103319 - protein, 9 aa, Artificial Sequence
  Description of Artificial Sequence: Synthetic peptide
  Seed: KAHEFIELI (MAGC3_HUMAN)
KDHEFIELL

SEQ ID NO: 103320 - protein, 10 aa, Artificial Sequence
  Description of Artificial Sequence: Synthetic peptide
  Seed: LNAIGPWSAL (MAGC3_HUMAN)
LFAIGPWSAY

SEQ ID NO: 103321 - protein, 9 aa, Artificial Sequence
  Description of Artificial Sequence: Synthetic peptide
  Seed: ELIFGIALT (MAGC3_HUMAN)
EQIFGIALV

SEQ ID NO: 103322 - protein, 9 aa, Artificial Sequence
  Description of Artificial Sequence: Synthetic peptide
  Seed: KKYKDYFPM (MAGC3_HUMAN)
KQYKDYFPI

SEQ ID NO: 103323 - protein, 10 aa, Artificial Sequence
  Description of Artificial Sequence: Synthetic peptide
  Seed: KLSSIIPSAF (MAGC3_HUMAN)
KSSSIIPSAW

SEQ ID NO: 103324 - protein, 10 aa, Artificial Sequence
  Description of Artificial Sequence: Synthetic peptide
  Seed: LIFGIALTDM (MAGC3_HUMAN)
LAFGIALTDY

SEQ ID NO: 103325 - protein, 9 aa, Artificial Sequence
  Description of Artificial Sequence: Synthetic peptide
  Seed: AMASASPSV (MAGC3_HUMAN)
ASASASPSI

SEQ ID NO: 103326 - protein, 11 aa, Artificial Sequence
  Description of Artificial Sequence: Synthetic peptide
  Seed: DLANPQGLAGH (MAGC3_HUMAN)
DTANPQGLAGR

SEQ ID NO: 103327 - protein, 9 aa, Artificial Sequence
  Description of Artificial Sequence: Synthetic peptide
  Seed: CHWVLDATF (MAGC3_HUMAN)
CKWVLDATY

SEQ ID NO: 103328 - protein, 10 aa, Artificial Sequence
  Description of Artificial Sequence: Synthetic peptide
  Seed: LNAIGPWSAL (MAGC3_HUMAN)
LQAIGPWSAF

SEQ ID NO: 103329 - protein, 9 aa, Artificial Sequence
  Description of Artificial Sequence: Synthetic peptide
  Seed: RPAREVLEF (MAGC3_HUMAN)
RTAREVLEF

SEQ ID NO: 103330 - protein, 9 aa, Artificial Sequence
  Description of Artificial Sequence: Synthetic peptide
  Seed: EVLEFLSKL (MAGC3_HUMAN)
EVLEFLSKI

SEQ ID NO: 103331 - protein, 9 aa, Artificial Sequence
  Description of Artificial Sequence: Synthetic peptide
  Seed: MQMNVINTY (MAGC3_HUMAN)
MCMNVINTW

SEQ ID NO: 103332 - protein, 8 aa, Artificial Sequence
  Description of Artificial Sequence: Synthetic peptide
  Seed: MEDRAQAI (MAGC3_HUMAN)
MIDRAQAI

SEQ ID NO: 103333 - protein, 9 aa, Artificial Sequence
  Description of Artificial Sequence: Synthetic peptide
  Seed: YTLDEKVDK (MAGC3_HUMAN)
YVLDEKVDY

SEQ ID NO: 103334 - protein, 9 aa, Artificial Sequence
  Description of Artificial Sequence: Synthetic peptide
  Seed: KFSLRRAVS (MAGC3_HUMAN)
KTSLRRAVV

SEQ ID NO: 103335 - protein, 9 aa, Artificial Sequence
  Description of Artificial Sequence: Synthetic peptide
  Seed: SESLPRYAL (MAGC3_HUMAN)
SESLPRYAW

SEQ ID NO: 103336 - protein, 9 aa, Artificial Sequence
  Description of Artificial Sequence: Synthetic peptide
  Seed: LDSCSSPLL (MAGC3_HUMAN)
LESCSSPLA

SEQ ID NO: 103337 - protein, 8 aa, Artificial Sequence
  Description of Artificial Sequence: Synthetic peptide
  Seed: YMDALKDM (MAGC3_HUMAN)
YTDALKDI

SEQ ID NO: 103338 - protein, 11 aa, Artificial Sequence
  Description of Artificial Sequence: Synthetic peptide
  Seed: ALWESEGPEAF (MAGC3_HUMAN)
AAWESEGPEAY

SEQ ID NO: 103339 - protein, 9 aa, Artificial Sequence
  Description of Artificial Sequence: Synthetic peptide
  Seed: IPPQGPPKI (MAGC3_HUMAN)
INPQGPPKL

SEQ ID NO: 103340 - protein, 9 aa, Artificial Sequence
  Description of Artificial Sequence: Synthetic peptide
  Seed: LRSAEGSVL (MAGC3_HUMAN)
LKSAEGSVY

SEQ ID NO: 103341 - protein, 8 aa, Artificial Sequence
  Description of Artificial Sequence: Synthetic peptide
  Seed: IFGKAHEF (MAGC3_HUMAN)
ISGKAHEY

SEQ ID NO: 103342 - protein, 9 aa, Artificial Sequence
  Description of Artificial Sequence: Synthetic peptide
  Seed: GSLPESEPL (MAGC3_HUMAN)
GTLPESEPV

SEQ ID NO: 103343 - protein, 9 aa, Artificial Sequence
  Description of Artificial Sequence: Synthetic peptide
  Seed: KYKDYFPMI (MAGC3_HUMAN)
KMKDYFPMS

SEQ ID NO: 103344 - protein, 9 aa, Artificial Sequence
  Description of Artificial Sequence: Synthetic peptide
  Seed: LRSAEGSVL (MAGC3_HUMAN)
LQSAEGSVL

SEQ ID NO: 103345 - protein, 10 aa, Artificial Sequence
  Description of Artificial Sequence: Synthetic peptide
  Seed: SQPEGKFSLR (MAGC3_HUMAN)
SVPEGKFSLY

SEQ ID NO: 103346 - protein, 11 aa, Artificial Sequence
  Description of Artificial Sequence: Synthetic peptide
  Seed: RYALDEKVAEL (MAGC3_HUMAN)
REALDEKVAEV

SEQ ID NO: 103347 - protein, 9 aa, Artificial Sequence
  Description of Artificial Sequence: Synthetic peptide
  Seed: TYFKLWRTL (MAGC3_HUMAN)
TVFKLWRTY

SEQ ID NO: 103348 - protein, 10 aa, Artificial Sequence
  Description of Artificial Sequence: Synthetic peptide
  Seed: KYQTKEPVTK (MAGC3_HUMAN)
KMQTKEPVTR

SEQ ID NO: 103349 - protein, 9 aa, Artificial Sequence
  Description of Artificial Sequence: Synthetic peptide
  Seed: WRRGTGYTL (MAGC3_HUMAN)
WVRGTGYTY

SEQ ID NO: 103350 - protein, 9 aa, Artificial Sequence
  Description of Artificial Sequence: Synthetic peptide
  Seed: QRMDSLVLC (MAGC3_HUMAN)
QHMDSLVLF

SEQ ID NO: 103351 - protein, 9 aa, Artificial Sequence
  Description of Artificial Sequence: Synthetic peptide
  Seed: HSYFFEDTL (MAGC3_HUMAN)
HTYFFEDTW

SEQ ID NO: 103352 - protein, 9 aa, Artificial Sequence
  Description of Artificial Sequence: Synthetic peptide
  Seed: MQMNVINTY (MAGC3_HUMAN)
MIMNVINTW

SEQ ID NO: 103353 - protein, 10 aa, Artificial Sequence
  Description of Artificial Sequence: Synthetic peptide
  Seed: IELIFGIALT (MAGC3_HUMAN)
INLIFGIALI

SEQ ID NO: 103354 - protein, 9 aa, Artificial Sequence
  Description of Artificial Sequence: Synthetic peptide
  Seed: SASPSVMST (MAGC3_HUMAN)
SMSPSVMSL

SEQ ID NO: 103355 - protein, 10 aa, Artificial Sequence
  Description of Artificial Sequence: Synthetic peptide
  Seed: PTYFKLWRTL (MAGC3_HUMAN)
PYYFKLWRTL

SEQ ID NO: 103356 - protein, 9 aa, Artificial Sequence
  Description of Artificial Sequence: Synthetic peptide
  Seed: YFFEDTLDL (MAGC3_HUMAN)
YHFEDTLDY

SEQ ID NO: 103357 - protein, 9 aa, Artificial Sequence
  Description of Artificial Sequence: Synthetic peptide
  Seed: DKDYSAFHL (MAGC3_HUMAN)
DHDYSAFHL

SEQ ID NO: 103358 - protein, 9 aa, Artificial Sequence
  Description of Artificial Sequence: Synthetic peptide
  Seed: WPLNEKRTL (MAGC3_HUMAN)
WALNEKRTY

SEQ ID NO: 103359 - protein, 11 aa, Artificial Sequence
  Description of Artificial Sequence: Synthetic peptide
  Seed: AEMQMNVINTY (MAGC3_HUMAN)
ARMQMNVINTF

SEQ ID NO: 103360 - protein, 11 aa, Artificial Sequence
  Description of Artificial Sequence: Synthetic peptide
  Seed: DLHFGSQPEGK (MAGC3_HUMAN)
DTHFGSQPEGK

SEQ ID NO: 103361 - protein, 9 aa, Artificial Sequence
  Description of Artificial Sequence: Synthetic peptide
  Seed: AIGPIQRPA (MAGC3_HUMAN)
ATGPIQRPY

SEQ ID NO: 103362 - protein, 11 aa, Artificial Sequence
  Description of Artificial Sequence: Synthetic peptide
  Seed: INTYTGYFPMI (MAGC3_HUMAN)
IDTYTGYFPMF

SEQ ID NO: 103363 - protein, 10 aa, Artificial Sequence
  Description of Artificial Sequence: Synthetic peptide
  Seed: SWYMDALKDM (MAGC3_HUMAN)
SIYMDALKDF

SEQ ID NO: 103364 - protein, 9 aa, Artificial Sequence
  Description of Artificial Sequence: Synthetic peptide
  Seed: YKDYFPMIF (MAGC3_HUMAN)
YQDYFPMIM

SEQ ID NO: 103365 - protein, 10 aa, Artificial Sequence
  Description of Artificial Sequence: Synthetic peptide
  Seed: EVIWEVLNAI (MAGC3_HUMAN)
ETIWEVLNAS

SEQ ID NO: 103366 - protein, 9 aa, Artificial Sequence
  Description of Artificial Sequence: Synthetic peptide
  Seed: MIFIKGSCV (MAGC3_HUMAN)
MTFIKGSCV

SEQ ID NO: 103367 - protein, 10 aa, Artificial Sequence
  Description of Artificial Sequence: Synthetic peptide
  Seed: YALSPVVLPP (MAGC3_HUMAN)
YMLSPVVLPS

SEQ ID NO: 103368 - protein, 10 aa, Artificial Sequence
  Description of Artificial Sequence: Synthetic peptide
  Seed: FFEDTLDLTY (MAGC3_HUMAN)
FTEDTLDLTW

SEQ ID NO: 103369 - protein, 9 aa, Artificial Sequence
  Description of Artificial Sequence: Synthetic peptide
  Seed: YQAKEPLTR (MAGC3_HUMAN)
YAAKEPLTR

SEQ ID NO: 103370 - protein, 9 aa, Artificial Sequence
  Description of Artificial Sequence: Synthetic peptide
  Seed: VIWEVLSAI (MAGC3_HUMAN)
VAWEVLSAA

SEQ ID NO: 103371 - protein, 9 aa, Artificial Sequence
  Description of Artificial Sequence: Synthetic peptide
  Seed: AIIDTTDDA (MAGC3_HUMAN)
AIIDTTDDI

SEQ ID NO: 103372 - protein, 11 aa, Artificial Sequence
  Description of Artificial Sequence: Synthetic peptide
  Seed: ATFSDGSLGQW (MAGC3_HUMAN)
AVFSDGSLGQF

SEQ ID NO: 103373 - protein, 10 aa, Artificial Sequence
  Description of Artificial Sequence: Synthetic peptide
  Seed: TDMDPDNHSY (MAGC3_HUMAN)
TEMDPDNHSL

SEQ ID NO: 103374 - protein, 9 aa, Artificial Sequence
  Description of Artificial Sequence: Synthetic peptide
  Seed: LKYQTKEPV (MAGC3_HUMAN)
LGYQTKEPY

SEQ ID NO: 103375 - protein, 9 aa, Artificial Sequence
  Description of Artificial Sequence: Synthetic peptide
  Seed: DMDPDNHSY (MAGC3_HUMAN)
DWDPDNHSL

SEQ ID NO: 103376 - protein, 8 aa, Artificial Sequence
  Description of Artificial Sequence: Synthetic peptide
  Seed: TTDDATAM (MAGC3_HUMAN)
TWDDATAI

SEQ ID NO: 103377 - protein, 9 aa, Artificial Sequence
  Description of Artificial Sequence: Synthetic peptide
  Seed: SESLPRYAL (MAGC3_HUMAN)
SMSLPRYAY

SEQ ID NO: 103378 - protein, 9 aa, Artificial Sequence
  Description of Artificial Sequence: Synthetic peptide
  Seed: LVLCPTYFK (MAGC3_HUMAN)
LMLCPTYFK

SEQ ID NO: 103379 - protein, 10 aa, Artificial Sequence
  Description of Artificial Sequence: Synthetic peptide
  Seed: LWKDSDLPTW (MAGC3_HUMAN)
LSKDSDLPTF

SEQ ID NO: 103380 - protein, 9 aa, Artificial Sequence
  Description of Artificial Sequence: Synthetic peptide
  Seed: MLTTVIKKY (MAGC3_HUMAN)
MMTTVIKKR

SEQ ID NO: 103381 - protein, 9 aa, Artificial Sequence
  Description of Artificial Sequence: Synthetic peptide
  Seed: KVAELVQFL (MAGC3_HUMAN)
KQAELVQFI

SEQ ID NO: 103382 - protein, 10 aa, Artificial Sequence
  Description of Artificial Sequence: Synthetic peptide
  Seed: LDSCSSPLLW (MAGC3_HUMAN)
LRSCSSPLLW

SEQ ID NO: 103383 - protein, 9 aa, Artificial Sequence
  Description of Artificial Sequence: Synthetic peptide
  Seed: HFYVFVNTL (MAGC3_HUMAN)
HAYVFVNTV

SEQ ID NO: 103384 - protein, 10 aa, Artificial Sequence
  Description of Artificial Sequence: Synthetic peptide
  Seed: MQMNVINTYT (MAGC3_HUMAN)
MGMNVINTYL

SEQ ID NO: 103385 - protein, 9 aa, Artificial Sequence
  Description of Artificial Sequence: Synthetic peptide
  Seed: ILILSVIFI (MAGC3_HUMAN)
ILILSVIFA

SEQ ID NO: 103386 - protein, 10 aa, Artificial Sequence
  Description of Artificial Sequence: Synthetic peptide
  Seed: IPSAFPSWYM (MAGC3_HUMAN)
INSAFPSWYF

SEQ ID NO: 103387 - protein, 10 aa, Artificial Sequence
  Description of Artificial Sequence: Synthetic peptide
  Seed: KKYKDYFPMI (MAGC3_HUMAN)
KPYKDYFPMW

SEQ ID NO: 103388 - protein, 8 aa, Artificial Sequence
  Description of Artificial Sequence: Synthetic peptide
  Seed: YTLSLPAV (MAGC3_HUMAN)
YLLSLPAI

SEQ ID NO: 103389 - protein, 8 aa, Artificial Sequence
  Description of Artificial Sequence: Synthetic peptide
  Seed: TTDDATAM (MAGC3_HUMAN)
TFDDATAV

SEQ ID NO: 103390 - protein, 9 aa, Artificial Sequence
  Description of Artificial Sequence: Synthetic peptide
  Seed: EVDPDHFYV (MAGC3_HUMAN)
EADPDHFYM

SEQ ID NO: 103391 - protein, 11 aa, Artificial Sequence
  Description of Artificial Sequence: Synthetic peptide
  Seed: FLSKLSSIIPS (MAGC3_HUMAN)
FLSKLSSIIPI

SEQ ID NO: 103392 - protein, 9 aa, Artificial Sequence
  Description of Artificial Sequence: Synthetic peptide
  Seed: GYFPMIFRK (MAGC3_HUMAN)
GMFPMIFRV

SEQ ID NO: 103393 - protein, 9 aa, Artificial Sequence
  Description of Artificial Sequence: Synthetic peptide
  Seed: FSLRRAVSV (MAGC3_HUMAN)
FTLRRAVSY

SEQ ID NO: 103394 - protein, 10 aa, Artificial Sequence
  Description of Artificial Sequence: Synthetic peptide
  Seed: EVIWEVLSAI (MAGC3_HUMAN)
EIIWEVLSAK

SEQ ID NO: 103395 - protein, 11 aa, Artificial Sequence
  Description of Artificial Sequence: Synthetic peptide
  Seed: ALWESEGPEAF (MAGC3_HUMAN)
ATWESEGPEAY

SEQ ID NO: 103396 - protein, 11 aa, Artificial Sequence
  Description of Artificial Sequence: Synthetic peptide
  Seed: IIDTTDDATAM (MAGC3_HUMAN)
IWDTTDDATAM

SEQ ID NO: 103397 - protein, 9 aa, Artificial Sequence
  Description of Artificial Sequence: Synthetic peptide
  Seed: KGSCVPEEV (MAGC3_HUMAN)
KASCVPEEV

SEQ ID NO: 103398 - protein, 11 aa, Artificial Sequence
  Description of Artificial Sequence: Synthetic peptide
  Seed: FPMIFRKAREF (MAGC3_HUMAN)
FPMIFRKAREY

SEQ ID NO: 103399 - protein, 10 aa, Artificial Sequence
  Description of Artificial Sequence: Synthetic peptide
  Seed: MDSLVLCPTY (MAGC3_HUMAN)
MTSLVLCPTM

SEQ ID NO: 103400 - protein, 9 aa, Artificial Sequence
  Description of Artificial Sequence: Synthetic peptide
  Seed: LIDDQGMPK (MAGC3_HUMAN)
LGDDQGMPL

SEQ ID NO: 103401 - protein, 10 aa, Artificial Sequence
  Description of Artificial Sequence: Synthetic peptide
  Seed: EKVAELVQFL (MAGC3_HUMAN)
EAVAELVQFY

SEQ ID NO: 103402 - protein, 9 aa, Artificial Sequence
  Description of Artificial Sequence: Synthetic peptide
  Seed: MQMNVINTY (MAGC3_HUMAN)
MYMNVINTF

SEQ ID NO: 103403 - protein, 10 aa, Artificial Sequence
  Description of Artificial Sequence: Synthetic peptide
  Seed: TGYFPMIFRK (MAGC3_HUMAN)
TQYFPMIFRR

SEQ ID NO: 103404 - protein, 11 aa, Artificial Sequence
  Description of Artificial Sequence: Synthetic peptide
  Seed: YTGYFPMIFRK (MAGC3_HUMAN)
YVGYFPMIFRR

SEQ ID NO: 103405 - protein, 9 aa, Artificial Sequence
  Description of Artificial Sequence: Synthetic peptide
  Seed: YSAFHLGHL (MAGC3_HUMAN)
YTAFHLGHR

SEQ ID NO: 103406 - protein, 9 aa, Artificial Sequence
  Description of Artificial Sequence: Synthetic peptide
  Seed: QLSDLHFGS (MAGC3_HUMAN)
QLSDLHFGM

SEQ ID NO: 103407 - protein, 10 aa, Artificial Sequence
  Description of Artificial Sequence: Synthetic peptide
  Seed: NTYTGYFPMI (MAGC3_HUMAN)
NFYTGYFPMF

SEQ ID NO: 103408 - protein, 10 aa, Artificial Sequence
  Description of Artificial Sequence: Synthetic peptide
  Seed: SLVLCPTYFK (MAGC3_HUMAN)
SAVLCPTYFK

SEQ ID NO: 103409 - protein, 11 aa, Artificial Sequence
  Description of Artificial Sequence: Synthetic peptide
  Seed: SASPSVMSTNF (MAGC3_HUMAN)
SPSPSVMSTNF

SEQ ID NO: 103410 - protein, 9 aa, Artificial Sequence
  Description of Artificial Sequence: Synthetic peptide
  Seed: KATDKDYSA (MAGC3_HUMAN)
KATDKDYSY

SEQ ID NO: 103411 - protein, 9 aa, Artificial Sequence
  Description of Artificial Sequence: Synthetic peptide
  Seed: DMDPDNHSY (MAGC3_HUMAN)
DMDPDNHSL

SEQ ID NO: 103412 - protein, 9 aa, Artificial Sequence
  Description of Artificial Sequence: Synthetic peptide
  Seed: ALDEKVAEL (MAGC3_HUMAN)
AMDEKVAEW

SEQ ID NO: 103413 - protein, 11 aa, Artificial Sequence
  Description of Artificial Sequence: Synthetic peptide
  Seed: LVLCPTYFKLW (MAGC3_HUMAN)
LALCPTYFKLW

SEQ ID NO: 103414 - protein, 10 aa, Artificial Sequence
  Description of Artificial Sequence: Synthetic peptide
  Seed: EVIWEVLSAI (MAGC3_HUMAN)
EIIWEVLSAM

SEQ ID NO: 103415 - protein, 9 aa, Artificial Sequence
  Description of Artificial Sequence: Synthetic peptide
  Seed: HFYVFVNTL (MAGC3_HUMAN)
HLYVFVNTV

SEQ ID NO: 103416 - protein, 11 aa, Artificial Sequence
  Description of Artificial Sequence: Synthetic peptide
  Seed: TTDDATAMASA (MAGC3_HUMAN)
TTDDATAMASF

SEQ ID NO: 103417 - protein, 10 aa, Artificial Sequence
  Description of Artificial Sequence: Synthetic peptide
  Seed: MLTTVIKKYK (MAGC3_HUMAN)
METTVIKKYK

SEQ ID NO: 103418 - protein, 9 aa, Artificial Sequence
  Description of Artificial Sequence: Synthetic peptide
  Seed: CATYALSPV (MAGC3_HUMAN)
CLTYALSPI

SEQ ID NO: 103419 - protein, 9 aa, Artificial Sequence
  Description of Artificial Sequence: Synthetic peptide
  Seed: MQMNVINTY (MAGC3_HUMAN)
MMMNVINTV

SEQ ID NO: 103420 - protein, 9 aa, Artificial Sequence
  Description of Artificial Sequence: Synthetic peptide
  Seed: RTLSGSPGL (MAGC3_HUMAN)
RILSGSPGF

SEQ ID NO: 103421 - protein, 9 aa, Artificial Sequence
  Description of Artificial Sequence: Synthetic peptide
  Seed: FKLWRTLSG (MAGC3_HUMAN)
FQLWRTLSW

SEQ ID NO: 103422 - protein, 10 aa, Artificial Sequence
  Description of Artificial Sequence: Synthetic peptide
  Seed: TDMDPDNHSY (MAGC3_HUMAN)
TMMDPDNHSF

SEQ ID NO: 103423 - protein, 10 aa, Artificial Sequence
  Description of Artificial Sequence: Synthetic peptide
  Seed: ELVQFLLLKY (MAGC3_HUMAN)
EVVQFLLLKR

SEQ ID NO: 103424 - protein, 10 aa, Artificial Sequence
  Description of Artificial Sequence: Synthetic peptide
  Seed: MIFRKAREFI (MAGC3_HUMAN)
MTFRKAREFL

SEQ ID NO: 103425 - protein, 11 aa, Artificial Sequence
  Description of Artificial Sequence: Synthetic peptide
  Seed: KDMEDRAQAII (MAGC3_HUMAN)
KEMEDRAQAIV

SEQ ID NO: 103426 - protein, 9 aa, Artificial Sequence
  Description of Artificial Sequence: Synthetic peptide
  Seed: CATYALSPV (MAGC3_HUMAN)
CSTYALSPY

SEQ ID NO: 103427 - protein, 9 aa, Artificial Sequence
  Description of Artificial Sequence: Synthetic peptide
  Seed: MQMNVINTY (MAGC3_HUMAN)
MMMNVINTH

SEQ ID NO: 103428 - protein, 9 aa, Artificial Sequence
  Description of Artificial Sequence: Synthetic peptide
  Seed: MEDRAQAII (MAGC3_HUMAN)
MEDRAQAIA

SEQ ID NO: 103429 - protein, 11 aa, Artificial Sequence
  Description of Artificial Sequence: Synthetic peptide
  Seed: LSKLSSIIPSA (MAGC3_HUMAN)
LAKLSSIIPSI

SEQ ID NO: 103430 - protein, 10 aa, Artificial Sequence
  Description of Artificial Sequence: Synthetic peptide
  Seed: DMPAAGMPPL (MAGC3_HUMAN)
DSPAAGMPPL

SEQ ID NO: 103431 - protein, 9 aa, Artificial Sequence
  Description of Artificial Sequence: Synthetic peptide
  Seed: IPPQGPPKI (MAGC3_HUMAN)
IGPQGPPKF

SEQ ID NO: 103432 - protein, 10 aa, Artificial Sequence
  Description of Artificial Sequence: Synthetic peptide
  Seed: NTYTGYFPMI (MAGC3_HUMAN)
NTYTGYFPMF

SEQ ID NO: 103433 - protein, 10 aa, Artificial Sequence
  Description of Artificial Sequence: Synthetic peptide
  Seed: KVAELVQFLL (MAGC3_HUMAN)
KAAELVQFLL

SEQ ID NO: 103434 - protein, 9 aa, Artificial Sequence
  Description of Artificial Sequence: Synthetic peptide
  Seed: VINTYTGYF (MAGC3_HUMAN)
VKNTYTGYY

SEQ ID NO: 103435 - protein, 10 aa, Artificial Sequence
  Description of Artificial Sequence: Synthetic peptide
  Seed: LNAIGPWSAL (MAGC3_HUMAN)
LNAIGPWSAF

SEQ ID NO: 103436 - protein, 9 aa, Artificial Sequence
  Description of Artificial Sequence: Synthetic peptide
  Seed: LKYQTKEPV (MAGC3_HUMAN)
LTYQTKEPY

SEQ ID NO: 103437 - protein, 9 aa, Artificial Sequence
  Description of Artificial Sequence: Synthetic peptide
  Seed: MPAAGMPPL (MAGC3_HUMAN)
MVAAGMPPW

SEQ ID NO: 103438 - protein, 10 aa, Artificial Sequence
  Description of Artificial Sequence: Synthetic peptide
  Seed: ATYALSPVVL (MAGC3_HUMAN)
AAYALSPVVL

SEQ ID NO: 103439 - protein, 10 aa, Artificial Sequence
  Description of Artificial Sequence: Synthetic peptide
  Seed: YFPMIFRKAR (MAGC3_HUMAN)
YMPMIFRKAR

SEQ ID NO: 103440 - protein, 9 aa, Artificial Sequence
  Description of Artificial Sequence: Synthetic peptide
  Seed: FKLWRTLSG (MAGC3_HUMAN)
FELWRTLSY

SEQ ID NO: 103441 - protein, 11 aa, Artificial Sequence
  Description of Artificial Sequence: Synthetic peptide
  Seed: KKYKDYFPMIF (MAGC3_HUMAN)
KYYKDYFPMIM

SEQ ID NO: 103442 - protein, 8 aa, Artificial Sequence
  Description of Artificial Sequence: Synthetic peptide
  Seed: LTYEGSLI (MAGC3_HUMAN)
LAYEGSLW

SEQ ID NO: 103443 - protein, 10 aa, Artificial Sequence
  Description of Artificial Sequence: Synthetic peptide
  Seed: KLSSIIPSAF (MAGC3_HUMAN)
KLSSIIPSAV

SEQ ID NO: 103444 - protein, 9 aa, Artificial Sequence
  Description of Artificial Sequence: Synthetic peptide
  Seed: LILSMIFIK (MAGC3_HUMAN)
LQLSMIFIR

SEQ ID NO: 103445 - protein, 10 aa, Artificial Sequence
  Description of Artificial Sequence: Synthetic peptide
  Seed: YALSPVVLPP (MAGC3_HUMAN)
YELSPVVLPM

SEQ ID NO: 103446 - protein, 9 aa, Artificial Sequence
  Description of Artificial Sequence: Synthetic peptide
  Seed: AGFADVLSR (MAGC3_HUMAN)
AVFADVLSK

SEQ ID NO: 103447 - protein, 9 aa, Artificial Sequence
  Description of Artificial Sequence: Synthetic peptide
  Seed: SQPEGKFSL (MAGC3_HUMAN)
SRPEGKFSY

SEQ ID NO: 103448 - protein, 10 aa, Artificial Sequence
  Description of Artificial Sequence: Synthetic peptide
  Seed: EEVIWEVLSA (MAGC3_HUMAN)
ERVIWEVLSV

SEQ ID NO: 103449 - protein, 10 aa, Artificial Sequence
  Description of Artificial Sequence: Synthetic peptide
  Seed: FKLWRTLSGS (MAGC3_HUMAN)
FYLWRTLSGM

SEQ ID NO: 103450 - protein, 9 aa, Artificial Sequence
  Description of Artificial Sequence: Synthetic peptide
  Seed: IPPQGPPKI (MAGC3_HUMAN)
IYPQGPPKF

SEQ ID NO: 103451 - protein, 9 aa, Artificial Sequence
  Description of Artificial Sequence: Synthetic peptide
  Seed: ALDEKVAEL (MAGC3_HUMAN)
AGDEKVAEM

SEQ ID NO: 103452 - protein, 10 aa, Artificial Sequence
  Description of Artificial Sequence: Synthetic peptide
  Seed: AEMQMNVINT (MAGC3_HUMAN)
AEMQMNVINM

SEQ ID NO: 103453 - protein, 10 aa, Artificial Sequence
  Description of Artificial Sequence: Synthetic peptide
  Seed: HLREVRLFLR (MAGC3_HUMAN)
HFREVRLFLR

SEQ ID NO: 103454 - protein, 9 aa, Artificial Sequence
  Description of Artificial Sequence: Synthetic peptide
  Seed: HSYFFEDTL (MAGC3_HUMAN)
HTYFFEDTA

SEQ ID NO: 103455 - protein, 9 aa, Artificial Sequence
  Description of Artificial Sequence: Synthetic peptide
  Seed: KVAELVQFL (MAGC3_HUMAN)
KEAELVQFV

SEQ ID NO: 103456 - protein, 9 aa, Artificial Sequence
  Description of Artificial Sequence: Synthetic peptide
  Seed: KVAELVQFL (MAGC3_HUMAN)
KRAELVQFI

SEQ ID NO: 103457 - protein, 9 aa, Artificial Sequence
  Description of Artificial Sequence: Synthetic peptide
  Seed: DKDYSAFHL (MAGC3_HUMAN)
DHDYSAFHM

SEQ ID NO: 103458 - protein, 9 aa, Artificial Sequence
  Description of Artificial Sequence: Synthetic peptide
  Seed: KLVQFLLLK (MAGC3_HUMAN)
KVVQFLLLF

SEQ ID NO: 103459 - protein, 10 aa, Artificial Sequence
  Description of Artificial Sequence: Synthetic peptide
  Seed: WVKNTCATYA (MAGC3_HUMAN)
WVKNTCATYY

SEQ ID NO: 103460 - protein, 10 aa, Artificial Sequence
  Description of Artificial Sequence: Synthetic peptide
  Seed: SLVLCPTYFK (MAGC3_HUMAN)
SGVLCPTYFR

SEQ ID NO: 103461 - protein, 9 aa, Artificial Sequence
  Description of Artificial Sequence: Synthetic peptide
  Seed: KYKDYFPMI (MAGC3_HUMAN)
KTKDYFPMK

SEQ ID NO: 103462 - protein, 9 aa, Artificial Sequence
  Description of Artificial Sequence: Synthetic peptide
  Seed: TAMASASPS (MAGC3_HUMAN)
TPMASASPY

SEQ ID NO: 103463 - protein, 10 aa, Artificial Sequence
  Description of Artificial Sequence: Synthetic peptide
  Seed: INTYTGYFPM (MAGC3_HUMAN)
IGTYTGYFPY

SEQ ID NO: 103464 - protein, 9 aa, Artificial Sequence
  Description of Artificial Sequence: Synthetic peptide
  Seed: AMASASPSV (MAGC3_HUMAN)
AMASASPSF

SEQ ID NO: 103465 - protein, 9 aa, Artificial Sequence
  Description of Artificial Sequence: Synthetic peptide
  Seed: FADVLSRLA (MAGC3_HUMAN)
FYDVLSRLV

SEQ ID NO: 103466 - protein, 10 aa, Artificial Sequence
  Description of Artificial Sequence: Synthetic peptide
  Seed: EKVAELVQFL (MAGC3_HUMAN)
ETVAELVQFA

SEQ ID NO: 103467 - protein, 9 aa, Artificial Sequence
  Description of Artificial Sequence: Synthetic peptide
  Seed: ATDKDYSAF (MAGC3_HUMAN)
APDKDYSAY

SEQ ID NO: 103468 - protein, 9 aa, Artificial Sequence
  Description of Artificial Sequence: Synthetic peptide
  Seed: KKYKDYFPM (MAGC3_HUMAN)
KLYKDYFPM

SEQ ID NO: 103469 - protein, 9 aa, Artificial Sequence
  Description of Artificial Sequence: Synthetic peptide
  Seed: AIGPWSALA (MAGC3_HUMAN)
AIGPWSALV

SEQ ID NO: 103470 - protein, 10 aa, Artificial Sequence
  Description of Artificial Sequence: Synthetic peptide
  Seed: FFEDTLDLTY (MAGC3_HUMAN)
FLEDTLDLTY

SEQ ID NO: 103471 - protein, 9 aa, Artificial Sequence
  Description of Artificial Sequence: Synthetic peptide
  Seed: EVIWEVLSA (MAGC3_HUMAN)
EVIWEVLSF

SEQ ID NO: 103472 - protein, 10 aa, Artificial Sequence
  Description of Artificial Sequence: Synthetic peptide
  Seed: MDSLVLCPTY (MAGC3_HUMAN)
MSSLVLCPTW

SEQ ID NO: 103473 - protein, 9 aa, Artificial Sequence
  Description of Artificial Sequence: Synthetic peptide
  Seed: VIWEVLSAI (MAGC3_HUMAN)
VIWEVLSAL

SEQ ID NO: 103474 - protein, 11 aa, Artificial Sequence
  Description of Artificial Sequence: Synthetic peptide
  Seed: VLCPTYFKLWR (MAGC3_HUMAN)
VFCPTYFKLWR

SEQ ID NO: 103475 - protein, 10 aa, Artificial Sequence
  Description of Artificial Sequence: Synthetic peptide
  Seed: LLKYQAKEPL (MAGC3_HUMAN)
LHKYQAKEPF

SEQ ID NO: 103476 - protein, 9 aa, Artificial Sequence
  Description of Artificial Sequence: Synthetic peptide
  Seed: AEGSVLDLA (MAGC3_HUMAN)
AEGSVLDLI

SEQ ID NO: 103477 - protein, 10 aa, Artificial Sequence
  Description of Artificial Sequence: Synthetic peptide
  Seed: KLSSIIPSAF (MAGC3_HUMAN)
KQSSIIPSAW

SEQ ID NO: 103478 - protein, 10 aa, Artificial Sequence
  Description of Artificial Sequence: Synthetic peptide
  Seed: REVRLFLRGG (MAGC3_HUMAN)
RSVRLFLRGK

SEQ ID NO: 103479 - protein, 9 aa, Artificial Sequence
  Description of Artificial Sequence: Synthetic peptide
  Seed: KAHEFIELI (MAGC3_HUMAN)
KMHEFIELA

SEQ ID NO: 103480 - protein, 10 aa, Artificial Sequence
  Description of Artificial Sequence: Synthetic peptide
  Seed: FSDGSLGQWV (MAGC3_HUMAN)
FVDGSLGQWY

SEQ ID NO: 103481 - protein, 9 aa, Artificial Sequence
  Description of Artificial Sequence: Synthetic peptide
  Seed: ALDEKVAEL (MAGC3_HUMAN)
ASDEKVAEL

SEQ ID NO: 103482 - protein, 9 aa, Artificial Sequence
  Description of Artificial Sequence: Synthetic peptide
  Seed: MLLPCHWVL (MAGC3_HUMAN)
MNLPCHWVW

SEQ ID NO: 103483 - protein, 9 aa, Artificial Sequence
  Description of Artificial Sequence: Synthetic peptide
  Seed: NVINTYTGY (MAGC3_HUMAN)
NVINTYTGW

SEQ ID NO: 103484 - protein, 9 aa, Artificial Sequence
  Description of Artificial Sequence: Synthetic peptide
  Seed: VDPDHFYVF (MAGC3_HUMAN)
VFPDHFYVI

SEQ ID NO: 103485 - protein, 11 aa, Artificial Sequence
  Description of Artificial Sequence: Synthetic peptide
  Seed: MQMNVINTYTG (MAGC3_HUMAN)
MVMNVINTYTF

SEQ ID NO: 103486 - protein, 9 aa, Artificial Sequence
  Description of Artificial Sequence: Synthetic peptide
  Seed: QTKEPVTKA (MAGC3_HUMAN)
QIKEPVTKR

SEQ ID NO: 103487 - protein, 11 aa, Artificial Sequence
  Description of Artificial Sequence: Synthetic peptide
  Seed: ATAMASASPSV (MAGC3_HUMAN)
ANAMASASPSV

SEQ ID NO: 103488 - protein, 9 aa, Artificial Sequence
  Description of Artificial Sequence: Synthetic peptide
  Seed: ATYALSPVV (MAGC3_HUMAN)
ATYALSPVW

SEQ ID NO: 103489 - protein, 9 aa, Artificial Sequence
  Description of Artificial Sequence: Synthetic peptide
  Seed: IIDTTDDAT (MAGC3_HUMAN)
IGDTTDDAM

SEQ ID NO: 103490 - protein, 9 aa, Artificial Sequence
  Description of Artificial Sequence: Synthetic peptide
  Seed: IELIFGIAL (MAGC3_HUMAN)
IHLIFGIAA

SEQ ID NO: 103491 - protein, 10 aa, Artificial Sequence
  Description of Artificial Sequence: Synthetic peptide
  Seed: YALDEKVAEL (MAGC3_HUMAN)
YALDEKVAEA

SEQ ID NO: 103492 - protein, 11 aa, Artificial Sequence
  Description of Artificial Sequence: Synthetic peptide
  Seed: YALDEKVAELV (MAGC3_HUMAN)
YMLDEKVAELE

SEQ ID NO: 103493 - protein, 9 aa, Artificial Sequence
  Description of Artificial Sequence: Synthetic peptide
  Seed: YFFEDTLDL (MAGC3_HUMAN)
YQFEDTLDL

SEQ ID NO: 103494 - protein, 9 aa, Artificial Sequence
  Description of Artificial Sequence: Synthetic peptide
  Seed: SLRRAVSVK (MAGC3_HUMAN)
SCRRAVSVK

SEQ ID NO: 103495 - protein, 11 aa, Artificial Sequence
  Description of Artificial Sequence: Synthetic peptide
  Seed: KVAELVQFLLL (MAGC3_HUMAN)
KMAELVQFLLR

SEQ ID NO: 103496 - protein, 9 aa, Artificial Sequence
  Description of Artificial Sequence: Synthetic peptide
  Seed: MDPDNHSYF (MAGC3_HUMAN)
MVPDNHSYI

SEQ ID NO: 103497 - protein, 9 aa, Artificial Sequence
  Description of Artificial Sequence: Synthetic peptide
  Seed: GYFPMIFRK (MAGC3_HUMAN)
GTFPMIFRF

SEQ ID NO: 103498 - protein, 9 aa, Artificial Sequence
  Description of Artificial Sequence: Synthetic peptide
  Seed: RTLSGSPGL (MAGC3_HUMAN)
RSLSGSPGL

SEQ ID NO: 103499 - protein, 10 aa, Artificial Sequence
  Description of Artificial Sequence: Synthetic peptide
  Seed: YALSPVVLPP (MAGC3_HUMAN)
YCLSPVVLPM

SEQ ID NO: 103500 - protein, 8 aa, Artificial Sequence
  Description of Artificial Sequence: Synthetic peptide
  Seed: FGISLTEV (MAGC3_HUMAN)
FQISLTEV

SEQ ID NO: 103501 - protein, 9 aa, Artificial Sequence
  Description of Artificial Sequence: Synthetic peptide
  Seed: GSLPESEPL (MAGC3_HUMAN)
GALPESEPY

SEQ ID NO: 103502 - protein, 9 aa, Artificial Sequence
  Description of Artificial Sequence: Synthetic peptide
  Seed: MIFGKAHEF (MAGC3_HUMAN)
MGFGKAHEV

SEQ ID NO: 103503 - protein, 10 aa, Artificial Sequence
  Description of Artificial Sequence: Synthetic peptide
  Seed: TEASPQQKKG (MAGC3_HUMAN)
TEASPQQKKA

SEQ ID NO: 103504 - protein, 8 aa, Artificial Sequence
  Description of Artificial Sequence: Synthetic peptide
  Seed: RSAEGSVL (MAGC3_HUMAN)
RAAEGSVY

SEQ ID NO: 103505 - protein, 10 aa, Artificial Sequence
  Description of Artificial Sequence: Synthetic peptide
  Seed: TDMDPDNHSY (MAGC3_HUMAN)
TSMDPDNHSF

SEQ ID NO: 103506 - protein, 9 aa, Artificial Sequence
  Description of Artificial Sequence: Synthetic peptide
  Seed: KLWRTLSGS (MAGC3_HUMAN)
KVWRTLSGI

SEQ ID NO: 103507 - protein, 9 aa, Artificial Sequence
  Description of Artificial Sequence: Synthetic peptide
  Seed: HALPESESL (MAGC3_HUMAN)
HHLPESESC

SEQ ID NO: 103508 - protein, 9 aa, Artificial Sequence
  Description of Artificial Sequence: Synthetic peptide
  Seed: SLRRAVSVK (MAGC3_HUMAN)
SYRRAVSVR

SEQ ID NO: 103509 - protein, 9 aa, Artificial Sequence
  Description of Artificial Sequence: Synthetic peptide
  Seed: KLSSIIPSA (MAGC3_HUMAN)
KASSIIPSM

SEQ ID NO: 103510 - protein, 10 aa, Artificial Sequence
  Description of Artificial Sequence: Synthetic peptide
  Seed: TTDDATAMAS (MAGC3_HUMAN)
TIDDATAMAI

SEQ ID NO: 103511 - protein, 9 aa, Artificial Sequence
  Description of Artificial Sequence: Synthetic peptide
  Seed: YQAKEPLTR (MAGC3_HUMAN)
YMAKEPLTM

SEQ ID NO: 103512 - protein, 9 aa, Artificial Sequence
  Description of Artificial Sequence: Synthetic peptide
  Seed: LRSAEGSVL (MAGC3_HUMAN)
LQSAEGSVV

SEQ ID NO: 103513 - protein, 9 aa, Artificial Sequence
  Description of Artificial Sequence: Synthetic peptide
  Seed: QAKEPLTRA (MAGC3_HUMAN)
QAKEPLTRM

SEQ ID NO: 103514 - protein, 10 aa, Artificial Sequence
  Description of Artificial Sequence: Synthetic peptide
  Seed: ILILSMIFIK (MAGC3_HUMAN)
IYILSMIFIR

SEQ ID NO: 103515 - protein, 11 aa, Artificial Sequence
  Description of Artificial Sequence: Synthetic peptide
  Seed: AEMQMNVINTY (MAGC3_HUMAN)
ASMQMNVINTF

SEQ ID NO: 103516 - protein, 9 aa, Artificial Sequence
  Description of Artificial Sequence: Synthetic peptide
  Seed: ELIFGIALT (MAGC3_HUMAN)
ENIFGIALV

SEQ ID NO: 103517 - protein, 9 aa, Artificial Sequence
  Description of Artificial Sequence: Synthetic peptide
  Seed: FSDGSLGQW (MAGC3_HUMAN)
FIDGSLGQY

SEQ ID NO: 103518 - protein, 10 aa, Artificial Sequence
  Description of Artificial Sequence: Synthetic peptide
  Seed: LIFGIALTDM (MAGC3_HUMAN)
LVFGIALTDL

SEQ ID NO: 103519 - protein, 10 aa, Artificial Sequence
  Description of Artificial Sequence: Synthetic peptide
  Seed: SWYMDALKDM (MAGC3_HUMAN)
SAYMDALKDF

SEQ ID NO: 103520 - protein, 9 aa, Artificial Sequence
  Description of Artificial Sequence: Synthetic peptide
  Seed: VLPPQPQPR (MAGC3_HUMAN)
VWPPQPQPL

SEQ ID NO: 103521 - protein, 11 aa, Artificial Sequence
  Description of Artificial Sequence: Synthetic peptide
  Seed: SASPSVMSTNF (MAGC3_HUMAN)
SSSPSVMSTNW

SEQ ID NO: 103522 - protein, 10 aa, Artificial Sequence
  Description of Artificial Sequence: Synthetic peptide
  Seed: SKLSSIIPSA (MAGC3_HUMAN)
SMLSSIIPST

SEQ ID NO: 103523 - protein, 10 aa, Artificial Sequence
  Description of Artificial Sequence: Synthetic peptide
  Seed: SWYMDALKDM (MAGC3_HUMAN)
SYYMDALKDW

SEQ ID NO: 103524 - protein, 9 aa, Artificial Sequence
  Description of Artificial Sequence: Synthetic peptide
  Seed: MEDRAQAII (MAGC3_HUMAN)
MVDRAQAIV

SEQ ID NO: 103525 - protein, 9 aa, Artificial Sequence
  Description of Artificial Sequence: Synthetic peptide
  Seed: DYFPMIFGK (MAGC3_HUMAN)
DGFPMIFGK

SEQ ID NO: 103526 - protein, 9 aa, Artificial Sequence
  Description of Artificial Sequence: Synthetic peptide
  Seed: MQMNVINTY (MAGC3_HUMAN)
MIMNVINTI

SEQ ID NO: 103527 - protein, 9 aa, Artificial Sequence
  Description of Artificial Sequence: Synthetic peptide
  Seed: FSDGSLGQW (MAGC3_HUMAN)
FMDGSLGQM

SEQ ID NO: 103528 - protein, 9 aa, Artificial Sequence
  Description of Artificial Sequence: Synthetic peptide
  Seed: EVDPDHFYV (MAGC3_HUMAN)
EMDPDHFYM

SEQ ID NO: 103529 - protein, 9 aa, Artificial Sequence
  Description of Artificial Sequence: Synthetic peptide
  Seed: VLPPQPQPR (MAGC3_HUMAN)
VTPPQPQPM

SEQ ID NO: 103530 - protein, 9 aa, Artificial Sequence
  Description of Artificial Sequence: Synthetic peptide
  Seed: EVLSAIGPI (MAGC3_HUMAN)
EVLSAIGPK

SEQ ID NO: 103531 - protein, 10 aa, Artificial Sequence
  Description of Artificial Sequence: Synthetic peptide
  Seed: LLKYQAKEPL (MAGC3_HUMAN)
LVKYQAKEPY

SEQ ID NO: 103532 - protein, 10 aa, Artificial Sequence
  Description of Artificial Sequence: Synthetic peptide
  Seed: SAFHLGHLRE (MAGC3_HUMAN)
SMFHLGHLRP

SEQ ID NO: 103533 - protein, 8 aa, Artificial Sequence
  Description of Artificial Sequence: Synthetic peptide
  Seed: VKNTCATY (MAGC3_HUMAN)
VQNTCATY

SEQ ID NO: 103534 - protein, 9 aa, Artificial Sequence
  Description of Artificial Sequence: Synthetic peptide
  Seed: YFFEDTLDL (MAGC3_HUMAN)
YLFEDTLDI

SEQ ID NO: 103535 - protein, 9 aa, Artificial Sequence
  Description of Artificial Sequence: Synthetic peptide
  Seed: EKVDKLVQF (MAGC3_HUMAN)
EMVDKLVQF

SEQ ID NO: 103536 - protein, 9 aa, Artificial Sequence
  Description of Artificial Sequence: Synthetic peptide
  Seed: EVDPDHFYV (MAGC3_HUMAN)
EMDPDHFYY

SEQ ID NO: 103537 - protein, 9 aa, Artificial Sequence
  Description of Artificial Sequence: Synthetic peptide
  Seed: IPPQGPPKI (MAGC3_HUMAN)
IRPQGPPKF

SEQ ID NO: 103538 - protein, 10 aa, Artificial Sequence
  Description of Artificial Sequence: Synthetic peptide
  Seed: YQAKEPLTRA (MAGC3_HUMAN)
YQAKEPLTRL

SEQ ID NO: 103539 - protein, 9 aa, Artificial Sequence
  Description of Artificial Sequence: Synthetic peptide
  Seed: AVSPGKRLW (MAGC3_HUMAN)
AVSPGKRLY

SEQ ID NO: 103540 - protein, 9 aa, Artificial Sequence
  Description of Artificial Sequence: Synthetic peptide
  Seed: YSAFHLGHL (MAGC3_HUMAN)
YSAFHLGHW

SEQ ID NO: 103541 - protein, 9 aa, Artificial Sequence
  Description of Artificial Sequence: Synthetic peptide
  Seed: MEDRAQAII (MAGC3_HUMAN)
MLDRAQAII

SEQ ID NO: 103542 - protein, 9 aa, Artificial Sequence
  Description of Artificial Sequence: Synthetic peptide
  Seed: YFFEDTLDL (MAGC3_HUMAN)
YKFEDTLDY

SEQ ID NO: 103543 - protein, 9 aa, Artificial Sequence
  Description of Artificial Sequence: Synthetic peptide
  Seed: MQMNVINTY (MAGC3_HUMAN)
MTMNVINTK

SEQ ID NO: 103544 - protein, 9 aa, Artificial Sequence
  Description of Artificial Sequence: Synthetic peptide
  Seed: TLDEKVDKL (MAGC3_HUMAN)
TEDEKVDKM

SEQ ID NO: 103545 - protein, 11 aa, Artificial Sequence
  Description of Artificial Sequence: Synthetic peptide
  Seed: DMDPDNHSYFF (MAGC3_HUMAN)
DIDPDNHSYFY

SEQ ID NO: 103546 - protein, 10 aa, Artificial Sequence
  Description of Artificial Sequence: Synthetic peptide
  Seed: TLDEKVDKLV (MAGC3_HUMAN)
TYDEKVDKLF

SEQ ID NO: 103547 - protein, 8 aa, Artificial Sequence
  Description of Artificial Sequence: Synthetic peptide
  Seed: TTDDATAM (MAGC3_HUMAN)
TMDDATAM

SEQ ID NO: 103548 - protein, 9 aa, Artificial Sequence
  Description of Artificial Sequence: Synthetic peptide
  Seed: MIFGKAHEF (MAGC3_HUMAN)
MTFGKAHEW

SEQ ID NO: 103549 - protein, 9 aa, Artificial Sequence
  Description of Artificial Sequence: Synthetic peptide
  Seed: CSSPLLWTR (MAGC3_HUMAN)
CLSPLLWTK

SEQ ID NO: 103550 - protein, 9 aa, Artificial Sequence
  Description of Artificial Sequence: Synthetic peptide
  Seed: ALKDMEDRA (MAGC3_HUMAN)
AMKDMEDRV

SEQ ID NO: 103551 - protein, 9 aa, Artificial Sequence
  Description of Artificial Sequence: Synthetic peptide
  Seed: YQAKEPLTR (MAGC3_HUMAN)
YAAKEPLTL

SEQ ID NO: 103552 - protein, 11 aa, Artificial Sequence
  Description of Artificial Sequence: Synthetic peptide
  Seed: LTDMDPDNHSY (MAGC3_HUMAN)
LADMDPDNHSL

SEQ ID NO: 103553 - protein, 9 aa, Artificial Sequence
  Description of Artificial Sequence: Synthetic peptide
  Seed: NAIGPWSAL (MAGC3_HUMAN)
NYIGPWSAY

SEQ ID NO: 103554 - protein, 9 aa, Artificial Sequence
  Description of Artificial Sequence: Synthetic peptide
  Seed: KYKDYFPMI (MAGC3_HUMAN)
KVKDYFPMI

SEQ ID NO: 103555 - protein, 10 aa, Artificial Sequence
  Description of Artificial Sequence: Synthetic peptide
  Seed: EKVAELVQFL (MAGC3_HUMAN)
EVVAELVQFV

SEQ ID NO: 103556 - protein, 10 aa, Artificial Sequence
  Description of Artificial Sequence: Synthetic peptide
  Seed: TLSGSPGLQL (MAGC3_HUMAN)
TMSGSPGLQL

SEQ ID NO: 103557 - protein, 9 aa, Artificial Sequence
  Description of Artificial Sequence: Synthetic peptide
  Seed: LKYQAKEPL (MAGC3_HUMAN)
LQYQAKEPV

SEQ ID NO: 103558 - protein, 10 aa, Artificial Sequence
  Description of Artificial Sequence: Synthetic peptide
  Seed: GPPQSPPQSP (MAGC3_HUMAN)
GPPQSPPQSA

SEQ ID NO: 103559 - protein, 9 aa, Artificial Sequence
  Description of Artificial Sequence: Synthetic peptide
  Seed: MLLPCHWVL (MAGC3_HUMAN)
MLLPCHWVT

SEQ ID NO: 103560 - protein, 9 aa, Artificial Sequence
  Description of Artificial Sequence: Synthetic peptide
  Seed: SAFHLGHLR (MAGC3_HUMAN)
STFHLGHLR

SEQ ID NO: 103561 - protein, 10 aa, Artificial Sequence
  Description of Artificial Sequence: Synthetic peptide
  Seed: KYKDYFPMIF (MAGC3_HUMAN)
KSKDYFPMIY

SEQ ID NO: 103562 - protein, 10 aa, Artificial Sequence
  Description of Artificial Sequence: Synthetic peptide
  Seed: MQMNVINTYT (MAGC3_HUMAN)
MPMNVINTYY

SEQ ID NO: 103563 - protein, 9 aa, Artificial Sequence
  Description of Artificial Sequence: Synthetic peptide
  Seed: SLRRAVSVK (MAGC3_HUMAN)
SMRRAVSVR

SEQ ID NO: 103564 - protein, 9 aa, Artificial Sequence
  Description of Artificial Sequence: Synthetic peptide
  Seed: AGFADVLSR (MAGC3_HUMAN)
AMFADVLSR

SEQ ID NO: 103565 - protein, 9 aa, Artificial Sequence
  Description of Artificial Sequence: Synthetic peptide
  Seed: LSSIIPSAF (MAGC3_HUMAN)
LYSIIPSAL

SEQ ID NO: 103566 - protein, 9 aa, Artificial Sequence
  Description of Artificial Sequence: Synthetic peptide
  Seed: KEPLTRAEM (MAGC3_HUMAN)
KAPLTRAEY

SEQ ID NO: 103567 - protein, 10 aa, Artificial Sequence
  Description of Artificial Sequence: Synthetic peptide
  Seed: ALDEKVAELV (MAGC3_HUMAN)
ALDEKVAELI

SEQ ID NO: 103568 - protein, 9 aa, Artificial Sequence
  Description of Artificial Sequence: Synthetic peptide
  Seed: FHLGHLREV (MAGC3_HUMAN)
FFLGHLREV

SEQ ID NO: 103569 - protein, 9 aa, Artificial Sequence
  Description of Artificial Sequence: Synthetic peptide
  Seed: MASASPSVM (MAGC3_HUMAN)
MESASPSVY

SEQ ID NO: 103570 - protein, 10 aa, Artificial Sequence
  Description of Artificial Sequence: Synthetic peptide
  Seed: FKLWRTLSGS (MAGC3_HUMAN)
FYLWRTLSGV

SEQ ID NO: 103571 - protein, 10 aa, Artificial Sequence
  Description of Artificial Sequence: Synthetic peptide
  Seed: TEVDPDHFYV (MAGC3_HUMAN)
TEVDPDHFYL

SEQ ID NO: 103572 - protein, 9 aa, Artificial Sequence
  Description of Artificial Sequence: Synthetic peptide
  Seed: YKDYFPMIF (MAGC3_HUMAN)
YADYFPMIV

SEQ ID NO: 103573 - protein, 9 aa, Artificial Sequence
  Description of Artificial Sequence: Synthetic peptide
  Seed: KGSCVPEEV (MAGC3_HUMAN)
KLSCVPEEI

SEQ ID NO: 103574 - protein, 11 aa, Artificial Sequence
  Description of Artificial Sequence: Synthetic peptide
  Seed: DYSAFHLGHLR (MAGC3_HUMAN)
DWSAFHLGHLR

SEQ ID NO: 103575 - protein, 8 aa, Artificial Sequence
  Description of Artificial Sequence: Synthetic peptide
  Seed: AEMQMNVI (MAGC3_HUMAN)
AQMQMNVV

SEQ ID NO: 103576 - protein, 9 aa, Artificial Sequence
  Description of Artificial Sequence: Synthetic peptide
  Seed: FSDGSLGQW (MAGC3_HUMAN)
FWDGSLGQL

SEQ ID NO: 103577 - protein, 11 aa, Artificial Sequence
  Description of Artificial Sequence: Synthetic peptide
  Seed: SVLDLANPQGL (MAGC3_HUMAN)
SMLDLANPQGV

SEQ ID NO: 103578 - protein, 10 aa, Artificial Sequence
  Description of Artificial Sequence: Synthetic peptide
  Seed: RSAEGSVLDL (MAGC3_HUMAN)
RSAEGSVLDM

SEQ ID NO: 103579 - protein, 9 aa, Artificial Sequence
  Description of Artificial Sequence: Synthetic peptide
  Seed: SDLHFGSQP (MAGC3_HUMAN)
SELHFGSQT

SEQ ID NO: 103580 - protein, 11 aa, Artificial Sequence
  Description of Artificial Sequence: Synthetic peptide
  Seed: SASPSVMSTNF (MAGC3_HUMAN)
SASPSVMSTNY

SEQ ID NO: 103581 - protein, 11 aa, Artificial Sequence
  Description of Artificial Sequence: Synthetic peptide
  Seed: LSKLSSIIPSA (MAGC3_HUMAN)
LQKLSSIIPSI

SEQ ID NO: 103582 - protein, 9 aa, Artificial Sequence
  Description of Artificial Sequence: Synthetic peptide
  Seed: KVAELVQFL (MAGC3_HUMAN)
KAAELVQFR

SEQ ID NO: 103583 - protein, 9 aa, Artificial Sequence
  Description of Artificial Sequence: Synthetic peptide
  Seed: RGTGYTLSL (MAGC3_HUMAN)
RWTGYTLSY

SEQ ID NO: 103584 - protein, 11 aa, Artificial Sequence
  Description of Artificial Sequence: Synthetic peptide
  Seed: FGSQPEGKFSL (MAGC3_HUMAN)
FASQPEGKFSF

SEQ ID NO: 103585 - protein, 9 aa, Artificial Sequence
  Description of Artificial Sequence: Synthetic peptide
  Seed: VIWEVLNAI (MAGC3_HUMAN)
VLWEVLNAS

SEQ ID NO: 103586 - protein, 9 aa, Artificial Sequence
  Description of Artificial Sequence: Synthetic peptide
  Seed: RTLSGSPGL (MAGC3_HUMAN)
RQLSGSPGL

SEQ ID NO: 103587 - protein, 9 aa, Artificial Sequence
  Description of Artificial Sequence: Synthetic peptide
  Seed: GYFPMIFRK (MAGC3_HUMAN)
GTFPMIFRY

SEQ ID NO: 103588 - protein, 9 aa, Artificial Sequence
  Description of Artificial Sequence: Synthetic peptide
  Seed: HLREVRLFL (MAGC3_HUMAN)
HRREVRLFY

SEQ ID NO: 103589 - protein, 9 aa, Artificial Sequence
  Description of Artificial Sequence: Synthetic peptide
  Seed: FSLRRAVSV (MAGC3_HUMAN)
FPLRRAVSF

SEQ ID NO: 103590 - protein, 10 aa, Artificial Sequence
  Description of Artificial Sequence: Synthetic peptide
  Seed: LNAIGPWSAL (MAGC3_HUMAN)
LRAIGPWSAM

SEQ ID NO: 103591 - protein, 9 aa, Artificial Sequence
  Description of Artificial Sequence: Synthetic peptide
  Seed: LTEASPQQK (MAGC3_HUMAN)
LAEASPQQY

SEQ ID NO: 103592 - protein, 9 aa, Artificial Sequence
  Description of Artificial Sequence: Synthetic peptide
  Seed: GYFPMIFRK (MAGC3_HUMAN)
GIFPMIFRK

SEQ ID NO: 103593 - protein, 10 aa, Artificial Sequence
  Description of Artificial Sequence: Synthetic peptide
  Seed: TDMDPDNHSY (MAGC3_HUMAN)
TTMDPDNHSY

SEQ ID NO: 103594 - protein, 9 aa, Artificial Sequence
  Description of Artificial Sequence: Synthetic peptide
  Seed: VIWEVLNAI (MAGC3_HUMAN)
VQWEVLNAL

SEQ ID NO: 103595 - protein, 9 aa, Artificial Sequence
  Description of Artificial Sequence: Synthetic peptide
  Seed: NVINTYTGY (MAGC3_HUMAN)
NQINTYTGY

SEQ ID NO: 103596 - protein, 9 aa, Artificial Sequence
  Description of Artificial Sequence: Synthetic peptide
  Seed: EVLEFLSKL (MAGC3_HUMAN)
EMLEFLSKV

SEQ ID NO: 103597 - protein, 9 aa, Artificial Sequence
  Description of Artificial Sequence: Synthetic peptide
  Seed: MLLPCHWVL (MAGC3_HUMAN)
MLLPCHWVW

SEQ ID NO: 103598 - protein, 9 aa, Artificial Sequence
  Description of Artificial Sequence: Synthetic peptide
  Seed: NTYTGYFPM (MAGC3_HUMAN)
NEYTGYFPY

SEQ ID NO: 103599 - protein, 10 aa, Artificial Sequence
  Description of Artificial Sequence: Synthetic peptide
  Seed: SCSSPLLWTR (MAGC3_HUMAN)
SMSSPLLWTK

SEQ ID NO: 103600 - protein, 10 aa, Artificial Sequence
  Description of Artificial Sequence: Synthetic peptide
  Seed: YALSPVVLPP (MAGC3_HUMAN)
YMLSPVVLPI

SEQ ID NO: 103601 - protein, 9 aa, Artificial Sequence
  Description of Artificial Sequence: Synthetic peptide
  Seed: KLSSIIPSA (MAGC3_HUMAN)
KMSSIIPSA

SEQ ID NO: 103602 - protein, 9 aa, Artificial Sequence
  Description of Artificial Sequence: Synthetic peptide
  Seed: ALSPVVLPP (MAGC3_HUMAN)
AQSPVVLPA

SEQ ID NO: 103603 - protein, 9 aa, Artificial Sequence
  Description of Artificial Sequence: Synthetic peptide
  Seed: IIDTTDDAT (MAGC3_HUMAN)
IGDTTDDAL

SEQ ID NO: 103604 - protein, 11 aa, Artificial Sequence
  Description of Artificial Sequence: Synthetic peptide
  Seed: TAMASASPSVM (MAGC3_HUMAN)
TRMASASPSVF

SEQ ID NO: 103605 - protein, 9 aa, Artificial Sequence
  Description of Artificial Sequence: Synthetic peptide
  Seed: IQRPAREVL (MAGC3_HUMAN)
IMRPAREVF

SEQ ID NO: 103606 - protein, 9 aa, Artificial Sequence
  Description of Artificial Sequence: Synthetic peptide
  Seed: YQAKEPLTR (MAGC3_HUMAN)
YTAKEPLTK

SEQ ID NO: 103607 - protein, 10 aa, Artificial Sequence
  Description of Artificial Sequence: Synthetic peptide
  Seed: EKVAELVQFL (MAGC3_HUMAN)
EGVAELVQFL

SEQ ID NO: 103608 - protein, 10 aa, Artificial Sequence
  Description of Artificial Sequence: Synthetic peptide
  Seed: LLILILSMIF (MAGC3_HUMAN)
LQILILSMIF

SEQ ID NO: 103609 - protein, 11 aa, Artificial Sequence
  Description of Artificial Sequence: Synthetic peptide
  Seed: ATFSDGSLGQW (MAGC3_HUMAN)
ANFSDGSLGQW

SEQ ID NO: 103610 - protein, 11 aa, Artificial Sequence
  Description of Artificial Sequence: Synthetic peptide
  Seed: ALWESEGPEAF (MAGC3_HUMAN)
ASWESEGPEAY

SEQ ID NO: 103611 - protein, 9 aa, Artificial Sequence
  Description of Artificial Sequence: Synthetic peptide
  Seed: NAIGPWSAL (MAGC3_HUMAN)
NIIGPWSAW

SEQ ID NO: 103612 - protein, 10 aa, Artificial Sequence
  Description of Artificial Sequence: Synthetic peptide
  Seed: NTYTGYFPMI (MAGC3_HUMAN)
NQYTGYFPMF

SEQ ID NO: 103613 - protein, 9 aa, Artificial Sequence
  Description of Artificial Sequence: Synthetic peptide
  Seed: MPAAGMPPL (MAGC3_HUMAN)
MGAAGMPPF

SEQ ID NO: 103614 - protein, 9 aa, Artificial Sequence
  Description of Artificial Sequence: Synthetic peptide
  Seed: FSDGSLGQW (MAGC3_HUMAN)
FADGSLGQA

SEQ ID NO: 103615 - protein, 8 aa, Artificial Sequence
  Description of Artificial Sequence: Synthetic peptide
  Seed: KVDKLVQF (MAGC3_HUMAN)
KTDKLVQV

SEQ ID NO: 103616 - protein, 10 aa, Artificial Sequence
  Description of Artificial Sequence: Synthetic peptide
  Seed: SQPEGKFSLR (MAGC3_HUMAN)
SMPEGKFSLR

SEQ ID NO: 103617 - protein, 11 aa, Artificial Sequence
  Description of Artificial Sequence: Synthetic peptide
  Seed: FLSKLSSIIPS (MAGC3_HUMAN)
FMSKLSSIIPT

SEQ ID NO: 103618 - protein, 9 aa, Artificial Sequence
  Description of Artificial Sequence: Synthetic peptide
  Seed: SEEEDTATW (MAGC3_HUMAN)
SLEEDTATI

SEQ ID NO: 103619 - protein, 10 aa, Artificial Sequence
  Description of Artificial Sequence: Synthetic peptide
  Seed: EKVAELVQFL (MAGC3_HUMAN)
EEVAELVQFI

SEQ ID NO: 103620 - protein, 9 aa, Artificial Sequence
  Description of Artificial Sequence: Synthetic peptide
  Seed: KLVQFLLLK (MAGC3_HUMAN)
KYVQFLLLR

SEQ ID NO: 103621 - protein, 9 aa, Artificial Sequence
  Description of Artificial Sequence: Synthetic peptide
  Seed: SPLDSCSSP (MAGC3_HUMAN)
SPLDSCSSL

SEQ ID NO: 103622 - protein, 9 aa, Artificial Sequence
  Description of Artificial Sequence: Synthetic peptide
  Seed: AIGPIQRPA (MAGC3_HUMAN)
AAGPIQRPM

SEQ ID NO: 103623 - protein, 9 aa, Artificial Sequence
  Description of Artificial Sequence: Synthetic peptide
  Seed: ALKDMEDRA (MAGC3_HUMAN)
AMKDMEDRL

SEQ ID NO: 103624 - protein, 10 aa, Artificial Sequence
  Description of Artificial Sequence: Synthetic peptide
  Seed: KLSSIIPSAF (MAGC3_HUMAN)
KISSIIPSAW

SEQ ID NO: 103625 - protein, 9 aa, Artificial Sequence
  Description of Artificial Sequence: Synthetic peptide
  Seed: LRSAEGSVL (MAGC3_HUMAN)
LRSAEGSVY

SEQ ID NO: 103626 - protein, 11 aa, Artificial Sequence
  Description of Artificial Sequence: Synthetic peptide
  Seed: LTDMDPDNHSY (MAGC3_HUMAN)
LLDMDPDNHSY

SEQ ID NO: 103627 - protein, 9 aa, Artificial Sequence
  Description of Artificial Sequence: Synthetic peptide
  Seed: SPQGPPQSP (MAGC3_HUMAN)
SPQGPPQSC

SEQ ID NO: 103628 - protein, 9 aa, Artificial Sequence
  Description of Artificial Sequence: Synthetic peptide
  Seed: AIGPWSALA (MAGC3_HUMAN)
AIGPWSALI

SEQ ID NO: 103629 - protein, 9 aa, Artificial Sequence
  Description of Artificial Sequence: Synthetic peptide
  Seed: HLREVRLFL (MAGC3_HUMAN)
HPREVRLFF

SEQ ID NO: 103630 - protein, 9 aa, Artificial Sequence
  Description of Artificial Sequence: Synthetic peptide
  Seed: MPAAGMPPL (MAGC3_HUMAN)
MKAAGMPPY

SEQ ID NO: 103631 - protein, 11 aa, Artificial Sequence
  Description of Artificial Sequence: Synthetic peptide
  Seed: FIELIFGIALT (MAGC3_HUMAN)
FEELIFGIALL

SEQ ID NO: 103632 - protein, 9 aa, Artificial Sequence
  Description of Artificial Sequence: Synthetic peptide
  Seed: AGFADVLSR (MAGC3_HUMAN)
ARFADVLSL

SEQ ID NO: 103633 - protein, 9 aa, Artificial Sequence
  Description of Artificial Sequence: Synthetic peptide
  Seed: VLPPQPQPR (MAGC3_HUMAN)
VQPPQPQPM

SEQ ID NO: 103634 - protein, 10 aa, Artificial Sequence
  Description of Artificial Sequence: Synthetic peptide
  Seed: LNAIGPWSAL (MAGC3_HUMAN)
LEAIGPWSAY

SEQ ID NO: 103635 - protein, 9 aa, Artificial Sequence
  Description of Artificial Sequence: Synthetic peptide
  Seed: ALDEKVAEL (MAGC3_HUMAN)
ALDEKVAEY

SEQ ID NO: 103636 - protein, 9 aa, Artificial Sequence
  Description of Artificial Sequence: Synthetic peptide
  Seed: HALPESESL (MAGC3_HUMAN)
HELPESESF

SEQ ID NO: 103637 - protein, 10 aa, Artificial Sequence
  Description of Artificial Sequence: Synthetic peptide
  Seed: TLDEKVDKLV (MAGC3_HUMAN)
TIDEKVDKLF

SEQ ID NO: 103638 - protein, 9 aa, Artificial Sequence
  Description of Artificial Sequence: Synthetic peptide
  Seed: YQAKEPLTR (MAGC3_HUMAN)
YAAKEPLTF

SEQ ID NO: 103639 - protein, 9 aa, Artificial Sequence
  Description of Artificial Sequence: Synthetic peptide
  Seed: LILSVIFIK (MAGC3_HUMAN)
LMLSVIFIK

SEQ ID NO: 103640 - protein, 11 aa, Artificial Sequence
  Description of Artificial Sequence: Synthetic peptide
  Seed: INTYTGYFPMI (MAGC3_HUMAN)
IKTYTGYFPMF

SEQ ID NO: 103641 - protein, 10 aa, Artificial Sequence
  Description of Artificial Sequence: Synthetic peptide
  Seed: VLDLANPQGL (MAGC3_HUMAN)
VMDLANPQGL

SEQ ID NO: 103642 - protein, 10 aa, Artificial Sequence
  Description of Artificial Sequence: Synthetic peptide
  Seed: SDQRMDSLVL (MAGC3_HUMAN)
SWQRMDSLVY

SEQ ID NO: 103643 - protein, 10 aa, Artificial Sequence
  Description of Artificial Sequence: Synthetic peptide
  Seed: KKYKDYFPMI (MAGC3_HUMAN)
KYYKDYFPMM

SEQ ID NO: 103644 - protein, 10 aa, Artificial Sequence
  Description of Artificial Sequence: Synthetic peptide
  Seed: LPTWRRGTGY (MAGC3_HUMAN)
LTTWRRGTGW

SEQ ID NO: 103645 - protein, 11 aa, Artificial Sequence
  Description of Artificial Sequence: Synthetic peptide
  Seed: MQMNVINTYTG (MAGC3_HUMAN)
MIMNVINTYTY

SEQ ID NO: 103646 - protein, 10 aa, Artificial Sequence
  Description of Artificial Sequence: Synthetic peptide
  Seed: NTYTGYFPMI (MAGC3_HUMAN)
NMYTGYFPMI

SEQ ID NO: 103647 - protein, 9 aa, Artificial Sequence
  Description of Artificial Sequence: Synthetic peptide
  Seed: IELIFGIAL (MAGC3_HUMAN)
IELIFGIAV

SEQ ID NO: 103648 - protein, 10 aa, Artificial Sequence
  Description of Artificial Sequence: Synthetic peptide
  Seed: KLVQFLLLKY (MAGC3_HUMAN)
KGVQFLLLKK

SEQ ID NO: 103649 - protein, 9 aa, Artificial Sequence
  Description of Artificial Sequence: Synthetic peptide
  Seed: MIFRKAREF (MAGC3_HUMAN)
MSFRKAREL

SEQ ID NO: 103650 - protein, 9 aa, Artificial Sequence
  Description of Artificial Sequence: Synthetic peptide
  Seed: FADVLSRLA (MAGC3_HUMAN)
FQDVLSRLM

SEQ ID NO: 103651 - protein, 8 aa, Artificial Sequence
  Description of Artificial Sequence: Synthetic peptide
  Seed: TTDDATAM (MAGC3_HUMAN)
TMDDATAF

SEQ ID NO: 103652 - protein, 10 aa, Artificial Sequence
  Description of Artificial Sequence: Synthetic peptide
  Seed: EVIWEVLNAI (MAGC3_HUMAN)
EIIWEVLNAL

SEQ ID NO: 103653 - protein, 9 aa, Artificial Sequence
  Description of Artificial Sequence: Synthetic peptide
  Seed: FHLGHLREV (MAGC3_HUMAN)
FRLGHLREF

SEQ ID NO: 103654 - protein, 9 aa, Artificial Sequence
  Description of Artificial Sequence: Synthetic peptide
  Seed: EFIELIFGI (MAGC3_HUMAN)
EMIELIFGV

SEQ ID NO: 103655 - protein, 9 aa, Artificial Sequence
  Description of Artificial Sequence: Synthetic peptide
  Seed: KAHEFIELI (MAGC3_HUMAN)
KLHEFIELR

SEQ ID NO: 103656 - protein, 9 aa, Artificial Sequence
  Description of Artificial Sequence: Synthetic peptide
  Seed: LGHLREVRL (MAGC3_HUMAN)
LPHLREVRL

SEQ ID NO: 103657 - protein, 9 aa, Artificial Sequence
  Description of Artificial Sequence: Synthetic peptide
  Seed: LILSVIFIK (MAGC3_HUMAN)
LLLSVIFIR

SEQ ID NO: 103658 - protein, 10 aa, Artificial Sequence
  Description of Artificial Sequence: Synthetic peptide
  Seed: FSDGSLGQWV (MAGC3_HUMAN)
FMDGSLGQWF

SEQ ID NO: 103659 - protein, 10 aa, Artificial Sequence
  Description of Artificial Sequence: Synthetic peptide
  Seed: MQMNVINTYT (MAGC3_HUMAN)
MVMNVINTYM

SEQ ID NO: 103660 - protein, 9 aa, Artificial Sequence
  Description of Artificial Sequence: Synthetic peptide
  Seed: KAHEFIELI (MAGC3_HUMAN)
KAHEFIELK

SEQ ID NO: 103661 - protein, 9 aa, Artificial Sequence
  Description of Artificial Sequence: Synthetic peptide
  Seed: MDPDNHSYF (MAGC3_HUMAN)
MQPDNHSYF

SEQ ID NO: 103662 - protein, 9 aa, Artificial Sequence
  Description of Artificial Sequence: Synthetic peptide
  Seed: SESLPRYAL (MAGC3_HUMAN)
SHSLPRYAV

SEQ ID NO: 103663 - protein, 10 aa, Artificial Sequence
  Description of Artificial Sequence: Synthetic peptide
  Seed: LDLANPQGLA (MAGC3_HUMAN)
LLLANPQGLV

SEQ ID NO: 103664 - protein, 10 aa, Artificial Sequence
  Description of Artificial Sequence: Synthetic peptide
  Seed: KLSSIIPSAF (MAGC3_HUMAN)
KQSSIIPSAL

SEQ ID NO: 103665 - protein, 9 aa, Artificial Sequence
  Description of Artificial Sequence: Synthetic peptide
  Seed: GLQLSDLHF (MAGC3_HUMAN)
GMQLSDLHF

SEQ ID NO: 103666 - protein, 9 aa, Artificial Sequence
  Description of Artificial Sequence: Synthetic peptide
  Seed: QRMDSLVLC (MAGC3_HUMAN)
QHMDSLVLM

SEQ ID NO: 103667 - protein, 10 aa, Artificial Sequence
  Description of Artificial Sequence: Synthetic peptide
  Seed: SKLSSIIPSA (MAGC3_HUMAN)
SGLSSIIPSA

SEQ ID NO: 103668 - protein, 9 aa, Artificial Sequence
  Description of Artificial Sequence: Synthetic peptide
  Seed: YALSPVVLP (MAGC3_HUMAN)
YVLSPVVLM

SEQ ID NO: 103669 - protein, 9 aa, Artificial Sequence
  Description of Artificial Sequence: Synthetic peptide
  Seed: LKYQAKEPL (MAGC3_HUMAN)
LSYQAKEPF

SEQ ID NO: 103670 - protein, 9 aa, Artificial Sequence
  Description of Artificial Sequence: Synthetic peptide
  Seed: EVLNAIGPW (MAGC3_HUMAN)
EILNAIGPF

SEQ ID NO: 103671 - protein, 11 aa, Artificial Sequence
  Description of Artificial Sequence: Synthetic peptide
  Seed: ILFGISLTEVD (MAGC3_HUMAN)
ILFGISLTEVM

SEQ ID NO: 103672 - protein, 10 aa, Artificial Sequence
  Description of Artificial Sequence: Synthetic peptide
  Seed: SALAGFADVL (MAGC3_HUMAN)
SFLAGFADVI

SEQ ID NO: 103673 - protein, 9 aa, Artificial Sequence
  Description of Artificial Sequence: Synthetic peptide
  Seed: TYFKLWRTL (MAGC3_HUMAN)
TWFKLWRTF

SEQ ID NO: 103674 - protein, 9 aa, Artificial Sequence
  Description of Artificial Sequence: Synthetic peptide
  Seed: KLSSIIPSA (MAGC3_HUMAN)
KMSSIIPSF

SEQ ID NO: 103675 - protein, 9 aa, Artificial Sequence
  Description of Artificial Sequence: Synthetic peptide
  Seed: GFADVLSRL (MAGC3_HUMAN)
GAADVLSRA

SEQ ID NO: 103676 - protein, 11 aa, Artificial Sequence
  Description of Artificial Sequence: Synthetic peptide
  Seed: RTLSGSPGLQL (MAGC3_HUMAN)
RLLSGSPGLQI

SEQ ID NO: 103677 - protein, 10 aa, Artificial Sequence
  Description of Artificial Sequence: Synthetic peptide
  Seed: REVRLFLRGG (MAGC3_HUMAN)
RIVRLFLRGI

SEQ ID NO: 103678 - protein, 10 aa, Artificial Sequence
  Description of Artificial Sequence: Synthetic peptide
  Seed: MPPLPQSPPE (MAGC3_HUMAN)
MPPLPQSPPV

SEQ ID NO: 103679 - protein, 9 aa, Artificial Sequence
  Description of Artificial Sequence: Synthetic peptide
  Seed: MASASPSVM (MAGC3_HUMAN)
MRSASPSVM

SEQ ID NO: 103680 - protein, 9 aa, Artificial Sequence
  Description of Artificial Sequence: Synthetic peptide
  Seed: TLDEKVDKL (MAGC3_HUMAN)
TIDEKVDKF

SEQ ID NO: 103681 - protein, 9 aa, Artificial Sequence
  Description of Artificial Sequence: Synthetic peptide
  Seed: MEDRAQAII (MAGC3_HUMAN)
MADRAQAIF

SEQ ID NO: 103682 - protein, 9 aa, Artificial Sequence
  Description of Artificial Sequence: Synthetic peptide
  Seed: QGMPKNCLL (MAGC3_HUMAN)
QAMPKNCLM

SEQ ID NO: 103683 - protein, 9 aa, Artificial Sequence
  Description of Artificial Sequence: Synthetic peptide
  Seed: YFFEDTLDL (MAGC3_HUMAN)
YVFEDTLDV

SEQ ID NO: 103684 - protein, 11 aa, Artificial Sequence
  Description of Artificial Sequence: Synthetic peptide
  Seed: AEMQMNVINTY (MAGC3_HUMAN)
ADMQMNVINTY

SEQ ID NO: 103685 - protein, 9 aa, Artificial Sequence
  Description of Artificial Sequence: Synthetic peptide
  Seed: SPQGPPQSP (MAGC3_HUMAN)
SPQGPPQSV

SEQ ID NO: 103686 - protein, 9 aa, Artificial Sequence
  Description of Artificial Sequence: Synthetic peptide
  Seed: FSDGSLGQW (MAGC3_HUMAN)
FLDGSLGQV

SEQ ID NO: 103687 - protein, 10 aa, Artificial Sequence
  Description of Artificial Sequence: Synthetic peptide
  Seed: RMDSLVLCPT (MAGC3_HUMAN)
RIDSLVLCPV

SEQ ID NO: 103688 - protein, 10 aa, Artificial Sequence
  Description of Artificial Sequence: Synthetic peptide
  Seed: LPTWRRGTGY (MAGC3_HUMAN)
LQTWRRGTGY

SEQ ID NO: 103689 - protein, 10 aa, Artificial Sequence
  Description of Artificial Sequence: Synthetic peptide
  Seed: ALPESESLPR (MAGC3_HUMAN)
AVPESESLPR

SEQ ID NO: 103690 - protein, 9 aa, Artificial Sequence
  Description of Artificial Sequence: Synthetic peptide
  Seed: FGSQPEGKF (MAGC3_HUMAN)
FASQPEGKL

SEQ ID NO: 103691 - protein, 9 aa, Artificial Sequence
  Description of Artificial Sequence: Synthetic peptide
  Seed: LSSIIPSAF (MAGC3_HUMAN)
LRSIIPSAM

SEQ ID NO: 103692 - protein, 8 aa, Artificial Sequence
  Description of Artificial Sequence: Synthetic peptide
  Seed: YFKLWRTL (MAGC3_HUMAN)
YYKLWRTM

SEQ ID NO: 103693 - protein, 9 aa, Artificial Sequence
  Description of Artificial Sequence: Synthetic peptide
  Seed: VIWEVLSAI (MAGC3_HUMAN)
VSWEVLSAV

SEQ ID NO: 103694 - protein, 9 aa, Artificial Sequence
  Description of Artificial Sequence: Synthetic peptide
  Seed: TKAEMLTTV (MAGC3_HUMAN)
TRAEMLTTL

SEQ ID NO: 103695 - protein, 10 aa, Artificial Sequence
  Description of Artificial Sequence: Synthetic peptide
  Seed: EVIWEVLSAI (MAGC3_HUMAN)
ETIWEVLSAI

SEQ ID NO: 103696 - protein, 10 aa, Artificial Sequence
  Description of Artificial Sequence: Synthetic peptide
  Seed: LDLANPQGLA (MAGC3_HUMAN)
LVLANPQGLV

SEQ ID NO: 103697 - protein, 9 aa, Artificial Sequence
  Description of Artificial Sequence: Synthetic peptide
  Seed: MQMNVINTY (MAGC3_HUMAN)
MSMNVINTV

SEQ ID NO: 103698 - protein, 9 aa, Artificial Sequence
  Description of Artificial Sequence: Synthetic peptide
  Seed: FLSKLSSII (MAGC3_HUMAN)
FRSKLSSIF

SEQ ID NO: 103699 - protein, 9 aa, Artificial Sequence
  Description of Artificial Sequence: Synthetic peptide
  Seed: EKVAELVQF (MAGC3_HUMAN)
EQVAELVQY

SEQ ID NO: 103700 - protein, 9 aa, Artificial Sequence
  Description of Artificial Sequence: Synthetic peptide
  Seed: HFYVFVNTL (MAGC3_HUMAN)
HHYVFVNTY

SEQ ID NO: 103701 - protein, 9 aa, Artificial Sequence
  Description of Artificial Sequence: Synthetic peptide
  Seed: GKFSLRRAV (MAGC3_HUMAN)
GQFSLRRAY

SEQ ID NO: 103702 - protein, 10 aa, Artificial Sequence
  Description of Artificial Sequence: Synthetic peptide
  Seed: MNVINTYTGY (MAGC3_HUMAN)
MSVINTYTGR

SEQ ID NO: 103703 - protein, 9 aa, Artificial Sequence
  Description of Artificial Sequence: Synthetic peptide
  Seed: YTGYFPMIF (MAGC3_HUMAN)
YRGYFPMIY

SEQ ID NO: 103704 - protein, 9 aa, Artificial Sequence
  Description of Artificial Sequence: Synthetic peptide
  Seed: SLPESEPLF (MAGC3_HUMAN)
SMPESEPLY

SEQ ID NO: 103705 - protein, 10 aa, Artificial Sequence
  Description of Artificial Sequence: Synthetic peptide
  Seed: EMQMNVINTY (MAGC3_HUMAN)
EVQMNVINTY

SEQ ID NO: 103706 - protein, 11 aa, Artificial Sequence
  Description of Artificial Sequence: Synthetic peptide
  Seed: MPAAGMPPLPQ (MAGC3_HUMAN)
MPAAGMPPLPT

SEQ ID NO: 103707 - protein, 10 aa, Artificial Sequence
  Description of Artificial Sequence: Synthetic peptide
  Seed: EKVAELVQFL (MAGC3_HUMAN)
EWVAELVQFY

SEQ ID NO: 103708 - protein, 9 aa, Artificial Sequence
  Description of Artificial Sequence: Synthetic peptide
  Seed: KYKDYFPMI (MAGC3_HUMAN)
KTKDYFPMN

SEQ ID NO: 103709 - protein, 9 aa, Artificial Sequence
  Description of Artificial Sequence: Synthetic peptide
  Seed: SLPESEPLF (MAGC3_HUMAN)
SQPESEPLY

SEQ ID NO: 103710 - protein, 9 aa, Artificial Sequence
  Description of Artificial Sequence: Synthetic peptide
  Seed: SESLPRYAL (MAGC3_HUMAN)
SQSLPRYAL

SEQ ID NO: 103711 - protein, 9 aa, Artificial Sequence
  Description of Artificial Sequence: Synthetic peptide
  Seed: VIWEVLSAI (MAGC3_HUMAN)
VAWEVLSAH

SEQ ID NO: 103712 - protein, 9 aa, Artificial Sequence
  Description of Artificial Sequence: Synthetic peptide
  Seed: MQMNVINTY (MAGC3_HUMAN)
MIMNVINTM

SEQ ID NO: 103713 - protein, 9 aa, Artificial Sequence
  Description of Artificial Sequence: Synthetic peptide
  Seed: TYTGYFPMI (MAGC3_HUMAN)
TYTGYFPMW

SEQ ID NO: 103714 - protein, 11 aa, Artificial Sequence
  Description of Artificial Sequence: Synthetic peptide
  Seed: DYSAFHLGHLR (MAGC3_HUMAN)
DSSAFHLGHLR

SEQ ID NO: 103715 - protein, 10 aa, Artificial Sequence
  Description of Artificial Sequence: Synthetic peptide
  Seed: EAFCEESGLR (MAGC3_HUMAN)
ETFCEESGLK

SEQ ID NO: 103716 - protein, 9 aa, Artificial Sequence
  Description of Artificial Sequence: Synthetic peptide
  Seed: TLDEKVDKL (MAGC3_HUMAN)
TWDEKVDKV

SEQ ID NO: 103717 - protein, 10 aa, Artificial Sequence
  Description of Artificial Sequence: Synthetic peptide
  Seed: IKKYKDYFPM (MAGC3_HUMAN)
IKKYKDYFPF

SEQ ID NO: 103718 - protein, 11 aa, Artificial Sequence
  Description of Artificial Sequence: Synthetic peptide
  Seed: AEMQMNVINTY (MAGC3_HUMAN)
AEMQMNVINTA

SEQ ID NO: 103719 - protein, 11 aa, Artificial Sequence
  Description of Artificial Sequence: Synthetic peptide
  Seed: QEDGRRGLTEA (MAGC3_HUMAN)
QEDGRRGLTEL

SEQ ID NO: 103720 - protein, 9 aa, Artificial Sequence
  Description of Artificial Sequence: Synthetic peptide
  Seed: KVDKLVQFL (MAGC3_HUMAN)
KYDKLVQFF

SEQ ID NO: 103721 - protein, 10 aa, Artificial Sequence
  Description of Artificial Sequence: Synthetic peptide
  Seed: MLTTVIKKYK (MAGC3_HUMAN)
MSTTVIKKYK

SEQ ID NO: 103722 - protein, 10 aa, Artificial Sequence
  Description of Artificial Sequence: Synthetic peptide
  Seed: REVRLFLRGG (MAGC3_HUMAN)
RDVRLFLRGV

SEQ ID NO: 103723 - protein, 10 aa, Artificial Sequence
  Description of Artificial Sequence: Synthetic peptide
  Seed: VVLPPQPQPR (MAGC3_HUMAN)
VTLPPQPQPR

SEQ ID NO: 103724 - protein, 10 aa, Artificial Sequence
  Description of Artificial Sequence: Synthetic peptide
  Seed: IIDTTDDATA (MAGC3_HUMAN)
ITDTTDDATL

SEQ ID NO: 103725 - protein, 9 aa, Artificial Sequence
  Description of Artificial Sequence: Synthetic peptide
  Seed: DTTDDATAM (MAGC3_HUMAN)
DTTDDATAK

SEQ ID NO: 103726 - protein, 10 aa, Artificial Sequence
  Description of Artificial Sequence: Synthetic peptide
  Seed: YALDEKVAEL (MAGC3_HUMAN)
YRLDEKVAEV

SEQ ID NO: 103727 - protein, 9 aa, Artificial Sequence
  Description of Artificial Sequence: Synthetic peptide
  Seed: EVIWEVLSA (MAGC3_HUMAN)
EVIWEVLSV

SEQ ID NO: 103728 - protein, 10 aa, Artificial Sequence
  Description of Artificial Sequence: Synthetic peptide
  Seed: LILILSVIFI (MAGC3_HUMAN)
LFLILSVIFV

SEQ ID NO: 103729 - protein, 9 aa, Artificial Sequence
  Description of Artificial Sequence: Synthetic peptide
  Seed: EVIWEVLSA (MAGC3_HUMAN)
EIIWEVLSK

SEQ ID NO: 103730 - protein, 9 aa, Artificial Sequence
  Description of Artificial Sequence: Synthetic peptide
  Seed: IELIFGIAL (MAGC3_HUMAN)
IELIFGIAI

SEQ ID NO: 103731 - protein, 9 aa, Artificial Sequence
  Description of Artificial Sequence: Synthetic peptide
  Seed: SEEVIWEVL (MAGC3_HUMAN)
SEEVIWEVI

SEQ ID NO: 103732 - protein, 10 aa, Artificial Sequence
  Description of Artificial Sequence: Synthetic peptide
  Seed: KKYKDYFPMI (MAGC3_HUMAN)
KLYKDYFPMK

SEQ ID NO: 103733 - protein, 9 aa, Artificial Sequence
  Description of Artificial Sequence: Synthetic peptide
  Seed: TYALSPVVL (MAGC3_HUMAN)
TYALSPVVY

SEQ ID NO: 103734 - protein, 9 aa, Artificial Sequence
  Description of Artificial Sequence: Synthetic peptide
  Seed: NAIGPWSAL (MAGC3_HUMAN)
NLIGPWSAL

SEQ ID NO: 103735 - protein, 9 aa, Artificial Sequence
  Description of Artificial Sequence: Synthetic peptide
  Seed: MPKNCLLIL (MAGC3_HUMAN)
MPKNCLLIM

SEQ ID NO: 103736 - protein, 9 aa, Artificial Sequence
  Description of Artificial Sequence: Synthetic peptide
  Seed: ELIFGIALT (MAGC3_HUMAN)
ETIFGIALI

SEQ ID NO: 103737 - protein, 10 aa, Artificial Sequence
  Description of Artificial Sequence: Synthetic peptide
  Seed: AMASASPSVM (MAGC3_HUMAN)
AKASASPSVM

SEQ ID NO: 103738 - protein, 9 aa, Artificial Sequence
  Description of Artificial Sequence: Synthetic peptide
  Seed: MEDRAQAII (MAGC3_HUMAN)
MMDRAQAIM

SEQ ID NO: 103739 - protein, 10 aa, Artificial Sequence
  Description of Artificial Sequence: Synthetic peptide
  Seed: SALAGFADVL (MAGC3_HUMAN)
SWLAGFADVV

SEQ ID NO: 103740 - protein, 9 aa, Artificial Sequence
  Description of Artificial Sequence: Synthetic peptide
  Seed: TSDQRMDSL (MAGC3_HUMAN)
TGDQRMDSV

SEQ ID NO: 103741 - protein, 9 aa, Artificial Sequence
  Description of Artificial Sequence: Synthetic peptide
  Seed: MQMNVINTY (MAGC3_HUMAN)
MWMNVINTV

SEQ ID NO: 103742 - protein, 9 aa, Artificial Sequence
  Description of Artificial Sequence: Synthetic peptide
  Seed: YALSPVVLP (MAGC3_HUMAN)
YGLSPVVLM

SEQ ID NO: 103743 - protein, 9 aa, Artificial Sequence
  Description of Artificial Sequence: Synthetic peptide
  Seed: SALAGFADV (MAGC3_HUMAN)
SILAGFADL

SEQ ID NO: 103744 - protein, 9 aa, Artificial Sequence
  Description of Artificial Sequence: Synthetic peptide
  Seed: LILSMIFIK (MAGC3_HUMAN)
LSLSMIFIR

SEQ ID NO: 103745 - protein, 10 aa, Artificial Sequence
  Description of Artificial Sequence: Synthetic peptide
  Seed: FFEDTLDLTY (MAGC3_HUMAN)
FIEDTLDLTL

SEQ ID NO: 103746 - protein, 9 aa, Artificial Sequence
  Description of Artificial Sequence: Synthetic peptide
  Seed: YALDEKVAE (MAGC3_HUMAN)
YQLDEKVAY

SEQ ID NO: 103747 - protein, 10 aa, Artificial Sequence
  Description of Artificial Sequence: Synthetic peptide
  Seed: MNVINTYTGY (MAGC3_HUMAN)
MCVINTYTGF

SEQ ID NO: 103748 - protein, 9 aa, Artificial Sequence
  Description of Artificial Sequence: Synthetic peptide
  Seed: EFIELIFGI (MAGC3_HUMAN)
EMIELIFGL

SEQ ID NO: 103749 - protein, 9 aa, Artificial Sequence
  Description of Artificial Sequence: Synthetic peptide
  Seed: HSYFFEDTL (MAGC3_HUMAN)
HMYFFEDTV

SEQ ID NO: 103750 - protein, 9 aa, Artificial Sequence
  Description of Artificial Sequence: Synthetic peptide
  Seed: EMLTTVIKK (MAGC3_HUMAN)
EYLTTVIKR

SEQ ID NO: 103751 - protein, 11 aa, Artificial Sequence
  Description of Artificial Sequence: Synthetic peptide
  Seed: LLLKYQAKEPL (MAGC3_HUMAN)
LMLKYQAKEPV

SEQ ID NO: 103752 - protein, 11 aa, Artificial Sequence
  Description of Artificial Sequence: Synthetic peptide
  Seed: ATDKDYSAFHL (MAGC3_HUMAN)
AMDKDYSAFHY

SEQ ID NO: 103753 - protein, 9 aa, Artificial Sequence
  Description of Artificial Sequence: Synthetic peptide
  Seed: MQMNVINTY (MAGC3_HUMAN)
MVMNVINTT

SEQ ID NO: 103754 - protein, 10 aa, Artificial Sequence
  Description of Artificial Sequence: Synthetic peptide
  Seed: TGYFPMIFRK (MAGC3_HUMAN)
TCYFPMIFRR

SEQ ID NO: 103755 - protein, 10 aa, Artificial Sequence
  Description of Artificial Sequence: Synthetic peptide
  Seed: INTYTGYFPM (MAGC3_HUMAN)
IVTYTGYFPY

SEQ ID NO: 103756 - protein, 10 aa, Artificial Sequence
  Description of Artificial Sequence: Synthetic peptide
  Seed: TGYFPMIFRK (MAGC3_HUMAN)
TVYFPMIFRA

SEQ ID NO: 103757 - protein, 9 aa, Artificial Sequence
  Description of Artificial Sequence: Synthetic peptide
  Seed: KVDKLVQFL (MAGC3_HUMAN)
KFDKLVQFV

SEQ ID NO: 103758 - protein, 9 aa, Artificial Sequence
  Description of Artificial Sequence: Synthetic peptide
  Seed: LKYQTKEPV (MAGC3_HUMAN)
LQYQTKEPI

SEQ ID NO: 103759 - protein, 10 aa, Artificial Sequence
  Description of Artificial Sequence: Synthetic peptide
  Seed: MLTTVIKKYK (MAGC3_HUMAN)
MGTTVIKKYK

SEQ ID NO: 103760 - protein, 9 aa, Artificial Sequence
  Description of Artificial Sequence: Synthetic peptide
  Seed: RTLWKDSDL (MAGC3_HUMAN)
RSLWKDSDY

SEQ ID NO: 103761 - protein, 10 aa, Artificial Sequence
  Description of Artificial Sequence: Synthetic peptide
  Seed: YALDEKVAEL (MAGC3_HUMAN)
YTLDEKVAEM

SEQ ID NO: 103762 - protein, 9 aa, Artificial Sequence
  Description of Artificial Sequence: Synthetic peptide
  Seed: MIFGKAHEF (MAGC3_HUMAN)
MLFGKAHET

SEQ ID NO: 103763 - protein, 9 aa, Artificial Sequence
  Description of Artificial Sequence: Synthetic peptide
  Seed: MLLPCHWVL (MAGC3_HUMAN)
MTLPCHWVM

SEQ ID NO: 103764 - protein, 11 aa, Artificial Sequence
  Description of Artificial Sequence: Synthetic peptide
  Seed: IIDTTDDATAM (MAGC3_HUMAN)
ISDTTDDATAF

SEQ ID NO: 103765 - protein, 9 aa, Artificial Sequence
  Description of Artificial Sequence: Synthetic peptide
  Seed: LSSIIPSAF (MAGC3_HUMAN)
LESIIPSAF

SEQ ID NO: 103766 - protein, 10 aa, Artificial Sequence
  Description of Artificial Sequence: Synthetic peptide
  Seed: SLIDDQGMPK (MAGC3_HUMAN)
SVIDDQGMPL

SEQ ID NO: 103767 - protein, 8 aa, Artificial Sequence
  Description of Artificial Sequence: Synthetic peptide
  Seed: FIELIFGI (MAGC3_HUMAN)
FMELIFGA

SEQ ID NO: 103768 - protein, 9 aa, Artificial Sequence
  Description of Artificial Sequence: Synthetic peptide
  Seed: RTLSGSPGL (MAGC3_HUMAN)
RTLSGSPGI

SEQ ID NO: 103769 - protein, 9 aa, Artificial Sequence
  Description of Artificial Sequence: Synthetic peptide
  Seed: TSDQRMDSL (MAGC3_HUMAN)
TEDQRMDSM

SEQ ID NO: 103770 - protein, 10 aa, Artificial Sequence
  Description of Artificial Sequence: Synthetic peptide
  Seed: EEVIWEVLNA (MAGC3_HUMAN)
EKVIWEVLNV

SEQ ID NO: 103771 - protein, 10 aa, Artificial Sequence
  Description of Artificial Sequence: Synthetic peptide
  Seed: VLSAIGPIQR (MAGC3_HUMAN)
VTSAIGPIQR

SEQ ID NO: 103772 - protein, 11 aa, Artificial Sequence
  Description of Artificial Sequence: Synthetic peptide
  Seed: RTLSGSPGLQL (MAGC3_HUMAN)
RYLSGSPGLQY

SEQ ID NO: 103773 - protein, 9 aa, Artificial Sequence
  Description of Artificial Sequence: Synthetic peptide
  Seed: YALDEKVAE (MAGC3_HUMAN)
YTLDEKVAM

SEQ ID NO: 103774 - protein, 9 aa, Artificial Sequence
  Description of Artificial Sequence: Synthetic peptide
  Seed: ALDEKVAEL (MAGC3_HUMAN)
AEDEKVAEM

SEQ ID NO: 103775 - protein, 10 aa, Artificial Sequence
  Description of Artificial Sequence: Synthetic peptide
  Seed: IELIFGIALT (MAGC3_HUMAN)
IILIFGIALL

SEQ ID NO: 103776 - protein, 9 aa, Artificial Sequence
  Description of Artificial Sequence: Synthetic peptide
  Seed: KGSCVPEEV (MAGC3_HUMAN)
KQSCVPEEL

SEQ ID NO: 103777 - protein, 10 aa, Artificial Sequence
  Description of Artificial Sequence: Synthetic peptide
  Seed: SAIGPIQRPA (MAGC3_HUMAN)
SAIGPIQRPF

SEQ ID NO: 103778 - protein, 9 aa, Artificial Sequence
  Description of Artificial Sequence: Synthetic peptide
  Seed: SPPEIPPQG (MAGC3_HUMAN)
SPPEIPPQF

SEQ ID NO: 103779 - protein, 10 aa, Artificial Sequence
  Description of Artificial Sequence: Synthetic peptide
  Seed: MIFGKAHEFI (MAGC3_HUMAN)
MAFGKAHEFA

SEQ ID NO: 103780 - protein, 10 aa, Artificial Sequence
  Description of Artificial Sequence: Synthetic peptide
  Seed: AMASASPSVM (MAGC3_HUMAN)
AAASASPSVY

SEQ ID NO: 103781 - protein, 9 aa, Artificial Sequence
  Description of Artificial Sequence: Synthetic peptide
  Seed: LKYQTKEPV (MAGC3_HUMAN)
LEYQTKEPM

SEQ ID NO: 103782 - protein, 9 aa, Artificial Sequence
  Description of Artificial Sequence: Synthetic peptide
  Seed: FPSWYMDAL (MAGC3_HUMAN)
FMSWYMDAL

SEQ ID NO: 103783 - protein, 9 aa, Artificial Sequence
  Description of Artificial Sequence: Synthetic peptide
  Seed: FPSWYMDAL (MAGC3_HUMAN)
FTSWYMDAL

SEQ ID NO: 103784 - protein, 10 aa, Artificial Sequence
  Description of Artificial Sequence: Synthetic peptide
  Seed: KLSSIIPSAF (MAGC3_HUMAN)
KVSSIIPSAR

SEQ ID NO: 103785 - protein, 10 aa, Artificial Sequence
  Description of Artificial Sequence: Synthetic peptide
  Seed: ILILSMIFIK (MAGC3_HUMAN)
IWILSMIFIR

SEQ ID NO: 103786 - protein, 10 aa, Artificial Sequence
  Description of Artificial Sequence: Synthetic peptide
  Seed: MDSLVLCPTY (MAGC3_HUMAN)
MRSLVLCPTF

SEQ ID NO: 103787 - protein, 9 aa, Artificial Sequence
  Description of Artificial Sequence: Synthetic peptide
  Seed: VIWEVLNAI (MAGC3_HUMAN)
VMWEVLNAV

SEQ ID NO: 103788 - protein, 10 aa, Artificial Sequence
  Description of Artificial Sequence: Synthetic peptide
  Seed: PTYFKLWRTL (MAGC3_HUMAN)
PVYFKLWRTF

SEQ ID NO: 103789 - protein, 9 aa, Artificial Sequence
  Description of Artificial Sequence: Synthetic peptide
  Seed: ATDKDYSAF (MAGC3_HUMAN)
AADKDYSAM

SEQ ID NO: 103790 - protein, 9 aa, Artificial Sequence
  Description of Artificial Sequence: Synthetic peptide
  Seed: RQEDGRRGL (MAGC3_HUMAN)
RQEDGRRGY

SEQ ID NO: 103791 - protein, 8 aa, Artificial Sequence
  Description of Artificial Sequence: Synthetic peptide
  Seed: IQRPAREV (MAGC3_HUMAN)
ISRPAREY

SEQ ID NO: 103792 - protein, 11 aa, Artificial Sequence
  Description of Artificial Sequence: Synthetic peptide
  Seed: AIGPWSALAGF (MAGC3_HUMAN)
ALGPWSALAGR

SEQ ID NO: 103793 - protein, 9 aa, Artificial Sequence
  Description of Artificial Sequence: Synthetic peptide
  Seed: YQTKEPVTK (MAGC3_HUMAN)
YSTKEPVTI

SEQ ID NO: 103794 - protein, 10 aa, Artificial Sequence
  Description of Artificial Sequence: Synthetic peptide
  Seed: INTYTGYFPM (MAGC3_HUMAN)
IPTYTGYFPY

SEQ ID NO: 103795 - protein, 10 aa, Artificial Sequence
  Description of Artificial Sequence: Synthetic peptide
  Seed: EMQMNVINTY (MAGC3_HUMAN)
EHQMNVINTF

SEQ ID NO: 103796 - protein, 10 aa, Artificial Sequence
  Description of Artificial Sequence: Synthetic peptide
  Seed: AMASASPSVM (MAGC3_HUMAN)
ALASASPSVV

SEQ ID NO: 103797 - protein, 9 aa, Artificial Sequence
  Description of Artificial Sequence: Synthetic peptide
  Seed: NTYTGYFPM (MAGC3_HUMAN)
NHYTGYFPF

SEQ ID NO: 103798 - protein, 9 aa, Artificial Sequence
  Description of Artificial Sequence: Synthetic peptide
  Seed: NAIGPWSAL (MAGC3_HUMAN)
NHIGPWSAF

SEQ ID NO: 103799 - protein, 9 aa, Artificial Sequence
  Description of Artificial Sequence: Synthetic peptide
  Seed: KVDKLVQFL (MAGC3_HUMAN)
KNDKLVQFL

SEQ ID NO: 103800 - protein, 10 aa, Artificial Sequence
  Description of Artificial Sequence: Synthetic peptide
  Seed: KKYKDYFPMI (MAGC3_HUMAN)
KFYKDYFPMW

SEQ ID NO: 103801 - protein, 10 aa, Artificial Sequence
  Description of Artificial Sequence: Synthetic peptide
  Seed: SKLSSIIPSA (MAGC3_HUMAN)
STLSSIIPSA

SEQ ID NO: 103802 - protein, 9 aa, Artificial Sequence
  Description of Artificial Sequence: Synthetic peptide
  Seed: DMDPDNHSY (MAGC3_HUMAN)
DADPDNHSY

SEQ ID NO: 103803 - protein, 10 aa, Artificial Sequence
  Description of Artificial Sequence: Synthetic peptide
  Seed: KFSLRRAVSV (MAGC3_HUMAN)
KFSLRRAVSK

SEQ ID NO: 103804 - protein, 10 aa, Artificial Sequence
  Description of Artificial Sequence: Synthetic peptide
  Seed: YALDEKVAEL (MAGC3_HUMAN)
YKLDEKVAEA

SEQ ID NO: 103805 - protein, 9 aa, Artificial Sequence
  Description of Artificial Sequence: Synthetic peptide
  Seed: TYALSPVVL (MAGC3_HUMAN)
TRALSPVVL

SEQ ID NO: 103806 - protein, 11 aa, Artificial Sequence
  Description of Artificial Sequence: Synthetic peptide
  Seed: VLNAIGPWSAL (MAGC3_HUMAN)
VANAIGPWSAL

SEQ ID NO: 103807 - protein, 10 aa, Artificial Sequence
  Description of Artificial Sequence: Synthetic peptide
  Seed: RPAREVLEFL (MAGC3_HUMAN)
RKAREVLEFK

SEQ ID NO: 103808 - protein, 10 aa, Artificial Sequence
  Description of Artificial Sequence: Synthetic peptide
  Seed: CLLILILSMI (MAGC3_HUMAN)
CYLILILSMV

SEQ ID NO: 103809 - protein, 9 aa, Artificial Sequence
  Description of Artificial Sequence: Synthetic peptide
  Seed: LSDLHFGSQ (MAGC3_HUMAN)
LIDLHFGSY

SEQ ID NO: 103810 - protein, 9 aa, Artificial Sequence
  Description of Artificial Sequence: Synthetic peptide
  Seed: ELIFGIALT (MAGC3_HUMAN)
EIIFGIALI

SEQ ID NO: 103811 - protein, 9 aa, Artificial Sequence
  Description of Artificial Sequence: Synthetic peptide
  Seed: HSYFFEDTL (MAGC3_HUMAN)
HPYFFEDTY

SEQ ID NO: 103812 - protein, 10 aa, Artificial Sequence
  Description of Artificial Sequence: Synthetic peptide
  Seed: MDPDNHSYFF (MAGC3_HUMAN)
MYPDNHSYFW

SEQ ID NO: 103813 - protein, 10 aa, Artificial Sequence
  Description of Artificial Sequence: Synthetic peptide
  Seed: NTYTGYFPMI (MAGC3_HUMAN)
NLYTGYFPMA

SEQ ID NO: 103814 - protein, 10 aa, Artificial Sequence
  Description of Artificial Sequence: Synthetic peptide
  Seed: ILILSMIFIK (MAGC3_HUMAN)
IAILSMIFIR

SEQ ID NO: 103815 - protein, 11 aa, Artificial Sequence
  Description of Artificial Sequence: Synthetic peptide
  Seed: NTYTGYFPMIF (MAGC3_HUMAN)
NWYTGYFPMIF

SEQ ID NO: 103816 - protein, 10 aa, Artificial Sequence
  Description of Artificial Sequence: Synthetic peptide
  Seed: KKYKDYFPMI (MAGC3_HUMAN)
KGYKDYFPMW

SEQ ID NO: 103817 - protein, 9 aa, Artificial Sequence
  Description of Artificial Sequence: Synthetic peptide
  Seed: TGYFPMIFR (MAGC3_HUMAN)
TNYFPMIFR

SEQ ID NO: 103818 - protein, 9 aa, Artificial Sequence
  Description of Artificial Sequence: Synthetic peptide
  Seed: GMPQNRLLI (MAGC3_HUMAN)
GIPQNRLLL

SEQ ID NO: 103819 - protein, 11 aa, Artificial Sequence
  Description of Artificial Sequence: Synthetic peptide
  Seed: KVAELVQFLLL (MAGC3_HUMAN)
KLAELVQFLLP

SEQ ID NO: 103820 - protein, 9 aa, Artificial Sequence
  Description of Artificial Sequence: Synthetic peptide
  Seed: LILILSMIF (MAGC3_HUMAN)
LQLILSMIL

SEQ ID NO: 103821 - protein, 10 aa, Artificial Sequence
  Description of Artificial Sequence: Synthetic peptide
  Seed: VLCPTYFKLW (MAGC3_HUMAN)
VWCPTYFKLW

SEQ ID NO: 103822 - protein, 10 aa, Artificial Sequence
  Description of Artificial Sequence: Synthetic peptide
  Seed: SIIPSAFPSW (MAGC3_HUMAN)
SQIPSAFPSL

SEQ ID NO: 103823 - protein, 9 aa, Artificial Sequence
  Description of Artificial Sequence: Synthetic peptide
  Seed: VDPDHFYVF (MAGC3_HUMAN)
VWPDHFYVW

SEQ ID NO: 103824 - protein, 9 aa, Artificial Sequence
  Description of Artificial Sequence: Synthetic peptide
  Seed: ISPQGPPQS (MAGC3_HUMAN)
ITPQGPPQL

SEQ ID NO: 103825 - protein, 10 aa, Artificial Sequence
  Description of Artificial Sequence: Synthetic peptide
  Seed: YTGYFPMIFR (MAGC3_HUMAN)
YWGYFPMIFK

SEQ ID NO: 103826 - protein, 10 aa, Artificial Sequence
  Description of Artificial Sequence: Synthetic peptide
  Seed: MNVINTYTGY (MAGC3_HUMAN)
MCVINTYTGR

SEQ ID NO: 103827 - protein, 9 aa, Artificial Sequence
  Description of Artificial Sequence: Synthetic peptide
  Seed: WESEGPEAF (MAGC3_HUMAN)
WQSEGPEAW

SEQ ID NO: 103828 - protein, 11 aa, Artificial Sequence
  Description of Artificial Sequence: Synthetic peptide
  Seed: AIIDTTDDATA (MAGC3_HUMAN)
ALIDTTDDATI

SEQ ID NO: 103829 - protein, 9 aa, Artificial Sequence
  Description of Artificial Sequence: Synthetic peptide
  Seed: YTGYFPMIF (MAGC3_HUMAN)
YGGYFPMIW

SEQ ID NO: 103830 - protein, 9 aa, Artificial Sequence
  Description of Artificial Sequence: Synthetic peptide
  Seed: QGMPKNCLL (MAGC3_HUMAN)
QAMPKNCLY

SEQ ID NO: 103831 - protein, 10 aa, Artificial Sequence
  Description of Artificial Sequence: Synthetic peptide
  Seed: LDSCSSPLLW (MAGC3_HUMAN)
LGSCSSPLLF

SEQ ID NO: 103832 - protein, 10 aa, Artificial Sequence
  Description of Artificial Sequence: Synthetic peptide
  Seed: YALDEKVAEL (MAGC3_HUMAN)
YTLDEKVAEI

SEQ ID NO: 103833 - protein, 8 aa, Artificial Sequence
  Description of Artificial Sequence: Synthetic peptide
  Seed: SGSPGLQL (MAGC3_HUMAN)
SASPGLQF

SEQ ID NO: 103834 - protein, 11 aa, Artificial Sequence
  Description of Artificial Sequence: Synthetic peptide
  Seed: IQRPAREVLEF (MAGC3_HUMAN)
IMRPAREVLEF

SEQ ID NO: 103835 - protein, 9 aa, Artificial Sequence
  Description of Artificial Sequence: Synthetic peptide
  Seed: FPSWYMDAL (MAGC3_HUMAN)
FTSWYMDAY

SEQ ID NO: 103836 - protein, 11 aa, Artificial Sequence
  Description of Artificial Sequence: Synthetic peptide
  Seed: DLANPQGLAGH (MAGC3_HUMAN)
DLANPQGLAGR

SEQ ID NO: 103837 - protein, 11 aa, Artificial Sequence
  Description of Artificial Sequence: Synthetic peptide
  Seed: SVLDLANPQGL (MAGC3_HUMAN)
SLLDLANPQGL

SEQ ID NO: 103838 - protein, 11 aa, Artificial Sequence
  Description of Artificial Sequence: Synthetic peptide
  Seed: YFFEDTLDLTY (MAGC3_HUMAN)
YMFEDTLDLTM

SEQ ID NO: 103839 - protein, 9 aa, Artificial Sequence
  Description of Artificial Sequence: Synthetic peptide
  Seed: KYKDYFPMI (MAGC3_HUMAN)
KVKDYFPMK

SEQ ID NO: 103840 - protein, 9 aa, Artificial Sequence
  Description of Artificial Sequence: Synthetic peptide
  Seed: AVSPGKRLW (MAGC3_HUMAN)
AQSPGKRLF

SEQ ID NO: 103841 - protein, 9 aa, Artificial Sequence
  Description of Artificial Sequence: Synthetic peptide
  Seed: VDPDHFYVF (MAGC3_HUMAN)
VMPDHFYVY

SEQ ID NO: 103842 - protein, 10 aa, Artificial Sequence
  Description of Artificial Sequence: Synthetic peptide
  Seed: TSDQRMDSLV (MAGC3_HUMAN)
TADQRMDSLL

SEQ ID NO: 103843 - protein, 9 aa, Artificial Sequence
  Description of Artificial Sequence: Synthetic peptide
  Seed: VLCPTYFKL (MAGC3_HUMAN)
VACPTYFKR

SEQ ID NO: 103844 - protein, 9 aa, Artificial Sequence
  Description of Artificial Sequence: Synthetic peptide
  Seed: MLLPCHWVL (MAGC3_HUMAN)
MWLPCHWVW

SEQ ID NO: 103845 - protein, 9 aa, Artificial Sequence
  Description of Artificial Sequence: Synthetic peptide
  Seed: ILILSMIFI (MAGC3_HUMAN)
IQILSMIFL

SEQ ID NO: 103846 - protein, 9 aa, Artificial Sequence
  Description of Artificial Sequence: Synthetic peptide
  Seed: KKYKDYFPM (MAGC3_HUMAN)
KTYKDYFPY

SEQ ID NO: 103847 - protein, 10 aa, Artificial Sequence
  Description of Artificial Sequence: Synthetic peptide
  Seed: TLWKDSDLPT (MAGC3_HUMAN)
TLWKDSDLPV

SEQ ID NO: 103848 - protein, 10 aa, Artificial Sequence
  Description of Artificial Sequence: Synthetic peptide
  Seed: SPLDSCSSPL (MAGC3_HUMAN)
SGLDSCSSPV

SEQ ID NO: 103849 - protein, 9 aa, Artificial Sequence
  Description of Artificial Sequence: Synthetic peptide
  Seed: ATDKDYSAF (MAGC3_HUMAN)
AYDKDYSAV

SEQ ID NO: 103850 - protein, 8 aa, Artificial Sequence
  Description of Artificial Sequence: Synthetic peptide
  Seed: FADVLSRL (MAGC3_HUMAN)
FNDVLSRI

SEQ ID NO: 103851 - protein, 9 aa, Artificial Sequence
  Description of Artificial Sequence: Synthetic peptide
  Seed: KVAELVQFL (MAGC3_HUMAN)
KSAELVQFK

SEQ ID NO: 103852 - protein, 9 aa, Artificial Sequence
  Description of Artificial Sequence: Synthetic peptide
  Seed: SLPESEPLF (MAGC3_HUMAN)
SQPESEPLV

SEQ ID NO: 103853 - protein, 9 aa, Artificial Sequence
  Description of Artificial Sequence: Synthetic peptide
  Seed: EFIELIFGI (MAGC3_HUMAN)
ELIELIFGV

SEQ ID NO: 103854 - protein, 9 aa, Artificial Sequence
  Description of Artificial Sequence: Synthetic peptide
  Seed: YSAFHLGHL (MAGC3_HUMAN)
YAAFHLGHH

SEQ ID NO: 103855 - protein, 9 aa, Artificial Sequence
  Description of Artificial Sequence: Synthetic peptide
  Seed: SALAGFADV (MAGC3_HUMAN)
SQLAGFADL

SEQ ID NO: 103856 - protein, 9 aa, Artificial Sequence
  Description of Artificial Sequence: Synthetic peptide
  Seed: ASEEVIWEV (MAGC3_HUMAN)
AMEEVIWET

SEQ ID NO: 103857 - protein, 10 aa, Artificial Sequence
  Description of Artificial Sequence: Synthetic peptide
  Seed: FKLWRTLSGS (MAGC3_HUMAN)
FELWRTLSGI

SEQ ID NO: 103858 - protein, 9 aa, Artificial Sequence
  Description of Artificial Sequence: Synthetic peptide
  Seed: MIFGKAHEF (MAGC3_HUMAN)
MMFGKAHEC

SEQ ID NO: 103859 - protein, 10 aa, Artificial Sequence
  Description of Artificial Sequence: Synthetic peptide
  Seed: MIFGKAHEFI (MAGC3_HUMAN)
MMFGKAHEFM

SEQ ID NO: 103860 - protein, 9 aa, Artificial Sequence
  Description of Artificial Sequence: Synthetic peptide
  Seed: MEDRAQAII (MAGC3_HUMAN)
MMDRAQAIL

SEQ ID NO: 103861 - protein, 9 aa, Artificial Sequence
  Description of Artificial Sequence: Synthetic peptide
  Seed: AEMLTTVIK (MAGC3_HUMAN)
AEMLTTVIY

SEQ ID NO: 103862 - protein, 9 aa, Artificial Sequence
  Description of Artificial Sequence: Synthetic peptide
  Seed: VLPPQPQPR (MAGC3_HUMAN)
VQPPQPQPL

SEQ ID NO: 103863 - protein, 9 aa, Artificial Sequence
  Description of Artificial Sequence: Synthetic peptide
  Seed: MLLPCHWVL (MAGC3_HUMAN)
MRLPCHWVY

SEQ ID NO: 103864 - protein, 10 aa, Artificial Sequence
  Description of Artificial Sequence: Synthetic peptide
  Seed: KLVQFLLLKY (MAGC3_HUMAN)
KIVQFLLLKK

SEQ ID NO: 103865 - protein, 10 aa, Artificial Sequence
  Description of Artificial Sequence: Synthetic peptide
  Seed: LDSCSSPLLW (MAGC3_HUMAN)
LKSCSSPLLF

SEQ ID NO: 103866 - protein, 10 aa, Artificial Sequence
  Description of Artificial Sequence: Synthetic peptide
  Seed: YQAKEPLTRA (MAGC3_HUMAN)
YMAKEPLTRM

SEQ ID NO: 103867 - protein, 9 aa, Artificial Sequence
  Description of Artificial Sequence: Synthetic peptide
  Seed: SQPEGKFSL (MAGC3_HUMAN)
SFPEGKFSL

SEQ ID NO: 103868 - protein, 10 aa, Artificial Sequence
  Description of Artificial Sequence: Synthetic peptide
  Seed: MNVINTYTGY (MAGC3_HUMAN)
MLVINTYTGY

SEQ ID NO: 103869 - protein, 9 aa, Artificial Sequence
  Description of Artificial Sequence: Synthetic peptide
  Seed: WESEGPEAF (MAGC3_HUMAN)
WESEGPEAI

SEQ ID NO: 103870 - protein, 9 aa, Artificial Sequence
  Description of Artificial Sequence: Synthetic peptide
  Seed: NVINTYTGY (MAGC3_HUMAN)
NIINTYTGY

SEQ ID NO: 103871 - protein, 9 aa, Artificial Sequence
  Description of Artificial Sequence: Synthetic peptide
  Seed: GYFPMIFRK (MAGC3_HUMAN)
GLFPMIFRK

SEQ ID NO: 103872 - protein, 10 aa, Artificial Sequence
  Description of Artificial Sequence: Synthetic peptide
  Seed: IELIFGIALT (MAGC3_HUMAN)
IALIFGIALV

SEQ ID NO: 103873 - protein, 9 aa, Artificial Sequence
  Description of Artificial Sequence: Synthetic peptide
  Seed: EFIELIFGI (MAGC3_HUMAN)
EIIELIFGI

SEQ ID NO: 103874 - protein, 9 aa, Artificial Sequence
  Description of Artificial Sequence: Synthetic peptide
  Seed: RGTGYTLSL (MAGC3_HUMAN)
RITGYTLSF

SEQ ID NO: 103875 - protein, 9 aa, Artificial Sequence
  Description of Artificial Sequence: Synthetic peptide
  Seed: FEDTLDLTY (MAGC3_HUMAN)
FVDTLDLTY

SEQ ID NO: 103876 - protein, 11 aa, Artificial Sequence
  Description of Artificial Sequence: Synthetic peptide
  Seed: ILFGISLTEVD (MAGC3_HUMAN)
IMFGISLTEVS

SEQ ID NO: 103877 - protein, 10 aa, Artificial Sequence
  Description of Artificial Sequence: Synthetic peptide
  Seed: MNVINTYTGY (MAGC3_HUMAN)
MHVINTYTGY

SEQ ID NO: 103878 - protein, 10 aa, Artificial Sequence
  Description of Artificial Sequence: Synthetic peptide
  Seed: ALDEKVAELV (MAGC3_HUMAN)
AWDEKVAELF

SEQ ID NO: 103879 - protein, 10 aa, Artificial Sequence
  Description of Artificial Sequence: Synthetic peptide
  Seed: EPQDWPLNEK (MAGC3_HUMAN)
EAQDWPLNEK

SEQ ID NO: 103880 - protein, 8 aa, Artificial Sequence
  Description of Artificial Sequence: Synthetic peptide
  Seed: YALSPVVL (MAGC3_HUMAN)
YYLSPVVL

SEQ ID NO: 103881 - protein, 10 aa, Artificial Sequence
  Description of Artificial Sequence: Synthetic peptide
  Seed: IPSAFPSWYM (MAGC3_HUMAN)
INSAFPSWYW

SEQ ID NO: 103882 - protein, 9 aa, Artificial Sequence
  Description of Artificial Sequence: Synthetic peptide
  Seed: HALPESESL (MAGC3_HUMAN)
HPLPESESL

SEQ ID NO: 103883 - protein, 10 aa, Artificial Sequence
  Description of Artificial Sequence: Synthetic peptide
  Seed: YALDEKVAEL (MAGC3_HUMAN)
YQLDEKVAET

SEQ ID NO: 103884 - protein, 8 aa, Artificial Sequence
  Description of Artificial Sequence: Synthetic peptide
  Seed: TTDDATAM (MAGC3_HUMAN)
TTDDATAF

SEQ ID NO: 103885 - protein, 9 aa, Artificial Sequence
  Description of Artificial Sequence: Synthetic peptide
  Seed: LKYQTKEPV (MAGC3_HUMAN)
LSYQTKEPY

SEQ ID NO: 103886 - protein, 10 aa, Artificial Sequence
  Description of Artificial Sequence: Synthetic peptide
  Seed: FKLWRTLSGS (MAGC3_HUMAN)
FVLWRTLSGM

SEQ ID NO: 103887 - protein, 9 aa, Artificial Sequence
  Description of Artificial Sequence: Synthetic peptide
  Seed: MLLPCHWVL (MAGC3_HUMAN)
MALPCHWVY

SEQ ID NO: 103888 - protein, 9 aa, Artificial Sequence
  Description of Artificial Sequence: Synthetic peptide
  Seed: VIWEVLSAI (MAGC3_HUMAN)
VMWEVLSAR

SEQ ID NO: 103889 - protein, 10 aa, Artificial Sequence
  Description of Artificial Sequence: Synthetic peptide
  Seed: EKVAELVQFL (MAGC3_HUMAN)
EEVAELVQFL

SEQ ID NO: 103890 - protein, 10 aa, Artificial Sequence
  Description of Artificial Sequence: Synthetic peptide
  Seed: YTLDEKVDKL (MAGC3_HUMAN)
YLLDEKVDKI

SEQ ID NO: 103891 - protein, 9 aa, Artificial Sequence
  Description of Artificial Sequence: Synthetic peptide
  Seed: KAHEFIELI (MAGC3_HUMAN)
KEHEFIELL

SEQ ID NO: 103892 - protein, 10 aa, Artificial Sequence
  Description of Artificial Sequence: Synthetic peptide
  Seed: LWKDSDLPTW (MAGC3_HUMAN)
LIKDSDLPTW

SEQ ID NO: 103893 - protein, 9 aa, Artificial Sequence
  Description of Artificial Sequence: Synthetic peptide
  Seed: IPPQGPPKI (MAGC3_HUMAN)
IFPQGPPKY

SEQ ID NO: 103894 - protein, 9 aa, Artificial Sequence
  Description of Artificial Sequence: Synthetic peptide
  Seed: EVLEFLSKL (MAGC3_HUMAN)
EILEFLSKA

SEQ ID NO: 103895 - protein, 10 aa, Artificial Sequence
  Description of Artificial Sequence: Synthetic peptide
  Seed: MIFGKAHEFI (MAGC3_HUMAN)
MLFGKAHEFT

SEQ ID NO: 103896 - protein, 9 aa, Artificial Sequence
  Description of Artificial Sequence: Synthetic peptide
  Seed: VDPDHFYVF (MAGC3_HUMAN)
VSPDHFYVM

SEQ ID NO: 103897 - protein, 9 aa, Artificial Sequence
  Description of Artificial Sequence: Synthetic peptide
  Seed: EKVDKLVQF (MAGC3_HUMAN)
EHVDKLVQM

SEQ ID NO: 103898 - protein, 9 aa, Artificial Sequence
  Description of Artificial Sequence: Synthetic peptide
  Seed: EVLSAIGPI (MAGC3_HUMAN)
ESLSAIGPF

SEQ ID NO: 103899 - protein, 9 aa, Artificial Sequence
  Description of Artificial Sequence: Synthetic peptide
  Seed: TLDEKVDKL (MAGC3_HUMAN)
TIDEKVDKY

SEQ ID NO: 103900 - protein, 9 aa, Artificial Sequence
  Description of Artificial Sequence: Synthetic peptide
  Seed: EVLEFLSKL (MAGC3_HUMAN)
ETLEFLSKI

SEQ ID NO: 103901 - protein, 9 aa, Artificial Sequence
  Description of Artificial Sequence: Synthetic peptide
  Seed: LANPQGLAG (MAGC3_HUMAN)
LMNPQGLAY

SEQ ID NO: 103902 - protein, 10 aa, Artificial Sequence
  Description of Artificial Sequence: Synthetic peptide
  Seed: KATDKDYSAF (MAGC3_HUMAN)
KQTDKDYSAW

SEQ ID NO: 103903 - protein, 10 aa, Artificial Sequence
  Description of Artificial Sequence: Synthetic peptide
  Seed: TDMDPDNHSY (MAGC3_HUMAN)
TVMDPDNHSM

SEQ ID NO: 103904 - protein, 9 aa, Artificial Sequence
  Description of Artificial Sequence: Synthetic peptide
  Seed: VLPPQPQPR (MAGC3_HUMAN)
VAPPQPQPV

SEQ ID NO: 103905 - protein, 10 aa, Artificial Sequence
  Description of Artificial Sequence: Synthetic peptide
  Seed: FSLRRAVSVK (MAGC3_HUMAN)
FMLRRAVSVK

SEQ ID NO: 103906 - protein, 9 aa, Artificial Sequence
  Description of Artificial Sequence: Synthetic peptide
  Seed: LSSIIPSAF (MAGC3_HUMAN)
LASIIPSAH

SEQ ID NO: 103907 - protein, 9 aa, Artificial Sequence
  Description of Artificial Sequence: Synthetic peptide
  Seed: KLVQFLLLK (MAGC3_HUMAN)
KIVQFLLLL

SEQ ID NO: 103908 - protein, 10 aa, Artificial Sequence
  Description of Artificial Sequence: Synthetic peptide
  Seed: EVIWEVLSAI (MAGC3_HUMAN)
ECIWEVLSAV

SEQ ID NO: 103909 - protein, 9 aa, Artificial Sequence
  Description of Artificial Sequence: Synthetic peptide
  Seed: AGFADVLSR (MAGC3_HUMAN)
AQFADVLSK

SEQ ID NO: 103910 - protein, 9 aa, Artificial Sequence
  Description of Artificial Sequence: Synthetic peptide
  Seed: SQPEGKFSL (MAGC3_HUMAN)
SHPEGKFSM

SEQ ID NO: 103911 - protein, 9 aa, Artificial Sequence
  Description of Artificial Sequence: Synthetic peptide
  Seed: ATDKDYSAF (MAGC3_HUMAN)
ALDKDYSAM

SEQ ID NO: 103912 - protein, 10 aa, Artificial Sequence
  Description of Artificial Sequence: Synthetic peptide
  Seed: FKLWRTLSGS (MAGC3_HUMAN)
FLLWRTLSGI

SEQ ID NO: 103913 - protein, 9 aa, Artificial Sequence
  Description of Artificial Sequence: Synthetic peptide
  Seed: WVKNTCATY (MAGC3_HUMAN)
WHKNTCATM

SEQ ID NO: 103914 - protein, 10 aa, Artificial Sequence
  Description of Artificial Sequence: Synthetic peptide
  Seed: MIFRKAREFI (MAGC3_HUMAN)
MSFRKAREFV

SEQ ID NO: 103915 - protein, 9 aa, Artificial Sequence
  Description of Artificial Sequence: Synthetic peptide
  Seed: FSLRRAVSV (MAGC3_HUMAN)
FVLRRAVSL

SEQ ID NO: 103916 - protein, 9 aa, Artificial Sequence
  Description of Artificial Sequence: Synthetic peptide
  Seed: KGSCVPEEV (MAGC3_HUMAN)
KASCVPEEF

SEQ ID NO: 103917 - protein, 11 aa, Artificial Sequence
  Description of Artificial Sequence: Synthetic peptide
  Seed: LDSCSSPLLWT (MAGC3_HUMAN)
LSSCSSPLLWN

SEQ ID NO: 103918 - protein, 9 aa, Artificial Sequence
  Description of Artificial Sequence: Synthetic peptide
  Seed: LSDEQGMPQ (MAGC3_HUMAN)
LMDEQGMPL

SEQ ID NO: 103919 - protein, 9 aa, Artificial Sequence
  Description of Artificial Sequence: Synthetic peptide
  Seed: ATYALSPVV (MAGC3_HUMAN)
AMYALSPVY

SEQ ID NO: 103920 - protein, 11 aa, Artificial Sequence
  Description of Artificial Sequence: Synthetic peptide
  Seed: RTLSGSPGLQL (MAGC3_HUMAN)
RSLSGSPGLQM

SEQ ID NO: 103921 - protein, 9 aa, Artificial Sequence
  Description of Artificial Sequence: Synthetic peptide
  Seed: AMASASPSV (MAGC3_HUMAN)
ATASASPSL

SEQ ID NO: 103922 - protein, 10 aa, Artificial Sequence
  Description of Artificial Sequence: Synthetic peptide
  Seed: EVIWEVLNAI (MAGC3_HUMAN)
ESIWEVLNAR

SEQ ID NO: 103923 - protein, 9 aa, Artificial Sequence
  Description of Artificial Sequence: Synthetic peptide
  Seed: KVDKLVQFL (MAGC3_HUMAN)
KFDKLVQFY

SEQ ID NO: 103924 - protein, 9 aa, Artificial Sequence
  Description of Artificial Sequence: Synthetic peptide
  Seed: TSDQRMDSL (MAGC3_HUMAN)
TGDQRMDSF

SEQ ID NO: 103925 - protein, 9 aa, Artificial Sequence
  Description of Artificial Sequence: Synthetic peptide
  Seed: TEASPQQKK (MAGC3_HUMAN)
TIASPQQKR

SEQ ID NO: 103926 - protein, 9 aa, Artificial Sequence
  Description of Artificial Sequence: Synthetic peptide
  Seed: AIGPWSALA (MAGC3_HUMAN)
AMGPWSALC

SEQ ID NO: 103927 - protein, 9 aa, Artificial Sequence
  Description of Artificial Sequence: Synthetic peptide
  Seed: MEDRAQAII (MAGC3_HUMAN)
MEDRAQAIL

SEQ ID NO: 103928 - protein, 9 aa, Artificial Sequence
  Description of Artificial Sequence: Synthetic peptide
  Seed: YSAFHLGHL (MAGC3_HUMAN)
YLAFHLGHM

SEQ ID NO: 103929 - protein, 9 aa, Artificial Sequence
  Description of Artificial Sequence: Synthetic peptide
  Seed: DVLSRLALW (MAGC3_HUMAN)
DILSRLALW

SEQ ID NO: 103930 - protein, 9 aa, Artificial Sequence
  Description of Artificial Sequence: Synthetic peptide
  Seed: MIFRKAREF (MAGC3_HUMAN)
MQFRKAREM

SEQ ID NO: 103931 - protein, 11 aa, Artificial Sequence
  Description of Artificial Sequence: Synthetic peptide
  Seed: AEMQMNVINTY (MAGC3_HUMAN)
AFMQMNVINTY

SEQ ID NO: 103932 - protein, 10 aa, Artificial Sequence
  Description of Artificial Sequence: Synthetic peptide
  Seed: ATYALSPVVL (MAGC3_HUMAN)
AIYALSPVVF

SEQ ID NO: 103933 - protein, 9 aa, Artificial Sequence
  Description of Artificial Sequence: Synthetic peptide
  Seed: FSDGSLGQW (MAGC3_HUMAN)
FIDGSLGQF

SEQ ID NO: 103934 - protein, 10 aa, Artificial Sequence
  Description of Artificial Sequence: Synthetic peptide
  Seed: TFSDGSLGQW (MAGC3_HUMAN)
TSSDGSLGQW

SEQ ID NO: 103935 - protein, 9 aa, Artificial Sequence
  Description of Artificial Sequence: Synthetic peptide
  Seed: GYFPMIFRK (MAGC3_HUMAN)
GLFPMIFRR

SEQ ID NO: 103936 - protein, 9 aa, Artificial Sequence
  Description of Artificial Sequence: Synthetic peptide
  Seed: KGSCVPEEV (MAGC3_HUMAN)
KLSCVPEEF

SEQ ID NO: 103937 - protein, 8 aa, Artificial Sequence
  Description of Artificial Sequence: Synthetic peptide
  Seed: KAHEFIEL (MAGC3_HUMAN)
KQHEFIEI

SEQ ID NO: 103938 - protein, 10 aa, Artificial Sequence
  Description of Artificial Sequence: Synthetic peptide
  Seed: SPLDSCSSPL (MAGC3_HUMAN)
SHLDSCSSPV

SEQ ID NO: 103939 - protein, 9 aa, Artificial Sequence
  Description of Artificial Sequence: Synthetic peptide
  Seed: GYFPMIFRK (MAGC3_HUMAN)
GSFPMIFRY

SEQ ID NO: 103940 - protein, 9 aa, Artificial Sequence
  Description of Artificial Sequence: Synthetic peptide
  Seed: HLREVRLFL (MAGC3_HUMAN)
HTREVRLFI

SEQ ID NO: 103941 - protein, 9 aa, Artificial Sequence
  Description of Artificial Sequence: Synthetic peptide
  Seed: AGFADVLSR (MAGC3_HUMAN)
AAFADVLSM

SEQ ID NO: 103942 - protein, 9 aa, Artificial Sequence
  Description of Artificial Sequence: Synthetic peptide
  Seed: QTKEPVTKA (MAGC3_HUMAN)
QLKEPVTKK

SEQ ID NO: 103943 - protein, 10 aa, Artificial Sequence
  Description of Artificial Sequence: Synthetic peptide
  Seed: TCATYALSPV (MAGC3_HUMAN)
TAATYALSPI

SEQ ID NO: 103944 - protein, 9 aa, Artificial Sequence
  Description of Artificial Sequence: Synthetic peptide
  Seed: NAIGPWSAL (MAGC3_HUMAN)
NLIGPWSAY

SEQ ID NO: 103945 - protein, 9 aa, Artificial Sequence
  Description of Artificial Sequence: Synthetic peptide
  Seed: YSAFHLGHL (MAGC3_HUMAN)
YMAFHLGHW

SEQ ID NO: 103946 - protein, 10 aa, Artificial Sequence
  Description of Artificial Sequence: Synthetic peptide
  Seed: VVLPPQPQPR (MAGC3_HUMAN)
VLLPPQPQPR

SEQ ID NO: 103947 - protein, 11 aa, Artificial Sequence
  Description of Artificial Sequence: Synthetic peptide
  Seed: MQMNVINTYTG (MAGC3_HUMAN)
MQMNVINTYTM

SEQ ID NO: 103948 - protein, 10 aa, Artificial Sequence
  Description of Artificial Sequence: Synthetic peptide
  Seed: TGYFPMIFRK (MAGC3_HUMAN)
TVYFPMIFRH

SEQ ID NO: 103949 - protein, 9 aa, Artificial Sequence
  Description of Artificial Sequence: Synthetic peptide
  Seed: QTKEPVTKA (MAGC3_HUMAN)
QAKEPVTKL

SEQ ID NO: 103950 - protein, 10 aa, Artificial Sequence
  Description of Artificial Sequence: Synthetic peptide
  Seed: MLTTVIKKYK (MAGC3_HUMAN)
MRTTVIKKYR

SEQ ID NO: 103951 - protein, 9 aa, Artificial Sequence
  Description of Artificial Sequence: Synthetic peptide
  Seed: KAHEFIELI (MAGC3_HUMAN)
KSHEFIELF

SEQ ID NO: 103952 - protein, 9 aa, Artificial Sequence
  Description of Artificial Sequence: Synthetic peptide
  Seed: EVDPDHFYV (MAGC3_HUMAN)
ESDPDHFYV

SEQ ID NO: 103953 - protein, 9 aa, Artificial Sequence
  Description of Artificial Sequence: Synthetic peptide
  Seed: ATYALSPVV (MAGC3_HUMAN)
ASYALSPVY

SEQ ID NO: 103954 - protein, 10 aa, Artificial Sequence
  Description of Artificial Sequence: Synthetic peptide
  Seed: YALDEKVAEL (MAGC3_HUMAN)
YYLDEKVAEL

SEQ ID NO: 103955 - protein, 11 aa, Artificial Sequence
  Description of Artificial Sequence: Synthetic peptide
  Seed: KKATDKDYSAF (MAGC3_HUMAN)
KQATDKDYSAY

SEQ ID NO: 103956 - protein, 8 aa, Artificial Sequence
  Description of Artificial Sequence: Synthetic peptide
  Seed: EVDPDHFY (MAGC3_HUMAN)
ETDPDHFY

SEQ ID NO: 103957 - protein, 9 aa, Artificial Sequence
  Description of Artificial Sequence: Synthetic peptide
  Seed: RGTGYTLSL (MAGC3_HUMAN)
RVTGYTLSY

SEQ ID NO: 103958 - protein, 9 aa, Artificial Sequence
  Description of Artificial Sequence: Synthetic peptide
  Seed: IPPQGPPKI (MAGC3_HUMAN)
ITPQGPPKF

SEQ ID NO: 103959 - protein, 9 aa, Artificial Sequence
  Description of Artificial Sequence: Synthetic peptide
  Seed: EVLEFLSKL (MAGC3_HUMAN)
EMLEFLSKR

SEQ ID NO: 103960 - protein, 9 aa, Artificial Sequence
  Description of Artificial Sequence: Synthetic peptide
  Seed: KVDKLVQFL (MAGC3_HUMAN)
KGDKLVQFY

SEQ ID NO: 103961 - protein, 9 aa, Artificial Sequence
  Description of Artificial Sequence: Synthetic peptide
  Seed: MDPDNHSYF (MAGC3_HUMAN)
MLPDNHSYI

SEQ ID NO: 103962 - protein, 9 aa, Artificial Sequence
  Description of Artificial Sequence: Synthetic peptide
  Seed: MPKNCLLIL (MAGC3_HUMAN)
MMKNCLLIY

SEQ ID NO: 103963 - protein, 10 aa, Artificial Sequence
  Description of Artificial Sequence: Synthetic peptide
  Seed: TLDEKVDKLV (MAGC3_HUMAN)
TMDEKVDKLM

SEQ ID NO: 103964 - protein, 9 aa, Artificial Sequence
  Description of Artificial Sequence: Synthetic peptide
  Seed: AVSPGKRLW (MAGC3_HUMAN)
AASPGKRLM

SEQ ID NO: 103965 - protein, 9 aa, Artificial Sequence
  Description of Artificial Sequence: Synthetic peptide
  Seed: IIDTTDDAT (MAGC3_HUMAN)
ILDTTDDAL

SEQ ID NO: 103966 - protein, 9 aa, Artificial Sequence
  Description of Artificial Sequence: Synthetic peptide
  Seed: TRAEMQMNV (MAGC3_HUMAN)
TRAEMQMNF

SEQ ID NO: 103967 - protein, 9 aa, Artificial Sequence
  Description of Artificial Sequence: Synthetic peptide
  Seed: MLTTVIKKY (MAGC3_HUMAN)
MATTVIKKI

SEQ ID NO: 103968 - protein, 10 aa, Artificial Sequence
  Description of Artificial Sequence: Synthetic peptide
  Seed: WVKNTCATYA (MAGC3_HUMAN)
WVKNTCATYF

SEQ ID NO: 103969 - protein, 9 aa, Artificial Sequence
  Description of Artificial Sequence: Synthetic peptide
  Seed: FPSWYMDAL (MAGC3_HUMAN)
FVSWYMDAI

SEQ ID NO: 103970 - protein, 11 aa, Artificial Sequence
  Description of Artificial Sequence: Synthetic peptide
  Seed: YFFEDTLDLTY (MAGC3_HUMAN)
YAFEDTLDLTY

SEQ ID NO: 103971 - protein, 9 aa, Artificial Sequence
  Description of Artificial Sequence: Synthetic peptide
  Seed: HALPESESL (MAGC3_HUMAN)
HQLPESESL

SEQ ID NO: 103972 - protein, 10 aa, Artificial Sequence
  Description of Artificial Sequence: Synthetic peptide
  Seed: EKVAELVQFL (MAGC3_HUMAN)
EVVAELVQFI

SEQ ID NO: 103973 - protein, 9 aa, Artificial Sequence
  Description of Artificial Sequence: Synthetic peptide
  Seed: VIWEVLSAI (MAGC3_HUMAN)
VTWEVLSAY

SEQ ID NO: 103974 - protein, 11 aa, Artificial Sequence
  Description of Artificial Sequence: Synthetic peptide
  Seed: FIKGSCVPEEV (MAGC3_HUMAN)
FLKGSCVPEEI

SEQ ID NO: 103975 - protein, 9 aa, Artificial Sequence
  Description of Artificial Sequence: Synthetic peptide
  Seed: TKAEMLTTV (MAGC3_HUMAN)
TAAEMLTTL

SEQ ID NO: 103976 - protein, 10 aa, Artificial Sequence
  Description of Artificial Sequence: Synthetic peptide
  Seed: MQMNVINTYT (MAGC3_HUMAN)
MWMNVINTYI

SEQ ID NO: 103977 - protein, 9 aa, Artificial Sequence
  Description of Artificial Sequence: Synthetic peptide
  Seed: KLVQFLLLK (MAGC3_HUMAN)
KYVQFLLLK

SEQ ID NO: 103978 - protein, 9 aa, Artificial Sequence
  Description of Artificial Sequence: Synthetic peptide
  Seed: GPWSALAGF (MAGC3_HUMAN)
GPWSALAGL

SEQ ID NO: 103979 - protein, 9 aa, Artificial Sequence
  Description of Artificial Sequence: Synthetic peptide
  Seed: YFFEDTLDL (MAGC3_HUMAN)
YLFEDTLDA

SEQ ID NO: 103980 - protein, 9 aa, Artificial Sequence
  Description of Artificial Sequence: Synthetic peptide
  Seed: EKVDKLVQF (MAGC3_HUMAN)
EEVDKLVQL

SEQ ID NO: 103981 - protein, 10 aa, Artificial Sequence
  Description of Artificial Sequence: Synthetic peptide
  Seed: KDYFPMIFGK (MAGC3_HUMAN)
KTYFPMIFGY

SEQ ID NO: 103982 - protein, 11 aa, Artificial Sequence
  Description of Artificial Sequence: Synthetic peptide
  Seed: GPPQSPPQSPL (MAGC3_HUMAN)
GPPQSPPQSPM

SEQ ID NO: 103983 - protein, 9 aa, Artificial Sequence
  Description of Artificial Sequence: Synthetic peptide
  Seed: FHLGHLREV (MAGC3_HUMAN)
FQLGHLREL

SEQ ID NO: 103984 - protein, 9 aa, Artificial Sequence
  Description of Artificial Sequence: Synthetic peptide
  Seed: VLPPQPQPR (MAGC3_HUMAN)
VGPPQPQPV

SEQ ID NO: 103985 - protein, 10 aa, Artificial Sequence
  Description of Artificial Sequence: Synthetic peptide
  Seed: YSAFHLGHLR (MAGC3_HUMAN)
YDAFHLGHLK

SEQ ID NO: 103986 - protein, 9 aa, Artificial Sequence
  Description of Artificial Sequence: Synthetic peptide
  Seed: VPEEVIWEV (MAGC3_HUMAN)
VTEEVIWEL

SEQ ID NO: 103987 - protein, 11 aa, Artificial Sequence
  Description of Artificial Sequence: Synthetic peptide
  Seed: LTDMDPDNHSY (MAGC3_HUMAN)
LVDMDPDNHSI

SEQ ID NO: 103988 - protein, 10 aa, Artificial Sequence
  Description of Artificial Sequence: Synthetic peptide
  Seed: SKLSSIIPSA (MAGC3_HUMAN)
STLSSIIPSV

SEQ ID NO: 103989 - protein, 9 aa, Artificial Sequence
  Description of Artificial Sequence: Synthetic peptide
  Seed: EMLTTVIKK (MAGC3_HUMAN)
EILTTVIKR

SEQ ID NO: 103990 - protein, 11 aa, Artificial Sequence
  Description of Artificial Sequence: Synthetic peptide
  Seed: TDMDPDNHSYF (MAGC3_HUMAN)
TSMDPDNHSYL

SEQ ID NO: 103991 - protein, 10 aa, Artificial Sequence
  Description of Artificial Sequence: Synthetic peptide
  Seed: MPKNCLLILI (MAGC3_HUMAN)
MPKNCLLILT

SEQ ID NO: 103992 - protein, 10 aa, Artificial Sequence
  Description of Artificial Sequence: Synthetic peptide
  Seed: REVRLFLRGG (MAGC3_HUMAN)
RFVRLFLRGV

SEQ ID NO: 103993 - protein, 11 aa, Artificial Sequence
  Description of Artificial Sequence: Synthetic peptide
  Seed: RTLSGSPGLQL (MAGC3_HUMAN)
RALSGSPGLQL

SEQ ID NO: 103994 - protein, 10 aa, Artificial Sequence
  Description of Artificial Sequence: Synthetic peptide
  Seed: REVLEFLSKL (MAGC3_HUMAN)
RVVLEFLSKV

SEQ ID NO: 103995 - protein, 10 aa, Artificial Sequence
  Description of Artificial Sequence: Synthetic peptide
  Seed: KLSSIIPSAF (MAGC3_HUMAN)
KMSSIIPSAW

SEQ ID NO: 103996 - protein, 11 aa, Artificial Sequence
  Description of Artificial Sequence: Synthetic peptide
  Seed: SPQGPPQSPPQ (MAGC3_HUMAN)
SPQGPPQSPPV

SEQ ID NO: 103997 - protein, 10 aa, Artificial Sequence
  Description of Artificial Sequence: Synthetic peptide
  Seed: MQMNVINTYT (MAGC3_HUMAN)
MQMNVINTYK

SEQ ID NO: 103998 - protein, 10 aa, Artificial Sequence
  Description of Artificial Sequence: Synthetic peptide
  Seed: YALDEKVAEL (MAGC3_HUMAN)
YLLDEKVAEA

SEQ ID NO: 103999 - protein, 10 aa, Artificial Sequence
  Description of Artificial Sequence: Synthetic peptide
  Seed: RLWGEKAGSL (MAGC3_HUMAN)
RTWGEKAGSF

SEQ ID NO: 104000 - protein, 11 aa, Artificial Sequence
  Description of Artificial Sequence: Synthetic peptide
  Seed: FLSKLSSIIPS (MAGC3_HUMAN)
FMSKLSSIIPI

SEQ ID NO: 104001 - protein, 10 aa, Artificial Sequence
  Description of Artificial Sequence: Synthetic peptide
  Seed: FPSWYMDALK (MAGC3_HUMAN)
FYSWYMDALR

SEQ ID NO: 104002 - protein, 10 aa, Artificial Sequence
  Description of Artificial Sequence: Synthetic peptide
  Seed: KLSSIIPSAF (MAGC3_HUMAN)
KMSSIIPSAM

SEQ ID NO: 104003 - protein, 9 aa, Artificial Sequence
  Description of Artificial Sequence: Synthetic peptide
  Seed: IPPQGPPKI (MAGC3_HUMAN)
IIPQGPPKF

SEQ ID NO: 104004 - protein, 9 aa, Artificial Sequence
  Description of Artificial Sequence: Synthetic peptide
  Seed: AIGPWSALA (MAGC3_HUMAN)
AMGPWSALM

SEQ ID NO: 104005 - protein, 9 aa, Artificial Sequence
  Description of Artificial Sequence: Synthetic peptide
  Seed: MQMNVINTY (MAGC3_HUMAN)
MSMNVINTW

SEQ ID NO: 104006 - protein, 9 aa, Artificial Sequence
  Description of Artificial Sequence: Synthetic peptide
  Seed: RGTGYTLSL (MAGC3_HUMAN)
RKTGYTLSM

SEQ ID NO: 104007 - protein, 10 aa, Artificial Sequence
  Description of Artificial Sequence: Synthetic peptide
  Seed: SQPEGKFSLR (MAGC3_HUMAN)
STPEGKFSLK

SEQ ID NO: 104008 - protein, 9 aa, Artificial Sequence
  Description of Artificial Sequence: Synthetic peptide
  Seed: NTYTGYFPM (MAGC3_HUMAN)
NSYTGYFPA

SEQ ID NO: 104009 - protein, 11 aa, Artificial Sequence
  Description of Artificial Sequence: Synthetic peptide
  Seed: LTDMDPDNHSY (MAGC3_HUMAN)
LSDMDPDNHSY

SEQ ID NO: 104010 - protein, 9 aa, Artificial Sequence
  Description of Artificial Sequence: Synthetic peptide
  Seed: AIGPIQRPA (MAGC3_HUMAN)
AAGPIQRPY

SEQ ID NO: 104011 - protein, 10 aa, Artificial Sequence
  Description of Artificial Sequence: Synthetic peptide
  Seed: EMQMNVINTY (MAGC3_HUMAN)
ETQMNVINTY

SEQ ID NO: 104012 - protein, 9 aa, Artificial Sequence
  Description of Artificial Sequence: Synthetic peptide
  Seed: KVAELVQFL (MAGC3_HUMAN)
KWAELVQFY

SEQ ID NO: 104013 - protein, 10 aa, Artificial Sequence
  Description of Artificial Sequence: Synthetic peptide
  Seed: YQAKEPLTRA (MAGC3_HUMAN)
YMAKEPLTRT

SEQ ID NO: 104014 - protein, 9 aa, Artificial Sequence
  Description of Artificial Sequence: Synthetic peptide
  Seed: IQRPAREVL (MAGC3_HUMAN)
IIRPAREVF

SEQ ID NO: 104015 - protein, 10 aa, Artificial Sequence
  Description of Artificial Sequence: Synthetic peptide
  Seed: EKVAELVQFL (MAGC3_HUMAN)
EIVAELVQFI

SEQ ID NO: 104016 - protein, 9 aa, Artificial Sequence
  Description of Artificial Sequence: Synthetic peptide
  Seed: YQAKEPLTR (MAGC3_HUMAN)
YAAKEPLTM

SEQ ID NO: 104017 - protein, 10 aa, Artificial Sequence
  Description of Artificial Sequence: Synthetic peptide
  Seed: EMQMNVINTY (MAGC3_HUMAN)
EYQMNVINTM

SEQ ID NO: 104018 - protein, 9 aa, Artificial Sequence
  Description of Artificial Sequence: Synthetic peptide
  Seed: EVIWEVLNA (MAGC3_HUMAN)
EAIWEVLNV

SEQ ID NO: 104019 - protein, 10 aa, Artificial Sequence
  Description of Artificial Sequence: Synthetic peptide
  Seed: KKYKDYFPMI (MAGC3_HUMAN)
KRYKDYFPMK

SEQ ID NO: 104020 - protein, 11 aa, Artificial Sequence
  Description of Artificial Sequence: Synthetic peptide
  Seed: LSKLSSIIPSA (MAGC3_HUMAN)
LYKLSSIIPSI

SEQ ID NO: 104021 - protein, 9 aa, Artificial Sequence
  Description of Artificial Sequence: Synthetic peptide
  Seed: MQMNVINTY (MAGC3_HUMAN)
MQMNVINTI

SEQ ID NO: 104022 - protein, 10 aa, Artificial Sequence
  Description of Artificial Sequence: Synthetic peptide
  Seed: TGYFPMIFRK (MAGC3_HUMAN)
THYFPMIFRR

SEQ ID NO: 104023 - protein, 8 aa, Artificial Sequence
  Description of Artificial Sequence: Synthetic peptide
  Seed: TYALSPVV (MAGC3_HUMAN)
TYALSPVL

SEQ ID NO: 104024 - protein, 9 aa, Artificial Sequence
  Description of Artificial Sequence: Synthetic peptide
  Seed: ALSPVVLPP (MAGC3_HUMAN)
AASPVVLPV

SEQ ID NO: 104025 - protein, 9 aa, Artificial Sequence
  Description of Artificial Sequence: Synthetic peptide
  Seed: HSYFFEDTL (MAGC3_HUMAN)
HGYFFEDTY

SEQ ID NO: 104026 - protein, 9 aa, Artificial Sequence
  Description of Artificial Sequence: Synthetic peptide
  Seed: YKDYFPMIF (MAGC3_HUMAN)
YSDYFPMIM

SEQ ID NO: 104027 - protein, 9 aa, Artificial Sequence
  Description of Artificial Sequence: Synthetic peptide
  Seed: HFYVFVNTL (MAGC3_HUMAN)
HLYVFVNTF

SEQ ID NO: 104028 - protein, 9 aa, Artificial Sequence
  Description of Artificial Sequence: Synthetic peptide
  Seed: IPPQGPPKI (MAGC3_HUMAN)
IIPQGPPKY

SEQ ID NO: 104029 - protein, 9 aa, Artificial Sequence
  Description of Artificial Sequence: Synthetic peptide
  Seed: SESLPRYAL (MAGC3_HUMAN)
SQSLPRYAI

SEQ ID NO: 104030 - protein, 9 aa, Artificial Sequence
  Description of Artificial Sequence: Synthetic peptide
  Seed: KLSSIIPSA (MAGC3_HUMAN)
KYSSIIPSA

SEQ ID NO: 104031 - protein, 9 aa, Artificial Sequence
  Description of Artificial Sequence: Synthetic peptide
  Seed: FSLRRAVSV (MAGC3_HUMAN)
FNLRRAVSI

SEQ ID NO: 104032 - protein, 9 aa, Artificial Sequence
  Description of Artificial Sequence: Synthetic peptide
  Seed: TAMASASPS (MAGC3_HUMAN)
TAMASASPW

SEQ ID NO: 104033 - protein, 9 aa, Artificial Sequence
  Description of Artificial Sequence: Synthetic peptide
  Seed: DTTDDATAM (MAGC3_HUMAN)
DATDDATAY

SEQ ID NO: 104034 - protein, 9 aa, Artificial Sequence
  Description of Artificial Sequence: Synthetic peptide
  Seed: TSDQRMDSL (MAGC3_HUMAN)
TVDQRMDSM

SEQ ID NO: 104035 - protein, 10 aa, Artificial Sequence
  Description of Artificial Sequence: Synthetic peptide
  Seed: MPAAGMPPLP (MAGC3_HUMAN)
MGAAGMPPLY

SEQ ID NO: 104036 - protein, 10 aa, Artificial Sequence
  Description of Artificial Sequence: Synthetic peptide
  Seed: KLVQFLLLKY (MAGC3_HUMAN)
KLVQFLLLKK

SEQ ID NO: 104037 - protein, 9 aa, Artificial Sequence
  Description of Artificial Sequence: Synthetic peptide
  Seed: NVINTYTGY (MAGC3_HUMAN)
NTINTYTGF

SEQ ID NO: 104038 - protein, 9 aa, Artificial Sequence
  Description of Artificial Sequence: Synthetic peptide
  Seed: MQMNVINTY (MAGC3_HUMAN)
MQMNVINTT

SEQ ID NO: 104039 - protein, 9 aa, Artificial Sequence
  Description of Artificial Sequence: Synthetic peptide
  Seed: MDPDNHSYF (MAGC3_HUMAN)
MMPDNHSYL

SEQ ID NO: 104040 - protein, 9 aa, Artificial Sequence
  Description of Artificial Sequence: Synthetic peptide
  Seed: MQMNVINTY (MAGC3_HUMAN)
MRMNVINTF

SEQ ID NO: 104041 - protein, 10 aa, Artificial Sequence
  Description of Artificial Sequence: Synthetic peptide
  Seed: VVLPPQPQPR (MAGC3_HUMAN)
VMLPPQPQPR

SEQ ID NO: 104042 - protein, 11 aa, Artificial Sequence
  Description of Artificial Sequence: Synthetic peptide
  Seed: ISLTEVDPDHF (MAGC3_HUMAN)
ITLTEVDPDHW

SEQ ID NO: 104043 - protein, 9 aa, Artificial Sequence
  Description of Artificial Sequence: Synthetic peptide
  Seed: IQRPAREVL (MAGC3_HUMAN)
IYRPAREVM

SEQ ID NO: 104044 - protein, 10 aa, Artificial Sequence
  Description of Artificial Sequence: Synthetic peptide
  Seed: MIFGKAHEFI (MAGC3_HUMAN)
MQFGKAHEFI

SEQ ID NO: 104045 - protein, 8 aa, Artificial Sequence
  Description of Artificial Sequence: Synthetic peptide
  Seed: KVDKLVQF (MAGC3_HUMAN)
KADKLVQL

SEQ ID NO: 104046 - protein, 10 aa, Artificial Sequence
  Description of Artificial Sequence: Synthetic peptide
  Seed: YFPMIFGKAH (MAGC3_HUMAN)
YYPMIFGKAI

SEQ ID NO: 104047 - protein, 10 aa, Artificial Sequence
  Description of Artificial Sequence: Synthetic peptide
  Seed: EKVAELVQFL (MAGC3_HUMAN)
ETVAELVQFL

SEQ ID NO: 104048 - protein, 9 aa, Artificial Sequence
  Description of Artificial Sequence: Synthetic peptide
  Seed: MASASPSVM (MAGC3_HUMAN)
MLSASPSVF

SEQ ID NO: 104049 - protein, 10 aa, Artificial Sequence
  Description of Artificial Sequence: Synthetic peptide
  Seed: KVAELVQFLL (MAGC3_HUMAN)
KTAELVQFLL

SEQ ID NO: 104050 - protein, 9 aa, Artificial Sequence
  Description of Artificial Sequence: Synthetic peptide
  Seed: WRRGTGYTL (MAGC3_HUMAN)
WTRGTGYTY

SEQ ID NO: 104051 - protein, 11 aa, Artificial Sequence
  Description of Artificial Sequence: Synthetic peptide
  Seed: AIGPWSALAGF (MAGC3_HUMAN)
AIGPWSALAGR

SEQ ID NO: 104052 - protein, 9 aa, Artificial Sequence
  Description of Artificial Sequence: Synthetic peptide
  Seed: KLVQFLLLK (MAGC3_HUMAN)
KYVQFLLLY

SEQ ID NO: 104053 - protein, 8 aa, Artificial Sequence
  Description of Artificial Sequence: Synthetic peptide
  Seed: ADVLSRLA (MAGC3_HUMAN)
AEVLSRLL

SEQ ID NO: 104054 - protein, 9 aa, Artificial Sequence
  Description of Artificial Sequence: Synthetic peptide
  Seed: TSDQRMDSL (MAGC3_HUMAN)
TIDQRMDSF

SEQ ID NO: 104055 - protein, 9 aa, Artificial Sequence
  Description of Artificial Sequence: Synthetic peptide
  Seed: SQPEGKFSL (MAGC3_HUMAN)
SYPEGKFSI

SEQ ID NO: 104056 - protein, 9 aa, Artificial Sequence
  Description of Artificial Sequence: Synthetic peptide
  Seed: SEEEDTATW (MAGC3_HUMAN)
SEEEDTATL

SEQ ID NO: 104057 - protein, 10 aa, Artificial Sequence
  Description of Artificial Sequence: Synthetic peptide
  Seed: TTDDATAMAS (MAGC3_HUMAN)
TIDDATAMAM

SEQ ID NO: 104058 - protein, 11 aa, Artificial Sequence
  Description of Artificial Sequence: Synthetic peptide
  Seed: AEMQMNVINTY (MAGC3_HUMAN)
ACMQMNVINTF

SEQ ID NO: 104059 - protein, 9 aa, Artificial Sequence
  Description of Artificial Sequence: Synthetic peptide
  Seed: NPQGLAGHR (MAGC3_HUMAN)
NIQGLAGHR

SEQ ID NO: 104060 - protein, 9 aa, Artificial Sequence
  Description of Artificial Sequence: Synthetic peptide
  Seed: AMASASPSV (MAGC3_HUMAN)
AMASASPSY

SEQ ID NO: 104061 - protein, 9 aa, Artificial Sequence
  Description of Artificial Sequence: Synthetic peptide
  Seed: CATYALSPV (MAGC3_HUMAN)
CMTYALSPI

SEQ ID NO: 104062 - protein, 9 aa, Artificial Sequence
  Description of Artificial Sequence: Synthetic peptide
  Seed: IQRPAREVL (MAGC3_HUMAN)
IQRPAREVF

SEQ ID NO: 104063 - protein, 9 aa, Artificial Sequence
  Description of Artificial Sequence: Synthetic peptide
  Seed: TYALSPVVL (MAGC3_HUMAN)
TYALSPVVW

SEQ ID NO: 104064 - protein, 9 aa, Artificial Sequence
  Description of Artificial Sequence: Synthetic peptide
  Seed: LVLCPTYFK (MAGC3_HUMAN)
LNLCPTYFK

SEQ ID NO: 104065 - protein, 10 aa, Artificial Sequence
  Description of Artificial Sequence: Synthetic peptide
  Seed: TEVDPDHFYV (MAGC3_HUMAN)
TMVDPDHFYA

SEQ ID NO: 104066 - protein, 9 aa, Artificial Sequence
  Description of Artificial Sequence: Synthetic peptide
  Seed: ALDEKVAEL (MAGC3_HUMAN)
APDEKVAEI

SEQ ID NO: 104067 - protein, 9 aa, Artificial Sequence
  Description of Artificial Sequence: Synthetic peptide
  Seed: TSDQRMDSL (MAGC3_HUMAN)
TTDQRMDSV

SEQ ID NO: 104068 - protein, 9 aa, Artificial Sequence
  Description of Artificial Sequence: Synthetic peptide
  Seed: SLVLCPTYF (MAGC3_HUMAN)
SMVLCPTYF

SEQ ID NO: 104069 - protein, 10 aa, Artificial Sequence
  Description of Artificial Sequence: Synthetic peptide
  Seed: YALDEKVAEL (MAGC3_HUMAN)
YYLDEKVAEA

SEQ ID NO: 104070 - protein, 9 aa, Artificial Sequence
  Description of Artificial Sequence: Synthetic peptide
  Seed: EVLNAIGPW (MAGC3_HUMAN)
ELLNAIGPY

SEQ ID NO: 104071 - protein, 9 aa, Artificial Sequence
  Description of Artificial Sequence: Synthetic peptide
  Seed: FADVLSRLA (MAGC3_HUMAN)
FADVLSRLL

SEQ ID NO: 104072 - protein, 9 aa, Artificial Sequence
  Description of Artificial Sequence: Synthetic peptide
  Seed: KKYKDYFPM (MAGC3_HUMAN)
KVYKDYFPY

SEQ ID NO: 104073 - protein, 9 aa, Artificial Sequence
  Description of Artificial Sequence: Synthetic peptide
  Seed: SLRRAVSVK (MAGC3_HUMAN)
SIRRAVSVI

SEQ ID NO: 104074 - protein, 9 aa, Artificial Sequence
  Description of Artificial Sequence: Synthetic peptide
  Seed: YQAKEPLTR (MAGC3_HUMAN)
YQAKEPLTY

SEQ ID NO: 104075 - protein, 10 aa, Artificial Sequence
  Description of Artificial Sequence: Synthetic peptide
  Seed: KLVQFLLLKY (MAGC3_HUMAN)
KSVQFLLLKK

SEQ ID NO: 104076 - protein, 10 aa, Artificial Sequence
  Description of Artificial Sequence: Synthetic peptide
  Seed: MDSLVLCPTY (MAGC3_HUMAN)
MASLVLCPTF

SEQ ID NO: 104077 - protein, 10 aa, Artificial Sequence
  Description of Artificial Sequence: Synthetic peptide
  Seed: YSAFHLGHLR (MAGC3_HUMAN)
YKAFHLGHLK

SEQ ID NO: 104078 - protein, 9 aa, Artificial Sequence
  Description of Artificial Sequence: Synthetic peptide
  Seed: SASPSVMST (MAGC3_HUMAN)
SPSPSVMSL

SEQ ID NO: 104079 - protein, 10 aa, Artificial Sequence
  Description of Artificial Sequence: Synthetic peptide
  Seed: TTDDATAMAS (MAGC3_HUMAN)
TSDDATAMAM

SEQ ID NO: 104080 - protein, 9 aa, Artificial Sequence
  Description of Artificial Sequence: Synthetic peptide
  Seed: VLCPTYFKL (MAGC3_HUMAN)
VYCPTYFKV

SEQ ID NO: 104081 - protein, 9 aa, Artificial Sequence
  Description of Artificial Sequence: Synthetic peptide
  Seed: VIWEVLSAI (MAGC3_HUMAN)
VAWEVLSAR

SEQ ID NO: 104082 - protein, 10 aa, Artificial Sequence
  Description of Artificial Sequence: Synthetic peptide
  Seed: SLIDDQGMPK (MAGC3_HUMAN)
SMIDDQGMPR

SEQ ID NO: 104083 - protein, 9 aa, Artificial Sequence
  Description of Artificial Sequence: Synthetic peptide
  Seed: TRAEMQMNV (MAGC3_HUMAN)
TYAEMQMNF

SEQ ID NO: 104084 - protein, 10 aa, Artificial Sequence
  Description of Artificial Sequence: Synthetic peptide
  Seed: MQMNVINTYT (MAGC3_HUMAN)
MFMNVINTYA

SEQ ID NO: 104085 - protein, 9 aa, Artificial Sequence
  Description of Artificial Sequence: Synthetic peptide
  Seed: FSDGSLGQW (MAGC3_HUMAN)
FLDGSLGQY

SEQ ID NO: 104086 - protein, 10 aa, Artificial Sequence
  Description of Artificial Sequence: Synthetic peptide
  Seed: AMASASPSVM (MAGC3_HUMAN)
ALASASPSVW

SEQ ID NO: 104087 - protein, 9 aa, Artificial Sequence
  Description of Artificial Sequence: Synthetic peptide
  Seed: SPSVMSTNF (MAGC3_HUMAN)
SPSVMSTNI

SEQ ID NO: 104088 - protein, 10 aa, Artificial Sequence
  Description of Artificial Sequence: Synthetic peptide
  Seed: EMQMNVINTY (MAGC3_HUMAN)
EKQMNVINTF

SEQ ID NO: 104089 - protein, 9 aa, Artificial Sequence
  Description of Artificial Sequence: Synthetic peptide
  Seed: KAHEFIELI (MAGC3_HUMAN)
KGHEFIELM

SEQ ID NO: 104090 - protein, 9 aa, Artificial Sequence
  Description of Artificial Sequence: Synthetic peptide
  Seed: QPEGKFSLR (MAGC3_HUMAN)
QLEGKFSLR

SEQ ID NO: 104091 - protein, 9 aa, Artificial Sequence
  Description of Artificial Sequence: Synthetic peptide
  Seed: YQTKEPVTK (MAGC3_HUMAN)
YATKEPVTM

SEQ ID NO: 104092 - protein, 9 aa, Artificial Sequence
  Description of Artificial Sequence: Synthetic peptide
  Seed: TLDEKVDKL (MAGC3_HUMAN)
TMDEKVDKW

SEQ ID NO: 104093 - protein, 9 aa, Artificial Sequence
  Description of Artificial Sequence: Synthetic peptide
  Seed: IPPQGPPKI (MAGC3_HUMAN)
IPPQGPPKW

SEQ ID NO: 104094 - protein, 10 aa, Artificial Sequence
  Description of Artificial Sequence: Synthetic peptide
  Seed: QEDGRRGLTE (MAGC3_HUMAN)
QEDGRRGLTL

SEQ ID NO: 104095 - protein, 9 aa, Artificial Sequence
  Description of Artificial Sequence: Synthetic peptide
  Seed: QPQPRKKAT (MAGC3_HUMAN)
QMQPRKKAL

SEQ ID NO: 104096 - protein, 9 aa, Artificial Sequence
  Description of Artificial Sequence: Synthetic peptide
  Seed: TLDEKVDKL (MAGC3_HUMAN)
TFDEKVDKY

SEQ ID NO: 104097 - protein, 9 aa, Artificial Sequence
  Description of Artificial Sequence: Synthetic peptide
  Seed: MIFRKAREF (MAGC3_HUMAN)
MWFRKAREF

SEQ ID NO: 104098 - protein, 9 aa, Artificial Sequence
  Description of Artificial Sequence: Synthetic peptide
  Seed: KYKDYFPMI (MAGC3_HUMAN)
KTKDYFPMF

SEQ ID NO: 104099 - protein, 10 aa, Artificial Sequence
  Description of Artificial Sequence: Synthetic peptide
  Seed: KATDKDYSAF (MAGC3_HUMAN)
KQTDKDYSAM

SEQ ID NO: 104100 - protein, 9 aa, Artificial Sequence
  Description of Artificial Sequence: Synthetic peptide
  Seed: TEASPQQKK (MAGC3_HUMAN)
TVASPQQKR

SEQ ID NO: 104101 - protein, 10 aa, Artificial Sequence
  Description of Artificial Sequence: Synthetic peptide
  Seed: AMASASPSVM (MAGC3_HUMAN)
ALASASPSVA

SEQ ID NO: 104102 - protein, 9 aa, Artificial Sequence
  Description of Artificial Sequence: Synthetic peptide
  Seed: ATYALSPVV (MAGC3_HUMAN)
AVYALSPVM

SEQ ID NO: 104103 - protein, 9 aa, Artificial Sequence
  Description of Artificial Sequence: Synthetic peptide
  Seed: FKLWRTLSG (MAGC3_HUMAN)
FQLWRTLSL

SEQ ID NO: 104104 - protein, 9 aa, Artificial Sequence
  Description of Artificial Sequence: Synthetic peptide
  Seed: MIFGKAHEF (MAGC3_HUMAN)
MAFGKAHEV

SEQ ID NO: 104105 - protein, 9 aa, Artificial Sequence
  Description of Artificial Sequence: Synthetic peptide
  Seed: LSGSPGLQL (MAGC3_HUMAN)
LMGSPGLQY

SEQ ID NO: 104106 - protein, 11 aa, Artificial Sequence
  Description of Artificial Sequence: Synthetic peptide
  Seed: LDSCSSPLLWT (MAGC3_HUMAN)
LKSCSSPLLWW

SEQ ID NO: 104107 - protein, 10 aa, Artificial Sequence
  Description of Artificial Sequence: Synthetic peptide
  Seed: MQMNVINTYT (MAGC3_HUMAN)
MTMNVINTYV

SEQ ID NO: 104108 - protein, 9 aa, Artificial Sequence
  Description of Artificial Sequence: Synthetic peptide
  Seed: QMNVINTYT (MAGC3_HUMAN)
QLNVINTYM

SEQ ID NO: 104109 - protein, 9 aa, Artificial Sequence
  Description of Artificial Sequence: Synthetic peptide
  Seed: SEEEDTATW (MAGC3_HUMAN)
SLEEDTATL

SEQ ID NO: 104110 - protein, 9 aa, Artificial Sequence
  Description of Artificial Sequence: Synthetic peptide
  Seed: KLSSIIPSA (MAGC3_HUMAN)
KMSSIIPSR

SEQ ID NO: 104111 - protein, 10 aa, Artificial Sequence
  Description of Artificial Sequence: Synthetic peptide
  Seed: TGYFPMIFRK (MAGC3_HUMAN)
TVYFPMIFRP

SEQ ID NO: 104112 - protein, 9 aa, Artificial Sequence
  Description of Artificial Sequence: Synthetic peptide
  Seed: WRRGTGYTL (MAGC3_HUMAN)
WQRGTGYTI

SEQ ID NO: 104113 - protein, 9 aa, Artificial Sequence
  Description of Artificial Sequence: Synthetic peptide
  Seed: HFYVFVNTL (MAGC3_HUMAN)
HVYVFVNTM

SEQ ID NO: 104114 - protein, 10 aa, Artificial Sequence
  Description of Artificial Sequence: Synthetic peptide
  Seed: MQMNVINTYT (MAGC3_HUMAN)
MEMNVINTYL

SEQ ID NO: 104115 - protein, 9 aa, Artificial Sequence
  Description of Artificial Sequence: Synthetic peptide
  Seed: CSSPLLWTR (MAGC3_HUMAN)
CISPLLWTK

SEQ ID NO: 104116 - protein, 9 aa, Artificial Sequence
  Description of Artificial Sequence: Synthetic peptide
  Seed: MLLPCHWVL (MAGC3_HUMAN)
MTLPCHWVI

SEQ ID NO: 104117 - protein, 10 aa, Artificial Sequence
  Description of Artificial Sequence: Synthetic peptide
  Seed: TGYFPMIFRK (MAGC3_HUMAN)
TDYFPMIFRR

SEQ ID NO: 104118 - protein, 9 aa, Artificial Sequence
  Description of Artificial Sequence: Synthetic peptide
  Seed: FSLRRAVSV (MAGC3_HUMAN)
FILRRAVSL

SEQ ID NO: 104119 - protein, 10 aa, Artificial Sequence
  Description of Artificial Sequence: Synthetic peptide
  Seed: REVRLFLRGG (MAGC3_HUMAN)
RSVRLFLRGI

SEQ ID NO: 104120 - protein, 9 aa, Artificial Sequence
  Description of Artificial Sequence: Synthetic peptide
  Seed: EVLSAIGPI (MAGC3_HUMAN)
ELLSAIGPV

SEQ ID NO: 104121 - protein, 10 aa, Artificial Sequence
  Description of Artificial Sequence: Synthetic peptide
  Seed: SCSSPLLWTR (MAGC3_HUMAN)
SCSSPLLWTK

SEQ ID NO: 104122 - protein, 10 aa, Artificial Sequence
  Description of Artificial Sequence: Synthetic peptide
  Seed: EVIWEVLSAI (MAGC3_HUMAN)
EIIWEVLSAV

SEQ ID NO: 104123 - protein, 9 aa, Artificial Sequence
  Description of Artificial Sequence: Synthetic peptide
  Seed: MIFRKAREF (MAGC3_HUMAN)
MQFRKAREY

SEQ ID NO: 104124 - protein, 9 aa, Artificial Sequence
  Description of Artificial Sequence: Synthetic peptide
  Seed: SIIPSAFPS (MAGC3_HUMAN)
SMIPSAFPV

SEQ ID NO: 104125 - protein, 10 aa, Artificial Sequence
  Description of Artificial Sequence: Synthetic peptide
  Seed: DMPAAGMPPL (MAGC3_HUMAN)
DYPAAGMPPY

SEQ ID NO: 104126 - protein, 9 aa, Artificial Sequence
  Description of Artificial Sequence: Synthetic peptide
  Seed: NTYTGYFPM (MAGC3_HUMAN)
NLYTGYFPY

SEQ ID NO: 104127 - protein, 10 aa, Artificial Sequence
  Description of Artificial Sequence: Synthetic peptide
  Seed: TLDEKVDKLV (MAGC3_HUMAN)
TVDEKVDKLM

SEQ ID NO: 104128 - protein, 9 aa, Artificial Sequence
  Description of Artificial Sequence: Synthetic peptide
  Seed: QLSDLHFGS (MAGC3_HUMAN)
QMSDLHFGI

SEQ ID NO: 104129 - protein, 10 aa, Artificial Sequence
  Description of Artificial Sequence: Synthetic peptide
  Seed: IIDTTDDATA (MAGC3_HUMAN)
ILDTTDDATL

SEQ ID NO: 104130 - protein, 9 aa, Artificial Sequence
  Description of Artificial Sequence: Synthetic peptide
  Seed: EKVDKLVQF (MAGC3_HUMAN)
EEVDKLVQF

SEQ ID NO: 104131 - protein, 10 aa, Artificial Sequence
  Description of Artificial Sequence: Synthetic peptide
  Seed: MIFGKAHEFI (MAGC3_HUMAN)
MLFGKAHEFI

SEQ ID NO: 104132 - protein, 11 aa, Artificial Sequence
  Description of Artificial Sequence: Synthetic peptide
  Seed: SLPESEPLFTY (MAGC3_HUMAN)
SIPESEPLFTL

SEQ ID NO: 104133 - protein, 9 aa, Artificial Sequence
  Description of Artificial Sequence: Synthetic peptide
  Seed: SQPEGKFSL (MAGC3_HUMAN)
SVPEGKFSM

SEQ ID NO: 104134 - protein, 10 aa, Artificial Sequence
  Description of Artificial Sequence: Synthetic peptide
  Seed: LPTWRRGTGY (MAGC3_HUMAN)
LYTWRRGTGF

SEQ ID NO: 104135 - protein, 11 aa, Artificial Sequence
  Description of Artificial Sequence: Synthetic peptide
  Seed: GSQPEGKFSLR (MAGC3_HUMAN)
GVQPEGKFSLK

SEQ ID NO: 104136 - protein, 9 aa, Artificial Sequence
  Description of Artificial Sequence: Synthetic peptide
  Seed: RGTGYTLSL (MAGC3_HUMAN)
RTTGYTLSV

SEQ ID NO: 104137 - protein, 10 aa, Artificial Sequence
  Description of Artificial Sequence: Synthetic peptide
  Seed: SKLSSIIPSA (MAGC3_HUMAN)
SMLSSIIPSV

SEQ ID NO: 104138 - protein, 9 aa, Artificial Sequence
  Description of Artificial Sequence: Synthetic peptide
  Seed: NTYTGYFPM (MAGC3_HUMAN)
NPYTGYFPL

SEQ ID NO: 104139 - protein, 9 aa, Artificial Sequence
  Description of Artificial Sequence: Synthetic peptide
  Seed: AGFADVLSR (MAGC3_HUMAN)
AAFADVLSV

SEQ ID NO: 104140 - protein, 11 aa, Artificial Sequence
  Description of Artificial Sequence: Synthetic peptide
  Seed: IIDTTDDATAM (MAGC3_HUMAN)
IADTTDDATAI

SEQ ID NO: 104141 - protein, 9 aa, Artificial Sequence
  Description of Artificial Sequence: Synthetic peptide
  Seed: MQMNVINTY (MAGC3_HUMAN)
MYMNVINTW

SEQ ID NO: 104142 - protein, 10 aa, Artificial Sequence
  Description of Artificial Sequence: Synthetic peptide
  Seed: CASEEVIWEV (MAGC3_HUMAN)
CMSEEVIWET

SEQ ID NO: 104143 - protein, 11 aa, Artificial Sequence
  Description of Artificial Sequence: Synthetic peptide
  Seed: ATFSDGSLGQW (MAGC3_HUMAN)
ATFSDGSLGQR

SEQ ID NO: 104144 - protein, 9 aa, Artificial Sequence
  Description of Artificial Sequence: Synthetic peptide
  Seed: SLVLCPTYF (MAGC3_HUMAN)
SMVLCPTYA

SEQ ID NO: 104145 - protein, 10 aa, Artificial Sequence
  Description of Artificial Sequence: Synthetic peptide
  Seed: TLDEKVDKLV (MAGC3_HUMAN)
TFDEKVDKLL

SEQ ID NO: 104146 - protein, 10 aa, Artificial Sequence
  Description of Artificial Sequence: Synthetic peptide
  Seed: SAFHLGHLRE (MAGC3_HUMAN)
STFHLGHLRT

SEQ ID NO: 104147 - protein, 9 aa, Artificial Sequence
  Description of Artificial Sequence: Synthetic peptide
  Seed: TTDDATAMA (MAGC3_HUMAN)
TSDDATAML

SEQ ID NO: 104148 - protein, 8 aa, Artificial Sequence
  Description of Artificial Sequence: Synthetic peptide
  Seed: IFGKAHEF (MAGC3_HUMAN)
IFGKAHEL

SEQ ID NO: 104149 - protein, 10 aa, Artificial Sequence
  Description of Artificial Sequence: Synthetic peptide
  Seed: LDSCSSPLLW (MAGC3_HUMAN)
LMSCSSPLLF

SEQ ID NO: 104150 - protein, 9 aa, Artificial Sequence
  Description of Artificial Sequence: Synthetic peptide
  Seed: HFYVFVNTL (MAGC3_HUMAN)
HIYVFVNTY

SEQ ID NO: 104151 - protein, 9 aa, Artificial Sequence
  Description of Artificial Sequence: Synthetic peptide
  Seed: YQAKEPLTR (MAGC3_HUMAN)
YQAKEPLTF

SEQ ID NO: 104152 - protein, 9 aa, Artificial Sequence
  Description of Artificial Sequence: Synthetic peptide
  Seed: TLDEKVDKL (MAGC3_HUMAN)
TIDEKVDKL

SEQ ID NO: 104153 - protein, 8 aa, Artificial Sequence
  Description of Artificial Sequence: Synthetic peptide
  Seed: FADVLSRL (MAGC3_HUMAN)
FFDVLSRM

SEQ ID NO: 104154 - protein, 10 aa, Artificial Sequence
  Description of Artificial Sequence: Synthetic peptide
  Seed: LDSCSSPLLW (MAGC3_HUMAN)
LWSCSSPLLW

SEQ ID NO: 104155 - protein, 10 aa, Artificial Sequence
  Description of Artificial Sequence: Synthetic peptide
  Seed: LVLCPTYFKL (MAGC3_HUMAN)
LYLCPTYFKV

SEQ ID NO: 104156 - protein, 11 aa, Artificial Sequence
  Description of Artificial Sequence: Synthetic peptide
  Seed: ATAMASASPSV (MAGC3_HUMAN)
AIAMASASPSV

SEQ ID NO: 104157 - protein, 10 aa, Artificial Sequence
  Description of Artificial Sequence: Synthetic peptide
  Seed: MQMNVINTYT (MAGC3_HUMAN)
MKMNVINTYP

SEQ ID NO: 104158 - protein, 8 aa, Artificial Sequence
  Description of Artificial Sequence: Synthetic peptide
  Seed: FIELIFGI (MAGC3_HUMAN)
FVELIFGV

SEQ ID NO: 104159 - protein, 10 aa, Artificial Sequence
  Description of Artificial Sequence: Synthetic peptide
  Seed: REVLEFLSKL (MAGC3_HUMAN)
REVLEFLSKI

SEQ ID NO: 104160 - protein, 10 aa, Artificial Sequence
  Description of Artificial Sequence: Synthetic peptide
  Seed: RPAREVLEFL (MAGC3_HUMAN)
RGAREVLEFK

SEQ ID NO: 104161 - protein, 9 aa, Artificial Sequence
  Description of Artificial Sequence: Synthetic peptide
  Seed: YTGYFPMIF (MAGC3_HUMAN)
YKGYFPMIM

SEQ ID NO: 104162 - protein, 9 aa, Artificial Sequence
  Description of Artificial Sequence: Synthetic peptide
  Seed: MPAAGMPPL (MAGC3_HUMAN)
MQAAGMPPV

SEQ ID NO: 104163 - protein, 9 aa, Artificial Sequence
  Description of Artificial Sequence: Synthetic peptide
  Seed: MEDRAQAII (MAGC3_HUMAN)
MVDRAQAIM

SEQ ID NO: 104164 - protein, 10 aa, Artificial Sequence
  Description of Artificial Sequence: Synthetic peptide
  Seed: AFPSWYMDAL (MAGC3_HUMAN)
AYPSWYMDAM

SEQ ID NO: 104165 - protein, 10 aa, Artificial Sequence
  Description of Artificial Sequence: Synthetic peptide
  Seed: KVAELVQFLL (MAGC3_HUMAN)
KPAELVQFLW

SEQ ID NO: 104166 - protein, 11 aa, Artificial Sequence
  Description of Artificial Sequence: Synthetic peptide
  Seed: LSKLSSIIPSA (MAGC3_HUMAN)
LFKLSSIIPSI

SEQ ID NO: 104167 - protein, 9 aa, Artificial Sequence
  Description of Artificial Sequence: Synthetic peptide
  Seed: MASASPSVM (MAGC3_HUMAN)
MPSASPSVA

SEQ ID NO: 104168 - protein, 11 aa, Artificial Sequence
  Description of Artificial Sequence: Synthetic peptide
  Seed: ALWESEGPEAF (MAGC3_HUMAN)
AAWESEGPEAW

SEQ ID NO: 104169 - protein, 9 aa, Artificial Sequence
  Description of Artificial Sequence: Synthetic peptide
  Seed: KAHEFIELI (MAGC3_HUMAN)
KIHEFIELK

SEQ ID NO: 104170 - protein, 9 aa, Artificial Sequence
  Description of Artificial Sequence: Synthetic peptide
  Seed: SLPAVSPGK (MAGC3_HUMAN)
STPAVSPGL

SEQ ID NO: 104171 - protein, 10 aa, Artificial Sequence
  Description of Artificial Sequence: Synthetic peptide
  Seed: SDQRMDSLVL (MAGC3_HUMAN)
SEQRMDSLVY

SEQ ID NO: 104172 - protein, 9 aa, Artificial Sequence
  Description of Artificial Sequence: Synthetic peptide
  Seed: AIGPIQRPA (MAGC3_HUMAN)
APGPIQRPV

SEQ ID NO: 104173 - protein, 9 aa, Artificial Sequence
  Description of Artificial Sequence: Synthetic peptide
  Seed: SQPEGKFSL (MAGC3_HUMAN)
SLPEGKFSV

SEQ ID NO: 104174 - protein, 10 aa, Artificial Sequence
  Description of Artificial Sequence: Synthetic peptide
  Seed: IIDTTDDATA (MAGC3_HUMAN)
ISDTTDDATF

SEQ ID NO: 104175 - protein, 10 aa, Artificial Sequence
  Description of Artificial Sequence: Synthetic peptide
  Seed: YALSPVVLPP (MAGC3_HUMAN)
YWLSPVVLPM

SEQ ID NO: 104176 - protein, 9 aa, Artificial Sequence
  Description of Artificial Sequence: Synthetic peptide
  Seed: NTYTGYFPM (MAGC3_HUMAN)
NAYTGYFPY

SEQ ID NO: 104177 - protein, 9 aa, Artificial Sequence
  Description of Artificial Sequence: Synthetic peptide
  Seed: QAKEPLTRA (MAGC3_HUMAN)
QPKEPLTRI

SEQ ID NO: 104178 - protein, 9 aa, Artificial Sequence
  Description of Artificial Sequence: Synthetic peptide
  Seed: VLCPTYFKL (MAGC3_HUMAN)
VLCPTYFKI

SEQ ID NO: 104179 - protein, 8 aa, Artificial Sequence
  Description of Artificial Sequence: Synthetic peptide
  Seed: KVDKLVQF (MAGC3_HUMAN)
KLDKLVQL

SEQ ID NO: 104180 - protein, 9 aa, Artificial Sequence
  Description of Artificial Sequence: Synthetic peptide
  Seed: HLREVRLFL (MAGC3_HUMAN)
HYREVRLFV

SEQ ID NO: 104181 - protein, 9 aa, Artificial Sequence
  Description of Artificial Sequence: Synthetic peptide
  Seed: AAGMPPLPQ (MAGC3_HUMAN)
AAGMPPLPF

SEQ ID NO: 104182 - protein, 9 aa, Artificial Sequence
  Description of Artificial Sequence: Synthetic peptide
  Seed: NTYTGYFPM (MAGC3_HUMAN)
NSYTGYFPL

SEQ ID NO: 104183 - protein, 10 aa, Artificial Sequence
  Description of Artificial Sequence: Synthetic peptide
  Seed: MLTTVIKKYK (MAGC3_HUMAN)
MQTTVIKKYR

SEQ ID NO: 104184 - protein, 9 aa, Artificial Sequence
  Description of Artificial Sequence: Synthetic peptide
  Seed: LIDDQGMPK (MAGC3_HUMAN)
LGDDQGMPM

SEQ ID NO: 104185 - protein, 11 aa, Artificial Sequence
  Description of Artificial Sequence: Synthetic peptide
  Seed: FPMIFGKAHEF (MAGC3_HUMAN)
FAMIFGKAHEY

SEQ ID NO: 104186 - protein, 10 aa, Artificial Sequence
  Description of Artificial Sequence: Synthetic peptide
  Seed: FSDGSLGQWV (MAGC3_HUMAN)
FGDGSLGQWL

SEQ ID NO: 104187 - protein, 9 aa, Artificial Sequence
  Description of Artificial Sequence: Synthetic peptide
  Seed: MEDRAQAII (MAGC3_HUMAN)
MHDRAQAIM

SEQ ID NO: 104188 - protein, 8 aa, Artificial Sequence
  Description of Artificial Sequence: Synthetic peptide
  Seed: KVDKLVQF (MAGC3_HUMAN)
KIDKLVQI

SEQ ID NO: 104189 - protein, 8 aa, Artificial Sequence
  Description of Artificial Sequence: Synthetic peptide
  Seed: KAHEFIEL (MAGC3_HUMAN)
KRHEFIEY

SEQ ID NO: 104190 - protein, 9 aa, Artificial Sequence
  Description of Artificial Sequence: Synthetic peptide
  Seed: LSAIGPIQR (MAGC3_HUMAN)
LVAIGPIQR

SEQ ID NO: 104191 - protein, 9 aa, Artificial Sequence
  Description of Artificial Sequence: Synthetic peptide
  Seed: EFIELIFGI (MAGC3_HUMAN)
EVIELIFGV

SEQ ID NO: 104192 - protein, 9 aa, Artificial Sequence
  Description of Artificial Sequence: Synthetic peptide
  Seed: SASPSVMST (MAGC3_HUMAN)
SLSPSVMSY

SEQ ID NO: 104193 - protein, 9 aa, Artificial Sequence
  Description of Artificial Sequence: Synthetic peptide
  Seed: KVAELVQFL (MAGC3_HUMAN)
KLAELVQFS

SEQ ID NO: 104194 - protein, 9 aa, Artificial Sequence
  Description of Artificial Sequence: Synthetic peptide
  Seed: IIPSAFPSW (MAGC3_HUMAN)
IGPSAFPSL

SEQ ID NO: 104195 - protein, 9 aa, Artificial Sequence
  Description of Artificial Sequence: Synthetic peptide
  Seed: YSAFHLGHL (MAGC3_HUMAN)
YRAFHLGHY

SEQ ID NO: 104196 - protein, 9 aa, Artificial Sequence
  Description of Artificial Sequence: Synthetic peptide
  Seed: FSDGSLGQW (MAGC3_HUMAN)
FMDGSLGQF

SEQ ID NO: 104197 - protein, 9 aa, Artificial Sequence
  Description of Artificial Sequence: Synthetic peptide
  Seed: EVLSAIGPI (MAGC3_HUMAN)
EVLSAIGPM

SEQ ID NO: 104198 - protein, 10 aa, Artificial Sequence
  Description of Artificial Sequence: Synthetic peptide
  Seed: FSDGSLGQWV (MAGC3_HUMAN)
FADGSLGQWI

SEQ ID NO: 104199 - protein, 10 aa, Artificial Sequence
  Description of Artificial Sequence: Synthetic peptide
  Seed: HRQEDGRRGL (MAGC3_HUMAN)
HHQEDGRRGF

SEQ ID NO: 104200 - protein, 10 aa, Artificial Sequence
  Description of Artificial Sequence: Synthetic peptide
  Seed: MNVINTYTGY (MAGC3_HUMAN)
MWVINTYTGY

SEQ ID NO: 104201 - protein, 10 aa, Artificial Sequence
  Description of Artificial Sequence: Synthetic peptide
  Seed: MDPDNHSYFF (MAGC3_HUMAN)
MVPDNHSYFM

SEQ ID NO: 104202 - protein, 10 aa, Artificial Sequence
  Description of Artificial Sequence: Synthetic peptide
  Seed: NTYTGYFPMI (MAGC3_HUMAN)
NLYTGYFPMV

SEQ ID NO: 104203 - protein, 11 aa, Artificial Sequence
  Description of Artificial Sequence: Synthetic peptide
  Seed: ALAGFADVLSR (MAGC3_HUMAN)
AAAGFADVLSL

SEQ ID NO: 104204 - protein, 11 aa, Artificial Sequence
  Description of Artificial Sequence: Synthetic peptide
  Seed: EPQDWPLNEKR (MAGC3_HUMAN)
EVQDWPLNEKR

SEQ ID NO: 104205 - protein, 10 aa, Artificial Sequence
  Description of Artificial Sequence: Synthetic peptide
  Seed: KYKDYFPMIF (MAGC3_HUMAN)
KFKDYFPMIF

SEQ ID NO: 104206 - protein, 9 aa, Artificial Sequence
  Description of Artificial Sequence: Synthetic peptide
  Seed: EVLNAIGPW (MAGC3_HUMAN)
EALNAIGPF

SEQ ID NO: 104207 - protein, 9 aa, Artificial Sequence
  Description of Artificial Sequence: Synthetic peptide
  Seed: KAHEFIELI (MAGC3_HUMAN)
KMHEFIELR

SEQ ID NO: 104208 - protein, 10 aa, Artificial Sequence
  Description of Artificial Sequence: Synthetic peptide
  Seed: LNAIGPWSAL (MAGC3_HUMAN)
LLAIGPWSAY

SEQ ID NO: 104209 - protein, 10 aa, Artificial Sequence
  Description of Artificial Sequence: Synthetic peptide
  Seed: IIDTTDDATA (MAGC3_HUMAN)
IVDTTDDATI

SEQ ID NO: 104210 - protein, 9 aa, Artificial Sequence
  Description of Artificial Sequence: Synthetic peptide
  Seed: YSAFHLGHL (MAGC3_HUMAN)
YMAFHLGHY

SEQ ID NO: 104211 - protein, 11 aa, Artificial Sequence
  Description of Artificial Sequence: Synthetic peptide
  Seed: VLNAIGPWSAL (MAGC3_HUMAN)
VMNAIGPWSAV

SEQ ID NO: 104212 - protein, 10 aa, Artificial Sequence
  Description of Artificial Sequence: Synthetic peptide
  Seed: TDMDPDNHSY (MAGC3_HUMAN)
TIMDPDNHSF

SEQ ID NO: 104213 - protein, 9 aa, Artificial Sequence
  Description of Artificial Sequence: Synthetic peptide
  Seed: TGYFPMIFR (MAGC3_HUMAN)
TMYFPMIFK

SEQ ID NO: 104214 - protein, 9 aa, Artificial Sequence
  Description of Artificial Sequence: Synthetic peptide
  Seed: IIPSAFPSW (MAGC3_HUMAN)
IQPSAFPSY

SEQ ID NO: 104215 - protein, 9 aa, Artificial Sequence
  Description of Artificial Sequence: Synthetic peptide
  Seed: DTTDDATAM (MAGC3_HUMAN)
DTTDDATAW

SEQ ID NO: 104216 - protein, 11 aa, Artificial Sequence
  Description of Artificial Sequence: Synthetic peptide
  Seed: VVLPPQPQPRK (MAGC3_HUMAN)
VMLPPQPQPRR

SEQ ID NO: 104217 - protein, 10 aa, Artificial Sequence
  Description of Artificial Sequence: Synthetic peptide
  Seed: FADVLSRLAL (MAGC3_HUMAN)
FPDVLSRLAA

SEQ ID NO: 104218 - protein, 9 aa, Artificial Sequence
  Description of Artificial Sequence: Synthetic peptide
  Seed: KEPLTRAEM (MAGC3_HUMAN)
KRPLTRAEM

SEQ ID NO: 104219 - protein, 9 aa, Artificial Sequence
  Description of Artificial Sequence: Synthetic peptide
  Seed: YSAFHLGHL (MAGC3_HUMAN)
YMAFHLGHL

SEQ ID NO: 104220 - protein, 9 aa, Artificial Sequence
  Description of Artificial Sequence: Synthetic peptide
  Seed: GFADVLSRL (MAGC3_HUMAN)
GAADVLSRL

SEQ ID NO: 104221 - protein, 9 aa, Artificial Sequence
  Description of Artificial Sequence: Synthetic peptide
  Seed: EKVDKLVQF (MAGC3_HUMAN)
EVVDKLVQY

SEQ ID NO: 104222 - protein, 8 aa, Artificial Sequence
  Description of Artificial Sequence: Synthetic peptide
  Seed: YALSPVVL (MAGC3_HUMAN)
YALSPVVY

SEQ ID NO: 104223 - protein, 9 aa, Artificial Sequence
  Description of Artificial Sequence: Synthetic peptide
  Seed: YFPMIFRKA (MAGC3_HUMAN)
YFPMIFRKM

SEQ ID NO: 104224 - protein, 9 aa, Artificial Sequence
  Description of Artificial Sequence: Synthetic peptide
  Seed: RGTGYTLSL (MAGC3_HUMAN)
RLTGYTLSW

SEQ ID NO: 104225 - protein, 11 aa, Artificial Sequence
  Description of Artificial Sequence: Synthetic peptide
  Seed: FPMIFGKAHEF (MAGC3_HUMAN)
FPMIFGKAHEW

SEQ ID NO: 104226 - protein, 10 aa, Artificial Sequence
  Description of Artificial Sequence: Synthetic peptide
  Seed: FPSWYMDALK (MAGC3_HUMAN)
FRSWYMDALR

SEQ ID NO: 104227 - protein, 11 aa, Artificial Sequence
  Description of Artificial Sequence: Synthetic peptide
  Seed: ILFGISLTEVD (MAGC3_HUMAN)
IMFGISLTEVC

SEQ ID NO: 104228 - protein, 10 aa, Artificial Sequence
  Description of Artificial Sequence: Synthetic peptide
  Seed: IELIFGIALT (MAGC3_HUMAN)
IILIFGIALV

SEQ ID NO: 104229 - protein, 9 aa, Artificial Sequence
  Description of Artificial Sequence: Synthetic peptide
  Seed: YSAFHLGHL (MAGC3_HUMAN)
YAAFHLGHF

SEQ ID NO: 104230 - protein, 9 aa, Artificial Sequence
  Description of Artificial Sequence: Synthetic peptide
  Seed: ADVLSRLAL (MAGC3_HUMAN)
AEVLSRLAI

SEQ ID NO: 104231 - protein, 9 aa, Artificial Sequence
  Description of Artificial Sequence: Synthetic peptide
  Seed: ATYALSPVV (MAGC3_HUMAN)
AMYALSPVF

SEQ ID NO: 104232 - protein, 9 aa, Artificial Sequence
  Description of Artificial Sequence: Synthetic peptide
  Seed: SLRRAVSVK (MAGC3_HUMAN)
SMRRAVSVK

SEQ ID NO: 104233 - protein, 9 aa, Artificial Sequence
  Description of Artificial Sequence: Synthetic peptide
  Seed: ALDEKVAEL (MAGC3_HUMAN)
AADEKVAEW

SEQ ID NO: 104234 - protein, 10 aa, Artificial Sequence
  Description of Artificial Sequence: Synthetic peptide
  Seed: KLVQFLLLKY (MAGC3_HUMAN)
KMVQFLLLKK

SEQ ID NO: 104235 - protein, 9 aa, Artificial Sequence
  Description of Artificial Sequence: Synthetic peptide
  Seed: MASASPSVM (MAGC3_HUMAN)
MFSASPSVI

SEQ ID NO: 104236 - protein, 11 aa, Artificial Sequence
  Description of Artificial Sequence: Synthetic peptide
  Seed: YALDEKVAELV (MAGC3_HUMAN)
YMLDEKVAELN

SEQ ID NO: 104237 - protein, 9 aa, Artificial Sequence
  Description of Artificial Sequence: Synthetic peptide
  Seed: FVNTLDLTC (MAGC3_HUMAN)
FSNTLDLTM

SEQ ID NO: 104238 - protein, 9 aa, Artificial Sequence
  Description of Artificial Sequence: Synthetic peptide
  Seed: VIWEVLSAI (MAGC3_HUMAN)
VSWEVLSAR

SEQ ID NO: 104239 - protein, 9 aa, Artificial Sequence
  Description of Artificial Sequence: Synthetic peptide
  Seed: ALDEKVAEL (MAGC3_HUMAN)
ACDEKVAEL

SEQ ID NO: 104240 - protein, 9 aa, Artificial Sequence
  Description of Artificial Sequence: Synthetic peptide
  Seed: LSDEQGMPQ (MAGC3_HUMAN)
LLDEQGMPF

SEQ ID NO: 104241 - protein, 10 aa, Artificial Sequence
  Description of Artificial Sequence: Synthetic peptide
  Seed: FFEDTLDLTY (MAGC3_HUMAN)
FAEDTLDLTI

SEQ ID NO: 104242 - protein, 11 aa, Artificial Sequence
  Description of Artificial Sequence: Synthetic peptide
  Seed: KKYKDYFPMIF (MAGC3_HUMAN)
KQYKDYFPMIY

SEQ ID NO: 104243 - protein, 9 aa, Artificial Sequence
  Description of Artificial Sequence: Synthetic peptide
  Seed: NTYTGYFPM (MAGC3_HUMAN)
NRYTGYFPY

SEQ ID NO: 104244 - protein, 9 aa, Artificial Sequence
  Description of Artificial Sequence: Synthetic peptide
  Seed: TAMASASPS (MAGC3_HUMAN)
TPMASASPA

SEQ ID NO: 104245 - protein, 10 aa, Artificial Sequence
  Description of Artificial Sequence: Synthetic peptide
  Seed: FPSWYMDALK (MAGC3_HUMAN)
FNSWYMDALK

SEQ ID NO: 104246 - protein, 9 aa, Artificial Sequence
  Description of Artificial Sequence: Synthetic peptide
  Seed: YSAFHLGHL (MAGC3_HUMAN)
YIAFHLGHA

SEQ ID NO: 104247 - protein, 9 aa, Artificial Sequence
  Description of Artificial Sequence: Synthetic peptide
  Seed: AIGPWSALA (MAGC3_HUMAN)
AVGPWSALV

SEQ ID NO: 104248 - protein, 10 aa, Artificial Sequence
  Description of Artificial Sequence: Synthetic peptide
  Seed: FIELIFGIAL (MAGC3_HUMAN)
FEELIFGIAM

SEQ ID NO: 104249 - protein, 9 aa, Artificial Sequence
  Description of Artificial Sequence: Synthetic peptide
  Seed: YFFEDTLDL (MAGC3_HUMAN)
YSFEDTLDY

SEQ ID NO: 104250 - protein, 9 aa, Artificial Sequence
  Description of Artificial Sequence: Synthetic peptide
  Seed: SIIPSAFPS (MAGC3_HUMAN)
SMIPSAFPL

SEQ ID NO: 104251 - protein, 9 aa, Artificial Sequence
  Description of Artificial Sequence: Synthetic peptide
  Seed: NTYTGYFPM (MAGC3_HUMAN)
NQYTGYFPY

SEQ ID NO: 104252 - protein, 9 aa, Artificial Sequence
  Description of Artificial Sequence: Synthetic peptide
  Seed: ALAGFADVL (MAGC3_HUMAN)
AQAGFADVF

SEQ ID NO: 104253 - protein, 9 aa, Artificial Sequence
  Description of Artificial Sequence: Synthetic peptide
  Seed: MQMNVINTY (MAGC3_HUMAN)
MNMNVINTY

SEQ ID NO: 104254 - protein, 9 aa, Artificial Sequence
  Description of Artificial Sequence: Synthetic peptide
  Seed: AGFADVLSR (MAGC3_HUMAN)
ATFADVLSY

SEQ ID NO: 104255 - protein, 9 aa, Artificial Sequence
  Description of Artificial Sequence: Synthetic peptide
  Seed: EVLNAIGPW (MAGC3_HUMAN)
ESLNAIGPR

SEQ ID NO: 104256 - protein, 9 aa, Artificial Sequence
  Description of Artificial Sequence: Synthetic peptide
  Seed: VLPPQPQPR (MAGC3_HUMAN)
VAPPQPQPL

SEQ ID NO: 104257 - protein, 10 aa, Artificial Sequence
  Description of Artificial Sequence: Synthetic peptide
  Seed: TLWKDSDLPT (MAGC3_HUMAN)
TMWKDSDLPV

SEQ ID NO: 104258 - protein, 10 aa, Artificial Sequence
  Description of Artificial Sequence: Synthetic peptide
  Seed: EKVAELVQFL (MAGC3_HUMAN)
EIVAELVQFY

SEQ ID NO: 104259 - protein, 10 aa, Artificial Sequence
  Description of Artificial Sequence: Synthetic peptide
  Seed: YALDEKVAEL (MAGC3_HUMAN)
YSLDEKVAEL

SEQ ID NO: 104260 - protein, 9 aa, Artificial Sequence
  Description of Artificial Sequence: Synthetic peptide
  Seed: LIDDQGMPK (MAGC3_HUMAN)
LCDDQGMPL

SEQ ID NO: 104261 - protein, 9 aa, Artificial Sequence
  Description of Artificial Sequence: Synthetic peptide
  Seed: LSDEQGMPQ (MAGC3_HUMAN)
LLDEQGMPL

SEQ ID NO: 104262 - protein, 11 aa, Artificial Sequence
  Description of Artificial Sequence: Synthetic peptide
  Seed: DLHFGSQPEGK (MAGC3_HUMAN)
DVHFGSQPEGR

SEQ ID NO: 104263 - protein, 9 aa, Artificial Sequence
  Description of Artificial Sequence: Synthetic peptide
  Seed: ATYALSPVV (MAGC3_HUMAN)
AMYALSPVW

SEQ ID NO: 104264 - protein, 10 aa, Artificial Sequence
  Description of Artificial Sequence: Synthetic peptide
  Seed: FKLWRTLSGS (MAGC3_HUMAN)
FVLWRTLSGI

SEQ ID NO: 104265 - protein, 9 aa, Artificial Sequence
  Description of Artificial Sequence: Synthetic peptide
  Seed: ALDEKVAEL (MAGC3_HUMAN)
AMDEKVAEL

SEQ ID NO: 104266 - protein, 9 aa, Artificial Sequence
  Description of Artificial Sequence: Synthetic peptide
  Seed: LKYQTKEPV (MAGC3_HUMAN)
LHYQTKEPV

SEQ ID NO: 104267 - protein, 9 aa, Artificial Sequence
  Description of Artificial Sequence: Synthetic peptide
  Seed: AMASASPSV (MAGC3_HUMAN)
ALASASPSM

SEQ ID NO: 104268 - protein, 10 aa, Artificial Sequence
  Description of Artificial Sequence: Synthetic peptide
  Seed: EVLSAIGPIQ (MAGC3_HUMAN)
EMLSAIGPIR

SEQ ID NO: 104269 - protein, 10 aa, Artificial Sequence
  Description of Artificial Sequence: Synthetic peptide
  Seed: MDPDNHSYFF (MAGC3_HUMAN)
MPPDNHSYFY

SEQ ID NO: 104270 - protein, 9 aa, Artificial Sequence
  Description of Artificial Sequence: Synthetic peptide
  Seed: EFLSKLSSI (MAGC3_HUMAN)
EPLSKLSSL

SEQ ID NO: 104271 - protein, 10 aa, Artificial Sequence
  Description of Artificial Sequence: Synthetic peptide
  Seed: MDPDNHSYFF (MAGC3_HUMAN)
MSPDNHSYFM

SEQ ID NO: 104272 - protein, 10 aa, Artificial Sequence
  Description of Artificial Sequence: Synthetic peptide
  Seed: YALSPVVLPP (MAGC3_HUMAN)
YCLSPVVLPT

SEQ ID NO: 104273 - protein, 11 aa, Artificial Sequence
  Description of Artificial Sequence: Synthetic peptide
  Seed: ALWESEGPEAF (MAGC3_HUMAN)
AAWESEGPEAF

SEQ ID NO: 104274 - protein, 10 aa, Artificial Sequence
  Description of Artificial Sequence: Synthetic peptide
  Seed: ATYALSPVVL (MAGC3_HUMAN)
AMYALSPVVL

SEQ ID NO: 104275 - protein, 10 aa, Artificial Sequence
  Description of Artificial Sequence: Synthetic peptide
  Seed: FSDGSLGQWV (MAGC3_HUMAN)
FLDGSLGQWF

SEQ ID NO: 104276 - protein, 11 aa, Artificial Sequence
  Description of Artificial Sequence: Synthetic peptide
  Seed: LTDMDPDNHSY (MAGC3_HUMAN)
LIDMDPDNHSL

SEQ ID NO: 104277 - protein, 8 aa, Artificial Sequence
  Description of Artificial Sequence: Synthetic peptide
  Seed: MPPLPQSP (MAGC3_HUMAN)
MPPLPQSA

SEQ ID NO: 104278 - protein, 11 aa, Artificial Sequence
  Description of Artificial Sequence: Synthetic peptide
  Seed: TTDDATAMASA (MAGC3_HUMAN)
TNDDATAMASY

SEQ ID NO: 104279 - protein, 9 aa, Artificial Sequence
  Description of Artificial Sequence: Synthetic peptide
  Seed: YQTKEPVTK (MAGC3_HUMAN)
YVTKEPVTF

SEQ ID NO: 104280 - protein, 9 aa, Artificial Sequence
  Description of Artificial Sequence: Synthetic peptide
  Seed: SAEGSVLDL (MAGC3_HUMAN)
STEGSVLDL

SEQ ID NO: 104281 - protein, 9 aa, Artificial Sequence
  Description of Artificial Sequence: Synthetic peptide
  Seed: LVLCPTYFK (MAGC3_HUMAN)
LGLCPTYFR

SEQ ID NO: 104282 - protein, 9 aa, Artificial Sequence
  Description of Artificial Sequence: Synthetic peptide
  Seed: KVAELVQFL (MAGC3_HUMAN)
KSAELVQFF

SEQ ID NO: 104283 - protein, 9 aa, Artificial Sequence
  Description of Artificial Sequence: Synthetic peptide
  Seed: LSRLALWES (MAGC3_HUMAN)
LYRLALWEK

SEQ ID NO: 104284 - protein, 10 aa, Artificial Sequence
  Description of Artificial Sequence: Synthetic peptide
  Seed: WEVLSAIGPI (MAGC3_HUMAN)
WVVLSAIGPV

SEQ ID NO: 104285 - protein, 10 aa, Artificial Sequence
  Description of Artificial Sequence: Synthetic peptide
  Seed: EVIWEVLSAI (MAGC3_HUMAN)
ELIWEVLSAA

SEQ ID NO: 104286 - protein, 10 aa, Artificial Sequence
  Description of Artificial Sequence: Synthetic peptide
  Seed: KVAELVQFLL (MAGC3_HUMAN)
KLAELVQFLF

SEQ ID NO: 104287 - protein, 9 aa, Artificial Sequence
  Description of Artificial Sequence: Synthetic peptide
  Seed: KFSLRRAVS (MAGC3_HUMAN)
KGSLRRAVK

SEQ ID NO: 104288 - protein, 9 aa, Artificial Sequence
  Description of Artificial Sequence: Synthetic peptide
  Seed: AEMLTTVIK (MAGC3_HUMAN)
AEMLTTVIA

SEQ ID NO: 104289 - protein, 9 aa, Artificial Sequence
  Description of Artificial Sequence: Synthetic peptide
  Seed: GFADVLSRL (MAGC3_HUMAN)
GRADVLSRL

SEQ ID NO: 104290 - protein, 10 aa, Artificial Sequence
  Description of Artificial Sequence: Synthetic peptide
  Seed: RSAEGSVLDL (MAGC3_HUMAN)
RTAEGSVLDL

SEQ ID NO: 104291 - protein, 10 aa, Artificial Sequence
  Description of Artificial Sequence: Synthetic peptide
  Seed: FKLWRTLSGS (MAGC3_HUMAN)
FMLWRTLSGV

SEQ ID NO: 104292 - protein, 11 aa, Artificial Sequence
  Description of Artificial Sequence: Synthetic peptide
  Seed: IIDTTDDATAM (MAGC3_HUMAN)
ITDTTDDATAY

SEQ ID NO: 104293 - protein, 9 aa, Artificial Sequence
  Description of Artificial Sequence: Synthetic peptide
  Seed: SQPEGKFSL (MAGC3_HUMAN)
SHPEGKFSI

SEQ ID NO: 104294 - protein, 10 aa, Artificial Sequence
  Description of Artificial Sequence: Synthetic peptide
  Seed: TLDEKVDKLV (MAGC3_HUMAN)
TLDEKVDKLF

SEQ ID NO: 104295 - protein, 10 aa, Artificial Sequence
  Description of Artificial Sequence: Synthetic peptide
  Seed: LNAIGPWSAL (MAGC3_HUMAN)
LQAIGPWSAM

SEQ ID NO: 104296 - protein, 10 aa, Artificial Sequence
  Description of Artificial Sequence: Synthetic peptide
  Seed: MNVINTYTGY (MAGC3_HUMAN)
MPVINTYTGY

SEQ ID NO: 104297 - protein, 11 aa, Artificial Sequence
  Description of Artificial Sequence: Synthetic peptide
  Seed: SASPSVMSTNF (MAGC3_HUMAN)
SISPSVMSTNW

SEQ ID NO: 104298 - protein, 10 aa, Artificial Sequence
  Description of Artificial Sequence: Synthetic peptide
  Seed: LLPCHWVLDA (MAGC3_HUMAN)
LLPCHWVLDV

SEQ ID NO: 104299 - protein, 9 aa, Artificial Sequence
  Description of Artificial Sequence: Synthetic peptide
  Seed: EKVDKLVQF (MAGC3_HUMAN)
EQVDKLVQL

SEQ ID NO: 104300 - protein, 9 aa, Artificial Sequence
  Description of Artificial Sequence: Synthetic peptide
  Seed: HLREVRLFL (MAGC3_HUMAN)
HMREVRLFG

SEQ ID NO: 104301 - protein, 9 aa, Artificial Sequence
  Description of Artificial Sequence: Synthetic peptide
  Seed: ASEEVIWEV (MAGC3_HUMAN)
AVEEVIWEI

SEQ ID NO: 104302 - protein, 9 aa, Artificial Sequence
  Description of Artificial Sequence: Synthetic peptide
  Seed: LKYQAKEPL (MAGC3_HUMAN)
LQYQAKEPW

SEQ ID NO: 104303 - protein, 10 aa, Artificial Sequence
  Description of Artificial Sequence: Synthetic peptide
  Seed: LNAIGPWSAL (MAGC3_HUMAN)
LFAIGPWSAL

SEQ ID NO: 104304 - protein, 9 aa, Artificial Sequence
  Description of Artificial Sequence: Synthetic peptide
  Seed: LILILSMIF (MAGC3_HUMAN)
LTLILSMIF

SEQ ID NO: 104305 - protein, 9 aa, Artificial Sequence
  Description of Artificial Sequence: Synthetic peptide
  Seed: ASEEVIWEV (MAGC3_HUMAN)
ATEEVIWEV

SEQ ID NO: 104306 - protein, 10 aa, Artificial Sequence
  Description of Artificial Sequence: Synthetic peptide
  Seed: AFPSWYMDAL (MAGC3_HUMAN)
AMPSWYMDAY

SEQ ID NO: 104307 - protein, 10 aa, Artificial Sequence
  Description of Artificial Sequence: Synthetic peptide
  Seed: YALDEKVAEL (MAGC3_HUMAN)
YKLDEKVAEC

SEQ ID NO: 104308 - protein, 9 aa, Artificial Sequence
  Description of Artificial Sequence: Synthetic peptide
  Seed: RRGTGYTLS (MAGC3_HUMAN)
RRGTGYTLL

SEQ ID NO: 104309 - protein, 8 aa, Artificial Sequence
  Description of Artificial Sequence: Synthetic peptide
  Seed: FIELIFGI (MAGC3_HUMAN)
FQELIFGV

SEQ ID NO: 104310 - protein, 11 aa, Artificial Sequence
  Description of Artificial Sequence: Synthetic peptide
  Seed: ALAGFADVLSR (MAGC3_HUMAN)
AAAGFADVLSK

SEQ ID NO: 104311 - protein, 9 aa, Artificial Sequence
  Description of Artificial Sequence: Synthetic peptide
  Seed: MDPDNHSYF (MAGC3_HUMAN)
MMPDNHSYM

SEQ ID NO: 104312 - protein, 9 aa, Artificial Sequence
  Description of Artificial Sequence: Synthetic peptide
  Seed: DPDNHSYFF (MAGC3_HUMAN)
DADNHSYFY

SEQ ID NO: 104313 - protein, 9 aa, Artificial Sequence
  Description of Artificial Sequence: Synthetic peptide
  Seed: SAIGPIQRP (MAGC3_HUMAN)
SQIGPIQRY

SEQ ID NO: 104314 - protein, 9 aa, Artificial Sequence
  Description of Artificial Sequence: Synthetic peptide
  Seed: IIPSAFPSW (MAGC3_HUMAN)
IVPSAFPSW

SEQ ID NO: 104315 - protein, 9 aa, Artificial Sequence
  Description of Artificial Sequence: Synthetic peptide
  Seed: EFLSKLSSI (MAGC3_HUMAN)
EMLSKLSSL

SEQ ID NO: 104316 - protein, 11 aa, Artificial Sequence
  Description of Artificial Sequence: Synthetic peptide
  Seed: SAIGPIQRPAR (MAGC3_HUMAN)
STIGPIQRPAK

SEQ ID NO: 104317 - protein, 9 aa, Artificial Sequence
  Description of Artificial Sequence: Synthetic peptide
  Seed: TLDEKVDKL (MAGC3_HUMAN)
THDEKVDKV

SEQ ID NO: 104318 - protein, 9 aa, Artificial Sequence
  Description of Artificial Sequence: Synthetic peptide
  Seed: FPMIFRKAR (MAGC3_HUMAN)
FPMIFRKAT

SEQ ID NO: 104319 - protein, 11 aa, Artificial Sequence
  Description of Artificial Sequence: Synthetic peptide
  Seed: LSKLSSIIPSA (MAGC3_HUMAN)
LDKLSSIIPSI

SEQ ID NO: 104320 - protein, 9 aa, Artificial Sequence
  Description of Artificial Sequence: Synthetic peptide
  Seed: SESLPRYAL (MAGC3_HUMAN)
SESLPRYAC

SEQ ID NO: 104321 - protein, 9 aa, Artificial Sequence
  Description of Artificial Sequence: Synthetic peptide
  Seed: HSYFFEDTL (MAGC3_HUMAN)
HQYFFEDTY

SEQ ID NO: 104322 - protein, 10 aa, Artificial Sequence
  Description of Artificial Sequence: Synthetic peptide
  Seed: AMASASPSVM (MAGC3_HUMAN)
ALASASPSVM

SEQ ID NO: 104323 - protein, 10 aa, Artificial Sequence
  Description of Artificial Sequence: Synthetic peptide
  Seed: YALDEKVAEL (MAGC3_HUMAN)
YHLDEKVAEM

SEQ ID NO: 104324 - protein, 10 aa, Artificial Sequence
  Description of Artificial Sequence: Synthetic peptide
  Seed: IELIFGIALT (MAGC3_HUMAN)
IWLIFGIALL

SEQ ID NO: 104325 - protein, 10 aa, Artificial Sequence
  Description of Artificial Sequence: Synthetic peptide
  Seed: FKLWRTLSGS (MAGC3_HUMAN)
FTLWRTLSGL

SEQ ID NO: 104326 - protein, 11 aa, Artificial Sequence
  Description of Artificial Sequence: Synthetic peptide
  Seed: ALAGFADVLSR (MAGC3_HUMAN)
ATAGFADVLSY

SEQ ID NO: 104327 - protein, 9 aa, Artificial Sequence
  Description of Artificial Sequence: Synthetic peptide
  Seed: KNCLLILIL (MAGC3_HUMAN)
KQCLLILIL

SEQ ID NO: 104328 - protein, 10 aa, Artificial Sequence
  Description of Artificial Sequence: Synthetic peptide
  Seed: TAMASASPSV (MAGC3_HUMAN)
TPMASASPSL

SEQ ID NO: 104329 - protein, 10 aa, Artificial Sequence
  Description of Artificial Sequence: Synthetic peptide
  Seed: YALDEKVAEL (MAGC3_HUMAN)
YFLDEKVAEF

SEQ ID NO: 104330 - protein, 9 aa, Artificial Sequence
  Description of Artificial Sequence: Synthetic peptide
  Seed: KYKDYFPMI (MAGC3_HUMAN)
KIKDYFPML

SEQ ID NO: 104331 - protein, 9 aa, Artificial Sequence
  Description of Artificial Sequence: Synthetic peptide
  Seed: IIPSAFPSW (MAGC3_HUMAN)
IVPSAFPSY

SEQ ID NO: 104332 - protein, 10 aa, Artificial Sequence
  Description of Artificial Sequence: Synthetic peptide
  Seed: YALDEKVAEL (MAGC3_HUMAN)
YQLDEKVAEY

SEQ ID NO: 104333 - protein, 10 aa, Artificial Sequence
  Description of Artificial Sequence: Synthetic peptide
  Seed: GLRSAEGSVL (MAGC3_HUMAN)
GMRSAEGSVY

SEQ ID NO: 104334 - protein, 9 aa, Artificial Sequence
  Description of Artificial Sequence: Synthetic peptide
  Seed: KVAELVQFL (MAGC3_HUMAN)
KIAELVQFR

SEQ ID NO: 104335 - protein, 10 aa, Artificial Sequence
  Description of Artificial Sequence: Synthetic peptide
  Seed: SDQRMDSLVL (MAGC3_HUMAN)
SYQRMDSLVF

SEQ ID NO: 104336 - protein, 9 aa, Artificial Sequence
  Description of Artificial Sequence: Synthetic peptide
  Seed: MIFGKAHEF (MAGC3_HUMAN)
MAFGKAHEW

SEQ ID NO: 104337 - protein, 10 aa, Artificial Sequence
  Description of Artificial Sequence: Synthetic peptide
  Seed: TLDEKVDKLV (MAGC3_HUMAN)
TSDEKVDKLF

SEQ ID NO: 104338 - protein, 10 aa, Artificial Sequence
  Description of Artificial Sequence: Synthetic peptide
  Seed: MIFGKAHEFI (MAGC3_HUMAN)
MQFGKAHEFL

SEQ ID NO: 104339 - protein, 10 aa, Artificial Sequence
  Description of Artificial Sequence: Synthetic peptide
  Seed: SALAGFADVL (MAGC3_HUMAN)
SWLAGFADVL

SEQ ID NO: 104340 - protein, 9 aa, Artificial Sequence
  Description of Artificial Sequence: Synthetic peptide
  Seed: SLRRAVSVK (MAGC3_HUMAN)
SVRRAVSVS

SEQ ID NO: 104341 - protein, 10 aa, Artificial Sequence
  Description of Artificial Sequence: Synthetic peptide
  Seed: WEVLSAIGPI (MAGC3_HUMAN)
WEVLSAIGPV

SEQ ID NO: 104342 - protein, 9 aa, Artificial Sequence
  Description of Artificial Sequence: Synthetic peptide
  Seed: YFFEDTLDL (MAGC3_HUMAN)
YMFEDTLDF

SEQ ID NO: 104343 - protein, 9 aa, Artificial Sequence
  Description of Artificial Sequence: Synthetic peptide
  Seed: GFADVLSRL (MAGC3_HUMAN)
GMADVLSRC

SEQ ID NO: 104344 - protein, 9 aa, Artificial Sequence
  Description of Artificial Sequence: Synthetic peptide
  Seed: SASPSVMST (MAGC3_HUMAN)
SFSPSVMSL

SEQ ID NO: 104345 - protein, 9 aa, Artificial Sequence
  Description of Artificial Sequence: Synthetic peptide
  Seed: VIWEVLSAI (MAGC3_HUMAN)
VIWEVLSAW

SEQ ID NO: 104346 - protein, 9 aa, Artificial Sequence
  Description of Artificial Sequence: Synthetic peptide
  Seed: IIDTTDDAT (MAGC3_HUMAN)
ISDTTDDAF

SEQ ID NO: 104347 - protein, 9 aa, Artificial Sequence
  Description of Artificial Sequence: Synthetic peptide
  Seed: HFYVFVNTL (MAGC3_HUMAN)
HNYVFVNTI

SEQ ID NO: 104348 - protein, 11 aa, Artificial Sequence
  Description of Artificial Sequence: Synthetic peptide
  Seed: RYALDEKVAEL (MAGC3_HUMAN)
RDALDEKVAEV

SEQ ID NO: 104349 - protein, 11 aa, Artificial Sequence
  Description of Artificial Sequence: Synthetic peptide
  Seed: RYALDEKVAEL (MAGC3_HUMAN)
RMALDEKVAEI

SEQ ID NO: 104350 - protein, 10 aa, Artificial Sequence
  Description of Artificial Sequence: Synthetic peptide
  Seed: LPTWRRGTGY (MAGC3_HUMAN)
LCTWRRGTGW

SEQ ID NO: 104351 - protein, 9 aa, Artificial Sequence
  Description of Artificial Sequence: Synthetic peptide
  Seed: MASASPSVM (MAGC3_HUMAN)
MRSASPSVL

SEQ ID NO: 104352 - protein, 9 aa, Artificial Sequence
  Description of Artificial Sequence: Synthetic peptide
  Seed: LANPQGLAG (MAGC3_HUMAN)
LTNPQGLAI

SEQ ID NO: 104353 - protein, 8 aa, Artificial Sequence
  Description of Artificial Sequence: Synthetic peptide
  Seed: TTDDATAM (MAGC3_HUMAN)
TCDDATAL

SEQ ID NO: 104354 - protein, 9 aa, Artificial Sequence
  Description of Artificial Sequence: Synthetic peptide
  Seed: FPSWYMDAL (MAGC3_HUMAN)
FTSWYMDAM

SEQ ID NO: 104355 - protein, 9 aa, Artificial Sequence
  Description of Artificial Sequence: Synthetic peptide
  Seed: YSAFHLGHL (MAGC3_HUMAN)
YRAFHLGHM

SEQ ID NO: 104356 - protein, 8 aa, Artificial Sequence
  Description of Artificial Sequence: Synthetic peptide
  Seed: YMDALKDM (MAGC3_HUMAN)
YTDALKDM

SEQ ID NO: 104357 - protein, 10 aa, Artificial Sequence
  Description of Artificial Sequence: Synthetic peptide
  Seed: SQPEGKFSLR (MAGC3_HUMAN)
SAPEGKFSLK

SEQ ID NO: 104358 - protein, 9 aa, Artificial Sequence
  Description of Artificial Sequence: Synthetic peptide
  Seed: CATYALSPV (MAGC3_HUMAN)
CATYALSPL

SEQ ID NO: 104359 - protein, 9 aa, Artificial Sequence
  Description of Artificial Sequence: Synthetic peptide
  Seed: LRSAEGSVL (MAGC3_HUMAN)
LMSAEGSVI

SEQ ID NO: 104360 - protein, 9 aa, Artificial Sequence
  Description of Artificial Sequence: Synthetic peptide
  Seed: FHLGHLREV (MAGC3_HUMAN)
FGLGHLREL

SEQ ID NO: 104361 - protein, 9 aa, Artificial Sequence
  Description of Artificial Sequence: Synthetic peptide
  Seed: MIFGKAHEF (MAGC3_HUMAN)
MWFGKAHEI

SEQ ID NO: 104362 - protein, 9 aa, Artificial Sequence
  Description of Artificial Sequence: Synthetic peptide
  Seed: YKDYFPMIF (MAGC3_HUMAN)
YGDYFPMIY

SEQ ID NO: 104363 - protein, 9 aa, Artificial Sequence
  Description of Artificial Sequence: Synthetic peptide
  Seed: KQREEPQDW (MAGC3_HUMAN)
KAREEPQDW

SEQ ID NO: 104364 - protein, 9 aa, Artificial Sequence
  Description of Artificial Sequence: Synthetic peptide
  Seed: MIFGKAHEF (MAGC3_HUMAN)
MYFGKAHEF

SEQ ID NO: 104365 - protein, 10 aa, Artificial Sequence
  Description of Artificial Sequence: Synthetic peptide
  Seed: MNVINTYTGY (MAGC3_HUMAN)
MFVINTYTGF

SEQ ID NO: 104366 - protein, 9 aa, Artificial Sequence
  Description of Artificial Sequence: Synthetic peptide
  Seed: FKLWRTLSG (MAGC3_HUMAN)
FMLWRTLSH

SEQ ID NO: 104367 - protein, 9 aa, Artificial Sequence
  Description of Artificial Sequence: Synthetic peptide
  Seed: MASASPSVM (MAGC3_HUMAN)
MGSASPSVY

SEQ ID NO: 104368 - protein, 9 aa, Artificial Sequence
  Description of Artificial Sequence: Synthetic peptide
  Seed: YTGYFPMIF (MAGC3_HUMAN)
YKGYFPMIF

SEQ ID NO: 104369 - protein, 9 aa, Artificial Sequence
  Description of Artificial Sequence: Synthetic peptide
  Seed: AMASASPSV (MAGC3_HUMAN)
AMASASPSW

SEQ ID NO: 104370 - protein, 10 aa, Artificial Sequence
  Description of Artificial Sequence: Synthetic peptide
  Seed: TGYFPMIFRK (MAGC3_HUMAN)
TVYFPMIFRY

SEQ ID NO: 104371 - protein, 10 aa, Artificial Sequence
  Description of Artificial Sequence: Synthetic peptide
  Seed: NTYTGYFPMI (MAGC3_HUMAN)
NTYTGYFPML

SEQ ID NO: 104372 - protein, 9 aa, Artificial Sequence
  Description of Artificial Sequence: Synthetic peptide
  Seed: KVAELVQFL (MAGC3_HUMAN)
KVAELVQFI

SEQ ID NO: 104373 - protein, 9 aa, Artificial Sequence
  Description of Artificial Sequence: Synthetic peptide
  Seed: FSDGSLGQW (MAGC3_HUMAN)
FFDGSLGQL

SEQ ID NO: 104374 - protein, 9 aa, Artificial Sequence
  Description of Artificial Sequence: Synthetic peptide
  Seed: SPSVMSTNF (MAGC3_HUMAN)
SMSVMSTNY

SEQ ID NO: 104375 - protein, 9 aa, Artificial Sequence
  Description of Artificial Sequence: Synthetic peptide
  Seed: ALAGFADVL (MAGC3_HUMAN)
ALAGFADVA

SEQ ID NO: 104376 - protein, 8 aa, Artificial Sequence
  Description of Artificial Sequence: Synthetic peptide
  Seed: MEDRAQAI (MAGC3_HUMAN)
MSDRAQAF

SEQ ID NO: 104377 - protein, 10 aa, Artificial Sequence
  Description of Artificial Sequence: Synthetic peptide
  Seed: ILFGISLTEV (MAGC3_HUMAN)
ILFGISLTEM

SEQ ID NO: 104378 - protein, 9 aa, Artificial Sequence
  Description of Artificial Sequence: Synthetic peptide
  Seed: KLSSIIPSA (MAGC3_HUMAN)
KGSSIIPSK

SEQ ID NO: 104379 - protein, 10 aa, Artificial Sequence
  Description of Artificial Sequence: Synthetic peptide
  Seed: CSSPLLWTRL (MAGC3_HUMAN)
CASPLLWTRW

SEQ ID NO: 104380 - protein, 10 aa, Artificial Sequence
  Description of Artificial Sequence: Synthetic peptide
  Seed: MNVINTYTGY (MAGC3_HUMAN)
MQVINTYTGK

SEQ ID NO: 104381 - protein, 10 aa, Artificial Sequence
  Description of Artificial Sequence: Synthetic peptide
  Seed: SLVLCPTYFK (MAGC3_HUMAN)
SQVLCPTYFR

SEQ ID NO: 104382 - protein, 9 aa, Artificial Sequence
  Description of Artificial Sequence: Synthetic peptide
  Seed: GFADVLSRL (MAGC3_HUMAN)
GQADVLSRV

SEQ ID NO: 104383 - protein, 10 aa, Artificial Sequence
  Description of Artificial Sequence: Synthetic peptide
  Seed: IELIFGIALT (MAGC3_HUMAN)
ISLIFGIALA

SEQ ID NO: 104384 - protein, 10 aa, Artificial Sequence
  Description of Artificial Sequence: Synthetic peptide
  Seed: FSDGSLGQWV (MAGC3_HUMAN)
FIDGSLGQWV

SEQ ID NO: 104385 - protein, 9 aa, Artificial Sequence
  Description of Artificial Sequence: Synthetic peptide
  Seed: HLREVRLFL (MAGC3_HUMAN)
HLREVRLFF

SEQ ID NO: 104386 - protein, 10 aa, Artificial Sequence
  Description of Artificial Sequence: Synthetic peptide
  Seed: IELIFGIALT (MAGC3_HUMAN)
IMLIFGIALV

SEQ ID NO: 104387 - protein, 10 aa, Artificial Sequence
  Description of Artificial Sequence: Synthetic peptide
  Seed: EKVAELVQFL (MAGC3_HUMAN)
EDVAELVQFL

SEQ ID NO: 104388 - protein, 10 aa, Artificial Sequence
  Description of Artificial Sequence: Synthetic peptide
  Seed: SDQRMDSLVL (MAGC3_HUMAN)
SRQRMDSLVM

SEQ ID NO: 104389 - protein, 9 aa, Artificial Sequence
  Description of Artificial Sequence: Synthetic peptide
  Seed: ALDEKVAEL (MAGC3_HUMAN)
ATDEKVAEL

SEQ ID NO: 104390 - protein, 10 aa, Artificial Sequence
  Description of Artificial Sequence: Synthetic peptide
  Seed: WRTLSGSPGL (MAGC3_HUMAN)
WRTLSGSPGF

SEQ ID NO: 104391 - protein, 11 aa, Artificial Sequence
  Description of Artificial Sequence: Synthetic peptide
  Seed: YALDEKVAELV (MAGC3_HUMAN)
YLLDEKVAELR

SEQ ID NO: 104392 - protein, 9 aa, Artificial Sequence
  Description of Artificial Sequence: Synthetic peptide
  Seed: ALDEKVAEL (MAGC3_HUMAN)
ASDEKVAEV

SEQ ID NO: 104393 - protein, 9 aa, Artificial Sequence
  Description of Artificial Sequence: Synthetic peptide
  Seed: RTLSGSPGL (MAGC3_HUMAN)
RTLSGSPGA

SEQ ID NO: 104394 - protein, 9 aa, Artificial Sequence
  Description of Artificial Sequence: Synthetic peptide
  Seed: FHLGHLREV (MAGC3_HUMAN)
FWLGHLREL

SEQ ID NO: 104395 - protein, 8 aa, Artificial Sequence
  Description of Artificial Sequence: Synthetic peptide
  Seed: IFGKAHEF (MAGC3_HUMAN)
IYGKAHEY

SEQ ID NO: 104396 - protein, 9 aa, Artificial Sequence
  Description of Artificial Sequence: Synthetic peptide
  Seed: TEASPQQKK (MAGC3_HUMAN)
TSASPQQKM

SEQ ID NO: 104397 - protein, 9 aa, Artificial Sequence
  Description of Artificial Sequence: Synthetic peptide
  Seed: FKLWRTLSG (MAGC3_HUMAN)
FMLWRTLSL

SEQ ID NO: 104398 - protein, 9 aa, Artificial Sequence
  Description of Artificial Sequence: Synthetic peptide
  Seed: ASEEVIWEV (MAGC3_HUMAN)
ALEEVIWEL

SEQ ID NO: 104399 - protein, 9 aa, Artificial Sequence
  Description of Artificial Sequence: Synthetic peptide
  Seed: TAMASASPS (MAGC3_HUMAN)
TQMASASPY

SEQ ID NO: 104400 - protein, 9 aa, Artificial Sequence
  Description of Artificial Sequence: Synthetic peptide
  Seed: RGTGYTLSL (MAGC3_HUMAN)
RMTGYTLSF

SEQ ID NO: 104401 - protein, 10 aa, Artificial Sequence
  Description of Artificial Sequence: Synthetic peptide
  Seed: FSDGSLGQWV (MAGC3_HUMAN)
FMDGSLGQWA

SEQ ID NO: 104402 - protein, 9 aa, Artificial Sequence
  Description of Artificial Sequence: Synthetic peptide
  Seed: DGSLGQWVK (MAGC3_HUMAN)
DVSLGQWVR

SEQ ID NO: 104403 - protein, 9 aa, Artificial Sequence
  Description of Artificial Sequence: Synthetic peptide
  Seed: LANPQGLAG (MAGC3_HUMAN)
LANPQGLAY

SEQ ID NO: 104404 - protein, 11 aa, Artificial Sequence
  Description of Artificial Sequence: Synthetic peptide
  Seed: LIDDQGMPKNC (MAGC3_HUMAN)
LADDQGMPKNI

SEQ ID NO: 104405 - protein, 10 aa, Artificial Sequence
  Description of Artificial Sequence: Synthetic peptide
  Seed: YSAFHLGHLR (MAGC3_HUMAN)
YNAFHLGHLK

SEQ ID NO: 104406 - protein, 10 aa, Artificial Sequence
  Description of Artificial Sequence: Synthetic peptide
  Seed: KDYFPMIFGK (MAGC3_HUMAN)
KNYFPMIFGK

SEQ ID NO: 104407 - protein, 11 aa, Artificial Sequence
  Description of Artificial Sequence: Synthetic peptide
  Seed: SLPESEPLFTY (MAGC3_HUMAN)
SVPESEPLFTV

SEQ ID NO: 104408 - protein, 10 aa, Artificial Sequence
  Description of Artificial Sequence: Synthetic peptide
  Seed: EVIWEVLSAI (MAGC3_HUMAN)
EIIWEVLSAI

SEQ ID NO: 104409 - protein, 9 aa, Artificial Sequence
  Description of Artificial Sequence: Synthetic peptide
  Seed: YSAFHLGHL (MAGC3_HUMAN)
YLAFHLGHY

SEQ ID NO: 104410 - protein, 10 aa, Artificial Sequence
  Description of Artificial Sequence: Synthetic peptide
  Seed: SDQRMDSLVL (MAGC3_HUMAN)
SQQRMDSLVL

SEQ ID NO: 104411 - protein, 9 aa, Artificial Sequence
  Description of Artificial Sequence: Synthetic peptide
  Seed: NTYTGYFPM (MAGC3_HUMAN)
NKYTGYFPL

SEQ ID NO: 104412 - protein, 9 aa, Artificial Sequence
  Description of Artificial Sequence: Synthetic peptide
  Seed: MIFRKAREF (MAGC3_HUMAN)
MVFRKAREV

SEQ ID NO: 104413 - protein, 9 aa, Artificial Sequence
  Description of Artificial Sequence: Synthetic peptide
  Seed: QGMPQNRLL (MAGC3_HUMAN)
QAMPQNRLL

SEQ ID NO: 104414 - protein, 10 aa, Artificial Sequence
  Description of Artificial Sequence: Synthetic peptide
  Seed: FKLWRTLSGS (MAGC3_HUMAN)
FDLWRTLSGA

SEQ ID NO: 104415 - protein, 9 aa, Artificial Sequence
  Description of Artificial Sequence: Synthetic peptide
  Seed: MASASPSVM (MAGC3_HUMAN)
MASASPSVV

SEQ ID NO: 104416 - protein, 9 aa, Artificial Sequence
  Description of Artificial Sequence: Synthetic peptide
  Seed: MPAAGMPPL (MAGC3_HUMAN)
MWAAGMPPL

SEQ ID NO: 104417 - protein, 9 aa, Artificial Sequence
  Description of Artificial Sequence: Synthetic peptide
  Seed: EFIELIFGI (MAGC3_HUMAN)
ESIELIFGL

SEQ ID NO: 104418 - protein, 9 aa, Artificial Sequence
  Description of Artificial Sequence: Synthetic peptide
  Seed: FSLRRAVSV (MAGC3_HUMAN)
FLLRRAVSM

SEQ ID NO: 104419 - protein, 9 aa, Artificial Sequence
  Description of Artificial Sequence: Synthetic peptide
  Seed: HLREVRLFL (MAGC3_HUMAN)
HGREVRLFA

SEQ ID NO: 104420 - protein, 9 aa, Artificial Sequence
  Description of Artificial Sequence: Synthetic peptide
  Seed: MLTTVIKKY (MAGC3_HUMAN)
MMTTVIKKF

SEQ ID NO: 104421 - protein, 10 aa, Artificial Sequence
  Description of Artificial Sequence: Synthetic peptide
  Seed: SCSSPLLWTR (MAGC3_HUMAN)
SPSSPLLWTR

SEQ ID NO: 104422 - protein, 9 aa, Artificial Sequence
  Description of Artificial Sequence: Synthetic peptide
  Seed: YFFEDTLDL (MAGC3_HUMAN)
YIFEDTLDF

SEQ ID NO: 104423 - protein, 9 aa, Artificial Sequence
  Description of Artificial Sequence: Synthetic peptide
  Seed: TLDEKVDKL (MAGC3_HUMAN)
TADEKVDKA

SEQ ID NO: 104424 - protein, 9 aa, Artificial Sequence
  Description of Artificial Sequence: Synthetic peptide
  Seed: FHLGHLREV (MAGC3_HUMAN)
FSLGHLREL

SEQ ID NO: 104425 - protein, 10 aa, Artificial Sequence
  Description of Artificial Sequence: Synthetic peptide
  Seed: KLSSIIPSAF (MAGC3_HUMAN)
KGSSIIPSAW

SEQ ID NO: 104426 - protein, 9 aa, Artificial Sequence
  Description of Artificial Sequence: Synthetic peptide
  Seed: FADVLSRLA (MAGC3_HUMAN)
FQDVLSRLI

SEQ ID NO: 104427 - protein, 9 aa, Artificial Sequence
  Description of Artificial Sequence: Synthetic peptide
  Seed: YQAKEPLTR (MAGC3_HUMAN)
YYAKEPLTF

SEQ ID NO: 104428 - protein, 11 aa, Artificial Sequence
  Description of Artificial Sequence: Synthetic peptide
  Seed: YTGYFPMIFRK (MAGC3_HUMAN)
YFGYFPMIFRR

SEQ ID NO: 104429 - protein, 9 aa, Artificial Sequence
  Description of Artificial Sequence: Synthetic peptide
  Seed: SLVLCPTYF (MAGC3_HUMAN)
SMVLCPTYI

SEQ ID NO: 104430 - protein, 9 aa, Artificial Sequence
  Description of Artificial Sequence: Synthetic peptide
  Seed: SPSVMSTNF (MAGC3_HUMAN)
SPSVMSTNA

SEQ ID NO: 104431 - protein, 11 aa, Artificial Sequence
  Description of Artificial Sequence: Synthetic peptide
  Seed: TTDDATAMASA (MAGC3_HUMAN)
TTDDATAMASY

SEQ ID NO: 104432 - protein, 8 aa, Artificial Sequence
  Description of Artificial Sequence: Synthetic peptide
  Seed: SYFFEDTL (MAGC3_HUMAN)
SYFFEDTF

SEQ ID NO: 104433 - protein, 9 aa, Artificial Sequence
  Description of Artificial Sequence: Synthetic peptide
  Seed: VIWEVLSAI (MAGC3_HUMAN)
VMWEVLSAT

SEQ ID NO: 104434 - protein, 10 aa, Artificial Sequence
  Description of Artificial Sequence: Synthetic peptide
  Seed: TGYFPMIFRK (MAGC3_HUMAN)
TAYFPMIFRT

SEQ ID NO: 104435 - protein, 11 aa, Artificial Sequence
  Description of Artificial Sequence: Synthetic peptide
  Seed: LPQSPPEIPPQ (MAGC3_HUMAN)
LPQSPPEIPPM

SEQ ID NO: 104436 - protein, 9 aa, Artificial Sequence
  Description of Artificial Sequence: Synthetic peptide
  Seed: YQTKEPVTK (MAGC3_HUMAN)
YSTKEPVTV

SEQ ID NO: 104437 - protein, 10 aa, Artificial Sequence
  Description of Artificial Sequence: Synthetic peptide
  Seed: SKLSSIIPSA (MAGC3_HUMAN)
SDLSSIIPSI

SEQ ID NO: 104438 - protein, 10 aa, Artificial Sequence
  Description of Artificial Sequence: Synthetic peptide
  Seed: EIPPQGPPKI (MAGC3_HUMAN)
EIPPQGPPKR

SEQ ID NO: 104439 - protein, 11 aa, Artificial Sequence
  Description of Artificial Sequence: Synthetic peptide
  Seed: AIGPWSALAGF (MAGC3_HUMAN)
AVGPWSALAGR

SEQ ID NO: 104440 - protein, 9 aa, Artificial Sequence
  Description of Artificial Sequence: Synthetic peptide
  Seed: SQPEGKFSL (MAGC3_HUMAN)
SYPEGKFSL

SEQ ID NO: 104441 - protein, 9 aa, Artificial Sequence
  Description of Artificial Sequence: Synthetic peptide
  Seed: KYKDYFPMI (MAGC3_HUMAN)
KFKDYFPML

SEQ ID NO: 104442 - protein, 11 aa, Artificial Sequence
  Description of Artificial Sequence: Synthetic peptide
  Seed: LTEVDPDHFYV (MAGC3_HUMAN)
LMEVDPDHFYI

SEQ ID NO: 104443 - protein, 10 aa, Artificial Sequence
  Description of Artificial Sequence: Synthetic peptide
  Seed: MDPDNHSYFF (MAGC3_HUMAN)
MTPDNHSYFY

SEQ ID NO: 104444 - protein, 9 aa, Artificial Sequence
  Description of Artificial Sequence: Synthetic peptide
  Seed: TYALSPVVL (MAGC3_HUMAN)
TWALSPVVF

SEQ ID NO: 104445 - protein, 9 aa, Artificial Sequence
  Description of Artificial Sequence: Synthetic peptide
  Seed: KVDKLVQFL (MAGC3_HUMAN)
KTDKLVQFL

SEQ ID NO: 104446 - protein, 11 aa, Artificial Sequence
  Description of Artificial Sequence: Synthetic peptide
  Seed: KFSLRRAVSVK (MAGC3_HUMAN)
KTSLRRAVSVK

SEQ ID NO: 104447 - protein, 9 aa, Artificial Sequence
  Description of Artificial Sequence: Synthetic peptide
  Seed: QLSDLHFGS (MAGC3_HUMAN)
QTSDLHFGV

SEQ ID NO: 104448 - protein, 9 aa, Artificial Sequence
  Description of Artificial Sequence: Synthetic peptide
  Seed: IIDTTDDAT (MAGC3_HUMAN)
IIDTTDDAM

SEQ ID NO: 104449 - protein, 9 aa, Artificial Sequence
  Description of Artificial Sequence: Synthetic peptide
  Seed: EVDPDHFYV (MAGC3_HUMAN)
ETDPDHFYL

SEQ ID NO: 104450 - protein, 11 aa, Artificial Sequence
  Description of Artificial Sequence: Synthetic peptide
  Seed: MPAAGMPPLPQ (MAGC3_HUMAN)
MPAAGMPPLPI

SEQ ID NO: 104451 - protein, 10 aa, Artificial Sequence
  Description of Artificial Sequence: Synthetic peptide
  Seed: MPAAGMPPLP (MAGC3_HUMAN)
MQAAGMPPLY

SEQ ID NO: 104452 - protein, 11 aa, Artificial Sequence
  Description of Artificial Sequence: Synthetic peptide
  Seed: KFSLRRAVSVK (MAGC3_HUMAN)
KTSLRRAVSVA

SEQ ID NO: 104453 - protein, 9 aa, Artificial Sequence
  Description of Artificial Sequence: Synthetic peptide
  Seed: MIFRKAREF (MAGC3_HUMAN)
MRFRKAREY

SEQ ID NO: 104454 - protein, 10 aa, Artificial Sequence
  Description of Artificial Sequence: Synthetic peptide
  Seed: VLDLANPQGL (MAGC3_HUMAN)
VLDLANPQGM

SEQ ID NO: 104455 - protein, 9 aa, Artificial Sequence
  Description of Artificial Sequence: Synthetic peptide
  Seed: QGMPKNCLL (MAGC3_HUMAN)
QVMPKNCLW

SEQ ID NO: 104456 - protein, 9 aa, Artificial Sequence
  Description of Artificial Sequence: Synthetic peptide
  Seed: KVAELVQFL (MAGC3_HUMAN)
KLAELVQFC

SEQ ID NO: 104457 - protein, 11 aa, Artificial Sequence
  Description of Artificial Sequence: Synthetic peptide
  Seed: HALPESESLPR (MAGC3_HUMAN)
HILPESESLPK

SEQ ID NO: 104458 - protein, 10 aa, Artificial Sequence
  Description of Artificial Sequence: Synthetic peptide
  Seed: LTRAEMQMNV (MAGC3_HUMAN)
LMRAEMQMNI

SEQ ID NO: 104459 - protein, 9 aa, Artificial Sequence
  Description of Artificial Sequence: Synthetic peptide
  Seed: VLCPTYFKL (MAGC3_HUMAN)
VLCPTYFKV

SEQ ID NO: 104460 - protein, 9 aa, Artificial Sequence
  Description of Artificial Sequence: Synthetic peptide
  Seed: LSDEQGMPQ (MAGC3_HUMAN)
LYDEQGMPL

SEQ ID NO: 104461 - protein, 10 aa, Artificial Sequence
  Description of Artificial Sequence: Synthetic peptide
  Seed: RPAREVLEFL (MAGC3_HUMAN)
RCAREVLEFK

SEQ ID NO: 104462 - protein, 9 aa, Artificial Sequence
  Description of Artificial Sequence: Synthetic peptide
  Seed: MPAAGMPPL (MAGC3_HUMAN)
MYAAGMPPF

SEQ ID NO: 104463 - protein, 9 aa, Artificial Sequence
  Description of Artificial Sequence: Synthetic peptide
  Seed: HALPESESL (MAGC3_HUMAN)
HPLPESESA

SEQ ID NO: 104464 - protein, 10 aa, Artificial Sequence
  Description of Artificial Sequence: Synthetic peptide
  Seed: KLSSIIPSAF (MAGC3_HUMAN)
KASSIIPSAM

SEQ ID NO: 104465 - protein, 9 aa, Artificial Sequence
  Description of Artificial Sequence: Synthetic peptide
  Seed: KQREEPQDW (MAGC3_HUMAN)
KMREEPQDY

SEQ ID NO: 104466 - protein, 9 aa, Artificial Sequence
  Description of Artificial Sequence: Synthetic peptide
  Seed: EVIWEVLSA (MAGC3_HUMAN)
EAIWEVLSY

SEQ ID NO: 104467 - protein, 9 aa, Artificial Sequence
  Description of Artificial Sequence: Synthetic peptide
  Seed: LSDEQGMPQ (MAGC3_HUMAN)
LQDEQGMPL

SEQ ID NO: 104468 - protein, 11 aa, Artificial Sequence
  Description of Artificial Sequence: Synthetic peptide
  Seed: ATFSDGSLGQW (MAGC3_HUMAN)
AMFSDGSLGQI

SEQ ID NO: 104469 - protein, 9 aa, Artificial Sequence
  Description of Artificial Sequence: Synthetic peptide
  Seed: MIFIKGSCV (MAGC3_HUMAN)
MAFIKGSCY

SEQ ID NO: 104470 - protein, 9 aa, Artificial Sequence
  Description of Artificial Sequence: Synthetic peptide
  Seed: MIFGKAHEF (MAGC3_HUMAN)
MTFGKAHER

SEQ ID NO: 104471 - protein, 9 aa, Artificial Sequence
  Description of Artificial Sequence: Synthetic peptide
  Seed: FEDTLDLTY (MAGC3_HUMAN)
FADTLDLTL

SEQ ID NO: 104472 - protein, 9 aa, Artificial Sequence
  Description of Artificial Sequence: Synthetic peptide
  Seed: LILSVIFIK (MAGC3_HUMAN)
LQLSVIFIK

SEQ ID NO: 104473 - protein, 9 aa, Artificial Sequence
  Description of Artificial Sequence: Synthetic peptide
  Seed: YSAFHLGHL (MAGC3_HUMAN)
YQAFHLGHM

SEQ ID NO: 104474 - protein, 9 aa, Artificial Sequence
  Description of Artificial Sequence: Synthetic peptide
  Seed: SAFHLGHLR (MAGC3_HUMAN)
SSFHLGHLF

SEQ ID NO: 104475 - protein, 9 aa, Artificial Sequence
  Description of Artificial Sequence: Synthetic peptide
  Seed: KKYKDYFPM (MAGC3_HUMAN)
KMYKDYFPL

SEQ ID NO: 104476 - protein, 10 aa, Artificial Sequence
  Description of Artificial Sequence: Synthetic peptide
  Seed: YALDEKVAEL (MAGC3_HUMAN)
YNLDEKVAEM

SEQ ID NO: 104477 - protein, 9 aa, Artificial Sequence
  Description of Artificial Sequence: Synthetic peptide
  Seed: FSDGSLGQW (MAGC3_HUMAN)
FADGSLGQI

SEQ ID NO: 104478 - protein, 9 aa, Artificial Sequence
  Description of Artificial Sequence: Synthetic peptide
  Seed: IPPQGPPKI (MAGC3_HUMAN)
IPPQGPPKL

SEQ ID NO: 104479 - protein, 9 aa, Artificial Sequence
  Description of Artificial Sequence: Synthetic peptide
  Seed: TLDEKVDKL (MAGC3_HUMAN)
TEDEKVDKF

SEQ ID NO: 104480 - protein, 9 aa, Artificial Sequence
  Description of Artificial Sequence: Synthetic peptide
  Seed: FLSKLSSII (MAGC3_HUMAN)
FLSKLSSIT

SEQ ID NO: 104481 - protein, 11 aa, Artificial Sequence
  Description of Artificial Sequence: Synthetic peptide
  Seed: TAMASASPSVM (MAGC3_HUMAN)
THMASASPSVF

SEQ ID NO: 104482 - protein, 9 aa, Artificial Sequence
  Description of Artificial Sequence: Synthetic peptide
  Seed: MASASPSVM (MAGC3_HUMAN)
MSSASPSVF

SEQ ID NO: 104483 - protein, 11 aa, Artificial Sequence
  Description of Artificial Sequence: Synthetic peptide
  Seed: DLANPQGLAGH (MAGC3_HUMAN)
DIANPQGLAGR

SEQ ID NO: 104484 - protein, 10 aa, Artificial Sequence
  Description of Artificial Sequence: Synthetic peptide
  Seed: FKLWRTLSGS (MAGC3_HUMAN)
FALWRTLSGL

SEQ ID NO: 104485 - protein, 10 aa, Artificial Sequence
  Description of Artificial Sequence: Synthetic peptide
  Seed: LVLCPTYFKL (MAGC3_HUMAN)
LMLCPTYFKV

SEQ ID NO: 104486 - protein, 9 aa, Artificial Sequence
  Description of Artificial Sequence: Synthetic peptide
  Seed: EVLSAIGPI (MAGC3_HUMAN)
EVLSAIGPW

SEQ ID NO: 104487 - protein, 11 aa, Artificial Sequence
  Description of Artificial Sequence: Synthetic peptide
  Seed: RTLSGSPGLQL (MAGC3_HUMAN)
RGLSGSPGLQW

SEQ ID NO: 104488 - protein, 9 aa, Artificial Sequence
  Description of Artificial Sequence: Synthetic peptide
  Seed: SASPSVMST (MAGC3_HUMAN)
SNSPSVMSI

SEQ ID NO: 104489 - protein, 9 aa, Artificial Sequence
  Description of Artificial Sequence: Synthetic peptide
  Seed: SESLPRYAL (MAGC3_HUMAN)
SESLPRYAP

SEQ ID NO: 104490 - protein, 9 aa, Artificial Sequence
  Description of Artificial Sequence: Synthetic peptide
  Seed: SLPAVSPGK (MAGC3_HUMAN)
SSPAVSPGL

SEQ ID NO: 104491 - protein, 9 aa, Artificial Sequence
  Description of Artificial Sequence: Synthetic peptide
  Seed: ASEEVIWEV (MAGC3_HUMAN)
ALEEVIWEC

SEQ ID NO: 104492 - protein, 11 aa, Artificial Sequence
  Description of Artificial Sequence: Synthetic peptide
  Seed: TDMDPDNHSYF (MAGC3_HUMAN)
TTMDPDNHSYF

SEQ ID NO: 104493 - protein, 9 aa, Artificial Sequence
  Description of Artificial Sequence: Synthetic peptide
  Seed: HLREVRLFL (MAGC3_HUMAN)
HTREVRLFH

SEQ ID NO: 104494 - protein, 10 aa, Artificial Sequence
  Description of Artificial Sequence: Synthetic peptide
  Seed: SLPESEPLFT (MAGC3_HUMAN)
SLPESEPLFV

SEQ ID NO: 104495 - protein, 10 aa, Artificial Sequence
  Description of Artificial Sequence: Synthetic peptide
  Seed: SKLSSIIPSA (MAGC3_HUMAN)
SCLSSIIPSV

SEQ ID NO: 104496 - protein, 9 aa, Artificial Sequence
  Description of Artificial Sequence: Synthetic peptide
  Seed: AVSPGKRLW (MAGC3_HUMAN)
AYSPGKRLY

SEQ ID NO: 104497 - protein, 10 aa, Artificial Sequence
  Description of Artificial Sequence: Synthetic peptide
  Seed: LDSCSSPLLW (MAGC3_HUMAN)
LASCSSPLLY

SEQ ID NO: 104498 - protein, 9 aa, Artificial Sequence
  Description of Artificial Sequence: Synthetic peptide
  Seed: NTYTGYFPM (MAGC3_HUMAN)
NQYTGYFPL

SEQ ID NO: 104499 - protein, 11 aa, Artificial Sequence
  Description of Artificial Sequence: Synthetic peptide
  Seed: TEVDPDHFYVF (MAGC3_HUMAN)
TEVDPDHFYVM

SEQ ID NO: 104500 - protein, 9 aa, Artificial Sequence
  Description of Artificial Sequence: Synthetic peptide
  Seed: ALDEKVAEL (MAGC3_HUMAN)
AQDEKVAEL

SEQ ID NO: 104501 - protein, 9 aa, Artificial Sequence
  Description of Artificial Sequence: Synthetic peptide
  Seed: TGYFPMIFR (MAGC3_HUMAN)
TAYFPMIFR

SEQ ID NO: 104502 - protein, 10 aa, Artificial Sequence
  Description of Artificial Sequence: Synthetic peptide
  Seed: YALDEKVAEL (MAGC3_HUMAN)
YKLDEKVAET

SEQ ID NO: 104503 - protein, 11 aa, Artificial Sequence
  Description of Artificial Sequence: Synthetic peptide
  Seed: YFFEDTLDLTY (MAGC3_HUMAN)
YRFEDTLDLTF

SEQ ID NO: 104504 - protein, 9 aa, Artificial Sequence
  Description of Artificial Sequence: Synthetic peptide
  Seed: IELIFGIAL (MAGC3_HUMAN)
IQLIFGIAL

SEQ ID NO: 104505 - protein, 9 aa, Artificial Sequence
  Description of Artificial Sequence: Synthetic peptide
  Seed: SPVVLPPQP (MAGC3_HUMAN)
SPVVLPPQT

SEQ ID NO: 104506 - protein, 11 aa, Artificial Sequence
  Description of Artificial Sequence: Synthetic peptide
  Seed: AEMQMNVINTY (MAGC3_HUMAN)
ALMQMNVINTF

SEQ ID NO: 104507 - protein, 10 aa, Artificial Sequence
  Description of Artificial Sequence: Synthetic peptide
  Seed: FADVLSRLAL (MAGC3_HUMAN)
FPDVLSRLAY

SEQ ID NO: 104508 - protein, 10 aa, Artificial Sequence
  Description of Artificial Sequence: Synthetic peptide
  Seed: RLLILILSVI (MAGC3_HUMAN)
RDLILILSVV

SEQ ID NO: 104509 - protein, 8 aa, Artificial Sequence
  Description of Artificial Sequence: Synthetic peptide
  Seed: SGSPGLQL (MAGC3_HUMAN)
SVSPGLQL

SEQ ID NO: 104510 - protein, 10 aa, Artificial Sequence
  Description of Artificial Sequence: Synthetic peptide
  Seed: EVIWEVLNAI (MAGC3_HUMAN)
ETIWEVLNAV

SEQ ID NO: 104511 - protein, 10 aa, Artificial Sequence
  Description of Artificial Sequence: Synthetic peptide
  Seed: YTLDEKVDKL (MAGC3_HUMAN)
YQLDEKVDKW

SEQ ID NO: 104512 - protein, 10 aa, Artificial Sequence
  Description of Artificial Sequence: Synthetic peptide
  Seed: VLCPTYFKLW (MAGC3_HUMAN)
VSCPTYFKLW

SEQ ID NO: 104513 - protein, 9 aa, Artificial Sequence
  Description of Artificial Sequence: Synthetic peptide
  Seed: SPQGPPQSP (MAGC3_HUMAN)
SAQGPPQSY

SEQ ID NO: 104514 - protein, 9 aa, Artificial Sequence
  Description of Artificial Sequence: Synthetic peptide
  Seed: RTLSGSPGL (MAGC3_HUMAN)
RFLSGSPGY

SEQ ID NO: 104515 - protein, 9 aa, Artificial Sequence
  Description of Artificial Sequence: Synthetic peptide
  Seed: FEDTLDLTY (MAGC3_HUMAN)
FQDTLDLTM

SEQ ID NO: 104516 - protein, 10 aa, Artificial Sequence
  Description of Artificial Sequence: Synthetic peptide
  Seed: IPSAFPSWYM (MAGC3_HUMAN)
IDSAFPSWYW

SEQ ID NO: 104517 - protein, 9 aa, Artificial Sequence
  Description of Artificial Sequence: Synthetic peptide
  Seed: KVAELVQFL (MAGC3_HUMAN)
KMAELVQFM

SEQ ID NO: 104518 - protein, 9 aa, Artificial Sequence
  Description of Artificial Sequence: Synthetic peptide
  Seed: NTYTGYFPM (MAGC3_HUMAN)
NWYTGYFPF

SEQ ID NO: 104519 - protein, 9 aa, Artificial Sequence
  Description of Artificial Sequence: Synthetic peptide
  Seed: GYFPMIFRK (MAGC3_HUMAN)
GWFPMIFRK

SEQ ID NO: 104520 - protein, 9 aa, Artificial Sequence
  Description of Artificial Sequence: Synthetic peptide
  Seed: ALDEKVAEL (MAGC3_HUMAN)
AYDEKVAEC

SEQ ID NO: 104521 - protein, 9 aa, Artificial Sequence
  Description of Artificial Sequence: Synthetic peptide
  Seed: YTGYFPMIF (MAGC3_HUMAN)
YAGYFPMIM

SEQ ID NO: 104522 - protein, 9 aa, Artificial Sequence
  Description of Artificial Sequence: Synthetic peptide
  Seed: GFADVLSRL (MAGC3_HUMAN)
GYADVLSRF

SEQ ID NO: 104523 - protein, 10 aa, Artificial Sequence
  Description of Artificial Sequence: Synthetic peptide
  Seed: MDPDNHSYFF (MAGC3_HUMAN)
MDPDNHSYFM

SEQ ID NO: 104524 - protein, 9 aa, Artificial Sequence
  Description of Artificial Sequence: Synthetic peptide
  Seed: YKDYFPMIF (MAGC3_HUMAN)
YIDYFPMIY

SEQ ID NO: 104525 - protein, 9 aa, Artificial Sequence
  Description of Artificial Sequence: Synthetic peptide
  Seed: TSDQRMDSL (MAGC3_HUMAN)
TLDQRMDSV

SEQ ID NO: 104526 - protein, 9 aa, Artificial Sequence
  Description of Artificial Sequence: Synthetic peptide
  Seed: YTLDEKVDK (MAGC3_HUMAN)
YTLDEKVDL

SEQ ID NO: 104527 - protein, 9 aa, Artificial Sequence
  Description of Artificial Sequence: Synthetic peptide
  Seed: VINTYTGYF (MAGC3_HUMAN)
VENTYTGYF

SEQ ID NO: 104528 - protein, 9 aa, Artificial Sequence
  Description of Artificial Sequence: Synthetic peptide
  Seed: VLPPQPQPR (MAGC3_HUMAN)
VTPPQPQPF

SEQ ID NO: 104529 - protein, 9 aa, Artificial Sequence
  Description of Artificial Sequence: Synthetic peptide
  Seed: LDEKVDKLV (MAGC3_HUMAN)
LEEKVDKLA

SEQ ID NO: 104530 - protein, 9 aa, Artificial Sequence
  Description of Artificial Sequence: Synthetic peptide
  Seed: VLPPQPQPR (MAGC3_HUMAN)
VCPPQPQPV

SEQ ID NO: 104531 - protein, 9 aa, Artificial Sequence
  Description of Artificial Sequence: Synthetic peptide
  Seed: TEASPQQKK (MAGC3_HUMAN)
TAASPQQKM

SEQ ID NO: 104532 - protein, 9 aa, Artificial Sequence
  Description of Artificial Sequence: Synthetic peptide
  Seed: GKFSLRRAV (MAGC3_HUMAN)
GHFSLRRAY

SEQ ID NO: 104533 - protein, 11 aa, Artificial Sequence
  Description of Artificial Sequence: Synthetic peptide
  Seed: FIELIFGIALT (MAGC3_HUMAN)
FPELIFGIALV

SEQ ID NO: 104534 - protein, 9 aa, Artificial Sequence
  Description of Artificial Sequence: Synthetic peptide
  Seed: QTKEPVTKA (MAGC3_HUMAN)
QMKEPVTKR

SEQ ID NO: 104535 - protein, 9 aa, Artificial Sequence
  Description of Artificial Sequence: Synthetic peptide
  Seed: MQMNVINTY (MAGC3_HUMAN)
MKMNVINTF

SEQ ID NO: 104536 - protein, 9 aa, Artificial Sequence
  Description of Artificial Sequence: Synthetic peptide
  Seed: MDPDNHSYF (MAGC3_HUMAN)
MQPDNHSYL

SEQ ID NO: 104537 - protein, 9 aa, Artificial Sequence
  Description of Artificial Sequence: Synthetic peptide
  Seed: TSDQRMDSL (MAGC3_HUMAN)
TIDQRMDSM

SEQ ID NO: 104538 - protein, 10 aa, Artificial Sequence
  Description of Artificial Sequence: Synthetic peptide
  Seed: KVAELVQFLL (MAGC3_HUMAN)
KTAELVQFLK

SEQ ID NO: 104539 - protein, 10 aa, Artificial Sequence
  Description of Artificial Sequence: Synthetic peptide
  Seed: FADVLSRLAL (MAGC3_HUMAN)
FSDVLSRLAM

SEQ ID NO: 104540 - protein, 9 aa, Artificial Sequence
  Description of Artificial Sequence: Synthetic peptide
  Seed: NVINTYTGY (MAGC3_HUMAN)
NSINTYTGK

SEQ ID NO: 104541 - protein, 10 aa, Artificial Sequence
  Description of Artificial Sequence: Synthetic peptide
  Seed: CASEEVIWEV (MAGC3_HUMAN)
CLSEEVIWEI

SEQ ID NO: 104542 - protein, 9 aa, Artificial Sequence
  Description of Artificial Sequence: Synthetic peptide
  Seed: VTKAEMLTT (MAGC3_HUMAN)
VVKAEMLTK

SEQ ID NO: 104543 - protein, 9 aa, Artificial Sequence
  Description of Artificial Sequence: Synthetic peptide
  Seed: LLILILSVI (MAGC3_HUMAN)
LLILILSVL

SEQ ID NO: 104544 - protein, 9 aa, Artificial Sequence
  Description of Artificial Sequence: Synthetic peptide
  Seed: RGTGYTLSL (MAGC3_HUMAN)
RLTGYTLSY

SEQ ID NO: 104545 - protein, 9 aa, Artificial Sequence
  Description of Artificial Sequence: Synthetic peptide
  Seed: SASPSVMST (MAGC3_HUMAN)
STSPSVMSL

SEQ ID NO: 104546 - protein, 9 aa, Artificial Sequence
  Description of Artificial Sequence: Synthetic peptide
  Seed: EAFCEESGL (MAGC3_HUMAN)
EVFCEESGF

SEQ ID NO: 104547 - protein, 11 aa, Artificial Sequence
  Description of Artificial Sequence: Synthetic peptide
  Seed: IIDTTDDATAM (MAGC3_HUMAN)
ITDTTDDATAL

SEQ ID NO: 104548 - protein, 9 aa, Artificial Sequence
  Description of Artificial Sequence: Synthetic peptide
  Seed: HLREVRLFL (MAGC3_HUMAN)
HRREVRLFL

SEQ ID NO: 104549 - protein, 9 aa, Artificial Sequence
  Description of Artificial Sequence: Synthetic peptide
  Seed: HSYFFEDTL (MAGC3_HUMAN)
HQYFFEDTL

SEQ ID NO: 104550 - protein, 9 aa, Artificial Sequence
  Description of Artificial Sequence: Synthetic peptide
  Seed: SQPEGKFSL (MAGC3_HUMAN)
SQPEGKFSW

SEQ ID NO: 104551 - protein, 9 aa, Artificial Sequence
  Description of Artificial Sequence: Synthetic peptide
  Seed: FGSQPEGKF (MAGC3_HUMAN)
FVSQPEGKY

SEQ ID NO: 104552 - protein, 10 aa, Artificial Sequence
  Description of Artificial Sequence: Synthetic peptide
  Seed: IKKYKDYFPM (MAGC3_HUMAN)
IVKYKDYFPF

SEQ ID NO: 104553 - protein, 9 aa, Artificial Sequence
  Description of Artificial Sequence: Synthetic peptide
  Seed: RTLSGSPGL (MAGC3_HUMAN)
RQLSGSPGY

SEQ ID NO: 104554 - protein, 9 aa, Artificial Sequence
  Description of Artificial Sequence: Synthetic peptide
  Seed: ATDKDYSAF (MAGC3_HUMAN)
AVDKDYSAF

SEQ ID NO: 104555 - protein, 10 aa, Artificial Sequence
  Description of Artificial Sequence: Synthetic peptide
  Seed: MIFGKAHEFI (MAGC3_HUMAN)
MSFGKAHEFL

SEQ ID NO: 104556 - protein, 11 aa, Artificial Sequence
  Description of Artificial Sequence: Synthetic peptide
  Seed: SSSEEEDTATW (MAGC3_HUMAN)
SMSEEEDTATM

SEQ ID NO: 104557 - protein, 9 aa, Artificial Sequence
  Description of Artificial Sequence: Synthetic peptide
  Seed: MQMNVINTY (MAGC3_HUMAN)
MPMNVINTF

SEQ ID NO: 104558 - protein, 10 aa, Artificial Sequence
  Description of Artificial Sequence: Synthetic peptide
  Seed: KLSSIIPSAF (MAGC3_HUMAN)
KASSIIPSAW

SEQ ID NO: 104559 - protein, 10 aa, Artificial Sequence
  Description of Artificial Sequence: Synthetic peptide
  Seed: CVPEEVIWEV (MAGC3_HUMAN)
CLPEEVIWEA

SEQ ID NO: 104560 - protein, 9 aa, Artificial Sequence
  Description of Artificial Sequence: Synthetic peptide
  Seed: ALAGFADVL (MAGC3_HUMAN)
AQAGFADVV

SEQ ID NO: 104561 - protein, 10 aa, Artificial Sequence
  Description of Artificial Sequence: Synthetic peptide
  Seed: CASEEVIWEV (MAGC3_HUMAN)
CLSEEVIWEM

SEQ ID NO: 104562 - protein, 9 aa, Artificial Sequence
  Description of Artificial Sequence: Synthetic peptide
  Seed: FPMIFGKAH (MAGC3_HUMAN)
FIMIFGKAY

SEQ ID NO: 104563 - protein, 9 aa, Artificial Sequence
  Description of Artificial Sequence: Synthetic peptide
  Seed: NAIGPWSAL (MAGC3_HUMAN)
NFIGPWSAV

SEQ ID NO: 104564 - protein, 9 aa, Artificial Sequence
  Description of Artificial Sequence: Synthetic peptide
  Seed: LEFLSKLSS (MAGC3_HUMAN)
LEFLSKLST

SEQ ID NO: 104565 - protein, 10 aa, Artificial Sequence
  Description of Artificial Sequence: Synthetic peptide
  Seed: KKYKDYFPMI (MAGC3_HUMAN)
KAYKDYFPMF

SEQ ID NO: 104566 - protein, 9 aa, Artificial Sequence
  Description of Artificial Sequence: Synthetic peptide
  Seed: MASASPSVM (MAGC3_HUMAN)
MHSASPSVF

SEQ ID NO: 104567 - protein, 9 aa, Artificial Sequence
  Description of Artificial Sequence: Synthetic peptide
  Seed: FSDGSLGQW (MAGC3_HUMAN)
FQDGSLGQM

SEQ ID NO: 104568 - protein, 10 aa, Artificial Sequence
  Description of Artificial Sequence: Synthetic peptide
  Seed: YALSPVVLPP (MAGC3_HUMAN)
YSLSPVVLPL

SEQ ID NO: 104569 - protein, 9 aa, Artificial Sequence
  Description of Artificial Sequence: Synthetic peptide
  Seed: QPQPRKKAT (MAGC3_HUMAN)
QIQPRKKAL

SEQ ID NO: 104570 - protein, 9 aa, Artificial Sequence
  Description of Artificial Sequence: Synthetic peptide
  Seed: SQPEGKFSL (MAGC3_HUMAN)
SYPEGKFSY

SEQ ID NO: 104571 - protein, 9 aa, Artificial Sequence
  Description of Artificial Sequence: Synthetic peptide
  Seed: RKKATDKDY (MAGC3_HUMAN)
RQKATDKDF

SEQ ID NO: 104572 - protein, 8 aa, Artificial Sequence
  Description of Artificial Sequence: Synthetic peptide
  Seed: TTDDATAM (MAGC3_HUMAN)
TLDDATAF

SEQ ID NO: 104573 - protein, 10 aa, Artificial Sequence
  Description of Artificial Sequence: Synthetic peptide
  Seed: TDMDPDNHSY (MAGC3_HUMAN)
TVMDPDNHSY

SEQ ID NO: 104574 - protein, 10 aa, Artificial Sequence
  Description of Artificial Sequence: Synthetic peptide
  Seed: YALSPVVLPP (MAGC3_HUMAN)
YKLSPVVLPV

SEQ ID NO: 104575 - protein, 9 aa, Artificial Sequence
  Description of Artificial Sequence: Synthetic peptide
  Seed: IIPSAFPSW (MAGC3_HUMAN)
IVPSAFPSV

SEQ ID NO: 104576 - protein, 10 aa, Artificial Sequence
  Description of Artificial Sequence: Synthetic peptide
  Seed: RLWGEKAGSL (MAGC3_HUMAN)
RLWGEKAGSY

SEQ ID NO: 104577 - protein, 9 aa, Artificial Sequence
  Description of Artificial Sequence: Synthetic peptide
  Seed: TLDEKVDKL (MAGC3_HUMAN)
TMDEKVDKY

SEQ ID NO: 104578 - protein, 9 aa, Artificial Sequence
  Description of Artificial Sequence: Synthetic peptide
  Seed: YFPMIFRKA (MAGC3_HUMAN)
YFPMIFRKY

SEQ ID NO: 104579 - protein, 9 aa, Artificial Sequence
  Description of Artificial Sequence: Synthetic peptide
  Seed: ISPQGPPQS (MAGC3_HUMAN)
IGPQGPPQM

SEQ ID NO: 104580 - protein, 9 aa, Artificial Sequence
  Description of Artificial Sequence: Synthetic peptide
  Seed: LKYQTKEPV (MAGC3_HUMAN)
LSYQTKEPM

SEQ ID NO: 104581 - protein, 10 aa, Artificial Sequence
  Description of Artificial Sequence: Synthetic peptide
  Seed: EVIWEVLSAI (MAGC3_HUMAN)
EIIWEVLSAW

SEQ ID NO: 104582 - protein, 9 aa, Artificial Sequence
  Description of Artificial Sequence: Synthetic peptide
  Seed: FADVLSRLA (MAGC3_HUMAN)
FQDVLSRLF

SEQ ID NO: 104583 - protein, 9 aa, Artificial Sequence
  Description of Artificial Sequence: Synthetic peptide
  Seed: SQPEGKFSL (MAGC3_HUMAN)
SEPEGKFSV

SEQ ID NO: 104584 - protein, 9 aa, Artificial Sequence
  Description of Artificial Sequence: Synthetic peptide
  Seed: TTDDATAMA (MAGC3_HUMAN)
TIDDATAMF

SEQ ID NO: 104585 - protein, 10 aa, Artificial Sequence
  Description of Artificial Sequence: Synthetic peptide
  Seed: TAMASASPSV (MAGC3_HUMAN)
TTMASASPSI

SEQ ID NO: 104586 - protein, 9 aa, Artificial Sequence
  Description of Artificial Sequence: Synthetic peptide
  Seed: MASASPSVM (MAGC3_HUMAN)
MQSASPSVA

SEQ ID NO: 104587 - protein, 11 aa, Artificial Sequence
  Description of Artificial Sequence: Synthetic peptide
  Seed: YALDEKVAELV (MAGC3_HUMAN)
YMLDEKVAELS

SEQ ID NO: 104588 - protein, 10 aa, Artificial Sequence
  Description of Artificial Sequence: Synthetic peptide
  Seed: EVIWEVLSAI (MAGC3_HUMAN)
EFIWEVLSAV

SEQ ID NO: 104589 - protein, 9 aa, Artificial Sequence
  Description of Artificial Sequence: Synthetic peptide
  Seed: RPAREVLEF (MAGC3_HUMAN)
RQAREVLEF

SEQ ID NO: 104590 - protein, 10 aa, Artificial Sequence
  Description of Artificial Sequence: Synthetic peptide
  Seed: FKLWRTLSGS (MAGC3_HUMAN)
FNLWRTLSGI

SEQ ID NO: 104591 - protein, 9 aa, Artificial Sequence
  Description of Artificial Sequence: Synthetic peptide
  Seed: MIFRKAREF (MAGC3_HUMAN)
MVFRKAREW

SEQ ID NO: 104592 - protein, 9 aa, Artificial Sequence
  Description of Artificial Sequence: Synthetic peptide
  Seed: MEDRAQAII (MAGC3_HUMAN)
MTDRAQAIL

SEQ ID NO: 104593 - protein, 9 aa, Artificial Sequence
  Description of Artificial Sequence: Synthetic peptide
  Seed: MQMNVINTY (MAGC3_HUMAN)
MQMNVINTC

SEQ ID NO: 104594 - protein, 11 aa, Artificial Sequence
  Description of Artificial Sequence: Synthetic peptide
  Seed: RTLSGSPGLQL (MAGC3_HUMAN)
RQLSGSPGLQF

SEQ ID NO: 104595 - protein, 9 aa, Artificial Sequence
  Description of Artificial Sequence: Synthetic peptide
  Seed: VDPDHFYVF (MAGC3_HUMAN)
VHPDHFYVM

SEQ ID NO: 104596 - protein, 9 aa, Artificial Sequence
  Description of Artificial Sequence: Synthetic peptide
  Seed: AGFADVLSR (MAGC3_HUMAN)
AIFADVLSL

SEQ ID NO: 104597 - protein, 9 aa, Artificial Sequence
  Description of Artificial Sequence: Synthetic peptide
  Seed: MLTTVIKKY (MAGC3_HUMAN)
MMTTVIKKY

SEQ ID NO: 104598 - protein, 10 aa, Artificial Sequence
  Description of Artificial Sequence: Synthetic peptide
  Seed: TAMASASPSV (MAGC3_HUMAN)
TWMASASPSL

SEQ ID NO: 104599 - protein, 9 aa, Artificial Sequence
  Description of Artificial Sequence: Synthetic peptide
  Seed: TSDQRMDSL (MAGC3_HUMAN)
TLDQRMDSY

SEQ ID NO: 104600 - protein, 9 aa, Artificial Sequence
  Description of Artificial Sequence: Synthetic peptide
  Seed: TGYFPMIFR (MAGC3_HUMAN)
TVYFPMIFR

SEQ ID NO: 104601 - protein, 10 aa, Artificial Sequence
  Description of Artificial Sequence: Synthetic peptide
  Seed: KVDKLVQFLL (MAGC3_HUMAN)
KLDKLVQFLI

SEQ ID NO: 104602 - protein, 9 aa, Artificial Sequence
  Description of Artificial Sequence: Synthetic peptide
  Seed: YQTKEPVTK (MAGC3_HUMAN)
YATKEPVTH

SEQ ID NO: 104603 - protein, 9 aa, Artificial Sequence
  Description of Artificial Sequence: Synthetic peptide
  Seed: SAFHLGHLR (MAGC3_HUMAN)
SLFHLGHLK

SEQ ID NO: 104604 - protein, 9 aa, Artificial Sequence
  Description of Artificial Sequence: Synthetic peptide
  Seed: GYFPMIFRK (MAGC3_HUMAN)
GQFPMIFRR

SEQ ID NO: 104605 - protein, 10 aa, Artificial Sequence
  Description of Artificial Sequence: Synthetic peptide
  Seed: MNVINTYTGY (MAGC3_HUMAN)
MYVINTYTGF

SEQ ID NO: 104606 - protein, 9 aa, Artificial Sequence
  Description of Artificial Sequence: Synthetic peptide
  Seed: YKDYFPMIF (MAGC3_HUMAN)
YMDYFPMIF

SEQ ID NO: 104607 - protein, 10 aa, Artificial Sequence
  Description of Artificial Sequence: Synthetic peptide
  Seed: EVLSAIGPIQ (MAGC3_HUMAN)
ELLSAIGPIR

SEQ ID NO: 104608 - protein, 9 aa, Artificial Sequence
  Description of Artificial Sequence: Synthetic peptide
  Seed: LSDEQGMPQ (MAGC3_HUMAN)
LIDEQGMPY

SEQ ID NO: 104609 - protein, 9 aa, Artificial Sequence
  Description of Artificial Sequence: Synthetic peptide
  Seed: TEASPQQKK (MAGC3_HUMAN)
TTASPQQKK

SEQ ID NO: 104610 - protein, 10 aa, Artificial Sequence
  Description of Artificial Sequence: Synthetic peptide
  Seed: YALSPVVLPP (MAGC3_HUMAN)
YNLSPVVLPI

SEQ ID NO: 104611 - protein, 11 aa, Artificial Sequence
  Description of Artificial Sequence: Synthetic peptide
  Seed: FLSKLSSIIPS (MAGC3_HUMAN)
FISKLSSIIPI

SEQ ID NO: 104612 - protein, 9 aa, Artificial Sequence
  Description of Artificial Sequence: Synthetic peptide
  Seed: DMDPDNHSY (MAGC3_HUMAN)
DIDPDNHSM

SEQ ID NO: 104613 - protein, 9 aa, Artificial Sequence
  Description of Artificial Sequence: Synthetic peptide
  Seed: QRMDSLVLC (MAGC3_HUMAN)
QHMDSLVLA

SEQ ID NO: 104614 - protein, 9 aa, Artificial Sequence
  Description of Artificial Sequence: Synthetic peptide
  Seed: YTGYFPMIF (MAGC3_HUMAN)
YWGYFPMIM

SEQ ID NO: 104615 - protein, 10 aa, Artificial Sequence
  Description of Artificial Sequence: Synthetic peptide
  Seed: SALAGFADVL (MAGC3_HUMAN)
SHLAGFADVV

SEQ ID NO: 104616 - protein, 9 aa, Artificial Sequence
  Description of Artificial Sequence: Synthetic peptide
  Seed: ALDEKVAEL (MAGC3_HUMAN)
ALDEKVAEA

SEQ ID NO: 104617 - protein, 9 aa, Artificial Sequence
  Description of Artificial Sequence: Synthetic peptide
  Seed: SLPAVSPGK (MAGC3_HUMAN)
SIPAVSPGK

SEQ ID NO: 104618 - protein, 11 aa, Artificial Sequence
  Description of Artificial Sequence: Synthetic peptide
  Seed: MQMNVINTYTG (MAGC3_HUMAN)
MSMNVINTYTF

SEQ ID NO: 104619 - protein, 9 aa, Artificial Sequence
  Description of Artificial Sequence: Synthetic peptide
  Seed: FSLRRAVSV (MAGC3_HUMAN)
FILRRAVSA

SEQ ID NO: 104620 - protein, 10 aa, Artificial Sequence
  Description of Artificial Sequence: Synthetic peptide
  Seed: SQPEGKFSLR (MAGC3_HUMAN)
SAPEGKFSLM

SEQ ID NO: 104621 - protein, 9 aa, Artificial Sequence
  Description of Artificial Sequence: Synthetic peptide
  Seed: SEEVIWEVL (MAGC3_HUMAN)
SHEVIWEVI

SEQ ID NO: 104622 - protein, 9 aa, Artificial Sequence
  Description of Artificial Sequence: Synthetic peptide
  Seed: ALDEKVAEL (MAGC3_HUMAN)
ALDEKVAET

SEQ ID NO: 104623 - protein, 9 aa, Artificial Sequence
  Description of Artificial Sequence: Synthetic peptide
  Seed: RTLWKDSDL (MAGC3_HUMAN)
RALWKDSDW

SEQ ID NO: 104624 - protein, 9 aa, Artificial Sequence
  Description of Artificial Sequence: Synthetic peptide
  Seed: TSDQRMDSL (MAGC3_HUMAN)
TADQRMDSL

SEQ ID NO: 104625 - protein, 10 aa, Artificial Sequence
  Description of Artificial Sequence: Synthetic peptide
  Seed: EVIWEVLNAI (MAGC3_HUMAN)
EIIWEVLNAI

SEQ ID NO: 104626 - protein, 9 aa, Artificial Sequence
  Description of Artificial Sequence: Synthetic peptide
  Seed: YQAKEPLTR (MAGC3_HUMAN)
YRAKEPLTF

SEQ ID NO: 104627 - protein, 10 aa, Artificial Sequence
  Description of Artificial Sequence: Synthetic peptide
  Seed: SQPEGKFSLR (MAGC3_HUMAN)
SVPEGKFSLR

SEQ ID NO: 104628 - protein, 10 aa, Artificial Sequence
  Description of Artificial Sequence: Synthetic peptide
  Seed: LILILSMIFI (MAGC3_HUMAN)
LWLILSMIFV

SEQ ID NO: 104629 - protein, 10 aa, Artificial Sequence
  Description of Artificial Sequence: Synthetic peptide
  Seed: TTDDATAMAS (MAGC3_HUMAN)
TADDATAMAF

SEQ ID NO: 104630 - protein, 9 aa, Artificial Sequence
  Description of Artificial Sequence: Synthetic peptide
  Seed: VLCPTYFKL (MAGC3_HUMAN)
VMCPTYFKL

SEQ ID NO: 104631 - protein, 10 aa, Artificial Sequence
  Description of Artificial Sequence: Synthetic peptide
  Seed: ANPQGLAGHR (MAGC3_HUMAN)
AVPQGLAGHR

SEQ ID NO: 104632 - protein, 9 aa, Artificial Sequence
  Description of Artificial Sequence: Synthetic peptide
  Seed: MIFGKAHEF (MAGC3_HUMAN)
MFFGKAHEF

SEQ ID NO: 104633 - protein, 9 aa, Artificial Sequence
  Description of Artificial Sequence: Synthetic peptide
  Seed: MPAAGMPPL (MAGC3_HUMAN)
MKAAGMPPL

SEQ ID NO: 104634 - protein, 10 aa, Artificial Sequence
  Description of Artificial Sequence: Synthetic peptide
  Seed: MQMNVINTYT (MAGC3_HUMAN)
MSMNVINTYA

SEQ ID NO: 104635 - protein, 9 aa, Artificial Sequence
  Description of Artificial Sequence: Synthetic peptide
  Seed: SASPSVMST (MAGC3_HUMAN)
SSSPSVMSI

SEQ ID NO: 104636 - protein, 9 aa, Artificial Sequence
  Description of Artificial Sequence: Synthetic peptide
  Seed: LANPQGLAG (MAGC3_HUMAN)
LSNPQGLAM

SEQ ID NO: 104637 - protein, 10 aa, Artificial Sequence
  Description of Artificial Sequence: Synthetic peptide
  Seed: MNVINTYTGY (MAGC3_HUMAN)
MHVINTYTGK

SEQ ID NO: 104638 - protein, 9 aa, Artificial Sequence
  Description of Artificial Sequence: Synthetic peptide
  Seed: MLLPCHWVL (MAGC3_HUMAN)
MMLPCHWVK

SEQ ID NO: 104639 - protein, 10 aa, Artificial Sequence
  Description of Artificial Sequence: Synthetic peptide
  Seed: INTYTGYFPM (MAGC3_HUMAN)
ICTYTGYFPY

SEQ ID NO: 104640 - protein, 10 aa, Artificial Sequence
  Description of Artificial Sequence: Synthetic peptide
  Seed: SCSSPLLWTR (MAGC3_HUMAN)
SYSSPLLWTR

SEQ ID NO: 104641 - protein, 9 aa, Artificial Sequence
  Description of Artificial Sequence: Synthetic peptide
  Seed: MQMNVINTY (MAGC3_HUMAN)
MAMNVINTI

SEQ ID NO: 104642 - protein, 9 aa, Artificial Sequence
  Description of Artificial Sequence: Synthetic peptide
  Seed: FADVLSRLA (MAGC3_HUMAN)
FSDVLSRLM

SEQ ID NO: 104643 - protein, 11 aa, Artificial Sequence
  Description of Artificial Sequence: Synthetic peptide
  Seed: EILFGISLTEV (MAGC3_HUMAN)
ETLFGISLTEV

SEQ ID NO: 104644 - protein, 9 aa, Artificial Sequence
  Description of Artificial Sequence: Synthetic peptide
  Seed: KGSCVPEEV (MAGC3_HUMAN)
KMSCVPEEF

SEQ ID NO: 104645 - protein, 9 aa, Artificial Sequence
  Description of Artificial Sequence: Synthetic peptide
  Seed: VINTYTGYF (MAGC3_HUMAN)
VTNTYTGYM

SEQ ID NO: 104646 - protein, 10 aa, Artificial Sequence
  Description of Artificial Sequence: Synthetic peptide
  Seed: EVIWEVLSAI (MAGC3_HUMAN)
ESIWEVLSAV

SEQ ID NO: 104647 - protein, 9 aa, Artificial Sequence
  Description of Artificial Sequence: Synthetic peptide
  Seed: RGTGYTLSL (MAGC3_HUMAN)
RMTGYTLSV

SEQ ID NO: 104648 - protein, 9 aa, Artificial Sequence
  Description of Artificial Sequence: Synthetic peptide
  Seed: WVKNTCATY (MAGC3_HUMAN)
WFKNTCATF

SEQ ID NO: 104649 - protein, 9 aa, Artificial Sequence
  Description of Artificial Sequence: Synthetic peptide
  Seed: FPMIFRKAR (MAGC3_HUMAN)
FPMIFRKAV

SEQ ID NO: 104650 - protein, 11 aa, Artificial Sequence
  Description of Artificial Sequence: Synthetic peptide
  Seed: TLWKDSDLPTW (MAGC3_HUMAN)
TLWKDSDLPTF

SEQ ID NO: 104651 - protein, 10 aa, Artificial Sequence
  Description of Artificial Sequence: Synthetic peptide
  Seed: KLVQFLLLKY (MAGC3_HUMAN)
KCVQFLLLKK

SEQ ID NO: 104652 - protein, 10 aa, Artificial Sequence
  Description of Artificial Sequence: Synthetic peptide
  Seed: ADVLSRLALW (MAGC3_HUMAN)
AEVLSRLALW

SEQ ID NO: 104653 - protein, 9 aa, Artificial Sequence
  Description of Artificial Sequence: Synthetic peptide
  Seed: LSGSPGLQL (MAGC3_HUMAN)
LTGSPGLQI

SEQ ID NO: 104654 - protein, 9 aa, Artificial Sequence
  Description of Artificial Sequence: Synthetic peptide
  Seed: EFIELIFGI (MAGC3_HUMAN)
EYIELIFGL

SEQ ID NO: 104655 - protein, 9 aa, Artificial Sequence
  Description of Artificial Sequence: Synthetic peptide
  Seed: FSLRRAVSV (MAGC3_HUMAN)
FILRRAVSY

SEQ ID NO: 104656 - protein, 10 aa, Artificial Sequence
  Description of Artificial Sequence: Synthetic peptide
  Seed: YTGYFPMIFR (MAGC3_HUMAN)
YSGYFPMIFK

SEQ ID NO: 104657 - protein, 8 aa, Artificial Sequence
  Description of Artificial Sequence: Synthetic peptide
  Seed: KVDKLVQF (MAGC3_HUMAN)
KFDKLVQL

SEQ ID NO: 104658 - protein, 9 aa, Artificial Sequence
  Description of Artificial Sequence: Synthetic peptide
  Seed: EVIWEVLNA (MAGC3_HUMAN)
EMIWEVLNV

SEQ ID NO: 104659 - protein, 10 aa, Artificial Sequence
  Description of Artificial Sequence: Synthetic peptide
  Seed: LILILSMIFI (MAGC3_HUMAN)
LMLILSMIFI

SEQ ID NO: 104660 - protein, 9 aa, Artificial Sequence
  Description of Artificial Sequence: Synthetic peptide
  Seed: KLVQFLLLK (MAGC3_HUMAN)
KMVQFLLLI

SEQ ID NO: 104661 - protein, 9 aa, Artificial Sequence
  Description of Artificial Sequence: Synthetic peptide
  Seed: IIPSAFPSW (MAGC3_HUMAN)
IWPSAFPSV

SEQ ID NO: 104662 - protein, 10 aa, Artificial Sequence
  Description of Artificial Sequence: Synthetic peptide
  Seed: MNVINTYTGY (MAGC3_HUMAN)
MFVINTYTGR

SEQ ID NO: 104663 - protein, 9 aa, Artificial Sequence
  Description of Artificial Sequence: Synthetic peptide
  Seed: FSDGSLGQW (MAGC3_HUMAN)
FFDGSLGQI

SEQ ID NO: 104664 - protein, 10 aa, Artificial Sequence
  Description of Artificial Sequence: Synthetic peptide
  Seed: MLLPCHWVLD (MAGC3_HUMAN)
MVLPCHWVLI

SEQ ID NO: 104665 - protein, 9 aa, Artificial Sequence
  Description of Artificial Sequence: Synthetic peptide
  Seed: LSRLALWES (MAGC3_HUMAN)
LTRLALWEK

SEQ ID NO: 104666 - protein, 10 aa, Artificial Sequence
  Description of Artificial Sequence: Synthetic peptide
  Seed: ATYALSPVVL (MAGC3_HUMAN)
AYYALSPVVY

SEQ ID NO: 104667 - protein, 10 aa, Artificial Sequence
  Description of Artificial Sequence: Synthetic peptide
  Seed: MDSLVLCPTY (MAGC3_HUMAN)
MSSLVLCPTY

SEQ ID NO: 104668 - protein, 9 aa, Artificial Sequence
  Description of Artificial Sequence: Synthetic peptide
  Seed: KLVQFLLLK (MAGC3_HUMAN)
KLVQFLLLH

SEQ ID NO: 104669 - protein, 10 aa, Artificial Sequence
  Description of Artificial Sequence: Synthetic peptide
  Seed: TDMDPDNHSY (MAGC3_HUMAN)
TVMDPDNHSF

SEQ ID NO: 104670 - protein, 9 aa, Artificial Sequence
  Description of Artificial Sequence: Synthetic peptide
  Seed: VIWEVLSAI (MAGC3_HUMAN)
VMWEVLSAV

SEQ ID NO: 104671 - protein, 9 aa, Artificial Sequence
  Description of Artificial Sequence: Synthetic peptide
  Seed: KKYKDYFPM (MAGC3_HUMAN)
KHYKDYFPM

SEQ ID NO: 104672 - protein, 9 aa, Artificial Sequence
  Description of Artificial Sequence: Synthetic peptide
  Seed: TEVDPDHFY (MAGC3_HUMAN)
TEVDPDHFM

SEQ ID NO: 104673 - protein, 9 aa, Artificial Sequence
  Description of Artificial Sequence: Synthetic peptide
  Seed: LRSAEGSVL (MAGC3_HUMAN)
LHSAEGSVL

SEQ ID NO: 104674 - protein, 9 aa, Artificial Sequence
  Description of Artificial Sequence: Synthetic peptide
  Seed: NAIGPWSAL (MAGC3_HUMAN)
NKIGPWSAM

SEQ ID NO: 104675 - protein, 9 aa, Artificial Sequence
  Description of Artificial Sequence: Synthetic peptide
  Seed: YTGYFPMIF (MAGC3_HUMAN)
YRGYFPMIL

SEQ ID NO: 104676 - protein, 9 aa, Artificial Sequence
  Description of Artificial Sequence: Synthetic peptide
  Seed: MQMNVINTY (MAGC3_HUMAN)
MPMNVINTT

SEQ ID NO: 104677 - protein, 9 aa, Artificial Sequence
  Description of Artificial Sequence: Synthetic peptide
  Seed: SLVLCPTYF (MAGC3_HUMAN)
SMVLCPTYY

SEQ ID NO: 104678 - protein, 11 aa, Artificial Sequence
  Description of Artificial Sequence: Synthetic peptide
  Seed: EILFGISLTEV (MAGC3_HUMAN)
EKLFGISLTEI

SEQ ID NO: 104679 - protein, 9 aa, Artificial Sequence
  Description of Artificial Sequence: Synthetic peptide
  Seed: NAIGPWSAL (MAGC3_HUMAN)
NVIGPWSAA

SEQ ID NO: 104680 - protein, 9 aa, Artificial Sequence
  Description of Artificial Sequence: Synthetic peptide
  Seed: ATYALSPVV (MAGC3_HUMAN)
AAYALSPVF

SEQ ID NO: 104681 - protein, 10 aa, Artificial Sequence
  Description of Artificial Sequence: Synthetic peptide
  Seed: KLVQFLLLKY (MAGC3_HUMAN)
KYVQFLLLKK

SEQ ID NO: 104682 - protein, 8 aa, Artificial Sequence
  Description of Artificial Sequence: Synthetic peptide
  Seed: MPQNRLLI (MAGC3_HUMAN)
MMQNRLLL

SEQ ID NO: 104683 - protein, 10 aa, Artificial Sequence
  Description of Artificial Sequence: Synthetic peptide
  Seed: SCSSPLLWTR (MAGC3_HUMAN)
SYSSPLLWTK

SEQ ID NO: 104684 - protein, 11 aa, Artificial Sequence
  Description of Artificial Sequence: Synthetic peptide
  Seed: AIIDTTDDATA (MAGC3_HUMAN)
ALIDTTDDATV

SEQ ID NO: 104685 - protein, 9 aa, Artificial Sequence
  Description of Artificial Sequence: Synthetic peptide
  Seed: TYTGYFPMI (MAGC3_HUMAN)
TYTGYFPML

SEQ ID NO: 104686 - protein, 9 aa, Artificial Sequence
  Description of Artificial Sequence: Synthetic peptide
  Seed: FPSWYMDAL (MAGC3_HUMAN)
FRSWYMDAL

SEQ ID NO: 104687 - protein, 10 aa, Artificial Sequence
  Description of Artificial Sequence: Synthetic peptide
  Seed: EVIWEVLNAI (MAGC3_HUMAN)
ETIWEVLNAK

SEQ ID NO: 104688 - protein, 9 aa, Artificial Sequence
  Description of Artificial Sequence: Synthetic peptide
  Seed: ATYALSPVV (MAGC3_HUMAN)
AMYALSPVA

SEQ ID NO: 104689 - protein, 9 aa, Artificial Sequence
  Description of Artificial Sequence: Synthetic peptide
  Seed: EVLEFLSKL (MAGC3_HUMAN)
EILEFLSKR

SEQ ID NO: 104690 - protein, 9 aa, Artificial Sequence
  Description of Artificial Sequence: Synthetic peptide
  Seed: SALAGFADV (MAGC3_HUMAN)
SALAGFADM

SEQ ID NO: 104691 - protein, 9 aa, Artificial Sequence
  Description of Artificial Sequence: Synthetic peptide
  Seed: FEDTLDLTY (MAGC3_HUMAN)
FPDTLDLTM

SEQ ID NO: 104692 - protein, 9 aa, Artificial Sequence
  Description of Artificial Sequence: Synthetic peptide
  Seed: TTDDATAMA (MAGC3_HUMAN)
TWDDATAMI

SEQ ID NO: 104693 - protein, 10 aa, Artificial Sequence
  Description of Artificial Sequence: Synthetic peptide
  Seed: YALSPVVLPP (MAGC3_HUMAN)
YKLSPVVLPA

SEQ ID NO: 104694 - protein, 9 aa, Artificial Sequence
  Description of Artificial Sequence: Synthetic peptide
  Seed: MASASPSVM (MAGC3_HUMAN)
MTSASPSVI

SEQ ID NO: 104695 - protein, 9 aa, Artificial Sequence
  Description of Artificial Sequence: Synthetic peptide
  Seed: WESEGPEAF (MAGC3_HUMAN)
WHSEGPEAF

SEQ ID NO: 104696 - protein, 9 aa, Artificial Sequence
  Description of Artificial Sequence: Synthetic peptide
  Seed: SAIGPIQRP (MAGC3_HUMAN)
STIGPIQRY

SEQ ID NO: 104697 - protein, 9 aa, Artificial Sequence
  Description of Artificial Sequence: Synthetic peptide
  Seed: MEDRAQAII (MAGC3_HUMAN)
MIDRAQAIL

SEQ ID NO: 104698 - protein, 11 aa, Artificial Sequence
  Description of Artificial Sequence: Synthetic peptide
  Seed: LSKLSSIIPSA (MAGC3_HUMAN)
LDKLSSIIPSV

SEQ ID NO: 104699 - protein, 10 aa, Artificial Sequence
  Description of Artificial Sequence: Synthetic peptide
  Seed: YSAFHLGHLR (MAGC3_HUMAN)
YCAFHLGHLK

SEQ ID NO: 104700 - protein, 11 aa, Artificial Sequence
  Description of Artificial Sequence: Synthetic peptide
  Seed: TDMDPDNHSYF (MAGC3_HUMAN)
TAMDPDNHSYM

SEQ ID NO: 104701 - protein, 9 aa, Artificial Sequence
  Description of Artificial Sequence: Synthetic peptide
  Seed: WRRGTGYTL (MAGC3_HUMAN)
WMRGTGYTY

SEQ ID NO: 104702 - protein, 9 aa, Artificial Sequence
  Description of Artificial Sequence: Synthetic peptide
  Seed: FSDGSLGQW (MAGC3_HUMAN)
FIDGSLGQM

SEQ ID NO: 104703 - protein, 9 aa, Artificial Sequence
  Description of Artificial Sequence: Synthetic peptide
  Seed: YQAKEPLTR (MAGC3_HUMAN)
YVAKEPLTH

SEQ ID NO: 104704 - protein, 8 aa, Artificial Sequence
  Description of Artificial Sequence: Synthetic peptide
  Seed: FADVLSRL (MAGC3_HUMAN)
FIDVLSRM

SEQ ID NO: 104705 - protein, 9 aa, Artificial Sequence
  Description of Artificial Sequence: Synthetic peptide
  Seed: MLLPCHWVL (MAGC3_HUMAN)
MWLPCHWVL

SEQ ID NO: 104706 - protein, 11 aa, Artificial Sequence
  Description of Artificial Sequence: Synthetic peptide
  Seed: IIDTTDDATAM (MAGC3_HUMAN)
IQDTTDDATAL

SEQ ID NO: 104707 - protein, 10 aa, Artificial Sequence
  Description of Artificial Sequence: Synthetic peptide
  Seed: YTGYFPMIFR (MAGC3_HUMAN)
YCGYFPMIFR

SEQ ID NO: 104708 - protein, 9 aa, Artificial Sequence
  Description of Artificial Sequence: Synthetic peptide
  Seed: KKYKDYFPM (MAGC3_HUMAN)
KGYKDYFPY

SEQ ID NO: 104709 - protein, 10 aa, Artificial Sequence
  Description of Artificial Sequence: Synthetic peptide
  Seed: LDSCSSPLLW (MAGC3_HUMAN)
LYSCSSPLLW

SEQ ID NO: 104710 - protein, 9 aa, Artificial Sequence
  Description of Artificial Sequence: Synthetic peptide
  Seed: FLSKLSSII (MAGC3_HUMAN)
FVSKLSSIF

SEQ ID NO: 104711 - protein, 10 aa, Artificial Sequence
  Description of Artificial Sequence: Synthetic peptide
  Seed: IPSAFPSWYM (MAGC3_HUMAN)
ITSAFPSWYW

SEQ ID NO: 104712 - protein, 10 aa, Artificial Sequence
  Description of Artificial Sequence: Synthetic peptide
  Seed: KDYFPMIFGK (MAGC3_HUMAN)
KSYFPMIFGK

SEQ ID NO: 104713 - protein, 10 aa, Artificial Sequence
  Description of Artificial Sequence: Synthetic peptide
  Seed: ATYALSPVVL (MAGC3_HUMAN)
ASYALSPVVW

SEQ ID NO: 104714 - protein, 9 aa, Artificial Sequence
  Description of Artificial Sequence: Synthetic peptide
  Seed: LILILSMIF (MAGC3_HUMAN)
LSLILSMIY

SEQ ID NO: 104715 - protein, 9 aa, Artificial Sequence
  Description of Artificial Sequence: Synthetic peptide
  Seed: LRSAEGSVL (MAGC3_HUMAN)
LVSAEGSVF

SEQ ID NO: 104716 - protein, 10 aa, Artificial Sequence
  Description of Artificial Sequence: Synthetic peptide
  Seed: LVLCPTYFKL (MAGC3_HUMAN)
LKLCPTYFKV

SEQ ID NO: 104717 - protein, 9 aa, Artificial Sequence
  Description of Artificial Sequence: Synthetic peptide
  Seed: DMDPDNHSY (MAGC3_HUMAN)
DADPDNHSL

SEQ ID NO: 104718 - protein, 10 aa, Artificial Sequence
  Description of Artificial Sequence: Synthetic peptide
  Seed: MDPDNHSYFF (MAGC3_HUMAN)
MMPDNHSYFL

SEQ ID NO: 104719 - protein, 9 aa, Artificial Sequence
  Description of Artificial Sequence: Synthetic peptide
  Seed: QGMPQNRLL (MAGC3_HUMAN)
QTMPQNRLW

SEQ ID NO: 104720 - protein, 9 aa, Artificial Sequence
  Description of Artificial Sequence: Synthetic peptide
  Seed: KVAELVQFL (MAGC3_HUMAN)
KLAELVQFL

SEQ ID NO: 104721 - protein, 11 aa, Artificial Sequence
  Description of Artificial Sequence: Synthetic peptide
  Seed: SVLDLANPQGL (MAGC3_HUMAN)
SQLDLANPQGW

SEQ ID NO: 104722 - protein, 10 aa, Artificial Sequence
  Description of Artificial Sequence: Synthetic peptide
  Seed: EVIWEVLNAI (MAGC3_HUMAN)
ETIWEVLNAT

SEQ ID NO: 104723 - protein, 11 aa, Artificial Sequence
  Description of Artificial Sequence: Synthetic peptide
  Seed: ALWESEGPEAF (MAGC3_HUMAN)
AQWESEGPEAF

SEQ ID NO: 104724 - protein, 10 aa, Artificial Sequence
  Description of Artificial Sequence: Synthetic peptide
  Seed: SPVVLPPQPQ (MAGC3_HUMAN)
SPVVLPPQPA

SEQ ID NO: 104725 - protein, 8 aa, Artificial Sequence
  Description of Artificial Sequence: Synthetic peptide
  Seed: IFGKAHEF (MAGC3_HUMAN)
IFGKAHEM

SEQ ID NO: 104726 - protein, 9 aa, Artificial Sequence
  Description of Artificial Sequence: Synthetic peptide
  Seed: EVIWEVLSA (MAGC3_HUMAN)
EVIWEVLSI

SEQ ID NO: 104727 - protein, 10 aa, Artificial Sequence
  Description of Artificial Sequence: Synthetic peptide
  Seed: NVINTYTGYF (MAGC3_HUMAN)
NQINTYTGYF

SEQ ID NO: 104728 - protein, 9 aa, Artificial Sequence
  Description of Artificial Sequence: Synthetic peptide
  Seed: LIDDQGMPK (MAGC3_HUMAN)
LLDDQGMPL

SEQ ID NO: 104729 - protein, 10 aa, Artificial Sequence
  Description of Artificial Sequence: Synthetic peptide
  Seed: LPQSPPEIPP (MAGC3_HUMAN)
LPQSPPEIPM

SEQ ID NO: 104730 - protein, 10 aa, Artificial Sequence
  Description of Artificial Sequence: Synthetic peptide
  Seed: IELIFGIALT (MAGC3_HUMAN)
IQLIFGIALA

SEQ ID NO: 104731 - protein, 9 aa, Artificial Sequence
  Description of Artificial Sequence: Synthetic peptide
  Seed: QLSDLHFGS (MAGC3_HUMAN)
QQSDLHFGL

SEQ ID NO: 104732 - protein, 9 aa, Artificial Sequence
  Description of Artificial Sequence: Synthetic peptide
  Seed: SAFHLGHLR (MAGC3_HUMAN)
SSFHLGHLY

SEQ ID NO: 104733 - protein, 9 aa, Artificial Sequence
  Description of Artificial Sequence: Synthetic peptide
  Seed: YKDYFPMIF (MAGC3_HUMAN)
YMDYFPMIM

SEQ ID NO: 104734 - protein, 10 aa, Artificial Sequence
  Description of Artificial Sequence: Synthetic peptide
  Seed: REVRLFLRGG (MAGC3_HUMAN)
RWVRLFLRGI

SEQ ID NO: 104735 - protein, 10 aa, Artificial Sequence
  Description of Artificial Sequence: Synthetic peptide
  Seed: CVPEEVIWEV (MAGC3_HUMAN)
CMPEEVIWEM

SEQ ID NO: 104736 - protein, 9 aa, Artificial Sequence
  Description of Artificial Sequence: Synthetic peptide
  Seed: FSLRRAVSV (MAGC3_HUMAN)
FALRRAVSY

SEQ ID NO: 104737 - protein, 10 aa, Artificial Sequence
  Description of Artificial Sequence: Synthetic peptide
  Seed: YTLDEKVDKL (MAGC3_HUMAN)
YPLDEKVDKV

SEQ ID NO: 104738 - protein, 9 aa, Artificial Sequence
  Description of Artificial Sequence: Synthetic peptide
  Seed: EVDPDHFYV (MAGC3_HUMAN)
EIDPDHFYM

SEQ ID NO: 104739 - protein, 9 aa, Artificial Sequence
  Description of Artificial Sequence: Synthetic peptide
  Seed: GKAHEFIEL (MAGC3_HUMAN)
GMAHEFIEF

SEQ ID NO: 104740 - protein, 9 aa, Artificial Sequence
  Description of Artificial Sequence: Synthetic peptide
  Seed: KYKDYFPMI (MAGC3_HUMAN)
KCKDYFPMK

SEQ ID NO: 104741 - protein, 9 aa, Artificial Sequence
  Description of Artificial Sequence: Synthetic peptide
  Seed: DTTDDATAM (MAGC3_HUMAN)
DQTDDATAY

SEQ ID NO: 104742 - protein, 9 aa, Artificial Sequence
  Description of Artificial Sequence: Synthetic peptide
  Seed: TTDDATAMA (MAGC3_HUMAN)
TTDDATAMY

SEQ ID NO: 104743 - protein, 9 aa, Artificial Sequence
  Description of Artificial Sequence: Synthetic peptide
  Seed: KYKDYFPMI (MAGC3_HUMAN)
KFKDYFPMI

SEQ ID NO: 104744 - protein, 10 aa, Artificial Sequence
  Description of Artificial Sequence: Synthetic peptide
  Seed: SIIPSAFPSW (MAGC3_HUMAN)
SFIPSAFPSF

SEQ ID NO: 104745 - protein, 10 aa, Artificial Sequence
  Description of Artificial Sequence: Synthetic peptide
  Seed: SAFHLGHLRE (MAGC3_HUMAN)
STFHLGHLRF

SEQ ID NO: 104746 - protein, 9 aa, Artificial Sequence
  Description of Artificial Sequence: Synthetic peptide
  Seed: WVKNTCATY (MAGC3_HUMAN)
WHKNTCATF

SEQ ID NO: 104747 - protein, 9 aa, Artificial Sequence
  Description of Artificial Sequence: Synthetic peptide
  Seed: KLVQFLLLK (MAGC3_HUMAN)
KAVQFLLLV

SEQ ID NO: 104748 - protein, 9 aa, Artificial Sequence
  Description of Artificial Sequence: Synthetic peptide
  Seed: SEEEDTATW (MAGC3_HUMAN)
SEEEDTATF

SEQ ID NO: 104749 - protein, 9 aa, Artificial Sequence
  Description of Artificial Sequence: Synthetic peptide
  Seed: RGTGYTLSL (MAGC3_HUMAN)
RVTGYTLSF

SEQ ID NO: 104750 - protein, 9 aa, Artificial Sequence
  Description of Artificial Sequence: Synthetic peptide
  Seed: SLRRAVSVK (MAGC3_HUMAN)
SARRAVSVA

SEQ ID NO: 104751 - protein, 9 aa, Artificial Sequence
  Description of Artificial Sequence: Synthetic peptide
  Seed: IIPSAFPSW (MAGC3_HUMAN)
ILPSAFPSI

SEQ ID NO: 104752 - protein, 9 aa, Artificial Sequence
  Description of Artificial Sequence: Synthetic peptide
  Seed: SIIPSAFPS (MAGC3_HUMAN)
SAIPSAFPV

SEQ ID NO: 104753 - protein, 11 aa, Artificial Sequence
  Description of Artificial Sequence: Synthetic peptide
  Seed: DSCSSPLLWTR (MAGC3_HUMAN)
DYCSSPLLWTR

SEQ ID NO: 104754 - protein, 9 aa, Artificial Sequence
  Description of Artificial Sequence: Synthetic peptide
  Seed: ALDEKVAEL (MAGC3_HUMAN)
APDEKVAEL

SEQ ID NO: 104755 - protein, 10 aa, Artificial Sequence
  Description of Artificial Sequence: Synthetic peptide
  Seed: FSDGSLGQWV (MAGC3_HUMAN)
FGDGSLGQWM

SEQ ID NO: 104756 - protein, 10 aa, Artificial Sequence
  Description of Artificial Sequence: Synthetic peptide
  Seed: REVLEFLSKL (MAGC3_HUMAN)
RKVLEFLSKV

SEQ ID NO: 104757 - protein, 9 aa, Artificial Sequence
  Description of Artificial Sequence: Synthetic peptide
  Seed: YFFEDTLDL (MAGC3_HUMAN)
YGFEDTLDF

SEQ ID NO: 104758 - protein, 9 aa, Artificial Sequence
  Description of Artificial Sequence: Synthetic peptide
  Seed: SASPSVMST (MAGC3_HUMAN)
SPSPSVMSP

SEQ ID NO: 104759 - protein, 9 aa, Artificial Sequence
  Description of Artificial Sequence: Synthetic peptide
  Seed: AGFADVLSR (MAGC3_HUMAN)
ATFADVLSH

SEQ ID NO: 104760 - protein, 9 aa, Artificial Sequence
  Description of Artificial Sequence: Synthetic peptide
  Seed: TSDQRMDSL (MAGC3_HUMAN)
TYDQRMDSL

SEQ ID NO: 104761 - protein, 9 aa, Artificial Sequence
  Description of Artificial Sequence: Synthetic peptide
  Seed: IPSAFPSWY (MAGC3_HUMAN)
IMSAFPSWY

SEQ ID NO: 104762 - protein, 10 aa, Artificial Sequence
  Description of Artificial Sequence: Synthetic peptide
  Seed: PTYFKLWRTL (MAGC3_HUMAN)
PYYFKLWRTF

SEQ ID NO: 104763 - protein, 9 aa, Artificial Sequence
  Description of Artificial Sequence: Synthetic peptide
  Seed: TSDQRMDSL (MAGC3_HUMAN)
TADQRMDSI

SEQ ID NO: 104764 - protein, 9 aa, Artificial Sequence
  Description of Artificial Sequence: Synthetic peptide
  Seed: EVLSAIGPI (MAGC3_HUMAN)
EMLSAIGPR

SEQ ID NO: 104765 - protein, 9 aa, Artificial Sequence
  Description of Artificial Sequence: Synthetic peptide
  Seed: TGYFPMIFR (MAGC3_HUMAN)
TGYFPMIFK

SEQ ID NO: 104766 - protein, 10 aa, Artificial Sequence
  Description of Artificial Sequence: Synthetic peptide
  Seed: YALDEKVAEL (MAGC3_HUMAN)
YTLDEKVAEV

SEQ ID NO: 104767 - protein, 9 aa, Artificial Sequence
  Description of Artificial Sequence: Synthetic peptide
  Seed: KKYKDYFPM (MAGC3_HUMAN)
KKYKDYFPF

SEQ ID NO: 104768 - protein, 9 aa, Artificial Sequence
  Description of Artificial Sequence: Synthetic peptide
  Seed: WYMDALKDM (MAGC3_HUMAN)
WYMDALKDW

SEQ ID NO: 104769 - protein, 9 aa, Artificial Sequence
  Description of Artificial Sequence: Synthetic peptide
  Seed: ALDEKVAEL (MAGC3_HUMAN)
ANDEKVAEL

SEQ ID NO: 104770 - protein, 10 aa, Artificial Sequence
  Description of Artificial Sequence: Synthetic peptide
  Seed: EIPPQGPPKI (MAGC3_HUMAN)
EMPPQGPPKR

SEQ ID NO: 104771 - protein, 11 aa, Artificial Sequence
  Description of Artificial Sequence: Synthetic peptide
  Seed: SLPESEPLFTY (MAGC3_HUMAN)
SLPESEPLFTI

SEQ ID NO: 104772 - protein, 10 aa, Artificial Sequence
  Description of Artificial Sequence: Synthetic peptide
  Seed: MDPDNHSYFF (MAGC3_HUMAN)
MRPDNHSYFM

SEQ ID NO: 104773 - protein, 9 aa, Artificial Sequence
  Description of Artificial Sequence: Synthetic peptide
  Seed: MIFGKAHEF (MAGC3_HUMAN)
MEFGKAHEF

SEQ ID NO: 104774 - protein, 9 aa, Artificial Sequence
  Description of Artificial Sequence: Synthetic peptide
  Seed: RKKATDKDY (MAGC3_HUMAN)
RMKATDKDY

SEQ ID NO: 104775 - protein, 10 aa, Artificial Sequence
  Description of Artificial Sequence: Synthetic peptide
  Seed: SAFHLGHLRE (MAGC3_HUMAN)
SMFHLGHLRH

SEQ ID NO: 104776 - protein, 9 aa, Artificial Sequence
  Description of Artificial Sequence: Synthetic peptide
  Seed: SAFHLGHLR (MAGC3_HUMAN)
SVFHLGHLK

SEQ ID NO: 104777 - protein, 10 aa, Artificial Sequence
  Description of Artificial Sequence: Synthetic peptide
  Seed: KVAELVQFLL (MAGC3_HUMAN)
KIAELVQFLW

SEQ ID NO: 104778 - protein, 10 aa, Artificial Sequence
  Description of Artificial Sequence: Synthetic peptide
  Seed: YFPMIFGKAH (MAGC3_HUMAN)
YYPMIFGKAL

SEQ ID NO: 104779 - protein, 10 aa, Artificial Sequence
  Description of Artificial Sequence: Synthetic peptide
  Seed: EVIWEVLNAI (MAGC3_HUMAN)
ESIWEVLNAV

SEQ ID NO: 104780 - protein, 10 aa, Artificial Sequence
  Description of Artificial Sequence: Synthetic peptide
  Seed: LSLPAVSPGK (MAGC3_HUMAN)
LLLPAVSPGK

SEQ ID NO: 104781 - protein, 9 aa, Artificial Sequence
  Description of Artificial Sequence: Synthetic peptide
  Seed: ALDEKVAEL (MAGC3_HUMAN)
ACDEKVAEV

SEQ ID NO: 104782 - protein, 10 aa, Artificial Sequence
  Description of Artificial Sequence: Synthetic peptide
  Seed: RLWGEKAGSL (MAGC3_HUMAN)
RMWGEKAGSV

SEQ ID NO: 104783 - protein, 9 aa, Artificial Sequence
  Description of Artificial Sequence: Synthetic peptide
  Seed: KKYKDYFPM (MAGC3_HUMAN)
KMYKDYFPV

SEQ ID NO: 104784 - protein, 9 aa, Artificial Sequence
  Description of Artificial Sequence: Synthetic peptide
  Seed: VIWEVLNAI (MAGC3_HUMAN)
VIWEVLNAA

SEQ ID NO: 104785 - protein, 9 aa, Artificial Sequence
  Description of Artificial Sequence: Synthetic peptide
  Seed: ALDEKVAEL (MAGC3_HUMAN)
AGDEKVAEL

SEQ ID NO: 104786 - protein, 10 aa, Artificial Sequence
  Description of Artificial Sequence: Synthetic peptide
  Seed: EVDPDHFYVF (MAGC3_HUMAN)
ELDPDHFYVY

SEQ ID NO: 104787 - protein, 10 aa, Artificial Sequence
  Description of Artificial Sequence: Synthetic peptide
  Seed: FFEDTLDLTY (MAGC3_HUMAN)
FMEDTLDLTF

SEQ ID NO: 104788 - protein, 10 aa, Artificial Sequence
  Description of Artificial Sequence: Synthetic peptide
  Seed: EVIWEVLSAI (MAGC3_HUMAN)
EMIWEVLSAA

SEQ ID NO: 104789 - protein, 9 aa, Artificial Sequence
  Description of Artificial Sequence: Synthetic peptide
  Seed: SLRRAVSVK (MAGC3_HUMAN)
STRRAVSVY

SEQ ID NO: 104790 - protein, 10 aa, Artificial Sequence
  Description of Artificial Sequence: Synthetic peptide
  Seed: KAEMLTTVIK (MAGC3_HUMAN)
KFEMLTTVIR

SEQ ID NO: 104791 - protein, 10 aa, Artificial Sequence
  Description of Artificial Sequence: Synthetic peptide
  Seed: WVKNTCATYA (MAGC3_HUMAN)
WMKNTCATYF

SEQ ID NO: 104792 - protein, 9 aa, Artificial Sequence
  Description of Artificial Sequence: Synthetic peptide
  Seed: NAIGPWSAL (MAGC3_HUMAN)
NVIGPWSAL

SEQ ID NO: 104793 - protein, 9 aa, Artificial Sequence
  Description of Artificial Sequence: Synthetic peptide
  Seed: MIFGKAHEF (MAGC3_HUMAN)
MNFGKAHEM

SEQ ID NO: 104794 - protein, 9 aa, Artificial Sequence
  Description of Artificial Sequence: Synthetic peptide
  Seed: SLRRAVSVK (MAGC3_HUMAN)
SVRRAVSVG

SEQ ID NO: 104795 - protein, 9 aa, Artificial Sequence
  Description of Artificial Sequence: Synthetic peptide
  Seed: ALAGFADVL (MAGC3_HUMAN)
ATAGFADVI

SEQ ID NO: 104796 - protein, 10 aa, Artificial Sequence
  Description of Artificial Sequence: Synthetic peptide
  Seed: ALAGFADVLS (MAGC3_HUMAN)
AMAGFADVLV

SEQ ID NO: 104797 - protein, 10 aa, Artificial Sequence
  Description of Artificial Sequence: Synthetic peptide
  Seed: TDMDPDNHSY (MAGC3_HUMAN)
TEMDPDNHSW

SEQ ID NO: 104798 - protein, 9 aa, Artificial Sequence
  Description of Artificial Sequence: Synthetic peptide
  Seed: TLDEKVDKL (MAGC3_HUMAN)
TFDEKVDKI

SEQ ID NO: 104799 - protein, 9 aa, Artificial Sequence
  Description of Artificial Sequence: Synthetic peptide
  Seed: DVLSRLALW (MAGC3_HUMAN)
DTLSRLALL

SEQ ID NO: 104800 - protein, 10 aa, Artificial Sequence
  Description of Artificial Sequence: Synthetic peptide
  Seed: ILILSVIFIK (MAGC3_HUMAN)
IAILSVIFIR

SEQ ID NO: 104801 - protein, 10 aa, Artificial Sequence
  Description of Artificial Sequence: Synthetic peptide
  Seed: LDLANPQGLA (MAGC3_HUMAN)
LELANPQGLV

SEQ ID NO: 104802 - protein, 11 aa, Artificial Sequence
  Description of Artificial Sequence: Synthetic peptide
  Seed: MQMNVINTYTG (MAGC3_HUMAN)
MHMNVINTYTY

SEQ ID NO: 104803 - protein, 10 aa, Artificial Sequence
  Description of Artificial Sequence: Synthetic peptide
  Seed: ATYALSPVVL (MAGC3_HUMAN)
AAYALSPVVM

SEQ ID NO: 104804 - protein, 11 aa, Artificial Sequence
  Description of Artificial Sequence: Synthetic peptide
  Seed: TTDDATAMASA (MAGC3_HUMAN)
TCDDATAMASF

SEQ ID NO: 104805 - protein, 9 aa, Artificial Sequence
  Description of Artificial Sequence: Synthetic peptide
  Seed: HLREVRLFL (MAGC3_HUMAN)
HYREVRLFG

SEQ ID NO: 104806 - protein, 9 aa, Artificial Sequence
  Description of Artificial Sequence: Synthetic peptide
  Seed: TYFKLWRTL (MAGC3_HUMAN)
TLFKLWRTY

SEQ ID NO: 104807 - protein, 9 aa, Artificial Sequence
  Description of Artificial Sequence: Synthetic peptide
  Seed: EVIWEVLSA (MAGC3_HUMAN)
EAIWEVLSI

SEQ ID NO: 104808 - protein, 11 aa, Artificial Sequence
  Description of Artificial Sequence: Synthetic peptide
  Seed: LSKLSSIIPSA (MAGC3_HUMAN)
LKKLSSIIPSL

SEQ ID NO: 104809 - protein, 9 aa, Artificial Sequence
  Description of Artificial Sequence: Synthetic peptide
  Seed: NTYTGYFPM (MAGC3_HUMAN)
NLYTGYFPT

SEQ ID NO: 104810 - protein, 9 aa, Artificial Sequence
  Description of Artificial Sequence: Synthetic peptide
  Seed: KDSDLPTWR (MAGC3_HUMAN)
KFSDLPTWR

SEQ ID NO: 104811 - protein, 10 aa, Artificial Sequence
  Description of Artificial Sequence: Synthetic peptide
  Seed: LDSCSSPLLW (MAGC3_HUMAN)
LGSCSSPLLW

SEQ ID NO: 104812 - protein, 11 aa, Artificial Sequence
  Description of Artificial Sequence: Synthetic peptide
  Seed: TTDDATAMASA (MAGC3_HUMAN)
TTDDATAMASM

SEQ ID NO: 104813 - protein, 9 aa, Artificial Sequence
  Description of Artificial Sequence: Synthetic peptide
  Seed: FLSKLSSII (MAGC3_HUMAN)
FVSKLSSIM

SEQ ID NO: 104814 - protein, 9 aa, Artificial Sequence
  Description of Artificial Sequence: Synthetic peptide
  Seed: IQRPAREVL (MAGC3_HUMAN)
IYRPAREVF

SEQ ID NO: 104815 - protein, 10 aa, Artificial Sequence
  Description of Artificial Sequence: Synthetic peptide
  Seed: YALSPVVLPP (MAGC3_HUMAN)
YNLSPVVLPV

SEQ ID NO: 104816 - protein, 11 aa, Artificial Sequence
  Description of Artificial Sequence: Synthetic peptide
  Seed: ATFSDGSLGQW (MAGC3_HUMAN)
ASFSDGSLGQW

SEQ ID NO: 104817 - protein, 9 aa, Artificial Sequence
  Description of Artificial Sequence: Synthetic peptide
  Seed: LANPQGLAG (MAGC3_HUMAN)
LTNPQGLAM

SEQ ID NO: 104818 - protein, 10 aa, Artificial Sequence
  Description of Artificial Sequence: Synthetic peptide
  Seed: IELIFGIALT (MAGC3_HUMAN)
ILLIFGIALV

SEQ ID NO: 104819 - protein, 9 aa, Artificial Sequence
  Description of Artificial Sequence: Synthetic peptide
  Seed: VIWEVLNAI (MAGC3_HUMAN)
VMWEVLNAK

SEQ ID NO: 104820 - protein, 9 aa, Artificial Sequence
  Description of Artificial Sequence: Synthetic peptide
  Seed: EAFCEESGL (MAGC3_HUMAN)
EVFCEESGK

SEQ ID NO: 104821 - protein, 10 aa, Artificial Sequence
  Description of Artificial Sequence: Synthetic peptide
  Seed: FKLWRTLSGS (MAGC3_HUMAN)
FQLWRTLSGA

SEQ ID NO: 104822 - protein, 9 aa, Artificial Sequence
  Description of Artificial Sequence: Synthetic peptide
  Seed: ASEEVIWEV (MAGC3_HUMAN)
AVEEVIWEV

SEQ ID NO: 104823 - protein, 9 aa, Artificial Sequence
  Description of Artificial Sequence: Synthetic peptide
  Seed: EVLSAIGPI (MAGC3_HUMAN)
ETLSAIGPT

SEQ ID NO: 104824 - protein, 9 aa, Artificial Sequence
  Description of Artificial Sequence: Synthetic peptide
  Seed: HSYFFEDTL (MAGC3_HUMAN)
HSYFFEDTM

SEQ ID NO: 104825 - protein, 10 aa, Artificial Sequence
  Description of Artificial Sequence: Synthetic peptide
  Seed: ILFGISLTEV (MAGC3_HUMAN)
IIFGISLTEL

SEQ ID NO: 104826 - protein, 10 aa, Artificial Sequence
  Description of Artificial Sequence: Synthetic peptide
  Seed: SKLSSIIPSA (MAGC3_HUMAN)
SRLSSIIPSL

SEQ ID NO: 104827 - protein, 9 aa, Artificial Sequence
  Description of Artificial Sequence: Synthetic peptide
  Seed: AIIDTTDDA (MAGC3_HUMAN)
AMIDTTDDL

SEQ ID NO: 104828 - protein, 9 aa, Artificial Sequence
  Description of Artificial Sequence: Synthetic peptide
  Seed: SIIPSAFPS (MAGC3_HUMAN)
STIPSAFPA

SEQ ID NO: 104829 - protein, 10 aa, Artificial Sequence
  Description of Artificial Sequence: Synthetic peptide
  Seed: SIIPSAFPSW (MAGC3_HUMAN)
SSIPSAFPSW

SEQ ID NO: 104830 - protein, 9 aa, Artificial Sequence
  Description of Artificial Sequence: Synthetic peptide
  Seed: MASASPSVM (MAGC3_HUMAN)
MASASPSVL

SEQ ID NO: 104831 - protein, 9 aa, Artificial Sequence
  Description of Artificial Sequence: Synthetic peptide
  Seed: TAMASASPS (MAGC3_HUMAN)
TIMASASPF

SEQ ID NO: 104832 - protein, 11 aa, Artificial Sequence
  Description of Artificial Sequence: Synthetic peptide
  Seed: RTLSGSPGLQL (MAGC3_HUMAN)
RLLSGSPGLQM

SEQ ID NO: 104833 - protein, 9 aa, Artificial Sequence
  Description of Artificial Sequence: Synthetic peptide
  Seed: SPSVMSTNF (MAGC3_HUMAN)
SVSVMSTNY

SEQ ID NO: 104834 - protein, 9 aa, Artificial Sequence
  Description of Artificial Sequence: Synthetic peptide
  Seed: HLREVRLFL (MAGC3_HUMAN)
HMREVRLFY

SEQ ID NO: 104835 - protein, 10 aa, Artificial Sequence
  Description of Artificial Sequence: Synthetic peptide
  Seed: INTYTGYFPM (MAGC3_HUMAN)
IKTYTGYFPF

SEQ ID NO: 104836 - protein, 9 aa, Artificial Sequence
  Description of Artificial Sequence: Synthetic peptide
  Seed: KQREEPQDW (MAGC3_HUMAN)
KVREEPQDY

SEQ ID NO: 104837 - protein, 10 aa, Artificial Sequence
  Description of Artificial Sequence: Synthetic peptide
  Seed: KYKDYFPMIF (MAGC3_HUMAN)
KTKDYFPMIY

SEQ ID NO: 104838 - protein, 9 aa, Artificial Sequence
  Description of Artificial Sequence: Synthetic peptide
  Seed: FLSKLSSII (MAGC3_HUMAN)
FTSKLSSIV

SEQ ID NO: 104839 - protein, 9 aa, Artificial Sequence
  Description of Artificial Sequence: Synthetic peptide
  Seed: LSDEQGMPQ (MAGC3_HUMAN)
LCDEQGMPF

SEQ ID NO: 104840 - protein, 10 aa, Artificial Sequence
  Description of Artificial Sequence: Synthetic peptide
  Seed: ILFGISLTEV (MAGC3_HUMAN)
IIFGISLTEV

SEQ ID NO: 104841 - protein, 9 aa, Artificial Sequence
  Description of Artificial Sequence: Synthetic peptide
  Seed: ASEEVIWEV (MAGC3_HUMAN)
AMEEVIWEA

SEQ ID NO: 104842 - protein, 9 aa, Artificial Sequence
  Description of Artificial Sequence: Synthetic peptide
  Seed: TSDQRMDSL (MAGC3_HUMAN)
TFDQRMDSM

SEQ ID NO: 104843 - protein, 9 aa, Artificial Sequence
  Description of Artificial Sequence: Synthetic peptide
  Seed: LRSAEGSVL (MAGC3_HUMAN)
LASAEGSVF

SEQ ID NO: 104844 - protein, 10 aa, Artificial Sequence
  Description of Artificial Sequence: Synthetic peptide
  Seed: TGYFPMIFRK (MAGC3_HUMAN)
TAYFPMIFRL

SEQ ID NO: 104845 - protein, 11 aa, Artificial Sequence
  Description of Artificial Sequence: Synthetic peptide
  Seed: SIIPSAFPSWY (MAGC3_HUMAN)
SMIPSAFPSWK

SEQ ID NO: 104846 - protein, 9 aa, Artificial Sequence
  Description of Artificial Sequence: Synthetic peptide
  Seed: KAHEFIELI (MAGC3_HUMAN)
KQHEFIELR

SEQ ID NO: 104847 - protein, 9 aa, Artificial Sequence
  Description of Artificial Sequence: Synthetic peptide
  Seed: SAEGSVLDL (MAGC3_HUMAN)
SIEGSVLDM

SEQ ID NO: 104848 - protein, 11 aa, Artificial Sequence
  Description of Artificial Sequence: Synthetic peptide
  Seed: SASPSVMSTNF (MAGC3_HUMAN)
SASPSVMSTNW

SEQ ID NO: 104849 - protein, 9 aa, Artificial Sequence
  Description of Artificial Sequence: Synthetic peptide
  Seed: MLTTVIKKY (MAGC3_HUMAN)
MATTVIKKV

SEQ ID NO: 104850 - protein, 9 aa, Artificial Sequence
  Description of Artificial Sequence: Synthetic peptide
  Seed: TTDDATAMA (MAGC3_HUMAN)
TWDDATAMV

SEQ ID NO: 104851 - protein, 9 aa, Artificial Sequence
  Description of Artificial Sequence: Synthetic peptide
  Seed: TYTGYFPMI (MAGC3_HUMAN)
TYTGYFPMY

SEQ ID NO: 104852 - protein, 9 aa, Artificial Sequence
  Description of Artificial Sequence: Synthetic peptide
  Seed: HLGHLREVR (MAGC3_HUMAN)
HMGHLREVR

SEQ ID NO: 104853 - protein, 9 aa, Artificial Sequence
  Description of Artificial Sequence: Synthetic peptide
  Seed: TTDDATAMA (MAGC3_HUMAN)
TLDDATAMV

SEQ ID NO: 104854 - protein, 10 aa, Artificial Sequence
  Description of Artificial Sequence: Synthetic peptide
  Seed: MNVINTYTGY (MAGC3_HUMAN)
MTVINTYTGR

SEQ ID NO: 104855 - protein, 8 aa, Artificial Sequence
  Description of Artificial Sequence: Synthetic peptide
  Seed: TTDDATAM (MAGC3_HUMAN)
TWDDATAL

SEQ ID NO: 104856 - protein, 9 aa, Artificial Sequence
  Description of Artificial Sequence: Synthetic peptide
  Seed: ALDEKVAEL (MAGC3_HUMAN)
AQDEKVAEM

SEQ ID NO: 104857 - protein, 9 aa, Artificial Sequence
  Description of Artificial Sequence: Synthetic peptide
  Seed: RGTGYTLSL (MAGC3_HUMAN)
RVTGYTLSL

SEQ ID NO: 104858 - protein, 10 aa, Artificial Sequence
  Description of Artificial Sequence: Synthetic peptide
  Seed: SAFHLGHLRE (MAGC3_HUMAN)
SFFHLGHLRK

SEQ ID NO: 104859 - protein, 10 aa, Artificial Sequence
  Description of Artificial Sequence: Synthetic peptide
  Seed: REVRLFLRGG (MAGC3_HUMAN)
RYVRLFLRGK

SEQ ID NO: 104860 - protein, 9 aa, Artificial Sequence
  Description of Artificial Sequence: Synthetic peptide
  Seed: EKVAELVQF (MAGC3_HUMAN)
EMVAELVQF

SEQ ID NO: 104861 - protein, 11 aa, Artificial Sequence
  Description of Artificial Sequence: Synthetic peptide
  Seed: TSDQRMDSLVL (MAGC3_HUMAN)
TADQRMDSLVY

SEQ ID NO: 104862 - protein, 9 aa, Artificial Sequence
  Description of Artificial Sequence: Synthetic peptide
  Seed: KVDKLVQFL (MAGC3_HUMAN)
KEDKLVQFI

SEQ ID NO: 104863 - protein, 9 aa, Artificial Sequence
  Description of Artificial Sequence: Synthetic peptide
  Seed: FPMIFRKAR (MAGC3_HUMAN)
FAMIFRKAR

SEQ ID NO: 104864 - protein, 9 aa, Artificial Sequence
  Description of Artificial Sequence: Synthetic peptide
  Seed: KVDKLVQFL (MAGC3_HUMAN)
KFDKLVQFI

SEQ ID NO: 104865 - protein, 11 aa, Artificial Sequence
  Description of Artificial Sequence: Synthetic peptide
  Seed: KVAELVQFLLL (MAGC3_HUMAN)
KLAELVQFLLK

SEQ ID NO: 104866 - protein, 9 aa, Artificial Sequence
  Description of Artificial Sequence: Synthetic peptide
  Seed: GEDEDMPAA (MAGC3_HUMAN)
GEDEDMPAL

SEQ ID NO: 104867 - protein, 9 aa, Artificial Sequence
  Description of Artificial Sequence: Synthetic peptide
  Seed: SESLPRYAL (MAGC3_HUMAN)
SHSLPRYAF

SEQ ID NO: 104868 - protein, 10 aa, Artificial Sequence
  Description of Artificial Sequence: Synthetic peptide
  Seed: TTDDATAMAS (MAGC3_HUMAN)
TSDDATAMAV

SEQ ID NO: 104869 - protein, 9 aa, Artificial Sequence
  Description of Artificial Sequence: Synthetic peptide
  Seed: TEASPQQKK (MAGC3_HUMAN)
TTASPQQKF

SEQ ID NO: 104870 - protein, 9 aa, Artificial Sequence
  Description of Artificial Sequence: Synthetic peptide
  Seed: TGYTLSLPA (MAGC3_HUMAN)
TPYTLSLPA

SEQ ID NO: 104871 - protein, 9 aa, Artificial Sequence
  Description of Artificial Sequence: Synthetic peptide
  Seed: ALAGFADVL (MAGC3_HUMAN)
AMAGFADVL

SEQ ID NO: 104872 - protein, 9 aa, Artificial Sequence
  Description of Artificial Sequence: Synthetic peptide
  Seed: MPKNCLLIL (MAGC3_HUMAN)
MPKNCLLII

SEQ ID NO: 104873 - protein, 9 aa, Artificial Sequence
  Description of Artificial Sequence: Synthetic peptide
  Seed: ALSPVVLPP (MAGC3_HUMAN)
ALSPVVLPI

SEQ ID NO: 104874 - protein, 9 aa, Artificial Sequence
  Description of Artificial Sequence: Synthetic peptide
  Seed: SLPESEPLF (MAGC3_HUMAN)
SAPESEPLM

SEQ ID NO: 104875 - protein, 9 aa, Artificial Sequence
  Description of Artificial Sequence: Synthetic peptide
  Seed: MEDRAQAII (MAGC3_HUMAN)
MGDRAQAII

SEQ ID NO: 104876 - protein, 9 aa, Artificial Sequence
  Description of Artificial Sequence: Synthetic peptide
  Seed: MPAAGMPPL (MAGC3_HUMAN)
MCAAGMPPM

SEQ ID NO: 104877 - protein, 9 aa, Artificial Sequence
  Description of Artificial Sequence: Synthetic peptide
  Seed: HLREVRLFL (MAGC3_HUMAN)
HFREVRLFG

SEQ ID NO: 104878 - protein, 9 aa, Artificial Sequence
  Description of Artificial Sequence: Synthetic peptide
  Seed: YFFEDTLDL (MAGC3_HUMAN)
YSFEDTLDM

SEQ ID NO: 104879 - protein, 9 aa, Artificial Sequence
  Description of Artificial Sequence: Synthetic peptide
  Seed: QTKEPVTKA (MAGC3_HUMAN)
QTKEPVTKF

SEQ ID NO: 104880 - protein, 10 aa, Artificial Sequence
  Description of Artificial Sequence: Synthetic peptide
  Seed: RSAEGSVLDL (MAGC3_HUMAN)
RQAEGSVLDM

SEQ ID NO: 104881 - protein, 10 aa, Artificial Sequence
  Description of Artificial Sequence: Synthetic peptide
  Seed: TGYFPMIFRK (MAGC3_HUMAN)
TTYFPMIFRR

SEQ ID NO: 104882 - protein, 9 aa, Artificial Sequence
  Description of Artificial Sequence: Synthetic peptide
  Seed: SLPESEPLF (MAGC3_HUMAN)
SQPESEPLL

SEQ ID NO: 104883 - protein, 9 aa, Artificial Sequence
  Description of Artificial Sequence: Synthetic peptide
  Seed: ALDEKVAEL (MAGC3_HUMAN)
AFDEKVAEC

SEQ ID NO: 104884 - protein, 9 aa, Artificial Sequence
  Description of Artificial Sequence: Synthetic peptide
  Seed: MQMNVINTY (MAGC3_HUMAN)
MKMNVINTV

SEQ ID NO: 104885 - protein, 9 aa, Artificial Sequence
  Description of Artificial Sequence: Synthetic peptide
  Seed: IPSAFPSWY (MAGC3_HUMAN)
IPSAFPSWF

SEQ ID NO: 104886 - protein, 9 aa, Artificial Sequence
  Description of Artificial Sequence: Synthetic peptide
  Seed: KVAELVQFL (MAGC3_HUMAN)
KIAELVQFY

SEQ ID NO: 104887 - protein, 9 aa, Artificial Sequence
  Description of Artificial Sequence: Synthetic peptide
  Seed: FADVLSRLA (MAGC3_HUMAN)
FWDVLSRLL

SEQ ID NO: 104888 - protein, 9 aa, Artificial Sequence
  Description of Artificial Sequence: Synthetic peptide
  Seed: HSYFFEDTL (MAGC3_HUMAN)
HEYFFEDTI

SEQ ID NO: 104889 - protein, 9 aa, Artificial Sequence
  Description of Artificial Sequence: Synthetic peptide
  Seed: FSDGSLGQW (MAGC3_HUMAN)
FEDGSLGQL

SEQ ID NO: 104890 - protein, 10 aa, Artificial Sequence
  Description of Artificial Sequence: Synthetic peptide
  Seed: IELIFGIALT (MAGC3_HUMAN)
IPLIFGIALA

SEQ ID NO: 104891 - protein, 9 aa, Artificial Sequence
  Description of Artificial Sequence: Synthetic peptide
  Seed: EFLSKLSSI (MAGC3_HUMAN)
EMLSKLSSM

SEQ ID NO: 104892 - protein, 10 aa, Artificial Sequence
  Description of Artificial Sequence: Synthetic peptide
  Seed: MQMNVINTYT (MAGC3_HUMAN)
MSMNVINTYL

SEQ ID NO: 104893 - protein, 8 aa, Artificial Sequence
  Description of Artificial Sequence: Synthetic peptide
  Seed: FADVLSRL (MAGC3_HUMAN)
FIDVLSRV

SEQ ID NO: 104894 - protein, 9 aa, Artificial Sequence
  Description of Artificial Sequence: Synthetic peptide
  Seed: MQMNVINTY (MAGC3_HUMAN)
MHMNVINTL

SEQ ID NO: 104895 - protein, 9 aa, Artificial Sequence
  Description of Artificial Sequence: Synthetic peptide
  Seed: EVLEFLSKL (MAGC3_HUMAN)
ESLEFLSKF

SEQ ID NO: 104896 - protein, 10 aa, Artificial Sequence
  Description of Artificial Sequence: Synthetic peptide
  Seed: VLCPTYFKLW (MAGC3_HUMAN)
VYCPTYFKLM

SEQ ID NO: 104897 - protein, 9 aa, Artificial Sequence
  Description of Artificial Sequence: Synthetic peptide
  Seed: RGTGYTLSL (MAGC3_HUMAN)
RRTGYTLSI

SEQ ID NO: 104898 - protein, 10 aa, Artificial Sequence
  Description of Artificial Sequence: Synthetic peptide
  Seed: LTEASPQQKK (MAGC3_HUMAN)
LAEASPQQKY

SEQ ID NO: 104899 - protein, 9 aa, Artificial Sequence
  Description of Artificial Sequence: Synthetic peptide
  Seed: MLLPCHWVL (MAGC3_HUMAN)
MVLPCHWVI

SEQ ID NO: 104900 - protein, 9 aa, Artificial Sequence
  Description of Artificial Sequence: Synthetic peptide
  Seed: QMNVINTYT (MAGC3_HUMAN)
QVNVINTYL

SEQ ID NO: 104901 - protein, 10 aa, Artificial Sequence
  Description of Artificial Sequence: Synthetic peptide
  Seed: TAMASASPSV (MAGC3_HUMAN)
THMASASPSI

SEQ ID NO: 104902 - protein, 9 aa, Artificial Sequence
  Description of Artificial Sequence: Synthetic peptide
  Seed: LILSMIFIK (MAGC3_HUMAN)
LSLSMIFIK

SEQ ID NO: 104903 - protein, 10 aa, Artificial Sequence
  Description of Artificial Sequence: Synthetic peptide
  Seed: MNVINTYTGY (MAGC3_HUMAN)
MTVINTYTGF

SEQ ID NO: 104904 - protein, 9 aa, Artificial Sequence
  Description of Artificial Sequence: Synthetic peptide
  Seed: QTKEPVTKA (MAGC3_HUMAN)
QLKEPVTKL

SEQ ID NO: 104905 - protein, 9 aa, Artificial Sequence
  Description of Artificial Sequence: Synthetic peptide
  Seed: AGFADVLSR (MAGC3_HUMAN)
ALFADVLSY

SEQ ID NO: 104906 - protein, 9 aa, Artificial Sequence
  Description of Artificial Sequence: Synthetic peptide
  Seed: MASASPSVM (MAGC3_HUMAN)
MKSASPSVI

SEQ ID NO: 104907 - protein, 9 aa, Artificial Sequence
  Description of Artificial Sequence: Synthetic peptide
  Seed: MIFGKAHEF (MAGC3_HUMAN)
MGFGKAHEI

SEQ ID NO: 104908 - protein, 9 aa, Artificial Sequence
  Description of Artificial Sequence: Synthetic peptide
  Seed: SPSVMSTNF (MAGC3_HUMAN)
SPSVMSTNY

SEQ ID NO: 104909 - protein, 11 aa, Artificial Sequence
  Description of Artificial Sequence: Synthetic peptide
  Seed: SKLSSIIPSAF (MAGC3_HUMAN)
SMLSSIIPSAY

SEQ ID NO: 104910 - protein, 10 aa, Artificial Sequence
  Description of Artificial Sequence: Synthetic peptide
  Seed: TGYFPMIFRK (MAGC3_HUMAN)
TAYFPMIFRN

SEQ ID NO: 104911 - protein, 9 aa, Artificial Sequence
  Description of Artificial Sequence: Synthetic peptide
  Seed: ISPQGPPQS (MAGC3_HUMAN)
ILPQGPPQL

SEQ ID NO: 104912 - protein, 10 aa, Artificial Sequence
  Description of Artificial Sequence: Synthetic peptide
  Seed: TDMDPDNHSY (MAGC3_HUMAN)
TSMDPDNHSY

SEQ ID NO: 104913 - protein, 10 aa, Artificial Sequence
  Description of Artificial Sequence: Synthetic peptide
  Seed: FSDGSLGQWV (MAGC3_HUMAN)
FQDGSLGQWV

SEQ ID NO: 104914 - protein, 10 aa, Artificial Sequence
  Description of Artificial Sequence: Synthetic peptide
  Seed: FLSKLSSIIP (MAGC3_HUMAN)
FMSKLSSIIM

SEQ ID NO: 104915 - protein, 10 aa, Artificial Sequence
  Description of Artificial Sequence: Synthetic peptide
  Seed: TFSDGSLGQW (MAGC3_HUMAN)
TTSDGSLGQW

SEQ ID NO: 104916 - protein, 9 aa, Artificial Sequence
  Description of Artificial Sequence: Synthetic peptide
  Seed: KLSSIIPSA (MAGC3_HUMAN)
KASSIIPSR

SEQ ID NO: 104917 - protein, 10 aa, Artificial Sequence
  Description of Artificial Sequence: Synthetic peptide
  Seed: YALDEKVAEL (MAGC3_HUMAN)
YPLDEKVAEI

SEQ ID NO: 104918 - protein, 9 aa, Artificial Sequence
  Description of Artificial Sequence: Synthetic peptide
  Seed: MASASPSVM (MAGC3_HUMAN)
MASASPSVY

SEQ ID NO: 104919 - protein, 9 aa, Artificial Sequence
  Description of Artificial Sequence: Synthetic peptide
  Seed: VIWEVLNAI (MAGC3_HUMAN)
VSWEVLNAM

SEQ ID NO: 104920 - protein, 9 aa, Artificial Sequence
  Description of Artificial Sequence: Synthetic peptide
  Seed: YFFEDTLDL (MAGC3_HUMAN)
YVFEDTLDA

SEQ ID NO: 104921 - protein, 9 aa, Artificial Sequence
  Description of Artificial Sequence: Synthetic peptide
  Seed: FSLRRAVSV (MAGC3_HUMAN)
FMLRRAVSI

SEQ ID NO: 104922 - protein, 11 aa, Artificial Sequence
  Description of Artificial Sequence: Synthetic peptide
  Seed: KDMEDRAQAII (MAGC3_HUMAN)
KEMEDRAQAIC

SEQ ID NO: 104923 - protein, 9 aa, Artificial Sequence
  Description of Artificial Sequence: Synthetic peptide
  Seed: GFADVLSRL (MAGC3_HUMAN)
GMADVLSRM

SEQ ID NO: 104924 - protein, 9 aa, Artificial Sequence
  Description of Artificial Sequence: Synthetic peptide
  Seed: MQMNVINTY (MAGC3_HUMAN)
MAMNVINTR

SEQ ID NO: 104925 - protein, 9 aa, Artificial Sequence
  Description of Artificial Sequence: Synthetic peptide
  Seed: VIWEVLNAI (MAGC3_HUMAN)
VMWEVLNAS

SEQ ID NO: 104926 - protein, 9 aa, Artificial Sequence
  Description of Artificial Sequence: Synthetic peptide
  Seed: FADVLSRLA (MAGC3_HUMAN)
FNDVLSRLL

SEQ ID NO: 104927 - protein, 9 aa, Artificial Sequence
  Description of Artificial Sequence: Synthetic peptide
  Seed: EVLEFLSKL (MAGC3_HUMAN)
EILEFLSKM

SEQ ID NO: 104928 - protein, 10 aa, Artificial Sequence
  Description of Artificial Sequence: Synthetic peptide
  Seed: ATFSDGSLGQ (MAGC3_HUMAN)
ASFSDGSLGK

SEQ ID NO: 104929 - protein, 9 aa, Artificial Sequence
  Description of Artificial Sequence: Synthetic peptide
  Seed: LSGSPGLQL (MAGC3_HUMAN)
LLGSPGLQF

SEQ ID NO: 104930 - protein, 8 aa, Artificial Sequence
  Description of Artificial Sequence: Synthetic peptide
  Seed: FIELIFGI (MAGC3_HUMAN)
FMELIFGM

SEQ ID NO: 104931 - protein, 10 aa, Artificial Sequence
  Description of Artificial Sequence: Synthetic peptide
  Seed: LVLCPTYFKL (MAGC3_HUMAN)
LSLCPTYFKK

SEQ ID NO: 104932 - protein, 9 aa, Artificial Sequence
  Description of Artificial Sequence: Synthetic peptide
  Seed: EVLEFLSKL (MAGC3_HUMAN)
ETLEFLSKK

SEQ ID NO: 104933 - protein, 9 aa, Artificial Sequence
  Description of Artificial Sequence: Synthetic peptide
  Seed: KVAELVQFL (MAGC3_HUMAN)
KYAELVQFK

SEQ ID NO: 104934 - protein, 8 aa, Artificial Sequence
  Description of Artificial Sequence: Synthetic peptide
  Seed: SESLPRYA (MAGC3_HUMAN)
SESLPRYL

SEQ ID NO: 104935 - protein, 10 aa, Artificial Sequence
  Description of Artificial Sequence: Synthetic peptide
  Seed: SALAGFADVL (MAGC3_HUMAN)
SLLAGFADVI

SEQ ID NO: 104936 - protein, 9 aa, Artificial Sequence
  Description of Artificial Sequence: Synthetic peptide
  Seed: KYKDYFPMI (MAGC3_HUMAN)
KTKDYFPMV

SEQ ID NO: 104937 - protein, 10 aa, Artificial Sequence
  Description of Artificial Sequence: Synthetic peptide
  Seed: KDMEDRAQAI (MAGC3_HUMAN)
KEMEDRAQAI

SEQ ID NO: 104938 - protein, 10 aa, Artificial Sequence
  Description of Artificial Sequence: Synthetic peptide
  Seed: REVRLFLRGG (MAGC3_HUMAN)
RLVRLFLRGK

SEQ ID NO: 104939 - protein, 10 aa, Artificial Sequence
  Description of Artificial Sequence: Synthetic peptide
  Seed: GMPKNCLLIL (MAGC3_HUMAN)
GLPKNCLLIV

SEQ ID NO: 104940 - protein, 11 aa, Artificial Sequence
  Description of Artificial Sequence: Synthetic peptide
  Seed: DYSAFHLGHLR (MAGC3_HUMAN)
DLSAFHLGHLR

SEQ ID NO: 104941 - protein, 9 aa, Artificial Sequence
  Description of Artificial Sequence: Synthetic peptide
  Seed: RTLSGSPGL (MAGC3_HUMAN)
RQLSGSPGV

SEQ ID NO: 104942 - protein, 11 aa, Artificial Sequence
  Description of Artificial Sequence: Synthetic peptide
  Seed: HALPESESLPR (MAGC3_HUMAN)
HVLPESESLPK

SEQ ID NO: 104943 - protein, 9 aa, Artificial Sequence
  Description of Artificial Sequence: Synthetic peptide
  Seed: EMLTTVIKK (MAGC3_HUMAN)
ETLTTVIKR

SEQ ID NO: 104944 - protein, 9 aa, Artificial Sequence
  Description of Artificial Sequence: Synthetic peptide
  Seed: FLSKLSSII (MAGC3_HUMAN)
FMSKLSSIA

SEQ ID NO: 104945 - protein, 10 aa, Artificial Sequence
  Description of Artificial Sequence: Synthetic peptide
  Seed: VKNTCATYAL (MAGC3_HUMAN)
VKNTCATYAF

SEQ ID NO: 104946 - protein, 9 aa, Artificial Sequence
  Description of Artificial Sequence: Synthetic peptide
  Seed: DMDPDNHSY (MAGC3_HUMAN)
DVDPDNHSV

SEQ ID NO: 104947 - protein, 9 aa, Artificial Sequence
  Description of Artificial Sequence: Synthetic peptide
  Seed: LSDEQGMPQ (MAGC3_HUMAN)
LLDEQGMPV

SEQ ID NO: 104948 - protein, 10 aa, Artificial Sequence
  Description of Artificial Sequence: Synthetic peptide
  Seed: YALDEKVAEL (MAGC3_HUMAN)
YDLDEKVAEV

SEQ ID NO: 104949 - protein, 10 aa, Artificial Sequence
  Description of Artificial Sequence: Synthetic peptide
  Seed: KVAELVQFLL (MAGC3_HUMAN)
KYAELVQFLW

SEQ ID NO: 104950 - protein, 9 aa, Artificial Sequence
  Description of Artificial Sequence: Synthetic peptide
  Seed: YQAKEPLTR (MAGC3_HUMAN)
YFAKEPLTL

SEQ ID NO: 104951 - protein, 8 aa, Artificial Sequence
  Description of Artificial Sequence: Synthetic peptide
  Seed: YMDALKDM (MAGC3_HUMAN)
YSDALKDF

SEQ ID NO: 104952 - protein, 11 aa, Artificial Sequence
  Description of Artificial Sequence: Synthetic peptide
  Seed: VLEFLSKLSSI (MAGC3_HUMAN)
VLEFLSKLSSV

SEQ ID NO: 104953 - protein, 9 aa, Artificial Sequence
  Description of Artificial Sequence: Synthetic peptide
  Seed: LRSAEGSVL (MAGC3_HUMAN)
LLSAEGSVM

SEQ ID NO: 104954 - protein, 10 aa, Artificial Sequence
  Description of Artificial Sequence: Synthetic peptide
  Seed: TGYFPMIFRK (MAGC3_HUMAN)
TLYFPMIFRR

SEQ ID NO: 104955 - protein, 9 aa, Artificial Sequence
  Description of Artificial Sequence: Synthetic peptide
  Seed: FSLRRAVSV (MAGC3_HUMAN)
FKLRRAVSM

SEQ ID NO: 104956 - protein, 10 aa, Artificial Sequence
  Description of Artificial Sequence: Synthetic peptide
  Seed: FKLWRTLSGS (MAGC3_HUMAN)
FTLWRTLSGV

SEQ ID NO: 104957 - protein, 11 aa, Artificial Sequence
  Description of Artificial Sequence: Synthetic peptide
  Seed: FIKGSCVPEEV (MAGC3_HUMAN)
FLKGSCVPEEM

SEQ ID NO: 104958 - protein, 9 aa, Artificial Sequence
  Description of Artificial Sequence: Synthetic peptide
  Seed: FHLGHLREV (MAGC3_HUMAN)
FHLGHLREM

SEQ ID NO: 104959 - protein, 9 aa, Artificial Sequence
  Description of Artificial Sequence: Synthetic peptide
  Seed: YSAFHLGHL (MAGC3_HUMAN)
YRAFHLGHF

SEQ ID NO: 104960 - protein, 9 aa, Artificial Sequence
  Description of Artificial Sequence: Synthetic peptide
  Seed: KDSDLPTWR (MAGC3_HUMAN)
KYSDLPTWK

SEQ ID NO: 104961 - protein, 10 aa, Artificial Sequence
  Description of Artificial Sequence: Synthetic peptide
  Seed: KVAELVQFLL (MAGC3_HUMAN)
KQAELVQFLI

SEQ ID NO: 104962 - protein, 9 aa, Artificial Sequence
  Description of Artificial Sequence: Synthetic peptide
  Seed: MQMNVINTY (MAGC3_HUMAN)
MDMNVINTW

SEQ ID NO: 104963 - protein, 10 aa, Artificial Sequence
  Description of Artificial Sequence: Synthetic peptide
  Seed: REVRLFLRGG (MAGC3_HUMAN)
RWVRLFLRGV

SEQ ID NO: 104964 - protein, 9 aa, Artificial Sequence
  Description of Artificial Sequence: Synthetic peptide
  Seed: LVLCPTYFK (MAGC3_HUMAN)
LWLCPTYFR

SEQ ID NO: 104965 - protein, 9 aa, Artificial Sequence
  Description of Artificial Sequence: Synthetic peptide
  Seed: EVIWEVLNA (MAGC3_HUMAN)
ETIWEVLNV

SEQ ID NO: 104966 - protein, 10 aa, Artificial Sequence
  Description of Artificial Sequence: Synthetic peptide
  Seed: SAFHLGHLRE (MAGC3_HUMAN)
SMFHLGHLRI

SEQ ID NO: 104967 - protein, 8 aa, Artificial Sequence
  Description of Artificial Sequence: Synthetic peptide
  Seed: IFGKAHEF (MAGC3_HUMAN)
IYGKAHEM

SEQ ID NO: 104968 - protein, 11 aa, Artificial Sequence
  Description of Artificial Sequence: Synthetic peptide
  Seed: SASPSVMSTNF (MAGC3_HUMAN)
SQSPSVMSTNL

SEQ ID NO: 104969 - protein, 9 aa, Artificial Sequence
  Description of Artificial Sequence: Synthetic peptide
  Seed: CHWVLDATF (MAGC3_HUMAN)
CMWVLDATY

SEQ ID NO: 104970 - protein, 10 aa, Artificial Sequence
  Description of Artificial Sequence: Synthetic peptide
  Seed: YALSPVVLPP (MAGC3_HUMAN)
YHLSPVVLPM

SEQ ID NO: 104971 - protein, 9 aa, Artificial Sequence
  Description of Artificial Sequence: Synthetic peptide
  Seed: KYKDYFPMI (MAGC3_HUMAN)
KVKDYFPMG

SEQ ID NO: 104972 - protein, 9 aa, Artificial Sequence
  Description of Artificial Sequence: Synthetic peptide
  Seed: EVIWEVLSA (MAGC3_HUMAN)
ETIWEVLST

SEQ ID NO: 104973 - protein, 11 aa, Artificial Sequence
  Description of Artificial Sequence: Synthetic peptide
  Seed: ATFSDGSLGQW (MAGC3_HUMAN)
AAFSDGSLGQF

SEQ ID NO: 104974 - protein, 9 aa, Artificial Sequence
  Description of Artificial Sequence: Synthetic peptide
  Seed: SQPEGKFSL (MAGC3_HUMAN)
SAPEGKFSL

SEQ ID NO: 104975 - protein, 10 aa, Artificial Sequence
  Description of Artificial Sequence: Synthetic peptide
  Seed: EVDPDHFYVF (MAGC3_HUMAN)
ETDPDHFYVY

SEQ ID NO: 104976 - protein, 11 aa, Artificial Sequence
  Description of Artificial Sequence: Synthetic peptide
  Seed: HSYFFEDTLDL (MAGC3_HUMAN)
HTYFFEDTLDW

SEQ ID NO: 104977 - protein, 10 aa, Artificial Sequence
  Description of Artificial Sequence: Synthetic peptide
  Seed: NTYTGYFPMI (MAGC3_HUMAN)
NGYTGYFPMF

SEQ ID NO: 104978 - protein, 9 aa, Artificial Sequence
  Description of Artificial Sequence: Synthetic peptide
  Seed: RGTGYTLSL (MAGC3_HUMAN)
RATGYTLSV

SEQ ID NO: 104979 - protein, 9 aa, Artificial Sequence
  Description of Artificial Sequence: Synthetic peptide
  Seed: YTGYFPMIF (MAGC3_HUMAN)
YAGYFPMIW

SEQ ID NO: 104980 - protein, 10 aa, Artificial Sequence
  Description of Artificial Sequence: Synthetic peptide
  Seed: ALDEKVAELV (MAGC3_HUMAN)
AIDEKVAELV

SEQ ID NO: 104981 - protein, 10 aa, Artificial Sequence
  Description of Artificial Sequence: Synthetic peptide
  Seed: VLDLANPQGL (MAGC3_HUMAN)
VSDLANPQGM

SEQ ID NO: 104982 - protein, 11 aa, Artificial Sequence
  Description of Artificial Sequence: Synthetic peptide
  Seed: TAMASASPSVM (MAGC3_HUMAN)
TPMASASPSVY

SEQ ID NO: 104983 - protein, 10 aa, Artificial Sequence
  Description of Artificial Sequence: Synthetic peptide
  Seed: KKYKDYFPMI (MAGC3_HUMAN)
KEYKDYFPMW

SEQ ID NO: 104984 - protein, 9 aa, Artificial Sequence
  Description of Artificial Sequence: Synthetic peptide
  Seed: KKYKDYFPM (MAGC3_HUMAN)
KIYKDYFPF

SEQ ID NO: 104985 - protein, 11 aa, Artificial Sequence
  Description of Artificial Sequence: Synthetic peptide
  Seed: DLANPQGLAGH (MAGC3_HUMAN)
DVANPQGLAGR

SEQ ID NO: 104986 - protein, 9 aa, Artificial Sequence
  Description of Artificial Sequence: Synthetic peptide
  Seed: FSDGSLGQW (MAGC3_HUMAN)
FGDGSLGQF

SEQ ID NO: 104987 - protein, 9 aa, Artificial Sequence
  Description of Artificial Sequence: Synthetic peptide
  Seed: MQMNVINTY (MAGC3_HUMAN)
MMMNVINTM

SEQ ID NO: 104988 - protein, 9 aa, Artificial Sequence
  Description of Artificial Sequence: Synthetic peptide
  Seed: SLPESEPLF (MAGC3_HUMAN)
SVPESEPLM

SEQ ID NO: 104989 - protein, 9 aa, Artificial Sequence
  Description of Artificial Sequence: Synthetic peptide
  Seed: VIWEVLSAI (MAGC3_HUMAN)
VVWEVLSAK

SEQ ID NO: 104990 - protein, 10 aa, Artificial Sequence
  Description of Artificial Sequence: Synthetic peptide
  Seed: MQMNVINTYT (MAGC3_HUMAN)
MWMNVINTYF

SEQ ID NO: 104991 - protein, 9 aa, Artificial Sequence
  Description of Artificial Sequence: Synthetic peptide
  Seed: EVIWEVLNA (MAGC3_HUMAN)
ESIWEVLNA

SEQ ID NO: 104992 - protein, 10 aa, Artificial Sequence
  Description of Artificial Sequence: Synthetic peptide
  Seed: YALSPVVLPP (MAGC3_HUMAN)
YWLSPVVLPT

SEQ ID NO: 104993 - protein, 9 aa, Artificial Sequence
  Description of Artificial Sequence: Synthetic peptide
  Seed: YSAFHLGHL (MAGC3_HUMAN)
YTAFHLGHA

SEQ ID NO: 104994 - protein, 9 aa, Artificial Sequence
  Description of Artificial Sequence: Synthetic peptide
  Seed: MPAAGMPPL (MAGC3_HUMAN)
MPAAGMPPQ

SEQ ID NO: 104995 - protein, 10 aa, Artificial Sequence
  Description of Artificial Sequence: Synthetic peptide
  Seed: FFEDTLDLTY (MAGC3_HUMAN)
FSEDTLDLTI

SEQ ID NO: 104996 - protein, 9 aa, Artificial Sequence
  Description of Artificial Sequence: Synthetic peptide
  Seed: QTKEPVTKA (MAGC3_HUMAN)
QPKEPVTKI

SEQ ID NO: 104997 - protein, 9 aa, Artificial Sequence
  Description of Artificial Sequence: Synthetic peptide
  Seed: KAEMLTTVI (MAGC3_HUMAN)
KQEMLTTVV

SEQ ID NO: 104998 - protein, 9 aa, Artificial Sequence
  Description of Artificial Sequence: Synthetic peptide
  Seed: LKYQTKEPV (MAGC3_HUMAN)
LLYQTKEPM

SEQ ID NO: 104999 - protein, 10 aa, Artificial Sequence
  Description of Artificial Sequence: Synthetic peptide
  Seed: GSQPEGKFSL (MAGC3_HUMAN)
GAQPEGKFSW

SEQ ID NO: 105000 - protein, 9 aa, Artificial Sequence
  Description of Artificial Sequence: Synthetic peptide
  Seed: MIFGKAHEF (MAGC3_HUMAN)
MKFGKAHEI

SEQ ID NO: 105001 - protein, 11 aa, Artificial Sequence
  Description of Artificial Sequence: Synthetic peptide
  Seed: YTGYFPMIFRK (MAGC3_HUMAN)
YQGYFPMIFRR

SEQ ID NO: 105002 - protein, 10 aa, Artificial Sequence
  Description of Artificial Sequence: Synthetic peptide
  Seed: LSLPAVSPGK (MAGC3_HUMAN)
LTLPAVSPGK

SEQ ID NO: 105003 - protein, 11 aa, Artificial Sequence
  Description of Artificial Sequence: Synthetic peptide
  Seed: FIELIFGIALT (MAGC3_HUMAN)
FCELIFGIALV

SEQ ID NO: 105004 - protein, 9 aa, Artificial Sequence
  Description of Artificial Sequence: Synthetic peptide
  Seed: DTTDDATAM (MAGC3_HUMAN)
DMTDDATAF

SEQ ID NO: 105005 - protein, 9 aa, Artificial Sequence
  Description of Artificial Sequence: Synthetic peptide
  Seed: KLWRTLSGS (MAGC3_HUMAN)
KMWRTLSGC

SEQ ID NO: 105006 - protein, 10 aa, Artificial Sequence
  Description of Artificial Sequence: Synthetic peptide
  Seed: LDLANPQGLA (MAGC3_HUMAN)
LQLANPQGLV

SEQ ID NO: 105007 - protein, 8 aa, Artificial Sequence
  Description of Artificial Sequence: Synthetic peptide
  Seed: MEDRAQAI (MAGC3_HUMAN)
MTDRAQAM

SEQ ID NO: 105008 - protein, 9 aa, Artificial Sequence
  Description of Artificial Sequence: Synthetic peptide
  Seed: IIDTTDDAT (MAGC3_HUMAN)
IADTTDDAM

SEQ ID NO: 105009 - protein, 10 aa, Artificial Sequence
  Description of Artificial Sequence: Synthetic peptide
  Seed: YQAKEPLTRA (MAGC3_HUMAN)
YQAKEPLTRV

SEQ ID NO: 105010 - protein, 10 aa, Artificial Sequence
  Description of Artificial Sequence: Synthetic peptide
  Seed: EEVIWEVLNA (MAGC3_HUMAN)
EPVIWEVLNV

SEQ ID NO: 105011 - protein, 9 aa, Artificial Sequence
  Description of Artificial Sequence: Synthetic peptide
  Seed: HALPESESL (MAGC3_HUMAN)
HHLPESESF

SEQ ID NO: 105012 - protein, 9 aa, Artificial Sequence
  Description of Artificial Sequence: Synthetic peptide
  Seed: SLRRAVSVK (MAGC3_HUMAN)
STRRAVSVR

SEQ ID NO: 105013 - protein, 9 aa, Artificial Sequence
  Description of Artificial Sequence: Synthetic peptide
  Seed: EDTATWHAL (MAGC3_HUMAN)
EETATWHAA

SEQ ID NO: 105014 - protein, 10 aa, Artificial Sequence
  Description of Artificial Sequence: Synthetic peptide
  Seed: SYFFEDTLDL (MAGC3_HUMAN)
SYFFEDTLDW

SEQ ID NO: 105015 - protein, 9 aa, Artificial Sequence
  Description of Artificial Sequence: Synthetic peptide
  Seed: FSDGSLGQW (MAGC3_HUMAN)
FMDGSLGQY

SEQ ID NO: 105016 - protein, 9 aa, Artificial Sequence
  Description of Artificial Sequence: Synthetic peptide
  Seed: MDPDNHSYF (MAGC3_HUMAN)
MSPDNHSYM

SEQ ID NO: 105017 - protein, 9 aa, Artificial Sequence
  Description of Artificial Sequence: Synthetic peptide
  Seed: KYKDYFPMI (MAGC3_HUMAN)
KYKDYFPMK

SEQ ID NO: 105018 - protein, 11 aa, Artificial Sequence
  Description of Artificial Sequence: Synthetic peptide
  Seed: TTDDATAMASA (MAGC3_HUMAN)
TQDDATAMASL

SEQ ID NO: 105019 - protein, 9 aa, Artificial Sequence
  Description of Artificial Sequence: Synthetic peptide
  Seed: VIWEVLNAI (MAGC3_HUMAN)
VSWEVLNAL

SEQ ID NO: 105020 - protein, 9 aa, Artificial Sequence
  Description of Artificial Sequence: Synthetic peptide
  Seed: SAFHLGHLR (MAGC3_HUMAN)
SSFHLGHLK

SEQ ID NO: 105021 - protein, 10 aa, Artificial Sequence
  Description of Artificial Sequence: Synthetic peptide
  Seed: ADVLSRLALW (MAGC3_HUMAN)
ATVLSRLALF

SEQ ID NO: 105022 - protein, 10 aa, Artificial Sequence
  Description of Artificial Sequence: Synthetic peptide
  Seed: LNAIGPWSAL (MAGC3_HUMAN)
LKAIGPWSAM

SEQ ID NO: 105023 - protein, 11 aa, Artificial Sequence
  Description of Artificial Sequence: Synthetic peptide
  Seed: PLDSCSSPLLW (MAGC3_HUMAN)
PMDSCSSPLLW

SEQ ID NO: 105024 - protein, 9 aa, Artificial Sequence
  Description of Artificial Sequence: Synthetic peptide
  Seed: AMASASPSV (MAGC3_HUMAN)
AKASASPSL

SEQ ID NO: 105025 - protein, 9 aa, Artificial Sequence
  Description of Artificial Sequence: Synthetic peptide
  Seed: FFEDTLDLT (MAGC3_HUMAN)
FYEDTLDLM

SEQ ID NO: 105026 - protein, 10 aa, Artificial Sequence
  Description of Artificial Sequence: Synthetic peptide
  Seed: MQMNVINTYT (MAGC3_HUMAN)
MFMNVINTYY

SEQ ID NO: 105027 - protein, 9 aa, Artificial Sequence
  Description of Artificial Sequence: Synthetic peptide
  Seed: SAFHLGHLR (MAGC3_HUMAN)
SIFHLGHLR

SEQ ID NO: 105028 - protein, 10 aa, Artificial Sequence
  Description of Artificial Sequence: Synthetic peptide
  Seed: YALDEKVAEL (MAGC3_HUMAN)
YPLDEKVAEW

SEQ ID NO: 105029 - protein, 8 aa, Artificial Sequence
  Description of Artificial Sequence: Synthetic peptide
  Seed: KAHEFIEL (MAGC3_HUMAN)
KRHEFIEF

SEQ ID NO: 105030 - protein, 9 aa, Artificial Sequence
  Description of Artificial Sequence: Synthetic peptide
  Seed: VLPPQPQPR (MAGC3_HUMAN)
VIPPQPQPF

SEQ ID NO: 105031 - protein, 9 aa, Artificial Sequence
  Description of Artificial Sequence: Synthetic peptide
  Seed: RTLWKDSDL (MAGC3_HUMAN)
RTLWKDSDY

SEQ ID NO: 105032 - protein, 9 aa, Artificial Sequence
  Description of Artificial Sequence: Synthetic peptide
  Seed: MQMNVINTY (MAGC3_HUMAN)
MEMNVINTH

SEQ ID NO: 105033 - protein, 11 aa, Artificial Sequence
  Description of Artificial Sequence: Synthetic peptide
  Seed: SASPSVMSTNF (MAGC3_HUMAN)
SSSPSVMSTNF

SEQ ID NO: 105034 - protein, 9 aa, Artificial Sequence
  Description of Artificial Sequence: Synthetic peptide
  Seed: TKAEMLTTV (MAGC3_HUMAN)
TMAEMLTTL

SEQ ID NO: 105035 - protein, 10 aa, Artificial Sequence
  Description of Artificial Sequence: Synthetic peptide
  Seed: INTYTGYFPM (MAGC3_HUMAN)
ISTYTGYFPW

SEQ ID NO: 105036 - protein, 9 aa, Artificial Sequence
  Description of Artificial Sequence: Synthetic peptide
  Seed: KVAELVQFL (MAGC3_HUMAN)
KTAELVQFV

SEQ ID NO: 105037 - protein, 9 aa, Artificial Sequence
  Description of Artificial Sequence: Synthetic peptide
  Seed: FGSQPEGKF (MAGC3_HUMAN)
FTSQPEGKL

SEQ ID NO: 105038 - protein, 9 aa, Artificial Sequence
  Description of Artificial Sequence: Synthetic peptide
  Seed: YTGYFPMIF (MAGC3_HUMAN)
YFGYFPMIY

SEQ ID NO: 105039 - protein, 9 aa, Artificial Sequence
  Description of Artificial Sequence: Synthetic peptide
  Seed: AGFADVLSR (MAGC3_HUMAN)
ASFADVLSM

SEQ ID NO: 105040 - protein, 10 aa, Artificial Sequence
  Description of Artificial Sequence: Synthetic peptide
  Seed: YTLDEKVDKL (MAGC3_HUMAN)
YLLDEKVDKM

SEQ ID NO: 105041 - protein, 9 aa, Artificial Sequence
  Description of Artificial Sequence: Synthetic peptide
  Seed: FSDGSLGQW (MAGC3_HUMAN)
FNDGSLGQI

SEQ ID NO: 105042 - protein, 9 aa, Artificial Sequence
  Description of Artificial Sequence: Synthetic peptide
  Seed: ALAGFADVL (MAGC3_HUMAN)
AAAGFADVV

SEQ ID NO: 105043 - protein, 9 aa, Artificial Sequence
  Description of Artificial Sequence: Synthetic peptide
  Seed: KNCLLILIL (MAGC3_HUMAN)
KQCLLILII

SEQ ID NO: 105044 - protein, 9 aa, Artificial Sequence
  Description of Artificial Sequence: Synthetic peptide
  Seed: LEFLSKLSS (MAGC3_HUMAN)
LEFLSKLSM

SEQ ID NO: 105045 - protein, 9 aa, Artificial Sequence
  Description of Artificial Sequence: Synthetic peptide
  Seed: VIWEVLNAI (MAGC3_HUMAN)
VLWEVLNAM

SEQ ID NO: 105046 - protein, 9 aa, Artificial Sequence
  Description of Artificial Sequence: Synthetic peptide
  Seed: FPSWYMDAL (MAGC3_HUMAN)
FRSWYMDAV

SEQ ID NO: 105047 - protein, 9 aa, Artificial Sequence
  Description of Artificial Sequence: Synthetic peptide
  Seed: FSLRRAVSV (MAGC3_HUMAN)
FTLRRAVSV

SEQ ID NO: 105048 - protein, 9 aa, Artificial Sequence
  Description of Artificial Sequence: Synthetic peptide
  Seed: KYKDYFPMI (MAGC3_HUMAN)
KYKDYFPMF

SEQ ID NO: 105049 - protein, 10 aa, Artificial Sequence
  Description of Artificial Sequence: Synthetic peptide
  Seed: LDSCSSPLLW (MAGC3_HUMAN)
LMSCSSPLLW

SEQ ID NO: 105050 - protein, 9 aa, Artificial Sequence
  Description of Artificial Sequence: Synthetic peptide
  Seed: SLVLCPTYF (MAGC3_HUMAN)
SMVLCPTYM

SEQ ID NO: 105051 - protein, 9 aa, Artificial Sequence
  Description of Artificial Sequence: Synthetic peptide
  Seed: SESLPRYAL (MAGC3_HUMAN)
SESLPRYAT

SEQ ID NO: 105052 - protein, 9 aa, Artificial Sequence
  Description of Artificial Sequence: Synthetic peptide
  Seed: VDPDHFYVF (MAGC3_HUMAN)
VEPDHFYVM

SEQ ID NO: 105053 - protein, 11 aa, Artificial Sequence
  Description of Artificial Sequence: Synthetic peptide
  Seed: AEMQMNVINTY (MAGC3_HUMAN)
APMQMNVINTF

SEQ ID NO: 105054 - protein, 9 aa, Artificial Sequence
  Description of Artificial Sequence: Synthetic peptide
  Seed: KKYKDYFPM (MAGC3_HUMAN)
KMYKDYFPF

SEQ ID NO: 105055 - protein, 10 aa, Artificial Sequence
  Description of Artificial Sequence: Synthetic peptide
  Seed: REVLEFLSKL (MAGC3_HUMAN)
RTVLEFLSKW

SEQ ID NO: 105056 - protein, 9 aa, Artificial Sequence
  Description of Artificial Sequence: Synthetic peptide
  Seed: RPAREVLEF (MAGC3_HUMAN)
RKAREVLEM

SEQ ID NO: 105057 - protein, 10 aa, Artificial Sequence
  Description of Artificial Sequence: Synthetic peptide
  Seed: FSDGSLGQWV (MAGC3_HUMAN)
FADGSLGQWL

SEQ ID NO: 105058 - protein, 9 aa, Artificial Sequence
  Description of Artificial Sequence: Synthetic peptide
  Seed: VLCPTYFKL (MAGC3_HUMAN)
VQCPTYFKF

SEQ ID NO: 105059 - protein, 9 aa, Artificial Sequence
  Description of Artificial Sequence: Synthetic peptide
  Seed: DYSAFHLGH (MAGC3_HUMAN)
DFSAFHLGK

SEQ ID NO: 105060 - protein, 10 aa, Artificial Sequence
  Description of Artificial Sequence: Synthetic peptide
  Seed: TGYFPMIFRK (MAGC3_HUMAN)
TMYFPMIFRT

SEQ ID NO: 105061 - protein, 9 aa, Artificial Sequence
  Description of Artificial Sequence: Synthetic peptide
  Seed: TLDEKVDKL (MAGC3_HUMAN)
TNDEKVDKI

SEQ ID NO: 105062 - protein, 9 aa, Artificial Sequence
  Description of Artificial Sequence: Synthetic peptide
  Seed: ALDEKVAEL (MAGC3_HUMAN)
AIDEKVAEL

SEQ ID NO: 105063 - protein, 9 aa, Artificial Sequence
  Description of Artificial Sequence: Synthetic peptide
  Seed: WESEGPEAF (MAGC3_HUMAN)
WHSEGPEAM

SEQ ID NO: 105064 - protein, 10 aa, Artificial Sequence
  Description of Artificial Sequence: Synthetic peptide
  Seed: REVRLFLRGG (MAGC3_HUMAN)
RGVRLFLRGA

SEQ ID NO: 105065 - protein, 10 aa, Artificial Sequence
  Description of Artificial Sequence: Synthetic peptide
  Seed: SWYMDALKDM (MAGC3_HUMAN)
SPYMDALKDF

SEQ ID NO: 105066 - protein, 11 aa, Artificial Sequence
  Description of Artificial Sequence: Synthetic peptide
  Seed: ATFSDGSLGQW (MAGC3_HUMAN)
ALFSDGSLGQF

SEQ ID NO: 105067 - protein, 10 aa, Artificial Sequence
  Description of Artificial Sequence: Synthetic peptide
  Seed: KLSSIIPSAF (MAGC3_HUMAN)
KTSSIIPSAF

SEQ ID NO: 105068 - protein, 9 aa, Artificial Sequence
  Description of Artificial Sequence: Synthetic peptide
  Seed: LLILILSVI (MAGC3_HUMAN)
LMILILSVA

SEQ ID NO: 105069 - protein, 10 aa, Artificial Sequence
  Description of Artificial Sequence: Synthetic peptide
  Seed: WEVLSAIGPI (MAGC3_HUMAN)
WMVLSAIGPA

SEQ ID NO: 105070 - protein, 9 aa, Artificial Sequence
  Description of Artificial Sequence: Synthetic peptide
  Seed: ELVQFLLLK (MAGC3_HUMAN)
EVVQFLLLR

SEQ ID NO: 105071 - protein, 11 aa, Artificial Sequence
  Description of Artificial Sequence: Synthetic peptide
  Seed: DYSAFHLGHLR (MAGC3_HUMAN)
DVSAFHLGHLK

SEQ ID NO: 105072 - protein, 9 aa, Artificial Sequence
  Description of Artificial Sequence: Synthetic peptide
  Seed: MASASPSVM (MAGC3_HUMAN)
MISASPSVF

SEQ ID NO: 105073 - protein, 10 aa, Artificial Sequence
  Description of Artificial Sequence: Synthetic peptide
  Seed: QWVKNTCATY (MAGC3_HUMAN)
QAVKNTCATY

SEQ ID NO: 105074 - protein, 9 aa, Artificial Sequence
  Description of Artificial Sequence: Synthetic peptide
  Seed: LILILSVIF (MAGC3_HUMAN)
LMLILSVIF

SEQ ID NO: 105075 - protein, 10 aa, Artificial Sequence
  Description of Artificial Sequence: Synthetic peptide
  Seed: YALDEKVAEL (MAGC3_HUMAN)
YTLDEKVAEF

SEQ ID NO: 105076 - protein, 9 aa, Artificial Sequence
  Description of Artificial Sequence: Synthetic peptide
  Seed: HLREVRLFL (MAGC3_HUMAN)
HSREVRLFV

SEQ ID NO: 105077 - protein, 9 aa, Artificial Sequence
  Description of Artificial Sequence: Synthetic peptide
  Seed: LKYQAKEPL (MAGC3_HUMAN)
LIYQAKEPF

SEQ ID NO: 105078 - protein, 9 aa, Artificial Sequence
  Description of Artificial Sequence: Synthetic peptide
  Seed: VLCPTYFKL (MAGC3_HUMAN)
VYCPTYFKW

SEQ ID NO: 105079 - protein, 9 aa, Artificial Sequence
  Description of Artificial Sequence: Synthetic peptide
  Seed: SLRRAVSVK (MAGC3_HUMAN)
SMRRAVSVV

SEQ ID NO: 105080 - protein, 9 aa, Artificial Sequence
  Description of Artificial Sequence: Synthetic peptide
  Seed: DTTDDATAM (MAGC3_HUMAN)
DPTDDATAF

SEQ ID NO: 105081 - protein, 9 aa, Artificial Sequence
  Description of Artificial Sequence: Synthetic peptide
  Seed: VIWEVLSAI (MAGC3_HUMAN)
VQWEVLSAW

SEQ ID NO: 105082 - protein, 10 aa, Artificial Sequence
  Description of Artificial Sequence: Synthetic peptide
  Seed: KVAELVQFLL (MAGC3_HUMAN)
KTAELVQFLM

SEQ ID NO: 105083 - protein, 9 aa, Artificial Sequence
  Description of Artificial Sequence: Synthetic peptide
  Seed: HALPESESL (MAGC3_HUMAN)
HALPESESH

SEQ ID NO: 105084 - protein, 9 aa, Artificial Sequence
  Description of Artificial Sequence: Synthetic peptide
  Seed: VDPDHFYVF (MAGC3_HUMAN)
VTPDHFYVI

SEQ ID NO: 105085 - protein, 11 aa, Artificial Sequence
  Description of Artificial Sequence: Synthetic peptide
  Seed: ATAMASASPSV (MAGC3_HUMAN)
AFAMASASPSV

SEQ ID NO: 105086 - protein, 8 aa, Artificial Sequence
  Description of Artificial Sequence: Synthetic peptide
  Seed: FLSKLSSI (MAGC3_HUMAN)
FQSKLSSI

SEQ ID NO: 105087 - protein, 10 aa, Artificial Sequence
  Description of Artificial Sequence: Synthetic peptide
  Seed: SSEEEDTATW (MAGC3_HUMAN)
SSEEEDTATY

SEQ ID NO: 105088 - protein, 10 aa, Artificial Sequence
  Description of Artificial Sequence: Synthetic peptide
  Seed: KYKDYFPMIF (MAGC3_HUMAN)
KMKDYFPMIF

SEQ ID NO: 105089 - protein, 9 aa, Artificial Sequence
  Description of Artificial Sequence: Synthetic peptide
  Seed: CLLILILSM (MAGC3_HUMAN)
CMLILILSY

SEQ ID NO: 105090 - protein, 10 aa, Artificial Sequence
  Description of Artificial Sequence: Synthetic peptide
  Seed: KVAELVQFLL (MAGC3_HUMAN)
KMAELVQFLA

SEQ ID NO: 105091 - protein, 10 aa, Artificial Sequence
  Description of Artificial Sequence: Synthetic peptide
  Seed: GSLPESEPLF (MAGC3_HUMAN)
GTLPESEPLW

SEQ ID NO: 105092 - protein, 10 aa, Artificial Sequence
  Description of Artificial Sequence: Synthetic peptide
  Seed: MDPDNHSYFF (MAGC3_HUMAN)
MYPDNHSYFF

SEQ ID NO: 105093 - protein, 9 aa, Artificial Sequence
  Description of Artificial Sequence: Synthetic peptide
  Seed: NAIGPWSAL (MAGC3_HUMAN)
NTIGPWSAF

SEQ ID NO: 105094 - protein, 9 aa, Artificial Sequence
  Description of Artificial Sequence: Synthetic peptide
  Seed: SLGQWVKNT (MAGC3_HUMAN)
SMGQWVKNL

SEQ ID NO: 105095 - protein, 10 aa, Artificial Sequence
  Description of Artificial Sequence: Synthetic peptide
  Seed: YALSPVVLPP (MAGC3_HUMAN)
YLLSPVVLPA

SEQ ID NO: 105096 - protein, 9 aa, Artificial Sequence
  Description of Artificial Sequence: Synthetic peptide
  Seed: LSGSPGLQL (MAGC3_HUMAN)
LYGSPGLQM

SEQ ID NO: 105097 - protein, 9 aa, Artificial Sequence
  Description of Artificial Sequence: Synthetic peptide
  Seed: HSYFFEDTL (MAGC3_HUMAN)
HAYFFEDTF

SEQ ID NO: 105098 - protein, 9 aa, Artificial Sequence
  Description of Artificial Sequence: Synthetic peptide
  Seed: AEMQMNVIN (MAGC3_HUMAN)
AEMQMNVIY

SEQ ID NO: 105099 - protein, 10 aa, Artificial Sequence
  Description of Artificial Sequence: Synthetic peptide
  Seed: INTYTGYFPM (MAGC3_HUMAN)
IFTYTGYFPY

SEQ ID NO: 105100 - protein, 9 aa, Artificial Sequence
  Description of Artificial Sequence: Synthetic peptide
  Seed: LKYQAKEPL (MAGC3_HUMAN)
LHYQAKEPM

SEQ ID NO: 105101 - protein, 9 aa, Artificial Sequence
  Description of Artificial Sequence: Synthetic peptide
  Seed: YKDYFPMIF (MAGC3_HUMAN)
YYDYFPMIL

SEQ ID NO: 105102 - protein, 9 aa, Artificial Sequence
  Description of Artificial Sequence: Synthetic peptide
  Seed: PLPQSPPEI (MAGC3_HUMAN)
PAPQSPPEL

SEQ ID NO: 105103 - protein, 10 aa, Artificial Sequence
  Description of Artificial Sequence: Synthetic peptide
  Seed: SDQRMDSLVL (MAGC3_HUMAN)
SGQRMDSLVF

SEQ ID NO: 105104 - protein, 11 aa, Artificial Sequence
  Description of Artificial Sequence: Synthetic peptide
  Seed: DSCSSPLLWTR (MAGC3_HUMAN)
DTCSSPLLWTK

SEQ ID NO: 105105 - protein, 10 aa, Artificial Sequence
  Description of Artificial Sequence: Synthetic peptide
  Seed: SIIPSAFPSW (MAGC3_HUMAN)
SYIPSAFPSW

SEQ ID NO: 105106 - protein, 10 aa, Artificial Sequence
  Description of Artificial Sequence: Synthetic peptide
  Seed: RPAREVLEFL (MAGC3_HUMAN)
REAREVLEFK

SEQ ID NO: 105107 - protein, 9 aa, Artificial Sequence
  Description of Artificial Sequence: Synthetic peptide
  Seed: FLSKLSSII (MAGC3_HUMAN)
FMSKLSSIF

SEQ ID NO: 105108 - protein, 11 aa, Artificial Sequence
  Description of Artificial Sequence: Synthetic peptide
  Seed: ILFGISLTEVD (MAGC3_HUMAN)
ILFGISLTEVG

SEQ ID NO: 105109 - protein, 10 aa, Artificial Sequence
  Description of Artificial Sequence: Synthetic peptide
  Seed: FPSWYMDALK (MAGC3_HUMAN)
FWSWYMDALR

SEQ ID NO: 105110 - protein, 9 aa, Artificial Sequence
  Description of Artificial Sequence: Synthetic peptide
  Seed: TYALSPVVL (MAGC3_HUMAN)
TFALSPVVL

SEQ ID NO: 105111 - protein, 10 aa, Artificial Sequence
  Description of Artificial Sequence: Synthetic peptide
  Seed: SIIPSAFPSW (MAGC3_HUMAN)
SAIPSAFPSL

SEQ ID NO: 105112 - protein, 9 aa, Artificial Sequence
  Description of Artificial Sequence: Synthetic peptide
  Seed: RPAREVLEF (MAGC3_HUMAN)
RTAREVLEW

SEQ ID NO: 105113 - protein, 10 aa, Artificial Sequence
  Description of Artificial Sequence: Synthetic peptide
  Seed: KDYFPMIFGK (MAGC3_HUMAN)
KHYFPMIFGK

SEQ ID NO: 105114 - protein, 9 aa, Artificial Sequence
  Description of Artificial Sequence: Synthetic peptide
  Seed: GYTLSLPAV (MAGC3_HUMAN)
GYTLSLPAF

SEQ ID NO: 105115 - protein, 10 aa, Artificial Sequence
  Description of Artificial Sequence: Synthetic peptide
  Seed: ALAGFADVLS (MAGC3_HUMAN)
AMAGFADVLA

SEQ ID NO: 105116 - protein, 9 aa, Artificial Sequence
  Description of Artificial Sequence: Synthetic peptide
  Seed: ELVQFLLLK (MAGC3_HUMAN)
EIVQFLLLR

SEQ ID NO: 105117 - protein, 9 aa, Artificial Sequence
  Description of Artificial Sequence: Synthetic peptide
  Seed: SLVLCPTYF (MAGC3_HUMAN)
STVLCPTYL

SEQ ID NO: 105118 - protein, 9 aa, Artificial Sequence
  Description of Artificial Sequence: Synthetic peptide
  Seed: YTGYFPMIF (MAGC3_HUMAN)
YMGYFPMIM

SEQ ID NO: 105119 - protein, 10 aa, Artificial Sequence
  Description of Artificial Sequence: Synthetic peptide
  Seed: EVIWEVLNAI (MAGC3_HUMAN)
EMIWEVLNAY

SEQ ID NO: 105120 - protein, 9 aa, Artificial Sequence
  Description of Artificial Sequence: Synthetic peptide
  Seed: YFPMIFRKA (MAGC3_HUMAN)
YYPMIFRKY

SEQ ID NO: 105121 - protein, 9 aa, Artificial Sequence
  Description of Artificial Sequence: Synthetic peptide
  Seed: KEPLTRAEM (MAGC3_HUMAN)
KMPLTRAEF

SEQ ID NO: 105122 - protein, 10 aa, Artificial Sequence
  Description of Artificial Sequence: Synthetic peptide
  Seed: SWYMDALKDM (MAGC3_HUMAN)
SEYMDALKDF

SEQ ID NO: 105123 - protein, 9 aa, Artificial Sequence
  Description of Artificial Sequence: Synthetic peptide
  Seed: VIWEVLSAI (MAGC3_HUMAN)
VLWEVLSAK

SEQ ID NO: 105124 - protein, 10 aa, Artificial Sequence
  Description of Artificial Sequence: Synthetic peptide
  Seed: EEVIWEVLNA (MAGC3_HUMAN)
EHVIWEVLNV

SEQ ID NO: 105125 - protein, 10 aa, Artificial Sequence
  Description of Artificial Sequence: Synthetic peptide
  Seed: SIIPSAFPSW (MAGC3_HUMAN)
SQIPSAFPSM

SEQ ID NO: 105126 - protein, 9 aa, Artificial Sequence
  Description of Artificial Sequence: Synthetic peptide
  Seed: SQPEGKFSL (MAGC3_HUMAN)
SYPEGKFSW

SEQ ID NO: 105127 - protein, 10 aa, Artificial Sequence
  Description of Artificial Sequence: Synthetic peptide
  Seed: KLVQFLLLKY (MAGC3_HUMAN)
KIVQFLLLKF

SEQ ID NO: 105128 - protein, 9 aa, Artificial Sequence
  Description of Artificial Sequence: Synthetic peptide
  Seed: IIDTTDDAT (MAGC3_HUMAN)
IFDTTDDAI

SEQ ID NO: 105129 - protein, 10 aa, Artificial Sequence
  Description of Artificial Sequence: Synthetic peptide
  Seed: MDPDNHSYFF (MAGC3_HUMAN)
MCPDNHSYFM

SEQ ID NO: 105130 - protein, 10 aa, Artificial Sequence
  Description of Artificial Sequence: Synthetic peptide
  Seed: LDLANPQGLA (MAGC3_HUMAN)
LDLANPQGLV

SEQ ID NO: 105131 - protein, 9 aa, Artificial Sequence
  Description of Artificial Sequence: Synthetic peptide
  Seed: KLVQFLLLK (MAGC3_HUMAN)
KAVQFLLLY

SEQ ID NO: 105132 - protein, 11 aa, Artificial Sequence
  Description of Artificial Sequence: Synthetic peptide
  Seed: TSDQRMDSLVL (MAGC3_HUMAN)
THDQRMDSLVY

SEQ ID NO: 105133 - protein, 10 aa, Artificial Sequence
  Description of Artificial Sequence: Synthetic peptide
  Seed: NRLLILILSV (MAGC3_HUMAN)
NQLLILILSV

SEQ ID NO: 105134 - protein, 10 aa, Artificial Sequence
  Description of Artificial Sequence: Synthetic peptide
  Seed: TEVDPDHFYV (MAGC3_HUMAN)
TVVDPDHFYV

SEQ ID NO: 105135 - protein, 9 aa, Artificial Sequence
  Description of Artificial Sequence: Synthetic peptide
  Seed: YALDEKVAE (MAGC3_HUMAN)
YALDEKVAH

SEQ ID NO: 105136 - protein, 9 aa, Artificial Sequence
  Description of Artificial Sequence: Synthetic peptide
  Seed: ASEEVIWEV (MAGC3_HUMAN)
AMEEVIWES

SEQ ID NO: 105137 - protein, 10 aa, Artificial Sequence
  Description of Artificial Sequence: Synthetic peptide
  Seed: LPQSPPEIPP (MAGC3_HUMAN)
LPQSPPEIPF

SEQ ID NO: 105138 - protein, 9 aa, Artificial Sequence
  Description of Artificial Sequence: Synthetic peptide
  Seed: EVIWEVLNA (MAGC3_HUMAN)
EVIWEVLNK

SEQ ID NO: 105139 - protein, 10 aa, Artificial Sequence
  Description of Artificial Sequence: Synthetic peptide
  Seed: SDQRMDSLVL (MAGC3_HUMAN)
SLQRMDSLVF

SEQ ID NO: 105140 - protein, 9 aa, Artificial Sequence
  Description of Artificial Sequence: Synthetic peptide
  Seed: KVDKLVQFL (MAGC3_HUMAN)
KDDKLVQFF

SEQ ID NO: 105141 - protein, 10 aa, Artificial Sequence
  Description of Artificial Sequence: Synthetic peptide
  Seed: MQMNVINTYT (MAGC3_HUMAN)
MQMNVINTYA

SEQ ID NO: 105142 - protein, 9 aa, Artificial Sequence
  Description of Artificial Sequence: Synthetic peptide
  Seed: AMASASPSV (MAGC3_HUMAN)
ARASASPSF

SEQ ID NO: 105143 - protein, 9 aa, Artificial Sequence
  Description of Artificial Sequence: Synthetic peptide
  Seed: TLDEKVDKL (MAGC3_HUMAN)
TRDEKVDKI

SEQ ID NO: 105144 - protein, 10 aa, Artificial Sequence
  Description of Artificial Sequence: Synthetic peptide
  Seed: TCATYALSPV (MAGC3_HUMAN)
TTATYALSPM

SEQ ID NO: 105145 - protein, 9 aa, Artificial Sequence
  Description of Artificial Sequence: Synthetic peptide
  Seed: YFFEDTLDL (MAGC3_HUMAN)
YPFEDTLDH

SEQ ID NO: 105146 - protein, 10 aa, Artificial Sequence
  Description of Artificial Sequence: Synthetic peptide
  Seed: TAMASASPSV (MAGC3_HUMAN)
TYMASASPSI

SEQ ID NO: 105147 - protein, 9 aa, Artificial Sequence
  Description of Artificial Sequence: Synthetic peptide
  Seed: SASPSVMST (MAGC3_HUMAN)
SISPSVMSM

SEQ ID NO: 105148 - protein, 11 aa, Artificial Sequence
  Description of Artificial Sequence: Synthetic peptide
  Seed: IIDTTDDATAM (MAGC3_HUMAN)
ITDTTDDATAW

SEQ ID NO: 105149 - protein, 10 aa, Artificial Sequence
  Description of Artificial Sequence: Synthetic peptide
  Seed: YALDEKVAEL (MAGC3_HUMAN)
YTLDEKVAEC

SEQ ID NO: 105150 - protein, 9 aa, Artificial Sequence
  Description of Artificial Sequence: Synthetic peptide
  Seed: ALDEKVAEL (MAGC3_HUMAN)
AMDEKVAET

SEQ ID NO: 105151 - protein, 9 aa, Artificial Sequence
  Description of Artificial Sequence: Synthetic peptide
  Seed: KLVQFLLLK (MAGC3_HUMAN)
KAVQFLLLK

SEQ ID NO: 105152 - protein, 9 aa, Artificial Sequence
  Description of Artificial Sequence: Synthetic peptide
  Seed: AMASASPSV (MAGC3_HUMAN)
AIASASPSL

SEQ ID NO: 105153 - protein, 9 aa, Artificial Sequence
  Description of Artificial Sequence: Synthetic peptide
  Seed: SAFHLGHLR (MAGC3_HUMAN)
STFHLGHLF

SEQ ID NO: 105154 - protein, 9 aa, Artificial Sequence
  Description of Artificial Sequence: Synthetic peptide
  Seed: ALDEKVAEL (MAGC3_HUMAN)
ALDEKVAEC

SEQ ID NO: 105155 - protein, 9 aa, Artificial Sequence
  Description of Artificial Sequence: Synthetic peptide
  Seed: FPMIFGKAH (MAGC3_HUMAN)
FPMIFGKAV

SEQ ID NO: 105156 - protein, 9 aa, Artificial Sequence
  Description of Artificial Sequence: Synthetic peptide
  Seed: ALDEKVAEL (MAGC3_HUMAN)
ANDEKVAEI

SEQ ID NO: 105157 - protein, 9 aa, Artificial Sequence
  Description of Artificial Sequence: Synthetic peptide
  Seed: DMDPDNHSY (MAGC3_HUMAN)
DADPDNHSI

SEQ ID NO: 105158 - protein, 9 aa, Artificial Sequence
  Description of Artificial Sequence: Synthetic peptide
  Seed: IIDTTDDAT (MAGC3_HUMAN)
IGDTTDDAF

SEQ ID NO: 105159 - protein, 8 aa, Artificial Sequence
  Description of Artificial Sequence: Synthetic peptide
  Seed: KAHEFIEL (MAGC3_HUMAN)
KRHEFIEL

SEQ ID NO: 105160 - protein, 9 aa, Artificial Sequence
  Description of Artificial Sequence: Synthetic peptide
  Seed: HLREVRLFL (MAGC3_HUMAN)
HVREVRLFP

SEQ ID NO: 105161 - protein, 9 aa, Artificial Sequence
  Description of Artificial Sequence: Synthetic peptide
  Seed: SLVLCPTYF (MAGC3_HUMAN)
SQVLCPTYI

SEQ ID NO: 105162 - protein, 9 aa, Artificial Sequence
  Description of Artificial Sequence: Synthetic peptide
  Seed: HLREVRLFL (MAGC3_HUMAN)
HTREVRLFG

SEQ ID NO: 105163 - protein, 9 aa, Artificial Sequence
  Description of Artificial Sequence: Synthetic peptide
  Seed: IIPSAFPSW (MAGC3_HUMAN)
IHPSAFPSF

SEQ ID NO: 105164 - protein, 9 aa, Artificial Sequence
  Description of Artificial Sequence: Synthetic peptide
  Seed: LWGEKAGSL (MAGC3_HUMAN)
LAGEKAGSL

SEQ ID NO: 105165 - protein, 9 aa, Artificial Sequence
  Description of Artificial Sequence: Synthetic peptide
  Seed: MIFGKAHEF (MAGC3_HUMAN)
MQFGKAHEL

SEQ ID NO: 105166 - protein, 9 aa, Artificial Sequence
  Description of Artificial Sequence: Synthetic peptide
  Seed: TTDDATAMA (MAGC3_HUMAN)
TADDATAMF

SEQ ID NO: 105167 - protein, 10 aa, Artificial Sequence
  Description of Artificial Sequence: Synthetic peptide
  Seed: FPSWYMDALK (MAGC3_HUMAN)
FKSWYMDALK

SEQ ID NO: 105168 - protein, 9 aa, Artificial Sequence
  Description of Artificial Sequence: Synthetic peptide
  Seed: IPPQGPPKI (MAGC3_HUMAN)
ISPQGPPKF

SEQ ID NO: 105169 - protein, 11 aa, Artificial Sequence
  Description of Artificial Sequence: Synthetic peptide
  Seed: TYTGYFPMIFR (MAGC3_HUMAN)
TRTGYFPMIFR

SEQ ID NO: 105170 - protein, 10 aa, Artificial Sequence
  Description of Artificial Sequence: Synthetic peptide
  Seed: YTGYFPMIFR (MAGC3_HUMAN)
YAGYFPMIFR

SEQ ID NO: 105171 - protein, 9 aa, Artificial Sequence
  Description of Artificial Sequence: Synthetic peptide
  Seed: LANPQGLAG (MAGC3_HUMAN)
LANPQGLAM

SEQ ID NO: 105172 - protein, 10 aa, Artificial Sequence
  Description of Artificial Sequence: Synthetic peptide
  Seed: REVRLFLRGG (MAGC3_HUMAN)
RFVRLFLRGI

SEQ ID NO: 105173 - protein, 9 aa, Artificial Sequence
  Description of Artificial Sequence: Synthetic peptide
  Seed: VIWEVLSAI (MAGC3_HUMAN)
VGWEVLSAF

SEQ ID NO: 105174 - protein, 9 aa, Artificial Sequence
  Description of Artificial Sequence: Synthetic peptide
  Seed: NTYTGYFPM (MAGC3_HUMAN)
NMYTGYFPT

SEQ ID NO: 105175 - protein, 8 aa, Artificial Sequence
  Description of Artificial Sequence: Synthetic peptide
  Seed: MEDRAQAI (MAGC3_HUMAN)
MTDRAQAI

SEQ ID NO: 105176 - protein, 10 aa, Artificial Sequence
  Description of Artificial Sequence: Synthetic peptide
  Seed: MDPDNHSYFF (MAGC3_HUMAN)
MRPDNHSYFY

SEQ ID NO: 105177 - protein, 10 aa, Artificial Sequence
  Description of Artificial Sequence: Synthetic peptide
  Seed: FFEDTLDLTY (MAGC3_HUMAN)
FYEDTLDLTL

SEQ ID NO: 105178 - protein, 9 aa, Artificial Sequence
  Description of Artificial Sequence: Synthetic peptide
  Seed: KLSSIIPSA (MAGC3_HUMAN)
KMSSIIPSC

SEQ ID NO: 105179 - protein, 10 aa, Artificial Sequence
  Description of Artificial Sequence: Synthetic peptide
  Seed: FFEDTLDLTY (MAGC3_HUMAN)
FSEDTLDLTF

SEQ ID NO: 105180 - protein, 10 aa, Artificial Sequence
  Description of Artificial Sequence: Synthetic peptide
  Seed: LPTWRRGTGY (MAGC3_HUMAN)
LNTWRRGTGF

SEQ ID NO: 105181 - protein, 11 aa, Artificial Sequence
  Description of Artificial Sequence: Synthetic peptide
  Seed: RTLSGSPGLQL (MAGC3_HUMAN)
RLLSGSPGLQR

SEQ ID NO: 105182 - protein, 10 aa, Artificial Sequence
  Description of Artificial Sequence: Synthetic peptide
  Seed: KKYKDYFPMI (MAGC3_HUMAN)
KEYKDYFPMF

SEQ ID NO: 105183 - protein, 9 aa, Artificial Sequence
  Description of Artificial Sequence: Synthetic peptide
  Seed: LSDEQGMPQ (MAGC3_HUMAN)
LIDEQGMPF

SEQ ID NO: 105184 - protein, 11 aa, Artificial Sequence
  Description of Artificial Sequence: Synthetic peptide
  Seed: ATFSDGSLGQW (MAGC3_HUMAN)
AAFSDGSLGQW

SEQ ID NO: 105185 - protein, 9 aa, Artificial Sequence
  Description of Artificial Sequence: Synthetic peptide
  Seed: HALPESESL (MAGC3_HUMAN)
HELPESESL

SEQ ID NO: 105186 - protein, 9 aa, Artificial Sequence
  Description of Artificial Sequence: Synthetic peptide
  Seed: VDPDHFYVF (MAGC3_HUMAN)
VSPDHFYVV

SEQ ID NO: 105187 - protein, 9 aa, Artificial Sequence
  Description of Artificial Sequence: Synthetic peptide
  Seed: ATYALSPVV (MAGC3_HUMAN)
ASYALSPVI

SEQ ID NO: 105188 - protein, 9 aa, Artificial Sequence
  Description of Artificial Sequence: Synthetic peptide
  Seed: TYFKLWRTL (MAGC3_HUMAN)
TIFKLWRTY

SEQ ID NO: 105189 - protein, 8 aa, Artificial Sequence
  Description of Artificial Sequence: Synthetic peptide
  Seed: KVDKLVQF (MAGC3_HUMAN)
KADKLVQI

SEQ ID NO: 105190 - protein, 11 aa, Artificial Sequence
  Description of Artificial Sequence: Synthetic peptide
  Seed: ATAMASASPSV (MAGC3_HUMAN)
AWAMASASPSV

SEQ ID NO: 105191 - protein, 10 aa, Artificial Sequence
  Description of Artificial Sequence: Synthetic peptide
  Seed: FKLWRTLSGS (MAGC3_HUMAN)
FKLWRTLSGM

SEQ ID NO: 105192 - protein, 9 aa, Artificial Sequence
  Description of Artificial Sequence: Synthetic peptide
  Seed: EVLNAIGPW (MAGC3_HUMAN)
ESLNAIGPY

SEQ ID NO: 105193 - protein, 10 aa, Artificial Sequence
  Description of Artificial Sequence: Synthetic peptide
  Seed: IPSAFPSWYM (MAGC3_HUMAN)
IISAFPSWYF

SEQ ID NO: 105194 - protein, 10 aa, Artificial Sequence
  Description of Artificial Sequence: Synthetic peptide
  Seed: IELIFGIALT (MAGC3_HUMAN)
ILLIFGIALL

SEQ ID NO: 105195 - protein, 9 aa, Artificial Sequence
  Description of Artificial Sequence: Synthetic peptide
  Seed: EVLSAIGPI (MAGC3_HUMAN)
EGLSAIGPR

SEQ ID NO: 105196 - protein, 9 aa, Artificial Sequence
  Description of Artificial Sequence: Synthetic peptide
  Seed: MEDRAQAII (MAGC3_HUMAN)
MVDRAQAIF

SEQ ID NO: 105197 - protein, 9 aa, Artificial Sequence
  Description of Artificial Sequence: Synthetic peptide
  Seed: KAHEFIELI (MAGC3_HUMAN)
KQHEFIELM

SEQ ID NO: 105198 - protein, 10 aa, Artificial Sequence
  Description of Artificial Sequence: Synthetic peptide
  Seed: ALWESEGPEA (MAGC3_HUMAN)
AMWESEGPEI

SEQ ID NO: 105199 - protein, 9 aa, Artificial Sequence
  Description of Artificial Sequence: Synthetic peptide
  Seed: FSLRRAVSV (MAGC3_HUMAN)
FLLRRAVSA

SEQ ID NO: 105200 - protein, 9 aa, Artificial Sequence
  Description of Artificial Sequence: Synthetic peptide
  Seed: KLSSIIPSA (MAGC3_HUMAN)
KQSSIIPSV

SEQ ID NO: 105201 - protein, 9 aa, Artificial Sequence
  Description of Artificial Sequence: Synthetic peptide
  Seed: LSRLALWES (MAGC3_HUMAN)
LSRLALWEA

SEQ ID NO: 105202 - protein, 11 aa, Artificial Sequence
  Description of Artificial Sequence: Synthetic peptide
  Seed: IDDQGMPKNCL (MAGC3_HUMAN)
IADQGMPKNCL

SEQ ID NO: 105203 - protein, 10 aa, Artificial Sequence
  Description of Artificial Sequence: Synthetic peptide
  Seed: SIIPSAFPSW (MAGC3_HUMAN)
STIPSAFPSM

SEQ ID NO: 105204 - protein, 9 aa, Artificial Sequence
  Description of Artificial Sequence: Synthetic peptide
  Seed: WVKNTCATY (MAGC3_HUMAN)
WLKNTCATM

SEQ ID NO: 105205 - protein, 9 aa, Artificial Sequence
  Description of Artificial Sequence: Synthetic peptide
  Seed: KVDKLVQFL (MAGC3_HUMAN)
KQDKLVQFW

SEQ ID NO: 105206 - protein, 9 aa, Artificial Sequence
  Description of Artificial Sequence: Synthetic peptide
  Seed: MIFGKAHEF (MAGC3_HUMAN)
MMFGKAHEK

SEQ ID NO: 105207 - protein, 9 aa, Artificial Sequence
  Description of Artificial Sequence: Synthetic peptide
  Seed: ILILSMIFI (MAGC3_HUMAN)
IMILSMIFV

SEQ ID NO: 105208 - protein, 9 aa, Artificial Sequence
  Description of Artificial Sequence: Synthetic peptide
  Seed: SCVPEEVIW (MAGC3_HUMAN)
STVPEEVIF

SEQ ID NO: 105209 - protein, 10 aa, Artificial Sequence
  Description of Artificial Sequence: Synthetic peptide
  Seed: TWRRGTGYTL (MAGC3_HUMAN)
TFRRGTGYTF

SEQ ID NO: 105210 - protein, 9 aa, Artificial Sequence
  Description of Artificial Sequence: Synthetic peptide
  Seed: QLSDLHFGS (MAGC3_HUMAN)
QVSDLHFGV

SEQ ID NO: 105211 - protein, 9 aa, Artificial Sequence
  Description of Artificial Sequence: Synthetic peptide
  Seed: NAIGPWSAL (MAGC3_HUMAN)
NAIGPWSAI

SEQ ID NO: 105212 - protein, 9 aa, Artificial Sequence
  Description of Artificial Sequence: Synthetic peptide
  Seed: YKDYFPMIF (MAGC3_HUMAN)
YYDYFPMIV

SEQ ID NO: 105213 - protein, 9 aa, Artificial Sequence
  Description of Artificial Sequence: Synthetic peptide
  Seed: KLSSIIPSA (MAGC3_HUMAN)
KSSSIIPSA

SEQ ID NO: 105214 - protein, 10 aa, Artificial Sequence
  Description of Artificial Sequence: Synthetic peptide
  Seed: EVIWEVLSAI (MAGC3_HUMAN)
ETIWEVLSAT

SEQ ID NO: 105215 - protein, 9 aa, Artificial Sequence
  Description of Artificial Sequence: Synthetic peptide
  Seed: NTYTGYFPM (MAGC3_HUMAN)
NVYTGYFPY

SEQ ID NO: 105216 - protein, 9 aa, Artificial Sequence
  Description of Artificial Sequence: Synthetic peptide
  Seed: MIFGKAHEF (MAGC3_HUMAN)
MPFGKAHEL

SEQ ID NO: 105217 - protein, 9 aa, Artificial Sequence
  Description of Artificial Sequence: Synthetic peptide
  Seed: LSSIIPSAF (MAGC3_HUMAN)
LTSIIPSAY

SEQ ID NO: 105218 - protein, 9 aa, Artificial Sequence
  Description of Artificial Sequence: Synthetic peptide
  Seed: KLSSIIPSA (MAGC3_HUMAN)
KISSIIPSY

SEQ ID NO: 105219 - protein, 10 aa, Artificial Sequence
  Description of Artificial Sequence: Synthetic peptide
  Seed: ALDEKVAELV (MAGC3_HUMAN)
ALDEKVAELF

SEQ ID NO: 105220 - protein, 9 aa, Artificial Sequence
  Description of Artificial Sequence: Synthetic peptide
  Seed: VPEEVIWEV (MAGC3_HUMAN)
VAEEVIWEL

SEQ ID NO: 105221 - protein, 10 aa, Artificial Sequence
  Description of Artificial Sequence: Synthetic peptide
  Seed: IKKYKDYFPM (MAGC3_HUMAN)
ISKYKDYFPF

SEQ ID NO: 105222 - protein, 9 aa, Artificial Sequence
  Description of Artificial Sequence: Synthetic peptide
  Seed: ELVQFLLLK (MAGC3_HUMAN)
EAVQFLLLK

SEQ ID NO: 105223 - protein, 9 aa, Artificial Sequence
  Description of Artificial Sequence: Synthetic peptide
  Seed: KVAELVQFL (MAGC3_HUMAN)
KVAELVQFT

SEQ ID NO: 105224 - protein, 9 aa, Artificial Sequence
  Description of Artificial Sequence: Synthetic peptide
  Seed: LSDEQGMPQ (MAGC3_HUMAN)
LVDEQGMPV

SEQ ID NO: 105225 - protein, 9 aa, Artificial Sequence
  Description of Artificial Sequence: Synthetic peptide
  Seed: TAMASASPS (MAGC3_HUMAN)
TMMASASPF

SEQ ID NO: 105226 - protein, 8 aa, Artificial Sequence
  Description of Artificial Sequence: Synthetic peptide
  Seed: YMDALKDM (MAGC3_HUMAN)
YSDALKDM

SEQ ID NO: 105227 - protein, 9 aa, Artificial Sequence
  Description of Artificial Sequence: Synthetic peptide
  Seed: WRRGTGYTL (MAGC3_HUMAN)
WYRGTGYTF

SEQ ID NO: 105228 - protein, 8 aa, Artificial Sequence
  Description of Artificial Sequence: Synthetic peptide
  Seed: KVDKLVQF (MAGC3_HUMAN)
KVDKLVQM

SEQ ID NO: 105229 - protein, 10 aa, Artificial Sequence
  Description of Artificial Sequence: Synthetic peptide
  Seed: KLVQFLLLKY (MAGC3_HUMAN)
KVVQFLLLKF

SEQ ID NO: 105230 - protein, 9 aa, Artificial Sequence
  Description of Artificial Sequence: Synthetic peptide
  Seed: WVKNTCATY (MAGC3_HUMAN)
WYKNTCATI

SEQ ID NO: 105231 - protein, 10 aa, Artificial Sequence
  Description of Artificial Sequence: Synthetic peptide
  Seed: FPSWYMDALK (MAGC3_HUMAN)
FASWYMDALR

SEQ ID NO: 105232 - protein, 10 aa, Artificial Sequence
  Description of Artificial Sequence: Synthetic peptide
  Seed: CVPEEVIWEV (MAGC3_HUMAN)
CVPEEVIWEL

SEQ ID NO: 105233 - protein, 9 aa, Artificial Sequence
  Description of Artificial Sequence: Synthetic peptide
  Seed: KLSSIIPSA (MAGC3_HUMAN)
KISSIIPSA

SEQ ID NO: 105234 - protein, 10 aa, Artificial Sequence
  Description of Artificial Sequence: Synthetic peptide
  Seed: YTLDEKVDKL (MAGC3_HUMAN)
YVLDEKVDKW

SEQ ID NO: 105235 - protein, 9 aa, Artificial Sequence
  Description of Artificial Sequence: Synthetic peptide
  Seed: HSYFFEDTL (MAGC3_HUMAN)
HTYFFEDTM

SEQ ID NO: 105236 - protein, 9 aa, Artificial Sequence
  Description of Artificial Sequence: Synthetic peptide
  Seed: LSDEQGMPQ (MAGC3_HUMAN)
LSDEQGMPI

SEQ ID NO: 105237 - protein, 9 aa, Artificial Sequence
  Description of Artificial Sequence: Synthetic peptide
  Seed: KKYKDYFPM (MAGC3_HUMAN)
KQYKDYFPL

SEQ ID NO: 105238 - protein, 10 aa, Artificial Sequence
  Description of Artificial Sequence: Synthetic peptide
  Seed: EVIWEVLNAI (MAGC3_HUMAN)
EVIWEVLNAL

SEQ ID NO: 105239 - protein, 9 aa, Artificial Sequence
  Description of Artificial Sequence: Synthetic peptide
  Seed: EVIWEVLNA (MAGC3_HUMAN)
ETIWEVLNR

SEQ ID NO: 105240 - protein, 10 aa, Artificial Sequence
  Description of Artificial Sequence: Synthetic peptide
  Seed: SIIPSAFPSW (MAGC3_HUMAN)
SSIPSAFPSI

SEQ ID NO: 105241 - protein, 9 aa, Artificial Sequence
  Description of Artificial Sequence: Synthetic peptide
  Seed: GYFPMIFRK (MAGC3_HUMAN)
GGFPMIFRK

SEQ ID NO: 105242 - protein, 9 aa, Artificial Sequence
  Description of Artificial Sequence: Synthetic peptide
  Seed: MLLPCHWVL (MAGC3_HUMAN)
MLLPCHWVF

SEQ ID NO: 105243 - protein, 9 aa, Artificial Sequence
  Description of Artificial Sequence: Synthetic peptide
  Seed: ILILSVIFI (MAGC3_HUMAN)
IMILSVIFI

SEQ ID NO: 105244 - protein, 10 aa, Artificial Sequence
  Description of Artificial Sequence: Synthetic peptide
  Seed: MPAAGMPPLP (MAGC3_HUMAN)
MMAAGMPPLF

SEQ ID NO: 105245 - protein, 9 aa, Artificial Sequence
  Description of Artificial Sequence: Synthetic peptide
  Seed: YQAKEPLTR (MAGC3_HUMAN)
YSAKEPLTF

SEQ ID NO: 105246 - protein, 10 aa, Artificial Sequence
  Description of Artificial Sequence: Synthetic peptide
  Seed: TGYFPMIFRK (MAGC3_HUMAN)
TMYFPMIFRH

SEQ ID NO: 105247 - protein, 11 aa, Artificial Sequence
  Description of Artificial Sequence: Synthetic peptide
  Seed: ALWESEGPEAF (MAGC3_HUMAN)
AYWESEGPEAF

SEQ ID NO: 105248 - protein, 10 aa, Artificial Sequence
  Description of Artificial Sequence: Synthetic peptide
  Seed: MPAAGMPPLP (MAGC3_HUMAN)
MPAAGMPPLW

SEQ ID NO: 105249 - protein, 9 aa, Artificial Sequence
  Description of Artificial Sequence: Synthetic peptide
  Seed: MQMNVINTY (MAGC3_HUMAN)
MSMNVINTF

SEQ ID NO: 105250 - protein, 9 aa, Artificial Sequence
  Description of Artificial Sequence: Synthetic peptide
  Seed: FPSWYMDAL (MAGC3_HUMAN)
FISWYMDAV

SEQ ID NO: 105251 - protein, 9 aa, Artificial Sequence
  Description of Artificial Sequence: Synthetic peptide
  Seed: IIDTTDDAT (MAGC3_HUMAN)
ILDTTDDAF

SEQ ID NO: 105252 - protein, 9 aa, Artificial Sequence
  Description of Artificial Sequence: Synthetic peptide
  Seed: MQMNVINTY (MAGC3_HUMAN)
MIMNVINTA

SEQ ID NO: 105253 - protein, 9 aa, Artificial Sequence
  Description of Artificial Sequence: Synthetic peptide
  Seed: EKVDKLVQF (MAGC3_HUMAN)
EMVDKLVQY

SEQ ID NO: 105254 - protein, 10 aa, Artificial Sequence
  Description of Artificial Sequence: Synthetic peptide
  Seed: EMQMNVINTY (MAGC3_HUMAN)
EMQMNVINTF

SEQ ID NO: 105255 - protein, 9 aa, Artificial Sequence
  Description of Artificial Sequence: Synthetic peptide
  Seed: DYFPMIFGK (MAGC3_HUMAN)
DAFPMIFGK

SEQ ID NO: 105256 - protein, 9 aa, Artificial Sequence
  Description of Artificial Sequence: Synthetic peptide
  Seed: DVLSRLALW (MAGC3_HUMAN)
DALSRLALF

SEQ ID NO: 105257 - protein, 9 aa, Artificial Sequence
  Description of Artificial Sequence: Synthetic peptide
  Seed: IQRPAREVL (MAGC3_HUMAN)
ILRPAREVY

SEQ ID NO: 105258 - protein, 9 aa, Artificial Sequence
  Description of Artificial Sequence: Synthetic peptide
  Seed: EKVAELVQF (MAGC3_HUMAN)
EAVAELVQF

SEQ ID NO: 105259 - protein, 9 aa, Artificial Sequence
  Description of Artificial Sequence: Synthetic peptide
  Seed: HFYVFVNTL (MAGC3_HUMAN)
HVYVFVNTI

SEQ ID NO: 105260 - protein, 10 aa, Artificial Sequence
  Description of Artificial Sequence: Synthetic peptide
  Seed: ILILSVIFIK (MAGC3_HUMAN)
IVILSVIFIK

SEQ ID NO: 105261 - protein, 9 aa, Artificial Sequence
  Description of Artificial Sequence: Synthetic peptide
  Seed: KNCLLILIL (MAGC3_HUMAN)
KTCLLILIW

SEQ ID NO: 105262 - protein, 11 aa, Artificial Sequence
  Description of Artificial Sequence: Synthetic peptide
  Seed: EVLSAIGPIQR (MAGC3_HUMAN)
EILSAIGPIQR

SEQ ID NO: 105263 - protein, 9 aa, Artificial Sequence
  Description of Artificial Sequence: Synthetic peptide
  Seed: NAIGPWSAL (MAGC3_HUMAN)
NSIGPWSAF

SEQ ID NO: 105264 - protein, 8 aa, Artificial Sequence
  Description of Artificial Sequence: Synthetic peptide
  Seed: YMDALKDM (MAGC3_HUMAN)
YTDALKDL

SEQ ID NO: 105265 - protein, 8 aa, Artificial Sequence
  Description of Artificial Sequence: Synthetic peptide
  Seed: AVSPGKRL (MAGC3_HUMAN)
AASPGKRL

SEQ ID NO: 105266 - protein, 9 aa, Artificial Sequence
  Description of Artificial Sequence: Synthetic peptide
  Seed: ATYALSPVV (MAGC3_HUMAN)
AAYALSPVW

SEQ ID NO: 105267 - protein, 10 aa, Artificial Sequence
  Description of Artificial Sequence: Synthetic peptide
  Seed: NTYTGYFPMI (MAGC3_HUMAN)
NMYTGYFPMF

SEQ ID NO: 105268 - protein, 9 aa, Artificial Sequence
  Description of Artificial Sequence: Synthetic peptide
  Seed: MQMNVINTY (MAGC3_HUMAN)
MDMNVINTI

SEQ ID NO: 105269 - protein, 9 aa, Artificial Sequence
  Description of Artificial Sequence: Synthetic peptide
  Seed: VLCPTYFKL (MAGC3_HUMAN)
VLCPTYFKW

SEQ ID NO: 105270 - protein, 8 aa, Artificial Sequence
  Description of Artificial Sequence: Synthetic peptide
  Seed: IFGKAHEF (MAGC3_HUMAN)
IQGKAHEY

SEQ ID NO: 105271 - protein, 10 aa, Artificial Sequence
  Description of Artificial Sequence: Synthetic peptide
  Seed: EEVIWEVLSA (MAGC3_HUMAN)
EAVIWEVLSV

SEQ ID NO: 105272 - protein, 9 aa, Artificial Sequence
  Description of Artificial Sequence: Synthetic peptide
  Seed: KLSSIIPSA (MAGC3_HUMAN)
KMSSIIPSL

SEQ ID NO: 105273 - protein, 9 aa, Artificial Sequence
  Description of Artificial Sequence: Synthetic peptide
  Seed: LKYQAKEPL (MAGC3_HUMAN)
LMYQAKEPL

SEQ ID NO: 105274 - protein, 9 aa, Artificial Sequence
  Description of Artificial Sequence: Synthetic peptide
  Seed: MIFIKGSCV (MAGC3_HUMAN)
MAFIKGSCL

SEQ ID NO: 105275 - protein, 10 aa, Artificial Sequence
  Description of Artificial Sequence: Synthetic peptide
  Seed: TLDEKVDKLV (MAGC3_HUMAN)
TADEKVDKLV

SEQ ID NO: 105276 - protein, 10 aa, Artificial Sequence
  Description of Artificial Sequence: Synthetic peptide
  Seed: TTDDATAMAS (MAGC3_HUMAN)
TSDDATAMAY

SEQ ID NO: 105277 - protein, 10 aa, Artificial Sequence
  Description of Artificial Sequence: Synthetic peptide
  Seed: KDYFPMIFGK (MAGC3_HUMAN)
KGYFPMIFGK

SEQ ID NO: 105278 - protein, 10 aa, Artificial Sequence
  Description of Artificial Sequence: Synthetic peptide
  Seed: VLSAIGPIQR (MAGC3_HUMAN)
VISAIGPIQK

SEQ ID NO: 105279 - protein, 10 aa, Artificial Sequence
  Description of Artificial Sequence: Synthetic peptide
  Seed: KLSSIIPSAF (MAGC3_HUMAN)
KHSSIIPSAY

SEQ ID NO: 105280 - protein, 9 aa, Artificial Sequence
  Description of Artificial Sequence: Synthetic peptide
  Seed: VIWEVLNAI (MAGC3_HUMAN)
VPWEVLNAV

SEQ ID NO: 105281 - protein, 11 aa, Artificial Sequence
  Description of Artificial Sequence: Synthetic peptide
  Seed: LSKLSSIIPSA (MAGC3_HUMAN)
LAKLSSIIPSL

SEQ ID NO: 105282 - protein, 9 aa, Artificial Sequence
  Description of Artificial Sequence: Synthetic peptide
  Seed: MLLPCHWVL (MAGC3_HUMAN)
MVLPCHWVF

SEQ ID NO: 105283 - protein, 9 aa, Artificial Sequence
  Description of Artificial Sequence: Synthetic peptide
  Seed: FEDTLDLTY (MAGC3_HUMAN)
FWDTLDLTM

SEQ ID NO: 105284 - protein, 9 aa, Artificial Sequence
  Description of Artificial Sequence: Synthetic peptide
  Seed: VIWEVLNAI (MAGC3_HUMAN)
VVWEVLNAW

SEQ ID NO: 105285 - protein, 9 aa, Artificial Sequence
  Description of Artificial Sequence: Synthetic peptide
  Seed: AMASASPSV (MAGC3_HUMAN)
AEASASPSF

SEQ ID NO: 105286 - protein, 9 aa, Artificial Sequence
  Description of Artificial Sequence: Synthetic peptide
  Seed: VIWEVLSAI (MAGC3_HUMAN)
VQWEVLSAV

SEQ ID NO: 105287 - protein, 10 aa, Artificial Sequence
  Description of Artificial Sequence: Synthetic peptide
  Seed: FFEDTLDLTY (MAGC3_HUMAN)
FPEDTLDLTY

SEQ ID NO: 105288 - protein, 9 aa, Artificial Sequence
  Description of Artificial Sequence: Synthetic peptide
  Seed: YTGYFPMIF (MAGC3_HUMAN)
YKGYFPMIY

SEQ ID NO: 105289 - protein, 9 aa, Artificial Sequence
  Description of Artificial Sequence: Synthetic peptide
  Seed: SAFHLGHLR (MAGC3_HUMAN)
SWFHLGHLY

SEQ ID NO: 105290 - protein, 8 aa, Artificial Sequence
  Description of Artificial Sequence: Synthetic peptide
  Seed: VLCPTYFK (MAGC3_HUMAN)
VYCPTYFR

SEQ ID NO: 105291 - protein, 10 aa, Artificial Sequence
  Description of Artificial Sequence: Synthetic peptide
  Seed: MQMNVINTYT (MAGC3_HUMAN)
MYMNVINTYA

SEQ ID NO: 105292 - protein, 10 aa, Artificial Sequence
  Description of Artificial Sequence: Synthetic peptide
  Seed: PTYFKLWRTL (MAGC3_HUMAN)
PKYFKLWRTF

SEQ ID NO: 105293 - protein, 9 aa, Artificial Sequence
  Description of Artificial Sequence: Synthetic peptide
  Seed: KLVQFLLLK (MAGC3_HUMAN)
KQVQFLLLY

SEQ ID NO: 105294 - protein, 8 aa, Artificial Sequence
  Description of Artificial Sequence: Synthetic peptide
  Seed: SEEVIWEV (MAGC3_HUMAN)
SEEVIWEA

SEQ ID NO: 105295 - protein, 10 aa, Artificial Sequence
  Description of Artificial Sequence: Synthetic peptide
  Seed: ALWESEGPEA (MAGC3_HUMAN)
AVWESEGPEV

SEQ ID NO: 105296 - protein, 10 aa, Artificial Sequence
  Description of Artificial Sequence: Synthetic peptide
  Seed: YALSPVVLPP (MAGC3_HUMAN)
YVLSPVVLPM

SEQ ID NO: 105297 - protein, 10 aa, Artificial Sequence
  Description of Artificial Sequence: Synthetic peptide
  Seed: YALSPVVLPP (MAGC3_HUMAN)
YPLSPVVLPL

SEQ ID NO: 105298 - protein, 9 aa, Artificial Sequence
  Description of Artificial Sequence: Synthetic peptide
  Seed: VIWEVLNAI (MAGC3_HUMAN)
VAWEVLNAF

SEQ ID NO: 105299 - protein, 10 aa, Artificial Sequence
  Description of Artificial Sequence: Synthetic peptide
  Seed: IELIFGIALT (MAGC3_HUMAN)
IMLIFGIALA

SEQ ID NO: 105300 - protein, 8 aa, Artificial Sequence
  Description of Artificial Sequence: Synthetic peptide
  Seed: DVLSRLAL (MAGC3_HUMAN)
DMLSRLAL

SEQ ID NO: 105301 - protein, 10 aa, Artificial Sequence
  Description of Artificial Sequence: Synthetic peptide
  Seed: EVIWEVLNAI (MAGC3_HUMAN)
EVIWEVLNAF

SEQ ID NO: 105302 - protein, 11 aa, Artificial Sequence
  Description of Artificial Sequence: Synthetic peptide
  Seed: KGNCASEEVIW (MAGC3_HUMAN)
KTNCASEEVIF

SEQ ID NO: 105303 - protein, 10 aa, Artificial Sequence
  Description of Artificial Sequence: Synthetic peptide
  Seed: INTYTGYFPM (MAGC3_HUMAN)
INTYTGYFPW

SEQ ID NO: 105304 - protein, 10 aa, Artificial Sequence
  Description of Artificial Sequence: Synthetic peptide
  Seed: LLILILSVIF (MAGC3_HUMAN)
LQILILSVIF

SEQ ID NO: 105305 - protein, 10 aa, Artificial Sequence
  Description of Artificial Sequence: Synthetic peptide
  Seed: YALSPVVLPP (MAGC3_HUMAN)
YSLSPVVLPI

SEQ ID NO: 105306 - protein, 9 aa, Artificial Sequence
  Description of Artificial Sequence: Synthetic peptide
  Seed: NAIGPWSAL (MAGC3_HUMAN)
NQIGPWSAI

SEQ ID NO: 105307 - protein, 11 aa, Artificial Sequence
  Description of Artificial Sequence: Synthetic peptide
  Seed: ALWESEGPEAF (MAGC3_HUMAN)
ALWESEGPEAM

SEQ ID NO: 105308 - protein, 10 aa, Artificial Sequence
  Description of Artificial Sequence: Synthetic peptide
  Seed: KKYKDYFPMI (MAGC3_HUMAN)
KRYKDYFPMW

SEQ ID NO: 105309 - protein, 9 aa, Artificial Sequence
  Description of Artificial Sequence: Synthetic peptide
  Seed: MQMNVINTY (MAGC3_HUMAN)
MWMNVINTF

SEQ ID NO: 105310 - protein, 8 aa, Artificial Sequence
  Description of Artificial Sequence: Synthetic peptide
  Seed: FADVLSRL (MAGC3_HUMAN)
FQDVLSRM

SEQ ID NO: 105311 - protein, 9 aa, Artificial Sequence
  Description of Artificial Sequence: Synthetic peptide
  Seed: GFADVLSRL (MAGC3_HUMAN)
GYADVLSRW

SEQ ID NO: 105312 - protein, 9 aa, Artificial Sequence
  Description of Artificial Sequence: Synthetic peptide
  Seed: EVLEFLSKL (MAGC3_HUMAN)
ESLEFLSKM

SEQ ID NO: 105313 - protein, 9 aa, Artificial Sequence
  Description of Artificial Sequence: Synthetic peptide
  Seed: TTDDATAMA (MAGC3_HUMAN)
TSDDATAMM

SEQ ID NO: 105314 - protein, 10 aa, Artificial Sequence
  Description of Artificial Sequence: Synthetic peptide
  Seed: FPSWYMDALK (MAGC3_HUMAN)
FASWYMDALF

SEQ ID NO: 105315 - protein, 10 aa, Artificial Sequence
  Description of Artificial Sequence: Synthetic peptide
  Seed: MDPDNHSYFF (MAGC3_HUMAN)
MAPDNHSYFW

SEQ ID NO: 105316 - protein, 10 aa, Artificial Sequence
  Description of Artificial Sequence: Synthetic peptide
  Seed: TGYFPMIFRK (MAGC3_HUMAN)
TAYFPMIFRG

SEQ ID NO: 105317 - protein, 9 aa, Artificial Sequence
  Description of Artificial Sequence: Synthetic peptide
  Seed: KVAELVQFL (MAGC3_HUMAN)
KRAELVQFM

SEQ ID NO: 105318 - protein, 9 aa, Artificial Sequence
  Description of Artificial Sequence: Synthetic peptide
  Seed: REVLEFLSK (MAGC3_HUMAN)
REVLEFLSY

SEQ ID NO: 105319 - protein, 9 aa, Artificial Sequence
  Description of Artificial Sequence: Synthetic peptide
  Seed: KYKDYFPMI (MAGC3_HUMAN)
KQKDYFPMF

SEQ ID NO: 105320 - protein, 9 aa, Artificial Sequence
  Description of Artificial Sequence: Synthetic peptide
  Seed: GSLPESEPL (MAGC3_HUMAN)
GQLPESEPF

SEQ ID NO: 105321 - protein, 9 aa, Artificial Sequence
  Description of Artificial Sequence: Synthetic peptide
  Seed: HFYVFVNTL (MAGC3_HUMAN)
HAYVFVNTY

SEQ ID NO: 105322 - protein, 9 aa, Artificial Sequence
  Description of Artificial Sequence: Synthetic peptide
  Seed: SQPEGKFSL (MAGC3_HUMAN)
SQPEGKFSF

SEQ ID NO: 105323 - protein, 10 aa, Artificial Sequence
  Description of Artificial Sequence: Synthetic peptide
  Seed: SIIPSAFPSW (MAGC3_HUMAN)
SWIPSAFPSF

SEQ ID NO: 105324 - protein, 9 aa, Artificial Sequence
  Description of Artificial Sequence: Synthetic peptide
  Seed: KLVQFLLLK (MAGC3_HUMAN)
KMVQFLLLF

SEQ ID NO: 105325 - protein, 9 aa, Artificial Sequence
  Description of Artificial Sequence: Synthetic peptide
  Seed: KEPVTKAEM (MAGC3_HUMAN)
KRPVTKAEF

SEQ ID NO: 105326 - protein, 10 aa, Artificial Sequence
  Description of Artificial Sequence: Synthetic peptide
  Seed: TDMDPDNHSY (MAGC3_HUMAN)
TFMDPDNHSY

SEQ ID NO: 105327 - protein, 10 aa, Artificial Sequence
  Description of Artificial Sequence: Synthetic peptide
  Seed: YALDEKVAEL (MAGC3_HUMAN)
YELDEKVAEA

SEQ ID NO: 105328 - protein, 9 aa, Artificial Sequence
  Description of Artificial Sequence: Synthetic peptide
  Seed: QGMPKNCLL (MAGC3_HUMAN)
QSMPKNCLL

SEQ ID NO: 105329 - protein, 10 aa, Artificial Sequence
  Description of Artificial Sequence: Synthetic peptide
  Seed: MLTTVIKKYK (MAGC3_HUMAN)
MPTTVIKKYR

SEQ ID NO: 105330 - protein, 10 aa, Artificial Sequence
  Description of Artificial Sequence: Synthetic peptide
  Seed: FYVFVNTLDL (MAGC3_HUMAN)
FYVFVNTLDF

SEQ ID NO: 105331 - protein, 10 aa, Artificial Sequence
  Description of Artificial Sequence: Synthetic peptide
  Seed: SKLSSIIPSA (MAGC3_HUMAN)
SPLSSIIPSL

SEQ ID NO: 105332 - protein, 10 aa, Artificial Sequence
  Description of Artificial Sequence: Synthetic peptide
  Seed: ALDEKVAELV (MAGC3_HUMAN)
AWDEKVAELM

SEQ ID NO: 105333 - protein, 10 aa, Artificial Sequence
  Description of Artificial Sequence: Synthetic peptide
  Seed: KAEMLTTVIK (MAGC3_HUMAN)
KIEMLTTVIR

SEQ ID NO: 105334 - protein, 8 aa, Artificial Sequence
  Description of Artificial Sequence: Synthetic peptide
  Seed: FADVLSRL (MAGC3_HUMAN)
FWDVLSRM

SEQ ID NO: 105335 - protein, 10 aa, Artificial Sequence
  Description of Artificial Sequence: Synthetic peptide
  Seed: FPSWYMDALK (MAGC3_HUMAN)
FSSWYMDALR

SEQ ID NO: 105336 - protein, 9 aa, Artificial Sequence
  Description of Artificial Sequence: Synthetic peptide
  Seed: YSAFHLGHL (MAGC3_HUMAN)
YMAFHLGHP

SEQ ID NO: 105337 - protein, 9 aa, Artificial Sequence
  Description of Artificial Sequence: Synthetic peptide
  Seed: FSLRRAVSV (MAGC3_HUMAN)
FVLRRAVSF

SEQ ID NO: 105338 - protein, 9 aa, Artificial Sequence
  Description of Artificial Sequence: Synthetic peptide
  Seed: VPEEVIWEV (MAGC3_HUMAN)
VAEEVIWEW

SEQ ID NO: 105339 - protein, 9 aa, Artificial Sequence
  Description of Artificial Sequence: Synthetic peptide
  Seed: FHLGHLREV (MAGC3_HUMAN)
FMLGHLREL

SEQ ID NO: 105340 - protein, 9 aa, Artificial Sequence
  Description of Artificial Sequence: Synthetic peptide
  Seed: VDPDHFYVF (MAGC3_HUMAN)
VLPDHFYVI

SEQ ID NO: 105341 - protein, 10 aa, Artificial Sequence
  Description of Artificial Sequence: Synthetic peptide
  Seed: YALDEKVAEL (MAGC3_HUMAN)
YHLDEKVAEC

SEQ ID NO: 105342 - protein, 9 aa, Artificial Sequence
  Description of Artificial Sequence: Synthetic peptide
  Seed: HSYFFEDTL (MAGC3_HUMAN)
HVYFFEDTI

SEQ ID NO: 105343 - protein, 11 aa, Artificial Sequence
  Description of Artificial Sequence: Synthetic peptide
  Seed: RTLSGSPGLQL (MAGC3_HUMAN)
RQLSGSPGLQM

SEQ ID NO: 105344 - protein, 9 aa, Artificial Sequence
  Description of Artificial Sequence: Synthetic peptide
  Seed: SLPESEPLF (MAGC3_HUMAN)
SCPESEPLL

SEQ ID NO: 105345 - protein, 9 aa, Artificial Sequence
  Description of Artificial Sequence: Synthetic peptide
  Seed: VDPDHFYVF (MAGC3_HUMAN)
VYPDHFYVL

SEQ ID NO: 105346 - protein, 9 aa, Artificial Sequence
  Description of Artificial Sequence: Synthetic peptide
  Seed: QAKEPLTRA (MAGC3_HUMAN)
QAKEPLTRL

SEQ ID NO: 105347 - protein, 9 aa, Artificial Sequence
  Description of Artificial Sequence: Synthetic peptide
  Seed: TTDDATAMA (MAGC3_HUMAN)
TIDDATAMI

SEQ ID NO: 105348 - protein, 9 aa, Artificial Sequence
  Description of Artificial Sequence: Synthetic peptide
  Seed: KLSSIIPSA (MAGC3_HUMAN)
KTSSIIPSM

SEQ ID NO: 105349 - protein, 10 aa, Artificial Sequence
  Description of Artificial Sequence: Synthetic peptide
  Seed: KVAELVQFLL (MAGC3_HUMAN)
KNAELVQFLW

SEQ ID NO: 105350 - protein, 9 aa, Artificial Sequence
  Description of Artificial Sequence: Synthetic peptide
  Seed: MEDRAQAII (MAGC3_HUMAN)
MLDRAQAIM

SEQ ID NO: 105351 - protein, 9 aa, Artificial Sequence
  Description of Artificial Sequence: Synthetic peptide
  Seed: REEPQDWPL (MAGC3_HUMAN)
RMEPQDWPW

SEQ ID NO: 105352 - protein, 9 aa, Artificial Sequence
  Description of Artificial Sequence: Synthetic peptide
  Seed: TYALSPVVL (MAGC3_HUMAN)
THALSPVVM

SEQ ID NO: 105353 - protein, 9 aa, Artificial Sequence
  Description of Artificial Sequence: Synthetic peptide
  Seed: FLSKLSSII (MAGC3_HUMAN)
FMSKLSSIL

SEQ ID NO: 105354 - protein, 9 aa, Artificial Sequence
  Description of Artificial Sequence: Synthetic peptide
  Seed: SPSVMSTNF (MAGC3_HUMAN)
SASVMSTNW

SEQ ID NO: 105355 - protein, 11 aa, Artificial Sequence
  Description of Artificial Sequence: Synthetic peptide
  Seed: FIKGSCVPEEV (MAGC3_HUMAN)
FMKGSCVPEEM

SEQ ID NO: 105356 - protein, 10 aa, Artificial Sequence
  Description of Artificial Sequence: Synthetic peptide
  Seed: SAFHLGHLRE (MAGC3_HUMAN)
SQFHLGHLRR

SEQ ID NO: 105357 - protein, 10 aa, Artificial Sequence
  Description of Artificial Sequence: Synthetic peptide
  Seed: ALAGFADVLS (MAGC3_HUMAN)
ALAGFADVLA

SEQ ID NO: 105358 - protein, 9 aa, Artificial Sequence
  Description of Artificial Sequence: Synthetic peptide
  Seed: MDPDNHSYF (MAGC3_HUMAN)
MSPDNHSYY

SEQ ID NO: 105359 - protein, 10 aa, Artificial Sequence
  Description of Artificial Sequence: Synthetic peptide
  Seed: YALSPVVLPP (MAGC3_HUMAN)
YSLSPVVLPV

SEQ ID NO: 105360 - protein, 9 aa, Artificial Sequence
  Description of Artificial Sequence: Synthetic peptide
  Seed: HALPESESL (MAGC3_HUMAN)
HQLPESESV

SEQ ID NO: 105361 - protein, 9 aa, Artificial Sequence
  Description of Artificial Sequence: Synthetic peptide
  Seed: SASPSVMST (MAGC3_HUMAN)
STSPSVMSM

SEQ ID NO: 105362 - protein, 9 aa, Artificial Sequence
  Description of Artificial Sequence: Synthetic peptide
  Seed: LEFLSKLSS (MAGC3_HUMAN)
LEFLSKLSL

SEQ ID NO: 105363 - protein, 9 aa, Artificial Sequence
  Description of Artificial Sequence: Synthetic peptide
  Seed: KYKDYFPMI (MAGC3_HUMAN)
KAKDYFPMR

SEQ ID NO: 105364 - protein, 9 aa, Artificial Sequence
  Description of Artificial Sequence: Synthetic peptide
  Seed: TVIKKYKDY (MAGC3_HUMAN)
TMIKKYKDY

SEQ ID NO: 105365 - protein, 10 aa, Artificial Sequence
  Description of Artificial Sequence: Synthetic peptide
  Seed: MDPDNHSYFF (MAGC3_HUMAN)
MDPDNHSYFL

SEQ ID NO: 105366 - protein, 9 aa, Artificial Sequence
  Description of Artificial Sequence: Synthetic peptide
  Seed: EFLSKLSSI (MAGC3_HUMAN)
EMLSKLSSI

SEQ ID NO: 105367 - protein, 11 aa, Artificial Sequence
  Description of Artificial Sequence: Synthetic peptide
  Seed: FLRGGTSDQRM (MAGC3_HUMAN)
FQRGGTSDQRY

SEQ ID NO: 105368 - protein, 9 aa, Artificial Sequence
  Description of Artificial Sequence: Synthetic peptide
  Seed: VIWEVLNAI (MAGC3_HUMAN)
VMWEVLNAM

SEQ ID NO: 105369 - protein, 9 aa, Artificial Sequence
  Description of Artificial Sequence: Synthetic peptide
  Seed: LIDDQGMPK (MAGC3_HUMAN)
LMDDQGMPI

SEQ ID NO: 105370 - protein, 9 aa, Artificial Sequence
  Description of Artificial Sequence: Synthetic peptide
  Seed: RPAREVLEF (MAGC3_HUMAN)
RRAREVLEI

SEQ ID NO: 105371 - protein, 9 aa, Artificial Sequence
  Description of Artificial Sequence: Synthetic peptide
  Seed: DYFPMIFGK (MAGC3_HUMAN)
DHFPMIFGR

SEQ ID NO: 105372 - protein, 11 aa, Artificial Sequence
  Description of Artificial Sequence: Synthetic peptide
  Seed: SVLDLANPQGL (MAGC3_HUMAN)
SALDLANPQGY

SEQ ID NO: 105373 - protein, 9 aa, Artificial Sequence
  Description of Artificial Sequence: Synthetic peptide
  Seed: TYALSPVVL (MAGC3_HUMAN)
TAALSPVVY

SEQ ID NO: 105374 - protein, 8 aa, Artificial Sequence
  Description of Artificial Sequence: Synthetic peptide
  Seed: AEMLTTVI (MAGC3_HUMAN)
AEMLTTVA

SEQ ID NO: 105375 - protein, 10 aa, Artificial Sequence
  Description of Artificial Sequence: Synthetic peptide
  Seed: RLLILILSVI (MAGC3_HUMAN)
RQLILILSVV

SEQ ID NO: 105376 - protein, 10 aa, Artificial Sequence
  Description of Artificial Sequence: Synthetic peptide
  Seed: AMASASPSVM (MAGC3_HUMAN)
ARASASPSVF

SEQ ID NO: 105377 - protein, 10 aa, Artificial Sequence
  Description of Artificial Sequence: Synthetic peptide
  Seed: KVAELVQFLL (MAGC3_HUMAN)
KLAELVQFLM

SEQ ID NO: 105378 - protein, 9 aa, Artificial Sequence
  Description of Artificial Sequence: Synthetic peptide
  Seed: VINTYTGYF (MAGC3_HUMAN)
VSNTYTGYL

SEQ ID NO: 105379 - protein, 9 aa, Artificial Sequence
  Description of Artificial Sequence: Synthetic peptide
  Seed: MIFRKAREF (MAGC3_HUMAN)
MFFRKAREY

SEQ ID NO: 105380 - protein, 11 aa, Artificial Sequence
  Description of Artificial Sequence: Synthetic peptide
  Seed: YFFEDTLDLTY (MAGC3_HUMAN)
YYFEDTLDLTY

SEQ ID NO: 105381 - protein, 9 aa, Artificial Sequence
  Description of Artificial Sequence: Synthetic peptide
  Seed: FPSWYMDAL (MAGC3_HUMAN)
FHSWYMDAI

SEQ ID NO: 105382 - protein, 11 aa, Artificial Sequence
  Description of Artificial Sequence: Synthetic peptide
  Seed: FIELIFGIALT (MAGC3_HUMAN)
FMELIFGIALV

SEQ ID NO: 105383 - protein, 9 aa, Artificial Sequence
  Description of Artificial Sequence: Synthetic peptide
  Seed: FLSKLSSII (MAGC3_HUMAN)
FESKLSSIM

SEQ ID NO: 105384 - protein, 9 aa, Artificial Sequence
  Description of Artificial Sequence: Synthetic peptide
  Seed: WVKNTCATY (MAGC3_HUMAN)
WFKNTCATM

SEQ ID NO: 105385 - protein, 11 aa, Artificial Sequence
  Description of Artificial Sequence: Synthetic peptide
  Seed: FGSQPEGKFSL (MAGC3_HUMAN)
FASQPEGKFSY

SEQ ID NO: 105386 - protein, 9 aa, Artificial Sequence
  Description of Artificial Sequence: Synthetic peptide
  Seed: QTKEPVTKA (MAGC3_HUMAN)
QMKEPVTKF

SEQ ID NO: 105387 - protein, 9 aa, Artificial Sequence
  Description of Artificial Sequence: Synthetic peptide
  Seed: VLCPTYFKL (MAGC3_HUMAN)
VQCPTYFKR

SEQ ID NO: 105388 - protein, 10 aa, Artificial Sequence
  Description of Artificial Sequence: Synthetic peptide
  Seed: SPLDSCSSPL (MAGC3_HUMAN)
SVLDSCSSPV

SEQ ID NO: 105389 - protein, 9 aa, Artificial Sequence
  Description of Artificial Sequence: Synthetic peptide
  Seed: FSDGSLGQW (MAGC3_HUMAN)
FDDGSLGQM

SEQ ID NO: 105390 - protein, 9 aa, Artificial Sequence
  Description of Artificial Sequence: Synthetic peptide
  Seed: ALDEKVAEL (MAGC3_HUMAN)
AYDEKVAET

SEQ ID NO: 105391 - protein, 9 aa, Artificial Sequence
  Description of Artificial Sequence: Synthetic peptide
  Seed: FSDGSLGQW (MAGC3_HUMAN)
FADGSLGQM

SEQ ID NO: 105392 - protein, 10 aa, Artificial Sequence
  Description of Artificial Sequence: Synthetic peptide
  Seed: NAIGPWSALA (MAGC3_HUMAN)
NTIGPWSALV

SEQ ID NO: 105393 - protein, 10 aa, Artificial Sequence
  Description of Artificial Sequence: Synthetic peptide
  Seed: ALWESEGPEA (MAGC3_HUMAN)
AMWESEGPEM

SEQ ID NO: 105394 - protein, 9 aa, Artificial Sequence
  Description of Artificial Sequence: Synthetic peptide
  Seed: HLREVRLFL (MAGC3_HUMAN)
HYREVRLFS

SEQ ID NO: 105395 - protein, 9 aa, Artificial Sequence
  Description of Artificial Sequence: Synthetic peptide
  Seed: SLGQWVKNT (MAGC3_HUMAN)
SMGQWVKNI

SEQ ID NO: 105396 - protein, 9 aa, Artificial Sequence
  Description of Artificial Sequence: Synthetic peptide
  Seed: HLREVRLFL (MAGC3_HUMAN)
HPREVRLFT

SEQ ID NO: 105397 - protein, 9 aa, Artificial Sequence
  Description of Artificial Sequence: Synthetic peptide
  Seed: FPSWYMDAL (MAGC3_HUMAN)
FLSWYMDAY

SEQ ID NO: 105398 - protein, 9 aa, Artificial Sequence
  Description of Artificial Sequence: Synthetic peptide
  Seed: RTLSGSPGL (MAGC3_HUMAN)
RILSGSPGY

SEQ ID NO: 105399 - protein, 9 aa, Artificial Sequence
  Description of Artificial Sequence: Synthetic peptide
  Seed: LLILILSMI (MAGC3_HUMAN)
LVILILSMV

SEQ ID NO: 105400 - protein, 9 aa, Artificial Sequence
  Description of Artificial Sequence: Synthetic peptide
  Seed: KLWRTLSGS (MAGC3_HUMAN)
KQWRTLSGI

SEQ ID NO: 105401 - protein, 9 aa, Artificial Sequence
  Description of Artificial Sequence: Synthetic peptide
  Seed: NAIGPWSAL (MAGC3_HUMAN)
NMIGPWSAI

SEQ ID NO: 105402 - protein, 10 aa, Artificial Sequence
  Description of Artificial Sequence: Synthetic peptide
  Seed: YTGYFPMIFR (MAGC3_HUMAN)
YVGYFPMIFK

SEQ ID NO: 105403 - protein, 9 aa, Artificial Sequence
  Description of Artificial Sequence: Synthetic peptide
  Seed: SEEEDTATW (MAGC3_HUMAN)
SQEEDTATM

SEQ ID NO: 105404 - protein, 9 aa, Artificial Sequence
  Description of Artificial Sequence: Synthetic peptide
  Seed: KYKDYFPMI (MAGC3_HUMAN)
KRKDYFPML

SEQ ID NO: 105405 - protein, 10 aa, Artificial Sequence
  Description of Artificial Sequence: Synthetic peptide
  Seed: ALAGFADVLS (MAGC3_HUMAN)
ALAGFADVLI

SEQ ID NO: 105406 - protein, 10 aa, Artificial Sequence
  Description of Artificial Sequence: Synthetic peptide
  Seed: RPAREVLEFL (MAGC3_HUMAN)
RTAREVLEFA

SEQ ID NO: 105407 - protein, 9 aa, Artificial Sequence
  Description of Artificial Sequence: Synthetic peptide
  Seed: NTYTGYFPM (MAGC3_HUMAN)
NAYTGYFPW

SEQ ID NO: 105408 - protein, 9 aa, Artificial Sequence
  Description of Artificial Sequence: Synthetic peptide
  Seed: WVKNTCATY (MAGC3_HUMAN)
WTKNTCATW

SEQ ID NO: 105409 - protein, 9 aa, Artificial Sequence
  Description of Artificial Sequence: Synthetic peptide
  Seed: DTTDDATAM (MAGC3_HUMAN)
DSTDDATAR

SEQ ID NO: 105410 - protein, 9 aa, Artificial Sequence
  Description of Artificial Sequence: Synthetic peptide
  Seed: VINTYTGYF (MAGC3_HUMAN)
VVNTYTGYY

SEQ ID NO: 105411 - protein, 10 aa, Artificial Sequence
  Description of Artificial Sequence: Synthetic peptide
  Seed: MQMNVINTYT (MAGC3_HUMAN)
MGMNVINTYV

SEQ ID NO: 105412 - protein, 9 aa, Artificial Sequence
  Description of Artificial Sequence: Synthetic peptide
  Seed: MASASPSVM (MAGC3_HUMAN)
MPSASPSVC

SEQ ID NO: 105413 - protein, 9 aa, Artificial Sequence
  Description of Artificial Sequence: Synthetic peptide
  Seed: GYFPMIFRK (MAGC3_HUMAN)
GQFPMIFRY

SEQ ID NO: 105414 - protein, 10 aa, Artificial Sequence
  Description of Artificial Sequence: Synthetic peptide
  Seed: SKLSSIIPSA (MAGC3_HUMAN)
SPLSSIIPSA

SEQ ID NO: 105415 - protein, 10 aa, Artificial Sequence
  Description of Artificial Sequence: Synthetic peptide
  Seed: MPAAGMPPLP (MAGC3_HUMAN)
MAAAGMPPLF

SEQ ID NO: 105416 - protein, 9 aa, Artificial Sequence
  Description of Artificial Sequence: Synthetic peptide
  Seed: FSDGSLGQW (MAGC3_HUMAN)
FWDGSLGQF

SEQ ID NO: 105417 - protein, 9 aa, Artificial Sequence
  Description of Artificial Sequence: Synthetic peptide
  Seed: IIPSAFPSW (MAGC3_HUMAN)
IPPSAFPSY

SEQ ID NO: 105418 - protein, 9 aa, Artificial Sequence
  Description of Artificial Sequence: Synthetic peptide
  Seed: LIDDQGMPK (MAGC3_HUMAN)
LMDDQGMPV

SEQ ID NO: 105419 - protein, 9 aa, Artificial Sequence
  Description of Artificial Sequence: Synthetic peptide
  Seed: KAHEFIELI (MAGC3_HUMAN)
KKHEFIELF

SEQ ID NO: 105420 - protein, 9 aa, Artificial Sequence
  Description of Artificial Sequence: Synthetic peptide
  Seed: NAIGPWSAL (MAGC3_HUMAN)
NSIGPWSAR

SEQ ID NO: 105421 - protein, 10 aa, Artificial Sequence
  Description of Artificial Sequence: Synthetic peptide
  Seed: MNVINTYTGY (MAGC3_HUMAN)
MSVINTYTGY

SEQ ID NO: 105422 - protein, 10 aa, Artificial Sequence
  Description of Artificial Sequence: Synthetic peptide
  Seed: LNAIGPWSAL (MAGC3_HUMAN)
LGAIGPWSAL

SEQ ID NO: 105423 - protein, 9 aa, Artificial Sequence
  Description of Artificial Sequence: Synthetic peptide
  Seed: LTEVDPDHF (MAGC3_HUMAN)
LAEVDPDHM

SEQ ID NO: 105424 - protein, 9 aa, Artificial Sequence
  Description of Artificial Sequence: Synthetic peptide
  Seed: EFIELIFGI (MAGC3_HUMAN)
EIIELIFGM

SEQ ID NO: 105425 - protein, 11 aa, Artificial Sequence
  Description of Artificial Sequence: Synthetic peptide
  Seed: SSSEEEDTATW (MAGC3_HUMAN)
SPSEEEDTATW

SEQ ID NO: 105426 - protein, 9 aa, Artificial Sequence
  Description of Artificial Sequence: Synthetic peptide
  Seed: IPPQGPPKI (MAGC3_HUMAN)
IWPQGPPKM

SEQ ID NO: 105427 - protein, 9 aa, Artificial Sequence
  Description of Artificial Sequence: Synthetic peptide
  Seed: EVLSAIGPI (MAGC3_HUMAN)
EALSAIGPY

SEQ ID NO: 105428 - protein, 10 aa, Artificial Sequence
  Description of Artificial Sequence: Synthetic peptide
  Seed: KVAELVQFLL (MAGC3_HUMAN)
KTAELVQFLW

SEQ ID NO: 105429 - protein, 9 aa, Artificial Sequence
  Description of Artificial Sequence: Synthetic peptide
  Seed: MLLPCHWVL (MAGC3_HUMAN)
MMLPCHWVT

SEQ ID NO: 105430 - protein, 11 aa, Artificial Sequence
  Description of Artificial Sequence: Synthetic peptide
  Seed: TDMDPDNHSYF (MAGC3_HUMAN)
TMMDPDNHSYY

SEQ ID NO: 105431 - protein, 9 aa, Artificial Sequence
  Description of Artificial Sequence: Synthetic peptide
  Seed: MLLPCHWVL (MAGC3_HUMAN)
MILPCHWVR

SEQ ID NO: 105432 - protein, 11 aa, Artificial Sequence
  Description of Artificial Sequence: Synthetic peptide
  Seed: VINTYTGYFPM (MAGC3_HUMAN)
VSNTYTGYFPW

SEQ ID NO: 105433 - protein, 8 aa, Artificial Sequence
  Description of Artificial Sequence: Synthetic peptide
  Seed: SLRRAVSV (MAGC3_HUMAN)
SMRRAVSM

SEQ ID NO: 105434 - protein, 11 aa, Artificial Sequence
  Description of Artificial Sequence: Synthetic peptide
  Seed: KFSLRRAVSVK (MAGC3_HUMAN)
KQSLRRAVSVK

SEQ ID NO: 105435 - protein, 9 aa, Artificial Sequence
  Description of Artificial Sequence: Synthetic peptide
  Seed: LPQSPPEIP (MAGC3_HUMAN)
LPQSPPEIY

SEQ ID NO: 105436 - protein, 9 aa, Artificial Sequence
  Description of Artificial Sequence: Synthetic peptide
  Seed: YALSPVVLP (MAGC3_HUMAN)
YALSPVVLF

SEQ ID NO: 105437 - protein, 10 aa, Artificial Sequence
  Description of Artificial Sequence: Synthetic peptide
  Seed: FKLWRTLSGS (MAGC3_HUMAN)
FCLWRTLSGV

SEQ ID NO: 105438 - protein, 9 aa, Artificial Sequence
  Description of Artificial Sequence: Synthetic peptide
  Seed: QGMPQNRLL (MAGC3_HUMAN)
QTMPQNRLF

SEQ ID NO: 105439 - protein, 10 aa, Artificial Sequence
  Description of Artificial Sequence: Synthetic peptide
  Seed: LDSCSSPLLW (MAGC3_HUMAN)
LTSCSSPLLW

SEQ ID NO: 105440 - protein, 11 aa, Artificial Sequence
  Description of Artificial Sequence: Synthetic peptide
  Seed: FIELIFGIALT (MAGC3_HUMAN)
FDELIFGIALV

SEQ ID NO: 105441 - protein, 9 aa, Artificial Sequence
  Description of Artificial Sequence: Synthetic peptide
  Seed: LVLCPTYFK (MAGC3_HUMAN)
LQLCPTYFK

SEQ ID NO: 105442 - protein, 9 aa, Artificial Sequence
  Description of Artificial Sequence: Synthetic peptide
  Seed: TYTGYFPMI (MAGC3_HUMAN)
TWTGYFPML

SEQ ID NO: 105443 - protein, 9 aa, Artificial Sequence
  Description of Artificial Sequence: Synthetic peptide
  Seed: KNCLLILIL (MAGC3_HUMAN)
KVCLLILIW

SEQ ID NO: 105444 - protein, 9 aa, Artificial Sequence
  Description of Artificial Sequence: Synthetic peptide
  Seed: MQMNVINTY (MAGC3_HUMAN)
MPMNVINTG

SEQ ID NO: 105445 - protein, 11 aa, Artificial Sequence
  Description of Artificial Sequence: Synthetic peptide
  Seed: ILFGISLTEVD (MAGC3_HUMAN)
ILFGISLTEVA

SEQ ID NO: 105446 - protein, 9 aa, Artificial Sequence
  Description of Artificial Sequence: Synthetic peptide
  Seed: EVLSAIGPI (MAGC3_HUMAN)
EALSAIGPI

SEQ ID NO: 105447 - protein, 11 aa, Artificial Sequence
  Description of Artificial Sequence: Synthetic peptide
  Seed: GEDEDMPAAGM (MAGC3_HUMAN)
GEDEDMPAAGL

SEQ ID NO: 105448 - protein, 9 aa, Artificial Sequence
  Description of Artificial Sequence: Synthetic peptide
  Seed: RGTGYTLSL (MAGC3_HUMAN)
RRTGYTLSV

SEQ ID NO: 105449 - protein, 9 aa, Artificial Sequence
  Description of Artificial Sequence: Synthetic peptide
  Seed: PQSPPQSPL (MAGC3_HUMAN)
PMSPPQSPY

SEQ ID NO: 105450 - protein, 9 aa, Artificial Sequence
  Description of Artificial Sequence: Synthetic peptide
  Seed: YALDEKVAE (MAGC3_HUMAN)
YGLDEKVAY

SEQ ID NO: 105451 - protein, 9 aa, Artificial Sequence
  Description of Artificial Sequence: Synthetic peptide
  Seed: AIGPWSALA (MAGC3_HUMAN)
AQGPWSALL

SEQ ID NO: 105452 - protein, 10 aa, Artificial Sequence
  Description of Artificial Sequence: Synthetic peptide
  Seed: FPSWYMDALK (MAGC3_HUMAN)
FLSWYMDALR

SEQ ID NO: 105453 - protein, 10 aa, Artificial Sequence
  Description of Artificial Sequence: Synthetic peptide
  Seed: MIFRKAREFI (MAGC3_HUMAN)
MLFRKAREFA

SEQ ID NO: 105454 - protein, 9 aa, Artificial Sequence
  Description of Artificial Sequence: Synthetic peptide
  Seed: LKYQTKEPV (MAGC3_HUMAN)
LKYQTKEPM

SEQ ID NO: 105455 - protein, 10 aa, Artificial Sequence
  Description of Artificial Sequence: Synthetic peptide
  Seed: MLTTVIKKYK (MAGC3_HUMAN)
MSTTVIKKYR

SEQ ID NO: 105456 - protein, 9 aa, Artificial Sequence
  Description of Artificial Sequence: Synthetic peptide
  Seed: MPAAGMPPL (MAGC3_HUMAN)
MQAAGMPPI

SEQ ID NO: 105457 - protein, 9 aa, Artificial Sequence
  Description of Artificial Sequence: Synthetic peptide
  Seed: SLVLCPTYF (MAGC3_HUMAN)
SYVLCPTYY

SEQ ID NO: 105458 - protein, 10 aa, Artificial Sequence
  Description of Artificial Sequence: Synthetic peptide
  Seed: TGYFPMIFRK (MAGC3_HUMAN)
TTYFPMIFRA

SEQ ID NO: 105459 - protein, 9 aa, Artificial Sequence
  Description of Artificial Sequence: Synthetic peptide
  Seed: SAFHLGHLR (MAGC3_HUMAN)
SVFHLGHLY

SEQ ID NO: 105460 - protein, 9 aa, Artificial Sequence
  Description of Artificial Sequence: Synthetic peptide
  Seed: ALDEKVAEL (MAGC3_HUMAN)
AYDEKVAEW

SEQ ID NO: 105461 - protein, 11 aa, Artificial Sequence
  Description of Artificial Sequence: Synthetic peptide
  Seed: SSSEEEDTATW (MAGC3_HUMAN)
SMSEEEDTATL

SEQ ID NO: 105462 - protein, 9 aa, Artificial Sequence
  Description of Artificial Sequence: Synthetic peptide
  Seed: NTYTGYFPM (MAGC3_HUMAN)
NMYTGYFPL

SEQ ID NO: 105463 - protein, 9 aa, Artificial Sequence
  Description of Artificial Sequence: Synthetic peptide
  Seed: ALSPVVLPP (MAGC3_HUMAN)
ALSPVVLPV

SEQ ID NO: 105464 - protein, 9 aa, Artificial Sequence
  Description of Artificial Sequence: Synthetic peptide
  Seed: QPEGKFSLR (MAGC3_HUMAN)
QMEGKFSLR

SEQ ID NO: 105465 - protein, 9 aa, Artificial Sequence
  Description of Artificial Sequence: Synthetic peptide
  Seed: YQTKEPVTK (MAGC3_HUMAN)
YATKEPVTV

SEQ ID NO: 105466 - protein, 9 aa, Artificial Sequence
  Description of Artificial Sequence: Synthetic peptide
  Seed: SLRRAVSVK (MAGC3_HUMAN)
SYRRAVSVV

SEQ ID NO: 105467 - protein, 10 aa, Artificial Sequence
  Description of Artificial Sequence: Synthetic peptide
  Seed: MLLPCHWVLD (MAGC3_HUMAN)
MMLPCHWVLL

SEQ ID NO: 105468 - protein, 10 aa, Artificial Sequence
  Description of Artificial Sequence: Synthetic peptide
  Seed: MPAAGMPPLP (MAGC3_HUMAN)
MPAAGMPPLM

SEQ ID NO: 105469 - protein, 10 aa, Artificial Sequence
  Description of Artificial Sequence: Synthetic peptide
  Seed: SALAGFADVL (MAGC3_HUMAN)
SYLAGFADVV

SEQ ID NO: 105470 - protein, 9 aa, Artificial Sequence
  Description of Artificial Sequence: Synthetic peptide
  Seed: KVAELVQFL (MAGC3_HUMAN)
KNAELVQFL

SEQ ID NO: 105471 - protein, 9 aa, Artificial Sequence
  Description of Artificial Sequence: Synthetic peptide
  Seed: ALSPVVLPP (MAGC3_HUMAN)
ATSPVVLPL

SEQ ID NO: 105472 - protein, 9 aa, Artificial Sequence
  Description of Artificial Sequence: Synthetic peptide
  Seed: LGHLREVRL (MAGC3_HUMAN)
LMHLREVRL

SEQ ID NO: 105473 - protein, 9 aa, Artificial Sequence
  Description of Artificial Sequence: Synthetic peptide
  Seed: MIFRKAREF (MAGC3_HUMAN)
MQFRKAREA

SEQ ID NO: 105474 - protein, 11 aa, Artificial Sequence
  Description of Artificial Sequence: Synthetic peptide
  Seed: GSQPEGKFSLR (MAGC3_HUMAN)
GTQPEGKFSLK

SEQ ID NO: 105475 - protein, 9 aa, Artificial Sequence
  Description of Artificial Sequence: Synthetic peptide
  Seed: DTTDDATAM (MAGC3_HUMAN)
DTTDDATAR

SEQ ID NO: 105476 - protein, 10 aa, Artificial Sequence
  Description of Artificial Sequence: Synthetic peptide
  Seed: WVKNTCATYA (MAGC3_HUMAN)
WQKNTCATYF

SEQ ID NO: 105477 - protein, 11 aa, Artificial Sequence
  Description of Artificial Sequence: Synthetic peptide
  Seed: SKLSSIIPSAF (MAGC3_HUMAN)
SSLSSIIPSAF

SEQ ID NO: 105478 - protein, 9 aa, Artificial Sequence
  Description of Artificial Sequence: Synthetic peptide
  Seed: SQPEGKFSL (MAGC3_HUMAN)
SVPEGKFSV

SEQ ID NO: 105479 - protein, 10 aa, Artificial Sequence
  Description of Artificial Sequence: Synthetic peptide
  Seed: KLSSIIPSAF (MAGC3_HUMAN)
KVSSIIPSAK

SEQ ID NO: 105480 - protein, 9 aa, Artificial Sequence
  Description of Artificial Sequence: Synthetic peptide
  Seed: FPSWYMDAL (MAGC3_HUMAN)
FPSWYMDAI

SEQ ID NO: 105481 - protein, 10 aa, Artificial Sequence
  Description of Artificial Sequence: Synthetic peptide
  Seed: TAMASASPSV (MAGC3_HUMAN)
TKMASASPSI

SEQ ID NO: 105482 - protein, 9 aa, Artificial Sequence
  Description of Artificial Sequence: Synthetic peptide
  Seed: VIWEVLNAI (MAGC3_HUMAN)
VLWEVLNAW

SEQ ID NO: 105483 - protein, 8 aa, Artificial Sequence
  Description of Artificial Sequence: Synthetic peptide
  Seed: SCSSPLLW (MAGC3_HUMAN)
SFSSPLLW

SEQ ID NO: 105484 - protein, 9 aa, Artificial Sequence
  Description of Artificial Sequence: Synthetic peptide
  Seed: FLSKLSSII (MAGC3_HUMAN)
FTSKLSSIL

SEQ ID NO: 105485 - protein, 9 aa, Artificial Sequence
  Description of Artificial Sequence: Synthetic peptide
  Seed: KVAELVQFL (MAGC3_HUMAN)
KIAELVQFW

SEQ ID NO: 105486 - protein, 10 aa, Artificial Sequence
  Description of Artificial Sequence: Synthetic peptide
  Seed: FYVFVNTLDL (MAGC3_HUMAN)
FYVFVNTLDW

SEQ ID NO: 105487 - protein, 11 aa, Artificial Sequence
  Description of Artificial Sequence: Synthetic peptide
  Seed: ILFGISLTEVD (MAGC3_HUMAN)
IMFGISLTEVI

SEQ ID NO: 105488 - protein, 11 aa, Artificial Sequence
  Description of Artificial Sequence: Synthetic peptide
  Seed: ATFSDGSLGQW (MAGC3_HUMAN)
AVFSDGSLGQW

SEQ ID NO: 105489 - protein, 9 aa, Artificial Sequence
  Description of Artificial Sequence: Synthetic peptide
  Seed: KFSLRRAVS (MAGC3_HUMAN)
KASLRRAVK

SEQ ID NO: 105490 - protein, 9 aa, Artificial Sequence
  Description of Artificial Sequence: Synthetic peptide
  Seed: SASPSVMST (MAGC3_HUMAN)
SASPSVMSA

SEQ ID NO: 105491 - protein, 10 aa, Artificial Sequence
  Description of Artificial Sequence: Synthetic peptide
  Seed: TCATYALSPV (MAGC3_HUMAN)
TVATYALSPV

SEQ ID NO: 105492 - protein, 11 aa, Artificial Sequence
  Description of Artificial Sequence: Synthetic peptide
  Seed: EILFGISLTEV (MAGC3_HUMAN)
EHLFGISLTEV

SEQ ID NO: 105493 - protein, 9 aa, Artificial Sequence
  Description of Artificial Sequence: Synthetic peptide
  Seed: NPQGLAGHR (MAGC3_HUMAN)
NVQGLAGHK

SEQ ID NO: 105494 - protein, 9 aa, Artificial Sequence
  Description of Artificial Sequence: Synthetic peptide
  Seed: FPSWYMDAL (MAGC3_HUMAN)
FPSWYMDAE

SEQ ID NO: 105495 - protein, 9 aa, Artificial Sequence
  Description of Artificial Sequence: Synthetic peptide
  Seed: HALPESESL (MAGC3_HUMAN)
HILPESESI

SEQ ID NO: 105496 - protein, 10 aa, Artificial Sequence
  Description of Artificial Sequence: Synthetic peptide
  Seed: SEEEDTATWH (MAGC3_HUMAN)
SEEEDTATWW

SEQ ID NO: 105497 - protein, 9 aa, Artificial Sequence
  Description of Artificial Sequence: Synthetic peptide
  Seed: LSSIIPSAF (MAGC3_HUMAN)
LTSIIPSAW

SEQ ID NO: 105498 - protein, 9 aa, Artificial Sequence
  Description of Artificial Sequence: Synthetic peptide
  Seed: YALSPVVLP (MAGC3_HUMAN)
YALSPVVLM

SEQ ID NO: 105499 - protein, 9 aa, Artificial Sequence
  Description of Artificial Sequence: Synthetic peptide
  Seed: LDEKVAELV (MAGC3_HUMAN)
LEEKVAELM

SEQ ID NO: 105500 - protein, 9 aa, Artificial Sequence
  Description of Artificial Sequence: Synthetic peptide
  Seed: DGSLGQWVK (MAGC3_HUMAN)
DASLGQWVR

SEQ ID NO: 105501 - protein, 10 aa, Artificial Sequence
  Description of Artificial Sequence: Synthetic peptide
  Seed: EVIWEVLNAI (MAGC3_HUMAN)
EVIWEVLNAY

SEQ ID NO: 105502 - protein, 9 aa, Artificial Sequence
  Description of Artificial Sequence: Synthetic peptide
  Seed: DVLSRLALW (MAGC3_HUMAN)
DTLSRLALW

SEQ ID NO: 105503 - protein, 9 aa, Artificial Sequence
  Description of Artificial Sequence: Synthetic peptide
  Seed: TSDQRMDSL (MAGC3_HUMAN)
TMDQRMDSY

SEQ ID NO: 105504 - protein, 9 aa, Artificial Sequence
  Description of Artificial Sequence: Synthetic peptide
  Seed: LTEVDPDHF (MAGC3_HUMAN)
LVEVDPDHM

SEQ ID NO: 105505 - protein, 11 aa, Artificial Sequence
  Description of Artificial Sequence: Synthetic peptide
  Seed: TSDQRMDSLVL (MAGC3_HUMAN)
TYDQRMDSLVF

SEQ ID NO: 105506 - protein, 9 aa, Artificial Sequence
  Description of Artificial Sequence: Synthetic peptide
  Seed: VIWEVLSAI (MAGC3_HUMAN)
VMWEVLSAF

SEQ ID NO: 105507 - protein, 9 aa, Artificial Sequence
  Description of Artificial Sequence: Synthetic peptide
  Seed: DQRMDSLVL (MAGC3_HUMAN)
DMRMDSLVY

SEQ ID NO: 105508 - protein, 9 aa, Artificial Sequence
  Description of Artificial Sequence: Synthetic peptide
  Seed: ELIFGIALT (MAGC3_HUMAN)
ESIFGIALM

SEQ ID NO: 105509 - protein, 9 aa, Artificial Sequence
  Description of Artificial Sequence: Synthetic peptide
  Seed: HFYVFVNTL (MAGC3_HUMAN)
HLYVFVNTI

SEQ ID NO: 105510 - protein, 10 aa, Artificial Sequence
  Description of Artificial Sequence: Synthetic peptide
  Seed: TAMASASPSV (MAGC3_HUMAN)
TTMASASPSV

SEQ ID NO: 105511 - protein, 10 aa, Artificial Sequence
  Description of Artificial Sequence: Synthetic peptide
  Seed: RSAEGSVLDL (MAGC3_HUMAN)
RAAEGSVLDW

SEQ ID NO: 105512 - protein, 9 aa, Artificial Sequence
  Description of Artificial Sequence: Synthetic peptide
  Seed: MPAAGMPPL (MAGC3_HUMAN)
MFAAGMPPI

SEQ ID NO: 105513 - protein, 11 aa, Artificial Sequence
  Description of Artificial Sequence: Synthetic peptide
  Seed: IIDTTDDATAM (MAGC3_HUMAN)
IYDTTDDATAF

SEQ ID NO: 105514 - protein, 10 aa, Artificial Sequence
  Description of Artificial Sequence: Synthetic peptide
  Seed: YALSPVVLPP (MAGC3_HUMAN)
YWLSPVVLPL

SEQ ID NO: 105515 - protein, 9 aa, Artificial Sequence
  Description of Artificial Sequence: Synthetic peptide
  Seed: KNCLLILIL (MAGC3_HUMAN)
KSCLLILIW

SEQ ID NO: 105516 - protein, 10 aa, Artificial Sequence
  Description of Artificial Sequence: Synthetic peptide
  Seed: YTLDEKVDKL (MAGC3_HUMAN)
YWLDEKVDKV

SEQ ID NO: 105517 - protein, 10 aa, Artificial Sequence
  Description of Artificial Sequence: Synthetic peptide
  Seed: VLCPTYFKLW (MAGC3_HUMAN)
VYCPTYFKLI

SEQ ID NO: 105518 - protein, 9 aa, Artificial Sequence
  Description of Artificial Sequence: Synthetic peptide
  Seed: LSSIIPSAF (MAGC3_HUMAN)
LQSIIPSAY

SEQ ID NO: 105519 - protein, 9 aa, Artificial Sequence
  Description of Artificial Sequence: Synthetic peptide
  Seed: KLVQFLLLK (MAGC3_HUMAN)
KFVQFLLLK

SEQ ID NO: 105520 - protein, 9 aa, Artificial Sequence
  Description of Artificial Sequence: Synthetic peptide
  Seed: AMASASPSV (MAGC3_HUMAN)
AMASASPSM

SEQ ID NO: 105521 - protein, 9 aa, Artificial Sequence
  Description of Artificial Sequence: Synthetic peptide
  Seed: ALDEKVAEL (MAGC3_HUMAN)
AYDEKVAEY

SEQ ID NO: 105522 - protein, 11 aa, Artificial Sequence
  Description of Artificial Sequence: Synthetic peptide
  Seed: ALWESEGPEAF (MAGC3_HUMAN)
ATWESEGPEAF

SEQ ID NO: 105523 - protein, 9 aa, Artificial Sequence
  Description of Artificial Sequence: Synthetic peptide
  Seed: MDPDNHSYF (MAGC3_HUMAN)
MPPDNHSYY

SEQ ID NO: 105524 - protein, 10 aa, Artificial Sequence
  Description of Artificial Sequence: Synthetic peptide
  Seed: LNAIGPWSAL (MAGC3_HUMAN)
LKAIGPWSAL

SEQ ID NO: 105525 - protein, 8 aa, Artificial Sequence
  Description of Artificial Sequence: Synthetic peptide
  Seed: YALSPVVL (MAGC3_HUMAN)
YSLSPVVM

SEQ ID NO: 105526 - protein, 10 aa, Artificial Sequence
  Description of Artificial Sequence: Synthetic peptide
  Seed: FFEDTLDLTY (MAGC3_HUMAN)
FYEDTLDLTF

SEQ ID NO: 105527 - protein, 9 aa, Artificial Sequence
  Description of Artificial Sequence: Synthetic peptide
  Seed: DQRMDSLVL (MAGC3_HUMAN)
DQRMDSLVY

SEQ ID NO: 105528 - protein, 10 aa, Artificial Sequence
  Description of Artificial Sequence: Synthetic peptide
  Seed: KAHEFIELIF (MAGC3_HUMAN)
KKHEFIELIF

SEQ ID NO: 105529 - protein, 10 aa, Artificial Sequence
  Description of Artificial Sequence: Synthetic peptide
  Seed: KLSSIIPSAF (MAGC3_HUMAN)
KKSSIIPSAW

SEQ ID NO: 105530 - protein, 11 aa, Artificial Sequence
  Description of Artificial Sequence: Synthetic peptide
  Seed: TTDDATAMASA (MAGC3_HUMAN)
TLDDATAMASL

SEQ ID NO: 105531 - protein, 10 aa, Artificial Sequence
  Description of Artificial Sequence: Synthetic peptide
  Seed: KLSSIIPSAF (MAGC3_HUMAN)
KTSSIIPSAY

SEQ ID NO: 105532 - protein, 11 aa, Artificial Sequence
  Description of Artificial Sequence: Synthetic peptide
  Seed: KKYKDYFPMIF (MAGC3_HUMAN)
KQYKDYFPMIF

SEQ ID NO: 105533 - protein, 9 aa, Artificial Sequence
  Description of Artificial Sequence: Synthetic peptide
  Seed: ALDEKVAEL (MAGC3_HUMAN)
ASDEKVAEF

SEQ ID NO: 105534 - protein, 10 aa, Artificial Sequence
  Description of Artificial Sequence: Synthetic peptide
  Seed: IKKYKDYFPM (MAGC3_HUMAN)
IRKYKDYFPF

SEQ ID NO: 105535 - protein, 10 aa, Artificial Sequence
  Description of Artificial Sequence: Synthetic peptide
  Seed: MQMNVINTYT (MAGC3_HUMAN)
MKMNVINTYY

SEQ ID NO: 105536 - protein, 9 aa, Artificial Sequence
  Description of Artificial Sequence: Synthetic peptide
  Seed: FLSKLSSII (MAGC3_HUMAN)
FSSKLSSIL

SEQ ID NO: 105537 - protein, 10 aa, Artificial Sequence
  Description of Artificial Sequence: Synthetic peptide
  Seed: SPLDSCSSPL (MAGC3_HUMAN)
SMLDSCSSPM

SEQ ID NO: 105538 - protein, 10 aa, Artificial Sequence
  Description of Artificial Sequence: Synthetic peptide
  Seed: WEVLSAIGPI (MAGC3_HUMAN)
WQVLSAIGPV

SEQ ID NO: 105539 - protein, 9 aa, Artificial Sequence
  Description of Artificial Sequence: Synthetic peptide
  Seed: MQMNVINTY (MAGC3_HUMAN)
MDMNVINTL

SEQ ID NO: 105540 - protein, 9 aa, Artificial Sequence
  Description of Artificial Sequence: Synthetic peptide
  Seed: FSLRRAVSV (MAGC3_HUMAN)
FHLRRAVSM

SEQ ID NO: 105541 - protein, 9 aa, Artificial Sequence
  Description of Artificial Sequence: Synthetic peptide
  Seed: SLVLCPTYF (MAGC3_HUMAN)
SAVLCPTYW

SEQ ID NO: 105542 - protein, 9 aa, Artificial Sequence
  Description of Artificial Sequence: Synthetic peptide
  Seed: SEEVIWEVL (MAGC3_HUMAN)
SEEVIWEVF

SEQ ID NO: 105543 - protein, 11 aa, Artificial Sequence
  Description of Artificial Sequence: Synthetic peptide
  Seed: INTYTGYFPMI (MAGC3_HUMAN)
ILTYTGYFPMF

SEQ ID NO: 105544 - protein, 9 aa, Artificial Sequence
  Description of Artificial Sequence: Synthetic peptide
  Seed: YTGYFPMIF (MAGC3_HUMAN)
YAGYFPMII

SEQ ID NO: 105545 - protein, 9 aa, Artificial Sequence
  Description of Artificial Sequence: Synthetic peptide
  Seed: SLPESEPLF (MAGC3_HUMAN)
SAPESEPLI

SEQ ID NO: 105546 - protein, 9 aa, Artificial Sequence
  Description of Artificial Sequence: Synthetic peptide
  Seed: SLVLCPTYF (MAGC3_HUMAN)
SKVLCPTYM

SEQ ID NO: 105547 - protein, 11 aa, Artificial Sequence
  Description of Artificial Sequence: Synthetic peptide
  Seed: SPQGPPQSPPQ (MAGC3_HUMAN)
SPQGPPQSPPI

SEQ ID NO: 105548 - protein, 11 aa, Artificial Sequence
  Description of Artificial Sequence: Synthetic peptide
  Seed: YFFEDTLDLTY (MAGC3_HUMAN)
YQFEDTLDLTL

SEQ ID NO: 105549 - protein, 9 aa, Artificial Sequence
  Description of Artificial Sequence: Synthetic peptide
  Seed: TKAEMLTTV (MAGC3_HUMAN)
TAAEMLTTM

SEQ ID NO: 105550 - protein, 10 aa, Artificial Sequence
  Description of Artificial Sequence: Synthetic peptide
  Seed: LLKYQAKEPL (MAGC3_HUMAN)
LQKYQAKEPF

SEQ ID NO: 105551 - protein, 9 aa, Artificial Sequence
  Description of Artificial Sequence: Synthetic peptide
  Seed: KLSSIIPSA (MAGC3_HUMAN)
KLSSIIPST

SEQ ID NO: 105552 - protein, 9 aa, Artificial Sequence
  Description of Artificial Sequence: Synthetic peptide
  Seed: NTYTGYFPM (MAGC3_HUMAN)
NNYTGYFPY

SEQ ID NO: 105553 - protein, 9 aa, Artificial Sequence
  Description of Artificial Sequence: Synthetic peptide
  Seed: YKDYFPMIF (MAGC3_HUMAN)
YVDYFPMIF

SEQ ID NO: 105554 - protein, 9 aa, Artificial Sequence
  Description of Artificial Sequence: Synthetic peptide
  Seed: NTYTGYFPM (MAGC3_HUMAN)
NSYTGYFPY

SEQ ID NO: 105555 - protein, 10 aa, Artificial Sequence
  Description of Artificial Sequence: Synthetic peptide
  Seed: FLSKLSSIIP (MAGC3_HUMAN)
FLSKLSSIIM

SEQ ID NO: 105556 - protein, 10 aa, Artificial Sequence
  Description of Artificial Sequence: Synthetic peptide
  Seed: AELVQFLLLK (MAGC3_HUMAN)
AMLVQFLLLK

SEQ ID NO: 105557 - protein, 10 aa, Artificial Sequence
  Description of Artificial Sequence: Synthetic peptide
  Seed: INTYTGYFPM (MAGC3_HUMAN)
IITYTGYFPW

SEQ ID NO: 105558 - protein, 11 aa, Artificial Sequence
  Description of Artificial Sequence: Synthetic peptide
  Seed: ILFGISLTEVD (MAGC3_HUMAN)
ILFGISLTEVP

SEQ ID NO: 105559 - protein, 11 aa, Artificial Sequence
  Description of Artificial Sequence: Synthetic peptide
  Seed: LSKLSSIIPSA (MAGC3_HUMAN)
LDKLSSIIPSL

SEQ ID NO: 105560 - protein, 10 aa, Artificial Sequence
  Description of Artificial Sequence: Synthetic peptide
  Seed: YTGYFPMIFR (MAGC3_HUMAN)
YMGYFPMIFK

SEQ ID NO: 105561 - protein, 9 aa, Artificial Sequence
  Description of Artificial Sequence: Synthetic peptide
  Seed: LSSIIPSAF (MAGC3_HUMAN)
LPSIIPSAY

SEQ ID NO: 105562 - protein, 9 aa, Artificial Sequence
  Description of Artificial Sequence: Synthetic peptide
  Seed: WRRGTGYTL (MAGC3_HUMAN)
WYRGTGYTL

SEQ ID NO: 105563 - protein, 9 aa, Artificial Sequence
  Description of Artificial Sequence: Synthetic peptide
  Seed: ATYALSPVV (MAGC3_HUMAN)
AVYALSPVR

SEQ ID NO: 105564 - protein, 9 aa, Artificial Sequence
  Description of Artificial Sequence: Synthetic peptide
  Seed: EVLEFLSKL (MAGC3_HUMAN)
EALEFLSKW

SEQ ID NO: 105565 - protein, 9 aa, Artificial Sequence
  Description of Artificial Sequence: Synthetic peptide
  Seed: GMPQNRLLI (MAGC3_HUMAN)
GSPQNRLLL

SEQ ID NO: 105566 - protein, 10 aa, Artificial Sequence
  Description of Artificial Sequence: Synthetic peptide
  Seed: DMPAAGMPPL (MAGC3_HUMAN)
DMPAAGMPPM

SEQ ID NO: 105567 - protein, 11 aa, Artificial Sequence
  Description of Artificial Sequence: Synthetic peptide
  Seed: TAMASASPSVM (MAGC3_HUMAN)
TQMASASPSVY

SEQ ID NO: 105568 - protein, 9 aa, Artificial Sequence
  Description of Artificial Sequence: Synthetic peptide
  Seed: YKDYFPMIF (MAGC3_HUMAN)
YIDYFPMIF

SEQ ID NO: 105569 - protein, 9 aa, Artificial Sequence
  Description of Artificial Sequence: Synthetic peptide
  Seed: LSGSPGLQL (MAGC3_HUMAN)
LQGSPGLQI

SEQ ID NO: 105570 - protein, 9 aa, Artificial Sequence
  Description of Artificial Sequence: Synthetic peptide
  Seed: HLREVRLFL (MAGC3_HUMAN)
HTREVRLFP

SEQ ID NO: 105571 - protein, 10 aa, Artificial Sequence
  Description of Artificial Sequence: Synthetic peptide
  Seed: YALDEKVAEL (MAGC3_HUMAN)
YALDEKVAEH

SEQ ID NO: 105572 - protein, 10 aa, Artificial Sequence
  Description of Artificial Sequence: Synthetic peptide
  Seed: LVLCPTYFKL (MAGC3_HUMAN)
LQLCPTYFKV

SEQ ID NO: 105573 - protein, 9 aa, Artificial Sequence
  Description of Artificial Sequence: Synthetic peptide
  Seed: YQTKEPVTK (MAGC3_HUMAN)
YSTKEPVTY

SEQ ID NO: 105574 - protein, 9 aa, Artificial Sequence
  Description of Artificial Sequence: Synthetic peptide
  Seed: TLDEKVDKL (MAGC3_HUMAN)
TIDEKVDKM

SEQ ID NO: 105575 - protein, 9 aa, Artificial Sequence
  Description of Artificial Sequence: Synthetic peptide
  Seed: LSGSPGLQL (MAGC3_HUMAN)
LSGSPGLQY

SEQ ID NO: 105576 - protein, 10 aa, Artificial Sequence
  Description of Artificial Sequence: Synthetic peptide
  Seed: MQMNVINTYT (MAGC3_HUMAN)
MKMNVINTYT

SEQ ID NO: 105577 - protein, 10 aa, Artificial Sequence
  Description of Artificial Sequence: Synthetic peptide
  Seed: TTDDATAMAS (MAGC3_HUMAN)
TTDDATAMAM

SEQ ID NO: 105578 - protein, 10 aa, Artificial Sequence
  Description of Artificial Sequence: Synthetic peptide
  Seed: MNVINTYTGY (MAGC3_HUMAN)
MDVINTYTGY

SEQ ID NO: 105579 - protein, 9 aa, Artificial Sequence
  Description of Artificial Sequence: Synthetic peptide
  Seed: EFIELIFGI (MAGC3_HUMAN)
EFIELIFGV

SEQ ID NO: 105580 - protein, 9 aa, Artificial Sequence
  Description of Artificial Sequence: Synthetic peptide
  Seed: VIWEVLNAI (MAGC3_HUMAN)
VSWEVLNAF

SEQ ID NO: 105581 - protein, 10 aa, Artificial Sequence
  Description of Artificial Sequence: Synthetic peptide
  Seed: KAHEFIELIF (MAGC3_HUMAN)
KLHEFIELIY

SEQ ID NO: 105582 - protein, 10 aa, Artificial Sequence
  Description of Artificial Sequence: Synthetic peptide
  Seed: TYTGYFPMIF (MAGC3_HUMAN)
TSTGYFPMIW

SEQ ID NO: 105583 - protein, 9 aa, Artificial Sequence
  Description of Artificial Sequence: Synthetic peptide
  Seed: NTYTGYFPM (MAGC3_HUMAN)
NAYTGYFPL

SEQ ID NO: 105584 - protein, 11 aa, Artificial Sequence
  Description of Artificial Sequence: Synthetic peptide
  Seed: TDMDPDNHSYF (MAGC3_HUMAN)
TVMDPDNHSYY

SEQ ID NO: 105585 - protein, 9 aa, Artificial Sequence
  Description of Artificial Sequence: Synthetic peptide
  Seed: HLREVRLFL (MAGC3_HUMAN)
HSREVRLFY

SEQ ID NO: 105586 - protein, 10 aa, Artificial Sequence
  Description of Artificial Sequence: Synthetic peptide
  Seed: KDYFPMIFGK (MAGC3_HUMAN)
KTYFPMIFGA

SEQ ID NO: 105587 - protein, 9 aa, Artificial Sequence
  Description of Artificial Sequence: Synthetic peptide
  Seed: FSDGSLGQW (MAGC3_HUMAN)
FMDGSLGQV

SEQ ID NO: 105588 - protein, 9 aa, Artificial Sequence
  Description of Artificial Sequence: Synthetic peptide
  Seed: LSDEQGMPQ (MAGC3_HUMAN)
LGDEQGMPL

SEQ ID NO: 105589 - protein, 10 aa, Artificial Sequence
  Description of Artificial Sequence: Synthetic peptide
  Seed: MQMNVINTYT (MAGC3_HUMAN)
MLMNVINTYA

SEQ ID NO: 105590 - protein, 10 aa, Artificial Sequence
  Description of Artificial Sequence: Synthetic peptide
  Seed: IELIFGIALT (MAGC3_HUMAN)
ILLIFGIALA

SEQ ID NO: 105591 - protein, 11 aa, Artificial Sequence
  Description of Artificial Sequence: Synthetic peptide
  Seed: SLPESEPLFTY (MAGC3_HUMAN)
SMPESEPLFTV

SEQ ID NO: 105592 - protein, 10 aa, Artificial Sequence
  Description of Artificial Sequence: Synthetic peptide
  Seed: FKLWRTLSGS (MAGC3_HUMAN)
FLLWRTLSGA

SEQ ID NO: 105593 - protein, 9 aa, Artificial Sequence
  Description of Artificial Sequence: Synthetic peptide
  Seed: MLLPCHWVL (MAGC3_HUMAN)
MYLPCHWVI

SEQ ID NO: 105594 - protein, 9 aa, Artificial Sequence
  Description of Artificial Sequence: Synthetic peptide
  Seed: DSDLPTWRR (MAGC3_HUMAN)
DYDLPTWRR

SEQ ID NO: 105595 - protein, 10 aa, Artificial Sequence
  Description of Artificial Sequence: Synthetic peptide
  Seed: NTYTGYFPMI (MAGC3_HUMAN)
NHYTGYFPMF

SEQ ID NO: 105596 - protein, 10 aa, Artificial Sequence
  Description of Artificial Sequence: Synthetic peptide
  Seed: ILILSVIFIK (MAGC3_HUMAN)
IFILSVIFIR

SEQ ID NO: 105597 - protein, 9 aa, Artificial Sequence
  Description of Artificial Sequence: Synthetic peptide
  Seed: FPMIFGKAH (MAGC3_HUMAN)
FSMIFGKAM

SEQ ID NO: 105598 - protein, 9 aa, Artificial Sequence
  Description of Artificial Sequence: Synthetic peptide
  Seed: FPSWYMDAL (MAGC3_HUMAN)
FVSWYMDAY

SEQ ID NO: 105599 - protein, 9 aa, Artificial Sequence
  Description of Artificial Sequence: Synthetic peptide
  Seed: FPMIFRKAR (MAGC3_HUMAN)
FLMIFRKAR

SEQ ID NO: 105600 - protein, 9 aa, Artificial Sequence
  Description of Artificial Sequence: Synthetic peptide
  Seed: SLVLCPTYF (MAGC3_HUMAN)
SWVLCPTYY

SEQ ID NO: 105601 - protein, 10 aa, Artificial Sequence
  Description of Artificial Sequence: Synthetic peptide
  Seed: TYTGYFPMIF (MAGC3_HUMAN)
TYTGYFPMIL

SEQ ID NO: 105602 - protein, 9 aa, Artificial Sequence
  Description of Artificial Sequence: Synthetic peptide
  Seed: SEEEDTATW (MAGC3_HUMAN)
SMEEDTATF

SEQ ID NO: 105603 - protein, 9 aa, Artificial Sequence
  Description of Artificial Sequence: Synthetic peptide
  Seed: VIWEVLSAI (MAGC3_HUMAN)
VSWEVLSAY

SEQ ID NO: 105604 - protein, 11 aa, Artificial Sequence
  Description of Artificial Sequence: Synthetic peptide
  Seed: SPQGPPQSPPQ (MAGC3_HUMAN)
SPQGPPQSPPL

SEQ ID NO: 105605 - protein, 10 aa, Artificial Sequence
  Description of Artificial Sequence: Synthetic peptide
  Seed: EVIWEVLSAI (MAGC3_HUMAN)
EVIWEVLSAA

SEQ ID NO: 105606 - protein, 10 aa, Artificial Sequence
  Description of Artificial Sequence: Synthetic peptide
  Seed: EEVIWEVLSA (MAGC3_HUMAN)
EVVIWEVLSV

SEQ ID NO: 105607 - protein, 10 aa, Artificial Sequence
  Description of Artificial Sequence: Synthetic peptide
  Seed: LIFGIALTDM (MAGC3_HUMAN)
LMFGIALTDF

SEQ ID NO: 105608 - protein, 11 aa, Artificial Sequence
  Description of Artificial Sequence: Synthetic peptide
  Seed: YALDEKVAELV (MAGC3_HUMAN)
YLLDEKVAELL

SEQ ID NO: 105609 - protein, 9 aa, Artificial Sequence
  Description of Artificial Sequence: Synthetic peptide
  Seed: EVDPDHFYV (MAGC3_HUMAN)
EMDPDHFYV

SEQ ID NO: 105610 - protein, 9 aa, Artificial Sequence
  Description of Artificial Sequence: Synthetic peptide
  Seed: EVLSAIGPI (MAGC3_HUMAN)
ESLSAIGPV

SEQ ID NO: 105611 - protein, 10 aa, Artificial Sequence
  Description of Artificial Sequence: Synthetic peptide
  Seed: ALDEKVAELV (MAGC3_HUMAN)
AFDEKVAELI

SEQ ID NO: 105612 - protein, 9 aa, Artificial Sequence
  Description of Artificial Sequence: Synthetic peptide
  Seed: SEEEDTATW (MAGC3_HUMAN)
SEEEDTATY

SEQ ID NO: 105613 - protein, 9 aa, Artificial Sequence
  Description of Artificial Sequence: Synthetic peptide
  Seed: VLPPQPQPR (MAGC3_HUMAN)
VNPPQPQPL

SEQ ID NO: 105614 - protein, 11 aa, Artificial Sequence
  Description of Artificial Sequence: Synthetic peptide
  Seed: DSCSSPLLWTR (MAGC3_HUMAN)
DACSSPLLWTK

SEQ ID NO: 105615 - protein, 9 aa, Artificial Sequence
  Description of Artificial Sequence: Synthetic peptide
  Seed: REVLEFLSK (MAGC3_HUMAN)
REVLEFLSS

SEQ ID NO: 105616 - protein, 9 aa, Artificial Sequence
  Description of Artificial Sequence: Synthetic peptide
  Seed: LVQFLLLKY (MAGC3_HUMAN)
LAQFLLLKY

SEQ ID NO: 105617 - protein, 10 aa, Artificial Sequence
  Description of Artificial Sequence: Synthetic peptide
  Seed: FKLWRTLSGS (MAGC3_HUMAN)
FPLWRTLSGM

SEQ ID NO: 105618 - protein, 10 aa, Artificial Sequence
  Description of Artificial Sequence: Synthetic peptide
  Seed: MDPDNHSYFF (MAGC3_HUMAN)
MSPDNHSYFY

SEQ ID NO: 105619 - protein, 9 aa, Artificial Sequence
  Description of Artificial Sequence: Synthetic peptide
  Seed: LSGSPGLQL (MAGC3_HUMAN)
LPGSPGLQY

SEQ ID NO: 105620 - protein, 9 aa, Artificial Sequence
  Description of Artificial Sequence: Synthetic peptide
  Seed: LSDEQGMPQ (MAGC3_HUMAN)
LVDEQGMPY

SEQ ID NO: 105621 - protein, 10 aa, Artificial Sequence
  Description of Artificial Sequence: Synthetic peptide
  Seed: TTDDATAMAS (MAGC3_HUMAN)
TGDDATAMAM

SEQ ID NO: 105622 - protein, 10 aa, Artificial Sequence
  Description of Artificial Sequence: Synthetic peptide
  Seed: VLDLANPQGL (MAGC3_HUMAN)
VFDLANPQGL

SEQ ID NO: 105623 - protein, 10 aa, Artificial Sequence
  Description of Artificial Sequence: Synthetic peptide
  Seed: SKLSSIIPSA (MAGC3_HUMAN)
SHLSSIIPSI

SEQ ID NO: 105624 - protein, 11 aa, Artificial Sequence
  Description of Artificial Sequence: Synthetic peptide
  Seed: DYSAFHLGHLR (MAGC3_HUMAN)
DMSAFHLGHLR

SEQ ID NO: 105625 - protein, 10 aa, Artificial Sequence
  Description of Artificial Sequence: Synthetic peptide
  Seed: MNVINTYTGY (MAGC3_HUMAN)
MAVINTYTGW

SEQ ID NO: 105626 - protein, 10 aa, Artificial Sequence
  Description of Artificial Sequence: Synthetic peptide
  Seed: KVAELVQFLL (MAGC3_HUMAN)
KVAELVQFLW

SEQ ID NO: 105627 - protein, 9 aa, Artificial Sequence
  Description of Artificial Sequence: Synthetic peptide
  Seed: ISPQGPPQS (MAGC3_HUMAN)
IVPQGPPQL

SEQ ID NO: 105628 - protein, 9 aa, Artificial Sequence
  Description of Artificial Sequence: Synthetic peptide
  Seed: NVINTYTGY (MAGC3_HUMAN)
NVINTYTGR

SEQ ID NO: 105629 - protein, 10 aa, Artificial Sequence
  Description of Artificial Sequence: Synthetic peptide
  Seed: ATYALSPVVL (MAGC3_HUMAN)
AWYALSPVVW

SEQ ID NO: 105630 - protein, 8 aa, Artificial Sequence
  Description of Artificial Sequence: Synthetic peptide
  Seed: FADVLSRL (MAGC3_HUMAN)
FIDVLSRI

SEQ ID NO: 105631 - protein, 11 aa, Artificial Sequence
  Description of Artificial Sequence: Synthetic peptide
  Seed: ATFSDGSLGQW (MAGC3_HUMAN)
AEFSDGSLGQF

SEQ ID NO: 105632 - protein, 9 aa, Artificial Sequence
  Description of Artificial Sequence: Synthetic peptide
  Seed: MLLPCHWVL (MAGC3_HUMAN)
MQLPCHWVV

SEQ ID NO: 105633 - protein, 11 aa, Artificial Sequence
  Description of Artificial Sequence: Synthetic peptide
  Seed: LDSCSSPLLWT (MAGC3_HUMAN)
LSSCSSPLLWI

SEQ ID NO: 105634 - protein, 10 aa, Artificial Sequence
  Description of Artificial Sequence: Synthetic peptide
  Seed: HRQEDGRRGL (MAGC3_HUMAN)
HHQEDGRRGL

SEQ ID NO: 105635 - protein, 10 aa, Artificial Sequence
  Description of Artificial Sequence: Synthetic peptide
  Seed: SLPESEPLFT (MAGC3_HUMAN)
SMPESEPLFI

SEQ ID NO: 105636 - protein, 10 aa, Artificial Sequence
  Description of Artificial Sequence: Synthetic peptide
  Seed: RPAREVLEFL (MAGC3_HUMAN)
RYAREVLEFK

SEQ ID NO: 105637 - protein, 10 aa, Artificial Sequence
  Description of Artificial Sequence: Synthetic peptide
  Seed: TGYFPMIFRK (MAGC3_HUMAN)
TAYFPMIFRH

SEQ ID NO: 105638 - protein, 11 aa, Artificial Sequence
  Description of Artificial Sequence: Synthetic peptide
  Seed: FIELIFGIALT (MAGC3_HUMAN)
FYELIFGIALI

SEQ ID NO: 105639 - protein, 9 aa, Artificial Sequence
  Description of Artificial Sequence: Synthetic peptide
  Seed: VIWEVLSAI (MAGC3_HUMAN)
VAWEVLSAV

SEQ ID NO: 105640 - protein, 10 aa, Artificial Sequence
  Description of Artificial Sequence: Synthetic peptide
  Seed: YALSPVVLPP (MAGC3_HUMAN)
YPLSPVVLPM

SEQ ID NO: 105641 - protein, 10 aa, Artificial Sequence
  Description of Artificial Sequence: Synthetic peptide
  Seed: LPTWRRGTGY (MAGC3_HUMAN)
LSTWRRGTGY

SEQ ID NO: 105642 - protein, 10 aa, Artificial Sequence
  Description of Artificial Sequence: Synthetic peptide
  Seed: MNVINTYTGY (MAGC3_HUMAN)
MMVINTYTGF

SEQ ID NO: 105643 - protein, 9 aa, Artificial Sequence
  Description of Artificial Sequence: Synthetic peptide
  Seed: EVLEFLSKL (MAGC3_HUMAN)
EALEFLSKR

SEQ ID NO: 105644 - protein, 9 aa, Artificial Sequence
  Description of Artificial Sequence: Synthetic peptide
  Seed: HALPESESL (MAGC3_HUMAN)
HMLPESESW

SEQ ID NO: 105645 - protein, 10 aa, Artificial Sequence
  Description of Artificial Sequence: Synthetic peptide
  Seed: IKKYKDYFPM (MAGC3_HUMAN)
IAKYKDYFPF

SEQ ID NO: 105646 - protein, 9 aa, Artificial Sequence
  Description of Artificial Sequence: Synthetic peptide
  Seed: FGSQPEGKF (MAGC3_HUMAN)
FLSQPEGKF

SEQ ID NO: 105647 - protein, 11 aa, Artificial Sequence
  Description of Artificial Sequence: Synthetic peptide
  Seed: DYSAFHLGHLR (MAGC3_HUMAN)
DVSAFHLGHLR

SEQ ID NO: 105648 - protein, 9 aa, Artificial Sequence
  Description of Artificial Sequence: Synthetic peptide
  Seed: ATDKDYSAF (MAGC3_HUMAN)
AGDKDYSAI

SEQ ID NO: 105649 - protein, 10 aa, Artificial Sequence
  Description of Artificial Sequence: Synthetic peptide
  Seed: EEVIWEVLSA (MAGC3_HUMAN)
EEVIWEVLSV

SEQ ID NO: 105650 - protein, 9 aa, Artificial Sequence
  Description of Artificial Sequence: Synthetic peptide
  Seed: KVAELVQFL (MAGC3_HUMAN)
KGAELVQFY

SEQ ID NO: 105651 - protein, 9 aa, Artificial Sequence
  Description of Artificial Sequence: Synthetic peptide
  Seed: YQTKEPVTK (MAGC3_HUMAN)
YYTKEPVTY

SEQ ID NO: 105652 - protein, 9 aa, Artificial Sequence
  Description of Artificial Sequence: Synthetic peptide
  Seed: DKLVQFLLL (MAGC3_HUMAN)
DRLVQFLLL

SEQ ID NO: 105653 - protein, 9 aa, Artificial Sequence
  Description of Artificial Sequence: Synthetic peptide
  Seed: KYKDYFPMI (MAGC3_HUMAN)
KTKDYFPMM

SEQ ID NO: 105654 - protein, 9 aa, Artificial Sequence
  Description of Artificial Sequence: Synthetic peptide
  Seed: VPEEVIWEV (MAGC3_HUMAN)
VVEEVIWEL

SEQ ID NO: 105655 - protein, 9 aa, Artificial Sequence
  Description of Artificial Sequence: Synthetic peptide
  Seed: HLREVRLFL (MAGC3_HUMAN)
HTREVRLFV

SEQ ID NO: 105656 - protein, 9 aa, Artificial Sequence
  Description of Artificial Sequence: Synthetic peptide
  Seed: SASPSVMST (MAGC3_HUMAN)
SVSPSVMSM

SEQ ID NO: 105657 - protein, 9 aa, Artificial Sequence
  Description of Artificial Sequence: Synthetic peptide
  Seed: MIFRKAREF (MAGC3_HUMAN)
MPFRKAREI

SEQ ID NO: 105658 - protein, 9 aa, Artificial Sequence
  Description of Artificial Sequence: Synthetic peptide
  Seed: HSYFFEDTL (MAGC3_HUMAN)
HDYFFEDTL

SEQ ID NO: 105659 - protein, 9 aa, Artificial Sequence
  Description of Artificial Sequence: Synthetic peptide
  Seed: KYKDYFPMI (MAGC3_HUMAN)
KAKDYFPML

SEQ ID NO: 105660 - protein, 10 aa, Artificial Sequence
  Description of Artificial Sequence: Synthetic peptide
  Seed: TDMDPDNHSY (MAGC3_HUMAN)
TRMDPDNHSY

SEQ ID NO: 105661 - protein, 9 aa, Artificial Sequence
  Description of Artificial Sequence: Synthetic peptide
  Seed: LIDDQGMPK (MAGC3_HUMAN)
LTDDQGMPI

SEQ ID NO: 105662 - protein, 9 aa, Artificial Sequence
  Description of Artificial Sequence: Synthetic peptide
  Seed: VLCPTYFKL (MAGC3_HUMAN)
VVCPTYFKV

SEQ ID NO: 105663 - protein, 9 aa, Artificial Sequence
  Description of Artificial Sequence: Synthetic peptide
  Seed: IFGKAHEFI (MAGC3_HUMAN)
IWGKAHEFI

SEQ ID NO: 105664 - protein, 10 aa, Artificial Sequence
  Description of Artificial Sequence: Synthetic peptide
  Seed: LVLCPTYFKL (MAGC3_HUMAN)
LLLCPTYFKA

SEQ ID NO: 105665 - protein, 9 aa, Artificial Sequence
  Description of Artificial Sequence: Synthetic peptide
  Seed: FKLWRTLSG (MAGC3_HUMAN)
FRLWRTLSF

SEQ ID NO: 105666 - protein, 9 aa, Artificial Sequence
  Description of Artificial Sequence: Synthetic peptide
  Seed: LGHLREVRL (MAGC3_HUMAN)
LAHLREVRM

SEQ ID NO: 105667 - protein, 9 aa, Artificial Sequence
  Description of Artificial Sequence: Synthetic peptide
  Seed: QRMDSLVLC (MAGC3_HUMAN)
QHMDSLVLL

SEQ ID NO: 105668 - protein, 8 aa, Artificial Sequence
  Description of Artificial Sequence: Synthetic peptide
  Seed: FYVFVNTL (MAGC3_HUMAN)
FYVFVNTM

SEQ ID NO: 105669 - protein, 8 aa, Artificial Sequence
  Description of Artificial Sequence: Synthetic peptide
  Seed: MEDRAQAI (MAGC3_HUMAN)
MVDRAQAM

SEQ ID NO: 105670 - protein, 9 aa, Artificial Sequence
  Description of Artificial Sequence: Synthetic peptide
  Seed: YFFEDTLDL (MAGC3_HUMAN)
YPFEDTLDL

SEQ ID NO: 105671 - protein, 9 aa, Artificial Sequence
  Description of Artificial Sequence: Synthetic peptide
  Seed: FPMIFGKAH (MAGC3_HUMAN)
FPMIFGKAI

SEQ ID NO: 105672 - protein, 10 aa, Artificial Sequence
  Description of Artificial Sequence: Synthetic peptide
  Seed: SDQRMDSLVL (MAGC3_HUMAN)
SEQRMDSLVL

SEQ ID NO: 105673 - protein, 9 aa, Artificial Sequence
  Description of Artificial Sequence: Synthetic peptide
  Seed: NTYTGYFPM (MAGC3_HUMAN)
NEYTGYFPF

SEQ ID NO: 105674 - protein, 10 aa, Artificial Sequence
  Description of Artificial Sequence: Synthetic peptide
  Seed: SKLSSIIPSA (MAGC3_HUMAN)
SFLSSIIPSM

SEQ ID NO: 105675 - protein, 10 aa, Artificial Sequence
  Description of Artificial Sequence: Synthetic peptide
  Seed: SQPEGKFSLR (MAGC3_HUMAN)
SAPEGKFSLF

SEQ ID NO: 105676 - protein, 9 aa, Artificial Sequence
  Description of Artificial Sequence: Synthetic peptide
  Seed: FSDGSLGQW (MAGC3_HUMAN)
FQDGSLGQL

SEQ ID NO: 105677 - protein, 9 aa, Artificial Sequence
  Description of Artificial Sequence: Synthetic peptide
  Seed: VLPPQPQPR (MAGC3_HUMAN)
VIPPQPQPL

SEQ ID NO: 105678 - protein, 9 aa, Artificial Sequence
  Description of Artificial Sequence: Synthetic peptide
  Seed: HFYVFVNTL (MAGC3_HUMAN)
HNYVFVNTV

SEQ ID NO: 105679 - protein, 9 aa, Artificial Sequence
  Description of Artificial Sequence: Synthetic peptide
  Seed: TEASPQQKK (MAGC3_HUMAN)
TIASPQQKF

SEQ ID NO: 105680 - protein, 10 aa, Artificial Sequence
  Description of Artificial Sequence: Synthetic peptide
  Seed: SDQRMDSLVL (MAGC3_HUMAN)
SGQRMDSLVM

SEQ ID NO: 105681 - protein, 9 aa, Artificial Sequence
  Description of Artificial Sequence: Synthetic peptide
  Seed: MPAAGMPPL (MAGC3_HUMAN)
MPAAGMPPN

SEQ ID NO: 105682 - protein, 11 aa, Artificial Sequence
  Description of Artificial Sequence: Synthetic peptide
  Seed: FIELIFGIALT (MAGC3_HUMAN)
FPELIFGIALL

SEQ ID NO: 105683 - protein, 10 aa, Artificial Sequence
  Description of Artificial Sequence: Synthetic peptide
  Seed: IELIFGIALT (MAGC3_HUMAN)
IDLIFGIALA

SEQ ID NO: 105684 - protein, 10 aa, Artificial Sequence
  Description of Artificial Sequence: Synthetic peptide
  Seed: SAFHLGHLRE (MAGC3_HUMAN)
SMFHLGHLRM

SEQ ID NO: 105685 - protein, 9 aa, Artificial Sequence
  Description of Artificial Sequence: Synthetic peptide
  Seed: FSLRRAVSV (MAGC3_HUMAN)
FVLRRAVSY

SEQ ID NO: 105686 - protein, 9 aa, Artificial Sequence
  Description of Artificial Sequence: Synthetic peptide
  Seed: TLDEKVDKL (MAGC3_HUMAN)
TYDEKVDKM

SEQ ID NO: 105687 - protein, 10 aa, Artificial Sequence
  Description of Artificial Sequence: Synthetic peptide
  Seed: MQMNVINTYT (MAGC3_HUMAN)
MSMNVINTYM

SEQ ID NO: 105688 - protein, 9 aa, Artificial Sequence
  Description of Artificial Sequence: Synthetic peptide
  Seed: KLVQFLLLK (MAGC3_HUMAN)
KVVQFLLLL

SEQ ID NO: 105689 - protein, 9 aa, Artificial Sequence
  Description of Artificial Sequence: Synthetic peptide
  Seed: MIFGKAHEF (MAGC3_HUMAN)
MTFGKAHEK

SEQ ID NO: 105690 - protein, 9 aa, Artificial Sequence
  Description of Artificial Sequence: Synthetic peptide
  Seed: ASEEVIWEV (MAGC3_HUMAN)
AVEEVIWEL

SEQ ID NO: 105691 - protein, 11 aa, Artificial Sequence
  Description of Artificial Sequence: Synthetic peptide
  Seed: RYALDEKVAEL (MAGC3_HUMAN)
RLALDEKVAEL

SEQ ID NO: 105692 - protein, 11 aa, Artificial Sequence
  Description of Artificial Sequence: Synthetic peptide
  Seed: ALWESEGPEAF (MAGC3_HUMAN)
ARWESEGPEAM

SEQ ID NO: 105693 - protein, 9 aa, Artificial Sequence
  Description of Artificial Sequence: Synthetic peptide
  Seed: HALPESESL (MAGC3_HUMAN)
HLLPESESI

SEQ ID NO: 105694 - protein, 8 aa, Artificial Sequence
  Description of Artificial Sequence: Synthetic peptide
  Seed: IFGKAHEF (MAGC3_HUMAN)
ITGKAHEM

SEQ ID NO: 105695 - protein, 9 aa, Artificial Sequence
  Description of Artificial Sequence: Synthetic peptide
  Seed: KLVQFLLLK (MAGC3_HUMAN)
KTVQFLLLR

SEQ ID NO: 105696 - protein, 10 aa, Artificial Sequence
  Description of Artificial Sequence: Synthetic peptide
  Seed: TWRRGTGYTL (MAGC3_HUMAN)
TWRRGTGYTF

SEQ ID NO: 105697 - protein, 10 aa, Artificial Sequence
  Description of Artificial Sequence: Synthetic peptide
  Seed: KVAELVQFLL (MAGC3_HUMAN)
KMAELVQFLV

SEQ ID NO: 105698 - protein, 10 aa, Artificial Sequence
  Description of Artificial Sequence: Synthetic peptide
  Seed: LDSCSSPLLW (MAGC3_HUMAN)
LWSCSSPLLF

SEQ ID NO: 105699 - protein, 11 aa, Artificial Sequence
  Description of Artificial Sequence: Synthetic peptide
  Seed: ALWESEGPEAF (MAGC3_HUMAN)
AMWESEGPEAY

SEQ ID NO: 105700 - protein, 10 aa, Artificial Sequence
  Description of Artificial Sequence: Synthetic peptide
  Seed: LPTWRRGTGY (MAGC3_HUMAN)
LHTWRRGTGF

SEQ ID NO: 105701 - protein, 11 aa, Artificial Sequence
  Description of Artificial Sequence: Synthetic peptide
  Seed: LHFGSQPEGKF (MAGC3_HUMAN)
LQFGSQPEGKY

SEQ ID NO: 105702 - protein, 9 aa, Artificial Sequence
  Description of Artificial Sequence: Synthetic peptide
  Seed: AVSPGKRLW (MAGC3_HUMAN)
ASSPGKRLM

SEQ ID NO: 105703 - protein, 10 aa, Artificial Sequence
  Description of Artificial Sequence: Synthetic peptide
  Seed: SPPEIPPQGP (MAGC3_HUMAN)
SPPEIPPQGL

SEQ ID NO: 105704 - protein, 9 aa, Artificial Sequence
  Description of Artificial Sequence: Synthetic peptide
  Seed: MIFRKAREF (MAGC3_HUMAN)
MYFRKAREL

SEQ ID NO: 105705 - protein, 9 aa, Artificial Sequence
  Description of Artificial Sequence: Synthetic peptide
  Seed: VDPDHFYVF (MAGC3_HUMAN)
VWPDHFYVI

SEQ ID NO: 105706 - protein, 9 aa, Artificial Sequence
  Description of Artificial Sequence: Synthetic peptide
  Seed: MASASPSVM (MAGC3_HUMAN)
MTSASPSVF

SEQ ID NO: 105707 - protein, 9 aa, Artificial Sequence
  Description of Artificial Sequence: Synthetic peptide
  Seed: GYFPMIFRK (MAGC3_HUMAN)
GMFPMIFRR

SEQ ID NO: 105708 - protein, 9 aa, Artificial Sequence
  Description of Artificial Sequence: Synthetic peptide
  Seed: EKVDKLVQF (MAGC3_HUMAN)
EHVDKLVQI

SEQ ID NO: 105709 - protein, 10 aa, Artificial Sequence
  Description of Artificial Sequence: Synthetic peptide
  Seed: EAFCEESGLR (MAGC3_HUMAN)
EIFCEESGLK

SEQ ID NO: 105710 - protein, 11 aa, Artificial Sequence
  Description of Artificial Sequence: Synthetic peptide
  Seed: TTDDATAMASA (MAGC3_HUMAN)
TTDDATAMASV

SEQ ID NO: 105711 - protein, 10 aa, Artificial Sequence
  Description of Artificial Sequence: Synthetic peptide
  Seed: VLDLANPQGL (MAGC3_HUMAN)
VIDLANPQGL

SEQ ID NO: 105712 - protein, 9 aa, Artificial Sequence
  Description of Artificial Sequence: Synthetic peptide
  Seed: YKDYFPMIF (MAGC3_HUMAN)
YRDYFPMII

SEQ ID NO: 105713 - protein, 9 aa, Artificial Sequence
  Description of Artificial Sequence: Synthetic peptide
  Seed: TYTGYFPMI (MAGC3_HUMAN)
TFTGYFPMW

SEQ ID NO: 105714 - protein, 9 aa, Artificial Sequence
  Description of Artificial Sequence: Synthetic peptide
  Seed: FEDTLDLTY (MAGC3_HUMAN)
FTDTLDLTF

SEQ ID NO: 105715 - protein, 9 aa, Artificial Sequence
  Description of Artificial Sequence: Synthetic peptide
  Seed: SLPESEPLF (MAGC3_HUMAN)
SIPESEPLF

SEQ ID NO: 105716 - protein, 9 aa, Artificial Sequence
  Description of Artificial Sequence: Synthetic peptide
  Seed: KGSCVPEEV (MAGC3_HUMAN)
KISCVPEEF

SEQ ID NO: 105717 - protein, 9 aa, Artificial Sequence
  Description of Artificial Sequence: Synthetic peptide
  Seed: VPEEVIWEV (MAGC3_HUMAN)
VTEEVIWEM

SEQ ID NO: 105718 - protein, 10 aa, Artificial Sequence
  Description of Artificial Sequence: Synthetic peptide
  Seed: YALSPVVLPP (MAGC3_HUMAN)
YGLSPVVLPL

SEQ ID NO: 105719 - protein, 10 aa, Artificial Sequence
  Description of Artificial Sequence: Synthetic peptide
  Seed: AMASASPSVM (MAGC3_HUMAN)
ALASASPSVY

SEQ ID NO: 105720 - protein, 9 aa, Artificial Sequence
  Description of Artificial Sequence: Synthetic peptide
  Seed: EVLEFLSKL (MAGC3_HUMAN)
EMLEFLSKM

SEQ ID NO: 105721 - protein, 8 aa, Artificial Sequence
  Description of Artificial Sequence: Synthetic peptide
  Seed: MEDRAQAI (MAGC3_HUMAN)
MEDRAQAL

SEQ ID NO: 105722 - protein, 9 aa, Artificial Sequence
  Description of Artificial Sequence: Synthetic peptide
  Seed: EVLEFLSKL (MAGC3_HUMAN)
EALEFLSKL

SEQ ID NO: 105723 - protein, 10 aa, Artificial Sequence
  Description of Artificial Sequence: Synthetic peptide
  Seed: SLIDDQGMPK (MAGC3_HUMAN)
SAIDDQGMPR

SEQ ID NO: 105724 - protein, 9 aa, Artificial Sequence
  Description of Artificial Sequence: Synthetic peptide
  Seed: LRSAEGSVL (MAGC3_HUMAN)
LMSAEGSVW

SEQ ID NO: 105725 - protein, 9 aa, Artificial Sequence
  Description of Artificial Sequence: Synthetic peptide
  Seed: FHLGHLREV (MAGC3_HUMAN)
FVLGHLREL

SEQ ID NO: 105726 - protein, 10 aa, Artificial Sequence
  Description of Artificial Sequence: Synthetic peptide
  Seed: SDQRMDSLVL (MAGC3_HUMAN)
SNQRMDSLVF

SEQ ID NO: 105727 - protein, 9 aa, Artificial Sequence
  Description of Artificial Sequence: Synthetic peptide
  Seed: MIFGKAHEF (MAGC3_HUMAN)
MSFGKAHEA

SEQ ID NO: 105728 - protein, 9 aa, Artificial Sequence
  Description of Artificial Sequence: Synthetic peptide
  Seed: MPAAGMPPL (MAGC3_HUMAN)
MLAAGMPPF

SEQ ID NO: 105729 - protein, 9 aa, Artificial Sequence
  Description of Artificial Sequence: Synthetic peptide
  Seed: LIDDQGMPK (MAGC3_HUMAN)
LIDDQGMPL

SEQ ID NO: 105730 - protein, 10 aa, Artificial Sequence
  Description of Artificial Sequence: Synthetic peptide
  Seed: YALDEKVAEL (MAGC3_HUMAN)
YFLDEKVAEV

SEQ ID NO: 105731 - protein, 10 aa, Artificial Sequence
  Description of Artificial Sequence: Synthetic peptide
  Seed: FPSWYMDALK (MAGC3_HUMAN)
FRSWYMDALK

SEQ ID NO: 105732 - protein, 10 aa, Artificial Sequence
  Description of Artificial Sequence: Synthetic peptide
  Seed: MIFRKAREFI (MAGC3_HUMAN)
MHFRKAREFK

SEQ ID NO: 105733 - protein, 10 aa, Artificial Sequence
  Description of Artificial Sequence: Synthetic peptide
  Seed: FADVLSRLAL (MAGC3_HUMAN)
FADVLSRLAF

SEQ ID NO: 105734 - protein, 9 aa, Artificial Sequence
  Description of Artificial Sequence: Synthetic peptide
  Seed: TTDDATAMA (MAGC3_HUMAN)
TADDATAMV

SEQ ID NO: 105735 - protein, 11 aa, Artificial Sequence
  Description of Artificial Sequence: Synthetic peptide
  Seed: LSLPAVSPGKR (MAGC3_HUMAN)
LTLPAVSPGKK

SEQ ID NO: 105736 - protein, 10 aa, Artificial Sequence
  Description of Artificial Sequence: Synthetic peptide
  Seed: ATYALSPVVL (MAGC3_HUMAN)
ATYALSPVVY

SEQ ID NO: 105737 - protein, 9 aa, Artificial Sequence
  Description of Artificial Sequence: Synthetic peptide
  Seed: EKVAELVQF (MAGC3_HUMAN)
EIVAELVQY

SEQ ID NO: 105738 - protein, 9 aa, Artificial Sequence
  Description of Artificial Sequence: Synthetic peptide
  Seed: FHLGHLREV (MAGC3_HUMAN)
FNLGHLREL

SEQ ID NO: 105739 - protein, 9 aa, Artificial Sequence
  Description of Artificial Sequence: Synthetic peptide
  Seed: QRMDSLVLC (MAGC3_HUMAN)
QRMDSLVLA

SEQ ID NO: 105740 - protein, 9 aa, Artificial Sequence
  Description of Artificial Sequence: Synthetic peptide
  Seed: LANPQGLAG (MAGC3_HUMAN)
LGNPQGLAY

SEQ ID NO: 105741 - protein, 9 aa, Artificial Sequence
  Description of Artificial Sequence: Synthetic peptide
  Seed: GFADVLSRL (MAGC3_HUMAN)
GLADVLSRM

SEQ ID NO: 105742 - protein, 9 aa, Artificial Sequence
  Description of Artificial Sequence: Synthetic peptide
  Seed: KAHEFIELI (MAGC3_HUMAN)
KAHEFIELM

SEQ ID NO: 105743 - protein, 9 aa, Artificial Sequence
  Description of Artificial Sequence: Synthetic peptide
  Seed: SEEVIWEVL (MAGC3_HUMAN)
SHEVIWEVL

SEQ ID NO: 105744 - protein, 10 aa, Artificial Sequence
  Description of Artificial Sequence: Synthetic peptide
  Seed: LDSCSSPLLW (MAGC3_HUMAN)
LPSCSSPLLW

SEQ ID NO: 105745 - protein, 10 aa, Artificial Sequence
  Description of Artificial Sequence: Synthetic peptide
  Seed: IELIFGIALT (MAGC3_HUMAN)
INLIFGIALV

SEQ ID NO: 105746 - protein, 10 aa, Artificial Sequence
  Description of Artificial Sequence: Synthetic peptide
  Seed: TDMDPDNHSY (MAGC3_HUMAN)
TTMDPDNHSM

SEQ ID NO: 105747 - protein, 9 aa, Artificial Sequence
  Description of Artificial Sequence: Synthetic peptide
  Seed: FSLRRAVSV (MAGC3_HUMAN)
FRLRRAVSF

SEQ ID NO: 105748 - protein, 9 aa, Artificial Sequence
  Description of Artificial Sequence: Synthetic peptide
  Seed: LSSIIPSAF (MAGC3_HUMAN)
LKSIIPSAY

SEQ ID NO: 105749 - protein, 9 aa, Artificial Sequence
  Description of Artificial Sequence: Synthetic peptide
  Seed: QLSDLHFGS (MAGC3_HUMAN)
QQSDLHFGI

SEQ ID NO: 105750 - protein, 9 aa, Artificial Sequence
  Description of Artificial Sequence: Synthetic peptide
  Seed: KVAELVQFL (MAGC3_HUMAN)
KNAELVQFW

SEQ ID NO: 105751 - protein, 9 aa, Artificial Sequence
  Description of Artificial Sequence: Synthetic peptide
  Seed: TKAEMLTTV (MAGC3_HUMAN)
TGAEMLTTL

SEQ ID NO: 105752 - protein, 11 aa, Artificial Sequence
  Description of Artificial Sequence: Synthetic peptide
  Seed: FGSQPEGKFSL (MAGC3_HUMAN)
FASQPEGKFSL

SEQ ID NO: 105753 - protein, 9 aa, Artificial Sequence
  Description of Artificial Sequence: Synthetic peptide
  Seed: IIDTTDDAT (MAGC3_HUMAN)
IIDTTDDAV

SEQ ID NO: 105754 - protein, 9 aa, Artificial Sequence
  Description of Artificial Sequence: Synthetic peptide
  Seed: EVLNAIGPW (MAGC3_HUMAN)
EILNAIGPY

SEQ ID NO: 105755 - protein, 9 aa, Artificial Sequence
  Description of Artificial Sequence: Synthetic peptide
  Seed: MPAAGMPPL (MAGC3_HUMAN)
MIAAGMPPL

SEQ ID NO: 105756 - protein, 10 aa, Artificial Sequence
  Description of Artificial Sequence: Synthetic peptide
  Seed: YALDEKVAEL (MAGC3_HUMAN)
YLLDEKVAEL

SEQ ID NO: 105757 - protein, 9 aa, Artificial Sequence
  Description of Artificial Sequence: Synthetic peptide
  Seed: MLTTVIKKY (MAGC3_HUMAN)
MSTTVIKKY

SEQ ID NO: 105758 - protein, 9 aa, Artificial Sequence
  Description of Artificial Sequence: Synthetic peptide
  Seed: KLWRTLSGS (MAGC3_HUMAN)
KLWRTLSGA

SEQ ID NO: 105759 - protein, 9 aa, Artificial Sequence
  Description of Artificial Sequence: Synthetic peptide
  Seed: KLSSIIPSA (MAGC3_HUMAN)
KLSSIIPSL

SEQ ID NO: 105760 - protein, 9 aa, Artificial Sequence
  Description of Artificial Sequence: Synthetic peptide
  Seed: ALDEKVAEL (MAGC3_HUMAN)
AQDEKVAEV

SEQ ID NO: 105761 - protein, 9 aa, Artificial Sequence
  Description of Artificial Sequence: Synthetic peptide
  Seed: SIIPSAFPS (MAGC3_HUMAN)
SVIPSAFPA

SEQ ID NO: 105762 - protein, 10 aa, Artificial Sequence
  Description of Artificial Sequence: Synthetic peptide
  Seed: SIIPSAFPSW (MAGC3_HUMAN)
SYIPSAFPSM

SEQ ID NO: 105763 - protein, 10 aa, Artificial Sequence
  Description of Artificial Sequence: Synthetic peptide
  Seed: ILILSVIFIK (MAGC3_HUMAN)
IWILSVIFIR

SEQ ID NO: 105764 - protein, 11 aa, Artificial Sequence
  Description of Artificial Sequence: Synthetic peptide
  Seed: ATFSDGSLGQW (MAGC3_HUMAN)
ALFSDGSLGQY

SEQ ID NO: 105765 - protein, 9 aa, Artificial Sequence
  Description of Artificial Sequence: Synthetic peptide
  Seed: WVKNTCATY (MAGC3_HUMAN)
WKKNTCATM

SEQ ID NO: 105766 - protein, 11 aa, Artificial Sequence
  Description of Artificial Sequence: Synthetic peptide
  Seed: SASPSVMSTNF (MAGC3_HUMAN)
SVSPSVMSTNW

SEQ ID NO: 105767 - protein, 10 aa, Artificial Sequence
  Description of Artificial Sequence: Synthetic peptide
  Seed: SDQRMDSLVL (MAGC3_HUMAN)
SDQRMDSLVY

SEQ ID NO: 105768 - protein, 10 aa, Artificial Sequence
  Description of Artificial Sequence: Synthetic peptide
  Seed: KKYKDYFPMI (MAGC3_HUMAN)
KSYKDYFPMF

SEQ ID NO: 105769 - protein, 8 aa, Artificial Sequence
  Description of Artificial Sequence: Synthetic peptide
  Seed: FADVLSRL (MAGC3_HUMAN)
FYDVLSRF

SEQ ID NO: 105770 - protein, 11 aa, Artificial Sequence
  Description of Artificial Sequence: Synthetic peptide
  Seed: RTLSGSPGLQL (MAGC3_HUMAN)
RALSGSPGLQF

SEQ ID NO: 105771 - protein, 9 aa, Artificial Sequence
  Description of Artificial Sequence: Synthetic peptide
  Seed: VDPDHFYVF (MAGC3_HUMAN)
VGPDHFYVF

SEQ ID NO: 105772 - protein, 9 aa, Artificial Sequence
  Description of Artificial Sequence: Synthetic peptide
  Seed: KDSDLPTWR (MAGC3_HUMAN)
KSSDLPTWR

SEQ ID NO: 105773 - protein, 10 aa, Artificial Sequence
  Description of Artificial Sequence: Synthetic peptide
  Seed: SWYMDALKDM (MAGC3_HUMAN)
SYYMDALKDL

SEQ ID NO: 105774 - protein, 11 aa, Artificial Sequence
  Description of Artificial Sequence: Synthetic peptide
  Seed: LSKLSSIIPSA (MAGC3_HUMAN)
LGKLSSIIPSV

SEQ ID NO: 105775 - protein, 9 aa, Artificial Sequence
  Description of Artificial Sequence: Synthetic peptide
  Seed: ALSPVVLPP (MAGC3_HUMAN)
AISPVVLPM

SEQ ID NO: 105776 - protein, 10 aa, Artificial Sequence
  Description of Artificial Sequence: Synthetic peptide
  Seed: SCSSPLLWTR (MAGC3_HUMAN)
SESSPLLWTR

SEQ ID NO: 105777 - protein, 9 aa, Artificial Sequence
  Description of Artificial Sequence: Synthetic peptide
  Seed: QMNVINTYT (MAGC3_HUMAN)
QMNVINTYM

SEQ ID NO: 105778 - protein, 9 aa, Artificial Sequence
  Description of Artificial Sequence: Synthetic peptide
  Seed: RGTGYTLSL (MAGC3_HUMAN)
RMTGYTLSW

SEQ ID NO: 105779 - protein, 10 aa, Artificial Sequence
  Description of Artificial Sequence: Synthetic peptide
  Seed: MDSLVLCPTY (MAGC3_HUMAN)
MQSLVLCPTY

SEQ ID NO: 105780 - protein, 9 aa, Artificial Sequence
  Description of Artificial Sequence: Synthetic peptide
  Seed: SQPEGKFSL (MAGC3_HUMAN)
SEPEGKFSC

SEQ ID NO: 105781 - protein, 9 aa, Artificial Sequence
  Description of Artificial Sequence: Synthetic peptide
  Seed: WVKNTCATY (MAGC3_HUMAN)
WAKNTCATY

SEQ ID NO: 105782 - protein, 10 aa, Artificial Sequence
  Description of Artificial Sequence: Synthetic peptide
  Seed: KVAELVQFLL (MAGC3_HUMAN)
KQAELVQFLM

SEQ ID NO: 105783 - protein, 9 aa, Artificial Sequence
  Description of Artificial Sequence: Synthetic peptide
  Seed: SESLPRYAL (MAGC3_HUMAN)
SQSLPRYAY

SEQ ID NO: 105784 - protein, 9 aa, Artificial Sequence
  Description of Artificial Sequence: Synthetic peptide
  Seed: HSYFFEDTL (MAGC3_HUMAN)
HRYFFEDTM

SEQ ID NO: 105785 - protein, 9 aa, Artificial Sequence
  Description of Artificial Sequence: Synthetic peptide
  Seed: GFADVLSRL (MAGC3_HUMAN)
GYADVLSRI

SEQ ID NO: 105786 - protein, 9 aa, Artificial Sequence
  Description of Artificial Sequence: Synthetic peptide
  Seed: SAFHLGHLR (MAGC3_HUMAN)
SAFHLGHLV

SEQ ID NO: 105787 - protein, 10 aa, Artificial Sequence
  Description of Artificial Sequence: Synthetic peptide
  Seed: HEFIELIFGI (MAGC3_HUMAN)
HEFIELIFGM

SEQ ID NO: 105788 - protein, 11 aa, Artificial Sequence
  Description of Artificial Sequence: Synthetic peptide
  Seed: DYSAFHLGHLR (MAGC3_HUMAN)
DTSAFHLGHLR

SEQ ID NO: 105789 - protein, 10 aa, Artificial Sequence
  Description of Artificial Sequence: Synthetic peptide
  Seed: LNAIGPWSAL (MAGC3_HUMAN)
LAAIGPWSAY

SEQ ID NO: 105790 - protein, 9 aa, Artificial Sequence
  Description of Artificial Sequence: Synthetic peptide
  Seed: YQTKEPVTK (MAGC3_HUMAN)
YTTKEPVTY

SEQ ID NO: 105791 - protein, 10 aa, Artificial Sequence
  Description of Artificial Sequence: Synthetic peptide
  Seed: SWYMDALKDM (MAGC3_HUMAN)
SSYMDALKDF

SEQ ID NO: 105792 - protein, 10 aa, Artificial Sequence
  Description of Artificial Sequence: Synthetic peptide
  Seed: TAMASASPSV (MAGC3_HUMAN)
TSMASASPSL

SEQ ID NO: 105793 - protein, 9 aa, Artificial Sequence
  Description of Artificial Sequence: Synthetic peptide
  Seed: LHFGSQPEG (MAGC3_HUMAN)
LHFGSQPEV

SEQ ID NO: 105794 - protein, 9 aa, Artificial Sequence
  Description of Artificial Sequence: Synthetic peptide
  Seed: LRSAEGSVL (MAGC3_HUMAN)
LQSAEGSVI

SEQ ID NO: 105795 - protein, 9 aa, Artificial Sequence
  Description of Artificial Sequence: Synthetic peptide
  Seed: GKAHEFIEL (MAGC3_HUMAN)
GQAHEFIEF

SEQ ID NO: 105796 - protein, 9 aa, Artificial Sequence
  Description of Artificial Sequence: Synthetic peptide
  Seed: LSSIIPSAF (MAGC3_HUMAN)
LASIIPSAM

SEQ ID NO: 105797 - protein, 10 aa, Artificial Sequence
  Description of Artificial Sequence: Synthetic peptide
  Seed: YTLDEKVDKL (MAGC3_HUMAN)
YMLDEKVDKM

SEQ ID NO: 105798 - protein, 9 aa, Artificial Sequence
  Description of Artificial Sequence: Synthetic peptide
  Seed: KEPLTRAEM (MAGC3_HUMAN)
KEPLTRAEA

SEQ ID NO: 105799 - protein, 9 aa, Artificial Sequence
  Description of Artificial Sequence: Synthetic peptide
  Seed: EVLEFLSKL (MAGC3_HUMAN)
EVLEFLSKV

SEQ ID NO: 105800 - protein, 9 aa, Artificial Sequence
  Description of Artificial Sequence: Synthetic peptide
  Seed: AMASASPSV (MAGC3_HUMAN)
AFASASPSY

SEQ ID NO: 105801 - protein, 8 aa, Artificial Sequence
  Description of Artificial Sequence: Synthetic peptide
  Seed: MEDRAQAI (MAGC3_HUMAN)
MEDRAQAV

SEQ ID NO: 105802 - protein, 9 aa, Artificial Sequence
  Description of Artificial Sequence: Synthetic peptide
  Seed: DMDPDNHSY (MAGC3_HUMAN)
DADPDNHSV

SEQ ID NO: 105803 - protein, 9 aa, Artificial Sequence
  Description of Artificial Sequence: Synthetic peptide
  Seed: MLTTVIKKY (MAGC3_HUMAN)
MTTTVIKKY

SEQ ID NO: 105804 - protein, 9 aa, Artificial Sequence
  Description of Artificial Sequence: Synthetic peptide
  Seed: SEEEDTATW (MAGC3_HUMAN)
SEEEDTATI

SEQ ID NO: 105805 - protein, 8 aa, Artificial Sequence
  Description of Artificial Sequence: Synthetic peptide
  Seed: TTDDATAM (MAGC3_HUMAN)
TIDDATAF

SEQ ID NO: 105806 - protein, 10 aa, Artificial Sequence
  Description of Artificial Sequence: Synthetic peptide
  Seed: TTDDATAMAS (MAGC3_HUMAN)
TMDDATAMAF

SEQ ID NO: 105807 - protein, 9 aa, Artificial Sequence
  Description of Artificial Sequence: Synthetic peptide
  Seed: MPAAGMPPL (MAGC3_HUMAN)
MAAAGMPPF

SEQ ID NO: 105808 - protein, 10 aa, Artificial Sequence
  Description of Artificial Sequence: Synthetic peptide
  Seed: MNVINTYTGY (MAGC3_HUMAN)
MPVINTYTGL

SEQ ID NO: 105809 - protein, 9 aa, Artificial Sequence
  Description of Artificial Sequence: Synthetic peptide
  Seed: MLLPCHWVL (MAGC3_HUMAN)
MPLPCHWVV

SEQ ID NO: 105810 - protein, 9 aa, Artificial Sequence
  Description of Artificial Sequence: Synthetic peptide
  Seed: NAIGPWSAL (MAGC3_HUMAN)
NHIGPWSAM

SEQ ID NO: 105811 - protein, 9 aa, Artificial Sequence
  Description of Artificial Sequence: Synthetic peptide
  Seed: KVAELVQFL (MAGC3_HUMAN)
KVAELVQFR

SEQ ID NO: 105812 - protein, 9 aa, Artificial Sequence
  Description of Artificial Sequence: Synthetic peptide
  Seed: KLVQFLLLK (MAGC3_HUMAN)
KLVQFLLLY

SEQ ID NO: 105813 - protein, 9 aa, Artificial Sequence
  Description of Artificial Sequence: Synthetic peptide
  Seed: TYFKLWRTL (MAGC3_HUMAN)
TTFKLWRTY

SEQ ID NO: 105814 - protein, 10 aa, Artificial Sequence
  Description of Artificial Sequence: Synthetic peptide
  Seed: IELIFGIALT (MAGC3_HUMAN)
INLIFGIALL

SEQ ID NO: 105815 - protein, 10 aa, Artificial Sequence
  Description of Artificial Sequence: Synthetic peptide
  Seed: EEVIWEVLNA (MAGC3_HUMAN)
ELVIWEVLNV

SEQ ID NO: 105816 - protein, 11 aa, Artificial Sequence
  Description of Artificial Sequence: Synthetic peptide
  Seed: KVAELVQFLLL (MAGC3_HUMAN)
KMAELVQFLLT

SEQ ID NO: 105817 - protein, 11 aa, Artificial Sequence
  Description of Artificial Sequence: Synthetic peptide
  Seed: ILFGISLTEVD (MAGC3_HUMAN)
ILFGISLTEVI

SEQ ID NO: 105818 - protein, 9 aa, Artificial Sequence
  Description of Artificial Sequence: Synthetic peptide
  Seed: EKVDKLVQF (MAGC3_HUMAN)
EHVDKLVQF

SEQ ID NO: 105819 - protein, 9 aa, Artificial Sequence
  Description of Artificial Sequence: Synthetic peptide
  Seed: SVLDLANPQ (MAGC3_HUMAN)
SVLDLANPR

SEQ ID NO: 105820 - protein, 9 aa, Artificial Sequence
  Description of Artificial Sequence: Synthetic peptide
  Seed: TYALSPVVL (MAGC3_HUMAN)
TFALSPVVY

SEQ ID NO: 105821 - protein, 10 aa, Artificial Sequence
  Description of Artificial Sequence: Synthetic peptide
  Seed: EKVAELVQFL (MAGC3_HUMAN)
EMVAELVQFY

SEQ ID NO: 105822 - protein, 9 aa, Artificial Sequence
  Description of Artificial Sequence: Synthetic peptide
  Seed: YSAFHLGHL (MAGC3_HUMAN)
YYAFHLGHM

SEQ ID NO: 105823 - protein, 9 aa, Artificial Sequence
  Description of Artificial Sequence: Synthetic peptide
  Seed: KYKDYFPMI (MAGC3_HUMAN)
KTKDYFPMS

SEQ ID NO: 105824 - protein, 9 aa, Artificial Sequence
  Description of Artificial Sequence: Synthetic peptide
  Seed: RTLSGSPGL (MAGC3_HUMAN)
RSLSGSPGI

SEQ ID NO: 105825 - protein, 10 aa, Artificial Sequence
  Description of Artificial Sequence: Synthetic peptide
  Seed: MNVINTYTGY (MAGC3_HUMAN)
MPVINTYTGK

SEQ ID NO: 105826 - protein, 11 aa, Artificial Sequence
  Description of Artificial Sequence: Synthetic peptide
  Seed: RYALDEKVAEL (MAGC3_HUMAN)
RPALDEKVAEV

SEQ ID NO: 105827 - protein, 10 aa, Artificial Sequence
  Description of Artificial Sequence: Synthetic peptide
  Seed: SAFHLGHLRE (MAGC3_HUMAN)
SNFHLGHLRR

SEQ ID NO: 105828 - protein, 10 aa, Artificial Sequence
  Description of Artificial Sequence: Synthetic peptide
  Seed: MPQNRLLILI (MAGC3_HUMAN)
MPQNRLLILY

SEQ ID NO: 105829 - protein, 9 aa, Artificial Sequence
  Description of Artificial Sequence: Synthetic peptide
  Seed: HFYVFVNTL (MAGC3_HUMAN)
HYYVFVNTL

SEQ ID NO: 105830 - protein, 9 aa, Artificial Sequence
  Description of Artificial Sequence: Synthetic peptide
  Seed: FLSKLSSII (MAGC3_HUMAN)
FSSKLSSIM

SEQ ID NO: 105831 - protein, 10 aa, Artificial Sequence
  Description of Artificial Sequence: Synthetic peptide
  Seed: AEMLTTVIKK (MAGC3_HUMAN)
AKMLTTVIKK

SEQ ID NO: 105832 - protein, 10 aa, Artificial Sequence
  Description of Artificial Sequence: Synthetic peptide
  Seed: YALSPVVLPP (MAGC3_HUMAN)
YHLSPVVLPL

SEQ ID NO: 105833 - protein, 9 aa, Artificial Sequence
  Description of Artificial Sequence: Synthetic peptide
  Seed: MLLPCHWVL (MAGC3_HUMAN)
MYLPCHWVW

SEQ ID NO: 105834 - protein, 10 aa, Artificial Sequence
  Description of Artificial Sequence: Synthetic peptide
  Seed: LDSCSSPLLW (MAGC3_HUMAN)
LISCSSPLLW

SEQ ID NO: 105835 - protein, 9 aa, Artificial Sequence
  Description of Artificial Sequence: Synthetic peptide
  Seed: MPAAGMPPL (MAGC3_HUMAN)
MPAAGMPPM

SEQ ID NO: 105836 - protein, 10 aa, Artificial Sequence
  Description of Artificial Sequence: Synthetic peptide
  Seed: MDPDNHSYFF (MAGC3_HUMAN)
MSPDNHSYFF

SEQ ID NO: 105837 - protein, 9 aa, Artificial Sequence
  Description of Artificial Sequence: Synthetic peptide
  Seed: ISPQGPPQS (MAGC3_HUMAN)
ISPQGPPQI

SEQ ID NO: 105838 - protein, 9 aa, Artificial Sequence
  Description of Artificial Sequence: Synthetic peptide
  Seed: SLVLCPTYF (MAGC3_HUMAN)
SQVLCPTYW

SEQ ID NO: 105839 - protein, 10 aa, Artificial Sequence
  Description of Artificial Sequence: Synthetic peptide
  Seed: MNVINTYTGY (MAGC3_HUMAN)
MGVINTYTGF

SEQ ID NO: 105840 - protein, 11 aa, Artificial Sequence
  Description of Artificial Sequence: Synthetic peptide
  Seed: RTLSGSPGLQL (MAGC3_HUMAN)
RALSGSPGLQK

SEQ ID NO: 105841 - protein, 10 aa, Artificial Sequence
  Description of Artificial Sequence: Synthetic peptide
  Seed: MQMNVINTYT (MAGC3_HUMAN)
MNMNVINTYF

SEQ ID NO: 105842 - protein, 9 aa, Artificial Sequence
  Description of Artificial Sequence: Synthetic peptide
  Seed: NAIGPWSAL (MAGC3_HUMAN)
NKIGPWSAY

SEQ ID NO: 105843 - protein, 9 aa, Artificial Sequence
  Description of Artificial Sequence: Synthetic peptide
  Seed: SQPEGKFSL (MAGC3_HUMAN)
SLPEGKFSM

SEQ ID NO: 105844 - protein, 9 aa, Artificial Sequence
  Description of Artificial Sequence: Synthetic peptide
  Seed: ALDEKVAEL (MAGC3_HUMAN)
ATDEKVAEC

SEQ ID NO: 105845 - protein, 9 aa, Artificial Sequence
  Description of Artificial Sequence: Synthetic peptide
  Seed: TKAEMLTTV (MAGC3_HUMAN)
THAEMLTTC

SEQ ID NO: 105846 - protein, 9 aa, Artificial Sequence
  Description of Artificial Sequence: Synthetic peptide
  Seed: VIWEVLNAI (MAGC3_HUMAN)
VLWEVLNAY

SEQ ID NO: 105847 - protein, 10 aa, Artificial Sequence
  Description of Artificial Sequence: Synthetic peptide
  Seed: SDQRMDSLVL (MAGC3_HUMAN)
SNQRMDSLVY

SEQ ID NO: 105848 - protein, 9 aa, Artificial Sequence
  Description of Artificial Sequence: Synthetic peptide
  Seed: ATDKDYSAF (MAGC3_HUMAN)
ASDKDYSAI

SEQ ID NO: 105849 - protein, 8 aa, Artificial Sequence
  Description of Artificial Sequence: Synthetic peptide
  Seed: KDYSAFHL (MAGC3_HUMAN)
KQYSAFHI

SEQ ID NO: 105850 - protein, 10 aa, Artificial Sequence
  Description of Artificial Sequence: Synthetic peptide
  Seed: EVIWEVLNAI (MAGC3_HUMAN)
EAIWEVLNAV

SEQ ID NO: 105851 - protein, 11 aa, Artificial Sequence
  Description of Artificial Sequence: Synthetic peptide
  Seed: MQMNVINTYTG (MAGC3_HUMAN)
MKMNVINTYTM

SEQ ID NO: 105852 - protein, 9 aa, Artificial Sequence
  Description of Artificial Sequence: Synthetic peptide
  Seed: TLDEKVDKL (MAGC3_HUMAN)
TGDEKVDKI

SEQ ID NO: 105853 - protein, 10 aa, Artificial Sequence
  Description of Artificial Sequence: Synthetic peptide
  Seed: RMDSLVLCPT (MAGC3_HUMAN)
RLDSLVLCPV

SEQ ID NO: 105854 - protein, 9 aa, Artificial Sequence
  Description of Artificial Sequence: Synthetic peptide
  Seed: WYMDALKDM (MAGC3_HUMAN)
WWMDALKDM

SEQ ID NO: 105855 - protein, 9 aa, Artificial Sequence
  Description of Artificial Sequence: Synthetic peptide
  Seed: AMASASPSV (MAGC3_HUMAN)
ALASASPSF

SEQ ID NO: 105856 - protein, 9 aa, Artificial Sequence
  Description of Artificial Sequence: Synthetic peptide
  Seed: VPEEVIWEV (MAGC3_HUMAN)
VAEEVIWEM

SEQ ID NO: 105857 - protein, 9 aa, Artificial Sequence
  Description of Artificial Sequence: Synthetic peptide
  Seed: WRRGTGYTL (MAGC3_HUMAN)
WYRGTGYTV

SEQ ID NO: 105858 - protein, 11 aa, Artificial Sequence
  Description of Artificial Sequence: Synthetic peptide
  Seed: KVAELVQFLLL (MAGC3_HUMAN)
KMAELVQFLLH

SEQ ID NO: 105859 - protein, 11 aa, Artificial Sequence
  Description of Artificial Sequence: Synthetic peptide
  Seed: MQMNVINTYTG (MAGC3_HUMAN)
MMMNVINTYTM

SEQ ID NO: 105860 - protein, 10 aa, Artificial Sequence
  Description of Artificial Sequence: Synthetic peptide
  Seed: VTKAEMLTTV (MAGC3_HUMAN)
VIKAEMLTTV

SEQ ID NO: 105861 - protein, 10 aa, Artificial Sequence
  Description of Artificial Sequence: Synthetic peptide
  Seed: LLKYQAKEPL (MAGC3_HUMAN)
LCKYQAKEPF

SEQ ID NO: 105862 - protein, 8 aa, Artificial Sequence
  Description of Artificial Sequence: Synthetic peptide
  Seed: TTDDATAM (MAGC3_HUMAN)
TSDDATAF

SEQ ID NO: 105863 - protein, 11 aa, Artificial Sequence
  Description of Artificial Sequence: Synthetic peptide
  Seed: LIDDQGMPKNC (MAGC3_HUMAN)
LADDQGMPKNV

SEQ ID NO: 105864 - protein, 11 aa, Artificial Sequence
  Description of Artificial Sequence: Synthetic peptide
  Seed: IIDTTDDATAM (MAGC3_HUMAN)
IIDTTDDATAV

SEQ ID NO: 105865 - protein, 9 aa, Artificial Sequence
  Description of Artificial Sequence: Synthetic peptide
  Seed: PLPQSPPEI (MAGC3_HUMAN)
PIPQSPPEL

SEQ ID NO: 105866 - protein, 9 aa, Artificial Sequence
  Description of Artificial Sequence: Synthetic peptide
  Seed: SAFHLGHLR (MAGC3_HUMAN)
SWFHLGHLR

SEQ ID NO: 105867 - protein, 9 aa, Artificial Sequence
  Description of Artificial Sequence: Synthetic peptide
  Seed: ALSPVVLPP (MAGC3_HUMAN)
AMSPVVLPT

SEQ ID NO: 105868 - protein, 9 aa, Artificial Sequence
  Description of Artificial Sequence: Synthetic peptide
  Seed: VDPDHFYVF (MAGC3_HUMAN)
VMPDHFYVL

SEQ ID NO: 105869 - protein, 9 aa, Artificial Sequence
  Description of Artificial Sequence: Synthetic peptide
  Seed: ASEEVIWEV (MAGC3_HUMAN)
AMEEVIWEM

SEQ ID NO: 105870 - protein, 10 aa, Artificial Sequence
  Description of Artificial Sequence: Synthetic peptide
  Seed: IELIFGIALT (MAGC3_HUMAN)
IELIFGIALI

SEQ ID NO: 105871 - protein, 9 aa, Artificial Sequence
  Description of Artificial Sequence: Synthetic peptide
  Seed: YQAKEPLTR (MAGC3_HUMAN)
YLAKEPLTL

SEQ ID NO: 105872 - protein, 10 aa, Artificial Sequence
  Description of Artificial Sequence: Synthetic peptide
  Seed: EVIWEVLSAI (MAGC3_HUMAN)
EIIWEVLSAA

SEQ ID NO: 105873 - protein, 9 aa, Artificial Sequence
  Description of Artificial Sequence: Synthetic peptide
  Seed: MIFGKAHEF (MAGC3_HUMAN)
MFFGKAHEY

SEQ ID NO: 105874 - protein, 10 aa, Artificial Sequence
  Description of Artificial Sequence: Synthetic peptide
  Seed: EVIWEVLSAI (MAGC3_HUMAN)
EVIWEVLSAF

SEQ ID NO: 105875 - protein, 9 aa, Artificial Sequence
  Description of Artificial Sequence: Synthetic peptide
  Seed: TAMASASPS (MAGC3_HUMAN)
TLMASASPM

SEQ ID NO: 105876 - protein, 9 aa, Artificial Sequence
  Description of Artificial Sequence: Synthetic peptide
  Seed: DEKVAELVQ (MAGC3_HUMAN)
DEKVAELVM

SEQ ID NO: 105877 - protein, 9 aa, Artificial Sequence
  Description of Artificial Sequence: Synthetic peptide
  Seed: NVINTYTGY (MAGC3_HUMAN)
NIINTYTGF

SEQ ID NO: 105878 - protein, 10 aa, Artificial Sequence
  Description of Artificial Sequence: Synthetic peptide
  Seed: SYFFEDTLDL (MAGC3_HUMAN)
SFFFEDTLDF

SEQ ID NO: 105879 - protein, 9 aa, Artificial Sequence
  Description of Artificial Sequence: Synthetic peptide
  Seed: RGTGYTLSL (MAGC3_HUMAN)
RATGYTLSM

SEQ ID NO: 105880 - protein, 11 aa, Artificial Sequence
  Description of Artificial Sequence: Synthetic peptide
  Seed: TTDDATAMASA (MAGC3_HUMAN)
TCDDATAMASM

SEQ ID NO: 105881 - protein, 11 aa, Artificial Sequence
  Description of Artificial Sequence: Synthetic peptide
  Seed: FIKGSCVPEEV (MAGC3_HUMAN)
FLKGSCVPEEL

SEQ ID NO: 105882 - protein, 9 aa, Artificial Sequence
  Description of Artificial Sequence: Synthetic peptide
  Seed: MASASPSVM (MAGC3_HUMAN)
MLSASPSVL

SEQ ID NO: 105883 - protein, 11 aa, Artificial Sequence
  Description of Artificial Sequence: Synthetic peptide
  Seed: LSKLSSIIPSA (MAGC3_HUMAN)
LTKLSSIIPSI

SEQ ID NO: 105884 - protein, 10 aa, Artificial Sequence
  Description of Artificial Sequence: Synthetic peptide
  Seed: TAMASASPSV (MAGC3_HUMAN)
TEMASASPSV

SEQ ID NO: 105885 - protein, 11 aa, Artificial Sequence
  Description of Artificial Sequence: Synthetic peptide
  Seed: ATAMASASPSV (MAGC3_HUMAN)
AQAMASASPSV

SEQ ID NO: 105886 - protein, 9 aa, Artificial Sequence
  Description of Artificial Sequence: Synthetic peptide
  Seed: LVQFLLLKY (MAGC3_HUMAN)
LQQFLLLKF

SEQ ID NO: 105887 - protein, 10 aa, Artificial Sequence
  Description of Artificial Sequence: Synthetic peptide
  Seed: IPSAFPSWYM (MAGC3_HUMAN)
IWSAFPSWYF

SEQ ID NO: 105888 - protein, 9 aa, Artificial Sequence
  Description of Artificial Sequence: Synthetic peptide
  Seed: EVLEFLSKL (MAGC3_HUMAN)
ETLEFLSKF

SEQ ID NO: 105889 - protein, 9 aa, Artificial Sequence
  Description of Artificial Sequence: Synthetic peptide
  Seed: NAIGPWSAL (MAGC3_HUMAN)
NPIGPWSAT

SEQ ID NO: 105890 - protein, 9 aa, Artificial Sequence
  Description of Artificial Sequence: Synthetic peptide
  Seed: EVLNAIGPW (MAGC3_HUMAN)
EILNAIGPM

SEQ ID NO: 105891 - protein, 9 aa, Artificial Sequence
  Description of Artificial Sequence: Synthetic peptide
  Seed: SAFHLGHLR (MAGC3_HUMAN)
SIFHLGHLK

SEQ ID NO: 105892 - protein, 10 aa, Artificial Sequence
  Description of Artificial Sequence: Synthetic peptide
  Seed: ALDEKVAELV (MAGC3_HUMAN)
ATDEKVAELF

SEQ ID NO: 105893 - protein, 10 aa, Artificial Sequence
  Description of Artificial Sequence: Synthetic peptide
  Seed: KLSSIIPSAF (MAGC3_HUMAN)
KISSIIPSAI

SEQ ID NO: 105894 - protein, 9 aa, Artificial Sequence
  Description of Artificial Sequence: Synthetic peptide
  Seed: AMASASPSV (MAGC3_HUMAN)
AHASASPSY

SEQ ID NO: 105895 - protein, 10 aa, Artificial Sequence
  Description of Artificial Sequence: Synthetic peptide
  Seed: KLSSIIPSAF (MAGC3_HUMAN)
KKSSIIPSAF

SEQ ID NO: 105896 - protein, 9 aa, Artificial Sequence
  Description of Artificial Sequence: Synthetic peptide
  Seed: NVINTYTGY (MAGC3_HUMAN)
NKINTYTGF

SEQ ID NO: 105897 - protein, 9 aa, Artificial Sequence
  Description of Artificial Sequence: Synthetic peptide
  Seed: NTYTGYFPM (MAGC3_HUMAN)
NNYTGYFPK

SEQ ID NO: 105898 - protein, 9 aa, Artificial Sequence
  Description of Artificial Sequence: Synthetic peptide
  Seed: WRRGTGYTL (MAGC3_HUMAN)
WLRGTGYTY

SEQ ID NO: 105899 - protein, 10 aa, Artificial Sequence
  Description of Artificial Sequence: Synthetic peptide
  Seed: TGYFPMIFRK (MAGC3_HUMAN)
TNYFPMIFRR

SEQ ID NO: 105900 - protein, 9 aa, Artificial Sequence
  Description of Artificial Sequence: Synthetic peptide
  Seed: LSDEQGMPQ (MAGC3_HUMAN)
LTDEQGMPY

SEQ ID NO: 105901 - protein, 10 aa, Artificial Sequence
  Description of Artificial Sequence: Synthetic peptide
  Seed: KDSDLPTWRR (MAGC3_HUMAN)
KISDLPTWRR

SEQ ID NO: 105902 - protein, 9 aa, Artificial Sequence
  Description of Artificial Sequence: Synthetic peptide
  Seed: TRAEMQMNV (MAGC3_HUMAN)
THAEMQMNL

SEQ ID NO: 105903 - protein, 9 aa, Artificial Sequence
  Description of Artificial Sequence: Synthetic peptide
  Seed: LTTVIKKYK (MAGC3_HUMAN)
LMTVIKKYR

SEQ ID NO: 105904 - protein, 10 aa, Artificial Sequence
  Description of Artificial Sequence: Synthetic peptide
  Seed: SIIPSAFPSW (MAGC3_HUMAN)
SYIPSAFPSI

SEQ ID NO: 105905 - protein, 9 aa, Artificial Sequence
  Description of Artificial Sequence: Synthetic peptide
  Seed: MIFIKGSCV (MAGC3_HUMAN)
MIFIKGSCL

SEQ ID NO: 105906 - protein, 9 aa, Artificial Sequence
  Description of Artificial Sequence: Synthetic peptide
  Seed: YQAKEPLTR (MAGC3_HUMAN)
YTAKEPLTR

SEQ ID NO: 105907 - protein, 10 aa, Artificial Sequence
  Description of Artificial Sequence: Synthetic peptide
  Seed: KYKDYFPMIF (MAGC3_HUMAN)
KIKDYFPMIY

SEQ ID NO: 105908 - protein, 9 aa, Artificial Sequence
  Description of Artificial Sequence: Synthetic peptide
  Seed: HLREVRLFL (MAGC3_HUMAN)
HQREVRLFF

SEQ ID NO: 105909 - protein, 9 aa, Artificial Sequence
  Description of Artificial Sequence: Synthetic peptide
  Seed: SLPAVSPGK (MAGC3_HUMAN)
SAPAVSPGK

SEQ ID NO: 105910 - protein, 11 aa, Artificial Sequence
  Description of Artificial Sequence: Synthetic peptide
  Seed: YFFEDTLDLTY (MAGC3_HUMAN)
YRFEDTLDLTL

SEQ ID NO: 105911 - protein, 9 aa, Artificial Sequence
  Description of Artificial Sequence: Synthetic peptide
  Seed: YALDEKVAE (MAGC3_HUMAN)
YSLDEKVAH

SEQ ID NO: 105912 - protein, 9 aa, Artificial Sequence
  Description of Artificial Sequence: Synthetic peptide
  Seed: LILSVIFIK (MAGC3_HUMAN)
LYLSVIFIR

SEQ ID NO: 105913 - protein, 10 aa, Artificial Sequence
  Description of Artificial Sequence: Synthetic peptide
  Seed: FSDGSLGQWV (MAGC3_HUMAN)
FLDGSLGQWY

SEQ ID NO: 105914 - protein, 9 aa, Artificial Sequence
  Description of Artificial Sequence: Synthetic peptide
  Seed: VIWEVLNAI (MAGC3_HUMAN)
VLWEVLNAC

SEQ ID NO: 105915 - protein, 9 aa, Artificial Sequence
  Description of Artificial Sequence: Synthetic peptide
  Seed: IIPSAFPSW (MAGC3_HUMAN)
ITPSAFPSW

SEQ ID NO: 105916 - protein, 9 aa, Artificial Sequence
  Description of Artificial Sequence: Synthetic peptide
  Seed: YKDYFPMIF (MAGC3_HUMAN)
YADYFPMIL

SEQ ID NO: 105917 - protein, 10 aa, Artificial Sequence
  Description of Artificial Sequence: Synthetic peptide
  Seed: NTYTGYFPMI (MAGC3_HUMAN)
NYYTGYFPMW

SEQ ID NO: 105918 - protein, 10 aa, Artificial Sequence
  Description of Artificial Sequence: Synthetic peptide
  Seed: VLDLANPQGL (MAGC3_HUMAN)
VFDLANPQGF

SEQ ID NO: 105919 - protein, 8 aa, Artificial Sequence
  Description of Artificial Sequence: Synthetic peptide
  Seed: YMDALKDM (MAGC3_HUMAN)
YFDALKDI

SEQ ID NO: 105920 - protein, 9 aa, Artificial Sequence
  Description of Artificial Sequence: Synthetic peptide
  Seed: YTGYFPMIF (MAGC3_HUMAN)
YAGYFPMIF

SEQ ID NO: 105921 - protein, 10 aa, Artificial Sequence
  Description of Artificial Sequence: Synthetic peptide
  Seed: MNVINTYTGY (MAGC3_HUMAN)
MCVINTYTGK

SEQ ID NO: 105922 - protein, 9 aa, Artificial Sequence
  Description of Artificial Sequence: Synthetic peptide
  Seed: LSGSPGLQL (MAGC3_HUMAN)
LLGSPGLQY

SEQ ID NO: 105923 - protein, 9 aa, Artificial Sequence
  Description of Artificial Sequence: Synthetic peptide
  Seed: MIFGKAHEF (MAGC3_HUMAN)
MVFGKAHEK

SEQ ID NO: 105924 - protein, 9 aa, Artificial Sequence
  Description of Artificial Sequence: Synthetic peptide
  Seed: ATDKDYSAF (MAGC3_HUMAN)
AQDKDYSAY

SEQ ID NO: 105925 - protein, 10 aa, Artificial Sequence
  Description of Artificial Sequence: Synthetic peptide
  Seed: IIPSAFPSWY (MAGC3_HUMAN)
IQPSAFPSWY

SEQ ID NO: 105926 - protein, 9 aa, Artificial Sequence
  Description of Artificial Sequence: Synthetic peptide
  Seed: AIIDTTDDA (MAGC3_HUMAN)
ALIDTTDDV

SEQ ID NO: 105927 - protein, 9 aa, Artificial Sequence
  Description of Artificial Sequence: Synthetic peptide
  Seed: DMDPDNHSY (MAGC3_HUMAN)
DVDPDNHSY

SEQ ID NO: 105928 - protein, 9 aa, Artificial Sequence
  Description of Artificial Sequence: Synthetic peptide
  Seed: DTTDDATAM (MAGC3_HUMAN)
DMTDDATAY

SEQ ID NO: 105929 - protein, 9 aa, Artificial Sequence
  Description of Artificial Sequence: Synthetic peptide
  Seed: ILILSVIFI (MAGC3_HUMAN)
ILILSVIFV

SEQ ID NO: 105930 - protein, 9 aa, Artificial Sequence
  Description of Artificial Sequence: Synthetic peptide
  Seed: AGFADVLSR (MAGC3_HUMAN)
AFFADVLSR

SEQ ID NO: 105931 - protein, 9 aa, Artificial Sequence
  Description of Artificial Sequence: Synthetic peptide
  Seed: AIIDTTDDA (MAGC3_HUMAN)
AMIDTTDDA

SEQ ID NO: 105932 - protein, 9 aa, Artificial Sequence
  Description of Artificial Sequence: Synthetic peptide
  Seed: MQMNVINTY (MAGC3_HUMAN)
MKMNVINTH

SEQ ID NO: 105933 - protein, 9 aa, Artificial Sequence
  Description of Artificial Sequence: Synthetic peptide
  Seed: YALSPVVLP (MAGC3_HUMAN)
YGLSPVVLF

SEQ ID NO: 105934 - protein, 9 aa, Artificial Sequence
  Description of Artificial Sequence: Synthetic peptide
  Seed: EVLNAIGPW (MAGC3_HUMAN)
EILNAIGPK

SEQ ID NO: 105935 - protein, 9 aa, Artificial Sequence
  Description of Artificial Sequence: Synthetic peptide
  Seed: HSYFFEDTL (MAGC3_HUMAN)
HKYFFEDTY

SEQ ID NO: 105936 - protein, 11 aa, Artificial Sequence
  Description of Artificial Sequence: Synthetic peptide
  Seed: SSSEEEDTATW (MAGC3_HUMAN)
SQSEEEDTATM

SEQ ID NO: 105937 - protein, 9 aa, Artificial Sequence
  Description of Artificial Sequence: Synthetic peptide
  Seed: MQMNVINTY (MAGC3_HUMAN)
MEMNVINTW

SEQ ID NO: 105938 - protein, 9 aa, Artificial Sequence
  Description of Artificial Sequence: Synthetic peptide
  Seed: ALDEKVAEL (MAGC3_HUMAN)
AEDEKVAEI

SEQ ID NO: 105939 - protein, 9 aa, Artificial Sequence
  Description of Artificial Sequence: Synthetic peptide
  Seed: ILILSMIFI (MAGC3_HUMAN)
IMILSMIFL

SEQ ID NO: 105940 - protein, 10 aa, Artificial Sequence
  Description of Artificial Sequence: Synthetic peptide
  Seed: IKKYKDYFPM (MAGC3_HUMAN)
INKYKDYFPF

SEQ ID NO: 105941 - protein, 9 aa, Artificial Sequence
  Description of Artificial Sequence: Synthetic peptide
  Seed: FADVLSRLA (MAGC3_HUMAN)
FIDVLSRLL

SEQ ID NO: 105942 - protein, 9 aa, Artificial Sequence
  Description of Artificial Sequence: Synthetic peptide
  Seed: MIFGKAHEF (MAGC3_HUMAN)
MQFGKAHEY

SEQ ID NO: 105943 - protein, 9 aa, Artificial Sequence
  Description of Artificial Sequence: Synthetic peptide
  Seed: LCPTYFKLW (MAGC3_HUMAN)
LAPTYFKLW

SEQ ID NO: 105944 - protein, 9 aa, Artificial Sequence
  Description of Artificial Sequence: Synthetic peptide
  Seed: FSLRRAVSV (MAGC3_HUMAN)
FRLRRAVSY

SEQ ID NO: 105945 - protein, 9 aa, Artificial Sequence
  Description of Artificial Sequence: Synthetic peptide
  Seed: SASPSVMST (MAGC3_HUMAN)
SMSPSVMSF

SEQ ID NO: 105946 - protein, 9 aa, Artificial Sequence
  Description of Artificial Sequence: Synthetic peptide
  Seed: MDPDNHSYF (MAGC3_HUMAN)
MAPDNHSYI

SEQ ID NO: 105947 - protein, 11 aa, Artificial Sequence
  Description of Artificial Sequence: Synthetic peptide
  Seed: TDMDPDNHSYF (MAGC3_HUMAN)
TEMDPDNHSYL

SEQ ID NO: 105948 - protein, 10 aa, Artificial Sequence
  Description of Artificial Sequence: Synthetic peptide
  Seed: FKLWRTLSGS (MAGC3_HUMAN)
FCLWRTLSGL

SEQ ID NO: 105949 - protein, 9 aa, Artificial Sequence
  Description of Artificial Sequence: Synthetic peptide
  Seed: FLSKLSSII (MAGC3_HUMAN)
FHSKLSSIY

SEQ ID NO: 105950 - protein, 10 aa, Artificial Sequence
  Description of Artificial Sequence: Synthetic peptide
  Seed: SDQRMDSLVL (MAGC3_HUMAN)
SPQRMDSLVF

SEQ ID NO: 105951 - protein, 11 aa, Artificial Sequence
  Description of Artificial Sequence: Synthetic peptide
  Seed: TTDDATAMASA (MAGC3_HUMAN)
TQDDATAMASY

SEQ ID NO: 105952 - protein, 10 aa, Artificial Sequence
  Description of Artificial Sequence: Synthetic peptide
  Seed: SWYMDALKDM (MAGC3_HUMAN)
SCYMDALKDF

SEQ ID NO: 105953 - protein, 9 aa, Artificial Sequence
  Description of Artificial Sequence: Synthetic peptide
  Seed: MEDRAQAII (MAGC3_HUMAN)
MIDRAQAIV

SEQ ID NO: 105954 - protein, 10 aa, Artificial Sequence
  Description of Artificial Sequence: Synthetic peptide
  Seed: EKVAELVQFL (MAGC3_HUMAN)
EFVAELVQFL

SEQ ID NO: 105955 - protein, 8 aa, Artificial Sequence
  Description of Artificial Sequence: Synthetic peptide
  Seed: AEMLTTVI (MAGC3_HUMAN)
AEMLTTVW

SEQ ID NO: 105956 - protein, 9 aa, Artificial Sequence
  Description of Artificial Sequence: Synthetic peptide
  Seed: MLLPCHWVL (MAGC3_HUMAN)
MVLPCHWVA

SEQ ID NO: 105957 - protein, 10 aa, Artificial Sequence
  Description of Artificial Sequence: Synthetic peptide
  Seed: IIDTTDDATA (MAGC3_HUMAN)
IIDTTDDATI

SEQ ID NO: 105958 - protein, 10 aa, Artificial Sequence
  Description of Artificial Sequence: Synthetic peptide
  Seed: TGYFPMIFRK (MAGC3_HUMAN)
TVYFPMIFRN

SEQ ID NO: 105959 - protein, 9 aa, Artificial Sequence
  Description of Artificial Sequence: Synthetic peptide
  Seed: ALDEKVAEL (MAGC3_HUMAN)
AVDEKVAEF

SEQ ID NO: 105960 - protein, 10 aa, Artificial Sequence
  Description of Artificial Sequence: Synthetic peptide
  Seed: IIDTTDDATA (MAGC3_HUMAN)
ISDTTDDATM

SEQ ID NO: 105961 - protein, 9 aa, Artificial Sequence
  Description of Artificial Sequence: Synthetic peptide
  Seed: KLSSIIPSA (MAGC3_HUMAN)
KSSSIIPSK

SEQ ID NO: 105962 - protein, 9 aa, Artificial Sequence
  Description of Artificial Sequence: Synthetic peptide
  Seed: SASPSVMST (MAGC3_HUMAN)
SFSPSVMSY

SEQ ID NO: 105963 - protein, 9 aa, Artificial Sequence
  Description of Artificial Sequence: Synthetic peptide
  Seed: RGTGYTLSL (MAGC3_HUMAN)
RNTGYTLSY

SEQ ID NO: 105964 - protein, 11 aa, Artificial Sequence
  Description of Artificial Sequence: Synthetic peptide
  Seed: VINTYTGYFPM (MAGC3_HUMAN)
VSNTYTGYFPY

SEQ ID NO: 105965 - protein, 9 aa, Artificial Sequence
  Description of Artificial Sequence: Synthetic peptide
  Seed: YQTKEPVTK (MAGC3_HUMAN)
YITKEPVTL

SEQ ID NO: 105966 - protein, 11 aa, Artificial Sequence
  Description of Artificial Sequence: Synthetic peptide
  Seed: SVLDLANPQGL (MAGC3_HUMAN)
SMLDLANPQGL

SEQ ID NO: 105967 - protein, 10 aa, Artificial Sequence
  Description of Artificial Sequence: Synthetic peptide
  Seed: MDPDNHSYFF (MAGC3_HUMAN)
MLPDNHSYFW

SEQ ID NO: 105968 - protein, 10 aa, Artificial Sequence
  Description of Artificial Sequence: Synthetic peptide
  Seed: KATDKDYSAF (MAGC3_HUMAN)
KQTDKDYSAF

SEQ ID NO: 105969 - protein, 10 aa, Artificial Sequence
  Description of Artificial Sequence: Synthetic peptide
  Seed: NTYTGYFPMI (MAGC3_HUMAN)
NSYTGYFPMV

SEQ ID NO: 105970 - protein, 10 aa, Artificial Sequence
  Description of Artificial Sequence: Synthetic peptide
  Seed: SLVLCPTYFK (MAGC3_HUMAN)
SGVLCPTYFK

SEQ ID NO: 105971 - protein, 9 aa, Artificial Sequence
  Description of Artificial Sequence: Synthetic peptide
  Seed: DYSAFHLGH (MAGC3_HUMAN)
DSSAFHLGR

SEQ ID NO: 105972 - protein, 9 aa, Artificial Sequence
  Description of Artificial Sequence: Synthetic peptide
  Seed: EVLEFLSKL (MAGC3_HUMAN)
EQLEFLSKV

SEQ ID NO: 105973 - protein, 9 aa, Artificial Sequence
  Description of Artificial Sequence: Synthetic peptide
  Seed: RTLSGSPGL (MAGC3_HUMAN)
RMLSGSPGF

SEQ ID NO: 105974 - protein, 10 aa, Artificial Sequence
  Description of Artificial Sequence: Synthetic peptide
  Seed: SALAGFADVL (MAGC3_HUMAN)
SYLAGFADVL

SEQ ID NO: 105975 - protein, 9 aa, Artificial Sequence
  Description of Artificial Sequence: Synthetic peptide
  Seed: VIWEVLNAI (MAGC3_HUMAN)
VTWEVLNAK

SEQ ID NO: 105976 - protein, 9 aa, Artificial Sequence
  Description of Artificial Sequence: Synthetic peptide
  Seed: FLSKLSSII (MAGC3_HUMAN)
FVSKLSSIA

SEQ ID NO: 105977 - protein, 9 aa, Artificial Sequence
  Description of Artificial Sequence: Synthetic peptide
  Seed: AIIDTTDDA (MAGC3_HUMAN)
ALIDTTDDI

SEQ ID NO: 105978 - protein, 11 aa, Artificial Sequence
  Description of Artificial Sequence: Synthetic peptide
  Seed: INTYTGYFPMI (MAGC3_HUMAN)
IETYTGYFPMF

SEQ ID NO: 105979 - protein, 11 aa, Artificial Sequence
  Description of Artificial Sequence: Synthetic peptide
  Seed: ATDKDYSAFHL (MAGC3_HUMAN)
AIDKDYSAFHY

SEQ ID NO: 105980 - protein, 11 aa, Artificial Sequence
  Description of Artificial Sequence: Synthetic peptide
  Seed: TYTGYFPMIFR (MAGC3_HUMAN)
TKTGYFPMIFR

SEQ ID NO: 105981 - protein, 8 aa, Artificial Sequence
  Description of Artificial Sequence: Synthetic peptide
  Seed: MEDRAQAI (MAGC3_HUMAN)
MQDRAQAL

SEQ ID NO: 105982 - protein, 9 aa, Artificial Sequence
  Description of Artificial Sequence: Synthetic peptide
  Seed: VIWEVLSAI (MAGC3_HUMAN)
VSWEVLSAI

SEQ ID NO: 105983 - protein, 9 aa, Artificial Sequence
  Description of Artificial Sequence: Synthetic peptide
  Seed: LSSIIPSAF (MAGC3_HUMAN)
LASIIPSAF

SEQ ID NO: 105984 - protein, 9 aa, Artificial Sequence
  Description of Artificial Sequence: Synthetic peptide
  Seed: FSLRRAVSV (MAGC3_HUMAN)
FILRRAVSI

SEQ ID NO: 105985 - protein, 9 aa, Artificial Sequence
  Description of Artificial Sequence: Synthetic peptide
  Seed: KLSSIIPSA (MAGC3_HUMAN)
KVSSIIPSM

SEQ ID NO: 105986 - protein, 9 aa, Artificial Sequence
  Description of Artificial Sequence: Synthetic peptide
  Seed: MASASPSVM (MAGC3_HUMAN)
MKSASPSVW

SEQ ID NO: 105987 - protein, 10 aa, Artificial Sequence
  Description of Artificial Sequence: Synthetic peptide
  Seed: AELVQFLLLK (MAGC3_HUMAN)
ASLVQFLLLK

SEQ ID NO: 105988 - protein, 10 aa, Artificial Sequence
  Description of Artificial Sequence: Synthetic peptide
  Seed: LDLANPQGLA (MAGC3_HUMAN)
LCLANPQGLV

SEQ ID NO: 105989 - protein, 9 aa, Artificial Sequence
  Description of Artificial Sequence: Synthetic peptide
  Seed: MLTTVIKKY (MAGC3_HUMAN)
MTTTVIKKF

SEQ ID NO: 105990 - protein, 10 aa, Artificial Sequence
  Description of Artificial Sequence: Synthetic peptide
  Seed: LVLCPTYFKL (MAGC3_HUMAN)
LLLCPTYFKI

SEQ ID NO: 105991 - protein, 9 aa, Artificial Sequence
  Description of Artificial Sequence: Synthetic peptide
  Seed: YSAFHLGHL (MAGC3_HUMAN)
YEAFHLGHF

SEQ ID NO: 105992 - protein, 9 aa, Artificial Sequence
  Description of Artificial Sequence: Synthetic peptide
  Seed: MIFIKGSCV (MAGC3_HUMAN)
MLFIKGSCA

SEQ ID NO: 105993 - protein, 10 aa, Artificial Sequence
  Description of Artificial Sequence: Synthetic peptide
  Seed: KVDKLVQFLL (MAGC3_HUMAN)
KSDKLVQFLW

SEQ ID NO: 105994 - protein, 10 aa, Artificial Sequence
  Description of Artificial Sequence: Synthetic peptide
  Seed: ALDEKVAELV (MAGC3_HUMAN)
AQDEKVAELW

SEQ ID NO: 105995 - protein, 9 aa, Artificial Sequence
  Description of Artificial Sequence: Synthetic peptide
  Seed: MLTTVIKKY (MAGC3_HUMAN)
MITTVIKKY

SEQ ID NO: 105996 - protein, 9 aa, Artificial Sequence
  Description of Artificial Sequence: Synthetic peptide
  Seed: LIDDQGMPK (MAGC3_HUMAN)
LVDDQGMPY

SEQ ID NO: 105997 - protein, 9 aa, Artificial Sequence
  Description of Artificial Sequence: Synthetic peptide
  Seed: GFADVLSRL (MAGC3_HUMAN)
GAADVLSRV

SEQ ID NO: 105998 - protein, 11 aa, Artificial Sequence
  Description of Artificial Sequence: Synthetic peptide
  Seed: RYALDEKVAEL (MAGC3_HUMAN)
RIALDEKVAEV

SEQ ID NO: 105999 - protein, 10 aa, Artificial Sequence
  Description of Artificial Sequence: Synthetic peptide
  Seed: TGYFPMIFRK (MAGC3_HUMAN)
TTYFPMIFRM

SEQ ID NO: 106000 - protein, 9 aa, Artificial Sequence
  Description of Artificial Sequence: Synthetic peptide
  Seed: LSRLALWES (MAGC3_HUMAN)
LVRLALWEK

SEQ ID NO: 106001 - protein, 9 aa, Artificial Sequence
  Description of Artificial Sequence: Synthetic peptide
  Seed: TEVDPDHFY (MAGC3_HUMAN)
TEVDPDHFV

SEQ ID NO: 106002 - protein, 10 aa, Artificial Sequence
  Description of Artificial Sequence: Synthetic peptide
  Seed: LNAIGPWSAL (MAGC3_HUMAN)
LNAIGPWSAY

SEQ ID NO: 106003 - protein, 10 aa, Artificial Sequence
  Description of Artificial Sequence: Synthetic peptide
  Seed: SKLSSIIPSA (MAGC3_HUMAN)
SILSSIIPSV

SEQ ID NO: 106004 - protein, 9 aa, Artificial Sequence
  Description of Artificial Sequence: Synthetic peptide
  Seed: IFGKAHEFI (MAGC3_HUMAN)
IFGKAHEFF

SEQ ID NO: 106005 - protein, 10 aa, Artificial Sequence
  Description of Artificial Sequence: Synthetic peptide
  Seed: SYFFEDTLDL (MAGC3_HUMAN)
SWFFEDTLDW

SEQ ID NO: 106006 - protein, 10 aa, Artificial Sequence
  Description of Artificial Sequence: Synthetic peptide
  Seed: FKLWRTLSGS (MAGC3_HUMAN)
FVLWRTLSGA

SEQ ID NO: 106007 - protein, 10 aa, Artificial Sequence
  Description of Artificial Sequence: Synthetic peptide
  Seed: MNVINTYTGY (MAGC3_HUMAN)
MLVINTYTGR

SEQ ID NO: 106008 - protein, 9 aa, Artificial Sequence
  Description of Artificial Sequence: Synthetic peptide
  Seed: LPQSPPEIP (MAGC3_HUMAN)
LPQSPPEIL

SEQ ID NO: 106009 - protein, 9 aa, Artificial Sequence
  Description of Artificial Sequence: Synthetic peptide
  Seed: ADVLSRLAL (MAGC3_HUMAN)
AEVLSRLAT

SEQ ID NO: 106010 - protein, 9 aa, Artificial Sequence
  Description of Artificial Sequence: Synthetic peptide
  Seed: HLREVRLFL (MAGC3_HUMAN)
HGREVRLFK

SEQ ID NO: 106011 - protein, 10 aa, Artificial Sequence
  Description of Artificial Sequence: Synthetic peptide
  Seed: RSAEGSVLDL (MAGC3_HUMAN)
RTAEGSVLDM

SEQ ID NO: 106012 - protein, 8 aa, Artificial Sequence
  Description of Artificial Sequence: Synthetic peptide
  Seed: DEKVAELV (MAGC3_HUMAN)
DEKVAELF

SEQ ID NO: 106013 - protein, 9 aa, Artificial Sequence
  Description of Artificial Sequence: Synthetic peptide
  Seed: TTDDATAMA (MAGC3_HUMAN)
TNDDATAML

SEQ ID NO: 106014 - protein, 10 aa, Artificial Sequence
  Description of Artificial Sequence: Synthetic peptide
  Seed: TEVDPDHFYV (MAGC3_HUMAN)
TTVDPDHFYV

SEQ ID NO: 106015 - protein, 9 aa, Artificial Sequence
  Description of Artificial Sequence: Synthetic peptide
  Seed: MLLPCHWVL (MAGC3_HUMAN)
MTLPCHWVA

SEQ ID NO: 106016 - protein, 8 aa, Artificial Sequence
  Description of Artificial Sequence: Synthetic peptide
  Seed: TTDDATAM (MAGC3_HUMAN)
TTDDATAL

SEQ ID NO: 106017 - protein, 9 aa, Artificial Sequence
  Description of Artificial Sequence: Synthetic peptide
  Seed: YKDYFPMIF (MAGC3_HUMAN)
YHDYFPMIF

SEQ ID NO: 106018 - protein, 10 aa, Artificial Sequence
  Description of Artificial Sequence: Synthetic peptide
  Seed: SDQRMDSLVL (MAGC3_HUMAN)
SRQRMDSLVY

SEQ ID NO: 106019 - protein, 9 aa, Artificial Sequence
  Description of Artificial Sequence: Synthetic peptide
  Seed: MEDRAQAII (MAGC3_HUMAN)
MGDRAQAIL

SEQ ID NO: 106020 - protein, 11 aa, Artificial Sequence
  Description of Artificial Sequence: Synthetic peptide
  Seed: TAMASASPSVM (MAGC3_HUMAN)
TRMASASPSVY

SEQ ID NO: 106021 - protein, 9 aa, Artificial Sequence
  Description of Artificial Sequence: Synthetic peptide
  Seed: EVLNAIGPW (MAGC3_HUMAN)
ELLNAIGPR

SEQ ID NO: 106022 - protein, 9 aa, Artificial Sequence
  Description of Artificial Sequence: Synthetic peptide
  Seed: MQMNVINTY (MAGC3_HUMAN)
MPMNVINTH

SEQ ID NO: 106023 - protein, 9 aa, Artificial Sequence
  Description of Artificial Sequence: Synthetic peptide
  Seed: YTLDEKVDK (MAGC3_HUMAN)
YSLDEKVDY

SEQ ID NO: 106024 - protein, 9 aa, Artificial Sequence
  Description of Artificial Sequence: Synthetic peptide
  Seed: KLSSIIPSA (MAGC3_HUMAN)
KVSSIIPSR

SEQ ID NO: 106025 - protein, 9 aa, Artificial Sequence
  Description of Artificial Sequence: Synthetic peptide
  Seed: VIWEVLNAI (MAGC3_HUMAN)
VIWEVLNAF

SEQ ID NO: 106026 - protein, 9 aa, Artificial Sequence
  Description of Artificial Sequence: Synthetic peptide
  Seed: GPWSALAGF (MAGC3_HUMAN)
GAWSALAGY

SEQ ID NO: 106027 - protein, 9 aa, Artificial Sequence
  Description of Artificial Sequence: Synthetic peptide
  Seed: FHLGHLREV (MAGC3_HUMAN)
FWLGHLREY

SEQ ID NO: 106028 - protein, 9 aa, Artificial Sequence
  Description of Artificial Sequence: Synthetic peptide
  Seed: LILILSVIF (MAGC3_HUMAN)
LTLILSVIW

SEQ ID NO: 106029 - protein, 10 aa, Artificial Sequence
  Description of Artificial Sequence: Synthetic peptide
  Seed: VVLPPQPQPR (MAGC3_HUMAN)
VVLPPQPQPY

SEQ ID NO: 106030 - protein, 9 aa, Artificial Sequence
  Description of Artificial Sequence: Synthetic peptide
  Seed: SVLDLANPQ (MAGC3_HUMAN)
STLDLANPR

SEQ ID NO: 106031 - protein, 11 aa, Artificial Sequence
  Description of Artificial Sequence: Synthetic peptide
  Seed: KVAELVQFLLL (MAGC3_HUMAN)
KLAELVQFLLI

SEQ ID NO: 106032 - protein, 9 aa, Artificial Sequence
  Description of Artificial Sequence: Synthetic peptide
  Seed: KFSLRRAVS (MAGC3_HUMAN)
KVSLRRAVK

SEQ ID NO: 106033 - protein, 8 aa, Artificial Sequence
  Description of Artificial Sequence: Synthetic peptide
  Seed: YMDALKDM (MAGC3_HUMAN)
YSDALKDV

SEQ ID NO: 106034 - protein, 11 aa, Artificial Sequence
  Description of Artificial Sequence: Synthetic peptide
  Seed: TSDQRMDSLVL (MAGC3_HUMAN)
TDDQRMDSLVY

SEQ ID NO: 106035 - protein, 10 aa, Artificial Sequence
  Description of Artificial Sequence: Synthetic peptide
  Seed: KKYKDYFPMI (MAGC3_HUMAN)
KYYKDYFPMK

SEQ ID NO: 106036 - protein, 10 aa, Artificial Sequence
  Description of Artificial Sequence: Synthetic peptide
  Seed: VKNTCATYAL (MAGC3_HUMAN)
VMNTCATYAF

SEQ ID NO: 106037 - protein, 9 aa, Artificial Sequence
  Description of Artificial Sequence: Synthetic peptide
  Seed: ASEEVIWEV (MAGC3_HUMAN)
ASEEVIWEI

SEQ ID NO: 106038 - protein, 10 aa, Artificial Sequence
  Description of Artificial Sequence: Synthetic peptide
  Seed: REVLEFLSKL (MAGC3_HUMAN)
RQVLEFLSKF

SEQ ID NO: 106039 - protein, 10 aa, Artificial Sequence
  Description of Artificial Sequence: Synthetic peptide
  Seed: TGYFPMIFRK (MAGC3_HUMAN)
TMYFPMIFRC

SEQ ID NO: 106040 - protein, 9 aa, Artificial Sequence
  Description of Artificial Sequence: Synthetic peptide
  Seed: KLVQFLLLK (MAGC3_HUMAN)
KVVQFLLLK

SEQ ID NO: 106041 - protein, 10 aa, Artificial Sequence
  Description of Artificial Sequence: Synthetic peptide
  Seed: SKLSSIIPSA (MAGC3_HUMAN)
SELSSIIPSV

SEQ ID NO: 106042 - protein, 9 aa, Artificial Sequence
  Description of Artificial Sequence: Synthetic peptide
  Seed: IIPSAFPSW (MAGC3_HUMAN)
IAPSAFPSF

SEQ ID NO: 106043 - protein, 10 aa, Artificial Sequence
  Description of Artificial Sequence: Synthetic peptide
  Seed: SIIPSAFPSW (MAGC3_HUMAN)
SMIPSAFPSM

SEQ ID NO: 106044 - protein, 8 aa, Artificial Sequence
  Description of Artificial Sequence: Synthetic peptide
  Seed: YMDALKDM (MAGC3_HUMAN)
YIDALKDI

SEQ ID NO: 106045 - protein, 9 aa, Artificial Sequence
  Description of Artificial Sequence: Synthetic peptide
  Seed: LPTWRRGTG (MAGC3_HUMAN)
LPTWRRGTM

SEQ ID NO: 106046 - protein, 9 aa, Artificial Sequence
  Description of Artificial Sequence: Synthetic peptide
  Seed: AMASASPSV (MAGC3_HUMAN)
AQASASPSH

SEQ ID NO: 106047 - protein, 9 aa, Artificial Sequence
  Description of Artificial Sequence: Synthetic peptide
  Seed: FSLRRAVSV (MAGC3_HUMAN)
FSLRRAVSI

SEQ ID NO: 106048 - protein, 9 aa, Artificial Sequence
  Description of Artificial Sequence: Synthetic peptide
  Seed: MIFRKAREF (MAGC3_HUMAN)
MTFRKAREF

SEQ ID NO: 106049 - protein, 10 aa, Artificial Sequence
  Description of Artificial Sequence: Synthetic peptide
  Seed: RLLILILSVI (MAGC3_HUMAN)
RMLILILSVA

SEQ ID NO: 106050 - protein, 9 aa, Artificial Sequence
  Description of Artificial Sequence: Synthetic peptide
  Seed: HLREVRLFL (MAGC3_HUMAN)
HLREVRLFY

SEQ ID NO: 106051 - protein, 9 aa, Artificial Sequence
  Description of Artificial Sequence: Synthetic peptide
  Seed: YFFEDTLDL (MAGC3_HUMAN)
YLFEDTLDF

SEQ ID NO: 106052 - protein, 10 aa, Artificial Sequence
  Description of Artificial Sequence: Synthetic peptide
  Seed: TLDEKVDKLV (MAGC3_HUMAN)
TADEKVDKLF

SEQ ID NO: 106053 - protein, 9 aa, Artificial Sequence
  Description of Artificial Sequence: Synthetic peptide
  Seed: NTYTGYFPM (MAGC3_HUMAN)
NIYTGYFPA

SEQ ID NO: 106054 - protein, 9 aa, Artificial Sequence
  Description of Artificial Sequence: Synthetic peptide
  Seed: CHWVLDATF (MAGC3_HUMAN)
CQWVLDATM

SEQ ID NO: 106055 - protein, 10 aa, Artificial Sequence
  Description of Artificial Sequence: Synthetic peptide
  Seed: TTDDATAMAS (MAGC3_HUMAN)
TQDDATAMAL

SEQ ID NO: 106056 - protein, 8 aa, Artificial Sequence
  Description of Artificial Sequence: Synthetic peptide
  Seed: IFGKAHEF (MAGC3_HUMAN)
ISGKAHEW

SEQ ID NO: 106057 - protein, 9 aa, Artificial Sequence
  Description of Artificial Sequence: Synthetic peptide
  Seed: FSDGSLGQW (MAGC3_HUMAN)
FCDGSLGQV

SEQ ID NO: 106058 - protein, 9 aa, Artificial Sequence
  Description of Artificial Sequence: Synthetic peptide
  Seed: MQMNVINTY (MAGC3_HUMAN)
MRMNVINTV

SEQ ID NO: 106059 - protein, 9 aa, Artificial Sequence
  Description of Artificial Sequence: Synthetic peptide
  Seed: AIGPIQRPA (MAGC3_HUMAN)
AMGPIQRPI

SEQ ID NO: 106060 - protein, 10 aa, Artificial Sequence
  Description of Artificial Sequence: Synthetic peptide
  Seed: TDMDPDNHSY (MAGC3_HUMAN)
TEMDPDNHSM

SEQ ID NO: 106061 - protein, 9 aa, Artificial Sequence
  Description of Artificial Sequence: Synthetic peptide
  Seed: EFIELIFGI (MAGC3_HUMAN)
EAIELIFGA

SEQ ID NO: 106062 - protein, 9 aa, Artificial Sequence
  Description of Artificial Sequence: Synthetic peptide
  Seed: HLREVRLFL (MAGC3_HUMAN)
HYREVRLFI

SEQ ID NO: 106063 - protein, 10 aa, Artificial Sequence
  Description of Artificial Sequence: Synthetic peptide
  Seed: FPSWYMDALK (MAGC3_HUMAN)
FGSWYMDALR

SEQ ID NO: 106064 - protein, 9 aa, Artificial Sequence
  Description of Artificial Sequence: Synthetic peptide
  Seed: RPAREVLEF (MAGC3_HUMAN)
RSAREVLEY

SEQ ID NO: 106065 - protein, 10 aa, Artificial Sequence
  Description of Artificial Sequence: Synthetic peptide
  Seed: VLCPTYFKLW (MAGC3_HUMAN)
VACPTYFKLW

SEQ ID NO: 106066 - protein, 9 aa, Artificial Sequence
  Description of Artificial Sequence: Synthetic peptide
  Seed: IPPQGPPKI (MAGC3_HUMAN)
IFPQGPPKL

SEQ ID NO: 106067 - protein, 10 aa, Artificial Sequence
  Description of Artificial Sequence: Synthetic peptide
  Seed: FADVLSRLAL (MAGC3_HUMAN)
FSDVLSRLAF

SEQ ID NO: 106068 - protein, 9 aa, Artificial Sequence
  Description of Artificial Sequence: Synthetic peptide
  Seed: SASPSVMST (MAGC3_HUMAN)
SLSPSVMSM

SEQ ID NO: 106069 - protein, 9 aa, Artificial Sequence
  Description of Artificial Sequence: Synthetic peptide
  Seed: GPWSALAGF (MAGC3_HUMAN)
GVWSALAGF

SEQ ID NO: 106070 - protein, 10 aa, Artificial Sequence
  Description of Artificial Sequence: Synthetic peptide
  Seed: ATFSDGSLGQ (MAGC3_HUMAN)
ATFSDGSLGR

SEQ ID NO: 106071 - protein, 9 aa, Artificial Sequence
  Description of Artificial Sequence: Synthetic peptide
  Seed: ALSPVVLPP (MAGC3_HUMAN)
ALSPVVLPL

SEQ ID NO: 106072 - protein, 9 aa, Artificial Sequence
  Description of Artificial Sequence: Synthetic peptide
  Seed: SASPSVMST (MAGC3_HUMAN)
SMSPSVMSY

SEQ ID NO: 106073 - protein, 9 aa, Artificial Sequence
  Description of Artificial Sequence: Synthetic peptide
  Seed: KVAELVQFL (MAGC3_HUMAN)
KVAELVQFW

SEQ ID NO: 106074 - protein, 9 aa, Artificial Sequence
  Description of Artificial Sequence: Synthetic peptide
  Seed: KQREEPQDW (MAGC3_HUMAN)
KKREEPQDY

SEQ ID NO: 106075 - protein, 9 aa, Artificial Sequence
  Description of Artificial Sequence: Synthetic peptide
  Seed: TRAEMQMNV (MAGC3_HUMAN)
THAEMQMNF

SEQ ID NO: 106076 - protein, 11 aa, Artificial Sequence
  Description of Artificial Sequence: Synthetic peptide
  Seed: YALDEKVAELV (MAGC3_HUMAN)
YMLDEKVAELA

SEQ ID NO: 106077 - protein, 11 aa, Artificial Sequence
  Description of Artificial Sequence: Synthetic peptide
  Seed: IDDQGMPKNCL (MAGC3_HUMAN)
ITDQGMPKNCL

SEQ ID NO: 106078 - protein, 10 aa, Artificial Sequence
  Description of Artificial Sequence: Synthetic peptide
  Seed: MQMNVINTYT (MAGC3_HUMAN)
MEMNVINTYF

SEQ ID NO: 106079 - protein, 11 aa, Artificial Sequence
  Description of Artificial Sequence: Synthetic peptide
  Seed: SIIPSAFPSWY (MAGC3_HUMAN)
SLIPSAFPSWK

SEQ ID NO: 106080 - protein, 9 aa, Artificial Sequence
  Description of Artificial Sequence: Synthetic peptide
  Seed: LSDEQGMPQ (MAGC3_HUMAN)
LADEQGMPI

SEQ ID NO: 106081 - protein, 9 aa, Artificial Sequence
  Description of Artificial Sequence: Synthetic peptide
  Seed: ASEEVIWEV (MAGC3_HUMAN)
ALEEVIWES

SEQ ID NO: 106082 - protein, 8 aa, Artificial Sequence
  Description of Artificial Sequence: Synthetic peptide
  Seed: FADVLSRL (MAGC3_HUMAN)
FWDVLSRL

SEQ ID NO: 106083 - protein, 9 aa, Artificial Sequence
  Description of Artificial Sequence: Synthetic peptide
  Seed: TSDQRMDSL (MAGC3_HUMAN)
TSDQRMDSV

SEQ ID NO: 106084 - protein, 10 aa, Artificial Sequence
  Description of Artificial Sequence: Synthetic peptide
  Seed: MIFGKAHEFI (MAGC3_HUMAN)
MMFGKAHEFT

SEQ ID NO: 106085 - protein, 9 aa, Artificial Sequence
  Description of Artificial Sequence: Synthetic peptide
  Seed: DYFPMIFGK (MAGC3_HUMAN)
DMFPMIFGR

SEQ ID NO: 106086 - protein, 9 aa, Artificial Sequence
  Description of Artificial Sequence: Synthetic peptide
  Seed: KAHEFIELI (MAGC3_HUMAN)
KIHEFIELV

SEQ ID NO: 106087 - protein, 9 aa, Artificial Sequence
  Description of Artificial Sequence: Synthetic peptide
  Seed: MQMNVINTY (MAGC3_HUMAN)
MQMNVINTK

SEQ ID NO: 106088 - protein, 10 aa, Artificial Sequence
  Description of Artificial Sequence: Synthetic peptide
  Seed: LVLCPTYFKL (MAGC3_HUMAN)
LNLCPTYFKV

SEQ ID NO: 106089 - protein, 9 aa, Artificial Sequence
  Description of Artificial Sequence: Synthetic peptide
  Seed: SASPSVMST (MAGC3_HUMAN)
SASPSVMSY

SEQ ID NO: 106090 - protein, 10 aa, Artificial Sequence
  Description of Artificial Sequence: Synthetic peptide
  Seed: ALDEKVAELV (MAGC3_HUMAN)
AQDEKVAELF

SEQ ID NO: 106091 - protein, 10 aa, Artificial Sequence
  Description of Artificial Sequence: Synthetic peptide
  Seed: TGYFPMIFRK (MAGC3_HUMAN)
TSYFPMIFRR

SEQ ID NO: 106092 - protein, 9 aa, Artificial Sequence
  Description of Artificial Sequence: Synthetic peptide
  Seed: FHLGHLREV (MAGC3_HUMAN)
FILGHLREL

SEQ ID NO: 106093 - protein, 10 aa, Artificial Sequence
  Description of Artificial Sequence: Synthetic peptide
  Seed: FFEDTLDLTY (MAGC3_HUMAN)
FYEDTLDLTY

SEQ ID NO: 106094 - protein, 11 aa, Artificial Sequence
  Description of Artificial Sequence: Synthetic peptide
  Seed: KVAELVQFLLL (MAGC3_HUMAN)
KQAELVQFLLV

SEQ ID NO: 106095 - protein, 9 aa, Artificial Sequence
  Description of Artificial Sequence: Synthetic peptide
  Seed: MQMNVINTY (MAGC3_HUMAN)
MMMNVINTA

SEQ ID NO: 106096 - protein, 9 aa, Artificial Sequence
  Description of Artificial Sequence: Synthetic peptide
  Seed: AVSPGKRLW (MAGC3_HUMAN)
ATSPGKRLL

SEQ ID NO: 106097 - protein, 9 aa, Artificial Sequence
  Description of Artificial Sequence: Synthetic peptide
  Seed: KDMEDRAQA (MAGC3_HUMAN)
KEMEDRAQM

SEQ ID NO: 106098 - protein, 10 aa, Artificial Sequence
  Description of Artificial Sequence: Synthetic peptide
  Seed: ASEEVIWEVL (MAGC3_HUMAN)
AEEEVIWEVM

SEQ ID NO: 106099 - protein, 11 aa, Artificial Sequence
  Description of Artificial Sequence: Synthetic peptide
  Seed: ATFSDGSLGQW (MAGC3_HUMAN)
ALFSDGSLGQK

SEQ ID NO: 106100 - protein, 9 aa, Artificial Sequence
  Description of Artificial Sequence: Synthetic peptide
  Seed: AMASASPSV (MAGC3_HUMAN)
AKASASPSI

SEQ ID NO: 106101 - protein, 10 aa, Artificial Sequence
  Description of Artificial Sequence: Synthetic peptide
  Seed: MQMNVINTYT (MAGC3_HUMAN)
MYMNVINTYM

SEQ ID NO: 106102 - protein, 10 aa, Artificial Sequence
  Description of Artificial Sequence: Synthetic peptide
  Seed: KVAELVQFLL (MAGC3_HUMAN)
KMAELVQFLL

SEQ ID NO: 106103 - protein, 11 aa, Artificial Sequence
  Description of Artificial Sequence: Synthetic peptide
  Seed: IIDTTDDATAM (MAGC3_HUMAN)
ITDTTDDATAM

SEQ ID NO: 106104 - protein, 10 aa, Artificial Sequence
  Description of Artificial Sequence: Synthetic peptide
  Seed: FKLWRTLSGS (MAGC3_HUMAN)
FRLWRTLSGI

SEQ ID NO: 106105 - protein, 10 aa, Artificial Sequence
  Description of Artificial Sequence: Synthetic peptide
  Seed: KLSSIIPSAF (MAGC3_HUMAN)
KTSSIIPSAM

SEQ ID NO: 106106 - protein, 9 aa, Artificial Sequence
  Description of Artificial Sequence: Synthetic peptide
  Seed: FHLGHLREV (MAGC3_HUMAN)
FTLGHLREM

SEQ ID NO: 106107 - protein, 9 aa, Artificial Sequence
  Description of Artificial Sequence: Synthetic peptide
  Seed: SLPESEPLF (MAGC3_HUMAN)
SYPESEPLL

SEQ ID NO: 106108 - protein, 9 aa, Artificial Sequence
  Description of Artificial Sequence: Synthetic peptide
  Seed: ELIFGIALT (MAGC3_HUMAN)
EIIFGIALV

SEQ ID NO: 106109 - protein, 9 aa, Artificial Sequence
  Description of Artificial Sequence: Synthetic peptide
  Seed: FFEDTLDLT (MAGC3_HUMAN)
FFEDTLDLV

SEQ ID NO: 106110 - protein, 10 aa, Artificial Sequence
  Description of Artificial Sequence: Synthetic peptide
  Seed: KVAELVQFLL (MAGC3_HUMAN)
KMAELVQFLG

SEQ ID NO: 106111 - protein, 9 aa, Artificial Sequence
  Description of Artificial Sequence: Synthetic peptide
  Seed: TTDDATAMA (MAGC3_HUMAN)
TNDDATAMI

SEQ ID NO: 106112 - protein, 9 aa, Artificial Sequence
  Description of Artificial Sequence: Synthetic peptide
  Seed: KAHEFIELI (MAGC3_HUMAN)
KIHEFIELL

SEQ ID NO: 106113 - protein, 11 aa, Artificial Sequence
  Description of Artificial Sequence: Synthetic peptide
  Seed: SSSEEEDTATW (MAGC3_HUMAN)
SQSEEEDTATF

SEQ ID NO: 106114 - protein, 11 aa, Artificial Sequence
  Description of Artificial Sequence: Synthetic peptide
  Seed: RYALDEKVAEL (MAGC3_HUMAN)
RWALDEKVAEV

SEQ ID NO: 106115 - protein, 9 aa, Artificial Sequence
  Description of Artificial Sequence: Synthetic peptide
  Seed: MASASPSVM (MAGC3_HUMAN)
MTSASPSVL

SEQ ID NO: 106116 - protein, 9 aa, Artificial Sequence
  Description of Artificial Sequence: Synthetic peptide
  Seed: MEDRAQAII (MAGC3_HUMAN)
MNDRAQAIL

SEQ ID NO: 106117 - protein, 9 aa, Artificial Sequence
  Description of Artificial Sequence: Synthetic peptide
  Seed: AMASASPSV (MAGC3_HUMAN)
ALASASPSW

SEQ ID NO: 106118 - protein, 9 aa, Artificial Sequence
  Description of Artificial Sequence: Synthetic peptide
  Seed: EVIWEVLSA (MAGC3_HUMAN)
EVIWEVLSK

SEQ ID NO: 106119 - protein, 9 aa, Artificial Sequence
  Description of Artificial Sequence: Synthetic peptide
  Seed: YQTKEPVTK (MAGC3_HUMAN)
YYTKEPVTF

SEQ ID NO: 106120 - protein, 9 aa, Artificial Sequence
  Description of Artificial Sequence: Synthetic peptide
  Seed: EVIWEVLSA (MAGC3_HUMAN)
ESIWEVLSY

SEQ ID NO: 106121 - protein, 9 aa, Artificial Sequence
  Description of Artificial Sequence: Synthetic peptide
  Seed: IELIFGIAL (MAGC3_HUMAN)
IMLIFGIAY

SEQ ID NO: 106122 - protein, 10 aa, Artificial Sequence
  Description of Artificial Sequence: Synthetic peptide
  Seed: LILILSVIFI (MAGC3_HUMAN)
LNLILSVIFV

SEQ ID NO: 106123 - protein, 9 aa, Artificial Sequence
  Description of Artificial Sequence: Synthetic peptide
  Seed: HALPESESL (MAGC3_HUMAN)
HQLPESESF

SEQ ID NO: 106124 - protein, 11 aa, Artificial Sequence
  Description of Artificial Sequence: Synthetic peptide
  Seed: RTLSGSPGLQL (MAGC3_HUMAN)
RLLSGSPGLQF

SEQ ID NO: 106125 - protein, 10 aa, Artificial Sequence
  Description of Artificial Sequence: Synthetic peptide
  Seed: LILILSVIFI (MAGC3_HUMAN)
LELILSVIFV

SEQ ID NO: 106126 - protein, 9 aa, Artificial Sequence
  Description of Artificial Sequence: Synthetic peptide
  Seed: LILILSMIF (MAGC3_HUMAN)
LKLILSMIL

SEQ ID NO: 106127 - protein, 10 aa, Artificial Sequence
  Description of Artificial Sequence: Synthetic peptide
  Seed: EVIWEVLNAI (MAGC3_HUMAN)
EVIWEVLNAR

SEQ ID NO: 106128 - protein, 9 aa, Artificial Sequence
  Description of Artificial Sequence: Synthetic peptide
  Seed: GFADVLSRL (MAGC3_HUMAN)
GIADVLSRA

SEQ ID NO: 106129 - protein, 9 aa, Artificial Sequence
  Description of Artificial Sequence: Synthetic peptide
  Seed: KAHEFIELI (MAGC3_HUMAN)
KMHEFIELC

SEQ ID NO: 106130 - protein, 9 aa, Artificial Sequence
  Description of Artificial Sequence: Synthetic peptide
  Seed: GYFPMIFRK (MAGC3_HUMAN)
GLFPMIFRL

SEQ ID NO: 106131 - protein, 9 aa, Artificial Sequence
  Description of Artificial Sequence: Synthetic peptide
  Seed: LSGSPGLQL (MAGC3_HUMAN)
LGGSPGLQW

SEQ ID NO: 106132 - protein, 10 aa, Artificial Sequence
  Description of Artificial Sequence: Synthetic peptide
  Seed: MLTTVIKKYK (MAGC3_HUMAN)
MTTTVIKKYK

SEQ ID NO: 106133 - protein, 10 aa, Artificial Sequence
  Description of Artificial Sequence: Synthetic peptide
  Seed: KLVQFLLLKY (MAGC3_HUMAN)
KHVQFLLLKK

SEQ ID NO: 106134 - protein, 9 aa, Artificial Sequence
  Description of Artificial Sequence: Synthetic peptide
  Seed: SAFHLGHLR (MAGC3_HUMAN)
SLFHLGHLF

SEQ ID NO: 106135 - protein, 9 aa, Artificial Sequence
  Description of Artificial Sequence: Synthetic peptide
  Seed: ELIFGIALT (MAGC3_HUMAN)
EVIFGIALI

SEQ ID NO: 106136 - protein, 9 aa, Artificial Sequence
  Description of Artificial Sequence: Synthetic peptide
  Seed: NCASEEVIW (MAGC3_HUMAN)
NTASEEVIW

SEQ ID NO: 106137 - protein, 10 aa, Artificial Sequence
  Description of Artificial Sequence: Synthetic peptide
  Seed: RLWGEKAGSL (MAGC3_HUMAN)
RQWGEKAGSL

SEQ ID NO: 106138 - protein, 10 aa, Artificial Sequence
  Description of Artificial Sequence: Synthetic peptide
  Seed: KATDKDYSAF (MAGC3_HUMAN)
KATDKDYSAY

SEQ ID NO: 106139 - protein, 9 aa, Artificial Sequence
  Description of Artificial Sequence: Synthetic peptide
  Seed: SASPSVMST (MAGC3_HUMAN)
STSPSVMSV

SEQ ID NO: 106140 - protein, 9 aa, Artificial Sequence
  Description of Artificial Sequence: Synthetic peptide
  Seed: SEEEDTATW (MAGC3_HUMAN)
SEEEDTATT

SEQ ID NO: 106141 - protein, 10 aa, Artificial Sequence
  Description of Artificial Sequence: Synthetic peptide
  Seed: KLVQFLLLKY (MAGC3_HUMAN)
KCVQFLLLKY

SEQ ID NO: 106142 - protein, 10 aa, Artificial Sequence
  Description of Artificial Sequence: Synthetic peptide
  Seed: FKLWRTLSGS (MAGC3_HUMAN)
FFLWRTLSGI

SEQ ID NO: 106143 - protein, 10 aa, Artificial Sequence
  Description of Artificial Sequence: Synthetic peptide
  Seed: VLCPTYFKLW (MAGC3_HUMAN)
VGCPTYFKLW

SEQ ID NO: 106144 - protein, 9 aa, Artificial Sequence
  Description of Artificial Sequence: Synthetic peptide
  Seed: YQAKEPLTR (MAGC3_HUMAN)
YQAKEPLTM

SEQ ID NO: 106145 - protein, 9 aa, Artificial Sequence
  Description of Artificial Sequence: Synthetic peptide
  Seed: VIWEVLSAI (MAGC3_HUMAN)
VIWEVLSAF

SEQ ID NO: 106146 - protein, 9 aa, Artificial Sequence
  Description of Artificial Sequence: Synthetic peptide
  Seed: YSAFHLGHL (MAGC3_HUMAN)
YLAFHLGHF

SEQ ID NO: 106147 - protein, 9 aa, Artificial Sequence
  Description of Artificial Sequence: Synthetic peptide
  Seed: FLSKLSSII (MAGC3_HUMAN)
FASKLSSIY

SEQ ID NO: 106148 - protein, 10 aa, Artificial Sequence
  Description of Artificial Sequence: Synthetic peptide
  Seed: MQMNVINTYT (MAGC3_HUMAN)
MWMNVINTYL

SEQ ID NO: 106149 - protein, 9 aa, Artificial Sequence
  Description of Artificial Sequence: Synthetic peptide
  Seed: KAHEFIELI (MAGC3_HUMAN)
KTHEFIELR

SEQ ID NO: 106150 - protein, 10 aa, Artificial Sequence
  Description of Artificial Sequence: Synthetic peptide
  Seed: KKYKDYFPMI (MAGC3_HUMAN)
KKYKDYFPMK

SEQ ID NO: 106151 - protein, 9 aa, Artificial Sequence
  Description of Artificial Sequence: Synthetic peptide
  Seed: FPSWYMDAL (MAGC3_HUMAN)
FISWYMDAY

SEQ ID NO: 106152 - protein, 10 aa, Artificial Sequence
  Description of Artificial Sequence: Synthetic peptide
  Seed: VLNAIGPWSA (MAGC3_HUMAN)
VINAIGPWSV

SEQ ID NO: 106153 - protein, 11 aa, Artificial Sequence
  Description of Artificial Sequence: Synthetic peptide
  Seed: AIIDTTDDATA (MAGC3_HUMAN)
AMIDTTDDATV

SEQ ID NO: 106154 - protein, 9 aa, Artificial Sequence
  Description of Artificial Sequence: Synthetic peptide
  Seed: IQRPAREVL (MAGC3_HUMAN)
IQRPAREVV

SEQ ID NO: 106155 - protein, 10 aa, Artificial Sequence
  Description of Artificial Sequence: Synthetic peptide
  Seed: LDSCSSPLLW (MAGC3_HUMAN)
LNSCSSPLLW

SEQ ID NO: 106156 - protein, 9 aa, Artificial Sequence
  Description of Artificial Sequence: Synthetic peptide
  Seed: VPEEVIWEV (MAGC3_HUMAN)
VAEEVIWEF

SEQ ID NO: 106157 - protein, 9 aa, Artificial Sequence
  Description of Artificial Sequence: Synthetic peptide
  Seed: VLPPQPQPR (MAGC3_HUMAN)
VLPPQPQPF

SEQ ID NO: 106158 - protein, 11 aa, Artificial Sequence
  Description of Artificial Sequence: Synthetic peptide
  Seed: CEGSLSDEQGM (MAGC3_HUMAN)
CEGSLSDEQGW

SEQ ID NO: 106159 - protein, 10 aa, Artificial Sequence
  Description of Artificial Sequence: Synthetic peptide
  Seed: IIDTTDDATA (MAGC3_HUMAN)
IADTTDDATV

SEQ ID NO: 106160 - protein, 9 aa, Artificial Sequence
  Description of Artificial Sequence: Synthetic peptide
  Seed: LLILILSMI (MAGC3_HUMAN)
LMILILSMV

SEQ ID NO: 106161 - protein, 9 aa, Artificial Sequence
  Description of Artificial Sequence: Synthetic peptide
  Seed: MIFIKGSCV (MAGC3_HUMAN)
MAFIKGSCV

SEQ ID NO: 106162 - protein, 10 aa, Artificial Sequence
  Description of Artificial Sequence: Synthetic peptide
  Seed: YALDEKVAEL (MAGC3_HUMAN)
YELDEKVAEL

SEQ ID NO: 106163 - protein, 10 aa, Artificial Sequence
  Description of Artificial Sequence: Synthetic peptide
  Seed: RRGTGYTLSL (MAGC3_HUMAN)
RRGTGYTLSK

SEQ ID NO: 106164 - protein, 10 aa, Artificial Sequence
  Description of Artificial Sequence: Synthetic peptide
  Seed: EVIWEVLNAI (MAGC3_HUMAN)
ETIWEVLNAR

SEQ ID NO: 106165 - protein, 9 aa, Artificial Sequence
  Description of Artificial Sequence: Synthetic peptide
  Seed: RPAREVLEF (MAGC3_HUMAN)
RIAREVLEW

SEQ ID NO: 106166 - protein, 10 aa, Artificial Sequence
  Description of Artificial Sequence: Synthetic peptide
  Seed: TCATYALSPV (MAGC3_HUMAN)
TVATYALSPA

SEQ ID NO: 106167 - protein, 9 aa, Artificial Sequence
  Description of Artificial Sequence: Synthetic peptide
  Seed: EFIELIFGI (MAGC3_HUMAN)
ELIELIFGT

SEQ ID NO: 106168 - protein, 9 aa, Artificial Sequence
  Description of Artificial Sequence: Synthetic peptide
  Seed: ALDEKVAEL (MAGC3_HUMAN)
AWDEKVAEF

SEQ ID NO: 106169 - protein, 8 aa, Artificial Sequence
  Description of Artificial Sequence: Synthetic peptide
  Seed: MEDRAQAI (MAGC3_HUMAN)
MADRAQAV

SEQ ID NO: 106170 - protein, 10 aa, Artificial Sequence
  Description of Artificial Sequence: Synthetic peptide
  Seed: LILILSVIFI (MAGC3_HUMAN)
LKLILSVIFV

SEQ ID NO: 106171 - protein, 10 aa, Artificial Sequence
  Description of Artificial Sequence: Synthetic peptide
  Seed: LDLANPQGLA (MAGC3_HUMAN)
LGLANPQGLV

SEQ ID NO: 106172 - protein, 10 aa, Artificial Sequence
  Description of Artificial Sequence: Synthetic peptide
  Seed: EEVIWEVLNA (MAGC3_HUMAN)
EIVIWEVLNV

SEQ ID NO: 106173 - protein, 9 aa, Artificial Sequence
  Description of Artificial Sequence: Synthetic peptide
  Seed: WVKNTCATY (MAGC3_HUMAN)
WLKNTCATF

SEQ ID NO: 106174 - protein, 10 aa, Artificial Sequence
  Description of Artificial Sequence: Synthetic peptide
  Seed: MIFGKAHEFI (MAGC3_HUMAN)
MVFGKAHEFM

SEQ ID NO: 106175 - protein, 10 aa, Artificial Sequence
  Description of Artificial Sequence: Synthetic peptide
  Seed: ALDEKVAELV (MAGC3_HUMAN)
AMDEKVAELF

SEQ ID NO: 106176 - protein, 9 aa, Artificial Sequence
  Description of Artificial Sequence: Synthetic peptide
  Seed: RTLSGSPGL (MAGC3_HUMAN)
RVLSGSPGL

SEQ ID NO: 106177 - protein, 11 aa, Artificial Sequence
  Description of Artificial Sequence: Synthetic peptide
  Seed: DSCSSPLLWTR (MAGC3_HUMAN)
DICSSPLLWTR

SEQ ID NO: 106178 - protein, 9 aa, Artificial Sequence
  Description of Artificial Sequence: Synthetic peptide
  Seed: FPSWYMDAL (MAGC3_HUMAN)
FPSWYMDAQ

SEQ ID NO: 106179 - protein, 9 aa, Artificial Sequence
  Description of Artificial Sequence: Synthetic peptide
  Seed: IELIFGIAL (MAGC3_HUMAN)
ISLIFGIAF

SEQ ID NO: 106180 - protein, 11 aa, Artificial Sequence
  Description of Artificial Sequence: Synthetic peptide
  Seed: YALDEKVAELV (MAGC3_HUMAN)
YLLDEKVAELP

SEQ ID NO: 106181 - protein, 10 aa, Artificial Sequence
  Description of Artificial Sequence: Synthetic peptide
  Seed: EVIWEVLSAI (MAGC3_HUMAN)
EVIWEVLSAW

SEQ ID NO: 106182 - protein, 9 aa, Artificial Sequence
  Description of Artificial Sequence: Synthetic peptide
  Seed: YSAFHLGHL (MAGC3_HUMAN)
YQAFHLGHL

SEQ ID NO: 106183 - protein, 10 aa, Artificial Sequence
  Description of Artificial Sequence: Synthetic peptide
  Seed: YALDEKVAEL (MAGC3_HUMAN)
YRLDEKVAEY

SEQ ID NO: 106184 - protein, 9 aa, Artificial Sequence
  Description of Artificial Sequence: Synthetic peptide
  Seed: MQMNVINTY (MAGC3_HUMAN)
MQMNVINTM

SEQ ID NO: 106185 - protein, 10 aa, Artificial Sequence
  Description of Artificial Sequence: Synthetic peptide
  Seed: KFSLRRAVSV (MAGC3_HUMAN)
KSSLRRAVSK

SEQ ID NO: 106186 - protein, 10 aa, Artificial Sequence
  Description of Artificial Sequence: Synthetic peptide
  Seed: KVAELVQFLL (MAGC3_HUMAN)
KIAELVQFLF

SEQ ID NO: 106187 - protein, 9 aa, Artificial Sequence
  Description of Artificial Sequence: Synthetic peptide
  Seed: RPAREVLEF (MAGC3_HUMAN)
RAAREVLEL

SEQ ID NO: 106188 - protein, 9 aa, Artificial Sequence
  Description of Artificial Sequence: Synthetic peptide
  Seed: ELVQFLLLK (MAGC3_HUMAN)
ELVQFLLLR

SEQ ID NO: 106189 - protein, 10 aa, Artificial Sequence
  Description of Artificial Sequence: Synthetic peptide
  Seed: YALSPVVLPP (MAGC3_HUMAN)
YYLSPVVLPI

SEQ ID NO: 106190 - protein, 10 aa, Artificial Sequence
  Description of Artificial Sequence: Synthetic peptide
  Seed: YALDEKVAEL (MAGC3_HUMAN)
YFLDEKVAEM

SEQ ID NO: 106191 - protein, 11 aa, Artificial Sequence
  Description of Artificial Sequence: Synthetic peptide
  Seed: LSKLSSIIPSA (MAGC3_HUMAN)
LMKLSSIIPSL

SEQ ID NO: 106192 - protein, 11 aa, Artificial Sequence
  Description of Artificial Sequence: Synthetic peptide
  Seed: LPAVSPGKRLW (MAGC3_HUMAN)
LSAVSPGKRLW

SEQ ID NO: 106193 - protein, 10 aa, Artificial Sequence
  Description of Artificial Sequence: Synthetic peptide
  Seed: SDQRMDSLVL (MAGC3_HUMAN)
SIQRMDSLVY

SEQ ID NO: 106194 - protein, 11 aa, Artificial Sequence
  Description of Artificial Sequence: Synthetic peptide
  Seed: YALDEKVAELV (MAGC3_HUMAN)
YLLDEKVAELA

SEQ ID NO: 106195 - protein, 9 aa, Artificial Sequence
  Description of Artificial Sequence: Synthetic peptide
  Seed: NPQGLAGHR (MAGC3_HUMAN)
NSQGLAGHR

SEQ ID NO: 106196 - protein, 9 aa, Artificial Sequence
  Description of Artificial Sequence: Synthetic peptide
  Seed: ATDKDYSAF (MAGC3_HUMAN)
AADKDYSAV

SEQ ID NO: 106197 - protein, 9 aa, Artificial Sequence
  Description of Artificial Sequence: Synthetic peptide
  Seed: SAFHLGHLR (MAGC3_HUMAN)
STFHLGHLH

SEQ ID NO: 106198 - protein, 9 aa, Artificial Sequence
  Description of Artificial Sequence: Synthetic peptide
  Seed: LIDDQGMPK (MAGC3_HUMAN)
LVDDQGMPI

SEQ ID NO: 106199 - protein, 10 aa, Artificial Sequence
  Description of Artificial Sequence: Synthetic peptide
  Seed: MNVINTYTGY (MAGC3_HUMAN)
MEVINTYTGF

SEQ ID NO: 106200 - protein, 11 aa, Artificial Sequence
  Description of Artificial Sequence: Synthetic peptide
  Seed: LSKLSSIIPSA (MAGC3_HUMAN)
LNKLSSIIPSL

SEQ ID NO: 106201 - protein, 10 aa, Artificial Sequence
  Description of Artificial Sequence: Synthetic peptide
  Seed: TTDDATAMAS (MAGC3_HUMAN)
TCDDATAMAY

SEQ ID NO: 106202 - protein, 9 aa, Artificial Sequence
  Description of Artificial Sequence: Synthetic peptide
  Seed: VIWEVLSAI (MAGC3_HUMAN)
VVWEVLSAM

SEQ ID NO: 106203 - protein, 11 aa, Artificial Sequence
  Description of Artificial Sequence: Synthetic peptide
  Seed: LTDMDPDNHSY (MAGC3_HUMAN)
LADMDPDNHSI

SEQ ID NO: 106204 - protein, 10 aa, Artificial Sequence
  Description of Artificial Sequence: Synthetic peptide
  Seed: SPLDSCSSPL (MAGC3_HUMAN)
SLLDSCSSPA

SEQ ID NO: 106205 - protein, 9 aa, Artificial Sequence
  Description of Artificial Sequence: Synthetic peptide
  Seed: ALSPVVLPP (MAGC3_HUMAN)
AASPVVLPL

SEQ ID NO: 106206 - protein, 9 aa, Artificial Sequence
  Description of Artificial Sequence: Synthetic peptide
  Seed: RTLSGSPGL (MAGC3_HUMAN)
RTLSGSPGR

SEQ ID NO: 106207 - protein, 9 aa, Artificial Sequence
  Description of Artificial Sequence: Synthetic peptide
  Seed: WVKNTCATY (MAGC3_HUMAN)
WHKNTCATY

SEQ ID NO: 106208 - protein, 9 aa, Artificial Sequence
  Description of Artificial Sequence: Synthetic peptide
  Seed: HFYVFVNTL (MAGC3_HUMAN)
HMYVFVNTF

SEQ ID NO: 106209 - protein, 9 aa, Artificial Sequence
  Description of Artificial Sequence: Synthetic peptide
  Seed: TTDDATAMA (MAGC3_HUMAN)
TIDDATAMY

SEQ ID NO: 106210 - protein, 9 aa, Artificial Sequence
  Description of Artificial Sequence: Synthetic peptide
  Seed: ALAGFADVL (MAGC3_HUMAN)
AAAGFADVY

SEQ ID NO: 106211 - protein, 9 aa, Artificial Sequence
  Description of Artificial Sequence: Synthetic peptide
  Seed: EFIELIFGI (MAGC3_HUMAN)
ETIELIFGS

SEQ ID NO: 106212 - protein, 9 aa, Artificial Sequence
  Description of Artificial Sequence: Synthetic peptide
  Seed: HALPESESL (MAGC3_HUMAN)
HVLPESESF

SEQ ID NO: 106213 - protein, 10 aa, Artificial Sequence
  Description of Artificial Sequence: Synthetic peptide
  Seed: MNVINTYTGY (MAGC3_HUMAN)
MAVINTYTGY

SEQ ID NO: 106214 - protein, 9 aa, Artificial Sequence
  Description of Artificial Sequence: Synthetic peptide
  Seed: YSAFHLGHL (MAGC3_HUMAN)
YIAFHLGHL

SEQ ID NO: 106215 - protein, 10 aa, Artificial Sequence
  Description of Artificial Sequence: Synthetic peptide
  Seed: SIIPSAFPSW (MAGC3_HUMAN)
SFIPSAFPSI

SEQ ID NO: 106216 - protein, 11 aa, Artificial Sequence
  Description of Artificial Sequence: Synthetic peptide
  Seed: TTDDATAMASA (MAGC3_HUMAN)
TADDATAMASI

SEQ ID NO: 106217 - protein, 9 aa, Artificial Sequence
  Description of Artificial Sequence: Synthetic peptide
  Seed: TTDDATAMA (MAGC3_HUMAN)
TGDDATAMY

SEQ ID NO: 106218 - protein, 9 aa, Artificial Sequence
  Description of Artificial Sequence: Synthetic peptide
  Seed: ELIFGIALT (MAGC3_HUMAN)
EVIFGIALA

SEQ ID NO: 106219 - protein, 9 aa, Artificial Sequence
  Description of Artificial Sequence: Synthetic peptide
  Seed: KYKDYFPMI (MAGC3_HUMAN)
KWKDYFPMK

SEQ ID NO: 106220 - protein, 9 aa, Artificial Sequence
  Description of Artificial Sequence: Synthetic peptide
  Seed: FSDGSLGQW (MAGC3_HUMAN)
FVDGSLGQM

SEQ ID NO: 106221 - protein, 10 aa, Artificial Sequence
  Description of Artificial Sequence: Synthetic peptide
  Seed: MQMNVINTYT (MAGC3_HUMAN)
MQMNVINTYL

SEQ ID NO: 106222 - protein, 9 aa, Artificial Sequence
  Description of Artificial Sequence: Synthetic peptide
  Seed: KKYKDYFPM (MAGC3_HUMAN)
KHYKDYFPF

SEQ ID NO: 106223 - protein, 9 aa, Artificial Sequence
  Description of Artificial Sequence: Synthetic peptide
  Seed: MDPDNHSYF (MAGC3_HUMAN)
MVPDNHSYV

SEQ ID NO: 106224 - protein, 11 aa, Artificial Sequence
  Description of Artificial Sequence: Synthetic peptide
  Seed: TSDQRMDSLVL (MAGC3_HUMAN)
TTDQRMDSLVY

SEQ ID NO: 106225 - protein, 11 aa, Artificial Sequence
  Description of Artificial Sequence: Synthetic peptide
  Seed: LTDMDPDNHSY (MAGC3_HUMAN)
LPDMDPDNHSY

SEQ ID NO: 106226 - protein, 9 aa, Artificial Sequence
  Description of Artificial Sequence: Synthetic peptide
  Seed: DYFPMIFGK (MAGC3_HUMAN)
DAFPMIFGR

SEQ ID NO: 106227 - protein, 9 aa, Artificial Sequence
  Description of Artificial Sequence: Synthetic peptide
  Seed: ISPQGPPQS (MAGC3_HUMAN)
IQPQGPPQL

SEQ ID NO: 106228 - protein, 9 aa, Artificial Sequence
  Description of Artificial Sequence: Synthetic peptide
  Seed: ATYALSPVV (MAGC3_HUMAN)
ATYALSPVL

SEQ ID NO: 106229 - protein, 9 aa, Artificial Sequence
  Description of Artificial Sequence: Synthetic peptide
  Seed: LSAIGPIQR (MAGC3_HUMAN)
LSAIGPIQM

SEQ ID NO: 106230 - protein, 10 aa, Artificial Sequence
  Description of Artificial Sequence: Synthetic peptide
  Seed: YTLDEKVDKL (MAGC3_HUMAN)
YNLDEKVDKL

SEQ ID NO: 106231 - protein, 11 aa, Artificial Sequence
  Description of Artificial Sequence: Synthetic peptide
  Seed: ALWESEGPEAF (MAGC3_HUMAN)
AVWESEGPEAY

SEQ ID NO: 106232 - protein, 10 aa, Artificial Sequence
  Description of Artificial Sequence: Synthetic peptide
  Seed: YALDEKVAEL (MAGC3_HUMAN)
YTLDEKVAEW

SEQ ID NO: 106233 - protein, 9 aa, Artificial Sequence
  Description of Artificial Sequence: Synthetic peptide
  Seed: FSLRRAVSV (MAGC3_HUMAN)
FWLRRAVSL

SEQ ID NO: 106234 - protein, 10 aa, Artificial Sequence
  Description of Artificial Sequence: Synthetic peptide
  Seed: MQMNVINTYT (MAGC3_HUMAN)
MCMNVINTYV

SEQ ID NO: 106235 - protein, 10 aa, Artificial Sequence
  Description of Artificial Sequence: Synthetic peptide
  Seed: MLLPCHWVLD (MAGC3_HUMAN)
MYLPCHWVLV

SEQ ID NO: 106236 - protein, 9 aa, Artificial Sequence
  Description of Artificial Sequence: Synthetic peptide
  Seed: SLPESEPLF (MAGC3_HUMAN)
SVPESEPLY

SEQ ID NO: 106237 - protein, 9 aa, Artificial Sequence
  Description of Artificial Sequence: Synthetic peptide
  Seed: ATDKDYSAF (MAGC3_HUMAN)
ASDKDYSAF

SEQ ID NO: 106238 - protein, 9 aa, Artificial Sequence
  Description of Artificial Sequence: Synthetic peptide
  Seed: MQMNVINTY (MAGC3_HUMAN)
MFMNVINTF

SEQ ID NO: 106239 - protein, 9 aa, Artificial Sequence
  Description of Artificial Sequence: Synthetic peptide
  Seed: SLPESEPLF (MAGC3_HUMAN)
STPESEPLM

SEQ ID NO: 106240 - protein, 9 aa, Artificial Sequence
  Description of Artificial Sequence: Synthetic peptide
  Seed: SAFHLGHLR (MAGC3_HUMAN)
SQFHLGHLY

SEQ ID NO: 106241 - protein, 9 aa, Artificial Sequence
  Description of Artificial Sequence: Synthetic peptide
  Seed: GYFPMIFRK (MAGC3_HUMAN)
GAFPMIFRR

SEQ ID NO: 106242 - protein, 9 aa, Artificial Sequence
  Description of Artificial Sequence: Synthetic peptide
  Seed: TLDEKVDKL (MAGC3_HUMAN)
TYDEKVDKL

SEQ ID NO: 106243 - protein, 10 aa, Artificial Sequence
  Description of Artificial Sequence: Synthetic peptide
  Seed: TGYFPMIFRK (MAGC3_HUMAN)
TMYFPMIFRL

SEQ ID NO: 106244 - protein, 10 aa, Artificial Sequence
  Description of Artificial Sequence: Synthetic peptide
  Seed: SAFHLGHLRE (MAGC3_HUMAN)
STFHLGHLRH

SEQ ID NO: 106245 - protein, 10 aa, Artificial Sequence
  Description of Artificial Sequence: Synthetic peptide
  Seed: INTYTGYFPM (MAGC3_HUMAN)
IMTYTGYFPW

SEQ ID NO: 106246 - protein, 10 aa, Artificial Sequence
  Description of Artificial Sequence: Synthetic peptide
  Seed: MDPDNHSYFF (MAGC3_HUMAN)
MCPDNHSYFY

SEQ ID NO: 106247 - protein, 9 aa, Artificial Sequence
  Description of Artificial Sequence: Synthetic peptide
  Seed: HSYFFEDTL (MAGC3_HUMAN)
HCYFFEDTW

SEQ ID NO: 106248 - protein, 10 aa, Artificial Sequence
  Description of Artificial Sequence: Synthetic peptide
  Seed: TYTGYFPMIF (MAGC3_HUMAN)
TYTGYFPMII

SEQ ID NO: 106249 - protein, 10 aa, Artificial Sequence
  Description of Artificial Sequence: Synthetic peptide
  Seed: PTYFKLWRTL (MAGC3_HUMAN)
PIYFKLWRTF

SEQ ID NO: 106250 - protein, 8 aa, Artificial Sequence
  Description of Artificial Sequence: Synthetic peptide
  Seed: MPQNRLLI (MAGC3_HUMAN)
MLQNRLLL

SEQ ID NO: 106251 - protein, 9 aa, Artificial Sequence
  Description of Artificial Sequence: Synthetic peptide
  Seed: FKLWRTLSG (MAGC3_HUMAN)
FRLWRTLSY

SEQ ID NO: 106252 - protein, 9 aa, Artificial Sequence
  Description of Artificial Sequence: Synthetic peptide
  Seed: MIFRKAREF (MAGC3_HUMAN)
MHFRKAREM

SEQ ID NO: 106253 - protein, 9 aa, Artificial Sequence
  Description of Artificial Sequence: Synthetic peptide
  Seed: QTKEPVTKA (MAGC3_HUMAN)
QAKEPVTKR

SEQ ID NO: 106254 - protein, 11 aa, Artificial Sequence
  Description of Artificial Sequence: Synthetic peptide
  Seed: AIIDTTDDATA (MAGC3_HUMAN)
ALIDTTDDATL

SEQ ID NO: 106255 - protein, 9 aa, Artificial Sequence
  Description of Artificial Sequence: Synthetic peptide
  Seed: EVLSAIGPI (MAGC3_HUMAN)
EVLSAIGPL

SEQ ID NO: 106256 - protein, 9 aa, Artificial Sequence
  Description of Artificial Sequence: Synthetic peptide
  Seed: SAIGPIQRP (MAGC3_HUMAN)
SAIGPIQRM

SEQ ID NO: 106257 - protein, 10 aa, Artificial Sequence
  Description of Artificial Sequence: Synthetic peptide
  Seed: SALAGFADVL (MAGC3_HUMAN)
SCLAGFADVV

SEQ ID NO: 106258 - protein, 10 aa, Artificial Sequence
  Description of Artificial Sequence: Synthetic peptide
  Seed: MPAAGMPPLP (MAGC3_HUMAN)
MPAAGMPPLF

SEQ ID NO: 106259 - protein, 10 aa, Artificial Sequence
  Description of Artificial Sequence: Synthetic peptide
  Seed: TAMASASPSV (MAGC3_HUMAN)
TAMASASPSI

SEQ ID NO: 106260 - protein, 10 aa, Artificial Sequence
  Description of Artificial Sequence: Synthetic peptide
  Seed: YALSPVVLPP (MAGC3_HUMAN)
YALSPVVLPM

SEQ ID NO: 106261 - protein, 9 aa, Artificial Sequence
  Description of Artificial Sequence: Synthetic peptide
  Seed: TLDEKVDKL (MAGC3_HUMAN)
TADEKVDKW

SEQ ID NO: 106262 - protein, 9 aa, Artificial Sequence
  Description of Artificial Sequence: Synthetic peptide
  Seed: MPAAGMPPL (MAGC3_HUMAN)
MMAAGMPPY

SEQ ID NO: 106263 - protein, 9 aa, Artificial Sequence
  Description of Artificial Sequence: Synthetic peptide
  Seed: KVAELVQFL (MAGC3_HUMAN)
KEAELVQFI

SEQ ID NO: 106264 - protein, 9 aa, Artificial Sequence
  Description of Artificial Sequence: Synthetic peptide
  Seed: KVAELVQFL (MAGC3_HUMAN)
KNAELVQFR

SEQ ID NO: 106265 - protein, 9 aa, Artificial Sequence
  Description of Artificial Sequence: Synthetic peptide
  Seed: MLLPCHWVL (MAGC3_HUMAN)
MQLPCHWVR

SEQ ID NO: 106266 - protein, 10 aa, Artificial Sequence
  Description of Artificial Sequence: Synthetic peptide
  Seed: KLVQFLLLKY (MAGC3_HUMAN)
KSVQFLLLKY

SEQ ID NO: 106267 - protein, 9 aa, Artificial Sequence
  Description of Artificial Sequence: Synthetic peptide
  Seed: MIFGKAHEF (MAGC3_HUMAN)
MLFGKAHEL

SEQ ID NO: 106268 - protein, 9 aa, Artificial Sequence
  Description of Artificial Sequence: Synthetic peptide
  Seed: TEASPQQKK (MAGC3_HUMAN)
TMASPQQKK

SEQ ID NO: 106269 - protein, 9 aa, Artificial Sequence
  Description of Artificial Sequence: Synthetic peptide
  Seed: EKVDKLVQF (MAGC3_HUMAN)
EDVDKLVQM

SEQ ID NO: 106270 - protein, 9 aa, Artificial Sequence
  Description of Artificial Sequence: Synthetic peptide
  Seed: HFYVFVNTL (MAGC3_HUMAN)
HRYVFVNTF

SEQ ID NO: 106271 - protein, 10 aa, Artificial Sequence
  Description of Artificial Sequence: Synthetic peptide
  Seed: LILILSVIFI (MAGC3_HUMAN)
LQLILSVIFV

SEQ ID NO: 106272 - protein, 9 aa, Artificial Sequence
  Description of Artificial Sequence: Synthetic peptide
  Seed: MLLPCHWVL (MAGC3_HUMAN)
MHLPCHWVL

SEQ ID NO: 106273 - protein, 9 aa, Artificial Sequence
  Description of Artificial Sequence: Synthetic peptide
  Seed: MLLPCHWVL (MAGC3_HUMAN)
MLLPCHWVM

SEQ ID NO: 106274 - protein, 10 aa, Artificial Sequence
  Description of Artificial Sequence: Synthetic peptide
  Seed: RSAEGSVLDL (MAGC3_HUMAN)
RLAEGSVLDL

SEQ ID NO: 106275 - protein, 10 aa, Artificial Sequence
  Description of Artificial Sequence: Synthetic peptide
  Seed: TLDEKVDKLV (MAGC3_HUMAN)
TLDEKVDKLL

SEQ ID NO: 106276 - protein, 9 aa, Artificial Sequence
  Description of Artificial Sequence: Synthetic peptide
  Seed: VLCPTYFKL (MAGC3_HUMAN)
VTCPTYFKM

SEQ ID NO: 106277 - protein, 9 aa, Artificial Sequence
  Description of Artificial Sequence: Synthetic peptide
  Seed: MIFGKAHEF (MAGC3_HUMAN)
MSFGKAHEI

SEQ ID NO: 106278 - protein, 9 aa, Artificial Sequence
  Description of Artificial Sequence: Synthetic peptide
  Seed: KVDKLVQFL (MAGC3_HUMAN)
KRDKLVQFY

SEQ ID NO: 106279 - protein, 9 aa, Artificial Sequence
  Description of Artificial Sequence: Synthetic peptide
  Seed: TEVDPDHFY (MAGC3_HUMAN)
TMVDPDHFF

SEQ ID NO: 106280 - protein, 10 aa, Artificial Sequence
  Description of Artificial Sequence: Synthetic peptide
  Seed: AEMLTTVIKK (MAGC3_HUMAN)
AFMLTTVIKK

SEQ ID NO: 106281 - protein, 9 aa, Artificial Sequence
  Description of Artificial Sequence: Synthetic peptide
  Seed: KEPLTRAEM (MAGC3_HUMAN)
KLPLTRAEY

SEQ ID NO: 106282 - protein, 10 aa, Artificial Sequence
  Description of Artificial Sequence: Synthetic peptide
  Seed: LNAIGPWSAL (MAGC3_HUMAN)
LSAIGPWSAM

SEQ ID NO: 106283 - protein, 9 aa, Artificial Sequence
  Description of Artificial Sequence: Synthetic peptide
  Seed: NAIGPWSAL (MAGC3_HUMAN)
NQIGPWSAY

SEQ ID NO: 106284 - protein, 10 aa, Artificial Sequence
  Description of Artificial Sequence: Synthetic peptide
  Seed: SQPEGKFSLR (MAGC3_HUMAN)
SSPEGKFSLY

SEQ ID NO: 106285 - protein, 10 aa, Artificial Sequence
  Description of Artificial Sequence: Synthetic peptide
  Seed: EMQMNVINTY (MAGC3_HUMAN)
EQQMNVINTY

SEQ ID NO: 106286 - protein, 9 aa, Artificial Sequence
  Description of Artificial Sequence: Synthetic peptide
  Seed: KKYKDYFPM (MAGC3_HUMAN)
KAYKDYFPY

SEQ ID NO: 106287 - protein, 9 aa, Artificial Sequence
  Description of Artificial Sequence: Synthetic peptide
  Seed: NTYTGYFPM (MAGC3_HUMAN)
NSYTGYFPV

SEQ ID NO: 106288 - protein, 9 aa, Artificial Sequence
  Description of Artificial Sequence: Synthetic peptide
  Seed: WVKNTCATY (MAGC3_HUMAN)
WQKNTCATY

SEQ ID NO: 106289 - protein, 9 aa, Artificial Sequence
  Description of Artificial Sequence: Synthetic peptide
  Seed: RTLSGSPGL (MAGC3_HUMAN)
RVLSGSPGK

SEQ ID NO: 106290 - protein, 11 aa, Artificial Sequence
  Description of Artificial Sequence: Synthetic peptide
  Seed: IIDTTDDATAM (MAGC3_HUMAN)
IADTTDDATAV

SEQ ID NO: 106291 - protein, 9 aa, Artificial Sequence
  Description of Artificial Sequence: Synthetic peptide
  Seed: QPEGKFSLR (MAGC3_HUMAN)
QYEGKFSLR

SEQ ID NO: 106292 - protein, 9 aa, Artificial Sequence
  Description of Artificial Sequence: Synthetic peptide
  Seed: FSDGSLGQW (MAGC3_HUMAN)
FSDGSLGQY

SEQ ID NO: 106293 - protein, 10 aa, Artificial Sequence
  Description of Artificial Sequence: Synthetic peptide
  Seed: LWKDSDLPTW (MAGC3_HUMAN)
LAKDSDLPTF

SEQ ID NO: 106294 - protein, 10 aa, Artificial Sequence
  Description of Artificial Sequence: Synthetic peptide
  Seed: SALAGFADVL (MAGC3_HUMAN)
SLLAGFADVA

SEQ ID NO: 106295 - protein, 9 aa, Artificial Sequence
  Description of Artificial Sequence: Synthetic peptide
  Seed: VLCPTYFKL (MAGC3_HUMAN)
VFCPTYFKF

SEQ ID NO: 106296 - protein, 10 aa, Artificial Sequence
  Description of Artificial Sequence: Synthetic peptide
  Seed: EKVAELVQFL (MAGC3_HUMAN)
EAVAELVQFL

SEQ ID NO: 106297 - protein, 9 aa, Artificial Sequence
  Description of Artificial Sequence: Synthetic peptide
  Seed: KYKDYFPMI (MAGC3_HUMAN)
KSKDYFPML

SEQ ID NO: 106298 - protein, 9 aa, Artificial Sequence
  Description of Artificial Sequence: Synthetic peptide
  Seed: GKAHEFIEL (MAGC3_HUMAN)
GMAHEFIEY

SEQ ID NO: 106299 - protein, 9 aa, Artificial Sequence
  Description of Artificial Sequence: Synthetic peptide
  Seed: TTDDATAMA (MAGC3_HUMAN)
TNDDATAMY

SEQ ID NO: 106300 - protein, 9 aa, Artificial Sequence
  Description of Artificial Sequence: Synthetic peptide
  Seed: FSLRRAVSV (MAGC3_HUMAN)
FALRRAVSW

SEQ ID NO: 106301 - protein, 9 aa, Artificial Sequence
  Description of Artificial Sequence: Synthetic peptide
  Seed: DYFPMIFGK (MAGC3_HUMAN)
DQFPMIFGK

SEQ ID NO: 106302 - protein, 10 aa, Artificial Sequence
  Description of Artificial Sequence: Synthetic peptide
  Seed: MQMNVINTYT (MAGC3_HUMAN)
MIMNVINTYV

SEQ ID NO: 106303 - protein, 10 aa, Artificial Sequence
  Description of Artificial Sequence: Synthetic peptide
  Seed: LTEASPQQKK (MAGC3_HUMAN)
LTEASPQQKY

SEQ ID NO: 106304 - protein, 9 aa, Artificial Sequence
  Description of Artificial Sequence: Synthetic peptide
  Seed: MPAAGMPPL (MAGC3_HUMAN)
MVAAGMPPI

SEQ ID NO: 106305 - protein, 10 aa, Artificial Sequence
  Description of Artificial Sequence: Synthetic peptide
  Seed: FSDGSLGQWV (MAGC3_HUMAN)
FIDGSLGQWY

SEQ ID NO: 106306 - protein, 9 aa, Artificial Sequence
  Description of Artificial Sequence: Synthetic peptide
  Seed: HLREVRLFL (MAGC3_HUMAN)
HTREVRLFC

SEQ ID NO: 106307 - protein, 8 aa, Artificial Sequence
  Description of Artificial Sequence: Synthetic peptide
  Seed: SCSSPLLW (MAGC3_HUMAN)
SASSPLLW

SEQ ID NO: 106308 - protein, 9 aa, Artificial Sequence
  Description of Artificial Sequence: Synthetic peptide
  Seed: QGMPQNRLL (MAGC3_HUMAN)
QSMPQNRLW

SEQ ID NO: 106309 - protein, 9 aa, Artificial Sequence
  Description of Artificial Sequence: Synthetic peptide
  Seed: SQPEGKFSL (MAGC3_HUMAN)
SIPEGKFSL

SEQ ID NO: 106310 - protein, 9 aa, Artificial Sequence
  Description of Artificial Sequence: Synthetic peptide
  Seed: VIWEVLSAI (MAGC3_HUMAN)
VMWEVLSAY

SEQ ID NO: 106311 - protein, 9 aa, Artificial Sequence
  Description of Artificial Sequence: Synthetic peptide
  Seed: RTLSGSPGL (MAGC3_HUMAN)
RQLSGSPGI

SEQ ID NO: 106312 - protein, 11 aa, Artificial Sequence
  Description of Artificial Sequence: Synthetic peptide
  Seed: FPMIFRKAREF (MAGC3_HUMAN)
FPMIFRKAREL

SEQ ID NO: 106313 - protein, 9 aa, Artificial Sequence
  Description of Artificial Sequence: Synthetic peptide
  Seed: HLREVRLFL (MAGC3_HUMAN)
HWREVRLFY

SEQ ID NO: 106314 - protein, 9 aa, Artificial Sequence
  Description of Artificial Sequence: Synthetic peptide
  Seed: FVNTLDLTC (MAGC3_HUMAN)
FGNTLDLTL

SEQ ID NO: 106315 - protein, 9 aa, Artificial Sequence
  Description of Artificial Sequence: Synthetic peptide
  Seed: HALPESESL (MAGC3_HUMAN)
HTLPESESL

SEQ ID NO: 106316 - protein, 10 aa, Artificial Sequence
  Description of Artificial Sequence: Synthetic peptide
  Seed: KFSLRRAVSV (MAGC3_HUMAN)
KYSLRRAVSK

SEQ ID NO: 106317 - protein, 9 aa, Artificial Sequence
  Description of Artificial Sequence: Synthetic peptide
  Seed: VLPPQPQPR (MAGC3_HUMAN)
VVPPQPQPI

SEQ ID NO: 106318 - protein, 10 aa, Artificial Sequence
  Description of Artificial Sequence: Synthetic peptide
  Seed: SWYMDALKDM (MAGC3_HUMAN)
SDYMDALKDF

SEQ ID NO: 106319 - protein, 9 aa, Artificial Sequence
  Description of Artificial Sequence: Synthetic peptide
  Seed: LILSVIFIK (MAGC3_HUMAN)
LALSVIFIK

SEQ ID NO: 106320 - protein, 11 aa, Artificial Sequence
  Description of Artificial Sequence: Synthetic peptide
  Seed: YALDEKVAELV (MAGC3_HUMAN)
YLLDEKVAELG

SEQ ID NO: 106321 - protein, 9 aa, Artificial Sequence
  Description of Artificial Sequence: Synthetic peptide
  Seed: LDLANPQGL (MAGC3_HUMAN)
LELANPQGV

SEQ ID NO: 106322 - protein, 9 aa, Artificial Sequence
  Description of Artificial Sequence: Synthetic peptide
  Seed: YTLDEKVDK (MAGC3_HUMAN)
YTLDEKVDR

SEQ ID NO: 106323 - protein, 9 aa, Artificial Sequence
  Description of Artificial Sequence: Synthetic peptide
  Seed: KVDKLVQFL (MAGC3_HUMAN)
KQDKLVQFY

SEQ ID NO: 106324 - protein, 10 aa, Artificial Sequence
  Description of Artificial Sequence: Synthetic peptide
  Seed: NTYTGYFPMI (MAGC3_HUMAN)
NMYTGYFPML

SEQ ID NO: 106325 - protein, 11 aa, Artificial Sequence
  Description of Artificial Sequence: Synthetic peptide
  Seed: ILFGISLTEVD (MAGC3_HUMAN)
ILFGISLTEVC

SEQ ID NO: 106326 - protein, 9 aa, Artificial Sequence
  Description of Artificial Sequence: Synthetic peptide
  Seed: NAIGPWSAL (MAGC3_HUMAN)
NTIGPWSAL

SEQ ID NO: 106327 - protein, 9 aa, Artificial Sequence
  Description of Artificial Sequence: Synthetic peptide
  Seed: SLPESEPLF (MAGC3_HUMAN)
SIPESEPLL

SEQ ID NO: 106328 - protein, 9 aa, Artificial Sequence
  Description of Artificial Sequence: Synthetic peptide
  Seed: FGSQPEGKF (MAGC3_HUMAN)
FSSQPEGKY

SEQ ID NO: 106329 - protein, 11 aa, Artificial Sequence
  Description of Artificial Sequence: Synthetic peptide
  Seed: RTLSGSPGLQL (MAGC3_HUMAN)
RVLSGSPGLQR

SEQ ID NO: 106330 - protein, 9 aa, Artificial Sequence
  Description of Artificial Sequence: Synthetic peptide
  Seed: HLREVRLFL (MAGC3_HUMAN)
HVREVRLFS

SEQ ID NO: 106331 - protein, 10 aa, Artificial Sequence
  Description of Artificial Sequence: Synthetic peptide
  Seed: MIFRKAREFI (MAGC3_HUMAN)
MAFRKAREFK

SEQ ID NO: 106332 - protein, 9 aa, Artificial Sequence
  Description of Artificial Sequence: Synthetic peptide
  Seed: LIDDQGMPK (MAGC3_HUMAN)
LLDDQGMPM

SEQ ID NO: 106333 - protein, 10 aa, Artificial Sequence
  Description of Artificial Sequence: Synthetic peptide
  Seed: KYQAKEPLTR (MAGC3_HUMAN)
KVQAKEPLTK

SEQ ID NO: 106334 - protein, 9 aa, Artificial Sequence
  Description of Artificial Sequence: Synthetic peptide
  Seed: NTYTGYFPM (MAGC3_HUMAN)
NWYTGYFPL

SEQ ID NO: 106335 - protein, 9 aa, Artificial Sequence
  Description of Artificial Sequence: Synthetic peptide
  Seed: HFYVFVNTL (MAGC3_HUMAN)
HIYVFVNTV

SEQ ID NO: 106336 - protein, 10 aa, Artificial Sequence
  Description of Artificial Sequence: Synthetic peptide
  Seed: EVLSAIGPIQ (MAGC3_HUMAN)
EILSAIGPIR

SEQ ID NO: 106337 - protein, 9 aa, Artificial Sequence
  Description of Artificial Sequence: Synthetic peptide
  Seed: FEDTLDLTY (MAGC3_HUMAN)
FVDTLDLTF

SEQ ID NO: 106338 - protein, 10 aa, Artificial Sequence
  Description of Artificial Sequence: Synthetic peptide
  Seed: KAHEFIELIF (MAGC3_HUMAN)
KQHEFIELIL

SEQ ID NO: 106339 - protein, 9 aa, Artificial Sequence
  Description of Artificial Sequence: Synthetic peptide
  Seed: KVDKLVQFL (MAGC3_HUMAN)
KRDKLVQFL

SEQ ID NO: 106340 - protein, 9 aa, Artificial Sequence
  Description of Artificial Sequence: Synthetic peptide
  Seed: DGSLGQWVK (MAGC3_HUMAN)
DISLGQWVK

SEQ ID NO: 106341 - protein, 10 aa, Artificial Sequence
  Description of Artificial Sequence: Synthetic peptide
  Seed: KYQAKEPLTR (MAGC3_HUMAN)
KVQAKEPLTR

SEQ ID NO: 106342 - protein, 10 aa, Artificial Sequence
  Description of Artificial Sequence: Synthetic peptide
  Seed: QWVKNTCATY (MAGC3_HUMAN)
QLVKNTCATF

SEQ ID NO: 106343 - protein, 11 aa, Artificial Sequence
  Description of Artificial Sequence: Synthetic peptide
  Seed: ALWESEGPEAF (MAGC3_HUMAN)
ALWESEGPEAY

SEQ ID NO: 106344 - protein, 9 aa, Artificial Sequence
  Description of Artificial Sequence: Synthetic peptide
  Seed: EVIWEVLNA (MAGC3_HUMAN)
EIIWEVLNR

SEQ ID NO: 106345 - protein, 9 aa, Artificial Sequence
  Description of Artificial Sequence: Synthetic peptide
  Seed: ALDEKVAEL (MAGC3_HUMAN)
ARDEKVAEV

SEQ ID NO: 106346 - protein, 9 aa, Artificial Sequence
  Description of Artificial Sequence: Synthetic peptide
  Seed: VLPPQPQPR (MAGC3_HUMAN)
VAPPQPQPY

SEQ ID NO: 106347 - protein, 10 aa, Artificial Sequence
  Description of Artificial Sequence: Synthetic peptide
  Seed: SLVLCPTYFK (MAGC3_HUMAN)
STVLCPTYFY

SEQ ID NO: 106348 - protein, 10 aa, Artificial Sequence
  Description of Artificial Sequence: Synthetic peptide
  Seed: YTLDEKVDKL (MAGC3_HUMAN)
YRLDEKVDKV

SEQ ID NO: 106349 - protein, 9 aa, Artificial Sequence
  Description of Artificial Sequence: Synthetic peptide
  Seed: TSDQRMDSL (MAGC3_HUMAN)
TADQRMDSY

SEQ ID NO: 106350 - protein, 11 aa, Artificial Sequence
  Description of Artificial Sequence: Synthetic peptide
  Seed: SASPSVMSTNF (MAGC3_HUMAN)
SMSPSVMSTNF

SEQ ID NO: 106351 - protein, 9 aa, Artificial Sequence
  Description of Artificial Sequence: Synthetic peptide
  Seed: FPSWYMDAL (MAGC3_HUMAN)
FVSWYMDAM

SEQ ID NO: 106352 - protein, 10 aa, Artificial Sequence
  Description of Artificial Sequence: Synthetic peptide
  Seed: KLSSIIPSAF (MAGC3_HUMAN)
KRSSIIPSAF

SEQ ID NO: 106353 - protein, 9 aa, Artificial Sequence
  Description of Artificial Sequence: Synthetic peptide
  Seed: MPAAGMPPL (MAGC3_HUMAN)
MAAAGMPPL

SEQ ID NO: 106354 - protein, 9 aa, Artificial Sequence
  Description of Artificial Sequence: Synthetic peptide
  Seed: SLRRAVSVK (MAGC3_HUMAN)
SYRRAVSVK

SEQ ID NO: 106355 - protein, 9 aa, Artificial Sequence
  Description of Artificial Sequence: Synthetic peptide
  Seed: TGYFPMIFR (MAGC3_HUMAN)
TWYFPMIFR

SEQ ID NO: 106356 - protein, 9 aa, Artificial Sequence
  Description of Artificial Sequence: Synthetic peptide
  Seed: ALDEKVAEL (MAGC3_HUMAN)
AIDEKVAEC

SEQ ID NO: 106357 - protein, 9 aa, Artificial Sequence
  Description of Artificial Sequence: Synthetic peptide
  Seed: HFYVFVNTL (MAGC3_HUMAN)
HEYVFVNTL

SEQ ID NO: 106358 - protein, 9 aa, Artificial Sequence
  Description of Artificial Sequence: Synthetic peptide
  Seed: IPPQGPPKI (MAGC3_HUMAN)
IFPQGPPKI

SEQ ID NO: 106359 - protein, 9 aa, Artificial Sequence
  Description of Artificial Sequence: Synthetic peptide
  Seed: SLPESEPLF (MAGC3_HUMAN)
SYPESEPLY

SEQ ID NO: 106360 - protein, 10 aa, Artificial Sequence
  Description of Artificial Sequence: Synthetic peptide
  Seed: TLDEKVDKLV (MAGC3_HUMAN)
TSDEKVDKLL

SEQ ID NO: 106361 - protein, 10 aa, Artificial Sequence
  Description of Artificial Sequence: Synthetic peptide
  Seed: MQMNVINTYT (MAGC3_HUMAN)
MMMNVINTYC

SEQ ID NO: 106362 - protein, 9 aa, Artificial Sequence
  Description of Artificial Sequence: Synthetic peptide
  Seed: VIWEVLSAI (MAGC3_HUMAN)
VMWEVLSAW

SEQ ID NO: 106363 - protein, 9 aa, Artificial Sequence
  Description of Artificial Sequence: Synthetic peptide
  Seed: FKLWRTLSG (MAGC3_HUMAN)
FMLWRTLSY

SEQ ID NO: 106364 - protein, 10 aa, Artificial Sequence
  Description of Artificial Sequence: Synthetic peptide
  Seed: RPAREVLEFL (MAGC3_HUMAN)
RHAREVLEFK

SEQ ID NO: 106365 - protein, 9 aa, Artificial Sequence
  Description of Artificial Sequence: Synthetic peptide
  Seed: YFFEDTLDL (MAGC3_HUMAN)
YAFEDTLDH

SEQ ID NO: 106366 - protein, 9 aa, Artificial Sequence
  Description of Artificial Sequence: Synthetic peptide
  Seed: NAIGPWSAL (MAGC3_HUMAN)
NWIGPWSAY

SEQ ID NO: 106367 - protein, 10 aa, Artificial Sequence
  Description of Artificial Sequence: Synthetic peptide
  Seed: INTYTGYFPM (MAGC3_HUMAN)
IHTYTGYFPW

SEQ ID NO: 106368 - protein, 10 aa, Artificial Sequence
  Description of Artificial Sequence: Synthetic peptide
  Seed: MDPDNHSYFF (MAGC3_HUMAN)
MIPDNHSYFM

SEQ ID NO: 106369 - protein, 9 aa, Artificial Sequence
  Description of Artificial Sequence: Synthetic peptide
  Seed: FLSKLSSII (MAGC3_HUMAN)
FASKLSSIV

SEQ ID NO: 106370 - protein, 9 aa, Artificial Sequence
  Description of Artificial Sequence: Synthetic peptide
  Seed: YTGYFPMIF (MAGC3_HUMAN)
YQGYFPMIL

SEQ ID NO: 106371 - protein, 9 aa, Artificial Sequence
  Description of Artificial Sequence: Synthetic peptide
  Seed: MPKNCLLIL (MAGC3_HUMAN)
MAKNCLLIL

SEQ ID NO: 106372 - protein, 9 aa, Artificial Sequence
  Description of Artificial Sequence: Synthetic peptide
  Seed: ALDEKVAEL (MAGC3_HUMAN)
AWDEKVAEI

SEQ ID NO: 106373 - protein, 9 aa, Artificial Sequence
  Description of Artificial Sequence: Synthetic peptide
  Seed: TTDDATAMA (MAGC3_HUMAN)
TFDDATAML

SEQ ID NO: 106374 - protein, 9 aa, Artificial Sequence
  Description of Artificial Sequence: Synthetic peptide
  Seed: ALAGFADVL (MAGC3_HUMAN)
ATAGFADVL

SEQ ID NO: 106375 - protein, 10 aa, Artificial Sequence
  Description of Artificial Sequence: Synthetic peptide
  Seed: KLVQFLLLKY (MAGC3_HUMAN)
KRVQFLLLKY

SEQ ID NO: 106376 - protein, 9 aa, Artificial Sequence
  Description of Artificial Sequence: Synthetic peptide
  Seed: SPQGPPQSP (MAGC3_HUMAN)
SAQGPPQSA

SEQ ID NO: 106377 - protein, 10 aa, Artificial Sequence
  Description of Artificial Sequence: Synthetic peptide
  Seed: LSLPAVSPGK (MAGC3_HUMAN)
LVLPAVSPGR

SEQ ID NO: 106378 - protein, 10 aa, Artificial Sequence
  Description of Artificial Sequence: Synthetic peptide
  Seed: NVINTYTGYF (MAGC3_HUMAN)
NTINTYTGYY

SEQ ID NO: 106379 - protein, 10 aa, Artificial Sequence
  Description of Artificial Sequence: Synthetic peptide
  Seed: GSLPESEPLF (MAGC3_HUMAN)
GQLPESEPLW

SEQ ID NO: 106380 - protein, 9 aa, Artificial Sequence
  Description of Artificial Sequence: Synthetic peptide
  Seed: RTLSGSPGL (MAGC3_HUMAN)
RTLSGSPGV

SEQ ID NO: 106381 - protein, 9 aa, Artificial Sequence
  Description of Artificial Sequence: Synthetic peptide
  Seed: RPAREVLEF (MAGC3_HUMAN)
RMAREVLEW

SEQ ID NO: 106382 - protein, 9 aa, Artificial Sequence
  Description of Artificial Sequence: Synthetic peptide
  Seed: IELIFGIAL (MAGC3_HUMAN)
IELIFGIAT

SEQ ID NO: 106383 - protein, 9 aa, Artificial Sequence
  Description of Artificial Sequence: Synthetic peptide
  Seed: FKLWRTLSG (MAGC3_HUMAN)
FQLWRTLSV

SEQ ID NO: 106384 - protein, 9 aa, Artificial Sequence
  Description of Artificial Sequence: Synthetic peptide
  Seed: EVLEFLSKL (MAGC3_HUMAN)
ELLEFLSKK

SEQ ID NO: 106385 - protein, 9 aa, Artificial Sequence
  Description of Artificial Sequence: Synthetic peptide
  Seed: MIFIKGSCV (MAGC3_HUMAN)
MPFIKGSCI

SEQ ID NO: 106386 - protein, 9 aa, Artificial Sequence
  Description of Artificial Sequence: Synthetic peptide
  Seed: AVSPGKRLW (MAGC3_HUMAN)
AASPGKRLW

SEQ ID NO: 106387 - protein, 9 aa, Artificial Sequence
  Description of Artificial Sequence: Synthetic peptide
  Seed: ATYALSPVV (MAGC3_HUMAN)
AVYALSPVK

SEQ ID NO: 106388 - protein, 10 aa, Artificial Sequence
  Description of Artificial Sequence: Synthetic peptide
  Seed: DMDPDNHSYF (MAGC3_HUMAN)
DADPDNHSYY

SEQ ID NO: 106389 - protein, 9 aa, Artificial Sequence
  Description of Artificial Sequence: Synthetic peptide
  Seed: AMASASPSV (MAGC3_HUMAN)
AEASASPSY

SEQ ID NO: 106390 - protein, 9 aa, Artificial Sequence
  Description of Artificial Sequence: Synthetic peptide
  Seed: EVLEFLSKL (MAGC3_HUMAN)
ENLEFLSKK

SEQ ID NO: 106391 - protein, 10 aa, Artificial Sequence
  Description of Artificial Sequence: Synthetic peptide
  Seed: FKLWRTLSGS (MAGC3_HUMAN)
FMLWRTLSGL

SEQ ID NO: 106392 - protein, 9 aa, Artificial Sequence
  Description of Artificial Sequence: Synthetic peptide
  Seed: NTYTGYFPM (MAGC3_HUMAN)
NAYTGYFPF

SEQ ID NO: 106393 - protein, 9 aa, Artificial Sequence
  Description of Artificial Sequence: Synthetic peptide
  Seed: QMNVINTYT (MAGC3_HUMAN)
QMNVINTYV

SEQ ID NO: 106394 - protein, 9 aa, Artificial Sequence
  Description of Artificial Sequence: Synthetic peptide
  Seed: SQPEGKFSL (MAGC3_HUMAN)
SSPEGKFSV

SEQ ID NO: 106395 - protein, 9 aa, Artificial Sequence
  Description of Artificial Sequence: Synthetic peptide
  Seed: SLVLCPTYF (MAGC3_HUMAN)
SIVLCPTYF

SEQ ID NO: 106396 - protein, 10 aa, Artificial Sequence
  Description of Artificial Sequence: Synthetic peptide
  Seed: ILFGISLTEV (MAGC3_HUMAN)
IQFGISLTEI

SEQ ID NO: 106397 - protein, 9 aa, Artificial Sequence
  Description of Artificial Sequence: Synthetic peptide
  Seed: YTGYFPMIF (MAGC3_HUMAN)
YMGYFPMIW

SEQ ID NO: 106398 - protein, 10 aa, Artificial Sequence
  Description of Artificial Sequence: Synthetic peptide
  Seed: KAHEFIELIF (MAGC3_HUMAN)
KQHEFIELIF

SEQ ID NO: 106399 - protein, 10 aa, Artificial Sequence
  Description of Artificial Sequence: Synthetic peptide
  Seed: PTYFKLWRTL (MAGC3_HUMAN)
PSYFKLWRTF

SEQ ID NO: 106400 - protein, 9 aa, Artificial Sequence
  Description of Artificial Sequence: Synthetic peptide
  Seed: VLCPTYFKL (MAGC3_HUMAN)
VICPTYFKW

SEQ ID NO: 106401 - protein, 9 aa, Artificial Sequence
  Description of Artificial Sequence: Synthetic peptide
  Seed: TLDEKVDKL (MAGC3_HUMAN)
TADEKVDKF

SEQ ID NO: 106402 - protein, 9 aa, Artificial Sequence
  Description of Artificial Sequence: Synthetic peptide
  Seed: ATYALSPVV (MAGC3_HUMAN)
ASYALSPVW

SEQ ID NO: 106403 - protein, 9 aa, Artificial Sequence
  Description of Artificial Sequence: Synthetic peptide
  Seed: LSGSPGLQL (MAGC3_HUMAN)
LRGSPGLQL

SEQ ID NO: 106404 - protein, 9 aa, Artificial Sequence
  Description of Artificial Sequence: Synthetic peptide
  Seed: FSLRRAVSV (MAGC3_HUMAN)
FVLRRAVSM

SEQ ID NO: 106405 - protein, 9 aa, Artificial Sequence
  Description of Artificial Sequence: Synthetic peptide
  Seed: KVAELVQFL (MAGC3_HUMAN)
KQAELVQFL

SEQ ID NO: 106406 - protein, 10 aa, Artificial Sequence
  Description of Artificial Sequence: Synthetic peptide
  Seed: LNAIGPWSAL (MAGC3_HUMAN)
LCAIGPWSAM

SEQ ID NO: 106407 - protein, 9 aa, Artificial Sequence
  Description of Artificial Sequence: Synthetic peptide
  Seed: MIFRKAREF (MAGC3_HUMAN)
MMFRKAREA

SEQ ID NO: 106408 - protein, 10 aa, Artificial Sequence
  Description of Artificial Sequence: Synthetic peptide
  Seed: ATYALSPVVL (MAGC3_HUMAN)
ACYALSPVVF

SEQ ID NO: 106409 - protein, 9 aa, Artificial Sequence
  Description of Artificial Sequence: Synthetic peptide
  Seed: GFADVLSRL (MAGC3_HUMAN)
GQADVLSRI

SEQ ID NO: 106410 - protein, 10 aa, Artificial Sequence
  Description of Artificial Sequence: Synthetic peptide
  Seed: FKLWRTLSGS (MAGC3_HUMAN)
FELWRTLSGM

SEQ ID NO: 106411 - protein, 9 aa, Artificial Sequence
  Description of Artificial Sequence: Synthetic peptide
  Seed: MQMNVINTY (MAGC3_HUMAN)
MYMNVINTL

SEQ ID NO: 106412 - protein, 9 aa, Artificial Sequence
  Description of Artificial Sequence: Synthetic peptide
  Seed: ELIFGIALT (MAGC3_HUMAN)
EMIFGIALI

SEQ ID NO: 106413 - protein, 9 aa, Artificial Sequence
  Description of Artificial Sequence: Synthetic peptide
  Seed: ATDKDYSAF (MAGC3_HUMAN)
ATDKDYSAW

SEQ ID NO: 106414 - protein, 8 aa, Artificial Sequence
  Description of Artificial Sequence: Synthetic peptide
  Seed: MEDRAQAI (MAGC3_HUMAN)
MTDRAQAV

SEQ ID NO: 106415 - protein, 9 aa, Artificial Sequence
  Description of Artificial Sequence: Synthetic peptide
  Seed: VLPPQPQPR (MAGC3_HUMAN)
VYPPQPQPL

SEQ ID NO: 106416 - protein, 11 aa, Artificial Sequence
  Description of Artificial Sequence: Synthetic peptide
  Seed: TTDDATAMASA (MAGC3_HUMAN)
TMDDATAMASL

SEQ ID NO: 106417 - protein, 11 aa, Artificial Sequence
  Description of Artificial Sequence: Synthetic peptide
  Seed: RTLSGSPGLQL (MAGC3_HUMAN)
RMLSGSPGLQK

SEQ ID NO: 106418 - protein, 9 aa, Artificial Sequence
  Description of Artificial Sequence: Synthetic peptide
  Seed: HALPESESL (MAGC3_HUMAN)
HSLPESESY

SEQ ID NO: 106419 - protein, 9 aa, Artificial Sequence
  Description of Artificial Sequence: Synthetic peptide
  Seed: KKYKDYFPM (MAGC3_HUMAN)
KEYKDYFPY

SEQ ID NO: 106420 - protein, 10 aa, Artificial Sequence
  Description of Artificial Sequence: Synthetic peptide
  Seed: TLSGSPGLQL (MAGC3_HUMAN)
TVSGSPGLQY

SEQ ID NO: 106421 - protein, 10 aa, Artificial Sequence
  Description of Artificial Sequence: Synthetic peptide
  Seed: EMQMNVINTY (MAGC3_HUMAN)
EGQMNVINTY

SEQ ID NO: 106422 - protein, 8 aa, Artificial Sequence
  Description of Artificial Sequence: Synthetic peptide
  Seed: TTDDATAM (MAGC3_HUMAN)
TSDDATAM

SEQ ID NO: 106423 - protein, 11 aa, Artificial Sequence
  Description of Artificial Sequence: Synthetic peptide
  Seed: YALDEKVAELV (MAGC3_HUMAN)
YMLDEKVAELF

SEQ ID NO: 106424 - protein, 10 aa, Artificial Sequence
  Description of Artificial Sequence: Synthetic peptide
  Seed: SKLSSIIPSA (MAGC3_HUMAN)
SWLSSIIPSM

SEQ ID NO: 106425 - protein, 9 aa, Artificial Sequence
  Description of Artificial Sequence: Synthetic peptide
  Seed: TGYFPMIFR (MAGC3_HUMAN)
TTYFPMIFY

SEQ ID NO: 106426 - protein, 10 aa, Artificial Sequence
  Description of Artificial Sequence: Synthetic peptide
  Seed: VLCPTYFKLW (MAGC3_HUMAN)
VWCPTYFKLL

SEQ ID NO: 106427 - protein, 10 aa, Artificial Sequence
  Description of Artificial Sequence: Synthetic peptide
  Seed: MQMNVINTYT (MAGC3_HUMAN)
MAMNVINTYV

SEQ ID NO: 106428 - protein, 9 aa, Artificial Sequence
  Description of Artificial Sequence: Synthetic peptide
  Seed: KLVQFLLLK (MAGC3_HUMAN)
KTVQFLLLY

SEQ ID NO: 106429 - protein, 9 aa, Artificial Sequence
  Description of Artificial Sequence: Synthetic peptide
  Seed: ISPQGPPQS (MAGC3_HUMAN)
ISPQGPPQM

SEQ ID NO: 106430 - protein, 9 aa, Artificial Sequence
  Description of Artificial Sequence: Synthetic peptide
  Seed: VIWEVLSAI (MAGC3_HUMAN)
VVWEVLSAY

SEQ ID NO: 106431 - protein, 10 aa, Artificial Sequence
  Description of Artificial Sequence: Synthetic peptide
  Seed: KLVQFLLLKY (MAGC3_HUMAN)
KNVQFLLLKK

SEQ ID NO: 106432 - protein, 10 aa, Artificial Sequence
  Description of Artificial Sequence: Synthetic peptide
  Seed: FKLWRTLSGS (MAGC3_HUMAN)
FPLWRTLSGV

SEQ ID NO: 106433 - protein, 9 aa, Artificial Sequence
  Description of Artificial Sequence: Synthetic peptide
  Seed: YKDYFPMIF (MAGC3_HUMAN)
YYDYFPMIM

SEQ ID NO: 106434 - protein, 8 aa, Artificial Sequence
  Description of Artificial Sequence: Synthetic peptide
  Seed: ASASPSVM (MAGC3_HUMAN)
AAASPSVY

SEQ ID NO: 106435 - protein, 9 aa, Artificial Sequence
  Description of Artificial Sequence: Synthetic peptide
  Seed: KAHEFIELI (MAGC3_HUMAN)
KTHEFIELK

SEQ ID NO: 106436 - protein, 9 aa, Artificial Sequence
  Description of Artificial Sequence: Synthetic peptide
  Seed: KVDKLVQFL (MAGC3_HUMAN)
KQDKLVQFI

SEQ ID NO: 106437 - protein, 9 aa, Artificial Sequence
  Description of Artificial Sequence: Synthetic peptide
  Seed: HLREVRLFL (MAGC3_HUMAN)
HSREVRLFG

SEQ ID NO: 106438 - protein, 9 aa, Artificial Sequence
  Description of Artificial Sequence: Synthetic peptide
  Seed: AGFADVLSR (MAGC3_HUMAN)
ARFADVLSV

SEQ ID NO: 106439 - protein, 9 aa, Artificial Sequence
  Description of Artificial Sequence: Synthetic peptide
  Seed: KVDKLVQFL (MAGC3_HUMAN)
KMDKLVQFY

SEQ ID NO: 106440 - protein, 9 aa, Artificial Sequence
  Description of Artificial Sequence: Synthetic peptide
  Seed: MDPDNHSYF (MAGC3_HUMAN)
MGPDNHSYI

SEQ ID NO: 106441 - protein, 10 aa, Artificial Sequence
  Description of Artificial Sequence: Synthetic peptide
  Seed: SCSSPLLWTR (MAGC3_HUMAN)
SSSSPLLWTR

SEQ ID NO: 106442 - protein, 10 aa, Artificial Sequence
  Description of Artificial Sequence: Synthetic peptide
  Seed: MNVINTYTGY (MAGC3_HUMAN)
MMVINTYTGR

SEQ ID NO: 106443 - protein, 10 aa, Artificial Sequence
  Description of Artificial Sequence: Synthetic peptide
  Seed: MPKNCLLILI (MAGC3_HUMAN)
MPKNCLLILY

SEQ ID NO: 106444 - protein, 11 aa, Artificial Sequence
  Description of Artificial Sequence: Synthetic peptide
  Seed: LSLPAVSPGKR (MAGC3_HUMAN)
LTLPAVSPGKR

SEQ ID NO: 106445 - protein, 9 aa, Artificial Sequence
  Description of Artificial Sequence: Synthetic peptide
  Seed: KAHEFIELI (MAGC3_HUMAN)
KIHEFIELW

SEQ ID NO: 106446 - protein, 10 aa, Artificial Sequence
  Description of Artificial Sequence: Synthetic peptide
  Seed: YSAFHLGHLR (MAGC3_HUMAN)
YAAFHLGHLK

SEQ ID NO: 106447 - protein, 9 aa, Artificial Sequence
  Description of Artificial Sequence: Synthetic peptide
  Seed: YQTKEPVTK (MAGC3_HUMAN)
YTTKEPVTI

SEQ ID NO: 106448 - protein, 9 aa, Artificial Sequence
  Description of Artificial Sequence: Synthetic peptide
  Seed: ATYALSPVV (MAGC3_HUMAN)
ATYALSPVI

SEQ ID NO: 106449 - protein, 10 aa, Artificial Sequence
  Description of Artificial Sequence: Synthetic peptide
  Seed: YALDEKVAEL (MAGC3_HUMAN)
YNLDEKVAEA

SEQ ID NO: 106450 - protein, 9 aa, Artificial Sequence
  Description of Artificial Sequence: Synthetic peptide
  Seed: MDPDNHSYF (MAGC3_HUMAN)
MMPDNHSYF

SEQ ID NO: 106451 - protein, 9 aa, Artificial Sequence
  Description of Artificial Sequence: Synthetic peptide
  Seed: KLWRTLSGS (MAGC3_HUMAN)
KQWRTLSGL

SEQ ID NO: 106452 - protein, 9 aa, Artificial Sequence
  Description of Artificial Sequence: Synthetic peptide
  Seed: FFEDTLDLT (MAGC3_HUMAN)
FWEDTLDLF

SEQ ID NO: 106453 - protein, 9 aa, Artificial Sequence
  Description of Artificial Sequence: Synthetic peptide
  Seed: SAFHLGHLR (MAGC3_HUMAN)
SPFHLGHLR

SEQ ID NO: 106454 - protein, 10 aa, Artificial Sequence
  Description of Artificial Sequence: Synthetic peptide
  Seed: LDLANPQGLA (MAGC3_HUMAN)
LTLANPQGLV

SEQ ID NO: 106455 - protein, 11 aa, Artificial Sequence
  Description of Artificial Sequence: Synthetic peptide
  Seed: AEMQMNVINTY (MAGC3_HUMAN)
AMMQMNVINTF

SEQ ID NO: 106456 - protein, 11 aa, Artificial Sequence
  Description of Artificial Sequence: Synthetic peptide
  Seed: TAMASASPSVM (MAGC3_HUMAN)
TSMASASPSVY

SEQ ID NO: 106457 - protein, 9 aa, Artificial Sequence
  Description of Artificial Sequence: Synthetic peptide
  Seed: GSLPESEPL (MAGC3_HUMAN)
GMLPESEPY

SEQ ID NO: 106458 - protein, 9 aa, Artificial Sequence
  Description of Artificial Sequence: Synthetic peptide
  Seed: GLQLSDLHF (MAGC3_HUMAN)
GKQLSDLHY

SEQ ID NO: 106459 - protein, 11 aa, Artificial Sequence
  Description of Artificial Sequence: Synthetic peptide
  Seed: LSKLSSIIPSA (MAGC3_HUMAN)
LIKLSSIIPSI

SEQ ID NO: 106460 - protein, 10 aa, Artificial Sequence
  Description of Artificial Sequence: Synthetic peptide
  Seed: ILILSVIFIK (MAGC3_HUMAN)
IVILSVIFIR

SEQ ID NO: 106461 - protein, 9 aa, Artificial Sequence
  Description of Artificial Sequence: Synthetic peptide
  Seed: NAIGPWSAL (MAGC3_HUMAN)
NIIGPWSAI

SEQ ID NO: 106462 - protein, 11 aa, Artificial Sequence
  Description of Artificial Sequence: Synthetic peptide
  Seed: TSDQRMDSLVL (MAGC3_HUMAN)
TVDQRMDSLVF

SEQ ID NO: 106463 - protein, 10 aa, Artificial Sequence
  Description of Artificial Sequence: Synthetic peptide
  Seed: ALDEKVAELV (MAGC3_HUMAN)
AADEKVAELL

SEQ ID NO: 106464 - protein, 9 aa, Artificial Sequence
  Description of Artificial Sequence: Synthetic peptide
  Seed: WESEGPEAF (MAGC3_HUMAN)
WISEGPEAY

SEQ ID NO: 106465 - protein, 10 aa, Artificial Sequence
  Description of Artificial Sequence: Synthetic peptide
  Seed: SCSSPLLWTR (MAGC3_HUMAN)
SNSSPLLWTK

SEQ ID NO: 106466 - protein, 10 aa, Artificial Sequence
  Description of Artificial Sequence: Synthetic peptide
  Seed: ALDEKVAELV (MAGC3_HUMAN)
AVDEKVAELI

SEQ ID NO: 106467 - protein, 9 aa, Artificial Sequence
  Description of Artificial Sequence: Synthetic peptide
  Seed: SASPSVMST (MAGC3_HUMAN)
SRSPSVMSV

SEQ ID NO: 106468 - protein, 11 aa, Artificial Sequence
  Description of Artificial Sequence: Synthetic peptide
  Seed: LSLPAVSPGKR (MAGC3_HUMAN)
LMLPAVSPGKR

SEQ ID NO: 106469 - protein, 9 aa, Artificial Sequence
  Description of Artificial Sequence: Synthetic peptide
  Seed: MIFGKAHEF (MAGC3_HUMAN)
MTFGKAHEM

SEQ ID NO: 106470 - protein, 9 aa, Artificial Sequence
  Description of Artificial Sequence: Synthetic peptide
  Seed: YQTKEPVTK (MAGC3_HUMAN)
YSTKEPVTM

SEQ ID NO: 106471 - protein, 9 aa, Artificial Sequence
  Description of Artificial Sequence: Synthetic peptide
  Seed: MEDRAQAII (MAGC3_HUMAN)
MTDRAQAII

SEQ ID NO: 106472 - protein, 9 aa, Artificial Sequence
  Description of Artificial Sequence: Synthetic peptide
  Seed: SAIGPIQRP (MAGC3_HUMAN)
SMIGPIQRY

SEQ ID NO: 106473 - protein, 9 aa, Artificial Sequence
  Description of Artificial Sequence: Synthetic peptide
  Seed: WVKNTCATY (MAGC3_HUMAN)
WKKNTCATY

SEQ ID NO: 106474 - protein, 9 aa, Artificial Sequence
  Description of Artificial Sequence: Synthetic peptide
  Seed: QAKEPLTRA (MAGC3_HUMAN)
QPKEPLTRM

SEQ ID NO: 106475 - protein, 9 aa, Artificial Sequence
  Description of Artificial Sequence: Synthetic peptide
  Seed: WRRGTGYTL (MAGC3_HUMAN)
WRRGTGYTM

SEQ ID NO: 106476 - protein, 9 aa, Artificial Sequence
  Description of Artificial Sequence: Synthetic peptide
  Seed: LSGSPGLQL (MAGC3_HUMAN)
LAGSPGLQI

SEQ ID NO: 106477 - protein, 9 aa, Artificial Sequence
  Description of Artificial Sequence: Synthetic peptide
  Seed: LKYQAKEPL (MAGC3_HUMAN)
LNYQAKEPF

SEQ ID NO: 106478 - protein, 10 aa, Artificial Sequence
  Description of Artificial Sequence: Synthetic peptide
  Seed: NTYTGYFPMI (MAGC3_HUMAN)
NRYTGYFPMF

SEQ ID NO: 106479 - protein, 10 aa, Artificial Sequence
  Description of Artificial Sequence: Synthetic peptide
  Seed: REVLEFLSKL (MAGC3_HUMAN)
RMVLEFLSKM

SEQ ID NO: 106480 - protein, 9 aa, Artificial Sequence
  Description of Artificial Sequence: Synthetic peptide
  Seed: RTLSGSPGL (MAGC3_HUMAN)
RTLSGSPGK

SEQ ID NO: 106481 - protein, 10 aa, Artificial Sequence
  Description of Artificial Sequence: Synthetic peptide
  Seed: VLCPTYFKLW (MAGC3_HUMAN)
VFCPTYFKLW

SEQ ID NO: 106482 - protein, 11 aa, Artificial Sequence
  Description of Artificial Sequence: Synthetic peptide
  Seed: AEMQMNVINTY (MAGC3_HUMAN)
ASMQMNVINTY

SEQ ID NO: 106483 - protein, 10 aa, Artificial Sequence
  Description of Artificial Sequence: Synthetic peptide
  Seed: EKVAELVQFL (MAGC3_HUMAN)
EGVAELVQFV

SEQ ID NO: 106484 - protein, 9 aa, Artificial Sequence
  Description of Artificial Sequence: Synthetic peptide
  Seed: KAHEFIELI (MAGC3_HUMAN)
KQHEFIELF

SEQ ID NO: 106485 - protein, 9 aa, Artificial Sequence
  Description of Artificial Sequence: Synthetic peptide
  Seed: EKVAELVQF (MAGC3_HUMAN)
EQVAELVQF

SEQ ID NO: 106486 - protein, 9 aa, Artificial Sequence
  Description of Artificial Sequence: Synthetic peptide
  Seed: SALAGFADV (MAGC3_HUMAN)
SALAGFADF

SEQ ID NO: 106487 - protein, 9 aa, Artificial Sequence
  Description of Artificial Sequence: Synthetic peptide
  Seed: SASPSVMST (MAGC3_HUMAN)
SPSPSVMSM

SEQ ID NO: 106488 - protein, 9 aa, Artificial Sequence
  Description of Artificial Sequence: Synthetic peptide
  Seed: KVDKLVQFL (MAGC3_HUMAN)
KTDKLVQFW

SEQ ID NO: 106489 - protein, 10 aa, Artificial Sequence
  Description of Artificial Sequence: Synthetic peptide
  Seed: TYFKLWRTLS (MAGC3_HUMAN)
TYFKLWRTLW

SEQ ID NO: 106490 - protein, 10 aa, Artificial Sequence
  Description of Artificial Sequence: Synthetic peptide
  Seed: HEFIELIFGI (MAGC3_HUMAN)
HEFIELIFGY

SEQ ID NO: 106491 - protein, 11 aa, Artificial Sequence
  Description of Artificial Sequence: Synthetic peptide
  Seed: AIGPWSALAGF (MAGC3_HUMAN)
AMGPWSALAGW

SEQ ID NO: 106492 - protein, 10 aa, Artificial Sequence
  Description of Artificial Sequence: Synthetic peptide
  Seed: TAMASASPSV (MAGC3_HUMAN)
TMMASASPSI

SEQ ID NO: 106493 - protein, 9 aa, Artificial Sequence
  Description of Artificial Sequence: Synthetic peptide
  Seed: HFYVFVNTL (MAGC3_HUMAN)
HEYVFVNTF

SEQ ID NO: 106494 - protein, 9 aa, Artificial Sequence
  Description of Artificial Sequence: Synthetic peptide
  Seed: KVDKLVQFL (MAGC3_HUMAN)
KGDKLVQFL

SEQ ID NO: 106495 - protein, 9 aa, Artificial Sequence
  Description of Artificial Sequence: Synthetic peptide
  Seed: SALAGFADV (MAGC3_HUMAN)
SVLAGFADA

SEQ ID NO: 106496 - protein, 9 aa, Artificial Sequence
  Description of Artificial Sequence: Synthetic peptide
  Seed: AELVQFLLL (MAGC3_HUMAN)
AELVQFLLY

SEQ ID NO: 106497 - protein, 9 aa, Artificial Sequence
  Description of Artificial Sequence: Synthetic peptide
  Seed: EIPPQGPPK (MAGC3_HUMAN)
EAPPQGPPR

SEQ ID NO: 106498 - protein, 9 aa, Artificial Sequence
  Description of Artificial Sequence: Synthetic peptide
  Seed: GKFSLRRAV (MAGC3_HUMAN)
GQFSLRRAL

SEQ ID NO: 106499 - protein, 9 aa, Artificial Sequence
  Description of Artificial Sequence: Synthetic peptide
  Seed: VLCPTYFKL (MAGC3_HUMAN)
VFCPTYFKI

SEQ ID NO: 106500 - protein, 9 aa, Artificial Sequence
  Description of Artificial Sequence: Synthetic peptide
  Seed: MIFGKAHEF (MAGC3_HUMAN)
MKFGKAHEL

SEQ ID NO: 106501 - protein, 11 aa, Artificial Sequence
  Description of Artificial Sequence: Synthetic peptide
  Seed: LSDEQGMPQNR (MAGC3_HUMAN)
LMDEQGMPQNY

SEQ ID NO: 106502 - protein, 11 aa, Artificial Sequence
  Description of Artificial Sequence: Synthetic peptide
  Seed: IQRPAREVLEF (MAGC3_HUMAN)
IQRPAREVLEY

SEQ ID NO: 106503 - protein, 9 aa, Artificial Sequence
  Description of Artificial Sequence: Synthetic peptide
  Seed: SPQGPPQSP (MAGC3_HUMAN)
SHQGPPQSI

SEQ ID NO: 106504 - protein, 10 aa, Artificial Sequence
  Description of Artificial Sequence: Synthetic peptide
  Seed: LNAIGPWSAL (MAGC3_HUMAN)
LLAIGPWSAL

SEQ ID NO: 106505 - protein, 10 aa, Artificial Sequence
  Description of Artificial Sequence: Synthetic peptide
  Seed: LDSCSSPLLW (MAGC3_HUMAN)
LQSCSSPLLF

SEQ ID NO: 106506 - protein, 9 aa, Artificial Sequence
  Description of Artificial Sequence: Synthetic peptide
  Seed: KDMEDRAQA (MAGC3_HUMAN)
KEMEDRAQA

SEQ ID NO: 106507 - protein, 10 aa, Artificial Sequence
  Description of Artificial Sequence: Synthetic peptide
  Seed: ILILSMIFIK (MAGC3_HUMAN)
IMILSMIFIK

SEQ ID NO: 106508 - protein, 9 aa, Artificial Sequence
  Description of Artificial Sequence: Synthetic peptide
  Seed: GSLPESEPL (MAGC3_HUMAN)
GLLPESEPF

SEQ ID NO: 106509 - protein, 10 aa, Artificial Sequence
  Description of Artificial Sequence: Synthetic peptide
  Seed: QEDGRRGLTE (MAGC3_HUMAN)
QEDGRRGLTV

SEQ ID NO: 106510 - protein, 9 aa, Artificial Sequence
  Description of Artificial Sequence: Synthetic peptide
  Seed: RPAREVLEF (MAGC3_HUMAN)
RPAREVLEI

SEQ ID NO: 106511 - protein, 10 aa, Artificial Sequence
  Description of Artificial Sequence: Synthetic peptide
  Seed: IELIFGIALT (MAGC3_HUMAN)
IQLIFGIALV

SEQ ID NO: 106512 - protein, 9 aa, Artificial Sequence
  Description of Artificial Sequence: Synthetic peptide
  Seed: KVAELVQFL (MAGC3_HUMAN)
KFAELVQFV

SEQ ID NO: 106513 - protein, 9 aa, Artificial Sequence
  Description of Artificial Sequence: Synthetic peptide
  Seed: SQPEGKFSL (MAGC3_HUMAN)
SFPEGKFSM

SEQ ID NO: 106514 - protein, 10 aa, Artificial Sequence
  Description of Artificial Sequence: Synthetic peptide
  Seed: KKYKDYFPMI (MAGC3_HUMAN)
KRYKDYFPML

SEQ ID NO: 106515 - protein, 10 aa, Artificial Sequence
  Description of Artificial Sequence: Synthetic peptide
  Seed: IELIFGIALT (MAGC3_HUMAN)
IALIFGIALL

SEQ ID NO: 106516 - protein, 9 aa, Artificial Sequence
  Description of Artificial Sequence: Synthetic peptide
  Seed: KVDKLVQFL (MAGC3_HUMAN)
KSDKLVQFL

SEQ ID NO: 106517 - protein, 9 aa, Artificial Sequence
  Description of Artificial Sequence: Synthetic peptide
  Seed: EVLEFLSKL (MAGC3_HUMAN)
EILEFLSKK

SEQ ID NO: 106518 - protein, 9 aa, Artificial Sequence
  Description of Artificial Sequence: Synthetic peptide
  Seed: MIFRKAREF (MAGC3_HUMAN)
MYFRKAREI

SEQ ID NO: 106519 - protein, 8 aa, Artificial Sequence
  Description of Artificial Sequence: Synthetic peptide
  Seed: FIELIFGI (MAGC3_HUMAN)
FLELIFGM

SEQ ID NO: 106520 - protein, 10 aa, Artificial Sequence
  Description of Artificial Sequence: Synthetic peptide
  Seed: TDMDPDNHSY (MAGC3_HUMAN)
TKMDPDNHSF

SEQ ID NO: 106521 - protein, 9 aa, Artificial Sequence
  Description of Artificial Sequence: Synthetic peptide
  Seed: ATDKDYSAF (MAGC3_HUMAN)
AYDKDYSAF

SEQ ID NO: 106522 - protein, 9 aa, Artificial Sequence
  Description of Artificial Sequence: Synthetic peptide
  Seed: MIFRKAREF (MAGC3_HUMAN)
MMFRKAREV

SEQ ID NO: 106523 - protein, 10 aa, Artificial Sequence
  Description of Artificial Sequence: Synthetic peptide
  Seed: MPAAGMPPLP (MAGC3_HUMAN)
MPAAGMPPLS

SEQ ID NO: 106524 - protein, 9 aa, Artificial Sequence
  Description of Artificial Sequence: Synthetic peptide
  Seed: VDPDHFYVF (MAGC3_HUMAN)
VRPDHFYVF

SEQ ID NO: 106525 - protein, 10 aa, Artificial Sequence
  Description of Artificial Sequence: Synthetic peptide
  Seed: LDSCSSPLLW (MAGC3_HUMAN)
LTSCSSPLLY

SEQ ID NO: 106526 - protein, 9 aa, Artificial Sequence
  Description of Artificial Sequence: Synthetic peptide
  Seed: SLVLCPTYF (MAGC3_HUMAN)
SQVLCPTYV

SEQ ID NO: 106527 - protein, 9 aa, Artificial Sequence
  Description of Artificial Sequence: Synthetic peptide
  Seed: EVLNAIGPW (MAGC3_HUMAN)
EILNAIGPW

SEQ ID NO: 106528 - protein, 9 aa, Artificial Sequence
  Description of Artificial Sequence: Synthetic peptide
  Seed: KDMEDRAQA (MAGC3_HUMAN)
KEMEDRAQP

SEQ ID NO: 106529 - protein, 9 aa, Artificial Sequence
  Description of Artificial Sequence: Synthetic peptide
  Seed: TLDEKVDKL (MAGC3_HUMAN)
TCDEKVDKL

SEQ ID NO: 106530 - protein, 9 aa, Artificial Sequence
  Description of Artificial Sequence: Synthetic peptide
  Seed: MIFGKAHEF (MAGC3_HUMAN)
MPFGKAHEH

SEQ ID NO: 106531 - protein, 9 aa, Artificial Sequence
  Description of Artificial Sequence: Synthetic peptide
  Seed: LSGSPGLQL (MAGC3_HUMAN)
LQGSPGLQL

SEQ ID NO: 106532 - protein, 9 aa, Artificial Sequence
  Description of Artificial Sequence: Synthetic peptide
  Seed: TTDDATAMA (MAGC3_HUMAN)
TADDATAMA

SEQ ID NO: 106533 - protein, 8 aa, Artificial Sequence
  Description of Artificial Sequence: Synthetic peptide
  Seed: TTDDATAM (MAGC3_HUMAN)
TLDDATAM

SEQ ID NO: 106534 - protein, 9 aa, Artificial Sequence
  Description of Artificial Sequence: Synthetic peptide
  Seed: FPSWYMDAL (MAGC3_HUMAN)
FPSWYMDAH

SEQ ID NO: 106535 - protein, 9 aa, Artificial Sequence
  Description of Artificial Sequence: Synthetic peptide
  Seed: CATYALSPV (MAGC3_HUMAN)
CSTYALSPV

SEQ ID NO: 106536 - protein, 10 aa, Artificial Sequence
  Description of Artificial Sequence: Synthetic peptide
  Seed: KDYFPMIFGK (MAGC3_HUMAN)
KAYFPMIFGR

SEQ ID NO: 106537 - protein, 10 aa, Artificial Sequence
  Description of Artificial Sequence: Synthetic peptide
  Seed: AMASASPSVM (MAGC3_HUMAN)
AIASASPSVF

SEQ ID NO: 106538 - protein, 11 aa, Artificial Sequence
  Description of Artificial Sequence: Synthetic peptide
  Seed: ATFSDGSLGQW (MAGC3_HUMAN)
AGFSDGSLGQW

SEQ ID NO: 106539 - protein, 9 aa, Artificial Sequence
  Description of Artificial Sequence: Synthetic peptide
  Seed: EVLEFLSKL (MAGC3_HUMAN)
ELLEFLSKY

SEQ ID NO: 106540 - protein, 9 aa, Artificial Sequence
  Description of Artificial Sequence: Synthetic peptide
  Seed: MLTTVIKKY (MAGC3_HUMAN)
MQTTVIKKY

SEQ ID NO: 106541 - protein, 10 aa, Artificial Sequence
  Description of Artificial Sequence: Synthetic peptide
  Seed: SWYMDALKDM (MAGC3_HUMAN)
SGYMDALKDF

SEQ ID NO: 106542 - protein, 10 aa, Artificial Sequence
  Description of Artificial Sequence: Synthetic peptide
  Seed: SQPEGKFSLR (MAGC3_HUMAN)
SSPEGKFSLR

SEQ ID NO: 106543 - protein, 9 aa, Artificial Sequence
  Description of Artificial Sequence: Synthetic peptide
  Seed: ASEEVIWEV (MAGC3_HUMAN)
AAEEVIWEL

SEQ ID NO: 106544 - protein, 10 aa, Artificial Sequence
  Description of Artificial Sequence: Synthetic peptide
  Seed: TLSGSPGLQL (MAGC3_HUMAN)
TQSGSPGLQL

SEQ ID NO: 106545 - protein, 11 aa, Artificial Sequence
  Description of Artificial Sequence: Synthetic peptide
  Seed: DSCSSPLLWTR (MAGC3_HUMAN)
DACSSPLLWTR

SEQ ID NO: 106546 - protein, 11 aa, Artificial Sequence
  Description of Artificial Sequence: Synthetic peptide
  Seed: YMDALKDMEDR (MAGC3_HUMAN)
YTDALKDMEDY

SEQ ID NO: 106547 - protein, 11 aa, Artificial Sequence
  Description of Artificial Sequence: Synthetic peptide
  Seed: ATAMASASPSV (MAGC3_HUMAN)
AAAMASASPSV

SEQ ID NO: 106548 - protein, 9 aa, Artificial Sequence
  Description of Artificial Sequence: Synthetic peptide
  Seed: AMASASPSV (MAGC3_HUMAN)
AIASASPSF

SEQ ID NO: 106549 - protein, 9 aa, Artificial Sequence
  Description of Artificial Sequence: Synthetic peptide
  Seed: MIFIKGSCV (MAGC3_HUMAN)
MMFIKGSCA

SEQ ID NO: 106550 - protein, 11 aa, Artificial Sequence
  Description of Artificial Sequence: Synthetic peptide
  Seed: RTLSGSPGLQL (MAGC3_HUMAN)
RWLSGSPGLQY

SEQ ID NO: 106551 - protein, 9 aa, Artificial Sequence
  Description of Artificial Sequence: Synthetic peptide
  Seed: LKYQTKEPV (MAGC3_HUMAN)
LFYQTKEPF

SEQ ID NO: 106552 - protein, 9 aa, Artificial Sequence
  Description of Artificial Sequence: Synthetic peptide
  Seed: FSDGSLGQW (MAGC3_HUMAN)
FYDGSLGQI

SEQ ID NO: 106553 - protein, 9 aa, Artificial Sequence
  Description of Artificial Sequence: Synthetic peptide
  Seed: ALDEKVAEL (MAGC3_HUMAN)
ATDEKVAEF

SEQ ID NO: 106554 - protein, 10 aa, Artificial Sequence
  Description of Artificial Sequence: Synthetic peptide
  Seed: TDMDPDNHSY (MAGC3_HUMAN)
TMMDPDNHSL

SEQ ID NO: 106555 - protein, 9 aa, Artificial Sequence
  Description of Artificial Sequence: Synthetic peptide
  Seed: FKLWRTLSG (MAGC3_HUMAN)
FALWRTLSY

SEQ ID NO: 106556 - protein, 9 aa, Artificial Sequence
  Description of Artificial Sequence: Synthetic peptide
  Seed: FHLGHLREV (MAGC3_HUMAN)
FFLGHLREM

SEQ ID NO: 106557 - protein, 9 aa, Artificial Sequence
  Description of Artificial Sequence: Synthetic peptide
  Seed: ALDEKVAEL (MAGC3_HUMAN)
AYDEKVAEV

SEQ ID NO: 106558 - protein, 9 aa, Artificial Sequence
  Description of Artificial Sequence: Synthetic peptide
  Seed: FSDGSLGQW (MAGC3_HUMAN)
FQDGSLGQF

SEQ ID NO: 106559 - protein, 9 aa, Artificial Sequence
  Description of Artificial Sequence: Synthetic peptide
  Seed: SLPESEPLF (MAGC3_HUMAN)
SRPESEPLY

SEQ ID NO: 106560 - protein, 9 aa, Artificial Sequence
  Description of Artificial Sequence: Synthetic peptide
  Seed: NTYTGYFPM (MAGC3_HUMAN)
NGYTGYFPR

SEQ ID NO: 106561 - protein, 11 aa, Artificial Sequence
  Description of Artificial Sequence: Synthetic peptide
  Seed: DYSAFHLGHLR (MAGC3_HUMAN)
DASAFHLGHLR

SEQ ID NO: 106562 - protein, 10 aa, Artificial Sequence
  Description of Artificial Sequence: Synthetic peptide
  Seed: YALSPVVLPP (MAGC3_HUMAN)
YWLSPVVLPI

SEQ ID NO: 106563 - protein, 11 aa, Artificial Sequence
  Description of Artificial Sequence: Synthetic peptide
  Seed: FIELIFGIALT (MAGC3_HUMAN)
FQELIFGIALV

SEQ ID NO: 106564 - protein, 9 aa, Artificial Sequence
  Description of Artificial Sequence: Synthetic peptide
  Seed: HFYVFVNTL (MAGC3_HUMAN)
HWYVFVNTL

SEQ ID NO: 106565 - protein, 10 aa, Artificial Sequence
  Description of Artificial Sequence: Synthetic peptide
  Seed: EVIWEVLSAI (MAGC3_HUMAN)
EAIWEVLSAA

SEQ ID NO: 106566 - protein, 9 aa, Artificial Sequence
  Description of Artificial Sequence: Synthetic peptide
  Seed: GFADVLSRL (MAGC3_HUMAN)
GRADVLSRF

SEQ ID NO: 106567 - protein, 9 aa, Artificial Sequence
  Description of Artificial Sequence: Synthetic peptide
  Seed: MASASPSVM (MAGC3_HUMAN)
MLSASPSVY

SEQ ID NO: 106568 - protein, 10 aa, Artificial Sequence
  Description of Artificial Sequence: Synthetic peptide
  Seed: DMPAAGMPPL (MAGC3_HUMAN)
DFPAAGMPPY

SEQ ID NO: 106569 - protein, 9 aa, Artificial Sequence
  Description of Artificial Sequence: Synthetic peptide
  Seed: AMASASPSV (MAGC3_HUMAN)
AAASASPSV

SEQ ID NO: 106570 - protein, 9 aa, Artificial Sequence
  Description of Artificial Sequence: Synthetic peptide
  Seed: GSLPESEPL (MAGC3_HUMAN)
GILPESEPI

SEQ ID NO: 106571 - protein, 10 aa, Artificial Sequence
  Description of Artificial Sequence: Synthetic peptide
  Seed: TYFKLWRTLS (MAGC3_HUMAN)
TFFKLWRTLF

SEQ ID NO: 106572 - protein, 10 aa, Artificial Sequence
  Description of Artificial Sequence: Synthetic peptide
  Seed: KAHEFIELIF (MAGC3_HUMAN)
KTHEFIELIF

SEQ ID NO: 106573 - protein, 9 aa, Artificial Sequence
  Description of Artificial Sequence: Synthetic peptide
  Seed: VPEEVIWEV (MAGC3_HUMAN)
VTEEVIWEI

SEQ ID NO: 106574 - protein, 9 aa, Artificial Sequence
  Description of Artificial Sequence: Synthetic peptide
  Seed: TEVDPDHFY (MAGC3_HUMAN)
TQVDPDHFY

SEQ ID NO: 106575 - protein, 10 aa, Artificial Sequence
  Description of Artificial Sequence: Synthetic peptide
  Seed: IPSAFPSWYM (MAGC3_HUMAN)
ISSAFPSWYL

SEQ ID NO: 106576 - protein, 10 aa, Artificial Sequence
  Description of Artificial Sequence: Synthetic peptide
  Seed: LLILILSVIF (MAGC3_HUMAN)
LMILILSVIY

SEQ ID NO: 106577 - protein, 11 aa, Artificial Sequence
  Description of Artificial Sequence: Synthetic peptide
  Seed: RYALDEKVAEL (MAGC3_HUMAN)
RYALDEKVAEF

SEQ ID NO: 106578 - protein, 9 aa, Artificial Sequence
  Description of Artificial Sequence: Synthetic peptide
  Seed: HLREVRLFL (MAGC3_HUMAN)
HNREVRLFY

SEQ ID NO: 106579 - protein, 9 aa, Artificial Sequence
  Description of Artificial Sequence: Synthetic peptide
  Seed: IIDTTDDAT (MAGC3_HUMAN)
IVDTTDDAF

SEQ ID NO: 106580 - protein, 9 aa, Artificial Sequence
  Description of Artificial Sequence: Synthetic peptide
  Seed: YFFEDTLDL (MAGC3_HUMAN)
YVFEDTLDM

SEQ ID NO: 106581 - protein, 9 aa, Artificial Sequence
  Description of Artificial Sequence: Synthetic peptide
  Seed: YTGYFPMIF (MAGC3_HUMAN)
YHGYFPMIF

SEQ ID NO: 106582 - protein, 10 aa, Artificial Sequence
  Description of Artificial Sequence: Synthetic peptide
  Seed: KAEMLTTVIK (MAGC3_HUMAN)
KSEMLTTVIR

SEQ ID NO: 106583 - protein, 9 aa, Artificial Sequence
  Description of Artificial Sequence: Synthetic peptide
  Seed: YQAKEPLTR (MAGC3_HUMAN)
YRAKEPLTY

SEQ ID NO: 106584 - protein, 9 aa, Artificial Sequence
  Description of Artificial Sequence: Synthetic peptide
  Seed: TAMASASPS (MAGC3_HUMAN)
TTMASASPY

SEQ ID NO: 106585 - protein, 9 aa, Artificial Sequence
  Description of Artificial Sequence: Synthetic peptide
  Seed: AMASASPSV (MAGC3_HUMAN)
AAASASPSH

SEQ ID NO: 106586 - protein, 10 aa, Artificial Sequence
  Description of Artificial Sequence: Synthetic peptide
  Seed: ASPSVMSTNF (MAGC3_HUMAN)
AAPSVMSTNY

SEQ ID NO: 106587 - protein, 9 aa, Artificial Sequence
  Description of Artificial Sequence: Synthetic peptide
  Seed: TVIKKYKDY (MAGC3_HUMAN)
TQIKKYKDY

SEQ ID NO: 106588 - protein, 11 aa, Artificial Sequence
  Description of Artificial Sequence: Synthetic peptide
  Seed: AEMQMNVINTY (MAGC3_HUMAN)
AKMQMNVINTF

SEQ ID NO: 106589 - protein, 9 aa, Artificial Sequence
  Description of Artificial Sequence: Synthetic peptide
  Seed: YKDYFPMIF (MAGC3_HUMAN)
YQDYFPMIY

SEQ ID NO: 106590 - protein, 9 aa, Artificial Sequence
  Description of Artificial Sequence: Synthetic peptide
  Seed: SLPESEPLF (MAGC3_HUMAN)
SQPESEPLI

SEQ ID NO: 106591 - protein, 10 aa, Artificial Sequence
  Description of Artificial Sequence: Synthetic peptide
  Seed: MDPDNHSYFF (MAGC3_HUMAN)
MHPDNHSYFF

SEQ ID NO: 106592 - protein, 10 aa, Artificial Sequence
  Description of Artificial Sequence: Synthetic peptide
  Seed: SDQRMDSLVL (MAGC3_HUMAN)
SIQRMDSLVM

SEQ ID NO: 106593 - protein, 10 aa, Artificial Sequence
  Description of Artificial Sequence: Synthetic peptide
  Seed: EFLSKLSSII (MAGC3_HUMAN)
EMLSKLSSIV

SEQ ID NO: 106594 - protein, 9 aa, Artificial Sequence
  Description of Artificial Sequence: Synthetic peptide
  Seed: LWGEKAGSL (MAGC3_HUMAN)
LYGEKAGSY

SEQ ID NO: 106595 - protein, 10 aa, Artificial Sequence
  Description of Artificial Sequence: Synthetic peptide
  Seed: ATYALSPVVL (MAGC3_HUMAN)
AWYALSPVVF

SEQ ID NO: 106596 - protein, 9 aa, Artificial Sequence
  Description of Artificial Sequence: Synthetic peptide
  Seed: IQRPAREVL (MAGC3_HUMAN)
IKRPAREVM

SEQ ID NO: 106597 - protein, 9 aa, Artificial Sequence
  Description of Artificial Sequence: Synthetic peptide
  Seed: MIFGKAHEF (MAGC3_HUMAN)
MYFGKAHEI

SEQ ID NO: 106598 - protein, 9 aa, Artificial Sequence
  Description of Artificial Sequence: Synthetic peptide
  Seed: SQPEGKFSL (MAGC3_HUMAN)
SHPEGKFSA

SEQ ID NO: 106599 - protein, 11 aa, Artificial Sequence
  Description of Artificial Sequence: Synthetic peptide
  Seed: FLSKLSSIIPS (MAGC3_HUMAN)
FQSKLSSIIPI

SEQ ID NO: 106600 - protein, 10 aa, Artificial Sequence
  Description of Artificial Sequence: Synthetic peptide
  Seed: FKLWRTLSGS (MAGC3_HUMAN)
FCLWRTLSGI

SEQ ID NO: 106601 - protein, 8 aa, Artificial Sequence
  Description of Artificial Sequence: Synthetic peptide
  Seed: IFGKAHEF (MAGC3_HUMAN)
IMGKAHEY

SEQ ID NO: 106602 - protein, 9 aa, Artificial Sequence
  Description of Artificial Sequence: Synthetic peptide
  Seed: ELVQFLLLK (MAGC3_HUMAN)
EFVQFLLLR

SEQ ID NO: 106603 - protein, 9 aa, Artificial Sequence
  Description of Artificial Sequence: Synthetic peptide
  Seed: SLGQWVKNT (MAGC3_HUMAN)
SLGQWVKNI

SEQ ID NO: 106604 - protein, 10 aa, Artificial Sequence
  Description of Artificial Sequence: Synthetic peptide
  Seed: KLSSIIPSAF (MAGC3_HUMAN)
KTSSIIPSAR

SEQ ID NO: 106605 - protein, 10 aa, Artificial Sequence
  Description of Artificial Sequence: Synthetic peptide
  Seed: EEVIWEVLNA (MAGC3_HUMAN)
EDVIWEVLNV

SEQ ID NO: 106606 - protein, 9 aa, Artificial Sequence
  Description of Artificial Sequence: Synthetic peptide
  Seed: MPKNCLLIL (MAGC3_HUMAN)
MPKNCLLIF

SEQ ID NO: 106607 - protein, 9 aa, Artificial Sequence
  Description of Artificial Sequence: Synthetic peptide
  Seed: ATYALSPVV (MAGC3_HUMAN)
ALYALSPVT

SEQ ID NO: 106608 - protein, 9 aa, Artificial Sequence
  Description of Artificial Sequence: Synthetic peptide
  Seed: SASPSVMST (MAGC3_HUMAN)
SQSPSVMSV

SEQ ID NO: 106609 - protein, 11 aa, Artificial Sequence
  Description of Artificial Sequence: Synthetic peptide
  Seed: DLANPQGLAGH (MAGC3_HUMAN)
DTANPQGLAGK

SEQ ID NO: 106610 - protein, 11 aa, Artificial Sequence
  Description of Artificial Sequence: Synthetic peptide
  Seed: ATFSDGSLGQW (MAGC3_HUMAN)
AMFSDGSLGQK

SEQ ID NO: 106611 - protein, 9 aa, Artificial Sequence
  Description of Artificial Sequence: Synthetic peptide
  Seed: KAHEFIELI (MAGC3_HUMAN)
KQHEFIELK

SEQ ID NO: 106612 - protein, 9 aa, Artificial Sequence
  Description of Artificial Sequence: Synthetic peptide
  Seed: MQMNVINTY (MAGC3_HUMAN)
MQMNVINTW

SEQ ID NO: 106613 - protein, 9 aa, Artificial Sequence
  Description of Artificial Sequence: Synthetic peptide
  Seed: QGMPQNRLL (MAGC3_HUMAN)
QSMPQNRLL

SEQ ID NO: 106614 - protein, 10 aa, Artificial Sequence
  Description of Artificial Sequence: Synthetic peptide
  Seed: MNVINTYTGY (MAGC3_HUMAN)
MMVINTYTGK

SEQ ID NO: 106615 - protein, 10 aa, Artificial Sequence
  Description of Artificial Sequence: Synthetic peptide
  Seed: ALDEKVAELV (MAGC3_HUMAN)
ALDEKVAELL

SEQ ID NO: 106616 - protein, 9 aa, Artificial Sequence
  Description of Artificial Sequence: Synthetic peptide
  Seed: FKLWRTLSG (MAGC3_HUMAN)
FLLWRTLSY

SEQ ID NO: 106617 - protein, 11 aa, Artificial Sequence
  Description of Artificial Sequence: Synthetic peptide
  Seed: TTDDATAMASA (MAGC3_HUMAN)
TSDDATAMASV

SEQ ID NO: 106618 - protein, 10 aa, Artificial Sequence
  Description of Artificial Sequence: Synthetic peptide
  Seed: KVAELVQFLL (MAGC3_HUMAN)
KGAELVQFLF

SEQ ID NO: 106619 - protein, 10 aa, Artificial Sequence
  Description of Artificial Sequence: Synthetic peptide
  Seed: DMPAAGMPPL (MAGC3_HUMAN)
DYPAAGMPPF

SEQ ID NO: 106620 - protein, 9 aa, Artificial Sequence
  Description of Artificial Sequence: Synthetic peptide
  Seed: LWGEKAGSL (MAGC3_HUMAN)
LFGEKAGSM

SEQ ID NO: 106621 - protein, 9 aa, Artificial Sequence
  Description of Artificial Sequence: Synthetic peptide
  Seed: KQREEPQDW (MAGC3_HUMAN)
KSREEPQDW

SEQ ID NO: 106622 - protein, 10 aa, Artificial Sequence
  Description of Artificial Sequence: Synthetic peptide
  Seed: TDMDPDNHSY (MAGC3_HUMAN)
TKMDPDNHSY

SEQ ID NO: 106623 - protein, 9 aa, Artificial Sequence
  Description of Artificial Sequence: Synthetic peptide
  Seed: TSDQRMDSL (MAGC3_HUMAN)
TSDQRMDSF

SEQ ID NO: 106624 - protein, 9 aa, Artificial Sequence
  Description of Artificial Sequence: Synthetic peptide
  Seed: HLREVRLFL (MAGC3_HUMAN)
HSREVRLFI

SEQ ID NO: 106625 - protein, 9 aa, Artificial Sequence
  Description of Artificial Sequence: Synthetic peptide
  Seed: TTDDATAMA (MAGC3_HUMAN)
TCDDATAMV

SEQ ID NO: 106626 - protein, 9 aa, Artificial Sequence
  Description of Artificial Sequence: Synthetic peptide
  Seed: MQMNVINTY (MAGC3_HUMAN)
MRMNVINTL

SEQ ID NO: 106627 - protein, 9 aa, Artificial Sequence
  Description of Artificial Sequence: Synthetic peptide
  Seed: NTYTGYFPM (MAGC3_HUMAN)
NLYTGYFPK

SEQ ID NO: 106628 - protein, 9 aa, Artificial Sequence
  Description of Artificial Sequence: Synthetic peptide
  Seed: EVLEFLSKL (MAGC3_HUMAN)
EQLEFLSKY

SEQ ID NO: 106629 - protein, 10 aa, Artificial Sequence
  Description of Artificial Sequence: Synthetic peptide
  Seed: MLTTVIKKYK (MAGC3_HUMAN)
MNTTVIKKYR

SEQ ID NO: 106630 - protein, 9 aa, Artificial Sequence
  Description of Artificial Sequence: Synthetic peptide
  Seed: FSDGSLGQW (MAGC3_HUMAN)
FTDGSLGQL

SEQ ID NO: 106631 - protein, 9 aa, Artificial Sequence
  Description of Artificial Sequence: Synthetic peptide
  Seed: SASPSVMST (MAGC3_HUMAN)
SLSPSVMSV

SEQ ID NO: 106632 - protein, 11 aa, Artificial Sequence
  Description of Artificial Sequence: Synthetic peptide
  Seed: IIDTTDDATAM (MAGC3_HUMAN)
IVDTTDDATAV

SEQ ID NO: 106633 - protein, 11 aa, Artificial Sequence
  Description of Artificial Sequence: Synthetic peptide
  Seed: IIDTTDDATAM (MAGC3_HUMAN)
IIDTTDDATAL

SEQ ID NO: 106634 - protein, 9 aa, Artificial Sequence
  Description of Artificial Sequence: Synthetic peptide
  Seed: SLVLCPTYF (MAGC3_HUMAN)
SMVLCPTYV

SEQ ID NO: 106635 - protein, 9 aa, Artificial Sequence
  Description of Artificial Sequence: Synthetic peptide
  Seed: YALSPVVLP (MAGC3_HUMAN)
YILSPVVLY

SEQ ID NO: 106636 - protein, 10 aa, Artificial Sequence
  Description of Artificial Sequence: Synthetic peptide
  Seed: SDQRMDSLVL (MAGC3_HUMAN)
SGQRMDSLVY

SEQ ID NO: 106637 - protein, 9 aa, Artificial Sequence
  Description of Artificial Sequence: Synthetic peptide
  Seed: YALSPVVLP (MAGC3_HUMAN)
YALSPVVLL

SEQ ID NO: 106638 - protein, 9 aa, Artificial Sequence
  Description of Artificial Sequence: Synthetic peptide
  Seed: KLVQFLLLK (MAGC3_HUMAN)
KWVQFLLLR

SEQ ID NO: 106639 - protein, 10 aa, Artificial Sequence
  Description of Artificial Sequence: Synthetic peptide
  Seed: TCATYALSPV (MAGC3_HUMAN)
TAATYALSPV

SEQ ID NO: 106640 - protein, 9 aa, Artificial Sequence
  Description of Artificial Sequence: Synthetic peptide
  Seed: GYFPMIFRK (MAGC3_HUMAN)
GFFPMIFRK

SEQ ID NO: 106641 - protein, 11 aa, Artificial Sequence
  Description of Artificial Sequence: Synthetic peptide
  Seed: EILFGISLTEV (MAGC3_HUMAN)
EQLFGISLTEV

SEQ ID NO: 106642 - protein, 9 aa, Artificial Sequence
  Description of Artificial Sequence: Synthetic peptide
  Seed: RTLSGSPGL (MAGC3_HUMAN)
RVLSGSPGI

SEQ ID NO: 106643 - protein, 11 aa, Artificial Sequence
  Description of Artificial Sequence: Synthetic peptide
  Seed: ATFSDGSLGQW (MAGC3_HUMAN)
APFSDGSLGQW

SEQ ID NO: 106644 - protein, 9 aa, Artificial Sequence
  Description of Artificial Sequence: Synthetic peptide
  Seed: NTYTGYFPM (MAGC3_HUMAN)
NPYTGYFPM

SEQ ID NO: 106645 - protein, 10 aa, Artificial Sequence
  Description of Artificial Sequence: Synthetic peptide
  Seed: ALPESESLPR (MAGC3_HUMAN)
AAPESESLPY

SEQ ID NO: 106646 - protein, 10 aa, Artificial Sequence
  Description of Artificial Sequence: Synthetic peptide
  Seed: GEKAGSLPES (MAGC3_HUMAN)
GEKAGSLPEV

SEQ ID NO: 106647 - protein, 10 aa, Artificial Sequence
  Description of Artificial Sequence: Synthetic peptide
  Seed: GPIQRPAREV (MAGC3_HUMAN)
GPIQRPAREL

SEQ ID NO: 106648 - protein, 11 aa, Artificial Sequence
  Description of Artificial Sequence: Synthetic peptide
  Seed: FLSKLSSIIPS (MAGC3_HUMAN)
FMSKLSSIIPV

SEQ ID NO: 106649 - protein, 9 aa, Artificial Sequence
  Description of Artificial Sequence: Synthetic peptide
  Seed: ALDEKVAEL (MAGC3_HUMAN)
AKDEKVAEY

SEQ ID NO: 106650 - protein, 9 aa, Artificial Sequence
  Description of Artificial Sequence: Synthetic peptide
  Seed: SQPEGKFSL (MAGC3_HUMAN)
SHPEGKFSF

SEQ ID NO: 106651 - protein, 9 aa, Artificial Sequence
  Description of Artificial Sequence: Synthetic peptide
  Seed: EVIWEVLSA (MAGC3_HUMAN)
ESIWEVLSA

SEQ ID NO: 106652 - protein, 8 aa, Artificial Sequence
  Description of Artificial Sequence: Synthetic peptide
  Seed: KVDKLVQF (MAGC3_HUMAN)
KTDKLVQY

SEQ ID NO: 106653 - protein, 9 aa, Artificial Sequence
  Description of Artificial Sequence: Synthetic peptide
  Seed: CATYALSPV (MAGC3_HUMAN)
CVTYALSPV

SEQ ID NO: 106654 - protein, 9 aa, Artificial Sequence
  Description of Artificial Sequence: Synthetic peptide
  Seed: YALDEKVAE (MAGC3_HUMAN)
YSLDEKVAL

SEQ ID NO: 106655 - protein, 10 aa, Artificial Sequence
  Description of Artificial Sequence: Synthetic peptide
  Seed: KKYKDYFPMI (MAGC3_HUMAN)
KHYKDYFPMK

SEQ ID NO: 106656 - protein, 9 aa, Artificial Sequence
  Description of Artificial Sequence: Synthetic peptide
  Seed: DYFPMIFGK (MAGC3_HUMAN)
DFFPMIFGK

SEQ ID NO: 106657 - protein, 10 aa, Artificial Sequence
  Description of Artificial Sequence: Synthetic peptide
  Seed: SLVLCPTYFK (MAGC3_HUMAN)
SEVLCPTYFK

SEQ ID NO: 106658 - protein, 10 aa, Artificial Sequence
  Description of Artificial Sequence: Synthetic peptide
  Seed: REVRLFLRGG (MAGC3_HUMAN)
RRVRLFLRGK

SEQ ID NO: 106659 - protein, 9 aa, Artificial Sequence
  Description of Artificial Sequence: Synthetic peptide
  Seed: FADVLSRLA (MAGC3_HUMAN)
FYDVLSRLL

SEQ ID NO: 106660 - protein, 9 aa, Artificial Sequence
  Description of Artificial Sequence: Synthetic peptide
  Seed: RGTGYTLSL (MAGC3_HUMAN)
RNTGYTLSF

SEQ ID NO: 106661 - protein, 9 aa, Artificial Sequence
  Description of Artificial Sequence: Synthetic peptide
  Seed: IIPSAFPSW (MAGC3_HUMAN)
ICPSAFPSM

SEQ ID NO: 106662 - protein, 9 aa, Artificial Sequence
  Description of Artificial Sequence: Synthetic peptide
  Seed: MIFGKAHEF (MAGC3_HUMAN)
MEFGKAHEY

SEQ ID NO: 106663 - protein, 9 aa, Artificial Sequence
  Description of Artificial Sequence: Synthetic peptide
  Seed: FLSKLSSII (MAGC3_HUMAN)
FRSKLSSIM

SEQ ID NO: 106664 - protein, 9 aa, Artificial Sequence
  Description of Artificial Sequence: Synthetic peptide
  Seed: MQMNVINTY (MAGC3_HUMAN)
MMMNVINTI

SEQ ID NO: 106665 - protein, 9 aa, Artificial Sequence
  Description of Artificial Sequence: Synthetic peptide
  Seed: DGSLGQWVK (MAGC3_HUMAN)
DMSLGQWVR

SEQ ID NO: 106666 - protein, 9 aa, Artificial Sequence
  Description of Artificial Sequence: Synthetic peptide
  Seed: TYTGYFPMI (MAGC3_HUMAN)
TWTGYFPMF

SEQ ID NO: 106667 - protein, 9 aa, Artificial Sequence
  Description of Artificial Sequence: Synthetic peptide
  Seed: KKYKDYFPM (MAGC3_HUMAN)
KNYKDYFPF

SEQ ID NO: 106668 - protein, 9 aa, Artificial Sequence
  Description of Artificial Sequence: Synthetic peptide
  Seed: HSYFFEDTL (MAGC3_HUMAN)
HDYFFEDTF

SEQ ID NO: 106669 - protein, 9 aa, Artificial Sequence
  Description of Artificial Sequence: Synthetic peptide
  Seed: YQAKEPLTR (MAGC3_HUMAN)
YTAKEPLTL

SEQ ID NO: 106670 - protein, 10 aa, Artificial Sequence
  Description of Artificial Sequence: Synthetic peptide
  Seed: LVLCPTYFKL (MAGC3_HUMAN)
LQLCPTYFKK

SEQ ID NO: 106671 - protein, 9 aa, Artificial Sequence
  Description of Artificial Sequence: Synthetic peptide
  Seed: TLDEKVDKL (MAGC3_HUMAN)
TADEKVDKC

SEQ ID NO: 106672 - protein, 9 aa, Artificial Sequence
  Description of Artificial Sequence: Synthetic peptide
  Seed: FSLRRAVSV (MAGC3_HUMAN)
FQLRRAVSV

SEQ ID NO: 106673 - protein, 9 aa, Artificial Sequence
  Description of Artificial Sequence: Synthetic peptide
  Seed: HLREVRLFL (MAGC3_HUMAN)
HTREVRLFR

SEQ ID NO: 106674 - protein, 9 aa, Artificial Sequence
  Description of Artificial Sequence: Synthetic peptide
  Seed: SLPESEPLF (MAGC3_HUMAN)
SAPESEPLY

SEQ ID NO: 106675 - protein, 10 aa, Artificial Sequence
  Description of Artificial Sequence: Synthetic peptide
  Seed: EVIWEVLSAI (MAGC3_HUMAN)
EFIWEVLSAL

SEQ ID NO: 106676 - protein, 9 aa, Artificial Sequence
  Description of Artificial Sequence: Synthetic peptide
  Seed: EVLEFLSKL (MAGC3_HUMAN)
ELLEFLSKM

SEQ ID NO: 106677 - protein, 9 aa, Artificial Sequence
  Description of Artificial Sequence: Synthetic peptide
  Seed: FEDTLDLTY (MAGC3_HUMAN)
FEDTLDLTW

SEQ ID NO: 106678 - protein, 11 aa, Artificial Sequence
  Description of Artificial Sequence: Synthetic peptide
  Seed: RGLTEASPQQK (MAGC3_HUMAN)
RSLTEASPQQR

SEQ ID NO: 106679 - protein, 9 aa, Artificial Sequence
  Description of Artificial Sequence: Synthetic peptide
  Seed: FPSWYMDAL (MAGC3_HUMAN)
FPSWYMDAF

SEQ ID NO: 106680 - protein, 9 aa, Artificial Sequence
  Description of Artificial Sequence: Synthetic peptide
  Seed: YFPMIFRKA (MAGC3_HUMAN)
YYPMIFRKF

SEQ ID NO: 106681 - protein, 10 aa, Artificial Sequence
  Description of Artificial Sequence: Synthetic peptide
  Seed: YTGYFPMIFR (MAGC3_HUMAN)
YFGYFPMIFR

SEQ ID NO: 106682 - protein, 11 aa, Artificial Sequence
  Description of Artificial Sequence: Synthetic peptide
  Seed: FIELIFGIALT (MAGC3_HUMAN)
FRELIFGIALL

SEQ ID NO: 106683 - protein, 9 aa, Artificial Sequence
  Description of Artificial Sequence: Synthetic peptide
  Seed: KKYKDYFPM (MAGC3_HUMAN)
KRYKDYFPA

SEQ ID NO: 106684 - protein, 9 aa, Artificial Sequence
  Description of Artificial Sequence: Synthetic peptide
  Seed: MASASPSVM (MAGC3_HUMAN)
MTSASPSVM

SEQ ID NO: 106685 - protein, 11 aa, Artificial Sequence
  Description of Artificial Sequence: Synthetic peptide
  Seed: SPLDSCSSPLL (MAGC3_HUMAN)
SPLDSCSSPLY

SEQ ID NO: 106686 - protein, 9 aa, Artificial Sequence
  Description of Artificial Sequence: Synthetic peptide
  Seed: IPPQGPPKI (MAGC3_HUMAN)
IRPQGPPKM

SEQ ID NO: 106687 - protein, 10 aa, Artificial Sequence
  Description of Artificial Sequence: Synthetic peptide
  Seed: TTDDATAMAS (MAGC3_HUMAN)
TMDDATAMAI

SEQ ID NO: 106688 - protein, 9 aa, Artificial Sequence
  Description of Artificial Sequence: Synthetic peptide
  Seed: YTGYFPMIF (MAGC3_HUMAN)
YSGYFPMIW

SEQ ID NO: 106689 - protein, 10 aa, Artificial Sequence
  Description of Artificial Sequence: Synthetic peptide
  Seed: EVIWEVLNAI (MAGC3_HUMAN)
ETIWEVLNAI

SEQ ID NO: 106690 - protein, 9 aa, Artificial Sequence
  Description of Artificial Sequence: Synthetic peptide
  Seed: HLREVRLFL (MAGC3_HUMAN)
HVREVRLFL

SEQ ID NO: 106691 - protein, 9 aa, Artificial Sequence
  Description of Artificial Sequence: Synthetic peptide
  Seed: AEMLTTVIK (MAGC3_HUMAN)
AEMLTTVIP

SEQ ID NO: 106692 - protein, 10 aa, Artificial Sequence
  Description of Artificial Sequence: Synthetic peptide
  Seed: RLWGEKAGSL (MAGC3_HUMAN)
RTWGEKAGSW

SEQ ID NO: 106693 - protein, 10 aa, Artificial Sequence
  Description of Artificial Sequence: Synthetic peptide
  Seed: SSEEEDTATW (MAGC3_HUMAN)
SQEEEDTATW

SEQ ID NO: 106694 - protein, 9 aa, Artificial Sequence
  Description of Artificial Sequence: Synthetic peptide
  Seed: SQPEGKFSL (MAGC3_HUMAN)
SPPEGKFSV

SEQ ID NO: 106695 - protein, 10 aa, Artificial Sequence
  Description of Artificial Sequence: Synthetic peptide
  Seed: RLLILILSVI (MAGC3_HUMAN)
RFLILILSVV

SEQ ID NO: 106696 - protein, 10 aa, Artificial Sequence
  Description of Artificial Sequence: Synthetic peptide
  Seed: KLSSIIPSAF (MAGC3_HUMAN)
KMSSIIPSAL

SEQ ID NO: 106697 - protein, 9 aa, Artificial Sequence
  Description of Artificial Sequence: Synthetic peptide
  Seed: EVLSAIGPI (MAGC3_HUMAN)
EQLSAIGPR

SEQ ID NO: 106698 - protein, 9 aa, Artificial Sequence
  Description of Artificial Sequence: Synthetic peptide
  Seed: SAFHLGHLR (MAGC3_HUMAN)
SWFHLGHLK

SEQ ID NO: 106699 - protein, 11 aa, Artificial Sequence
  Description of Artificial Sequence: Synthetic peptide
  Seed: YKDYFPMIFGK (MAGC3_HUMAN)
YFDYFPMIFGR

SEQ ID NO: 106700 - protein, 9 aa, Artificial Sequence
  Description of Artificial Sequence: Synthetic peptide
  Seed: ALAGFADVL (MAGC3_HUMAN)
AMAGFADVW

SEQ ID NO: 106701 - protein, 9 aa, Artificial Sequence
  Description of Artificial Sequence: Synthetic peptide
  Seed: HSYFFEDTL (MAGC3_HUMAN)
HHYFFEDTF

SEQ ID NO: 106702 - protein, 9 aa, Artificial Sequence
  Description of Artificial Sequence: Synthetic peptide
  Seed: SPPEIPPQG (MAGC3_HUMAN)
SPPEIPPQM

SEQ ID NO: 106703 - protein, 9 aa, Artificial Sequence
  Description of Artificial Sequence: Synthetic peptide
  Seed: TYALSPVVL (MAGC3_HUMAN)
TRALSPVVF

SEQ ID NO: 106704 - protein, 9 aa, Artificial Sequence
  Description of Artificial Sequence: Synthetic peptide
  Seed: FLSKLSSII (MAGC3_HUMAN)
FKSKLSSIL

SEQ ID NO: 106705 - protein, 11 aa, Artificial Sequence
  Description of Artificial Sequence: Synthetic peptide
  Seed: LSKLSSIIPSA (MAGC3_HUMAN)
LGKLSSIIPSL

SEQ ID NO: 106706 - protein, 9 aa, Artificial Sequence
  Description of Artificial Sequence: Synthetic peptide
  Seed: ALAGFADVL (MAGC3_HUMAN)
AIAGFADVV

SEQ ID NO: 106707 - protein, 10 aa, Artificial Sequence
  Description of Artificial Sequence: Synthetic peptide
  Seed: SKLSSIIPSA (MAGC3_HUMAN)
SALSSIIPSL

SEQ ID NO: 106708 - protein, 9 aa, Artificial Sequence
  Description of Artificial Sequence: Synthetic peptide
  Seed: TKAEMLTTV (MAGC3_HUMAN)
THAEMLTTA

SEQ ID NO: 106709 - protein, 10 aa, Artificial Sequence
  Description of Artificial Sequence: Synthetic peptide
  Seed: SAFHLGHLRE (MAGC3_HUMAN)
STFHLGHLRN

SEQ ID NO: 106710 - protein, 9 aa, Artificial Sequence
  Description of Artificial Sequence: Synthetic peptide
  Seed: MIFGKAHEF (MAGC3_HUMAN)
MAFGKAHEI

SEQ ID NO: 106711 - protein, 10 aa, Artificial Sequence
  Description of Artificial Sequence: Synthetic peptide
  Seed: TTDDATAMAS (MAGC3_HUMAN)
TNDDATAMAL

SEQ ID NO: 106712 - protein, 9 aa, Artificial Sequence
  Description of Artificial Sequence: Synthetic peptide
  Seed: HLREVRLFL (MAGC3_HUMAN)
HFREVRLFK

SEQ ID NO: 106713 - protein, 10 aa, Artificial Sequence
  Description of Artificial Sequence: Synthetic peptide
  Seed: YALDEKVAEL (MAGC3_HUMAN)
YNLDEKVAEC

SEQ ID NO: 106714 - protein, 10 aa, Artificial Sequence
  Description of Artificial Sequence: Synthetic peptide
  Seed: KKYKDYFPMI (MAGC3_HUMAN)
KKYKDYFPMW

SEQ ID NO: 106715 - protein, 10 aa, Artificial Sequence
  Description of Artificial Sequence: Synthetic peptide
  Seed: YALDEKVAEL (MAGC3_HUMAN)
YLLDEKVAES

SEQ ID NO: 106716 - protein, 9 aa, Artificial Sequence
  Description of Artificial Sequence: Synthetic peptide
  Seed: QDWPLNEKR (MAGC3_HUMAN)
QWWPLNEKR

SEQ ID NO: 106717 - protein, 10 aa, Artificial Sequence
  Description of Artificial Sequence: Synthetic peptide
  Seed: MQMNVINTYT (MAGC3_HUMAN)
MEMNVINTYA

SEQ ID NO: 106718 - protein, 9 aa, Artificial Sequence
  Description of Artificial Sequence: Synthetic peptide
  Seed: HALPESESL (MAGC3_HUMAN)
HPLPESESI

SEQ ID NO: 106719 - protein, 9 aa, Artificial Sequence
  Description of Artificial Sequence: Synthetic peptide
  Seed: WPLNEKRTL (MAGC3_HUMAN)
WPLNEKRTM

SEQ ID NO: 106720 - protein, 10 aa, Artificial Sequence
  Description of Artificial Sequence: Synthetic peptide
  Seed: EEVIWEVLSA (MAGC3_HUMAN)
EIVIWEVLSV

SEQ ID NO: 106721 - protein, 9 aa, Artificial Sequence
  Description of Artificial Sequence: Synthetic peptide
  Seed: YQTKEPVTK (MAGC3_HUMAN)
YFTKEPVTM

SEQ ID NO: 106722 - protein, 9 aa, Artificial Sequence
  Description of Artificial Sequence: Synthetic peptide
  Seed: VIKKYKDYF (MAGC3_HUMAN)
VMKKYKDYF

SEQ ID NO: 106723 - protein, 9 aa, Artificial Sequence
  Description of Artificial Sequence: Synthetic peptide
  Seed: SQPEGKFSL (MAGC3_HUMAN)
SEPEGKFSM

SEQ ID NO: 106724 - protein, 9 aa, Artificial Sequence
  Description of Artificial Sequence: Synthetic peptide
  Seed: EMLTTVIKK (MAGC3_HUMAN)
EVLTTVIKR

SEQ ID NO: 106725 - protein, 9 aa, Artificial Sequence
  Description of Artificial Sequence: Synthetic peptide
  Seed: KVDKLVQFL (MAGC3_HUMAN)
KCDKLVQFL

SEQ ID NO: 106726 - protein, 9 aa, Artificial Sequence
  Description of Artificial Sequence: Synthetic peptide
  Seed: EVIWEVLSA (MAGC3_HUMAN)
ETIWEVLSM

SEQ ID NO: 106727 - protein, 9 aa, Artificial Sequence
  Description of Artificial Sequence: Synthetic peptide
  Seed: FSDGSLGQW (MAGC3_HUMAN)
FNDGSLGQM

SEQ ID NO: 106728 - protein, 8 aa, Artificial Sequence
  Description of Artificial Sequence: Synthetic peptide
  Seed: TTDDATAM (MAGC3_HUMAN)
TIDDATAV

SEQ ID NO: 106729 - protein, 9 aa, Artificial Sequence
  Description of Artificial Sequence: Synthetic peptide
  Seed: TTDDATAMA (MAGC3_HUMAN)
TGDDATAMV

SEQ ID NO: 106730 - protein, 10 aa, Artificial Sequence
  Description of Artificial Sequence: Synthetic peptide
  Seed: YSAFHLGHLR (MAGC3_HUMAN)
YFAFHLGHLK

SEQ ID NO: 106731 - protein, 9 aa, Artificial Sequence
  Description of Artificial Sequence: Synthetic peptide
  Seed: FKLWRTLSG (MAGC3_HUMAN)
FLLWRTLSF

SEQ ID NO: 106732 - protein, 11 aa, Artificial Sequence
  Description of Artificial Sequence: Synthetic peptide
  Seed: YALDEKVAELV (MAGC3_HUMAN)
YLLDEKVAELY

SEQ ID NO: 106733 - protein, 10 aa, Artificial Sequence
  Description of Artificial Sequence: Synthetic peptide
  Seed: CASEEVIWEV (MAGC3_HUMAN)
CVSEEVIWEL

SEQ ID NO: 106734 - protein, 10 aa, Artificial Sequence
  Description of Artificial Sequence: Synthetic peptide
  Seed: FIELIFGIAL (MAGC3_HUMAN)
FEELIFGIAL

SEQ ID NO: 106735 - protein, 10 aa, Artificial Sequence
  Description of Artificial Sequence: Synthetic peptide
  Seed: MIFGKAHEFI (MAGC3_HUMAN)
MAFGKAHEFI

SEQ ID NO: 106736 - protein, 10 aa, Artificial Sequence
  Description of Artificial Sequence: Synthetic peptide
  Seed: SDQRMDSLVL (MAGC3_HUMAN)
SFQRMDSLVF

SEQ ID NO: 106737 - protein, 9 aa, Artificial Sequence
  Description of Artificial Sequence: Synthetic peptide
  Seed: FEDTLDLTY (MAGC3_HUMAN)
FQDTLDLTF

SEQ ID NO: 106738 - protein, 10 aa, Artificial Sequence
  Description of Artificial Sequence: Synthetic peptide
  Seed: TGYFPMIFRK (MAGC3_HUMAN)
TVYFPMIFRD

SEQ ID NO: 106739 - protein, 10 aa, Artificial Sequence
  Description of Artificial Sequence: Synthetic peptide
  Seed: TDMDPDNHSY (MAGC3_HUMAN)
TEMDPDNHSF

SEQ ID NO: 106740 - protein, 10 aa, Artificial Sequence
  Description of Artificial Sequence: Synthetic peptide
  Seed: YALDEKVAEL (MAGC3_HUMAN)
YVLDEKVAEM

SEQ ID NO: 106741 - protein, 10 aa, Artificial Sequence
  Description of Artificial Sequence: Synthetic peptide
  Seed: KVAELVQFLL (MAGC3_HUMAN)
KDAELVQFLW

SEQ ID NO: 106742 - protein, 9 aa, Artificial Sequence
  Description of Artificial Sequence: Synthetic peptide
  Seed: LDLANPQGL (MAGC3_HUMAN)
LELANPQGM

SEQ ID NO: 106743 - protein, 9 aa, Artificial Sequence
  Description of Artificial Sequence: Synthetic peptide
  Seed: YQAKEPLTR (MAGC3_HUMAN)
YLAKEPLTK

SEQ ID NO: 106744 - protein, 9 aa, Artificial Sequence
  Description of Artificial Sequence: Synthetic peptide
  Seed: KLVQFLLLK (MAGC3_HUMAN)
KSVQFLLLF

SEQ ID NO: 106745 - protein, 9 aa, Artificial Sequence
  Description of Artificial Sequence: Synthetic peptide
  Seed: TTDDATAMA (MAGC3_HUMAN)
TGDDATAMM

SEQ ID NO: 106746 - protein, 9 aa, Artificial Sequence
  Description of Artificial Sequence: Synthetic peptide
  Seed: LILSVIFIK (MAGC3_HUMAN)
LYLSVIFIK

SEQ ID NO: 106747 - protein, 9 aa, Artificial Sequence
  Description of Artificial Sequence: Synthetic peptide
  Seed: ILILSMIFI (MAGC3_HUMAN)
IMILSMIFI

SEQ ID NO: 106748 - protein, 10 aa, Artificial Sequence
  Description of Artificial Sequence: Synthetic peptide
  Seed: MPKNCLLILI (MAGC3_HUMAN)
MPKNCLLILF

SEQ ID NO: 106749 - protein, 8 aa, Artificial Sequence
  Description of Artificial Sequence: Synthetic peptide
  Seed: TTDDATAM (MAGC3_HUMAN)
TLDDATAI

SEQ ID NO: 106750 - protein, 9 aa, Artificial Sequence
  Description of Artificial Sequence: Synthetic peptide
  Seed: FFEDTLDLT (MAGC3_HUMAN)
FWEDTLDLM

SEQ ID NO: 106751 - protein, 9 aa, Artificial Sequence
  Description of Artificial Sequence: Synthetic peptide
  Seed: CSSPLLWTR (MAGC3_HUMAN)
CMSPLLWTR

SEQ ID NO: 106752 - protein, 10 aa, Artificial Sequence
  Description of Artificial Sequence: Synthetic peptide
  Seed: KVDKLVQFLL (MAGC3_HUMAN)
KSDKLVQFLF

SEQ ID NO: 106753 - protein, 10 aa, Artificial Sequence
  Description of Artificial Sequence: Synthetic peptide
  Seed: SLVLCPTYFK (MAGC3_HUMAN)
SCVLCPTYFK

SEQ ID NO: 106754 - protein, 9 aa, Artificial Sequence
  Description of Artificial Sequence: Synthetic peptide
  Seed: GFADVLSRL (MAGC3_HUMAN)
GAADVLSRM

SEQ ID NO: 106755 - protein, 10 aa, Artificial Sequence
  Description of Artificial Sequence: Synthetic peptide
  Seed: YALDEKVAEL (MAGC3_HUMAN)
YYLDEKVAEF

SEQ ID NO: 106756 - protein, 10 aa, Artificial Sequence
  Description of Artificial Sequence: Synthetic peptide
  Seed: TLSGSPGLQL (MAGC3_HUMAN)
TASGSPGLQM

SEQ ID NO: 106757 - protein, 9 aa, Artificial Sequence
  Description of Artificial Sequence: Synthetic peptide
  Seed: YTGYFPMIF (MAGC3_HUMAN)
YFGYFPMIL

SEQ ID NO: 106758 - protein, 8 aa, Artificial Sequence
  Description of Artificial Sequence: Synthetic peptide
  Seed: FIELIFGI (MAGC3_HUMAN)
FLELIFGV

SEQ ID NO: 106759 - protein, 9 aa, Artificial Sequence
  Description of Artificial Sequence: Synthetic peptide
  Seed: FADVLSRLA (MAGC3_HUMAN)
FNDVLSRLV

SEQ ID NO: 106760 - protein, 11 aa, Artificial Sequence
  Description of Artificial Sequence: Synthetic peptide
  Seed: LPAVSPGKRLW (MAGC3_HUMAN)
LSAVSPGKRLF

SEQ ID NO: 106761 - protein, 9 aa, Artificial Sequence
  Description of Artificial Sequence: Synthetic peptide
  Seed: IQRPAREVL (MAGC3_HUMAN)
IRRPAREVY

SEQ ID NO: 106762 - protein, 10 aa, Artificial Sequence
  Description of Artificial Sequence: Synthetic peptide
  Seed: YALSPVVLPP (MAGC3_HUMAN)
YYLSPVVLPM

SEQ ID NO: 106763 - protein, 10 aa, Artificial Sequence
  Description of Artificial Sequence: Synthetic peptide
  Seed: FSDGSLGQWV (MAGC3_HUMAN)
FADGSLGQWV

SEQ ID NO: 106764 - protein, 9 aa, Artificial Sequence
  Description of Artificial Sequence: Synthetic peptide
  Seed: LIDDQGMPK (MAGC3_HUMAN)
LWDDQGMPM

SEQ ID NO: 106765 - protein, 9 aa, Artificial Sequence
  Description of Artificial Sequence: Synthetic peptide
  Seed: VLCPTYFKL (MAGC3_HUMAN)
VQCPTYFKY

SEQ ID NO: 106766 - protein, 9 aa, Artificial Sequence
  Description of Artificial Sequence: Synthetic peptide
  Seed: EFIELIFGI (MAGC3_HUMAN)
EGIELIFGV

SEQ ID NO: 106767 - protein, 9 aa, Artificial Sequence
  Description of Artificial Sequence: Synthetic peptide
  Seed: KYKDYFPMI (MAGC3_HUMAN)
KVKDYFPMM

SEQ ID NO: 106768 - protein, 9 aa, Artificial Sequence
  Description of Artificial Sequence: Synthetic peptide
  Seed: ATDKDYSAF (MAGC3_HUMAN)
AIDKDYSAM

SEQ ID NO: 106769 - protein, 11 aa, Artificial Sequence
  Description of Artificial Sequence: Synthetic peptide
  Seed: IIDTTDDATAM (MAGC3_HUMAN)
IFDTTDDATAF

SEQ ID NO: 106770 - protein, 10 aa, Artificial Sequence
  Description of Artificial Sequence: Synthetic peptide
  Seed: AFPSWYMDAL (MAGC3_HUMAN)
AMPSWYMDAF

SEQ ID NO: 106771 - protein, 10 aa, Artificial Sequence
  Description of Artificial Sequence: Synthetic peptide
  Seed: LPTWRRGTGY (MAGC3_HUMAN)
LATWRRGTGF

SEQ ID NO: 106772 - protein, 9 aa, Artificial Sequence
  Description of Artificial Sequence: Synthetic peptide
  Seed: MIFGKAHEF (MAGC3_HUMAN)
MAFGKAHEK

SEQ ID NO: 106773 - protein, 10 aa, Artificial Sequence
  Description of Artificial Sequence: Synthetic peptide
  Seed: WSALAGFADV (MAGC3_HUMAN)
WQALAGFADV

SEQ ID NO: 106774 - protein, 9 aa, Artificial Sequence
  Description of Artificial Sequence: Synthetic peptide
  Seed: EFIELIFGI (MAGC3_HUMAN)
EVIELIFGA

SEQ ID NO: 106775 - protein, 10 aa, Artificial Sequence
  Description of Artificial Sequence: Synthetic peptide
  Seed: EMQMNVINTY (MAGC3_HUMAN)
EMQMNVINTM

SEQ ID NO: 106776 - protein, 10 aa, Artificial Sequence
  Description of Artificial Sequence: Synthetic peptide
  Seed: MQMNVINTYT (MAGC3_HUMAN)
MTMNVINTYY

SEQ ID NO: 106777 - protein, 10 aa, Artificial Sequence
  Description of Artificial Sequence: Synthetic peptide
  Seed: SALAGFADVL (MAGC3_HUMAN)
SHLAGFADVL

SEQ ID NO: 106778 - protein, 9 aa, Artificial Sequence
  Description of Artificial Sequence: Synthetic peptide
  Seed: YTGYFPMIF (MAGC3_HUMAN)
YSGYFPMIF

SEQ ID NO: 106779 - protein, 10 aa, Artificial Sequence
  Description of Artificial Sequence: Synthetic peptide
  Seed: MQMNVINTYT (MAGC3_HUMAN)
MHMNVINTYF

SEQ ID NO: 106780 - protein, 9 aa, Artificial Sequence
  Description of Artificial Sequence: Synthetic peptide
  Seed: ALAGFADVL (MAGC3_HUMAN)
AVAGFADVA

SEQ ID NO: 106781 - protein, 10 aa, Artificial Sequence
  Description of Artificial Sequence: Synthetic peptide
  Seed: KVDKLVQFLL (MAGC3_HUMAN)
KADKLVQFLW

SEQ ID NO: 106782 - protein, 10 aa, Artificial Sequence
  Description of Artificial Sequence: Synthetic peptide
  Seed: LDLANPQGLA (MAGC3_HUMAN)
LMLANPQGLV

SEQ ID NO: 106783 - protein, 9 aa, Artificial Sequence
  Description of Artificial Sequence: Synthetic peptide
  Seed: TSDQRMDSL (MAGC3_HUMAN)
TFDQRMDSV

SEQ ID NO: 106784 - protein, 9 aa, Artificial Sequence
  Description of Artificial Sequence: Synthetic peptide
  Seed: GYFPMIFRK (MAGC3_HUMAN)
GIFPMIFRY

SEQ ID NO: 106785 - protein, 10 aa, Artificial Sequence
  Description of Artificial Sequence: Synthetic peptide
  Seed: KLSSIIPSAF (MAGC3_HUMAN)
KLSSIIPSAA

SEQ ID NO: 106786 - protein, 10 aa, Artificial Sequence
  Description of Artificial Sequence: Synthetic peptide
  Seed: IKKYKDYFPM (MAGC3_HUMAN)
IIKYKDYFPY

SEQ ID NO: 106787 - protein, 9 aa, Artificial Sequence
  Description of Artificial Sequence: Synthetic peptide
  Seed: MIFRKAREF (MAGC3_HUMAN)
MSFRKAREW

SEQ ID NO: 106788 - protein, 10 aa, Artificial Sequence
  Description of Artificial Sequence: Synthetic peptide
  Seed: VVLPPQPQPR (MAGC3_HUMAN)
VALPPQPQPM

SEQ ID NO: 106789 - protein, 10 aa, Artificial Sequence
  Description of Artificial Sequence: Synthetic peptide
  Seed: MQMNVINTYT (MAGC3_HUMAN)
MYMNVINTYF

SEQ ID NO: 106790 - protein, 9 aa, Artificial Sequence
  Description of Artificial Sequence: Synthetic peptide
  Seed: LIDDQGMPK (MAGC3_HUMAN)
LADDQGMPY

SEQ ID NO: 106791 - protein, 11 aa, Artificial Sequence
  Description of Artificial Sequence: Synthetic peptide
  Seed: KVAELVQFLLL (MAGC3_HUMAN)
KTAELVQFLLW

SEQ ID NO: 106792 - protein, 9 aa, Artificial Sequence
  Description of Artificial Sequence: Synthetic peptide
  Seed: AHEFIELIF (MAGC3_HUMAN)
AQEFIELIF

SEQ ID NO: 106793 - protein, 9 aa, Artificial Sequence
  Description of Artificial Sequence: Synthetic peptide
  Seed: SQPEGKFSL (MAGC3_HUMAN)
STPEGKFSL

SEQ ID NO: 106794 - protein, 11 aa, Artificial Sequence
  Description of Artificial Sequence: Synthetic peptide
  Seed: DLHFGSQPEGK (MAGC3_HUMAN)
DTHFGSQPEGR

SEQ ID NO: 106795 - protein, 9 aa, Artificial Sequence
  Description of Artificial Sequence: Synthetic peptide
  Seed: FSDGSLGQW (MAGC3_HUMAN)
FCDGSLGQI

SEQ ID NO: 106796 - protein, 9 aa, Artificial Sequence
  Description of Artificial Sequence: Synthetic peptide
  Seed: EIPPQGPPK (MAGC3_HUMAN)
EAPPQGPPL

SEQ ID NO: 106797 - protein, 9 aa, Artificial Sequence
  Description of Artificial Sequence: Synthetic peptide
  Seed: EVLSAIGPI (MAGC3_HUMAN)
EILSAIGPF

SEQ ID NO: 106798 - protein, 9 aa, Artificial Sequence
  Description of Artificial Sequence: Synthetic peptide
  Seed: YALSPVVLP (MAGC3_HUMAN)
YSLSPVVLF

SEQ ID NO: 106799 - protein, 10 aa, Artificial Sequence
  Description of Artificial Sequence: Synthetic peptide
  Seed: MLTTVIKKYK (MAGC3_HUMAN)
MWTTVIKKYR

SEQ ID NO: 106800 - protein, 9 aa, Artificial Sequence
  Description of Artificial Sequence: Synthetic peptide
  Seed: KVDKLVQFL (MAGC3_HUMAN)
KADKLVQFF

SEQ ID NO: 106801 - protein, 10 aa, Artificial Sequence
  Description of Artificial Sequence: Synthetic peptide
  Seed: EEVIWEVLNA (MAGC3_HUMAN)
ETVIWEVLNV

SEQ ID NO: 106802 - protein, 9 aa, Artificial Sequence
  Description of Artificial Sequence: Synthetic peptide
  Seed: FPSWYMDAL (MAGC3_HUMAN)
FTSWYMDAI

SEQ ID NO: 106803 - protein, 10 aa, Artificial Sequence
  Description of Artificial Sequence: Synthetic peptide
  Seed: YALDEKVAEL (MAGC3_HUMAN)
YGLDEKVAEC

SEQ ID NO: 106804 - protein, 9 aa, Artificial Sequence
  Description of Artificial Sequence: Synthetic peptide
  Seed: YKDYFPMIF (MAGC3_HUMAN)
YFDYFPMIM

SEQ ID NO: 106805 - protein, 9 aa, Artificial Sequence
  Description of Artificial Sequence: Synthetic peptide
  Seed: SQPEGKFSL (MAGC3_HUMAN)
SLPEGKFSW

SEQ ID NO: 106806 - protein, 11 aa, Artificial Sequence
  Description of Artificial Sequence: Synthetic peptide
  Seed: LSKLSSIIPSA (MAGC3_HUMAN)
LCKLSSIIPSL

SEQ ID NO: 106807 - protein, 9 aa, Artificial Sequence
  Description of Artificial Sequence: Synthetic peptide
  Seed: FSLRRAVSV (MAGC3_HUMAN)
FFLRRAVSL

SEQ ID NO: 106808 - protein, 9 aa, Artificial Sequence
  Description of Artificial Sequence: Synthetic peptide
  Seed: IIDTTDDAT (MAGC3_HUMAN)
ITDTTDDAI

SEQ ID NO: 106809 - protein, 9 aa, Artificial Sequence
  Description of Artificial Sequence: Synthetic peptide
  Seed: SPVVLPPQP (MAGC3_HUMAN)
SPVVLPPQV

SEQ ID NO: 106810 - protein, 10 aa, Artificial Sequence
  Description of Artificial Sequence: Synthetic peptide
  Seed: WHALPESESL (MAGC3_HUMAN)
WHALPESESF

SEQ ID NO: 106811 - protein, 9 aa, Artificial Sequence
  Description of Artificial Sequence: Synthetic peptide
  Seed: MIFRKAREF (MAGC3_HUMAN)
MWFRKAREY

SEQ ID NO: 106812 - protein, 9 aa, Artificial Sequence
  Description of Artificial Sequence: Synthetic peptide
  Seed: MDPDNHSYF (MAGC3_HUMAN)
MVPDNHSYF

SEQ ID NO: 106813 - protein, 9 aa, Artificial Sequence
  Description of Artificial Sequence: Synthetic peptide
  Seed: SAFHLGHLR (MAGC3_HUMAN)
SYFHLGHLK

SEQ ID NO: 106814 - protein, 10 aa, Artificial Sequence
  Description of Artificial Sequence: Synthetic peptide
  Seed: ILILSMIFIK (MAGC3_HUMAN)
IQILSMIFIK

SEQ ID NO: 106815 - protein, 9 aa, Artificial Sequence
  Description of Artificial Sequence: Synthetic peptide
  Seed: AEMQMNVIN (MAGC3_HUMAN)
AEMQMNVIA

SEQ ID NO: 106816 - protein, 10 aa, Artificial Sequence
  Description of Artificial Sequence: Synthetic peptide
  Seed: MIFRKAREFI (MAGC3_HUMAN)
MMFRKAREFA

SEQ ID NO: 106817 - protein, 10 aa, Artificial Sequence
  Description of Artificial Sequence: Synthetic peptide
  Seed: NTYTGYFPMI (MAGC3_HUMAN)
NCYTGYFPMF

SEQ ID NO: 106818 - protein, 9 aa, Artificial Sequence
  Description of Artificial Sequence: Synthetic peptide
  Seed: HFYVFVNTL (MAGC3_HUMAN)
HGYVFVNTY

SEQ ID NO: 106819 - protein, 9 aa, Artificial Sequence
  Description of Artificial Sequence: Synthetic peptide
  Seed: MPAAGMPPL (MAGC3_HUMAN)
MIAAGMPPV

SEQ ID NO: 106820 - protein, 9 aa, Artificial Sequence
  Description of Artificial Sequence: Synthetic peptide
  Seed: LVQFLLLKY (MAGC3_HUMAN)
LSQFLLLKW

SEQ ID NO: 106821 - protein, 9 aa, Artificial Sequence
  Description of Artificial Sequence: Synthetic peptide
  Seed: HLGHLREVR (MAGC3_HUMAN)
HTGHLREVR

SEQ ID NO: 106822 - protein, 9 aa, Artificial Sequence
  Description of Artificial Sequence: Synthetic peptide
  Seed: LLILILSVI (MAGC3_HUMAN)
LMILILSVV

SEQ ID NO: 106823 - protein, 10 aa, Artificial Sequence
  Description of Artificial Sequence: Synthetic peptide
  Seed: EPQDWPLNEK (MAGC3_HUMAN)
ETQDWPLNER

SEQ ID NO: 106824 - protein, 9 aa, Artificial Sequence
  Description of Artificial Sequence: Synthetic peptide
  Seed: VDPDHFYVF (MAGC3_HUMAN)
VFPDHFYVL

SEQ ID NO: 106825 - protein, 9 aa, Artificial Sequence
  Description of Artificial Sequence: Synthetic peptide
  Seed: EVLSAIGPI (MAGC3_HUMAN)
EILSAIGPW

SEQ ID NO: 106826 - protein, 11 aa, Artificial Sequence
  Description of Artificial Sequence: Synthetic peptide
  Seed: LPAVSPGKRLW (MAGC3_HUMAN)
LVAVSPGKRLW

SEQ ID NO: 106827 - protein, 9 aa, Artificial Sequence
  Description of Artificial Sequence: Synthetic peptide
  Seed: RGTGYTLSL (MAGC3_HUMAN)
RATGYTLSW

SEQ ID NO: 106828 - protein, 9 aa, Artificial Sequence
  Description of Artificial Sequence: Synthetic peptide
  Seed: FKLWRTLSG (MAGC3_HUMAN)
FILWRTLSY

SEQ ID NO: 106829 - protein, 11 aa, Artificial Sequence
  Description of Artificial Sequence: Synthetic peptide
  Seed: RTLSGSPGLQL (MAGC3_HUMAN)
RSLSGSPGLQL

SEQ ID NO: 106830 - protein, 9 aa, Artificial Sequence
  Description of Artificial Sequence: Synthetic peptide
  Seed: WVKNTCATY (MAGC3_HUMAN)
WAKNTCATF

SEQ ID NO: 106831 - protein, 8 aa, Artificial Sequence
  Description of Artificial Sequence: Synthetic peptide
  Seed: FADVLSRL (MAGC3_HUMAN)
FTDVLSRY

SEQ ID NO: 106832 - protein, 10 aa, Artificial Sequence
  Description of Artificial Sequence: Synthetic peptide
  Seed: SPQGPPQSPP (MAGC3_HUMAN)
SPQGPPQSPA

SEQ ID NO: 106833 - protein, 10 aa, Artificial Sequence
  Description of Artificial Sequence: Synthetic peptide
  Seed: YALSPVVLPP (MAGC3_HUMAN)
YELSPVVLPL

SEQ ID NO: 106834 - protein, 10 aa, Artificial Sequence
  Description of Artificial Sequence: Synthetic peptide
  Seed: MQMNVINTYT (MAGC3_HUMAN)
MTMNVINTYF

SEQ ID NO: 106835 - protein, 9 aa, Artificial Sequence
  Description of Artificial Sequence: Synthetic peptide
  Seed: KVAELVQFL (MAGC3_HUMAN)
KSAELVQFA

SEQ ID NO: 106836 - protein, 9 aa, Artificial Sequence
  Description of Artificial Sequence: Synthetic peptide
  Seed: YFFEDTLDL (MAGC3_HUMAN)
YIFEDTLDA

SEQ ID NO: 106837 - protein, 9 aa, Artificial Sequence
  Description of Artificial Sequence: Synthetic peptide
  Seed: AGFADVLSR (MAGC3_HUMAN)
ASFADVLSK

SEQ ID NO: 106838 - protein, 10 aa, Artificial Sequence
  Description of Artificial Sequence: Synthetic peptide
  Seed: YSAFHLGHLR (MAGC3_HUMAN)
YPAFHLGHLK

SEQ ID NO: 106839 - protein, 10 aa, Artificial Sequence
  Description of Artificial Sequence: Synthetic peptide
  Seed: MPKNCLLILI (MAGC3_HUMAN)
MPKNCLLILL

SEQ ID NO: 106840 - protein, 10 aa, Artificial Sequence
  Description of Artificial Sequence: Synthetic peptide
  Seed: SAFHLGHLRE (MAGC3_HUMAN)
SMFHLGHLRQ

SEQ ID NO: 106841 - protein, 10 aa, Artificial Sequence
  Description of Artificial Sequence: Synthetic peptide
  Seed: SDQRMDSLVL (MAGC3_HUMAN)
SQQRMDSLVF

SEQ ID NO: 106842 - protein, 10 aa, Artificial Sequence
  Description of Artificial Sequence: Synthetic peptide
  Seed: VKNTCATYAL (MAGC3_HUMAN)
VKNTCATYAY

SEQ ID NO: 106843 - protein, 10 aa, Artificial Sequence
  Description of Artificial Sequence: Synthetic peptide
  Seed: GSLPESEPLF (MAGC3_HUMAN)
GSLPESEPLW

SEQ ID NO: 106844 - protein, 10 aa, Artificial Sequence
  Description of Artificial Sequence: Synthetic peptide
  Seed: LILILSVIFI (MAGC3_HUMAN)
LLLILSVIFV

SEQ ID NO: 106845 - protein, 9 aa, Artificial Sequence
  Description of Artificial Sequence: Synthetic peptide
  Seed: HFYVFVNTL (MAGC3_HUMAN)
HMYVFVNTM

SEQ ID NO: 106846 - protein, 9 aa, Artificial Sequence
  Description of Artificial Sequence: Synthetic peptide
  Seed: LDLTYEGSL (MAGC3_HUMAN)
LELTYEGSL

SEQ ID NO: 106847 - protein, 9 aa, Artificial Sequence
  Description of Artificial Sequence: Synthetic peptide
  Seed: IPPQGPPKI (MAGC3_HUMAN)
IQPQGPPKM

SEQ ID NO: 106848 - protein, 9 aa, Artificial Sequence
  Description of Artificial Sequence: Synthetic peptide
  Seed: ILILSVIFI (MAGC3_HUMAN)
IMILSVIFA

SEQ ID NO: 106849 - protein, 10 aa, Artificial Sequence
  Description of Artificial Sequence: Synthetic peptide
  Seed: MQMNVINTYT (MAGC3_HUMAN)
MMMNVINTYY

SEQ ID NO: 106850 - protein, 9 aa, Artificial Sequence
  Description of Artificial Sequence: Synthetic peptide
  Seed: ELIFGIALT (MAGC3_HUMAN)
ETIFGIALC

SEQ ID NO: 106851 - protein, 9 aa, Artificial Sequence
  Description of Artificial Sequence: Synthetic peptide
  Seed: MLTTVIKKY (MAGC3_HUMAN)
MTTTVIKKM

SEQ ID NO: 106852 - protein, 11 aa, Artificial Sequence
  Description of Artificial Sequence: Synthetic peptide
  Seed: TTDDATAMASA (MAGC3_HUMAN)
TMDDATAMASF

SEQ ID NO: 106853 - protein, 9 aa, Artificial Sequence
  Description of Artificial Sequence: Synthetic peptide
  Seed: MPAAGMPPL (MAGC3_HUMAN)
MIAAGMPPF

SEQ ID NO: 106854 - protein, 11 aa, Artificial Sequence
  Description of Artificial Sequence: Synthetic peptide
  Seed: ALAGFADVLSR (MAGC3_HUMAN)
AAAGFADVLSY

SEQ ID NO: 106855 - protein, 9 aa, Artificial Sequence
  Description of Artificial Sequence: Synthetic peptide
  Seed: EKVDKLVQF (MAGC3_HUMAN)
ELVDKLVQY

SEQ ID NO: 106856 - protein, 11 aa, Artificial Sequence
  Description of Artificial Sequence: Synthetic peptide
  Seed: HALPESESLPR (MAGC3_HUMAN)
HFLPESESLPR

SEQ ID NO: 106857 - protein, 10 aa, Artificial Sequence
  Description of Artificial Sequence: Synthetic peptide
  Seed: SLRRAVSVKQ (MAGC3_HUMAN)
SLRRAVSVKK

SEQ ID NO: 106858 - protein, 10 aa, Artificial Sequence
  Description of Artificial Sequence: Synthetic peptide
  Seed: MQMNVINTYT (MAGC3_HUMAN)
MQMNVINTYI

SEQ ID NO: 106859 - protein, 10 aa, Artificial Sequence
  Description of Artificial Sequence: Synthetic peptide
  Seed: SAFHLGHLRE (MAGC3_HUMAN)
SVFHLGHLRK

SEQ ID NO: 106860 - protein, 10 aa, Artificial Sequence
  Description of Artificial Sequence: Synthetic peptide
  Seed: KVAELVQFLL (MAGC3_HUMAN)
KQAELVQFLF

SEQ ID NO: 106861 - protein, 9 aa, Artificial Sequence
  Description of Artificial Sequence: Synthetic peptide
  Seed: HSYFFEDTL (MAGC3_HUMAN)
HKYFFEDTM

SEQ ID NO: 106862 - protein, 10 aa, Artificial Sequence
  Description of Artificial Sequence: Synthetic peptide
  Seed: RLWGEKAGSL (MAGC3_HUMAN)
RLWGEKAGSI

SEQ ID NO: 106863 - protein, 9 aa, Artificial Sequence
  Description of Artificial Sequence: Synthetic peptide
  Seed: RGTGYTLSL (MAGC3_HUMAN)
RATGYTLSL

SEQ ID NO: 106864 - protein, 9 aa, Artificial Sequence
  Description of Artificial Sequence: Synthetic peptide
  Seed: IIPSAFPSW (MAGC3_HUMAN)
IAPSAFPSW

SEQ ID NO: 106865 - protein, 10 aa, Artificial Sequence
  Description of Artificial Sequence: Synthetic peptide
  Seed: SDQRMDSLVL (MAGC3_HUMAN)
SCQRMDSLVM

SEQ ID NO: 106866 - protein, 9 aa, Artificial Sequence
  Description of Artificial Sequence: Synthetic peptide
  Seed: FLSKLSSII (MAGC3_HUMAN)
FISKLSSIF

SEQ ID NO: 106867 - protein, 10 aa, Artificial Sequence
  Description of Artificial Sequence: Synthetic peptide
  Seed: KLSSIIPSAF (MAGC3_HUMAN)
KMSSIIPSAA

SEQ ID NO: 106868 - protein, 10 aa, Artificial Sequence
  Description of Artificial Sequence: Synthetic peptide
  Seed: FSDGSLGQWV (MAGC3_HUMAN)
FQDGSLGQWL

SEQ ID NO: 106869 - protein, 10 aa, Artificial Sequence
  Description of Artificial Sequence: Synthetic peptide
  Seed: YALSPVVLPP (MAGC3_HUMAN)
YVLSPVVLPL

SEQ ID NO: 106870 - protein, 10 aa, Artificial Sequence
  Description of Artificial Sequence: Synthetic peptide
  Seed: SPQGPPQSPP (MAGC3_HUMAN)
SPQGPPQSPV

SEQ ID NO: 106871 - protein, 10 aa, Artificial Sequence
  Description of Artificial Sequence: Synthetic peptide
  Seed: TTDDATAMAS (MAGC3_HUMAN)
TVDDATAMAF

SEQ ID NO: 106872 - protein, 10 aa, Artificial Sequence
  Description of Artificial Sequence: Synthetic peptide
  Seed: SKLSSIIPSA (MAGC3_HUMAN)
SLLSSIIPSA

SEQ ID NO: 106873 - protein, 8 aa, Artificial Sequence
  Description of Artificial Sequence: Synthetic peptide
  Seed: KVDKLVQF (MAGC3_HUMAN)
KMDKLVQL

SEQ ID NO: 106874 - protein, 10 aa, Artificial Sequence
  Description of Artificial Sequence: Synthetic peptide
  Seed: KAHEFIELIF (MAGC3_HUMAN)
KQHEFIELIY

SEQ ID NO: 106875 - protein, 9 aa, Artificial Sequence
  Description of Artificial Sequence: Synthetic peptide
  Seed: SVLDLANPQ (MAGC3_HUMAN)
SVLDLANPK

SEQ ID NO: 106876 - protein, 9 aa, Artificial Sequence
  Description of Artificial Sequence: Synthetic peptide
  Seed: TKAEMLTTV (MAGC3_HUMAN)
TMAEMLTTV

SEQ ID NO: 106877 - protein, 9 aa, Artificial Sequence
  Description of Artificial Sequence: Synthetic peptide
  Seed: VPEEVIWEV (MAGC3_HUMAN)
VAEEVIWEI

SEQ ID NO: 106878 - protein, 9 aa, Artificial Sequence
  Description of Artificial Sequence: Synthetic peptide
  Seed: FADVLSRLA (MAGC3_HUMAN)
FYDVLSRLI

SEQ ID NO: 106879 - protein, 10 aa, Artificial Sequence
  Description of Artificial Sequence: Synthetic peptide
  Seed: KLSSIIPSAF (MAGC3_HUMAN)
KASSIIPSAL

SEQ ID NO: 106880 - protein, 9 aa, Artificial Sequence
  Description of Artificial Sequence: Synthetic peptide
  Seed: KVDKLVQFL (MAGC3_HUMAN)
KQDKLVQFL

SEQ ID NO: 106881 - protein, 9 aa, Artificial Sequence
  Description of Artificial Sequence: Synthetic peptide
  Seed: MDPDNHSYF (MAGC3_HUMAN)
MLPDNHSYL

SEQ ID NO: 106882 - protein, 9 aa, Artificial Sequence
  Description of Artificial Sequence: Synthetic peptide
  Seed: SIIPSAFPS (MAGC3_HUMAN)
STIPSAFPM

SEQ ID NO: 106883 - protein, 9 aa, Artificial Sequence
  Description of Artificial Sequence: Synthetic peptide
  Seed: YFFEDTLDL (MAGC3_HUMAN)
YSFEDTLDI

SEQ ID NO: 106884 - protein, 9 aa, Artificial Sequence
  Description of Artificial Sequence: Synthetic peptide
  Seed: LTEVDPDHF (MAGC3_HUMAN)
LTEVDPDHL

SEQ ID NO: 106885 - protein, 9 aa, Artificial Sequence
  Description of Artificial Sequence: Synthetic peptide
  Seed: QPQPRKKAT (MAGC3_HUMAN)
QAQPRKKAL

SEQ ID NO: 106886 - protein, 9 aa, Artificial Sequence
  Description of Artificial Sequence: Synthetic peptide
  Seed: NAIGPWSAL (MAGC3_HUMAN)
NPIGPWSAL

SEQ ID NO: 106887 - protein, 9 aa, Artificial Sequence
  Description of Artificial Sequence: Synthetic peptide
  Seed: VLCPTYFKL (MAGC3_HUMAN)
VLCPTYFKY

SEQ ID NO: 106888 - protein, 9 aa, Artificial Sequence
  Description of Artificial Sequence: Synthetic peptide
  Seed: LSDEQGMPQ (MAGC3_HUMAN)
LMDEQGMPM

SEQ ID NO: 106889 - protein, 10 aa, Artificial Sequence
  Description of Artificial Sequence: Synthetic peptide
  Seed: SKLSSIIPSA (MAGC3_HUMAN)
SELSSIIPSL

SEQ ID NO: 106890 - protein, 9 aa, Artificial Sequence
  Description of Artificial Sequence: Synthetic peptide
  Seed: TYFKLWRTL (MAGC3_HUMAN)
TYFKLWRTI

SEQ ID NO: 106891 - protein, 9 aa, Artificial Sequence
  Description of Artificial Sequence: Synthetic peptide
  Seed: DEKVAELVQ (MAGC3_HUMAN)
DEKVAELVF

SEQ ID NO: 106892 - protein, 9 aa, Artificial Sequence
  Description of Artificial Sequence: Synthetic peptide
  Seed: AMASASPSV (MAGC3_HUMAN)
ANASASPSF

SEQ ID NO: 106893 - protein, 10 aa, Artificial Sequence
  Description of Artificial Sequence: Synthetic peptide
  Seed: MDPDNHSYFF (MAGC3_HUMAN)
MIPDNHSYFF

SEQ ID NO: 106894 - protein, 9 aa, Artificial Sequence
  Description of Artificial Sequence: Synthetic peptide
  Seed: SLVLCPTYF (MAGC3_HUMAN)
SKVLCPTYF

SEQ ID NO: 106895 - protein, 9 aa, Artificial Sequence
  Description of Artificial Sequence: Synthetic peptide
  Seed: QTKEPVTKA (MAGC3_HUMAN)
QAKEPVTKY

SEQ ID NO: 106896 - protein, 10 aa, Artificial Sequence
  Description of Artificial Sequence: Synthetic peptide
  Seed: KDYFPMIFGK (MAGC3_HUMAN)
KSYFPMIFGR

SEQ ID NO: 106897 - protein, 9 aa, Artificial Sequence
  Description of Artificial Sequence: Synthetic peptide
  Seed: KLSSIIPSA (MAGC3_HUMAN)
KYSSIIPSK

SEQ ID NO: 106898 - protein, 10 aa, Artificial Sequence
  Description of Artificial Sequence: Synthetic peptide
  Seed: INTYTGYFPM (MAGC3_HUMAN)
IETYTGYFPY

SEQ ID NO: 106899 - protein, 9 aa, Artificial Sequence
  Description of Artificial Sequence: Synthetic peptide
  Seed: KYKDYFPMI (MAGC3_HUMAN)
KYKDYFPML

SEQ ID NO: 106900 - protein, 11 aa, Artificial Sequence
  Description of Artificial Sequence: Synthetic peptide
  Seed: HALPESESLPR (MAGC3_HUMAN)
HALPESESLPY

SEQ ID NO: 106901 - protein, 9 aa, Artificial Sequence
  Description of Artificial Sequence: Synthetic peptide
  Seed: HLREVRLFL (MAGC3_HUMAN)
HVREVRLFV

SEQ ID NO: 106902 - protein, 9 aa, Artificial Sequence
  Description of Artificial Sequence: Synthetic peptide
  Seed: FEDTLDLTY (MAGC3_HUMAN)
FYDTLDLTI

SEQ ID NO: 106903 - protein, 9 aa, Artificial Sequence
  Description of Artificial Sequence: Synthetic peptide
  Seed: KYKDYFPMI (MAGC3_HUMAN)
KIKDYFPMR

SEQ ID NO: 106904 - protein, 11 aa, Artificial Sequence
  Description of Artificial Sequence: Synthetic peptide
  Seed: FIELIFGIALT (MAGC3_HUMAN)
FTELIFGIALV

SEQ ID NO: 106905 - protein, 9 aa, Artificial Sequence
  Description of Artificial Sequence: Synthetic peptide
  Seed: KAHEFIELI (MAGC3_HUMAN)
KMHEFIELV

SEQ ID NO: 106906 - protein, 9 aa, Artificial Sequence
  Description of Artificial Sequence: Synthetic peptide
  Seed: SDLHFGSQP (MAGC3_HUMAN)
SELHFGSQV

SEQ ID NO: 106907 - protein, 10 aa, Artificial Sequence
  Description of Artificial Sequence: Synthetic peptide
  Seed: YTLDEKVDKL (MAGC3_HUMAN)
YSLDEKVDKW

SEQ ID NO: 106908 - protein, 10 aa, Artificial Sequence
  Description of Artificial Sequence: Synthetic peptide
  Seed: INTYTGYFPM (MAGC3_HUMAN)
ILTYTGYFPF

SEQ ID NO: 106909 - protein, 10 aa, Artificial Sequence
  Description of Artificial Sequence: Synthetic peptide
  Seed: LPTWRRGTGY (MAGC3_HUMAN)
LLTWRRGTGW

SEQ ID NO: 106910 - protein, 9 aa, Artificial Sequence
  Description of Artificial Sequence: Synthetic peptide
  Seed: LILSMIFIK (MAGC3_HUMAN)
LMLSMIFIK

SEQ ID NO: 106911 - protein, 10 aa, Artificial Sequence
  Description of Artificial Sequence: Synthetic peptide
  Seed: SIIPSAFPSW (MAGC3_HUMAN)
SAIPSAFPSF

SEQ ID NO: 106912 - protein, 9 aa, Artificial Sequence
  Description of Artificial Sequence: Synthetic peptide
  Seed: FADVLSRLA (MAGC3_HUMAN)
FWDVLSRLI

SEQ ID NO: 106913 - protein, 11 aa, Artificial Sequence
  Description of Artificial Sequence: Synthetic peptide
  Seed: ISLTEVDPDHF (MAGC3_HUMAN)
IALTEVDPDHW

SEQ ID NO: 106914 - protein, 11 aa, Artificial Sequence
  Description of Artificial Sequence: Synthetic peptide
  Seed: SSSEEEDTATW (MAGC3_HUMAN)
SLSEEEDTATW

SEQ ID NO: 106915 - protein, 9 aa, Artificial Sequence
  Description of Artificial Sequence: Synthetic peptide
  Seed: RGTGYTLSL (MAGC3_HUMAN)
RSTGYTLSY

SEQ ID NO: 106916 - protein, 10 aa, Artificial Sequence
  Description of Artificial Sequence: Synthetic peptide
  Seed: EVLSAIGPIQ (MAGC3_HUMAN)
EALSAIGPIR

SEQ ID NO: 106917 - protein, 9 aa, Artificial Sequence
  Description of Artificial Sequence: Synthetic peptide
  Seed: AIIDTTDDA (MAGC3_HUMAN)
AVIDTTDDI

SEQ ID NO: 106918 - protein, 9 aa, Artificial Sequence
  Description of Artificial Sequence: Synthetic peptide
  Seed: QPQPRKKAT (MAGC3_HUMAN)
QVQPRKKAL

SEQ ID NO: 106919 - protein, 10 aa, Artificial Sequence
  Description of Artificial Sequence: Synthetic peptide
  Seed: GNCASEEVIW (MAGC3_HUMAN)
GSCASEEVIW

SEQ ID NO: 106920 - protein, 8 aa, Artificial Sequence
  Description of Artificial Sequence: Synthetic peptide
  Seed: TTDDATAM (MAGC3_HUMAN)
TWDDATAM

SEQ ID NO: 106921 - protein, 9 aa, Artificial Sequence
  Description of Artificial Sequence: Synthetic peptide
  Seed: AMASASPSV (MAGC3_HUMAN)
AGASASPSF

SEQ ID NO: 106922 - protein, 9 aa, Artificial Sequence
  Description of Artificial Sequence: Synthetic peptide
  Seed: GSLPESEPL (MAGC3_HUMAN)
GILPESEPF

SEQ ID NO: 106923 - protein, 9 aa, Artificial Sequence
  Description of Artificial Sequence: Synthetic peptide
  Seed: SLVLCPTYF (MAGC3_HUMAN)
SYVLCPTYF

SEQ ID NO: 106924 - protein, 10 aa, Artificial Sequence
  Description of Artificial Sequence: Synthetic peptide
  Seed: CVPEEVIWEV (MAGC3_HUMAN)
CLPEEVIWEL

SEQ ID NO: 106925 - protein, 9 aa, Artificial Sequence
  Description of Artificial Sequence: Synthetic peptide
  Seed: VIWEVLNAI (MAGC3_HUMAN)
VVWEVLNAV

SEQ ID NO: 106926 - protein, 10 aa, Artificial Sequence
  Description of Artificial Sequence: Synthetic peptide
  Seed: FKLWRTLSGS (MAGC3_HUMAN)
FALWRTLSGA

SEQ ID NO: 106927 - protein, 9 aa, Artificial Sequence
  Description of Artificial Sequence: Synthetic peptide
  Seed: RTLSGSPGL (MAGC3_HUMAN)
RLLSGSPGY

SEQ ID NO: 106928 - protein, 11 aa, Artificial Sequence
  Description of Artificial Sequence: Synthetic peptide
  Seed: FIELIFGIALT (MAGC3_HUMAN)
FGELIFGIALI

SEQ ID NO: 106929 - protein, 10 aa, Artificial Sequence
  Description of Artificial Sequence: Synthetic peptide
  Seed: REVRLFLRGG (MAGC3_HUMAN)
RAVRLFLRGA

SEQ ID NO: 106930 - protein, 9 aa, Artificial Sequence
  Description of Artificial Sequence: Synthetic peptide
  Seed: ATYALSPVV (MAGC3_HUMAN)
AQYALSPVM

SEQ ID NO: 106931 - protein, 9 aa, Artificial Sequence
  Description of Artificial Sequence: Synthetic peptide
  Seed: LSRLALWES (MAGC3_HUMAN)
LQRLALWEK

SEQ ID NO: 106932 - protein, 10 aa, Artificial Sequence
  Description of Artificial Sequence: Synthetic peptide
  Seed: KDYFPMIFGK (MAGC3_HUMAN)
KDYFPMIFGR

SEQ ID NO: 106933 - protein, 11 aa, Artificial Sequence
  Description of Artificial Sequence: Synthetic peptide
  Seed: YALDEKVAELV (MAGC3_HUMAN)
YVLDEKVAELV

SEQ ID NO: 106934 - protein, 9 aa, Artificial Sequence
  Description of Artificial Sequence: Synthetic peptide
  Seed: FADVLSRLA (MAGC3_HUMAN)
FADVLSRLI

SEQ ID NO: 106935 - protein, 9 aa, Artificial Sequence
  Description of Artificial Sequence: Synthetic peptide
  Seed: YSAFHLGHL (MAGC3_HUMAN)
YMAFHLGHC

SEQ ID NO: 106936 - protein, 9 aa, Artificial Sequence
  Description of Artificial Sequence: Synthetic peptide
  Seed: FSDGSLGQW (MAGC3_HUMAN)
FVDGSLGQL

SEQ ID NO: 106937 - protein, 9 aa, Artificial Sequence
  Description of Artificial Sequence: Synthetic peptide
  Seed: KVDKLVQFL (MAGC3_HUMAN)
KTDKLVQFY

SEQ ID NO: 106938 - protein, 8 aa, Artificial Sequence
  Description of Artificial Sequence: Synthetic peptide
  Seed: TTDDATAM (MAGC3_HUMAN)
TADDATAM

SEQ ID NO: 106939 - protein, 9 aa, Artificial Sequence
  Description of Artificial Sequence: Synthetic peptide
  Seed: SQPEGKFSL (MAGC3_HUMAN)
SFPEGKFSY

SEQ ID NO: 106940 - protein, 10 aa, Artificial Sequence
  Description of Artificial Sequence: Synthetic peptide
  Seed: YALDEKVAEL (MAGC3_HUMAN)
YDLDEKVAEI

SEQ ID NO: 106941 - protein, 11 aa, Artificial Sequence
  Description of Artificial Sequence: Synthetic peptide
  Seed: FIKGSCVPEEV (MAGC3_HUMAN)
FMKGSCVPEEV

SEQ ID NO: 106942 - protein, 9 aa, Artificial Sequence
  Description of Artificial Sequence: Synthetic peptide
  Seed: WESEGPEAF (MAGC3_HUMAN)
WESEGPEAY

SEQ ID NO: 106943 - protein, 9 aa, Artificial Sequence
  Description of Artificial Sequence: Synthetic peptide
  Seed: EVLEFLSKL (MAGC3_HUMAN)
ESLEFLSKI

SEQ ID NO: 106944 - protein, 10 aa, Artificial Sequence
  Description of Artificial Sequence: Synthetic peptide
  Seed: EVIWEVLNAI (MAGC3_HUMAN)
ESIWEVLNAM

SEQ ID NO: 106945 - protein, 10 aa, Artificial Sequence
  Description of Artificial Sequence: Synthetic peptide
  Seed: FKLWRTLSGS (MAGC3_HUMAN)
FLLWRTLSGV

SEQ ID NO: 106946 - protein, 9 aa, Artificial Sequence
  Description of Artificial Sequence: Synthetic peptide
  Seed: KKYKDYFPM (MAGC3_HUMAN)
KMYKDYFPH

SEQ ID NO: 106947 - protein, 10 aa, Artificial Sequence
  Description of Artificial Sequence: Synthetic peptide
  Seed: AEMQMNVINT (MAGC3_HUMAN)
AEMQMNVINL

SEQ ID NO: 106948 - protein, 10 aa, Artificial Sequence
  Description of Artificial Sequence: Synthetic peptide
  Seed: LNAIGPWSAL (MAGC3_HUMAN)
LGAIGPWSAF

SEQ ID NO: 106949 - protein, 9 aa, Artificial Sequence
  Description of Artificial Sequence: Synthetic peptide
  Seed: SQPEGKFSL (MAGC3_HUMAN)
SEPEGKFSI

SEQ ID NO: 106950 - protein, 9 aa, Artificial Sequence
  Description of Artificial Sequence: Synthetic peptide
  Seed: YKDYFPMIF (MAGC3_HUMAN)
YFDYFPMIF

SEQ ID NO: 106951 - protein, 11 aa, Artificial Sequence
  Description of Artificial Sequence: Synthetic peptide
  Seed: TTDDATAMASA (MAGC3_HUMAN)
TVDDATAMASI

SEQ ID NO: 106952 - protein, 9 aa, Artificial Sequence
  Description of Artificial Sequence: Synthetic peptide
  Seed: MIFRKAREF (MAGC3_HUMAN)
MQFRKAREF

SEQ ID NO: 106953 - protein, 9 aa, Artificial Sequence
  Description of Artificial Sequence: Synthetic peptide
  Seed: LSDEQGMPQ (MAGC3_HUMAN)
LNDEQGMPI

SEQ ID NO: 106954 - protein, 9 aa, Artificial Sequence
  Description of Artificial Sequence: Synthetic peptide
  Seed: HEFIELIFG (MAGC3_HUMAN)
HEFIELIFV

SEQ ID NO: 106955 - protein, 11 aa, Artificial Sequence
  Description of Artificial Sequence: Synthetic peptide
  Seed: LPQSPPEIPPQ (MAGC3_HUMAN)
LPQSPPEIPPC

SEQ ID NO: 106956 - protein, 10 aa, Artificial Sequence
  Description of Artificial Sequence: Synthetic peptide
  Seed: QWVKNTCATY (MAGC3_HUMAN)
QQVKNTCATM

SEQ ID NO: 106957 - protein, 10 aa, Artificial Sequence
  Description of Artificial Sequence: Synthetic peptide
  Seed: SALAGFADVL (MAGC3_HUMAN)
SELAGFADVV

SEQ ID NO: 106958 - protein, 10 aa, Artificial Sequence
  Description of Artificial Sequence: Synthetic peptide
  Seed: SKLSSIIPSA (MAGC3_HUMAN)
SALSSIIPSA

SEQ ID NO: 106959 - protein, 11 aa, Artificial Sequence
  Description of Artificial Sequence: Synthetic peptide
  Seed: TSDQRMDSLVL (MAGC3_HUMAN)
TVDQRMDSLVY

SEQ ID NO: 106960 - protein, 10 aa, Artificial Sequence
  Description of Artificial Sequence: Synthetic peptide
  Seed: KLVQFLLLKY (MAGC3_HUMAN)
KIVQFLLLKW

SEQ ID NO: 106961 - protein, 8 aa, Artificial Sequence
  Description of Artificial Sequence: Synthetic peptide
  Seed: IFGKAHEF (MAGC3_HUMAN)
IVGKAHEL

SEQ ID NO: 106962 - protein, 9 aa, Artificial Sequence
  Description of Artificial Sequence: Synthetic peptide
  Seed: KVDKLVQFL (MAGC3_HUMAN)
KFDKLVQFW

SEQ ID NO: 106963 - protein, 10 aa, Artificial Sequence
  Description of Artificial Sequence: Synthetic peptide
  Seed: NTYTGYFPMI (MAGC3_HUMAN)
NQYTGYFPMV

SEQ ID NO: 106964 - protein, 10 aa, Artificial Sequence
  Description of Artificial Sequence: Synthetic peptide
  Seed: NTYTGYFPMI (MAGC3_HUMAN)
NYYTGYFPML

SEQ ID NO: 106965 - protein, 9 aa, Artificial Sequence
  Description of Artificial Sequence: Synthetic peptide
  Seed: HALPESESL (MAGC3_HUMAN)
HRLPESESF

SEQ ID NO: 106966 - protein, 10 aa, Artificial Sequence
  Description of Artificial Sequence: Synthetic peptide
  Seed: EVIWEVLNAI (MAGC3_HUMAN)
EQIWEVLNAV

SEQ ID NO: 106967 - protein, 9 aa, Artificial Sequence
  Description of Artificial Sequence: Synthetic peptide
  Seed: RPAREVLEF (MAGC3_HUMAN)
RMAREVLEY

SEQ ID NO: 106968 - protein, 9 aa, Artificial Sequence
  Description of Artificial Sequence: Synthetic peptide
  Seed: KYKDYFPMI (MAGC3_HUMAN)
KTKDYFPMA

SEQ ID NO: 106969 - protein, 9 aa, Artificial Sequence
  Description of Artificial Sequence: Synthetic peptide
  Seed: RTLWKDSDL (MAGC3_HUMAN)
RTLWKDSDW

SEQ ID NO: 106970 - protein, 8 aa, Artificial Sequence
  Description of Artificial Sequence: Synthetic peptide
  Seed: AIGPWSAL (MAGC3_HUMAN)
AAGPWSAY

SEQ ID NO: 106971 - protein, 11 aa, Artificial Sequence
  Description of Artificial Sequence: Synthetic peptide
  Seed: RTLSGSPGLQL (MAGC3_HUMAN)
RMLSGSPGLQR

SEQ ID NO: 106972 - protein, 9 aa, Artificial Sequence
  Description of Artificial Sequence: Synthetic peptide
  Seed: ILILSMIFI (MAGC3_HUMAN)
IIILSMIFV

SEQ ID NO: 106973 - protein, 9 aa, Artificial Sequence
  Description of Artificial Sequence: Synthetic peptide
  Seed: LIDDQGMPK (MAGC3_HUMAN)
LLDDQGMPV

SEQ ID NO: 106974 - protein, 9 aa, Artificial Sequence
  Description of Artificial Sequence: Synthetic peptide
  Seed: LEFLSKLSS (MAGC3_HUMAN)
LEFLSKLSI

SEQ ID NO: 106975 - protein, 9 aa, Artificial Sequence
  Description of Artificial Sequence: Synthetic peptide
  Seed: REVRLFLRG (MAGC3_HUMAN)
REVRLFLRA

SEQ ID NO: 106976 - protein, 9 aa, Artificial Sequence
  Description of Artificial Sequence: Synthetic peptide
  Seed: EFIELIFGI (MAGC3_HUMAN)
ECIELIFGI

SEQ ID NO: 106977 - protein, 9 aa, Artificial Sequence
  Description of Artificial Sequence: Synthetic peptide
  Seed: ATDKDYSAF (MAGC3_HUMAN)
AWDKDYSAF

SEQ ID NO: 106978 - protein, 9 aa, Artificial Sequence
  Description of Artificial Sequence: Synthetic peptide
  Seed: KYKDYFPMI (MAGC3_HUMAN)
KFKDYFPMA

SEQ ID NO: 106979 - protein, 11 aa, Artificial Sequence
  Description of Artificial Sequence: Synthetic peptide
  Seed: ILFGISLTEVD (MAGC3_HUMAN)
ILFGISLTEVT

SEQ ID NO: 106980 - protein, 9 aa, Artificial Sequence
  Description of Artificial Sequence: Synthetic peptide
  Seed: IFGKAHEFI (MAGC3_HUMAN)
IWGKAHEFW

SEQ ID NO: 106981 - protein, 9 aa, Artificial Sequence
  Description of Artificial Sequence: Synthetic peptide
  Seed: HALPESESL (MAGC3_HUMAN)
HHLPESESI

SEQ ID NO: 106982 - protein, 9 aa, Artificial Sequence
  Description of Artificial Sequence: Synthetic peptide
  Seed: DYFPMIFGK (MAGC3_HUMAN)
DVFPMIFGR

SEQ ID NO: 106983 - protein, 10 aa, Artificial Sequence
  Description of Artificial Sequence: Synthetic peptide
  Seed: EVIWEVLSAI (MAGC3_HUMAN)
ETIWEVLSAL

SEQ ID NO: 106984 - protein, 10 aa, Artificial Sequence
  Description of Artificial Sequence: Synthetic peptide
  Seed: SLVLCPTYFK (MAGC3_HUMAN)
STVLCPTYFR

SEQ ID NO: 106985 - protein, 11 aa, Artificial Sequence
  Description of Artificial Sequence: Synthetic peptide
  Seed: TSDQRMDSLVL (MAGC3_HUMAN)
TRDQRMDSLVF

SEQ ID NO: 106986 - protein, 9 aa, Artificial Sequence
  Description of Artificial Sequence: Synthetic peptide
  Seed: LSGSPGLQL (MAGC3_HUMAN)
LVGSPGLQW

SEQ ID NO: 106987 - protein, 10 aa, Artificial Sequence
  Description of Artificial Sequence: Synthetic peptide
  Seed: MLTTVIKKYK (MAGC3_HUMAN)
MITTVIKKYR

SEQ ID NO: 106988 - protein, 10 aa, Artificial Sequence
  Description of Artificial Sequence: Synthetic peptide
  Seed: YALDEKVAEL (MAGC3_HUMAN)
YWLDEKVAEC

SEQ ID NO: 106989 - protein, 10 aa, Artificial Sequence
  Description of Artificial Sequence: Synthetic peptide
  Seed: REVRLFLRGG (MAGC3_HUMAN)
RDVRLFLRGK

SEQ ID NO: 106990 - protein, 9 aa, Artificial Sequence
  Description of Artificial Sequence: Synthetic peptide
  Seed: MIFGKAHEF (MAGC3_HUMAN)
MWFGKAHEV

SEQ ID NO: 106991 - protein, 10 aa, Artificial Sequence
  Description of Artificial Sequence: Synthetic peptide
  Seed: FFEDTLDLTY (MAGC3_HUMAN)
FPEDTLDLTF

SEQ ID NO: 106992 - protein, 9 aa, Artificial Sequence
  Description of Artificial Sequence: Synthetic peptide
  Seed: AMASASPSV (MAGC3_HUMAN)
AIASASPSR

SEQ ID NO: 106993 - protein, 9 aa, Artificial Sequence
  Description of Artificial Sequence: Synthetic peptide
  Seed: KVAELVQFL (MAGC3_HUMAN)
KYAELVQFY

SEQ ID NO: 106994 - protein, 11 aa, Artificial Sequence
  Description of Artificial Sequence: Synthetic peptide
  Seed: HSYFFEDTLDL (MAGC3_HUMAN)
HSYFFEDTLDF

SEQ ID NO: 106995 - protein, 9 aa, Artificial Sequence
  Description of Artificial Sequence: Synthetic peptide
  Seed: SALAGFADV (MAGC3_HUMAN)
SMLAGFADA

SEQ ID NO: 106996 - protein, 9 aa, Artificial Sequence
  Description of Artificial Sequence: Synthetic peptide
  Seed: FKLWRTLSG (MAGC3_HUMAN)
FKLWRTLSY

SEQ ID NO: 106997 - protein, 10 aa, Artificial Sequence
  Description of Artificial Sequence: Synthetic peptide
  Seed: PAVSPGKRLW (MAGC3_HUMAN)
PTVSPGKRLW

SEQ ID NO: 106998 - protein, 10 aa, Artificial Sequence
  Description of Artificial Sequence: Synthetic peptide
  Seed: ILFGISLTEV (MAGC3_HUMAN)
IAFGISLTEV

SEQ ID NO: 106999 - protein, 9 aa, Artificial Sequence
  Description of Artificial Sequence: Synthetic peptide
  Seed: MPAAGMPPL (MAGC3_HUMAN)
MLAAGMPPY

SEQ ID NO: 107000 - protein, 9 aa, Artificial Sequence
  Description of Artificial Sequence: Synthetic peptide
  Seed: EAFCEESGL (MAGC3_HUMAN)
ETFCEESGR

SEQ ID NO: 107001 - protein, 9 aa, Artificial Sequence
  Description of Artificial Sequence: Synthetic peptide
  Seed: KLSSIIPSA (MAGC3_HUMAN)
KTSSIIPSL

SEQ ID NO: 107002 - protein, 9 aa, Artificial Sequence
  Description of Artificial Sequence: Synthetic peptide
  Seed: YFFEDTLDL (MAGC3_HUMAN)
YFFEDTLDW

SEQ ID NO: 107003 - protein, 10 aa, Artificial Sequence
  Description of Artificial Sequence: Synthetic peptide
  Seed: KLSSIIPSAF (MAGC3_HUMAN)
KNSSIIPSAF

SEQ ID NO: 107004 - protein, 9 aa, Artificial Sequence
  Description of Artificial Sequence: Synthetic peptide
  Seed: MIFGKAHEF (MAGC3_HUMAN)
MLFGKAHES

SEQ ID NO: 107005 - protein, 9 aa, Artificial Sequence
  Description of Artificial Sequence: Synthetic peptide
  Seed: KAHEFIELI (MAGC3_HUMAN)
KAHEFIELA

SEQ ID NO: 107006 - protein, 10 aa, Artificial Sequence
  Description of Artificial Sequence: Synthetic peptide
  Seed: YALDEKVAEL (MAGC3_HUMAN)
YDLDEKVAEA

SEQ ID NO: 107007 - protein, 9 aa, Artificial Sequence
  Description of Artificial Sequence: Synthetic peptide
  Seed: MIFGKAHEF (MAGC3_HUMAN)
MPFGKAHES

SEQ ID NO: 107008 - protein, 10 aa, Artificial Sequence
  Description of Artificial Sequence: Synthetic peptide
  Seed: MDPDNHSYFF (MAGC3_HUMAN)
MHPDNHSYFY

SEQ ID NO: 107009 - protein, 9 aa, Artificial Sequence
  Description of Artificial Sequence: Synthetic peptide
  Seed: ALDEKVAEL (MAGC3_HUMAN)
AFDEKVAEM

SEQ ID NO: 107010 - protein, 9 aa, Artificial Sequence
  Description of Artificial Sequence: Synthetic peptide
  Seed: SPPEIPPQG (MAGC3_HUMAN)
SPPEIPPQP

SEQ ID NO: 107011 - protein, 9 aa, Artificial Sequence
  Description of Artificial Sequence: Synthetic peptide
  Seed: FPSWYMDAL (MAGC3_HUMAN)
FASWYMDAW

SEQ ID NO: 107012 - protein, 10 aa, Artificial Sequence
  Description of Artificial Sequence: Synthetic peptide
  Seed: REVLEFLSKL (MAGC3_HUMAN)
RCVLEFLSKV

SEQ ID NO: 107013 - protein, 9 aa, Artificial Sequence
  Description of Artificial Sequence: Synthetic peptide
  Seed: DMDPDNHSY (MAGC3_HUMAN)
DTDPDNHSM

SEQ ID NO: 107014 - protein, 10 aa, Artificial Sequence
  Description of Artificial Sequence: Synthetic peptide
  Seed: VVLPPQPQPR (MAGC3_HUMAN)
VILPPQPQPR

SEQ ID NO: 107015 - protein, 9 aa, Artificial Sequence
  Description of Artificial Sequence: Synthetic peptide
  Seed: LANPQGLAG (MAGC3_HUMAN)
LTNPQGLAF

SEQ ID NO: 107016 - protein, 10 aa, Artificial Sequence
  Description of Artificial Sequence: Synthetic peptide
  Seed: FPSWYMDALK (MAGC3_HUMAN)
FPSWYMDALV

SEQ ID NO: 107017 - protein, 10 aa, Artificial Sequence
  Description of Artificial Sequence: Synthetic peptide
  Seed: FPSWYMDALK (MAGC3_HUMAN)
FCSWYMDALK

SEQ ID NO: 107018 - protein, 9 aa, Artificial Sequence
  Description of Artificial Sequence: Synthetic peptide
  Seed: IQRPAREVL (MAGC3_HUMAN)
IQRPAREVY

SEQ ID NO: 107019 - protein, 10 aa, Artificial Sequence
  Description of Artificial Sequence: Synthetic peptide
  Seed: SLVLCPTYFK (MAGC3_HUMAN)
SHVLCPTYFR

SEQ ID NO: 107020 - protein, 9 aa, Artificial Sequence
  Description of Artificial Sequence: Synthetic peptide
  Seed: MIFRKAREF (MAGC3_HUMAN)
MIFRKAREY

SEQ ID NO: 107021 - protein, 9 aa, Artificial Sequence
  Description of Artificial Sequence: Synthetic peptide
  Seed: TTDDATAMA (MAGC3_HUMAN)
TMDDATAML

SEQ ID NO: 107022 - protein, 9 aa, Artificial Sequence
  Description of Artificial Sequence: Synthetic peptide
  Seed: TLDEKVDKL (MAGC3_HUMAN)
TMDEKVDKF

SEQ ID NO: 107023 - protein, 9 aa, Artificial Sequence
  Description of Artificial Sequence: Synthetic peptide
  Seed: IIPSAFPSW (MAGC3_HUMAN)
IVPSAFPSL

SEQ ID NO: 107024 - protein, 10 aa, Artificial Sequence
  Description of Artificial Sequence: Synthetic peptide
  Seed: MDPDNHSYFF (MAGC3_HUMAN)
MLPDNHSYFY

SEQ ID NO: 107025 - protein, 9 aa, Artificial Sequence
  Description of Artificial Sequence: Synthetic peptide
  Seed: MQMNVINTY (MAGC3_HUMAN)
MGMNVINTV

SEQ ID NO: 107026 - protein, 9 aa, Artificial Sequence
  Description of Artificial Sequence: Synthetic peptide
  Seed: TYFKLWRTL (MAGC3_HUMAN)
TMFKLWRTY

SEQ ID NO: 107027 - protein, 11 aa, Artificial Sequence
  Description of Artificial Sequence: Synthetic peptide
  Seed: KYKDYFPMIFG (MAGC3_HUMAN)
KWKDYFPMIFF

SEQ ID NO: 107028 - protein, 10 aa, Artificial Sequence
  Description of Artificial Sequence: Synthetic peptide
  Seed: MQMNVINTYT (MAGC3_HUMAN)
MKMNVINTYI

SEQ ID NO: 107029 - protein, 9 aa, Artificial Sequence
  Description of Artificial Sequence: Synthetic peptide
  Seed: EVDPDHFYV (MAGC3_HUMAN)
EVDPDHFYY

SEQ ID NO: 107030 - protein, 9 aa, Artificial Sequence
  Description of Artificial Sequence: Synthetic peptide
  Seed: FEDTLDLTY (MAGC3_HUMAN)
FYDTLDLTY

SEQ ID NO: 107031 - protein, 9 aa, Artificial Sequence
  Description of Artificial Sequence: Synthetic peptide
  Seed: SDQRMDSLV (MAGC3_HUMAN)
SEQRMDSLL

SEQ ID NO: 107032 - protein, 9 aa, Artificial Sequence
  Description of Artificial Sequence: Synthetic peptide
  Seed: MIFGKAHEF (MAGC3_HUMAN)
MLFGKAHEA

SEQ ID NO: 107033 - protein, 9 aa, Artificial Sequence
  Description of Artificial Sequence: Synthetic peptide
  Seed: TGYFPMIFR (MAGC3_HUMAN)
TSYFPMIFK

SEQ ID NO: 107034 - protein, 9 aa, Artificial Sequence
  Description of Artificial Sequence: Synthetic peptide
  Seed: FSLRRAVSV (MAGC3_HUMAN)
FQLRRAVSL

SEQ ID NO: 107035 - protein, 10 aa, Artificial Sequence
  Description of Artificial Sequence: Synthetic peptide
  Seed: LLKYQAKEPL (MAGC3_HUMAN)
LAKYQAKEPF

SEQ ID NO: 107036 - protein, 9 aa, Artificial Sequence
  Description of Artificial Sequence: Synthetic peptide
  Seed: SESLPRYAL (MAGC3_HUMAN)
SQSLPRYAV

SEQ ID NO: 107037 - protein, 11 aa, Artificial Sequence
  Description of Artificial Sequence: Synthetic peptide
  Seed: IIDTTDDATAM (MAGC3_HUMAN)
IVDTTDDATAM

SEQ ID NO: 107038 - protein, 9 aa, Artificial Sequence
  Description of Artificial Sequence: Synthetic peptide
  Seed: QMNVINTYT (MAGC3_HUMAN)
QQNVINTYV

SEQ ID NO: 107039 - protein, 11 aa, Artificial Sequence
  Description of Artificial Sequence: Synthetic peptide
  Seed: ATFSDGSLGQW (MAGC3_HUMAN)
AEFSDGSLGQW

SEQ ID NO: 107040 - protein, 9 aa, Artificial Sequence
  Description of Artificial Sequence: Synthetic peptide
  Seed: CATYALSPV (MAGC3_HUMAN)
CTTYALSPF

SEQ ID NO: 107041 - protein, 9 aa, Artificial Sequence
  Description of Artificial Sequence: Synthetic peptide
  Seed: YSAFHLGHL (MAGC3_HUMAN)
YTAFHLGHY

SEQ ID NO: 107042 - protein, 9 aa, Artificial Sequence
  Description of Artificial Sequence: Synthetic peptide
  Seed: ALDEKVAEL (MAGC3_HUMAN)
ASDEKVAEY

SEQ ID NO: 107043 - protein, 10 aa, Artificial Sequence
  Description of Artificial Sequence: Synthetic peptide
  Seed: AEMLTTVIKK (MAGC3_HUMAN)
AYMLTTVIKK

SEQ ID NO: 107044 - protein, 8 aa, Artificial Sequence
  Description of Artificial Sequence: Synthetic peptide
  Seed: IFGKAHEF (MAGC3_HUMAN)
IAGKAHEL

SEQ ID NO: 107045 - protein, 9 aa, Artificial Sequence
  Description of Artificial Sequence: Synthetic peptide
  Seed: MLLPCHWVL (MAGC3_HUMAN)
MLLPCHWVY

SEQ ID NO: 107046 - protein, 9 aa, Artificial Sequence
  Description of Artificial Sequence: Synthetic peptide
  Seed: HFYVFVNTL (MAGC3_HUMAN)
HQYVFVNTI

SEQ ID NO: 107047 - protein, 9 aa, Artificial Sequence
  Description of Artificial Sequence: Synthetic peptide
  Seed: HALPESESL (MAGC3_HUMAN)
HWLPESESY

SEQ ID NO: 107048 - protein, 9 aa, Artificial Sequence
  Description of Artificial Sequence: Synthetic peptide
  Seed: ATYALSPVV (MAGC3_HUMAN)
ASYALSPVK

SEQ ID NO: 107049 - protein, 10 aa, Artificial Sequence
  Description of Artificial Sequence: Synthetic peptide
  Seed: YALSPVVLPP (MAGC3_HUMAN)
YILSPVVLPT

SEQ ID NO: 107050 - protein, 9 aa, Artificial Sequence
  Description of Artificial Sequence: Synthetic peptide
  Seed: DSDLPTWRR (MAGC3_HUMAN)
DVDLPTWRR

SEQ ID NO: 107051 - protein, 9 aa, Artificial Sequence
  Description of Artificial Sequence: Synthetic peptide
  Seed: IIPSAFPSW (MAGC3_HUMAN)
ILPSAFPSW

SEQ ID NO: 107052 - protein, 9 aa, Artificial Sequence
  Description of Artificial Sequence: Synthetic peptide
  Seed: MIFGKAHEF (MAGC3_HUMAN)
MVFGKAHEW

SEQ ID NO: 107053 - protein, 9 aa, Artificial Sequence
  Description of Artificial Sequence: Synthetic peptide
  Seed: NTYTGYFPM (MAGC3_HUMAN)
NQYTGYFPH

SEQ ID NO: 107054 - protein, 8 aa, Artificial Sequence
  Description of Artificial Sequence: Synthetic peptide
  Seed: FIELIFGI (MAGC3_HUMAN)
FMELIFGL

SEQ ID NO: 107055 - protein, 9 aa, Artificial Sequence
  Description of Artificial Sequence: Synthetic peptide
  Seed: GLQLSDLHF (MAGC3_HUMAN)
GQQLSDLHM

SEQ ID NO: 107056 - protein, 10 aa, Artificial Sequence
  Description of Artificial Sequence: Synthetic peptide
  Seed: KKYKDYFPMI (MAGC3_HUMAN)
KYYKDYFPMF

SEQ ID NO: 107057 - protein, 9 aa, Artificial Sequence
  Description of Artificial Sequence: Synthetic peptide
  Seed: RTLSGSPGL (MAGC3_HUMAN)
RTLSGSPGF

SEQ ID NO: 107058 - protein, 8 aa, Artificial Sequence
  Description of Artificial Sequence: Synthetic peptide
  Seed: MASASPSV (MAGC3_HUMAN)
MASASPSL

SEQ ID NO: 107059 - protein, 9 aa, Artificial Sequence
  Description of Artificial Sequence: Synthetic peptide
  Seed: MASASPSVM (MAGC3_HUMAN)
MCSASPSVW

SEQ ID NO: 107060 - protein, 9 aa, Artificial Sequence
  Description of Artificial Sequence: Synthetic peptide
  Seed: IQRPAREVL (MAGC3_HUMAN)
ITRPAREVL

SEQ ID NO: 107061 - protein, 9 aa, Artificial Sequence
  Description of Artificial Sequence: Synthetic peptide
  Seed: REVLEFLSK (MAGC3_HUMAN)
RLVLEFLSR

SEQ ID NO: 107062 - protein, 9 aa, Artificial Sequence
  Description of Artificial Sequence: Synthetic peptide
  Seed: SPQGPPQSP (MAGC3_HUMAN)
SPQGPPQST

SEQ ID NO: 107063 - protein, 10 aa, Artificial Sequence
  Description of Artificial Sequence: Synthetic peptide
  Seed: AFPSWYMDAL (MAGC3_HUMAN)
AFPSWYMDAM

SEQ ID NO: 107064 - protein, 10 aa, Artificial Sequence
  Description of Artificial Sequence: Synthetic peptide
  Seed: MDPDNHSYFF (MAGC3_HUMAN)
MTPDNHSYFF

SEQ ID NO: 107065 - protein, 10 aa, Artificial Sequence
  Description of Artificial Sequence: Synthetic peptide
  Seed: TTDDATAMAS (MAGC3_HUMAN)
TVDDATAMAM

SEQ ID NO: 107066 - protein, 9 aa, Artificial Sequence
  Description of Artificial Sequence: Synthetic peptide
  Seed: RPAREVLEF (MAGC3_HUMAN)
RQAREVLEI

SEQ ID NO: 107067 - protein, 9 aa, Artificial Sequence
  Description of Artificial Sequence: Synthetic peptide
  Seed: KAHEFIELI (MAGC3_HUMAN)
KEHEFIELI

SEQ ID NO: 107068 - protein, 9 aa, Artificial Sequence
  Description of Artificial Sequence: Synthetic peptide
  Seed: SQPEGKFSL (MAGC3_HUMAN)
SSPEGKFSM

SEQ ID NO: 107069 - protein, 10 aa, Artificial Sequence
  Description of Artificial Sequence: Synthetic peptide
  Seed: EKVAELVQFL (MAGC3_HUMAN)
EKVAELVQFV

SEQ ID NO: 107070 - protein, 9 aa, Artificial Sequence
  Description of Artificial Sequence: Synthetic peptide
  Seed: FKLWRTLSG (MAGC3_HUMAN)
FVLWRTLSM

SEQ ID NO: 107071 - protein, 10 aa, Artificial Sequence
  Description of Artificial Sequence: Synthetic peptide
  Seed: KDYFPMIFGK (MAGC3_HUMAN)
KKYFPMIFGR

SEQ ID NO: 107072 - protein, 9 aa, Artificial Sequence
  Description of Artificial Sequence: Synthetic peptide
  Seed: WEVLNAIGP (MAGC3_HUMAN)
WEVLNAIGM

SEQ ID NO: 107073 - protein, 9 aa, Artificial Sequence
  Description of Artificial Sequence: Synthetic peptide
  Seed: SLPESEPLF (MAGC3_HUMAN)
SFPESEPLF

SEQ ID NO: 107074 - protein, 10 aa, Artificial Sequence
  Description of Artificial Sequence: Synthetic peptide
  Seed: VLSAIGPIQR (MAGC3_HUMAN)
VMSAIGPIQK

SEQ ID NO: 107075 - protein, 10 aa, Artificial Sequence
  Description of Artificial Sequence: Synthetic peptide
  Seed: MNVINTYTGY (MAGC3_HUMAN)
MGVINTYTGW

SEQ ID NO: 107076 - protein, 9 aa, Artificial Sequence
  Description of Artificial Sequence: Synthetic peptide
  Seed: VPEEVIWEV (MAGC3_HUMAN)
VPEEVIWEL

SEQ ID NO: 107077 - protein, 9 aa, Artificial Sequence
  Description of Artificial Sequence: Synthetic peptide
  Seed: ATDKDYSAF (MAGC3_HUMAN)
AIDKDYSAY

SEQ ID NO: 107078 - protein, 9 aa, Artificial Sequence
  Description of Artificial Sequence: Synthetic peptide
  Seed: MDPDNHSYF (MAGC3_HUMAN)
MIPDNHSYV

SEQ ID NO: 107079 - protein, 10 aa, Artificial Sequence
  Description of Artificial Sequence: Synthetic peptide
  Seed: ATDKDYSAFH (MAGC3_HUMAN)
AMDKDYSAFY

SEQ ID NO: 107080 - protein, 9 aa, Artificial Sequence
  Description of Artificial Sequence: Synthetic peptide
  Seed: YFPMIFRKA (MAGC3_HUMAN)
YFPMIFRKF

SEQ ID NO: 107081 - protein, 9 aa, Artificial Sequence
  Description of Artificial Sequence: Synthetic peptide
  Seed: EVLSAIGPI (MAGC3_HUMAN)
ETLSAIGPR

SEQ ID NO: 107082 - protein, 9 aa, Artificial Sequence
  Description of Artificial Sequence: Synthetic peptide
  Seed: QAKEPLTRA (MAGC3_HUMAN)
QPKEPLTRA

SEQ ID NO: 107083 - protein, 9 aa, Artificial Sequence
  Description of Artificial Sequence: Synthetic peptide
  Seed: ALDEKVAEL (MAGC3_HUMAN)
AFDEKVAEA

SEQ ID NO: 107084 - protein, 9 aa, Artificial Sequence
  Description of Artificial Sequence: Synthetic peptide
  Seed: KLVQFLLLK (MAGC3_HUMAN)
KVVQFLLLR

SEQ ID NO: 107085 - protein, 9 aa, Artificial Sequence
  Description of Artificial Sequence: Synthetic peptide
  Seed: MLTTVIKKY (MAGC3_HUMAN)
MLTTVIKKW

SEQ ID NO: 107086 - protein, 10 aa, Artificial Sequence
  Description of Artificial Sequence: Synthetic peptide
  Seed: MIFGKAHEFI (MAGC3_HUMAN)
MMFGKAHEFV

SEQ ID NO: 107087 - protein, 10 aa, Artificial Sequence
  Description of Artificial Sequence: Synthetic peptide
  Seed: VLPPQPQPRK (MAGC3_HUMAN)
VTPPQPQPRK

SEQ ID NO: 107088 - protein, 10 aa, Artificial Sequence
  Description of Artificial Sequence: Synthetic peptide
  Seed: REVRLFLRGG (MAGC3_HUMAN)
RGVRLFLRGI

SEQ ID NO: 107089 - protein, 11 aa, Artificial Sequence
  Description of Artificial Sequence: Synthetic peptide
  Seed: IIDTTDDATAM (MAGC3_HUMAN)
IFDTTDDATAV

SEQ ID NO: 107090 - protein, 9 aa, Artificial Sequence
  Description of Artificial Sequence: Synthetic peptide
  Seed: TEASPQQKK (MAGC3_HUMAN)
TAASPQQKY

SEQ ID NO: 107091 - protein, 9 aa, Artificial Sequence
  Description of Artificial Sequence: Synthetic peptide
  Seed: RTLWKDSDL (MAGC3_HUMAN)
RTLWKDSDM

SEQ ID NO: 107092 - protein, 10 aa, Artificial Sequence
  Description of Artificial Sequence: Synthetic peptide
  Seed: IELIFGIALT (MAGC3_HUMAN)
IYLIFGIALL

SEQ ID NO: 107093 - protein, 11 aa, Artificial Sequence
  Description of Artificial Sequence: Synthetic peptide
  Seed: ATAMASASPSV (MAGC3_HUMAN)
AMAMASASPSV

SEQ ID NO: 107094 - protein, 9 aa, Artificial Sequence
  Description of Artificial Sequence: Synthetic peptide
  Seed: GFADVLSRL (MAGC3_HUMAN)
GMADVLSRV

SEQ ID NO: 107095 - protein, 9 aa, Artificial Sequence
  Description of Artificial Sequence: Synthetic peptide
  Seed: DGSLGQWVK (MAGC3_HUMAN)
DSSLGQWVK

SEQ ID NO: 107096 - protein, 10 aa, Artificial Sequence
  Description of Artificial Sequence: Synthetic peptide
  Seed: LNAIGPWSAL (MAGC3_HUMAN)
LEAIGPWSAL

SEQ ID NO: 107097 - protein, 9 aa, Artificial Sequence
  Description of Artificial Sequence: Synthetic peptide
  Seed: TKAEMLTTV (MAGC3_HUMAN)
TRAEMLTTM

SEQ ID NO: 107098 - protein, 11 aa, Artificial Sequence
  Description of Artificial Sequence: Synthetic peptide
  Seed: TTDDATAMASA (MAGC3_HUMAN)
TGDDATAMASM

SEQ ID NO: 107099 - protein, 10 aa, Artificial Sequence
  Description of Artificial Sequence: Synthetic peptide
  Seed: AEMQMNVINT (MAGC3_HUMAN)
AEMQMNVINF

SEQ ID NO: 107100 - protein, 11 aa, Artificial Sequence
  Description of Artificial Sequence: Synthetic peptide
  Seed: NTYTGYFPMIF (MAGC3_HUMAN)
NTYTGYFPMIW

SEQ ID NO: 107101 - protein, 9 aa, Artificial Sequence
  Description of Artificial Sequence: Synthetic peptide
  Seed: ATDKDYSAF (MAGC3_HUMAN)
ASDKDYSAL

SEQ ID NO: 107102 - protein, 9 aa, Artificial Sequence
  Description of Artificial Sequence: Synthetic peptide
  Seed: SEEEDTATW (MAGC3_HUMAN)
SVEEDTATY

SEQ ID NO: 107103 - protein, 11 aa, Artificial Sequence
  Description of Artificial Sequence: Synthetic peptide
  Seed: KKYKDYFPMIF (MAGC3_HUMAN)
KYYKDYFPMIW

SEQ ID NO: 107104 - protein, 9 aa, Artificial Sequence
  Description of Artificial Sequence: Synthetic peptide
  Seed: KEPVTKAEM (MAGC3_HUMAN)
KMPVTKAEF

SEQ ID NO: 107105 - protein, 10 aa, Artificial Sequence
  Description of Artificial Sequence: Synthetic peptide
  Seed: SKLSSIIPSA (MAGC3_HUMAN)
SNLSSIIPSI

SEQ ID NO: 107106 - protein, 9 aa, Artificial Sequence
  Description of Artificial Sequence: Synthetic peptide
  Seed: ELIFGIALT (MAGC3_HUMAN)
ESIFGIALA

SEQ ID NO: 107107 - protein, 9 aa, Artificial Sequence
  Description of Artificial Sequence: Synthetic peptide
  Seed: YQAKEPLTR (MAGC3_HUMAN)
YAAKEPLTH

SEQ ID NO: 107108 - protein, 10 aa, Artificial Sequence
  Description of Artificial Sequence: Synthetic peptide
  Seed: MQMNVINTYT (MAGC3_HUMAN)
MPMNVINTYA

SEQ ID NO: 107109 - protein, 10 aa, Artificial Sequence
  Description of Artificial Sequence: Synthetic peptide
  Seed: SPLDSCSSPL (MAGC3_HUMAN)
SSLDSCSSPV

SEQ ID NO: 107110 - protein, 9 aa, Artificial Sequence
  Description of Artificial Sequence: Synthetic peptide
  Seed: MLLPCHWVL (MAGC3_HUMAN)
MPLPCHWVM

SEQ ID NO: 107111 - protein, 9 aa, Artificial Sequence
  Description of Artificial Sequence: Synthetic peptide
  Seed: REVLEFLSK (MAGC3_HUMAN)
REVLEFLSC

SEQ ID NO: 107112 - protein, 10 aa, Artificial Sequence
  Description of Artificial Sequence: Synthetic peptide
  Seed: INTYTGYFPM (MAGC3_HUMAN)
IMTYTGYFPY

SEQ ID NO: 107113 - protein, 9 aa, Artificial Sequence
  Description of Artificial Sequence: Synthetic peptide
  Seed: GSLPESEPL (MAGC3_HUMAN)
GLLPESEPV

SEQ ID NO: 107114 - protein, 10 aa, Artificial Sequence
  Description of Artificial Sequence: Synthetic peptide
  Seed: MQMNVINTYT (MAGC3_HUMAN)
MHMNVINTYI

SEQ ID NO: 107115 - protein, 9 aa, Artificial Sequence
  Description of Artificial Sequence: Synthetic peptide
  Seed: TEVDPDHFY (MAGC3_HUMAN)
TTVDPDHFY

SEQ ID NO: 107116 - protein, 10 aa, Artificial Sequence
  Description of Artificial Sequence: Synthetic peptide
  Seed: SAFHLGHLRE (MAGC3_HUMAN)
STFHLGHLRW

SEQ ID NO: 107117 - protein, 9 aa, Artificial Sequence
  Description of Artificial Sequence: Synthetic peptide
  Seed: LSGSPGLQL (MAGC3_HUMAN)
LTGSPGLQY

SEQ ID NO: 107118 - protein, 8 aa, Artificial Sequence
  Description of Artificial Sequence: Synthetic peptide
  Seed: TTDDATAM (MAGC3_HUMAN)
TQDDATAL

SEQ ID NO: 107119 - protein, 9 aa, Artificial Sequence
  Description of Artificial Sequence: Synthetic peptide
  Seed: RTLSGSPGL (MAGC3_HUMAN)
RLLSGSPGM

SEQ ID NO: 107120 - protein, 10 aa, Artificial Sequence
  Description of Artificial Sequence: Synthetic peptide
  Seed: MDPDNHSYFF (MAGC3_HUMAN)
MEPDNHSYFF

SEQ ID NO: 107121 - protein, 9 aa, Artificial Sequence
  Description of Artificial Sequence: Synthetic peptide
  Seed: NTYTGYFPM (MAGC3_HUMAN)
NNYTGYFPV

SEQ ID NO: 107122 - protein, 9 aa, Artificial Sequence
  Description of Artificial Sequence: Synthetic peptide
  Seed: NTYTGYFPM (MAGC3_HUMAN)
NSYTGYFPW

SEQ ID NO: 107123 - protein, 10 aa, Artificial Sequence
  Description of Artificial Sequence: Synthetic peptide
  Seed: SLPAVSPGKR (MAGC3_HUMAN)
SSPAVSPGKK

SEQ ID NO: 107124 - protein, 9 aa, Artificial Sequence
  Description of Artificial Sequence: Synthetic peptide
  Seed: ALAGFADVL (MAGC3_HUMAN)
AMAGFADVA

SEQ ID NO: 107125 - protein, 11 aa, Artificial Sequence
  Description of Artificial Sequence: Synthetic peptide
  Seed: RGLTEASPQQK (MAGC3_HUMAN)
RMLTEASPQQK

SEQ ID NO: 107126 - protein, 9 aa, Artificial Sequence
  Description of Artificial Sequence: Synthetic peptide
  Seed: KAEMLTTVI (MAGC3_HUMAN)
KSEMLTTVF

SEQ ID NO: 107127 - protein, 9 aa, Artificial Sequence
  Description of Artificial Sequence: Synthetic peptide
  Seed: MPKNCLLIL (MAGC3_HUMAN)
MMKNCLLIF

SEQ ID NO: 107128 - protein, 9 aa, Artificial Sequence
  Description of Artificial Sequence: Synthetic peptide
  Seed: YFFEDTLDL (MAGC3_HUMAN)
YSFEDTLDF

SEQ ID NO: 107129 - protein, 9 aa, Artificial Sequence
  Description of Artificial Sequence: Synthetic peptide
  Seed: RPAREVLEF (MAGC3_HUMAN)
RSAREVLEW

SEQ ID NO: 107130 - protein, 9 aa, Artificial Sequence
  Description of Artificial Sequence: Synthetic peptide
  Seed: SLPESEPLF (MAGC3_HUMAN)
SWPESEPLW

SEQ ID NO: 107131 - protein, 9 aa, Artificial Sequence
  Description of Artificial Sequence: Synthetic peptide
  Seed: ELIFGIALT (MAGC3_HUMAN)
ESIFGIALI

SEQ ID NO: 107132 - protein, 9 aa, Artificial Sequence
  Description of Artificial Sequence: Synthetic peptide
  Seed: ATYALSPVV (MAGC3_HUMAN)
AVYALSPVI

SEQ ID NO: 107133 - protein, 9 aa, Artificial Sequence
  Description of Artificial Sequence: Synthetic peptide
  Seed: RTLSGSPGL (MAGC3_HUMAN)
RWLSGSPGY

SEQ ID NO: 107134 - protein, 10 aa, Artificial Sequence
  Description of Artificial Sequence: Synthetic peptide
  Seed: YSAFHLGHLR (MAGC3_HUMAN)
YAAFHLGHLR

SEQ ID NO: 107135 - protein, 9 aa, Artificial Sequence
  Description of Artificial Sequence: Synthetic peptide
  Seed: QRMDSLVLC (MAGC3_HUMAN)
QRMDSLVLY

SEQ ID NO: 107136 - protein, 9 aa, Artificial Sequence
  Description of Artificial Sequence: Synthetic peptide
  Seed: FGSQPEGKF (MAGC3_HUMAN)
FPSQPEGKM

SEQ ID NO: 107137 - protein, 9 aa, Artificial Sequence
  Description of Artificial Sequence: Synthetic peptide
  Seed: VIWEVLSAI (MAGC3_HUMAN)
VTWEVLSAK

SEQ ID NO: 107138 - protein, 9 aa, Artificial Sequence
  Description of Artificial Sequence: Synthetic peptide
  Seed: SLPESEPLF (MAGC3_HUMAN)
SMPESEPLM

SEQ ID NO: 107139 - protein, 10 aa, Artificial Sequence
  Description of Artificial Sequence: Synthetic peptide
  Seed: KDMEDRAQAI (MAGC3_HUMAN)
KEMEDRAQAL

SEQ ID NO: 107140 - protein, 9 aa, Artificial Sequence
  Description of Artificial Sequence: Synthetic peptide
  Seed: EKVDKLVQF (MAGC3_HUMAN)
EEVDKLVQV

SEQ ID NO: 107141 - protein, 10 aa, Artificial Sequence
  Description of Artificial Sequence: Synthetic peptide
  Seed: TAMASASPSV (MAGC3_HUMAN)
TSMASASPSV

SEQ ID NO: 107142 - protein, 9 aa, Artificial Sequence
  Description of Artificial Sequence: Synthetic peptide
  Seed: FSLRRAVSV (MAGC3_HUMAN)
FSLRRAVSY

SEQ ID NO: 107143 - protein, 11 aa, Artificial Sequence
  Description of Artificial Sequence: Synthetic peptide
  Seed: KKYKDYFPMIF (MAGC3_HUMAN)
KYYKDYFPMII

SEQ ID NO: 107144 - protein, 10 aa, Artificial Sequence
  Description of Artificial Sequence: Synthetic peptide
  Seed: KVAELVQFLL (MAGC3_HUMAN)
KVAELVQFLR

SEQ ID NO: 107145 - protein, 9 aa, Artificial Sequence
  Description of Artificial Sequence: Synthetic peptide
  Seed: FSLRRAVSV (MAGC3_HUMAN)
FQLRRAVSM

SEQ ID NO: 107146 - protein, 10 aa, Artificial Sequence
  Description of Artificial Sequence: Synthetic peptide
  Seed: YTGYFPMIFR (MAGC3_HUMAN)
YFGYFPMIFK

SEQ ID NO: 107147 - protein, 10 aa, Artificial Sequence
  Description of Artificial Sequence: Synthetic peptide
  Seed: IPSAFPSWYM (MAGC3_HUMAN)
ILSAFPSWYW

SEQ ID NO: 107148 - protein, 9 aa, Artificial Sequence
  Description of Artificial Sequence: Synthetic peptide
  Seed: SAIGPIQRP (MAGC3_HUMAN)
SVIGPIQRM

SEQ ID NO: 107149 - protein, 9 aa, Artificial Sequence
  Description of Artificial Sequence: Synthetic peptide
  Seed: YFFEDTLDL (MAGC3_HUMAN)
YIFEDTLDI

SEQ ID NO: 107150 - protein, 9 aa, Artificial Sequence
  Description of Artificial Sequence: Synthetic peptide
  Seed: TTDDATAMA (MAGC3_HUMAN)
TTDDATAMV

SEQ ID NO: 107151 - protein, 10 aa, Artificial Sequence
  Description of Artificial Sequence: Synthetic peptide
  Seed: EFLSKLSSII (MAGC3_HUMAN)
EFLSKLSSIL

SEQ ID NO: 107152 - protein, 9 aa, Artificial Sequence
  Description of Artificial Sequence: Synthetic peptide
  Seed: MQMNVINTY (MAGC3_HUMAN)
MPMNVINTW

SEQ ID NO: 107153 - protein, 9 aa, Artificial Sequence
  Description of Artificial Sequence: Synthetic peptide
  Seed: MIFGKAHEF (MAGC3_HUMAN)
MNFGKAHEF

SEQ ID NO: 107154 - protein, 9 aa, Artificial Sequence
  Description of Artificial Sequence: Synthetic peptide
  Seed: LSSIIPSAF (MAGC3_HUMAN)
LMSIIPSAF

SEQ ID NO: 107155 - protein, 9 aa, Artificial Sequence
  Description of Artificial Sequence: Synthetic peptide
  Seed: SQPEGKFSL (MAGC3_HUMAN)
SFPEGKFSF

SEQ ID NO: 107156 - protein, 9 aa, Artificial Sequence
  Description of Artificial Sequence: Synthetic peptide
  Seed: VIWEVLSAI (MAGC3_HUMAN)
VVWEVLSAW

SEQ ID NO: 107157 - protein, 11 aa, Artificial Sequence
  Description of Artificial Sequence: Synthetic peptide
  Seed: ATFSDGSLGQW (MAGC3_HUMAN)
AVFSDGSLGQY

SEQ ID NO: 107158 - protein, 10 aa, Artificial Sequence
  Description of Artificial Sequence: Synthetic peptide
  Seed: FFEDTLDLTY (MAGC3_HUMAN)
FAEDTLDLTY

SEQ ID NO: 107159 - protein, 9 aa, Artificial Sequence
  Description of Artificial Sequence: Synthetic peptide
  Seed: FVNTLDLTC (MAGC3_HUMAN)
FANTLDLTL

SEQ ID NO: 107160 - protein, 9 aa, Artificial Sequence
  Description of Artificial Sequence: Synthetic peptide
  Seed: KVAELVQFL (MAGC3_HUMAN)
KIAELVQFT

SEQ ID NO: 107161 - protein, 9 aa, Artificial Sequence
  Description of Artificial Sequence: Synthetic peptide
  Seed: NTYTGYFPM (MAGC3_HUMAN)
NIYTGYFPW

SEQ ID NO: 107162 - protein, 9 aa, Artificial Sequence
  Description of Artificial Sequence: Synthetic peptide
  Seed: EVDPDHFYV (MAGC3_HUMAN)
ELDPDHFYL

SEQ ID NO: 107163 - protein, 9 aa, Artificial Sequence
  Description of Artificial Sequence: Synthetic peptide
  Seed: MIFRKAREF (MAGC3_HUMAN)
MGFRKAREY

SEQ ID NO: 107164 - protein, 10 aa, Artificial Sequence
  Description of Artificial Sequence: Synthetic peptide
  Seed: KVAELVQFLL (MAGC3_HUMAN)
KAAELVQFLF

SEQ ID NO: 107165 - protein, 9 aa, Artificial Sequence
  Description of Artificial Sequence: Synthetic peptide
  Seed: KAHEFIELI (MAGC3_HUMAN)
KPHEFIELI

SEQ ID NO: 107166 - protein, 9 aa, Artificial Sequence
  Description of Artificial Sequence: Synthetic peptide
  Seed: HFYVFVNTL (MAGC3_HUMAN)
HGYVFVNTV

SEQ ID NO: 107167 - protein, 10 aa, Artificial Sequence
  Description of Artificial Sequence: Synthetic peptide
  Seed: TEVDPDHFYV (MAGC3_HUMAN)
TEVDPDHFYM

SEQ ID NO: 107168 - protein, 10 aa, Artificial Sequence
  Description of Artificial Sequence: Synthetic peptide
  Seed: EVLSAIGPIQ (MAGC3_HUMAN)
EVLSAIGPIR

SEQ ID NO: 107169 - protein, 9 aa, Artificial Sequence
  Description of Artificial Sequence: Synthetic peptide
  Seed: FGSQPEGKF (MAGC3_HUMAN)
FTSQPEGKW

SEQ ID NO: 107170 - protein, 9 aa, Artificial Sequence
  Description of Artificial Sequence: Synthetic peptide
  Seed: SQPEGKFSL (MAGC3_HUMAN)
SCPEGKFSM

SEQ ID NO: 107171 - protein, 9 aa, Artificial Sequence
  Description of Artificial Sequence: Synthetic peptide
  Seed: SLPAVSPGK (MAGC3_HUMAN)
SIPAVSPGR

SEQ ID NO: 107172 - protein, 9 aa, Artificial Sequence
  Description of Artificial Sequence: Synthetic peptide
  Seed: QDWPLNEKR (MAGC3_HUMAN)
QAWPLNEKR

SEQ ID NO: 107173 - protein, 10 aa, Artificial Sequence
  Description of Artificial Sequence: Synthetic peptide
  Seed: MIFRKAREFI (MAGC3_HUMAN)
MTFRKAREFK

SEQ ID NO: 107174 - protein, 9 aa, Artificial Sequence
  Description of Artificial Sequence: Synthetic peptide
  Seed: HFYVFVNTL (MAGC3_HUMAN)
HVYVFVNTL

SEQ ID NO: 107175 - protein, 9 aa, Artificial Sequence
  Description of Artificial Sequence: Synthetic peptide
  Seed: FEDTLDLTY (MAGC3_HUMAN)
FQDTLDLTY

SEQ ID NO: 107176 - protein, 9 aa, Artificial Sequence
  Description of Artificial Sequence: Synthetic peptide
  Seed: SIIPSAFPS (MAGC3_HUMAN)
STIPSAFPL

SEQ ID NO: 107177 - protein, 11 aa, Artificial Sequence
  Description of Artificial Sequence: Synthetic peptide
  Seed: LSKLSSIIPSA (MAGC3_HUMAN)
LPKLSSIIPSV

SEQ ID NO: 107178 - protein, 11 aa, Artificial Sequence
  Description of Artificial Sequence: Synthetic peptide
  Seed: TSDQRMDSLVL (MAGC3_HUMAN)
TNDQRMDSLVF

SEQ ID NO: 107179 - protein, 10 aa, Artificial Sequence
  Description of Artificial Sequence: Synthetic peptide
  Seed: VLSAIGPIQR (MAGC3_HUMAN)
VMSAIGPIQR

SEQ ID NO: 107180 - protein, 10 aa, Artificial Sequence
  Description of Artificial Sequence: Synthetic peptide
  Seed: KDMEDRAQAI (MAGC3_HUMAN)
KEMEDRAQAV

SEQ ID NO: 107181 - protein, 9 aa, Artificial Sequence
  Description of Artificial Sequence: Synthetic peptide
  Seed: RTLSGSPGL (MAGC3_HUMAN)
RALSGSPGM

SEQ ID NO: 107182 - protein, 9 aa, Artificial Sequence
  Description of Artificial Sequence: Synthetic peptide
  Seed: ALDEKVAEL (MAGC3_HUMAN)
AHDEKVAEF

SEQ ID NO: 107183 - protein, 10 aa, Artificial Sequence
  Description of Artificial Sequence: Synthetic peptide
  Seed: TLSGSPGLQL (MAGC3_HUMAN)
TLSGSPGLQV

SEQ ID NO: 107184 - protein, 9 aa, Artificial Sequence
  Description of Artificial Sequence: Synthetic peptide
  Seed: FADVLSRLA (MAGC3_HUMAN)
FTDVLSRLF

SEQ ID NO: 107185 - protein, 9 aa, Artificial Sequence
  Description of Artificial Sequence: Synthetic peptide
  Seed: KAHEFIELI (MAGC3_HUMAN)
KMHEFIELW

SEQ ID NO: 107186 - protein, 9 aa, Artificial Sequence
  Description of Artificial Sequence: Synthetic peptide
  Seed: FSDGSLGQW (MAGC3_HUMAN)
FTDGSLGQY

SEQ ID NO: 107187 - protein, 9 aa, Artificial Sequence
  Description of Artificial Sequence: Synthetic peptide
  Seed: MIFGKAHEF (MAGC3_HUMAN)
MRFGKAHEF

SEQ ID NO: 107188 - protein, 9 aa, Artificial Sequence
  Description of Artificial Sequence: Synthetic peptide
  Seed: EVLNAIGPW (MAGC3_HUMAN)
ESLNAIGPF

SEQ ID NO: 107189 - protein, 10 aa, Artificial Sequence
  Description of Artificial Sequence: Synthetic peptide
  Seed: TTDDATAMAS (MAGC3_HUMAN)
TMDDATAMAM

SEQ ID NO: 107190 - protein, 9 aa, Artificial Sequence
  Description of Artificial Sequence: Synthetic peptide
  Seed: ATYALSPVV (MAGC3_HUMAN)
ALYALSPVA

SEQ ID NO: 107191 - protein, 9 aa, Artificial Sequence
  Description of Artificial Sequence: Synthetic peptide
  Seed: NVINTYTGY (MAGC3_HUMAN)
NAINTYTGY

SEQ ID NO: 107192 - protein, 9 aa, Artificial Sequence
  Description of Artificial Sequence: Synthetic peptide
  Seed: YQAKEPLTR (MAGC3_HUMAN)
YMAKEPLTF

SEQ ID NO: 107193 - protein, 9 aa, Artificial Sequence
  Description of Artificial Sequence: Synthetic peptide
  Seed: YKDYFPMIF (MAGC3_HUMAN)
YYDYFPMIY

SEQ ID NO: 107194 - protein, 9 aa, Artificial Sequence
  Description of Artificial Sequence: Synthetic peptide
  Seed: KAHEFIELI (MAGC3_HUMAN)
KWHEFIELY

SEQ ID NO: 107195 - protein, 9 aa, Artificial Sequence
  Description of Artificial Sequence: Synthetic peptide
  Seed: EVDPDHFYV (MAGC3_HUMAN)
ELDPDHFYM

SEQ ID NO: 107196 - protein, 10 aa, Artificial Sequence
  Description of Artificial Sequence: Synthetic peptide
  Seed: ILFGISLTEV (MAGC3_HUMAN)
IVFGISLTER

SEQ ID NO: 107197 - protein, 9 aa, Artificial Sequence
  Description of Artificial Sequence: Synthetic peptide
  Seed: MEDRAQAII (MAGC3_HUMAN)
MEDRAQAIF

SEQ ID NO: 107198 - protein, 9 aa, Artificial Sequence
  Description of Artificial Sequence: Synthetic peptide
  Seed: QAKEPLTRA (MAGC3_HUMAN)
QVKEPLTRY

SEQ ID NO: 107199 - protein, 9 aa, Artificial Sequence
  Description of Artificial Sequence: Synthetic peptide
  Seed: ALAGFADVL (MAGC3_HUMAN)
AAAGFADVL

SEQ ID NO: 107200 - protein, 9 aa, Artificial Sequence
  Description of Artificial Sequence: Synthetic peptide
  Seed: KKYKDYFPM (MAGC3_HUMAN)
KMYKDYFPA

SEQ ID NO: 107201 - protein, 9 aa, Artificial Sequence
  Description of Artificial Sequence: Synthetic peptide
  Seed: YKDYFPMIF (MAGC3_HUMAN)
YADYFPMIY

SEQ ID NO: 107202 - protein, 9 aa, Artificial Sequence
  Description of Artificial Sequence: Synthetic peptide
  Seed: LSAIGPIQR (MAGC3_HUMAN)
LAAIGPIQI

SEQ ID NO: 107203 - protein, 9 aa, Artificial Sequence
  Description of Artificial Sequence: Synthetic peptide
  Seed: QTKEPVTKA (MAGC3_HUMAN)
QTKEPVTKK

SEQ ID NO: 107204 - protein, 9 aa, Artificial Sequence
  Description of Artificial Sequence: Synthetic peptide
  Seed: MQMNVINTY (MAGC3_HUMAN)
MIMNVINTK

SEQ ID NO: 107205 - protein, 9 aa, Artificial Sequence
  Description of Artificial Sequence: Synthetic peptide
  Seed: FPSWYMDAL (MAGC3_HUMAN)
FPSWYMDAT

SEQ ID NO: 107206 - protein, 9 aa, Artificial Sequence
  Description of Artificial Sequence: Synthetic peptide
  Seed: HFYVFVNTL (MAGC3_HUMAN)
HNYVFVNTY

SEQ ID NO: 107207 - protein, 10 aa, Artificial Sequence
  Description of Artificial Sequence: Synthetic peptide
  Seed: LVLCPTYFKL (MAGC3_HUMAN)
LILCPTYFKL

SEQ ID NO: 107208 - protein, 9 aa, Artificial Sequence
  Description of Artificial Sequence: Synthetic peptide
  Seed: YQAKEPLTR (MAGC3_HUMAN)
YLAKEPLTR

SEQ ID NO: 107209 - protein, 9 aa, Artificial Sequence
  Description of Artificial Sequence: Synthetic peptide
  Seed: ILILSMIFI (MAGC3_HUMAN)
ILILSMIFL

SEQ ID NO: 107210 - protein, 9 aa, Artificial Sequence
  Description of Artificial Sequence: Synthetic peptide
  Seed: SAIGPIQRP (MAGC3_HUMAN)
SIIGPIQRY

SEQ ID NO: 107211 - protein, 11 aa, Artificial Sequence
  Description of Artificial Sequence: Synthetic peptide
  Seed: IIDTTDDATAM (MAGC3_HUMAN)
IMDTTDDATAL

SEQ ID NO: 107212 - protein, 9 aa, Artificial Sequence
  Description of Artificial Sequence: Synthetic peptide
  Seed: KGSCVPEEV (MAGC3_HUMAN)
KASCVPEEI

SEQ ID NO: 107213 - protein, 9 aa, Artificial Sequence
  Description of Artificial Sequence: Synthetic peptide
  Seed: YTGYFPMIF (MAGC3_HUMAN)
YEGYFPMIY

SEQ ID NO: 107214 - protein, 10 aa, Artificial Sequence
  Description of Artificial Sequence: Synthetic peptide
  Seed: LNAIGPWSAL (MAGC3_HUMAN)
LYAIGPWSAY

SEQ ID NO: 107215 - protein, 9 aa, Artificial Sequence
  Description of Artificial Sequence: Synthetic peptide
  Seed: LIDDQGMPK (MAGC3_HUMAN)
LFDDQGMPF

SEQ ID NO: 107216 - protein, 9 aa, Artificial Sequence
  Description of Artificial Sequence: Synthetic peptide
  Seed: LSAIGPIQR (MAGC3_HUMAN)
LTAIGPIQL

SEQ ID NO: 107217 - protein, 10 aa, Artificial Sequence
  Description of Artificial Sequence: Synthetic peptide
  Seed: MDSLVLCPTY (MAGC3_HUMAN)
MKSLVLCPTF

SEQ ID NO: 107218 - protein, 11 aa, Artificial Sequence
  Description of Artificial Sequence: Synthetic peptide
  Seed: FIKGNCASEEV (MAGC3_HUMAN)
FMKGNCASEEV

SEQ ID NO: 107219 - protein, 10 aa, Artificial Sequence
  Description of Artificial Sequence: Synthetic peptide
  Seed: NTYTGYFPMI (MAGC3_HUMAN)
NEYTGYFPMF

SEQ ID NO: 107220 - protein, 9 aa, Artificial Sequence
  Description of Artificial Sequence: Synthetic peptide
  Seed: NAIGPWSAL (MAGC3_HUMAN)
NWIGPWSAF

SEQ ID NO: 107221 - protein, 11 aa, Artificial Sequence
  Description of Artificial Sequence: Synthetic peptide
  Seed: ILFGISLTEVD (MAGC3_HUMAN)
ILFGISLTEVF

SEQ ID NO: 107222 - protein, 9 aa, Artificial Sequence
  Description of Artificial Sequence: Synthetic peptide
  Seed: NVINTYTGY (MAGC3_HUMAN)
NMINTYTGM

SEQ ID NO: 107223 - protein, 10 aa, Artificial Sequence
  Description of Artificial Sequence: Synthetic peptide
  Seed: YALSPVVLPP (MAGC3_HUMAN)
YLLSPVVLPV

SEQ ID NO: 107224 - protein, 10 aa, Artificial Sequence
  Description of Artificial Sequence: Synthetic peptide
  Seed: YTLDEKVDKL (MAGC3_HUMAN)
YMLDEKVDKW

SEQ ID NO: 107225 - protein, 9 aa, Artificial Sequence
  Description of Artificial Sequence: Synthetic peptide
  Seed: VDPDHFYVF (MAGC3_HUMAN)
VSPDHFYVY

SEQ ID NO: 107226 - protein, 11 aa, Artificial Sequence
  Description of Artificial Sequence: Synthetic peptide
  Seed: SSSEEEDTATW (MAGC3_HUMAN)
SQSEEEDTATI

SEQ ID NO: 107227 - protein, 9 aa, Artificial Sequence
  Description of Artificial Sequence: Synthetic peptide
  Seed: FPSWYMDAL (MAGC3_HUMAN)
FASWYMDAI

SEQ ID NO: 107228 - protein, 9 aa, Artificial Sequence
  Description of Artificial Sequence: Synthetic peptide
  Seed: FHLGHLREV (MAGC3_HUMAN)
FALGHLREY

SEQ ID NO: 107229 - protein, 10 aa, Artificial Sequence
  Description of Artificial Sequence: Synthetic peptide
  Seed: YALDEKVAEL (MAGC3_HUMAN)
YDLDEKVAEM

SEQ ID NO: 107230 - protein, 11 aa, Artificial Sequence
  Description of Artificial Sequence: Synthetic peptide
  Seed: TDMDPDNHSYF (MAGC3_HUMAN)
TLMDPDNHSYY

SEQ ID NO: 107231 - protein, 9 aa, Artificial Sequence
  Description of Artificial Sequence: Synthetic peptide
  Seed: FEDTLDLTY (MAGC3_HUMAN)
FIDTLDLTY

SEQ ID NO: 107232 - protein, 9 aa, Artificial Sequence
  Description of Artificial Sequence: Synthetic peptide
  Seed: YTGYFPMIF (MAGC3_HUMAN)
YLGYFPMIY

SEQ ID NO: 107233 - protein, 9 aa, Artificial Sequence
  Description of Artificial Sequence: Synthetic peptide
  Seed: KYKDYFPMI (MAGC3_HUMAN)
KMKDYFPMV

SEQ ID NO: 107234 - protein, 10 aa, Artificial Sequence
  Description of Artificial Sequence: Synthetic peptide
  Seed: IPSAFPSWYM (MAGC3_HUMAN)
IVSAFPSWYW

SEQ ID NO: 107235 - protein, 11 aa, Artificial Sequence
  Description of Artificial Sequence: Synthetic peptide
  Seed: FLSKLSSIIPS (MAGC3_HUMAN)
FLSKLSSIIPM

SEQ ID NO: 107236 - protein, 10 aa, Artificial Sequence
  Description of Artificial Sequence: Synthetic peptide
  Seed: LNAIGPWSAL (MAGC3_HUMAN)
LTAIGPWSAF

SEQ ID NO: 107237 - protein, 9 aa, Artificial Sequence
  Description of Artificial Sequence: Synthetic peptide
  Seed: SLVLCPTYF (MAGC3_HUMAN)
STVLCPTYY

SEQ ID NO: 107238 - protein, 10 aa, Artificial Sequence
  Description of Artificial Sequence: Synthetic peptide
  Seed: LLKYQAKEPL (MAGC3_HUMAN)
LHKYQAKEPY

SEQ ID NO: 107239 - protein, 9 aa, Artificial Sequence
  Description of Artificial Sequence: Synthetic peptide
  Seed: HALPESESL (MAGC3_HUMAN)
HRLPESESL

SEQ ID NO: 107240 - protein, 9 aa, Artificial Sequence
  Description of Artificial Sequence: Synthetic peptide
  Seed: DMDPDNHSY (MAGC3_HUMAN)
DTDPDNHSF

SEQ ID NO: 107241 - protein, 9 aa, Artificial Sequence
  Description of Artificial Sequence: Synthetic peptide
  Seed: ALAGFADVL (MAGC3_HUMAN)
AQAGFADVI

SEQ ID NO: 107242 - protein, 10 aa, Artificial Sequence
  Description of Artificial Sequence: Synthetic peptide
  Seed: KAHEFIELIF (MAGC3_HUMAN)
KAHEFIELIW

SEQ ID NO: 107243 - protein, 10 aa, Artificial Sequence
  Description of Artificial Sequence: Synthetic peptide
  Seed: LDSCSSPLLW (MAGC3_HUMAN)
LLSCSSPLLF

SEQ ID NO: 107244 - protein, 9 aa, Artificial Sequence
  Description of Artificial Sequence: Synthetic peptide
  Seed: NAIGPWSAL (MAGC3_HUMAN)
NRIGPWSAY

SEQ ID NO: 107245 - protein, 9 aa, Artificial Sequence
  Description of Artificial Sequence: Synthetic peptide
  Seed: VLPPQPQPR (MAGC3_HUMAN)
VSPPQPQPY

SEQ ID NO: 107246 - protein, 10 aa, Artificial Sequence
  Description of Artificial Sequence: Synthetic peptide
  Seed: KDYFPMIFGK (MAGC3_HUMAN)
KCYFPMIFGK

SEQ ID NO: 107247 - protein, 9 aa, Artificial Sequence
  Description of Artificial Sequence: Synthetic peptide
  Seed: ATYALSPVV (MAGC3_HUMAN)
AAYALSPVL

SEQ ID NO: 107248 - protein, 9 aa, Artificial Sequence
  Description of Artificial Sequence: Synthetic peptide
  Seed: IPSAFPSWY (MAGC3_HUMAN)
IYSAFPSWY

SEQ ID NO: 107249 - protein, 10 aa, Artificial Sequence
  Description of Artificial Sequence: Synthetic peptide
  Seed: SALAGFADVL (MAGC3_HUMAN)
SLLAGFADVV

SEQ ID NO: 107250 - protein, 9 aa, Artificial Sequence
  Description of Artificial Sequence: Synthetic peptide
  Seed: AIGPWSALA (MAGC3_HUMAN)
AMGPWSALV

SEQ ID NO: 107251 - protein, 10 aa, Artificial Sequence
  Description of Artificial Sequence: Synthetic peptide
  Seed: LNAIGPWSAL (MAGC3_HUMAN)
LDAIGPWSAL

SEQ ID NO: 107252 - protein, 9 aa, Artificial Sequence
  Description of Artificial Sequence: Synthetic peptide
  Seed: RTLSGSPGL (MAGC3_HUMAN)
RLLSGSPGW

SEQ ID NO: 107253 - protein, 9 aa, Artificial Sequence
  Description of Artificial Sequence: Synthetic peptide
  Seed: DEQGMPQNR (MAGC3_HUMAN)
DVQGMPQNK

SEQ ID NO: 107254 - protein, 9 aa, Artificial Sequence
  Description of Artificial Sequence: Synthetic peptide
  Seed: ATYALSPVV (MAGC3_HUMAN)
AQYALSPVY

SEQ ID NO: 107255 - protein, 9 aa, Artificial Sequence
  Description of Artificial Sequence: Synthetic peptide
  Seed: LSDEQGMPQ (MAGC3_HUMAN)
LQDEQGMPF

SEQ ID NO: 107256 - protein, 9 aa, Artificial Sequence
  Description of Artificial Sequence: Synthetic peptide
  Seed: ATDKDYSAF (MAGC3_HUMAN)
AIDKDYSAV

SEQ ID NO: 107257 - protein, 10 aa, Artificial Sequence
  Description of Artificial Sequence: Synthetic peptide
  Seed: MNVINTYTGY (MAGC3_HUMAN)
MVVINTYTGY

SEQ ID NO: 107258 - protein, 10 aa, Artificial Sequence
  Description of Artificial Sequence: Synthetic peptide
  Seed: SLVLCPTYFK (MAGC3_HUMAN)
STVLCPTYFK

SEQ ID NO: 107259 - protein, 8 aa, Artificial Sequence
  Description of Artificial Sequence: Synthetic peptide
  Seed: TTDDATAM (MAGC3_HUMAN)
TWDDATAF

SEQ ID NO: 107260 - protein, 9 aa, Artificial Sequence
  Description of Artificial Sequence: Synthetic peptide
  Seed: KVDKLVQFL (MAGC3_HUMAN)
KGDKLVQFW

SEQ ID NO: 107261 - protein, 10 aa, Artificial Sequence
  Description of Artificial Sequence: Synthetic peptide
  Seed: SDQRMDSLVL (MAGC3_HUMAN)
SSQRMDSLVF

SEQ ID NO: 107262 - protein, 10 aa, Artificial Sequence
  Description of Artificial Sequence: Synthetic peptide
  Seed: KVAELVQFLL (MAGC3_HUMAN)
KTAELVQFLY

SEQ ID NO: 107263 - protein, 11 aa, Artificial Sequence
  Description of Artificial Sequence: Synthetic peptide
  Seed: SIIPSAFPSWY (MAGC3_HUMAN)
SFIPSAFPSWY

SEQ ID NO: 107264 - protein, 10 aa, Artificial Sequence
  Description of Artificial Sequence: Synthetic peptide
  Seed: IPSAFPSWYM (MAGC3_HUMAN)
ITSAFPSWYF

SEQ ID NO: 107265 - protein, 9 aa, Artificial Sequence
  Description of Artificial Sequence: Synthetic peptide
  Seed: HSYFFEDTL (MAGC3_HUMAN)
HQYFFEDTV

SEQ ID NO: 107266 - protein, 11 aa, Artificial Sequence
  Description of Artificial Sequence: Synthetic peptide
  Seed: DLANPQGLAGH (MAGC3_HUMAN)
DLANPQGLAGK

SEQ ID NO: 107267 - protein, 10 aa, Artificial Sequence
  Description of Artificial Sequence: Synthetic peptide
  Seed: GHLREVRLFL (MAGC3_HUMAN)
GYLREVRLFV

SEQ ID NO: 107268 - protein, 10 aa, Artificial Sequence
  Description of Artificial Sequence: Synthetic peptide
  Seed: TLDEKVDKLV (MAGC3_HUMAN)
TTDEKVDKLM

SEQ ID NO: 107269 - protein, 11 aa, Artificial Sequence
  Description of Artificial Sequence: Synthetic peptide
  Seed: DMDPDNHSYFF (MAGC3_HUMAN)
DMDPDNHSYFY

SEQ ID NO: 107270 - protein, 9 aa, Artificial Sequence
  Description of Artificial Sequence: Synthetic peptide
  Seed: EVLSAIGPI (MAGC3_HUMAN)
EALSAIGPK

SEQ ID NO: 107271 - protein, 10 aa, Artificial Sequence
  Description of Artificial Sequence: Synthetic peptide
  Seed: SKLSSIIPSA (MAGC3_HUMAN)
SVLSSIIPSV

SEQ ID NO: 107272 - protein, 10 aa, Artificial Sequence
  Description of Artificial Sequence: Synthetic peptide
  Seed: TYTGYFPMIF (MAGC3_HUMAN)
TLTGYFPMIY

SEQ ID NO: 107273 - protein, 9 aa, Artificial Sequence
  Description of Artificial Sequence: Synthetic peptide
  Seed: SQPEGKFSL (MAGC3_HUMAN)
SCPEGKFSL

SEQ ID NO: 107274 - protein, 10 aa, Artificial Sequence
  Description of Artificial Sequence: Synthetic peptide
  Seed: SQPEGKFSLR (MAGC3_HUMAN)
SAPEGKFSLY

SEQ ID NO: 107275 - protein, 9 aa, Artificial Sequence
  Description of Artificial Sequence: Synthetic peptide
  Seed: MASASPSVM (MAGC3_HUMAN)
MFSASPSVY

SEQ ID NO: 107276 - protein, 10 aa, Artificial Sequence
  Description of Artificial Sequence: Synthetic peptide
  Seed: IKKYKDYFPM (MAGC3_HUMAN)
IMKYKDYFPM

SEQ ID NO: 107277 - protein, 9 aa, Artificial Sequence
  Description of Artificial Sequence: Synthetic peptide
  Seed: NPQGLAGHR (MAGC3_HUMAN)
NFQGLAGHR

SEQ ID NO: 107278 - protein, 8 aa, Artificial Sequence
  Description of Artificial Sequence: Synthetic peptide
  Seed: FLSKLSSI (MAGC3_HUMAN)
FLSKLSSA

SEQ ID NO: 107279 - protein, 9 aa, Artificial Sequence
  Description of Artificial Sequence: Synthetic peptide
  Seed: IIPSAFPSW (MAGC3_HUMAN)
IAPSAFPSL

SEQ ID NO: 107280 - protein, 9 aa, Artificial Sequence
  Description of Artificial Sequence: Synthetic peptide
  Seed: KEPLTRAEM (MAGC3_HUMAN)
KQPLTRAEY

SEQ ID NO: 107281 - protein, 10 aa, Artificial Sequence
  Description of Artificial Sequence: Synthetic peptide
  Seed: KVAELVQFLL (MAGC3_HUMAN)
KSAELVQFLY

SEQ ID NO: 107282 - protein, 9 aa, Artificial Sequence
  Description of Artificial Sequence: Synthetic peptide
  Seed: GMPQNRLLI (MAGC3_HUMAN)
GAPQNRLLM

SEQ ID NO: 107283 - protein, 10 aa, Artificial Sequence
  Description of Artificial Sequence: Synthetic peptide
  Seed: SLTEVDPDHF (MAGC3_HUMAN)
SQTEVDPDHW

SEQ ID NO: 107284 - protein, 9 aa, Artificial Sequence
  Description of Artificial Sequence: Synthetic peptide
  Seed: LFGISLTEV (MAGC3_HUMAN)
LYGISLTEL

SEQ ID NO: 107285 - protein, 9 aa, Artificial Sequence
  Description of Artificial Sequence: Synthetic peptide
  Seed: VIWEVLSAI (MAGC3_HUMAN)
VVWEVLSAA

SEQ ID NO: 107286 - protein, 11 aa, Artificial Sequence
  Description of Artificial Sequence: Synthetic peptide
  Seed: SSSEEEDTATW (MAGC3_HUMAN)
SESEEEDTATW

SEQ ID NO: 107287 - protein, 10 aa, Artificial Sequence
  Description of Artificial Sequence: Synthetic peptide
  Seed: ALDEKVAELV (MAGC3_HUMAN)
AQDEKVAELM

SEQ ID NO: 107288 - protein, 9 aa, Artificial Sequence
  Description of Artificial Sequence: Synthetic peptide
  Seed: YQAKEPLTR (MAGC3_HUMAN)
YVAKEPLTF

SEQ ID NO: 107289 - protein, 10 aa, Artificial Sequence
  Description of Artificial Sequence: Synthetic peptide
  Seed: TEVDPDHFYV (MAGC3_HUMAN)
TEVDPDHFYF

SEQ ID NO: 107290 - protein, 10 aa, Artificial Sequence
  Description of Artificial Sequence: Synthetic peptide
  Seed: YALSPVVLPP (MAGC3_HUMAN)
YRLSPVVLPL

SEQ ID NO: 107291 - protein, 10 aa, Artificial Sequence
  Description of Artificial Sequence: Synthetic peptide
  Seed: KKYKDYFPMI (MAGC3_HUMAN)
KGYKDYFPMF

SEQ ID NO: 107292 - protein, 10 aa, Artificial Sequence
  Description of Artificial Sequence: Synthetic peptide
  Seed: FPSWYMDALK (MAGC3_HUMAN)
FHSWYMDALK

SEQ ID NO: 107293 - protein, 9 aa, Artificial Sequence
  Description of Artificial Sequence: Synthetic peptide
  Seed: NAIGPWSAL (MAGC3_HUMAN)
NPIGPWSAA

SEQ ID NO: 107294 - protein, 9 aa, Artificial Sequence
  Description of Artificial Sequence: Synthetic peptide
  Seed: MLLPCHWVL (MAGC3_HUMAN)
MQLPCHWVW

SEQ ID NO: 107295 - protein, 10 aa, Artificial Sequence
  Description of Artificial Sequence: Synthetic peptide
  Seed: SKLSSIIPSA (MAGC3_HUMAN)
SRLSSIIPSV

SEQ ID NO: 107296 - protein, 9 aa, Artificial Sequence
  Description of Artificial Sequence: Synthetic peptide
  Seed: KAHEFIELI (MAGC3_HUMAN)
KQHEFIELC

SEQ ID NO: 107297 - protein, 9 aa, Artificial Sequence
  Description of Artificial Sequence: Synthetic peptide
  Seed: FEDTLDLTY (MAGC3_HUMAN)
FVDTLDLTL

SEQ ID NO: 107298 - protein, 9 aa, Artificial Sequence
  Description of Artificial Sequence: Synthetic peptide
  Seed: SASPSVMST (MAGC3_HUMAN)
SVSPSVMSV

SEQ ID NO: 107299 - protein, 9 aa, Artificial Sequence
  Description of Artificial Sequence: Synthetic peptide
  Seed: HLREVRLFL (MAGC3_HUMAN)
HIREVRLFA

SEQ ID NO: 107300 - protein, 10 aa, Artificial Sequence
  Description of Artificial Sequence: Synthetic peptide
  Seed: LILILSVIFI (MAGC3_HUMAN)
LRLILSVIFV

SEQ ID NO: 107301 - protein, 11 aa, Artificial Sequence
  Description of Artificial Sequence: Synthetic peptide
  Seed: FSDGSLGQWVK (MAGC3_HUMAN)
FLDGSLGQWVY

SEQ ID NO: 107302 - protein, 10 aa, Artificial Sequence
  Description of Artificial Sequence: Synthetic peptide
  Seed: LILILSMIFI (MAGC3_HUMAN)
LFLILSMIFV

SEQ ID NO: 107303 - protein, 10 aa, Artificial Sequence
  Description of Artificial Sequence: Synthetic peptide
  Seed: KAHEFIELIF (MAGC3_HUMAN)
KQHEFIELIW

SEQ ID NO: 107304 - protein, 9 aa, Artificial Sequence
  Description of Artificial Sequence: Synthetic peptide
  Seed: HSYFFEDTL (MAGC3_HUMAN)
HQYFFEDTI

SEQ ID NO: 107305 - protein, 9 aa, Artificial Sequence
  Description of Artificial Sequence: Synthetic peptide
  Seed: RQEDGRRGL (MAGC3_HUMAN)
REEDGRRGI

SEQ ID NO: 107306 - protein, 9 aa, Artificial Sequence
  Description of Artificial Sequence: Synthetic peptide
  Seed: MQMNVINTY (MAGC3_HUMAN)
MEMNVINTL

SEQ ID NO: 107307 - protein, 9 aa, Artificial Sequence
  Description of Artificial Sequence: Synthetic peptide
  Seed: MQMNVINTY (MAGC3_HUMAN)
MYMNVINTI

SEQ ID NO: 107308 - protein, 9 aa, Artificial Sequence
  Description of Artificial Sequence: Synthetic peptide
  Seed: IELIFGIAL (MAGC3_HUMAN)
IHLIFGIAV

SEQ ID NO: 107309 - protein, 10 aa, Artificial Sequence
  Description of Artificial Sequence: Synthetic peptide
  Seed: MLLPCHWVLD (MAGC3_HUMAN)
MHLPCHWVLV

SEQ ID NO: 107310 - protein, 9 aa, Artificial Sequence
  Description of Artificial Sequence: Synthetic peptide
  Seed: SIIPSAFPS (MAGC3_HUMAN)
SVIPSAFPV

SEQ ID NO: 107311 - protein, 9 aa, Artificial Sequence
  Description of Artificial Sequence: Synthetic peptide
  Seed: LKYQAKEPL (MAGC3_HUMAN)
LAYQAKEPM

SEQ ID NO: 107312 - protein, 11 aa, Artificial Sequence
  Description of Artificial Sequence: Synthetic peptide
  Seed: LPAVSPGKRLW (MAGC3_HUMAN)
LTAVSPGKRLW

SEQ ID NO: 107313 - protein, 11 aa, Artificial Sequence
  Description of Artificial Sequence: Synthetic peptide
  Seed: TAMASASPSVM (MAGC3_HUMAN)
TFMASASPSVY

SEQ ID NO: 107314 - protein, 10 aa, Artificial Sequence
  Description of Artificial Sequence: Synthetic peptide
  Seed: MLLPCHWVLD (MAGC3_HUMAN)
MLLPCHWVLL

SEQ ID NO: 107315 - protein, 9 aa, Artificial Sequence
  Description of Artificial Sequence: Synthetic peptide
  Seed: RTLSGSPGL (MAGC3_HUMAN)
RALSGSPGL

SEQ ID NO: 107316 - protein, 9 aa, Artificial Sequence
  Description of Artificial Sequence: Synthetic peptide
  Seed: QTKEPVTKA (MAGC3_HUMAN)
QIKEPVTKM

SEQ ID NO: 107317 - protein, 9 aa, Artificial Sequence
  Description of Artificial Sequence: Synthetic peptide
  Seed: FKLWRTLSG (MAGC3_HUMAN)
FHLWRTLSM

SEQ ID NO: 107318 - protein, 10 aa, Artificial Sequence
  Description of Artificial Sequence: Synthetic peptide
  Seed: MQMNVINTYT (MAGC3_HUMAN)
MCMNVINTYY

SEQ ID NO: 107319 - protein, 10 aa, Artificial Sequence
  Description of Artificial Sequence: Synthetic peptide
  Seed: KDSDLPTWRR (MAGC3_HUMAN)
KVSDLPTWRR

SEQ ID NO: 107320 - protein, 10 aa, Artificial Sequence
  Description of Artificial Sequence: Synthetic peptide
  Seed: SIIPSAFPSW (MAGC3_HUMAN)
STIPSAFPSL

SEQ ID NO: 107321 - protein, 10 aa, Artificial Sequence
  Description of Artificial Sequence: Synthetic peptide
  Seed: TAMASASPSV (MAGC3_HUMAN)
TFMASASPSV

SEQ ID NO: 107322 - protein, 9 aa, Artificial Sequence
  Description of Artificial Sequence: Synthetic peptide
  Seed: EVLEFLSKL (MAGC3_HUMAN)
EMLEFLSKY

SEQ ID NO: 107323 - protein, 10 aa, Artificial Sequence
  Description of Artificial Sequence: Synthetic peptide
  Seed: MPAAGMPPLP (MAGC3_HUMAN)
MPAAGMPPLT

SEQ ID NO: 107324 - protein, 9 aa, Artificial Sequence
  Description of Artificial Sequence: Synthetic peptide
  Seed: IIDTTDDAT (MAGC3_HUMAN)
IWDTTDDAL

SEQ ID NO: 107325 - protein, 9 aa, Artificial Sequence
  Description of Artificial Sequence: Synthetic peptide
  Seed: LIDDQGMPK (MAGC3_HUMAN)
LNDDQGMPL

SEQ ID NO: 107326 - protein, 9 aa, Artificial Sequence
  Description of Artificial Sequence: Synthetic peptide
  Seed: QDWPLNEKR (MAGC3_HUMAN)
QTWPLNEKK

SEQ ID NO: 107327 - protein, 9 aa, Artificial Sequence
  Description of Artificial Sequence: Synthetic peptide
  Seed: SASPSVMST (MAGC3_HUMAN)
SQSPSVMSY

SEQ ID NO: 107328 - protein, 9 aa, Artificial Sequence
  Description of Artificial Sequence: Synthetic peptide
  Seed: VIWEVLSAI (MAGC3_HUMAN)
VTWEVLSAM

SEQ ID NO: 107329 - protein, 9 aa, Artificial Sequence
  Description of Artificial Sequence: Synthetic peptide
  Seed: ALAGFADVL (MAGC3_HUMAN)
ALAGFADVM

SEQ ID NO: 107330 - protein, 9 aa, Artificial Sequence
  Description of Artificial Sequence: Synthetic peptide
  Seed: SESLPRYAL (MAGC3_HUMAN)
SKSLPRYAF

SEQ ID NO: 107331 - protein, 9 aa, Artificial Sequence
  Description of Artificial Sequence: Synthetic peptide
  Seed: VIWEVLSAI (MAGC3_HUMAN)
VLWEVLSAY

SEQ ID NO: 107332 - protein, 10 aa, Artificial Sequence
  Description of Artificial Sequence: Synthetic peptide
  Seed: ALAGFADVLS (MAGC3_HUMAN)
AMAGFADVLL

SEQ ID NO: 107333 - protein, 9 aa, Artificial Sequence
  Description of Artificial Sequence: Synthetic peptide
  Seed: SQPEGKFSL (MAGC3_HUMAN)
SSPEGKFSF

SEQ ID NO: 107334 - protein, 10 aa, Artificial Sequence
  Description of Artificial Sequence: Synthetic peptide
  Seed: LSLPAVSPGK (MAGC3_HUMAN)
LYLPAVSPGR

SEQ ID NO: 107335 - protein, 11 aa, Artificial Sequence
  Description of Artificial Sequence: Synthetic peptide
  Seed: TAMASASPSVM (MAGC3_HUMAN)
TYMASASPSVY

SEQ ID NO: 107336 - protein, 9 aa, Artificial Sequence
  Description of Artificial Sequence: Synthetic peptide
  Seed: KAEMLTTVI (MAGC3_HUMAN)
KAEMLTTVW

SEQ ID NO: 107337 - protein, 9 aa, Artificial Sequence
  Description of Artificial Sequence: Synthetic peptide
  Seed: SDLHFGSQP (MAGC3_HUMAN)
SELHFGSQP

SEQ ID NO: 107338 - protein, 9 aa, Artificial Sequence
  Description of Artificial Sequence: Synthetic peptide
  Seed: YTGYFPMIF (MAGC3_HUMAN)
YVGYFPMIM

SEQ ID NO: 107339 - protein, 10 aa, Artificial Sequence
  Description of Artificial Sequence: Synthetic peptide
  Seed: MNVINTYTGY (MAGC3_HUMAN)
MQVINTYTGY

SEQ ID NO: 107340 - protein, 9 aa, Artificial Sequence
  Description of Artificial Sequence: Synthetic peptide
  Seed: IPPQGPPKI (MAGC3_HUMAN)
IIPQGPPKL

SEQ ID NO: 107341 - protein, 9 aa, Artificial Sequence
  Description of Artificial Sequence: Synthetic peptide
  Seed: FADVLSRLA (MAGC3_HUMAN)
FGDVLSRLV

SEQ ID NO: 107342 - protein, 10 aa, Artificial Sequence
  Description of Artificial Sequence: Synthetic peptide
  Seed: MQMNVINTYT (MAGC3_HUMAN)
MQMNVINTYS

SEQ ID NO: 107343 - protein, 10 aa, Artificial Sequence
  Description of Artificial Sequence: Synthetic peptide
  Seed: YALDEKVAEL (MAGC3_HUMAN)
YWLDEKVAEF

SEQ ID NO: 107344 - protein, 11 aa, Artificial Sequence
  Description of Artificial Sequence: Synthetic peptide
  Seed: SASPSVMSTNF (MAGC3_HUMAN)
SGSPSVMSTNW

SEQ ID NO: 107345 - protein, 9 aa, Artificial Sequence
  Description of Artificial Sequence: Synthetic peptide
  Seed: QGMPQNRLL (MAGC3_HUMAN)
QVMPQNRLF

SEQ ID NO: 107346 - protein, 9 aa, Artificial Sequence
  Description of Artificial Sequence: Synthetic peptide
  Seed: CATYALSPV (MAGC3_HUMAN)
CTTYALSPV

SEQ ID NO: 107347 - protein, 10 aa, Artificial Sequence
  Description of Artificial Sequence: Synthetic peptide
  Seed: KAHEFIELIF (MAGC3_HUMAN)
KIHEFIELIW

SEQ ID NO: 107348 - protein, 9 aa, Artificial Sequence
  Description of Artificial Sequence: Synthetic peptide
  Seed: VIWEVLNAI (MAGC3_HUMAN)
VAWEVLNAL

SEQ ID NO: 107349 - protein, 9 aa, Artificial Sequence
  Description of Artificial Sequence: Synthetic peptide
  Seed: MQMNVINTY (MAGC3_HUMAN)
MVMNVINTK

SEQ ID NO: 107350 - protein, 10 aa, Artificial Sequence
  Description of Artificial Sequence: Synthetic peptide
  Seed: RLWGEKAGSL (MAGC3_HUMAN)
RMWGEKAGSF

SEQ ID NO: 107351 - protein, 11 aa, Artificial Sequence
  Description of Artificial Sequence: Synthetic peptide
  Seed: KVAELVQFLLL (MAGC3_HUMAN)
KMAELVQFLLA

SEQ ID NO: 107352 - protein, 9 aa, Artificial Sequence
  Description of Artificial Sequence: Synthetic peptide
  Seed: RRAVSVKQR (MAGC3_HUMAN)
RRAVSVKQI

SEQ ID NO: 107353 - protein, 10 aa, Artificial Sequence
  Description of Artificial Sequence: Synthetic peptide
  Seed: YTGYFPMIFR (MAGC3_HUMAN)
YLGYFPMIFR

SEQ ID NO: 107354 - protein, 9 aa, Artificial Sequence
  Description of Artificial Sequence: Synthetic peptide
  Seed: MPAAGMPPL (MAGC3_HUMAN)
MFAAGMPPV

SEQ ID NO: 107355 - protein, 10 aa, Artificial Sequence
  Description of Artificial Sequence: Synthetic peptide
  Seed: SALAGFADVL (MAGC3_HUMAN)
SDLAGFADVV

SEQ ID NO: 107356 - protein, 9 aa, Artificial Sequence
  Description of Artificial Sequence: Synthetic peptide
  Seed: MPKNCLLIL (MAGC3_HUMAN)
MLKNCLLIF

SEQ ID NO: 107357 - protein, 11 aa, Artificial Sequence
  Description of Artificial Sequence: Synthetic peptide
  Seed: SASPSVMSTNF (MAGC3_HUMAN)
SPSPSVMSTNY

SEQ ID NO: 107358 - protein, 9 aa, Artificial Sequence
  Description of Artificial Sequence: Synthetic peptide
  Seed: QMNVINTYT (MAGC3_HUMAN)
QLNVINTYV

SEQ ID NO: 107359 - protein, 9 aa, Artificial Sequence
  Description of Artificial Sequence: Synthetic peptide
  Seed: IIPSAFPSW (MAGC3_HUMAN)
IYPSAFPSM

SEQ ID NO: 107360 - protein, 9 aa, Artificial Sequence
  Description of Artificial Sequence: Synthetic peptide
  Seed: KVAELVQFL (MAGC3_HUMAN)
KLAELVQFR

SEQ ID NO: 107361 - protein, 10 aa, Artificial Sequence
  Description of Artificial Sequence: Synthetic peptide
  Seed: MLLPCHWVLD (MAGC3_HUMAN)
MQLPCHWVLL

SEQ ID NO: 107362 - protein, 10 aa, Artificial Sequence
  Description of Artificial Sequence: Synthetic peptide
  Seed: YTLDEKVDKL (MAGC3_HUMAN)
YTLDEKVDKF

SEQ ID NO: 107363 - protein, 8 aa, Artificial Sequence
  Description of Artificial Sequence: Synthetic peptide
  Seed: FADVLSRL (MAGC3_HUMAN)
FCDVLSRL

SEQ ID NO: 107364 - protein, 10 aa, Artificial Sequence
  Description of Artificial Sequence: Synthetic peptide
  Seed: LIFGIALTDM (MAGC3_HUMAN)
LQFGIALTDY

SEQ ID NO: 107365 - protein, 9 aa, Artificial Sequence
  Description of Artificial Sequence: Synthetic peptide
  Seed: AMASASPSV (MAGC3_HUMAN)
AKASASPSF

SEQ ID NO: 107366 - protein, 11 aa, Artificial Sequence
  Description of Artificial Sequence: Synthetic peptide
  Seed: KKYKDYFPMIF (MAGC3_HUMAN)
KYYKDYFPMIF

SEQ ID NO: 107367 - protein, 9 aa, Artificial Sequence
  Description of Artificial Sequence: Synthetic peptide
  Seed: GEDEDMPAA (MAGC3_HUMAN)
GEDEDMPAV

SEQ ID NO: 107368 - protein, 9 aa, Artificial Sequence
  Description of Artificial Sequence: Synthetic peptide
  Seed: MLLPCHWVL (MAGC3_HUMAN)
MRLPCHWVI

SEQ ID NO: 107369 - protein, 9 aa, Artificial Sequence
  Description of Artificial Sequence: Synthetic peptide
  Seed: LKYQAKEPL (MAGC3_HUMAN)
LNYQAKEPY

SEQ ID NO: 107370 - protein, 9 aa, Artificial Sequence
  Description of Artificial Sequence: Synthetic peptide
  Seed: AVSPGKRLW (MAGC3_HUMAN)
ASSPGKRLY

SEQ ID NO: 107371 - protein, 10 aa, Artificial Sequence
  Description of Artificial Sequence: Synthetic peptide
  Seed: TFSDGSLGQW (MAGC3_HUMAN)
TYSDGSLGQF

SEQ ID NO: 107372 - protein, 11 aa, Artificial Sequence
  Description of Artificial Sequence: Synthetic peptide
  Seed: EILFGISLTEV (MAGC3_HUMAN)
EFLFGISLTEI

SEQ ID NO: 107373 - protein, 9 aa, Artificial Sequence
  Description of Artificial Sequence: Synthetic peptide
  Seed: SIIPSAFPS (MAGC3_HUMAN)
SQIPSAFPA

SEQ ID NO: 107374 - protein, 9 aa, Artificial Sequence
  Description of Artificial Sequence: Synthetic peptide
  Seed: HALPESESL (MAGC3_HUMAN)
HHLPESESM

SEQ ID NO: 107375 - protein, 9 aa, Artificial Sequence
  Description of Artificial Sequence: Synthetic peptide
  Seed: NTYTGYFPM (MAGC3_HUMAN)
NPYTGYFPV

SEQ ID NO: 107376 - protein, 10 aa, Artificial Sequence
  Description of Artificial Sequence: Synthetic peptide
  Seed: TGYFPMIFRK (MAGC3_HUMAN)
TVYFPMIFRM

SEQ ID NO: 107377 - protein, 9 aa, Artificial Sequence
  Description of Artificial Sequence: Synthetic peptide
  Seed: SASPSVMST (MAGC3_HUMAN)
SQSPSVMSM

SEQ ID NO: 107378 - protein, 9 aa, Artificial Sequence
  Description of Artificial Sequence: Synthetic peptide
  Seed: VIWEVLSAI (MAGC3_HUMAN)
VQWEVLSAY

SEQ ID NO: 107379 - protein, 9 aa, Artificial Sequence
  Description of Artificial Sequence: Synthetic peptide
  Seed: AMASASPSV (MAGC3_HUMAN)
AAASASPSM

SEQ ID NO: 107380 - protein, 9 aa, Artificial Sequence
  Description of Artificial Sequence: Synthetic peptide
  Seed: YFFEDTLDL (MAGC3_HUMAN)
YMFEDTLDA

SEQ ID NO: 107381 - protein, 9 aa, Artificial Sequence
  Description of Artificial Sequence: Synthetic peptide
  Seed: LSDEQGMPQ (MAGC3_HUMAN)
LTDEQGMPL

SEQ ID NO: 107382 - protein, 10 aa, Artificial Sequence
  Description of Artificial Sequence: Synthetic peptide
  Seed: YTLDEKVDKL (MAGC3_HUMAN)
YDLDEKVDKV

SEQ ID NO: 107383 - protein, 10 aa, Artificial Sequence
  Description of Artificial Sequence: Synthetic peptide
  Seed: YALDEKVAEL (MAGC3_HUMAN)
YVLDEKVAEA

SEQ ID NO: 107384 - protein, 9 aa, Artificial Sequence
  Description of Artificial Sequence: Synthetic peptide
  Seed: IIPSAFPSW (MAGC3_HUMAN)
IQPSAFPSL

SEQ ID NO: 107385 - protein, 10 aa, Artificial Sequence
  Description of Artificial Sequence: Synthetic peptide
  Seed: INTYTGYFPM (MAGC3_HUMAN)
ILTYTGYFPY

SEQ ID NO: 107386 - protein, 9 aa, Artificial Sequence
  Description of Artificial Sequence: Synthetic peptide
  Seed: LSGSPGLQL (MAGC3_HUMAN)
LTGSPGLQF

SEQ ID NO: 107387 - protein, 9 aa, Artificial Sequence
  Description of Artificial Sequence: Synthetic peptide
  Seed: TTDDATAMA (MAGC3_HUMAN)
TCDDATAMM

SEQ ID NO: 107388 - protein, 10 aa, Artificial Sequence
  Description of Artificial Sequence: Synthetic peptide
  Seed: SKLSSIIPSA (MAGC3_HUMAN)
SYLSSIIPSM

SEQ ID NO: 107389 - protein, 11 aa, Artificial Sequence
  Description of Artificial Sequence: Synthetic peptide
  Seed: FIELIFGIALT (MAGC3_HUMAN)
FVELIFGIALV

SEQ ID NO: 107390 - protein, 9 aa, Artificial Sequence
  Description of Artificial Sequence: Synthetic peptide
  Seed: KVAELVQFL (MAGC3_HUMAN)
KLAELVQFA

SEQ ID NO: 107391 - protein, 9 aa, Artificial Sequence
  Description of Artificial Sequence: Synthetic peptide
  Seed: ALAGFADVL (MAGC3_HUMAN)
AQAGFADVM

SEQ ID NO: 107392 - protein, 9 aa, Artificial Sequence
  Description of Artificial Sequence: Synthetic peptide
  Seed: DVLSRLALW (MAGC3_HUMAN)
DALSRLALW

SEQ ID NO: 107393 - protein, 10 aa, Artificial Sequence
  Description of Artificial Sequence: Synthetic peptide
  Seed: KVDKLVQFLL (MAGC3_HUMAN)
KQDKLVQFLL

SEQ ID NO: 107394 - protein, 9 aa, Artificial Sequence
  Description of Artificial Sequence: Synthetic peptide
  Seed: KVDKLVQFL (MAGC3_HUMAN)
KLDKLVQFI

SEQ ID NO: 107395 - protein, 9 aa, Artificial Sequence
  Description of Artificial Sequence: Synthetic peptide
  Seed: SLRRAVSVK (MAGC3_HUMAN)
SQRRAVSVA

SEQ ID NO: 107396 - protein, 9 aa, Artificial Sequence
  Description of Artificial Sequence: Synthetic peptide
  Seed: DTTDDATAM (MAGC3_HUMAN)
DITDDATAW

SEQ ID NO: 107397 - protein, 9 aa, Artificial Sequence
  Description of Artificial Sequence: Synthetic peptide
  Seed: KVAELVQFL (MAGC3_HUMAN)
KIAELVQFK

SEQ ID NO: 107398 - protein, 9 aa, Artificial Sequence
  Description of Artificial Sequence: Synthetic peptide
  Seed: WRRGTGYTL (MAGC3_HUMAN)
WNRGTGYTF

SEQ ID NO: 107399 - protein, 9 aa, Artificial Sequence
  Description of Artificial Sequence: Synthetic peptide
  Seed: FSLRRAVSV (MAGC3_HUMAN)
FMLRRAVSL

SEQ ID NO: 107400 - protein, 9 aa, Artificial Sequence
  Description of Artificial Sequence: Synthetic peptide
  Seed: RGTGYTLSL (MAGC3_HUMAN)
RETGYTLSL

SEQ ID NO: 107401 - protein, 9 aa, Artificial Sequence
  Description of Artificial Sequence: Synthetic peptide
  Seed: SEEVIWEVL (MAGC3_HUMAN)
SHEVIWEVM

SEQ ID NO: 107402 - protein, 9 aa, Artificial Sequence
  Description of Artificial Sequence: Synthetic peptide
  Seed: EVLEFLSKL (MAGC3_HUMAN)
EALEFLSKV

SEQ ID NO: 107403 - protein, 9 aa, Artificial Sequence
  Description of Artificial Sequence: Synthetic peptide
  Seed: KYKDYFPMI (MAGC3_HUMAN)
KSKDYFPMR

SEQ ID NO: 107404 - protein, 10 aa, Artificial Sequence
  Description of Artificial Sequence: Synthetic peptide
  Seed: EEVIWEVLNA (MAGC3_HUMAN)
EMVIWEVLNV

SEQ ID NO: 107405 - protein, 11 aa, Artificial Sequence
  Description of Artificial Sequence: Synthetic peptide
  Seed: EILFGISLTEV (MAGC3_HUMAN)
EMLFGISLTEV

SEQ ID NO: 107406 - protein, 10 aa, Artificial Sequence
  Description of Artificial Sequence: Synthetic peptide
  Seed: MQMNVINTYT (MAGC3_HUMAN)
MMMNVINTYI

SEQ ID NO: 107407 - protein, 10 aa, Artificial Sequence
  Description of Artificial Sequence: Synthetic peptide
  Seed: NTYTGYFPMI (MAGC3_HUMAN)
NLYTGYFPML

SEQ ID NO: 107408 - protein, 8 aa, Artificial Sequence
  Description of Artificial Sequence: Synthetic peptide
  Seed: VKNTCATY (MAGC3_HUMAN)
VMNTCATF

SEQ ID NO: 107409 - protein, 9 aa, Artificial Sequence
  Description of Artificial Sequence: Synthetic peptide
  Seed: HSYFFEDTL (MAGC3_HUMAN)
HSYFFEDTW

SEQ ID NO: 107410 - protein, 9 aa, Artificial Sequence
  Description of Artificial Sequence: Synthetic peptide
  Seed: IIDTTDDAT (MAGC3_HUMAN)
IQDTTDDAL

SEQ ID NO: 107411 - protein, 9 aa, Artificial Sequence
  Description of Artificial Sequence: Synthetic peptide
  Seed: MIFIKGSCV (MAGC3_HUMAN)
MQFIKGSCV

SEQ ID NO: 107412 - protein, 9 aa, Artificial Sequence
  Description of Artificial Sequence: Synthetic peptide
  Seed: MLLPCHWVL (MAGC3_HUMAN)
MTLPCHWVV

SEQ ID NO: 107413 - protein, 11 aa, Artificial Sequence
  Description of Artificial Sequence: Synthetic peptide
  Seed: HALPESESLPR (MAGC3_HUMAN)
HILPESESLPR

SEQ ID NO: 107414 - protein, 9 aa, Artificial Sequence
  Description of Artificial Sequence: Synthetic peptide
  Seed: LSDEQGMPQ (MAGC3_HUMAN)
LCDEQGMPL

SEQ ID NO: 107415 - protein, 9 aa, Artificial Sequence
  Description of Artificial Sequence: Synthetic peptide
  Seed: EFIELIFGI (MAGC3_HUMAN)
ELIELIFGM

SEQ ID NO: 107416 - protein, 11 aa, Artificial Sequence
  Description of Artificial Sequence: Synthetic peptide
  Seed: TSDQRMDSLVL (MAGC3_HUMAN)
TDDQRMDSLVF

SEQ ID NO: 107417 - protein, 10 aa, Artificial Sequence
  Description of Artificial Sequence: Synthetic peptide
  Seed: RPAREVLEFL (MAGC3_HUMAN)
RVAREVLEFA

SEQ ID NO: 107418 - protein, 9 aa, Artificial Sequence
  Description of Artificial Sequence: Synthetic peptide
  Seed: NTYTGYFPM (MAGC3_HUMAN)
NQYTGYFPK

SEQ ID NO: 107419 - protein, 9 aa, Artificial Sequence
  Description of Artificial Sequence: Synthetic peptide
  Seed: MIFGKAHEF (MAGC3_HUMAN)
MRFGKAHEI

SEQ ID NO: 107420 - protein, 10 aa, Artificial Sequence
  Description of Artificial Sequence: Synthetic peptide
  Seed: SALAGFADVL (MAGC3_HUMAN)
SGLAGFADVL

SEQ ID NO: 107421 - protein, 9 aa, Artificial Sequence
  Description of Artificial Sequence: Synthetic peptide
  Seed: MIFIKGSCV (MAGC3_HUMAN)
MPFIKGSCL

SEQ ID NO: 107422 - protein, 10 aa, Artificial Sequence
  Description of Artificial Sequence: Synthetic peptide
  Seed: VTKAEMLTTV (MAGC3_HUMAN)
VLKAEMLTTI

SEQ ID NO: 107423 - protein, 10 aa, Artificial Sequence
  Description of Artificial Sequence: Synthetic peptide
  Seed: KKYKDYFPMI (MAGC3_HUMAN)
KGYKDYFPMK

SEQ ID NO: 107424 - protein, 9 aa, Artificial Sequence
  Description of Artificial Sequence: Synthetic peptide
  Seed: MIFRKAREF (MAGC3_HUMAN)
MVFRKAREY

SEQ ID NO: 107425 - protein, 9 aa, Artificial Sequence
  Description of Artificial Sequence: Synthetic peptide
  Seed: ELVQFLLLK (MAGC3_HUMAN)
EGVQFLLLR

SEQ ID NO: 107426 - protein, 10 aa, Artificial Sequence
  Description of Artificial Sequence: Synthetic peptide
  Seed: SKLSSIIPSA (MAGC3_HUMAN)
SSLSSIIPSI

SEQ ID NO: 107427 - protein, 9 aa, Artificial Sequence
  Description of Artificial Sequence: Synthetic peptide
  Seed: HALPESESL (MAGC3_HUMAN)
HHLPESESW

SEQ ID NO: 107428 - protein, 10 aa, Artificial Sequence
  Description of Artificial Sequence: Synthetic peptide
  Seed: SALAGFADVL (MAGC3_HUMAN)
SALAGFADVV

SEQ ID NO: 107429 - protein, 9 aa, Artificial Sequence
  Description of Artificial Sequence: Synthetic peptide
  Seed: AGFADVLSR (MAGC3_HUMAN)
AVFADVLSY

SEQ ID NO: 107430 - protein, 9 aa, Artificial Sequence
  Description of Artificial Sequence: Synthetic peptide
  Seed: MQMNVINTY (MAGC3_HUMAN)
MIMNVINTY

SEQ ID NO: 107431 - protein, 9 aa, Artificial Sequence
  Description of Artificial Sequence: Synthetic peptide
  Seed: RTLSGSPGL (MAGC3_HUMAN)
RFLSGSPGK

SEQ ID NO: 107432 - protein, 9 aa, Artificial Sequence
  Description of Artificial Sequence: Synthetic peptide
  Seed: MASASPSVM (MAGC3_HUMAN)
MNSASPSVY

SEQ ID NO: 107433 - protein, 9 aa, Artificial Sequence
  Description of Artificial Sequence: Synthetic peptide
  Seed: YTGYFPMIF (MAGC3_HUMAN)
YVGYFPMIW

SEQ ID NO: 107434 - protein, 9 aa, Artificial Sequence
  Description of Artificial Sequence: Synthetic peptide
  Seed: AEMLTTVIK (MAGC3_HUMAN)
AEMLTTVII

SEQ ID NO: 107435 - protein, 9 aa, Artificial Sequence
  Description of Artificial Sequence: Synthetic peptide
  Seed: GQWVKNTCA (MAGC3_HUMAN)
GHWVKNTCA

SEQ ID NO: 107436 - protein, 9 aa, Artificial Sequence
  Description of Artificial Sequence: Synthetic peptide
  Seed: LSGSPGLQL (MAGC3_HUMAN)
LSGSPGLQW

SEQ ID NO: 107437 - protein, 9 aa, Artificial Sequence
  Description of Artificial Sequence: Synthetic peptide
  Seed: KQREEPQDW (MAGC3_HUMAN)
KIREEPQDY

SEQ ID NO: 107438 - protein, 9 aa, Artificial Sequence
  Description of Artificial Sequence: Synthetic peptide
  Seed: KVDKLVQFL (MAGC3_HUMAN)
KSDKLVQFM

SEQ ID NO: 107439 - protein, 9 aa, Artificial Sequence
  Description of Artificial Sequence: Synthetic peptide
  Seed: ALDEKVAEL (MAGC3_HUMAN)
AEDEKVAEL

SEQ ID NO: 107440 - protein, 10 aa, Artificial Sequence
  Description of Artificial Sequence: Synthetic peptide
  Seed: SDQRMDSLVL (MAGC3_HUMAN)
SRQRMDSLVF

SEQ ID NO: 107441 - protein, 11 aa, Artificial Sequence
  Description of Artificial Sequence: Synthetic peptide
  Seed: TAMASASPSVM (MAGC3_HUMAN)
TQMASASPSVF

SEQ ID NO: 107442 - protein, 9 aa, Artificial Sequence
  Description of Artificial Sequence: Synthetic peptide
  Seed: ASEEVIWEV (MAGC3_HUMAN)
ATEEVIWEW

SEQ ID NO: 107443 - protein, 9 aa, Artificial Sequence
  Description of Artificial Sequence: Synthetic peptide
  Seed: KEPLTRAEM (MAGC3_HUMAN)
KAPLTRAEF

SEQ ID NO: 107444 - protein, 10 aa, Artificial Sequence
  Description of Artificial Sequence: Synthetic peptide
  Seed: VLSAIGPIQR (MAGC3_HUMAN)
VISAIGPIQR

SEQ ID NO: 107445 - protein, 10 aa, Artificial Sequence
  Description of Artificial Sequence: Synthetic peptide
  Seed: ALDEKVAELV (MAGC3_HUMAN)
AADEKVAELV

SEQ ID NO: 107446 - protein, 9 aa, Artificial Sequence
  Description of Artificial Sequence: Synthetic peptide
  Seed: TYFKLWRTL (MAGC3_HUMAN)
TFFKLWRTY

SEQ ID NO: 107447 - protein, 11 aa, Artificial Sequence
  Description of Artificial Sequence: Synthetic peptide
  Seed: TTDDATAMASA (MAGC3_HUMAN)
TFDDATAMASL

SEQ ID NO: 107448 - protein, 10 aa, Artificial Sequence
  Description of Artificial Sequence: Synthetic peptide
  Seed: KYQAKEPLTR (MAGC3_HUMAN)
KIQAKEPLTR

SEQ ID NO: 107449 - protein, 11 aa, Artificial Sequence
  Description of Artificial Sequence: Synthetic peptide
  Seed: TTDDATAMASA (MAGC3_HUMAN)
TCDDATAMASL

SEQ ID NO: 107450 - protein, 9 aa, Artificial Sequence
  Description of Artificial Sequence: Synthetic peptide
  Seed: LSDLHFGSQ (MAGC3_HUMAN)
LADLHFGSY

SEQ ID NO: 107451 - protein, 9 aa, Artificial Sequence
  Description of Artificial Sequence: Synthetic peptide
  Seed: LPQSPPEIP (MAGC3_HUMAN)
LAQSPPEIY

SEQ ID NO: 107452 - protein, 10 aa, Artificial Sequence
  Description of Artificial Sequence: Synthetic peptide
  Seed: SAFHLGHLRE (MAGC3_HUMAN)
SFFHLGHLRR

SEQ ID NO: 107453 - protein, 9 aa, Artificial Sequence
  Description of Artificial Sequence: Synthetic peptide
  Seed: SLRRAVSVK (MAGC3_HUMAN)
SQRRAVSVR

SEQ ID NO: 107454 - protein, 9 aa, Artificial Sequence
  Description of Artificial Sequence: Synthetic peptide
  Seed: YSAFHLGHL (MAGC3_HUMAN)
YLAFHLGHL

SEQ ID NO: 107455 - protein, 10 aa, Artificial Sequence
  Description of Artificial Sequence: Synthetic peptide
  Seed: MQMNVINTYT (MAGC3_HUMAN)
MWMNVINTYV

SEQ ID NO: 107456 - protein, 10 aa, Artificial Sequence
  Description of Artificial Sequence: Synthetic peptide
  Seed: YALSPVVLPP (MAGC3_HUMAN)
YCLSPVVLPA

SEQ ID NO: 107457 - protein, 9 aa, Artificial Sequence
  Description of Artificial Sequence: Synthetic peptide
  Seed: LIDDQGMPK (MAGC3_HUMAN)
LYDDQGMPV

SEQ ID NO: 107458 - protein, 8 aa, Artificial Sequence
  Description of Artificial Sequence: Synthetic peptide
  Seed: AEMQMNVI (MAGC3_HUMAN)
AEMQMNVW

SEQ ID NO: 107459 - protein, 9 aa, Artificial Sequence
  Description of Artificial Sequence: Synthetic peptide
  Seed: MPAAGMPPL (MAGC3_HUMAN)
MVAAGMPPV

SEQ ID NO: 107460 - protein, 9 aa, Artificial Sequence
  Description of Artificial Sequence: Synthetic peptide
  Seed: DTTDDATAM (MAGC3_HUMAN)
DTTDDATAV

SEQ ID NO: 107461 - protein, 9 aa, Artificial Sequence
  Description of Artificial Sequence: Synthetic peptide
  Seed: GKFSLRRAV (MAGC3_HUMAN)
GMFSLRRAY

SEQ ID NO: 107462 - protein, 10 aa, Artificial Sequence
  Description of Artificial Sequence: Synthetic peptide
  Seed: SLIDDQGMPK (MAGC3_HUMAN)
SIIDDQGMPR

SEQ ID NO: 107463 - protein, 10 aa, Artificial Sequence
  Description of Artificial Sequence: Synthetic peptide
  Seed: TGYFPMIFRK (MAGC3_HUMAN)
TSYFPMIFRY

SEQ ID NO: 107464 - protein, 9 aa, Artificial Sequence
  Description of Artificial Sequence: Synthetic peptide
  Seed: KVAELVQFL (MAGC3_HUMAN)
KSAELVQFY

SEQ ID NO: 107465 - protein, 9 aa, Artificial Sequence
  Description of Artificial Sequence: Synthetic peptide
  Seed: YTGYFPMIF (MAGC3_HUMAN)
YPGYFPMIW

SEQ ID NO: 107466 - protein, 10 aa, Artificial Sequence
  Description of Artificial Sequence: Synthetic peptide
  Seed: VLDLANPQGL (MAGC3_HUMAN)
VIDLANPQGM

SEQ ID NO: 107467 - protein, 9 aa, Artificial Sequence
  Description of Artificial Sequence: Synthetic peptide
  Seed: HFYVFVNTL (MAGC3_HUMAN)
HYYVFVNTW

SEQ ID NO: 107468 - protein, 9 aa, Artificial Sequence
  Description of Artificial Sequence: Synthetic peptide
  Seed: GQWVKNTCA (MAGC3_HUMAN)
GEWVKNTCV

SEQ ID NO: 107469 - protein, 10 aa, Artificial Sequence
  Description of Artificial Sequence: Synthetic peptide
  Seed: REVLEFLSKL (MAGC3_HUMAN)
RMVLEFLSKI

SEQ ID NO: 107470 - protein, 9 aa, Artificial Sequence
  Description of Artificial Sequence: Synthetic peptide
  Seed: VLCPTYFKL (MAGC3_HUMAN)
VWCPTYFKW

SEQ ID NO: 107471 - protein, 9 aa, Artificial Sequence
  Description of Artificial Sequence: Synthetic peptide
  Seed: YQTKEPVTK (MAGC3_HUMAN)
YRTKEPVTI

SEQ ID NO: 107472 - protein, 9 aa, Artificial Sequence
  Description of Artificial Sequence: Synthetic peptide
  Seed: YQAKEPLTR (MAGC3_HUMAN)
YSAKEPLTM

SEQ ID NO: 107473 - protein, 9 aa, Artificial Sequence
  Description of Artificial Sequence: Synthetic peptide
  Seed: TAMASASPS (MAGC3_HUMAN)
TPMASASPW

SEQ ID NO: 107474 - protein, 9 aa, Artificial Sequence
  Description of Artificial Sequence: Synthetic peptide
  Seed: TTDDATAMA (MAGC3_HUMAN)
TFDDATAMV

SEQ ID NO: 107475 - protein, 9 aa, Artificial Sequence
  Description of Artificial Sequence: Synthetic peptide
  Seed: FLSKLSSII (MAGC3_HUMAN)
FSSKLSSIY

SEQ ID NO: 107476 - protein, 10 aa, Artificial Sequence
  Description of Artificial Sequence: Synthetic peptide
  Seed: EPQDWPLNEK (MAGC3_HUMAN)
EMQDWPLNER

SEQ ID NO: 107477 - protein, 9 aa, Artificial Sequence
  Description of Artificial Sequence: Synthetic peptide
  Seed: AEGSVLDLA (MAGC3_HUMAN)
AEGSVLDLV

SEQ ID NO: 107478 - protein, 10 aa, Artificial Sequence
  Description of Artificial Sequence: Synthetic peptide
  Seed: MQMNVINTYT (MAGC3_HUMAN)
MHMNVINTYM

SEQ ID NO: 107479 - protein, 9 aa, Artificial Sequence
  Description of Artificial Sequence: Synthetic peptide
  Seed: KFSLRRAVS (MAGC3_HUMAN)
KTSLRRAVA

SEQ ID NO: 107480 - protein, 10 aa, Artificial Sequence
  Description of Artificial Sequence: Synthetic peptide
  Seed: SWYMDALKDM (MAGC3_HUMAN)
SKYMDALKDF

SEQ ID NO: 107481 - protein, 9 aa, Artificial Sequence
  Description of Artificial Sequence: Synthetic peptide
  Seed: KFSLRRAVS (MAGC3_HUMAN)
KSSLRRAVA

SEQ ID NO: 107482 - protein, 9 aa, Artificial Sequence
  Description of Artificial Sequence: Synthetic peptide
  Seed: TEASPQQKK (MAGC3_HUMAN)
TSASPQQKR

SEQ ID NO: 107483 - protein, 9 aa, Artificial Sequence
  Description of Artificial Sequence: Synthetic peptide
  Seed: LSDEQGMPQ (MAGC3_HUMAN)
LLDEQGMPI

SEQ ID NO: 107484 - protein, 10 aa, Artificial Sequence
  Description of Artificial Sequence: Synthetic peptide
  Seed: KLSSIIPSAF (MAGC3_HUMAN)
KYSSIIPSAF

SEQ ID NO: 107485 - protein, 9 aa, Artificial Sequence
  Description of Artificial Sequence: Synthetic peptide
  Seed: KGSCVPEEV (MAGC3_HUMAN)
KLSCVPEEM

SEQ ID NO: 107486 - protein, 9 aa, Artificial Sequence
  Description of Artificial Sequence: Synthetic peptide
  Seed: IPSAFPSWY (MAGC3_HUMAN)
IVSAFPSWY

SEQ ID NO: 107487 - protein, 11 aa, Artificial Sequence
  Description of Artificial Sequence: Synthetic peptide
  Seed: LSKLSSIIPSA (MAGC3_HUMAN)
LSKLSSIIPSI

SEQ ID NO: 107488 - protein, 10 aa, Artificial Sequence
  Description of Artificial Sequence: Synthetic peptide
  Seed: ATYALSPVVL (MAGC3_HUMAN)
ADYALSPVVF

SEQ ID NO: 107489 - protein, 11 aa, Artificial Sequence
  Description of Artificial Sequence: Synthetic peptide
  Seed: KGSCVPEEVIW (MAGC3_HUMAN)
KTSCVPEEVIW

SEQ ID NO: 107490 - protein, 9 aa, Artificial Sequence
  Description of Artificial Sequence: Synthetic peptide
  Seed: DYFPMIFGK (MAGC3_HUMAN)
DTFPMIFGY

SEQ ID NO: 107491 - protein, 10 aa, Artificial Sequence
  Description of Artificial Sequence: Synthetic peptide
  Seed: FKLWRTLSGS (MAGC3_HUMAN)
FPLWRTLSGI

SEQ ID NO: 107492 - protein, 9 aa, Artificial Sequence
  Description of Artificial Sequence: Synthetic peptide
  Seed: VIWEVLSAI (MAGC3_HUMAN)
VQWEVLSAF

SEQ ID NO: 107493 - protein, 9 aa, Artificial Sequence
  Description of Artificial Sequence: Synthetic peptide
  Seed: RTLSGSPGL (MAGC3_HUMAN)
RILSGSPGW

SEQ ID NO: 107494 - protein, 8 aa, Artificial Sequence
  Description of Artificial Sequence: Synthetic peptide
  Seed: FIELIFGI (MAGC3_HUMAN)
FQELIFGL

SEQ ID NO: 107495 - protein, 8 aa, Artificial Sequence
  Description of Artificial Sequence: Synthetic peptide
  Seed: GYFPMIFR (MAGC3_HUMAN)
GMFPMIFR

SEQ ID NO: 107496 - protein, 11 aa, Artificial Sequence
  Description of Artificial Sequence: Synthetic peptide
  Seed: TLWKDSDLPTW (MAGC3_HUMAN)
TSWKDSDLPTF

SEQ ID NO: 107497 - protein, 11 aa, Artificial Sequence
  Description of Artificial Sequence: Synthetic peptide
  Seed: ALWESEGPEAF (MAGC3_HUMAN)
AMWESEGPEAW

SEQ ID NO: 107498 - protein, 11 aa, Artificial Sequence
  Description of Artificial Sequence: Synthetic peptide
  Seed: SVLDLANPQGL (MAGC3_HUMAN)
SQLDLANPQGI

SEQ ID NO: 107499 - protein, 9 aa, Artificial Sequence
  Description of Artificial Sequence: Synthetic peptide
  Seed: NAIGPWSAL (MAGC3_HUMAN)
NTIGPWSAV

SEQ ID NO: 107500 - protein, 10 aa, Artificial Sequence
  Description of Artificial Sequence: Synthetic peptide
  Seed: RLWGEKAGSL (MAGC3_HUMAN)
RIWGEKAGSW

SEQ ID NO: 107501 - protein, 9 aa, Artificial Sequence
  Description of Artificial Sequence: Synthetic peptide
  Seed: KVAELVQFL (MAGC3_HUMAN)
KMAELVQFI

SEQ ID NO: 107502 - protein, 10 aa, Artificial Sequence
  Description of Artificial Sequence: Synthetic peptide
  Seed: SLPAVSPGKR (MAGC3_HUMAN)
SYPAVSPGKR

SEQ ID NO: 107503 - protein, 11 aa, Artificial Sequence
  Description of Artificial Sequence: Synthetic peptide
  Seed: YFFEDTLDLTY (MAGC3_HUMAN)
YTFEDTLDLTY

SEQ ID NO: 107504 - protein, 9 aa, Artificial Sequence
  Description of Artificial Sequence: Synthetic peptide
  Seed: TLDEKVDKL (MAGC3_HUMAN)
TTDEKVDKY

SEQ ID NO: 107505 - protein, 8 aa, Artificial Sequence
  Description of Artificial Sequence: Synthetic peptide
  Seed: MPQNRLLI (MAGC3_HUMAN)
MPQNRLLL

SEQ ID NO: 107506 - protein, 8 aa, Artificial Sequence
  Description of Artificial Sequence: Synthetic peptide
  Seed: KVDKLVQF (MAGC3_HUMAN)
KSDKLVQM

SEQ ID NO: 107507 - protein, 9 aa, Artificial Sequence
  Description of Artificial Sequence: Synthetic peptide
  Seed: TRAEMQMNV (MAGC3_HUMAN)
THAEMQMNV

SEQ ID NO: 107508 - protein, 10 aa, Artificial Sequence
  Description of Artificial Sequence: Synthetic peptide
  Seed: LNAIGPWSAL (MAGC3_HUMAN)
LVAIGPWSAY

SEQ ID NO: 107509 - protein, 11 aa, Artificial Sequence
  Description of Artificial Sequence: Synthetic peptide
  Seed: ALAGFADVLSR (MAGC3_HUMAN)
AIAGFADVLSR

SEQ ID NO: 107510 - protein, 9 aa, Artificial Sequence
  Description of Artificial Sequence: Synthetic peptide
  Seed: LIDDQGMPK (MAGC3_HUMAN)
LADDQGMPI

SEQ ID NO: 107511 - protein, 10 aa, Artificial Sequence
  Description of Artificial Sequence: Synthetic peptide
  Seed: RSAEGSVLDL (MAGC3_HUMAN)
RLAEGSVLDW

SEQ ID NO: 107512 - protein, 9 aa, Artificial Sequence
  Description of Artificial Sequence: Synthetic peptide
  Seed: WEVLSAIGP (MAGC3_HUMAN)
WEVLSAIGA

SEQ ID NO: 107513 - protein, 10 aa, Artificial Sequence
  Description of Artificial Sequence: Synthetic peptide
  Seed: FPSWYMDALK (MAGC3_HUMAN)
FLSWYMDALK

SEQ ID NO: 107514 - protein, 8 aa, Artificial Sequence
  Description of Artificial Sequence: Synthetic peptide
  Seed: KVDKLVQF (MAGC3_HUMAN)
KIDKLVQM

SEQ ID NO: 107515 - protein, 9 aa, Artificial Sequence
  Description of Artificial Sequence: Synthetic peptide
  Seed: MIFGKAHEF (MAGC3_HUMAN)
MQFGKAHEH

SEQ ID NO: 107516 - protein, 9 aa, Artificial Sequence
  Description of Artificial Sequence: Synthetic peptide
  Seed: NAIGPWSAL (MAGC3_HUMAN)
NVIGPWSAR

SEQ ID NO: 107517 - protein, 8 aa, Artificial Sequence
  Description of Artificial Sequence: Synthetic peptide
  Seed: YMDALKDM (MAGC3_HUMAN)
YYDALKDF

SEQ ID NO: 107518 - protein, 9 aa, Artificial Sequence
  Description of Artificial Sequence: Synthetic peptide
  Seed: IIPSAFPSW (MAGC3_HUMAN)
ITPSAFPSY

SEQ ID NO: 107519 - protein, 9 aa, Artificial Sequence
  Description of Artificial Sequence: Synthetic peptide
  Seed: HLREVRLFL (MAGC3_HUMAN)
HYREVRLFK

SEQ ID NO: 107520 - protein, 10 aa, Artificial Sequence
  Description of Artificial Sequence: Synthetic peptide
  Seed: KVAELVQFLL (MAGC3_HUMAN)
KVAELVQFLV

SEQ ID NO: 107521 - protein, 9 aa, Artificial Sequence
  Description of Artificial Sequence: Synthetic peptide
  Seed: DVLSRLALW (MAGC3_HUMAN)
DALSRLALY

SEQ ID NO: 107522 - protein, 11 aa, Artificial Sequence
  Description of Artificial Sequence: Synthetic peptide
  Seed: ATFSDGSLGQW (MAGC3_HUMAN)
AMFSDGSLGQL

SEQ ID NO: 107523 - protein, 9 aa, Artificial Sequence
  Description of Artificial Sequence: Synthetic peptide
  Seed: FSLRRAVSV (MAGC3_HUMAN)
FSLRRAVSW

SEQ ID NO: 107524 - protein, 9 aa, Artificial Sequence
  Description of Artificial Sequence: Synthetic peptide
  Seed: FSDGSLGQW (MAGC3_HUMAN)
FDDGSLGQL

SEQ ID NO: 107525 - protein, 10 aa, Artificial Sequence
  Description of Artificial Sequence: Synthetic peptide
  Seed: TGYFPMIFRK (MAGC3_HUMAN)
TAYFPMIFRE

SEQ ID NO: 107526 - protein, 9 aa, Artificial Sequence
  Description of Artificial Sequence: Synthetic peptide
  Seed: AMASASPSV (MAGC3_HUMAN)
AIASASPSA

SEQ ID NO: 107527 - protein, 10 aa, Artificial Sequence
  Description of Artificial Sequence: Synthetic peptide
  Seed: EKVAELVQFL (MAGC3_HUMAN)
ENVAELVQFV

SEQ ID NO: 107528 - protein, 9 aa, Artificial Sequence
  Description of Artificial Sequence: Synthetic peptide
  Seed: CHWVLDATF (MAGC3_HUMAN)
CHWVLDATI

SEQ ID NO: 107529 - protein, 10 aa, Artificial Sequence
  Description of Artificial Sequence: Synthetic peptide
  Seed: MDPDNHSYFF (MAGC3_HUMAN)
MMPDNHSYFW

SEQ ID NO: 107530 - protein, 10 aa, Artificial Sequence
  Description of Artificial Sequence: Synthetic peptide
  Seed: KLSSIIPSAF (MAGC3_HUMAN)
KSSSIIPSAF

SEQ ID NO: 107531 - protein, 11 aa, Artificial Sequence
  Description of Artificial Sequence: Synthetic peptide
  Seed: SIIPSAFPSWY (MAGC3_HUMAN)
SMIPSAFPSWF

SEQ ID NO: 107532 - protein, 11 aa, Artificial Sequence
  Description of Artificial Sequence: Synthetic peptide
  Seed: ALWESEGPEAF (MAGC3_HUMAN)
AMWESEGPEAV

SEQ ID NO: 107533 - protein, 9 aa, Artificial Sequence
  Description of Artificial Sequence: Synthetic peptide
  Seed: KVDKLVQFL (MAGC3_HUMAN)
KYDKLVQFL

SEQ ID NO: 107534 - protein, 9 aa, Artificial Sequence
  Description of Artificial Sequence: Synthetic peptide
  Seed: IQRPAREVL (MAGC3_HUMAN)
IPRPAREVA

SEQ ID NO: 107535 - protein, 9 aa, Artificial Sequence
  Description of Artificial Sequence: Synthetic peptide
  Seed: CATYALSPV (MAGC3_HUMAN)
CATYALSPM

SEQ ID NO: 107536 - protein, 10 aa, Artificial Sequence
  Description of Artificial Sequence: Synthetic peptide
  Seed: EMLTTVIKKY (MAGC3_HUMAN)
EVLTTVIKKK

SEQ ID NO: 107537 - protein, 9 aa, Artificial Sequence
  Description of Artificial Sequence: Synthetic peptide
  Seed: CSSPLLWTR (MAGC3_HUMAN)
CGSPLLWTR

SEQ ID NO: 107538 - protein, 9 aa, Artificial Sequence
  Description of Artificial Sequence: Synthetic peptide
  Seed: NVINTYTGY (MAGC3_HUMAN)
NMINTYTGK

SEQ ID NO: 107539 - protein, 9 aa, Artificial Sequence
  Description of Artificial Sequence: Synthetic peptide
  Seed: MPAAGMPPL (MAGC3_HUMAN)
MWAAGMPPM

SEQ ID NO: 107540 - protein, 10 aa, Artificial Sequence
  Description of Artificial Sequence: Synthetic peptide
  Seed: KLVQFLLLKY (MAGC3_HUMAN)
KTVQFLLLKR

SEQ ID NO: 107541 - protein, 11 aa, Artificial Sequence
  Description of Artificial Sequence: Synthetic peptide
  Seed: ILFGISLTEVD (MAGC3_HUMAN)
ILFGISLTEVW

SEQ ID NO: 107542 - protein, 9 aa, Artificial Sequence
  Description of Artificial Sequence: Synthetic peptide
  Seed: YFFEDTLDL (MAGC3_HUMAN)
YQFEDTLDA

SEQ ID NO: 107543 - protein, 9 aa, Artificial Sequence
  Description of Artificial Sequence: Synthetic peptide
  Seed: QTKEPVTKA (MAGC3_HUMAN)
QSKEPVTKL

SEQ ID NO: 107544 - protein, 9 aa, Artificial Sequence
  Description of Artificial Sequence: Synthetic peptide
  Seed: KAHEFIELI (MAGC3_HUMAN)
KAHEFIELW

SEQ ID NO: 107545 - protein, 8 aa, Artificial Sequence
  Description of Artificial Sequence: Synthetic peptide
  Seed: MEDRAQAI (MAGC3_HUMAN)
MADRAQAM

SEQ ID NO: 107546 - protein, 9 aa, Artificial Sequence
  Description of Artificial Sequence: Synthetic peptide
  Seed: AAGMPPLPQ (MAGC3_HUMAN)
AAGMPPLPM

SEQ ID NO: 107547 - protein, 9 aa, Artificial Sequence
  Description of Artificial Sequence: Synthetic peptide
  Seed: SQPEGKFSL (MAGC3_HUMAN)
SKPEGKFSY

SEQ ID NO: 107548 - protein, 10 aa, Artificial Sequence
  Description of Artificial Sequence: Synthetic peptide
  Seed: AMASASPSVM (MAGC3_HUMAN)
AMASASPSVY

SEQ ID NO: 107549 - protein, 10 aa, Artificial Sequence
  Description of Artificial Sequence: Synthetic peptide
  Seed: YALDEKVAEL (MAGC3_HUMAN)
YMLDEKVAEF

SEQ ID NO: 107550 - protein, 9 aa, Artificial Sequence
  Description of Artificial Sequence: Synthetic peptide
  Seed: KVDKLVQFL (MAGC3_HUMAN)
KIDKLVQFL

SEQ ID NO: 107551 - protein, 10 aa, Artificial Sequence
  Description of Artificial Sequence: Synthetic peptide
  Seed: KKYKDYFPMI (MAGC3_HUMAN)
KHYKDYFPMF

SEQ ID NO: 107552 - protein, 9 aa, Artificial Sequence
  Description of Artificial Sequence: Synthetic peptide
  Seed: LRSAEGSVL (MAGC3_HUMAN)
LASAEGSVY

SEQ ID NO: 107553 - protein, 9 aa, Artificial Sequence
  Description of Artificial Sequence: Synthetic peptide
  Seed: MLLPCHWVL (MAGC3_HUMAN)
MHLPCHWVF

SEQ ID NO: 107554 - protein, 10 aa, Artificial Sequence
  Description of Artificial Sequence: Synthetic peptide
  Seed: YALDEKVAEL (MAGC3_HUMAN)
YQLDEKVAEV

SEQ ID NO: 107555 - protein, 10 aa, Artificial Sequence
  Description of Artificial Sequence: Synthetic peptide
  Seed: EVIWEVLSAI (MAGC3_HUMAN)
ESIWEVLSAF

SEQ ID NO: 107556 - protein, 8 aa, Artificial Sequence
  Description of Artificial Sequence: Synthetic peptide
  Seed: LTYEGSLI (MAGC3_HUMAN)
LTYEGSLW

SEQ ID NO: 107557 - protein, 11 aa, Artificial Sequence
  Description of Artificial Sequence: Synthetic peptide
  Seed: SSSEEEDTATW (MAGC3_HUMAN)
SSSEEEDTATY

SEQ ID NO: 107558 - protein, 9 aa, Artificial Sequence
  Description of Artificial Sequence: Synthetic peptide
  Seed: MDPDNHSYF (MAGC3_HUMAN)
MMPDNHSYY

SEQ ID NO: 107559 - protein, 9 aa, Artificial Sequence
  Description of Artificial Sequence: Synthetic peptide
  Seed: EKVDKLVQF (MAGC3_HUMAN)
EIVDKLVQF

SEQ ID NO: 107560 - protein, 10 aa, Artificial Sequence
  Description of Artificial Sequence: Synthetic peptide
  Seed: ILILSVIFIK (MAGC3_HUMAN)
IHILSVIFIR

SEQ ID NO: 107561 - protein, 9 aa, Artificial Sequence
  Description of Artificial Sequence: Synthetic peptide
  Seed: NAIGPWSAL (MAGC3_HUMAN)
NVIGPWSAY

SEQ ID NO: 107562 - protein, 9 aa, Artificial Sequence
  Description of Artificial Sequence: Synthetic peptide
  Seed: MIFRKAREF (MAGC3_HUMAN)
MHFRKAREY

SEQ ID NO: 107563 - protein, 9 aa, Artificial Sequence
  Description of Artificial Sequence: Synthetic peptide
  Seed: DGSLGQWVK (MAGC3_HUMAN)
DISLGQWVR

SEQ ID NO: 107564 - protein, 9 aa, Artificial Sequence
  Description of Artificial Sequence: Synthetic peptide
  Seed: LIDDQGMPK (MAGC3_HUMAN)
LSDDQGMPV

SEQ ID NO: 107565 - protein, 9 aa, Artificial Sequence
  Description of Artificial Sequence: Synthetic peptide
  Seed: TLDEKVDKL (MAGC3_HUMAN)
TLDEKVDKF

SEQ ID NO: 107566 - protein, 9 aa, Artificial Sequence
  Description of Artificial Sequence: Synthetic peptide
  Seed: FPSWYMDAL (MAGC3_HUMAN)
FPSWYMDAG

SEQ ID NO: 107567 - protein, 10 aa, Artificial Sequence
  Description of Artificial Sequence: Synthetic peptide
  Seed: ILFGISLTEV (MAGC3_HUMAN)
IVFGISLTEA

SEQ ID NO: 107568 - protein, 9 aa, Artificial Sequence
  Description of Artificial Sequence: Synthetic peptide
  Seed: EVDPDHFYV (MAGC3_HUMAN)
EVDPDHFYM

SEQ ID NO: 107569 - protein, 9 aa, Artificial Sequence
  Description of Artificial Sequence: Synthetic peptide
  Seed: AMASASPSV (MAGC3_HUMAN)
AQASASPSV

SEQ ID NO: 107570 - protein, 9 aa, Artificial Sequence
  Description of Artificial Sequence: Synthetic peptide
  Seed: SIIPSAFPS (MAGC3_HUMAN)
SIIPSAFPI

SEQ ID NO: 107571 - protein, 10 aa, Artificial Sequence
  Description of Artificial Sequence: Synthetic peptide
  Seed: REVLEFLSKL (MAGC3_HUMAN)
RNVLEFLSKV

SEQ ID NO: 107572 - protein, 9 aa, Artificial Sequence
  Description of Artificial Sequence: Synthetic peptide
  Seed: YSAFHLGHL (MAGC3_HUMAN)
YVAFHLGHF

SEQ ID NO: 107573 - protein, 9 aa, Artificial Sequence
  Description of Artificial Sequence: Synthetic peptide
  Seed: ALDEKVAEL (MAGC3_HUMAN)
AIDEKVAEV

SEQ ID NO: 107574 - protein, 9 aa, Artificial Sequence
  Description of Artificial Sequence: Synthetic peptide
  Seed: FSDGSLGQW (MAGC3_HUMAN)
FADGSLGQF

SEQ ID NO: 107575 - protein, 9 aa, Artificial Sequence
  Description of Artificial Sequence: Synthetic peptide
  Seed: KAHEFIELI (MAGC3_HUMAN)
KQHEFIELL

SEQ ID NO: 107576 - protein, 9 aa, Artificial Sequence
  Description of Artificial Sequence: Synthetic peptide
  Seed: MIFRKAREF (MAGC3_HUMAN)
MKFRKAREL

SEQ ID NO: 107577 - protein, 9 aa, Artificial Sequence
  Description of Artificial Sequence: Synthetic peptide
  Seed: SLRRAVSVK (MAGC3_HUMAN)
SMRRAVSVA

SEQ ID NO: 107578 - protein, 9 aa, Artificial Sequence
  Description of Artificial Sequence: Synthetic peptide
  Seed: FSDGSLGQW (MAGC3_HUMAN)
FCDGSLGQM

SEQ ID NO: 107579 - protein, 10 aa, Artificial Sequence
  Description of Artificial Sequence: Synthetic peptide
  Seed: TGYFPMIFRK (MAGC3_HUMAN)
TTYFPMIFRH

SEQ ID NO: 107580 - protein, 10 aa, Artificial Sequence
  Description of Artificial Sequence: Synthetic peptide
  Seed: KVAELVQFLL (MAGC3_HUMAN)
KQAELVQFLW

SEQ ID NO: 107581 - protein, 9 aa, Artificial Sequence
  Description of Artificial Sequence: Synthetic peptide
  Seed: QLSDLHFGS (MAGC3_HUMAN)
QLSDLHFGI

SEQ ID NO: 107582 - protein, 11 aa, Artificial Sequence
  Description of Artificial Sequence: Synthetic peptide
  Seed: VLEFLSKLSSI (MAGC3_HUMAN)
VMEFLSKLSSV

SEQ ID NO: 107583 - protein, 11 aa, Artificial Sequence
  Description of Artificial Sequence: Synthetic peptide
  Seed: DSLVLCPTYFK (MAGC3_HUMAN)
DKLVLCPTYFR

SEQ ID NO: 107584 - protein, 9 aa, Artificial Sequence
  Description of Artificial Sequence: Synthetic peptide
  Seed: LKYQAKEPL (MAGC3_HUMAN)
LRYQAKEPM

SEQ ID NO: 107585 - protein, 11 aa, Artificial Sequence
  Description of Artificial Sequence: Synthetic peptide
  Seed: TTDDATAMASA (MAGC3_HUMAN)
TIDDATAMASI

SEQ ID NO: 107586 - protein, 9 aa, Artificial Sequence
  Description of Artificial Sequence: Synthetic peptide
  Seed: GYFPMIFRK (MAGC3_HUMAN)
GQFPMIFRK

SEQ ID NO: 107587 - protein, 9 aa, Artificial Sequence
  Description of Artificial Sequence: Synthetic peptide
  Seed: TLDEKVDKL (MAGC3_HUMAN)
TQDEKVDKW

SEQ ID NO: 107588 - protein, 10 aa, Artificial Sequence
  Description of Artificial Sequence: Synthetic peptide
  Seed: IIDTTDDATA (MAGC3_HUMAN)
IADTTDDATL

SEQ ID NO: 107589 - protein, 11 aa, Artificial Sequence
  Description of Artificial Sequence: Synthetic peptide
  Seed: INTYTGYFPMI (MAGC3_HUMAN)
IQTYTGYFPMF

SEQ ID NO: 107590 - protein, 11 aa, Artificial Sequence
  Description of Artificial Sequence: Synthetic peptide
  Seed: AEMQMNVINTY (MAGC3_HUMAN)
AHMQMNVINTF

SEQ ID NO: 107591 - protein, 10 aa, Artificial Sequence
  Description of Artificial Sequence: Synthetic peptide
  Seed: YALDEKVAEL (MAGC3_HUMAN)
YCLDEKVAEA

SEQ ID NO: 107592 - protein, 10 aa, Artificial Sequence
  Description of Artificial Sequence: Synthetic peptide
  Seed: YALDEKVAEL (MAGC3_HUMAN)
YTLDEKVAET

SEQ ID NO: 107593 - protein, 10 aa, Artificial Sequence
  Description of Artificial Sequence: Synthetic peptide
  Seed: MIFGKAHEFI (MAGC3_HUMAN)
MAFGKAHEFV

SEQ ID NO: 107594 - protein, 9 aa, Artificial Sequence
  Description of Artificial Sequence: Synthetic peptide
  Seed: TEVDPDHFY (MAGC3_HUMAN)
TEVDPDHFW

SEQ ID NO: 107595 - protein, 9 aa, Artificial Sequence
  Description of Artificial Sequence: Synthetic peptide
  Seed: EKVDKLVQF (MAGC3_HUMAN)
ERVDKLVQF

SEQ ID NO: 107596 - protein, 9 aa, Artificial Sequence
  Description of Artificial Sequence: Synthetic peptide
  Seed: MIFRKAREF (MAGC3_HUMAN)
MLFRKAREF

SEQ ID NO: 107597 - protein, 9 aa, Artificial Sequence
  Description of Artificial Sequence: Synthetic peptide
  Seed: MQMNVINTY (MAGC3_HUMAN)
MLMNVINTY

SEQ ID NO: 107598 - protein, 9 aa, Artificial Sequence
  Description of Artificial Sequence: Synthetic peptide
  Seed: IPPQGPPKI (MAGC3_HUMAN)
IIPQGPPKI

SEQ ID NO: 107599 - protein, 9 aa, Artificial Sequence
  Description of Artificial Sequence: Synthetic peptide
  Seed: KVAELVQFL (MAGC3_HUMAN)
KGAELVQFF

SEQ ID NO: 107600 - protein, 10 aa, Artificial Sequence
  Description of Artificial Sequence: Synthetic peptide
  Seed: TLDEKVDKLV (MAGC3_HUMAN)
TWDEKVDKLF

SEQ ID NO: 107601 - protein, 10 aa, Artificial Sequence
  Description of Artificial Sequence: Synthetic peptide
  Seed: SCSSPLLWTR (MAGC3_HUMAN)
SPSSPLLWTK

SEQ ID NO: 107602 - protein, 10 aa, Artificial Sequence
  Description of Artificial Sequence: Synthetic peptide
  Seed: IKKYKDYFPM (MAGC3_HUMAN)
IRKYKDYFPY

SEQ ID NO: 107603 - protein, 10 aa, Artificial Sequence
  Description of Artificial Sequence: Synthetic peptide
  Seed: YALDEKVAEL (MAGC3_HUMAN)
YSLDEKVAEA

SEQ ID NO: 107604 - protein, 11 aa, Artificial Sequence
  Description of Artificial Sequence: Synthetic peptide
  Seed: LSDEQGMPQNR (MAGC3_HUMAN)
LIDEQGMPQNY

SEQ ID NO: 107605 - protein, 11 aa, Artificial Sequence
  Description of Artificial Sequence: Synthetic peptide
  Seed: TLWKDSDLPTW (MAGC3_HUMAN)
TAWKDSDLPTW

SEQ ID NO: 107606 - protein, 10 aa, Artificial Sequence
  Description of Artificial Sequence: Synthetic peptide
  Seed: ALDEKVAELV (MAGC3_HUMAN)
ATDEKVAELM

SEQ ID NO: 107607 - protein, 10 aa, Artificial Sequence
  Description of Artificial Sequence: Synthetic peptide
  Seed: KLSSIIPSAF (MAGC3_HUMAN)
KVSSIIPSAY

SEQ ID NO: 107608 - protein, 10 aa, Artificial Sequence
  Description of Artificial Sequence: Synthetic peptide
  Seed: LNAIGPWSAL (MAGC3_HUMAN)
LVAIGPWSAM

SEQ ID NO: 107609 - protein, 9 aa, Artificial Sequence
  Description of Artificial Sequence: Synthetic peptide
  Seed: SLRRAVSVK (MAGC3_HUMAN)
SIRRAVSVM

SEQ ID NO: 107610 - protein, 10 aa, Artificial Sequence
  Description of Artificial Sequence: Synthetic peptide
  Seed: LNAIGPWSAL (MAGC3_HUMAN)
LHAIGPWSAM

SEQ ID NO: 107611 - protein, 10 aa, Artificial Sequence
  Description of Artificial Sequence: Synthetic peptide
  Seed: SIIPSAFPSW (MAGC3_HUMAN)
SQIPSAFPSF

SEQ ID NO: 107612 - protein, 9 aa, Artificial Sequence
  Description of Artificial Sequence: Synthetic peptide
  Seed: RTLSGSPGL (MAGC3_HUMAN)
RILSGSPGK

SEQ ID NO: 107613 - protein, 10 aa, Artificial Sequence
  Description of Artificial Sequence: Synthetic peptide
  Seed: LNAIGPWSAL (MAGC3_HUMAN)
LWAIGPWSAY

SEQ ID NO: 107614 - protein, 9 aa, Artificial Sequence
  Description of Artificial Sequence: Synthetic peptide
  Seed: EVLEFLSKL (MAGC3_HUMAN)
EQLEFLSKL

SEQ ID NO: 107615 - protein, 10 aa, Artificial Sequence
  Description of Artificial Sequence: Synthetic peptide
  Seed: KDYFPMIFGK (MAGC3_HUMAN)
KPYFPMIFGK

SEQ ID NO: 107616 - protein, 11 aa, Artificial Sequence
  Description of Artificial Sequence: Synthetic peptide
  Seed: KFSLRRAVSVK (MAGC3_HUMAN)
KASLRRAVSVK

SEQ ID NO: 107617 - protein, 10 aa, Artificial Sequence
  Description of Artificial Sequence: Synthetic peptide
  Seed: ALDEKVAELV (MAGC3_HUMAN)
ACDEKVAELL

SEQ ID NO: 107618 - protein, 9 aa, Artificial Sequence
  Description of Artificial Sequence: Synthetic peptide
  Seed: IPPQGPPKI (MAGC3_HUMAN)
IFPQGPPKV

SEQ ID NO: 107619 - protein, 9 aa, Artificial Sequence
  Description of Artificial Sequence: Synthetic peptide
  Seed: KLVQFLLLK (MAGC3_HUMAN)
KMVQFLLLT

SEQ ID NO: 107620 - protein, 10 aa, Artificial Sequence
  Description of Artificial Sequence: Synthetic peptide
  Seed: WVKNTCATYA (MAGC3_HUMAN)
WQKNTCATYW

SEQ ID NO: 107621 - protein, 9 aa, Artificial Sequence
  Description of Artificial Sequence: Synthetic peptide
  Seed: TLDEKVDKL (MAGC3_HUMAN)
TIDEKVDKI

SEQ ID NO: 107622 - protein, 10 aa, Artificial Sequence
  Description of Artificial Sequence: Synthetic peptide
  Seed: VLDLANPQGL (MAGC3_HUMAN)
VWDLANPQGM

SEQ ID NO: 107623 - protein, 10 aa, Artificial Sequence
  Description of Artificial Sequence: Synthetic peptide
  Seed: MQMNVINTYT (MAGC3_HUMAN)
MAMNVINTYY

SEQ ID NO: 107624 - protein, 9 aa, Artificial Sequence
  Description of Artificial Sequence: Synthetic peptide
  Seed: RTLSGSPGL (MAGC3_HUMAN)
RILSGSPGV

SEQ ID NO: 107625 - protein, 9 aa, Artificial Sequence
  Description of Artificial Sequence: Synthetic peptide
  Seed: MLLPCHWVL (MAGC3_HUMAN)
MTLPCHWVY

SEQ ID NO: 107626 - protein, 11 aa, Artificial Sequence
  Description of Artificial Sequence: Synthetic peptide
  Seed: YFFEDTLDLTY (MAGC3_HUMAN)
YAFEDTLDLTF

SEQ ID NO: 107627 - protein, 9 aa, Artificial Sequence
  Description of Artificial Sequence: Synthetic peptide
  Seed: DEKVDKLVQ (MAGC3_HUMAN)
DEKVDKLVY

SEQ ID NO: 107628 - protein, 11 aa, Artificial Sequence
  Description of Artificial Sequence: Synthetic peptide
  Seed: EVLSAIGPIQR (MAGC3_HUMAN)
EILSAIGPIQK

SEQ ID NO: 107629 - protein, 10 aa, Artificial Sequence
  Description of Artificial Sequence: Synthetic peptide
  Seed: IKKYKDYFPM (MAGC3_HUMAN)
INKYKDYFPY

SEQ ID NO: 107630 - protein, 9 aa, Artificial Sequence
  Description of Artificial Sequence: Synthetic peptide
  Seed: MIFGKAHEF (MAGC3_HUMAN)
MMFGKAHES

SEQ ID NO: 107631 - protein, 10 aa, Artificial Sequence
  Description of Artificial Sequence: Synthetic peptide
  Seed: FSDGSLGQWV (MAGC3_HUMAN)
FMDGSLGQWL

SEQ ID NO: 107632 - protein, 10 aa, Artificial Sequence
  Description of Artificial Sequence: Synthetic peptide
  Seed: TGYFPMIFRK (MAGC3_HUMAN)
TMYFPMIFRD

SEQ ID NO: 107633 - protein, 9 aa, Artificial Sequence
  Description of Artificial Sequence: Synthetic peptide
  Seed: AVSPGKRLW (MAGC3_HUMAN)
ALSPGKRLW

SEQ ID NO: 107634 - protein, 9 aa, Artificial Sequence
  Description of Artificial Sequence: Synthetic peptide
  Seed: WRRGTGYTL (MAGC3_HUMAN)
WKRGTGYTL

SEQ ID NO: 107635 - protein, 9 aa, Artificial Sequence
  Description of Artificial Sequence: Synthetic peptide
  Seed: FPSWYMDAL (MAGC3_HUMAN)
FPSWYMDAS

SEQ ID NO: 107636 - protein, 10 aa, Artificial Sequence
  Description of Artificial Sequence: Synthetic peptide
  Seed: MDPDNHSYFF (MAGC3_HUMAN)
MLPDNHSYFF

SEQ ID NO: 107637 - protein, 11 aa, Artificial Sequence
  Description of Artificial Sequence: Synthetic peptide
  Seed: IIDTTDDATAM (MAGC3_HUMAN)
IQDTTDDATAM

SEQ ID NO: 107638 - protein, 9 aa, Artificial Sequence
  Description of Artificial Sequence: Synthetic peptide
  Seed: HSYFFEDTL (MAGC3_HUMAN)
HMYFFEDTM

SEQ ID NO: 107639 - protein, 9 aa, Artificial Sequence
  Description of Artificial Sequence: Synthetic peptide
  Seed: TSDQRMDSL (MAGC3_HUMAN)
TLDQRMDSI

SEQ ID NO: 107640 - protein, 10 aa, Artificial Sequence
  Description of Artificial Sequence: Synthetic peptide
  Seed: KLSSIIPSAF (MAGC3_HUMAN)
KCSSIIPSAF

SEQ ID NO: 107641 - protein, 10 aa, Artificial Sequence
  Description of Artificial Sequence: Synthetic peptide
  Seed: AFPSWYMDAL (MAGC3_HUMAN)
AYPSWYMDAW

SEQ ID NO: 107642 - protein, 9 aa, Artificial Sequence
  Description of Artificial Sequence: Synthetic peptide
  Seed: MIFGKAHEF (MAGC3_HUMAN)
MWFGKAHEM

SEQ ID NO: 107643 - protein, 9 aa, Artificial Sequence
  Description of Artificial Sequence: Synthetic peptide
  Seed: IPPQGPPKI (MAGC3_HUMAN)
IGPQGPPKI

SEQ ID NO: 107644 - protein, 9 aa, Artificial Sequence
  Description of Artificial Sequence: Synthetic peptide
  Seed: MIFGKAHEF (MAGC3_HUMAN)
MDFGKAHEF

SEQ ID NO: 107645 - protein, 9 aa, Artificial Sequence
  Description of Artificial Sequence: Synthetic peptide
  Seed: EFIELIFGI (MAGC3_HUMAN)
EIIELIFGV

SEQ ID NO: 107646 - protein, 10 aa, Artificial Sequence
  Description of Artificial Sequence: Synthetic peptide
  Seed: LLKYQAKEPL (MAGC3_HUMAN)
LLKYQAKEPF

SEQ ID NO: 107647 - protein, 9 aa, Artificial Sequence
  Description of Artificial Sequence: Synthetic peptide
  Seed: TKAEMLTTV (MAGC3_HUMAN)
TLAEMLTTI

SEQ ID NO: 107648 - protein, 9 aa, Artificial Sequence
  Description of Artificial Sequence: Synthetic peptide
  Seed: VLCPTYFKL (MAGC3_HUMAN)
VACPTYFKM

SEQ ID NO: 107649 - protein, 9 aa, Artificial Sequence
  Description of Artificial Sequence: Synthetic peptide
  Seed: AIGPWSALA (MAGC3_HUMAN)
AQGPWSALI

SEQ ID NO: 107650 - protein, 9 aa, Artificial Sequence
  Description of Artificial Sequence: Synthetic peptide
  Seed: MIFGKAHEF (MAGC3_HUMAN)
MRFGKAHEM

SEQ ID NO: 107651 - protein, 9 aa, Artificial Sequence
  Description of Artificial Sequence: Synthetic peptide
  Seed: QTKEPVTKA (MAGC3_HUMAN)
QTKEPVTKV

SEQ ID NO: 107652 - protein, 8 aa, Artificial Sequence
  Description of Artificial Sequence: Synthetic peptide
  Seed: AEMLTTVI (MAGC3_HUMAN)
AQMLTTVV

SEQ ID NO: 107653 - protein, 9 aa, Artificial Sequence
  Description of Artificial Sequence: Synthetic peptide
  Seed: FSDGSLGQW (MAGC3_HUMAN)
FADGSLGQW

SEQ ID NO: 107654 - protein, 10 aa, Artificial Sequence
  Description of Artificial Sequence: Synthetic peptide
  Seed: KYKDYFPMIF (MAGC3_HUMAN)
KYKDYFPMIL

SEQ ID NO: 107655 - protein, 9 aa, Artificial Sequence
  Description of Artificial Sequence: Synthetic peptide
  Seed: TYFKLWRTL (MAGC3_HUMAN)
TAFKLWRTY

SEQ ID NO: 107656 - protein, 9 aa, Artificial Sequence
  Description of Artificial Sequence: Synthetic peptide
  Seed: SLVLCPTYF (MAGC3_HUMAN)
SAVLCPTYL

SEQ ID NO: 107657 - protein, 9 aa, Artificial Sequence
  Description of Artificial Sequence: Synthetic peptide
  Seed: SCVPEEVIW (MAGC3_HUMAN)
SVVPEEVIW

SEQ ID NO: 107658 - protein, 9 aa, Artificial Sequence
  Description of Artificial Sequence: Synthetic peptide
  Seed: FPMIFGKAH (MAGC3_HUMAN)
FAMIFGKAY

SEQ ID NO: 107659 - protein, 10 aa, Artificial Sequence
  Description of Artificial Sequence: Synthetic peptide
  Seed: REVRLFLRGG (MAGC3_HUMAN)
RTVRLFLRGS

SEQ ID NO: 107660 - protein, 9 aa, Artificial Sequence
  Description of Artificial Sequence: Synthetic peptide
  Seed: AGFADVLSR (MAGC3_HUMAN)
AMFADVLSY

SEQ ID NO: 107661 - protein, 9 aa, Artificial Sequence
  Description of Artificial Sequence: Synthetic peptide
  Seed: YSAFHLGHL (MAGC3_HUMAN)
YVAFHLGHW

SEQ ID NO: 107662 - protein, 9 aa, Artificial Sequence
  Description of Artificial Sequence: Synthetic peptide
  Seed: ALDEKVAEL (MAGC3_HUMAN)
ANDEKVAEM

SEQ ID NO: 107663 - protein, 10 aa, Artificial Sequence
  Description of Artificial Sequence: Synthetic peptide
  Seed: EMQMNVINTY (MAGC3_HUMAN)
EFQMNVINTM

SEQ ID NO: 107664 - protein, 9 aa, Artificial Sequence
  Description of Artificial Sequence: Synthetic peptide
  Seed: MIFRKAREF (MAGC3_HUMAN)
MRFRKAREF

SEQ ID NO: 107665 - protein, 9 aa, Artificial Sequence
  Description of Artificial Sequence: Synthetic peptide
  Seed: EVLNAIGPW (MAGC3_HUMAN)
EVLNAIGPL

SEQ ID NO: 107666 - protein, 9 aa, Artificial Sequence
  Description of Artificial Sequence: Synthetic peptide
  Seed: EVIWEVLSA (MAGC3_HUMAN)
EAIWEVLSV

SEQ ID NO: 107667 - protein, 10 aa, Artificial Sequence
  Description of Artificial Sequence: Synthetic peptide
  Seed: LLILILSMIF (MAGC3_HUMAN)
LQILILSMIY

SEQ ID NO: 107668 - protein, 9 aa, Artificial Sequence
  Description of Artificial Sequence: Synthetic peptide
  Seed: GQWVKNTCA (MAGC3_HUMAN)
GEWVKNTCP

SEQ ID NO: 107669 - protein, 9 aa, Artificial Sequence
  Description of Artificial Sequence: Synthetic peptide
  Seed: EKVDKLVQF (MAGC3_HUMAN)
EEVDKLVQY

SEQ ID NO: 107670 - protein, 9 aa, Artificial Sequence
  Description of Artificial Sequence: Synthetic peptide
  Seed: VIWEVLNAI (MAGC3_HUMAN)
VSWEVLNAY

SEQ ID NO: 107671 - protein, 9 aa, Artificial Sequence
  Description of Artificial Sequence: Synthetic peptide
  Seed: FPMIFRKAR (MAGC3_HUMAN)
FPMIFRKAL

SEQ ID NO: 107672 - protein, 10 aa, Artificial Sequence
  Description of Artificial Sequence: Synthetic peptide
  Seed: KLSSIIPSAF (MAGC3_HUMAN)
KISSIIPSAR

SEQ ID NO: 107673 - protein, 9 aa, Artificial Sequence
  Description of Artificial Sequence: Synthetic peptide
  Seed: HLREVRLFL (MAGC3_HUMAN)
HLREVRLFW

SEQ ID NO: 107674 - protein, 9 aa, Artificial Sequence
  Description of Artificial Sequence: Synthetic peptide
  Seed: ISPQGPPQS (MAGC3_HUMAN)
ILPQGPPQI

SEQ ID NO: 107675 - protein, 9 aa, Artificial Sequence
  Description of Artificial Sequence: Synthetic peptide
  Seed: NTYTGYFPM (MAGC3_HUMAN)
NMYTGYFPS

SEQ ID NO: 107676 - protein, 9 aa, Artificial Sequence
  Description of Artificial Sequence: Synthetic peptide
  Seed: KLVQFLLLK (MAGC3_HUMAN)
KIVQFLLLA

SEQ ID NO: 107677 - protein, 9 aa, Artificial Sequence
  Description of Artificial Sequence: Synthetic peptide
  Seed: SQPEGKFSL (MAGC3_HUMAN)
SHPEGKFSL

SEQ ID NO: 107678 - protein, 9 aa, Artificial Sequence
  Description of Artificial Sequence: Synthetic peptide
  Seed: MIFGKAHEF (MAGC3_HUMAN)
MRFGKAHEL

SEQ ID NO: 107679 - protein, 10 aa, Artificial Sequence
  Description of Artificial Sequence: Synthetic peptide
  Seed: SKLSSIIPSA (MAGC3_HUMAN)
SFLSSIIPSL

SEQ ID NO: 107680 - protein, 9 aa, Artificial Sequence
  Description of Artificial Sequence: Synthetic peptide
  Seed: YQAKEPLTR (MAGC3_HUMAN)
YAAKEPLTI

SEQ ID NO: 107681 - protein, 9 aa, Artificial Sequence
  Description of Artificial Sequence: Synthetic peptide
  Seed: FPSWYMDAL (MAGC3_HUMAN)
FSSWYMDAI

SEQ ID NO: 107682 - protein, 10 aa, Artificial Sequence
  Description of Artificial Sequence: Synthetic peptide
  Seed: LNAIGPWSAL (MAGC3_HUMAN)
LWAIGPWSAF

SEQ ID NO: 107683 - protein, 9 aa, Artificial Sequence
  Description of Artificial Sequence: Synthetic peptide
  Seed: KAHEFIELI (MAGC3_HUMAN)
KQHEFIELI

SEQ ID NO: 107684 - protein, 9 aa, Artificial Sequence
  Description of Artificial Sequence: Synthetic peptide
  Seed: DYSAFHLGH (MAGC3_HUMAN)
DYSAFHLGK

SEQ ID NO: 107685 - protein, 9 aa, Artificial Sequence
  Description of Artificial Sequence: Synthetic peptide
  Seed: HALPESESL (MAGC3_HUMAN)
HGLPESESW

SEQ ID NO: 107686 - protein, 10 aa, Artificial Sequence
  Description of Artificial Sequence: Synthetic peptide
  Seed: EVIWEVLNAI (MAGC3_HUMAN)
EVIWEVLNAK

SEQ ID NO: 107687 - protein, 11 aa, Artificial Sequence
  Description of Artificial Sequence: Synthetic peptide
  Seed: ATDKDYSAFHL (MAGC3_HUMAN)
AVDKDYSAFHY

SEQ ID NO: 107688 - protein, 9 aa, Artificial Sequence
  Description of Artificial Sequence: Synthetic peptide
  Seed: FLSKLSSII (MAGC3_HUMAN)
FVSKLSSIV

SEQ ID NO: 107689 - protein, 9 aa, Artificial Sequence
  Description of Artificial Sequence: Synthetic peptide
  Seed: MQMNVINTY (MAGC3_HUMAN)
MPMNVINTI

SEQ ID NO: 107690 - protein, 9 aa, Artificial Sequence
  Description of Artificial Sequence: Synthetic peptide
  Seed: KQREEPQDW (MAGC3_HUMAN)
KQREEPQDF

SEQ ID NO: 107691 - protein, 9 aa, Artificial Sequence
  Description of Artificial Sequence: Synthetic peptide
  Seed: SQPEGKFSL (MAGC3_HUMAN)
SSPEGKFSY

SEQ ID NO: 107692 - protein, 9 aa, Artificial Sequence
  Description of Artificial Sequence: Synthetic peptide
  Seed: LIDDQGMPK (MAGC3_HUMAN)
LGDDQGMPI

SEQ ID NO: 107693 - protein, 9 aa, Artificial Sequence
  Description of Artificial Sequence: Synthetic peptide
  Seed: MIFGKAHEF (MAGC3_HUMAN)
MTFGKAHEA

SEQ ID NO: 107694 - protein, 8 aa, Artificial Sequence
  Description of Artificial Sequence: Synthetic peptide
  Seed: KVDKLVQF (MAGC3_HUMAN)
KYDKLVQL

SEQ ID NO: 107695 - protein, 10 aa, Artificial Sequence
  Description of Artificial Sequence: Synthetic peptide
  Seed: TGYFPMIFRK (MAGC3_HUMAN)
TVYFPMIFRT

SEQ ID NO: 107696 - protein, 9 aa, Artificial Sequence
  Description of Artificial Sequence: Synthetic peptide
  Seed: KQREEPQDW (MAGC3_HUMAN)
KEREEPQDY

SEQ ID NO: 107697 - protein, 9 aa, Artificial Sequence
  Description of Artificial Sequence: Synthetic peptide
  Seed: VINTYTGYF (MAGC3_HUMAN)
VFNTYTGYL

SEQ ID NO: 107698 - protein, 10 aa, Artificial Sequence
  Description of Artificial Sequence: Synthetic peptide
  Seed: SALAGFADVL (MAGC3_HUMAN)
SMLAGFADVL

SEQ ID NO: 107699 - protein, 10 aa, Artificial Sequence
  Description of Artificial Sequence: Synthetic peptide
  Seed: SKLSSIIPSA (MAGC3_HUMAN)
SWLSSIIPSA

SEQ ID NO: 107700 - protein, 11 aa, Artificial Sequence
  Description of Artificial Sequence: Synthetic peptide
  Seed: VINTYTGYFPM (MAGC3_HUMAN)
VSNTYTGYFPF

SEQ ID NO: 107701 - protein, 8 aa, Artificial Sequence
  Description of Artificial Sequence: Synthetic peptide
  Seed: TYALSPVV (MAGC3_HUMAN)
TYALSPVF

SEQ ID NO: 107702 - protein, 11 aa, Artificial Sequence
  Description of Artificial Sequence: Synthetic peptide
  Seed: ATDKDYSAFHL (MAGC3_HUMAN)
ASDKDYSAFHY

SEQ ID NO: 107703 - protein, 9 aa, Artificial Sequence
  Description of Artificial Sequence: Synthetic peptide
  Seed: SESLPRYAL (MAGC3_HUMAN)
SMSLPRYAF

SEQ ID NO: 107704 - protein, 10 aa, Artificial Sequence
  Description of Artificial Sequence: Synthetic peptide
  Seed: FADVLSRLAL (MAGC3_HUMAN)
FTDVLSRLAL

SEQ ID NO: 107705 - protein, 10 aa, Artificial Sequence
  Description of Artificial Sequence: Synthetic peptide
  Seed: INTYTGYFPM (MAGC3_HUMAN)
IDTYTGYFPF

SEQ ID NO: 107706 - protein, 11 aa, Artificial Sequence
  Description of Artificial Sequence: Synthetic peptide
  Seed: LSKLSSIIPSA (MAGC3_HUMAN)
LPKLSSIIPSL

SEQ ID NO: 107707 - protein, 9 aa, Artificial Sequence
  Description of Artificial Sequence: Synthetic peptide
  Seed: HFYVFVNTL (MAGC3_HUMAN)
HNYVFVNTF

SEQ ID NO: 107708 - protein, 9 aa, Artificial Sequence
  Description of Artificial Sequence: Synthetic peptide
  Seed: MQMNVINTY (MAGC3_HUMAN)
MVMNVINTA

SEQ ID NO: 107709 - protein, 11 aa, Artificial Sequence
  Description of Artificial Sequence: Synthetic peptide
  Seed: KVAELVQFLLL (MAGC3_HUMAN)
KVAELVQFLLW

SEQ ID NO: 107710 - protein, 9 aa, Artificial Sequence
  Description of Artificial Sequence: Synthetic peptide
  Seed: FEDTLDLTY (MAGC3_HUMAN)
FADTLDLTY

SEQ ID NO: 107711 - protein, 10 aa, Artificial Sequence
  Description of Artificial Sequence: Synthetic peptide
  Seed: EVIWEVLSAI (MAGC3_HUMAN)
EIIWEVLSAR

SEQ ID NO: 107712 - protein, 10 aa, Artificial Sequence
  Description of Artificial Sequence: Synthetic peptide
  Seed: KDSDLPTWRR (MAGC3_HUMAN)
KQSDLPTWRR

SEQ ID NO: 107713 - protein, 10 aa, Artificial Sequence
  Description of Artificial Sequence: Synthetic peptide
  Seed: FKLWRTLSGS (MAGC3_HUMAN)
FSLWRTLSGM

SEQ ID NO: 107714 - protein, 10 aa, Artificial Sequence
  Description of Artificial Sequence: Synthetic peptide
  Seed: MDPDNHSYFF (MAGC3_HUMAN)
MEPDNHSYFY

SEQ ID NO: 107715 - protein, 9 aa, Artificial Sequence
  Description of Artificial Sequence: Synthetic peptide
  Seed: RPAREVLEF (MAGC3_HUMAN)
RQAREVLEM

SEQ ID NO: 107716 - protein, 10 aa, Artificial Sequence
  Description of Artificial Sequence: Synthetic peptide
  Seed: SALAGFADVL (MAGC3_HUMAN)
SSLAGFADVL

SEQ ID NO: 107717 - protein, 9 aa, Artificial Sequence
  Description of Artificial Sequence: Synthetic peptide
  Seed: EVDPDHFYV (MAGC3_HUMAN)
EIDPDHFYY

SEQ ID NO: 107718 - protein, 9 aa, Artificial Sequence
  Description of Artificial Sequence: Synthetic peptide
  Seed: IQRPAREVL (MAGC3_HUMAN)
ISRPAREVL

SEQ ID NO: 107719 - protein, 10 aa, Artificial Sequence
  Description of Artificial Sequence: Synthetic peptide
  Seed: YALSPVVLPP (MAGC3_HUMAN)
YILSPVVLPV

SEQ ID NO: 107720 - protein, 9 aa, Artificial Sequence
  Description of Artificial Sequence: Synthetic peptide
  Seed: MIFIKGSCV (MAGC3_HUMAN)
MMFIKGSCV

SEQ ID NO: 107721 - protein, 9 aa, Artificial Sequence
  Description of Artificial Sequence: Synthetic peptide
  Seed: KLVQFLLLK (MAGC3_HUMAN)
KFVQFLLLY

SEQ ID NO: 107722 - protein, 9 aa, Artificial Sequence
  Description of Artificial Sequence: Synthetic peptide
  Seed: KLVQFLLLK (MAGC3_HUMAN)
KLVQFLLLA

SEQ ID NO: 107723 - protein, 9 aa, Artificial Sequence
  Description of Artificial Sequence: Synthetic peptide
  Seed: LANPQGLAG (MAGC3_HUMAN)
LGNPQGLAM

SEQ ID NO: 107724 - protein, 10 aa, Artificial Sequence
  Description of Artificial Sequence: Synthetic peptide
  Seed: EEVIWEVLSA (MAGC3_HUMAN)
EWVIWEVLSV

SEQ ID NO: 107725 - protein, 9 aa, Artificial Sequence
  Description of Artificial Sequence: Synthetic peptide
  Seed: LSGSPGLQL (MAGC3_HUMAN)
LAGSPGLQY

SEQ ID NO: 107726 - protein, 9 aa, Artificial Sequence
  Description of Artificial Sequence: Synthetic peptide
  Seed: MLLPCHWVL (MAGC3_HUMAN)
MALPCHWVV

SEQ ID NO: 107727 - protein, 9 aa, Artificial Sequence
  Description of Artificial Sequence: Synthetic peptide
  Seed: VPEEVIWEV (MAGC3_HUMAN)
VAEEVIWEV

SEQ ID NO: 107728 - protein, 9 aa, Artificial Sequence
  Description of Artificial Sequence: Synthetic peptide
  Seed: LRSAEGSVL (MAGC3_HUMAN)
LKSAEGSVF

SEQ ID NO: 107729 - protein, 11 aa, Artificial Sequence
  Description of Artificial Sequence: Synthetic peptide
  Seed: YKDYFPMIFGK (MAGC3_HUMAN)
YTDYFPMIFGR

SEQ ID NO: 107730 - protein, 9 aa, Artificial Sequence
  Description of Artificial Sequence: Synthetic peptide
  Seed: KYKDYFPMI (MAGC3_HUMAN)
KSKDYFPMG

SEQ ID NO: 107731 - protein, 11 aa, Artificial Sequence
  Description of Artificial Sequence: Synthetic peptide
  Seed: LTDMDPDNHSY (MAGC3_HUMAN)
LMDMDPDNHSM

SEQ ID NO: 107732 - protein, 8 aa, Artificial Sequence
  Description of Artificial Sequence: Synthetic peptide
  Seed: TTDDATAM (MAGC3_HUMAN)
TVDDATAL

SEQ ID NO: 107733 - protein, 10 aa, Artificial Sequence
  Description of Artificial Sequence: Synthetic peptide
  Seed: KLSSIIPSAF (MAGC3_HUMAN)
KVSSIIPSAW

SEQ ID NO: 107734 - protein, 9 aa, Artificial Sequence
  Description of Artificial Sequence: Synthetic peptide
  Seed: HSYFFEDTL (MAGC3_HUMAN)
HMYFFEDTL

SEQ ID NO: 107735 - protein, 9 aa, Artificial Sequence
  Description of Artificial Sequence: Synthetic peptide
  Seed: WESEGPEAF (MAGC3_HUMAN)
WISEGPEAF

SEQ ID NO: 107736 - protein, 10 aa, Artificial Sequence
  Description of Artificial Sequence: Synthetic peptide
  Seed: SCSSPLLWTR (MAGC3_HUMAN)
SRSSPLLWTR

SEQ ID NO: 107737 - protein, 11 aa, Artificial Sequence
  Description of Artificial Sequence: Synthetic peptide
  Seed: LDSCSSPLLWT (MAGC3_HUMAN)
LSSCSSPLLWE

SEQ ID NO: 107738 - protein, 9 aa, Artificial Sequence
  Description of Artificial Sequence: Synthetic peptide
  Seed: IELIFGIAL (MAGC3_HUMAN)
ISLIFGIAY

SEQ ID NO: 107739 - protein, 9 aa, Artificial Sequence
  Description of Artificial Sequence: Synthetic peptide
  Seed: MIFIKGSCV (MAGC3_HUMAN)
MLFIKGSCM

SEQ ID NO: 107740 - protein, 9 aa, Artificial Sequence
  Description of Artificial Sequence: Synthetic peptide
  Seed: FEDTLDLTY (MAGC3_HUMAN)
FMDTLDLTY

SEQ ID NO: 107741 - protein, 9 aa, Artificial Sequence
  Description of Artificial Sequence: Synthetic peptide
  Seed: WVKNTCATY (MAGC3_HUMAN)
WMKNTCATY

SEQ ID NO: 107742 - protein, 9 aa, Artificial Sequence
  Description of Artificial Sequence: Synthetic peptide
  Seed: SAFHLGHLR (MAGC3_HUMAN)
SIFHLGHLY

SEQ ID NO: 107743 - protein, 8 aa, Artificial Sequence
  Description of Artificial Sequence: Synthetic peptide
  Seed: IFGKAHEF (MAGC3_HUMAN)
IYGKAHEI

SEQ ID NO: 107744 - protein, 10 aa, Artificial Sequence
  Description of Artificial Sequence: Synthetic peptide
  Seed: INTYTGYFPM (MAGC3_HUMAN)
IKTYTGYFPW

SEQ ID NO: 107745 - protein, 9 aa, Artificial Sequence
  Description of Artificial Sequence: Synthetic peptide
  Seed: FHLGHLREV (MAGC3_HUMAN)
FQLGHLREY

SEQ ID NO: 107746 - protein, 11 aa, Artificial Sequence
  Description of Artificial Sequence: Synthetic peptide
  Seed: YALDEKVAELV (MAGC3_HUMAN)
YMLDEKVAELQ

SEQ ID NO: 107747 - protein, 10 aa, Artificial Sequence
  Description of Artificial Sequence: Synthetic peptide
  Seed: EVIWEVLSAI (MAGC3_HUMAN)
EVIWEVLSAK

SEQ ID NO: 107748 - protein, 11 aa, Artificial Sequence
  Description of Artificial Sequence: Synthetic peptide
  Seed: LTEVDPDHFYV (MAGC3_HUMAN)
LMEVDPDHFYV

SEQ ID NO: 107749 - protein, 8 aa, Artificial Sequence
  Description of Artificial Sequence: Synthetic peptide
  Seed: KVAELVQF (MAGC3_HUMAN)
KTAELVQW

SEQ ID NO: 107750 - protein, 11 aa, Artificial Sequence
  Description of Artificial Sequence: Synthetic peptide
  Seed: EVLSAIGPIQR (MAGC3_HUMAN)
EALSAIGPIQK

SEQ ID NO: 107751 - protein, 9 aa, Artificial Sequence
  Description of Artificial Sequence: Synthetic peptide
  Seed: MIFGKAHEF (MAGC3_HUMAN)
MQFGKAHER

SEQ ID NO: 107752 - protein, 9 aa, Artificial Sequence
  Description of Artificial Sequence: Synthetic peptide
  Seed: MEDRAQAII (MAGC3_HUMAN)
MFDRAQAIL

SEQ ID NO: 107753 - protein, 9 aa, Artificial Sequence
  Description of Artificial Sequence: Synthetic peptide
  Seed: TKAEMLTTV (MAGC3_HUMAN)
TRAEMLTTV

SEQ ID NO: 107754 - protein, 9 aa, Artificial Sequence
  Description of Artificial Sequence: Synthetic peptide
  Seed: ELIFGIALT (MAGC3_HUMAN)
EAIFGIALL

SEQ ID NO: 107755 - protein, 9 aa, Artificial Sequence
  Description of Artificial Sequence: Synthetic peptide
  Seed: YQTKEPVTK (MAGC3_HUMAN)
YLTKEPVTR

SEQ ID NO: 107756 - protein, 9 aa, Artificial Sequence
  Description of Artificial Sequence: Synthetic peptide
  Seed: KAHEFIELI (MAGC3_HUMAN)
KEHEFIELF

SEQ ID NO: 107757 - protein, 9 aa, Artificial Sequence
  Description of Artificial Sequence: Synthetic peptide
  Seed: MIFRKAREF (MAGC3_HUMAN)
MMFRKAREL

SEQ ID NO: 107758 - protein, 10 aa, Artificial Sequence
  Description of Artificial Sequence: Synthetic peptide
  Seed: FFEDTLDLTY (MAGC3_HUMAN)
FPEDTLDLTM

SEQ ID NO: 107759 - protein, 11 aa, Artificial Sequence
  Description of Artificial Sequence: Synthetic peptide
  Seed: TYTGYFPMIFR (MAGC3_HUMAN)
TFTGYFPMIFR

SEQ ID NO: 107760 - protein, 11 aa, Artificial Sequence
  Description of Artificial Sequence: Synthetic peptide
  Seed: GYFPMIFRKAR (MAGC3_HUMAN)
GMFPMIFRKAR

SEQ ID NO: 107761 - protein, 9 aa, Artificial Sequence
  Description of Artificial Sequence: Synthetic peptide
  Seed: VLPPQPQPR (MAGC3_HUMAN)
VGPPQPQPM

SEQ ID NO: 107762 - protein, 9 aa, Artificial Sequence
  Description of Artificial Sequence: Synthetic peptide
  Seed: SLRRAVSVK (MAGC3_HUMAN)
SVRRAVSVV

SEQ ID NO: 107763 - protein, 9 aa, Artificial Sequence
  Description of Artificial Sequence: Synthetic peptide
  Seed: DTTDDATAM (MAGC3_HUMAN)
DITDDATAF

SEQ ID NO: 107764 - protein, 10 aa, Artificial Sequence
  Description of Artificial Sequence: Synthetic peptide
  Seed: SQPEGKFSLR (MAGC3_HUMAN)
STPEGKFSLR

SEQ ID NO: 107765 - protein, 9 aa, Artificial Sequence
  Description of Artificial Sequence: Synthetic peptide
  Seed: ELIFGIALT (MAGC3_HUMAN)
EMIFGIALA

SEQ ID NO: 107766 - protein, 10 aa, Artificial Sequence
  Description of Artificial Sequence: Synthetic peptide
  Seed: ELVQFLLLKY (MAGC3_HUMAN)
EMVQFLLLKK

SEQ ID NO: 107767 - protein, 8 aa, Artificial Sequence
  Description of Artificial Sequence: Synthetic peptide
  Seed: FADVLSRL (MAGC3_HUMAN)
FTDVLSRL

SEQ ID NO: 107768 - protein, 10 aa, Artificial Sequence
  Description of Artificial Sequence: Synthetic peptide
  Seed: SDQRMDSLVL (MAGC3_HUMAN)
SEQRMDSLVF

SEQ ID NO: 107769 - protein, 9 aa, Artificial Sequence
  Description of Artificial Sequence: Synthetic peptide
  Seed: NAIGPWSAL (MAGC3_HUMAN)
NLIGPWSAV

SEQ ID NO: 107770 - protein, 10 aa, Artificial Sequence
  Description of Artificial Sequence: Synthetic peptide
  Seed: SPLDSCSSPL (MAGC3_HUMAN)
SPLDSCSSPF

SEQ ID NO: 107771 - protein, 10 aa, Artificial Sequence
  Description of Artificial Sequence: Synthetic peptide
  Seed: REVLEFLSKL (MAGC3_HUMAN)
RGVLEFLSKV

SEQ ID NO: 107772 - protein, 10 aa, Artificial Sequence
  Description of Artificial Sequence: Synthetic peptide
  Seed: TEVDPDHFYV (MAGC3_HUMAN)
TMVDPDHFYV

SEQ ID NO: 107773 - protein, 10 aa, Artificial Sequence
  Description of Artificial Sequence: Synthetic peptide
  Seed: LPESEPLFTY (MAGC3_HUMAN)
LPESEPLFTM

SEQ ID NO: 107774 - protein, 10 aa, Artificial Sequence
  Description of Artificial Sequence: Synthetic peptide
  Seed: SDQRMDSLVL (MAGC3_HUMAN)
SQQRMDSLVM

SEQ ID NO: 107775 - protein, 9 aa, Artificial Sequence
  Description of Artificial Sequence: Synthetic peptide
  Seed: MLLPCHWVL (MAGC3_HUMAN)
MWLPCHWVF

SEQ ID NO: 107776 - protein, 9 aa, Artificial Sequence
  Description of Artificial Sequence: Synthetic peptide
  Seed: WRRGTGYTL (MAGC3_HUMAN)
WFRGTGYTL

SEQ ID NO: 107777 - protein, 10 aa, Artificial Sequence
  Description of Artificial Sequence: Synthetic peptide
  Seed: MQMNVINTYT (MAGC3_HUMAN)
MRMNVINTYV

SEQ ID NO: 107778 - protein, 10 aa, Artificial Sequence
  Description of Artificial Sequence: Synthetic peptide
  Seed: KDYFPMIFGK (MAGC3_HUMAN)
KMYFPMIFGK

SEQ ID NO: 107779 - protein, 9 aa, Artificial Sequence
  Description of Artificial Sequence: Synthetic peptide
  Seed: RPAREVLEF (MAGC3_HUMAN)
RTAREVLEL

SEQ ID NO: 107780 - protein, 8 aa, Artificial Sequence
  Description of Artificial Sequence: Synthetic peptide
  Seed: HLREVRLF (MAGC3_HUMAN)
HQREVRLY

SEQ ID NO: 107781 - protein, 9 aa, Artificial Sequence
  Description of Artificial Sequence: Synthetic peptide
  Seed: DTTDDATAM (MAGC3_HUMAN)
DITDDATAY

SEQ ID NO: 107782 - protein, 10 aa, Artificial Sequence
  Description of Artificial Sequence: Synthetic peptide
  Seed: FKLWRTLSGS (MAGC3_HUMAN)
FSLWRTLSGV

SEQ ID NO: 107783 - protein, 11 aa, Artificial Sequence
  Description of Artificial Sequence: Synthetic peptide
  Seed: INTYTGYFPMI (MAGC3_HUMAN)
INTYTGYFPMF

SEQ ID NO: 107784 - protein, 9 aa, Artificial Sequence
  Description of Artificial Sequence: Synthetic peptide
  Seed: YKDYFPMIF (MAGC3_HUMAN)
YFDYFPMIL

SEQ ID NO: 107785 - protein, 10 aa, Artificial Sequence
  Description of Artificial Sequence: Synthetic peptide
  Seed: MQMNVINTYT (MAGC3_HUMAN)
MQMNVINTYG

SEQ ID NO: 107786 - protein, 9 aa, Artificial Sequence
  Description of Artificial Sequence: Synthetic peptide
  Seed: SPSVMSTNF (MAGC3_HUMAN)
SVSVMSTNF

SEQ ID NO: 107787 - protein, 10 aa, Artificial Sequence
  Description of Artificial Sequence: Synthetic peptide
  Seed: YALSPVVLPP (MAGC3_HUMAN)
YVLSPVVLPA

SEQ ID NO: 107788 - protein, 10 aa, Artificial Sequence
  Description of Artificial Sequence: Synthetic peptide
  Seed: FPSWYMDALK (MAGC3_HUMAN)
FMSWYMDALR

SEQ ID NO: 107789 - protein, 10 aa, Artificial Sequence
  Description of Artificial Sequence: Synthetic peptide
  Seed: KKYKDYFPMI (MAGC3_HUMAN)
KWYKDYFPMK

SEQ ID NO: 107790 - protein, 9 aa, Artificial Sequence
  Description of Artificial Sequence: Synthetic peptide
  Seed: SLRRAVSVK (MAGC3_HUMAN)
SFRRAVSVA

SEQ ID NO: 107791 - protein, 9 aa, Artificial Sequence
  Description of Artificial Sequence: Synthetic peptide
  Seed: KKYKDYFPM (MAGC3_HUMAN)
KQYKDYFPY

SEQ ID NO: 107792 - protein, 10 aa, Artificial Sequence
  Description of Artificial Sequence: Synthetic peptide
  Seed: SLVLCPTYFK (MAGC3_HUMAN)
SFVLCPTYFR

SEQ ID NO: 107793 - protein, 10 aa, Artificial Sequence
  Description of Artificial Sequence: Synthetic peptide
  Seed: LTEVDPDHFY (MAGC3_HUMAN)
LVEVDPDHFY

SEQ ID NO: 107794 - protein, 9 aa, Artificial Sequence
  Description of Artificial Sequence: Synthetic peptide
  Seed: SALAGFADV (MAGC3_HUMAN)
SMLAGFADI

SEQ ID NO: 107795 - protein, 9 aa, Artificial Sequence
  Description of Artificial Sequence: Synthetic peptide
  Seed: DVLSRLALW (MAGC3_HUMAN)
DTLSRLALY

SEQ ID NO: 107796 - protein, 10 aa, Artificial Sequence
  Description of Artificial Sequence: Synthetic peptide
  Seed: REVRLFLRGG (MAGC3_HUMAN)
RTVRLFLRGM

SEQ ID NO: 107797 - protein, 10 aa, Artificial Sequence
  Description of Artificial Sequence: Synthetic peptide
  Seed: MDPDNHSYFF (MAGC3_HUMAN)
MQPDNHSYFF

SEQ ID NO: 107798 - protein, 9 aa, Artificial Sequence
  Description of Artificial Sequence: Synthetic peptide
  Seed: SAIGPIQRP (MAGC3_HUMAN)
SAIGPIQRF

SEQ ID NO: 107799 - protein, 9 aa, Artificial Sequence
  Description of Artificial Sequence: Synthetic peptide
  Seed: SASPSVMST (MAGC3_HUMAN)
SRSPSVMSM

SEQ ID NO: 107800 - protein, 10 aa, Artificial Sequence
  Description of Artificial Sequence: Synthetic peptide
  Seed: KAHEFIELIF (MAGC3_HUMAN)
KTHEFIELIY

SEQ ID NO: 107801 - protein, 9 aa, Artificial Sequence
  Description of Artificial Sequence: Synthetic peptide
  Seed: TLDEKVDKL (MAGC3_HUMAN)
TCDEKVDKM

SEQ ID NO: 107802 - protein, 10 aa, Artificial Sequence
  Description of Artificial Sequence: Synthetic peptide
  Seed: AEMLTTVIKK (MAGC3_HUMAN)
APMLTTVIKK

SEQ ID NO: 107803 - protein, 10 aa, Artificial Sequence
  Description of Artificial Sequence: Synthetic peptide
  Seed: REVRLFLRGG (MAGC3_HUMAN)
RNVRLFLRGK

SEQ ID NO: 107804 - protein, 9 aa, Artificial Sequence
  Description of Artificial Sequence: Synthetic peptide
  Seed: LIDDQGMPK (MAGC3_HUMAN)
LLDDQGMPY

SEQ ID NO: 107805 - protein, 9 aa, Artificial Sequence
  Description of Artificial Sequence: Synthetic peptide
  Seed: FSDGSLGQW (MAGC3_HUMAN)
FMDGSLGQL

SEQ ID NO: 107806 - protein, 9 aa, Artificial Sequence
  Description of Artificial Sequence: Synthetic peptide
  Seed: SAIGPIQRP (MAGC3_HUMAN)
SAIGPIQRL

SEQ ID NO: 107807 - protein, 8 aa, Artificial Sequence
  Description of Artificial Sequence: Synthetic peptide
  Seed: MPAAGMPP (MAGC3_HUMAN)
MPAAGMPA

SEQ ID NO: 107808 - protein, 10 aa, Artificial Sequence
  Description of Artificial Sequence: Synthetic peptide
  Seed: SLIDDQGMPK (MAGC3_HUMAN)
SVIDDQGMPR

SEQ ID NO: 107809 - protein, 9 aa, Artificial Sequence
  Description of Artificial Sequence: Synthetic peptide
  Seed: SLPESEPLF (MAGC3_HUMAN)
SVPESEPLI

SEQ ID NO: 107810 - protein, 9 aa, Artificial Sequence
  Description of Artificial Sequence: Synthetic peptide
  Seed: HLREVRLFL (MAGC3_HUMAN)
HIREVRLFK

SEQ ID NO: 107811 - protein, 9 aa, Artificial Sequence
  Description of Artificial Sequence: Synthetic peptide
  Seed: AEMLTTVIK (MAGC3_HUMAN)
ADMLTTVIL

SEQ ID NO: 107812 - protein, 10 aa, Artificial Sequence
  Description of Artificial Sequence: Synthetic peptide
  Seed: SLIDDQGMPK (MAGC3_HUMAN)
SAIDDQGMPF

SEQ ID NO: 107813 - protein, 11 aa, Artificial Sequence
  Description of Artificial Sequence: Synthetic peptide
  Seed: RGLTEASPQQK (MAGC3_HUMAN)
RILTEASPQQK

SEQ ID NO: 107814 - protein, 9 aa, Artificial Sequence
  Description of Artificial Sequence: Synthetic peptide
  Seed: KGSCVPEEV (MAGC3_HUMAN)
KVSCVPEEV

SEQ ID NO: 107815 - protein, 9 aa, Artificial Sequence
  Description of Artificial Sequence: Synthetic peptide
  Seed: MPAAGMPPL (MAGC3_HUMAN)
MRAAGMPPM

SEQ ID NO: 107816 - protein, 10 aa, Artificial Sequence
  Description of Artificial Sequence: Synthetic peptide
  Seed: EKVAELVQFL (MAGC3_HUMAN)
ECVAELVQFY

SEQ ID NO: 107817 - protein, 10 aa, Artificial Sequence
  Description of Artificial Sequence: Synthetic peptide
  Seed: IKKYKDYFPM (MAGC3_HUMAN)
IWKYKDYFPY

SEQ ID NO: 107818 - protein, 10 aa, Artificial Sequence
  Description of Artificial Sequence: Synthetic peptide
  Seed: LNAIGPWSAL (MAGC3_HUMAN)
LDAIGPWSAY

SEQ ID NO: 107819 - protein, 9 aa, Artificial Sequence
  Description of Artificial Sequence: Synthetic peptide
  Seed: NTYTGYFPM (MAGC3_HUMAN)
NQYTGYFPI

SEQ ID NO: 107820 - protein, 9 aa, Artificial Sequence
  Description of Artificial Sequence: Synthetic peptide
  Seed: SEEEDTATW (MAGC3_HUMAN)
SQEEDTATL

SEQ ID NO: 107821 - protein, 9 aa, Artificial Sequence
  Description of Artificial Sequence: Synthetic peptide
  Seed: TLDEKVDKL (MAGC3_HUMAN)
TFDEKVDKW

SEQ ID NO: 107822 - protein, 10 aa, Artificial Sequence
  Description of Artificial Sequence: Synthetic peptide
  Seed: TDMDPDNHSY (MAGC3_HUMAN)
TIMDPDNHSY

SEQ ID NO: 107823 - protein, 10 aa, Artificial Sequence
  Description of Artificial Sequence: Synthetic peptide
  Seed: LLKYQAKEPL (MAGC3_HUMAN)
LKKYQAKEPF

SEQ ID NO: 107824 - protein, 10 aa, Artificial Sequence
  Description of Artificial Sequence: Synthetic peptide
  Seed: SWYMDALKDM (MAGC3_HUMAN)
SYYMDALKDM

SEQ ID NO: 107825 - protein, 10 aa, Artificial Sequence
  Description of Artificial Sequence: Synthetic peptide
  Seed: KLVQFLLLKY (MAGC3_HUMAN)
KTVQFLLLKW

SEQ ID NO: 107826 - protein, 9 aa, Artificial Sequence
  Description of Artificial Sequence: Synthetic peptide
  Seed: KKYKDYFPM (MAGC3_HUMAN)
KNYKDYFPY

SEQ ID NO: 107827 - protein, 10 aa, Artificial Sequence
  Description of Artificial Sequence: Synthetic peptide
  Seed: ATYALSPVVL (MAGC3_HUMAN)
AEYALSPVVF

SEQ ID NO: 107828 - protein, 8 aa, Artificial Sequence
  Description of Artificial Sequence: Synthetic peptide
  Seed: SCSSPLLW (MAGC3_HUMAN)
SISSPLLW

SEQ ID NO: 107829 - protein, 11 aa, Artificial Sequence
  Description of Artificial Sequence: Synthetic peptide
  Seed: RTLSGSPGLQL (MAGC3_HUMAN)
RNLSGSPGLQW

SEQ ID NO: 107830 - protein, 9 aa, Artificial Sequence
  Description of Artificial Sequence: Synthetic peptide
  Seed: SLPAVSPGK (MAGC3_HUMAN)
SVPAVSPGK

SEQ ID NO: 107831 - protein, 9 aa, Artificial Sequence
  Description of Artificial Sequence: Synthetic peptide
  Seed: AMASASPSV (MAGC3_HUMAN)
AAASASPSY

SEQ ID NO: 107832 - protein, 9 aa, Artificial Sequence
  Description of Artificial Sequence: Synthetic peptide
  Seed: DYSAFHLGH (MAGC3_HUMAN)
DISAFHLGR

SEQ ID NO: 107833 - protein, 9 aa, Artificial Sequence
  Description of Artificial Sequence: Synthetic peptide
  Seed: TTDDATAMA (MAGC3_HUMAN)
TWDDATAML

SEQ ID NO: 107834 - protein, 10 aa, Artificial Sequence
  Description of Artificial Sequence: Synthetic peptide
  Seed: ATYALSPVVL (MAGC3_HUMAN)
AVYALSPVVV

SEQ ID NO: 107835 - protein, 10 aa, Artificial Sequence
  Description of Artificial Sequence: Synthetic peptide
  Seed: LDSCSSPLLW (MAGC3_HUMAN)
LCSCSSPLLF

SEQ ID NO: 107836 - protein, 9 aa, Artificial Sequence
  Description of Artificial Sequence: Synthetic peptide
  Seed: KLSSIIPSA (MAGC3_HUMAN)
KSSSIIPSL

SEQ ID NO: 107837 - protein, 9 aa, Artificial Sequence
  Description of Artificial Sequence: Synthetic peptide
  Seed: SIIPSAFPS (MAGC3_HUMAN)
SLIPSAFPV

SEQ ID NO: 107838 - protein, 9 aa, Artificial Sequence
  Description of Artificial Sequence: Synthetic peptide
  Seed: MDPDNHSYF (MAGC3_HUMAN)
MAPDNHSYV

SEQ ID NO: 107839 - protein, 9 aa, Artificial Sequence
  Description of Artificial Sequence: Synthetic peptide
  Seed: FKLWRTLSG (MAGC3_HUMAN)
FKLWRTLSL

SEQ ID NO: 107840 - protein, 9 aa, Artificial Sequence
  Description of Artificial Sequence: Synthetic peptide
  Seed: VIWEVLSAI (MAGC3_HUMAN)
VLWEVLSAT

SEQ ID NO: 107841 - protein, 9 aa, Artificial Sequence
  Description of Artificial Sequence: Synthetic peptide
  Seed: KGSCVPEEV (MAGC3_HUMAN)
KVSCVPEEF

SEQ ID NO: 107842 - protein, 9 aa, Artificial Sequence
  Description of Artificial Sequence: Synthetic peptide
  Seed: YQTKEPVTK (MAGC3_HUMAN)
YGTKEPVTM

SEQ ID NO: 107843 - protein, 11 aa, Artificial Sequence
  Description of Artificial Sequence: Synthetic peptide
  Seed: IPPQGPPKISP (MAGC3_HUMAN)
IPPQGPPKISM

SEQ ID NO: 107844 - protein, 11 aa, Artificial Sequence
  Description of Artificial Sequence: Synthetic peptide
  Seed: AIGPWSALAGF (MAGC3_HUMAN)
AMGPWSALAGR

SEQ ID NO: 107845 - protein, 9 aa, Artificial Sequence
  Description of Artificial Sequence: Synthetic peptide
  Seed: YFFEDTLDL (MAGC3_HUMAN)
YMFEDTLDW

SEQ ID NO: 107846 - protein, 10 aa, Artificial Sequence
  Description of Artificial Sequence: Synthetic peptide
  Seed: ATYALSPVVL (MAGC3_HUMAN)
AVYALSPVVF

SEQ ID NO: 107847 - protein, 10 aa, Artificial Sequence
  Description of Artificial Sequence: Synthetic peptide
  Seed: ATYALSPVVL (MAGC3_HUMAN)
ANYALSPVVF

SEQ ID NO: 107848 - protein, 9 aa, Artificial Sequence
  Description of Artificial Sequence: Synthetic peptide
  Seed: HALPESESL (MAGC3_HUMAN)
HMLPESESF

SEQ ID NO: 107849 - protein, 10 aa, Artificial Sequence
  Description of Artificial Sequence: Synthetic peptide
  Seed: KLSSIIPSAF (MAGC3_HUMAN)
KWSSIIPSAY

SEQ ID NO: 107850 - protein, 9 aa, Artificial Sequence
  Description of Artificial Sequence: Synthetic peptide
  Seed: MLLPCHWVL (MAGC3_HUMAN)
MPLPCHWVT

SEQ ID NO: 107851 - protein, 9 aa, Artificial Sequence
  Description of Artificial Sequence: Synthetic peptide
  Seed: KEPVTKAEM (MAGC3_HUMAN)
KVPVTKAEY

SEQ ID NO: 107852 - protein, 10 aa, Artificial Sequence
  Description of Artificial Sequence: Synthetic peptide
  Seed: KDYFPMIFGK (MAGC3_HUMAN)
KHYFPMIFGR

SEQ ID NO: 107853 - protein, 9 aa, Artificial Sequence
  Description of Artificial Sequence: Synthetic peptide
  Seed: YFFEDTLDL (MAGC3_HUMAN)
YYFEDTLDI

SEQ ID NO: 107854 - protein, 9 aa, Artificial Sequence
  Description of Artificial Sequence: Synthetic peptide
  Seed: QGMPKNCLL (MAGC3_HUMAN)
QSMPKNCLF

SEQ ID NO: 107855 - protein, 9 aa, Artificial Sequence
  Description of Artificial Sequence: Synthetic peptide
  Seed: QDWPLNEKR (MAGC3_HUMAN)
QSWPLNEKR

SEQ ID NO: 107856 - protein, 9 aa, Artificial Sequence
  Description of Artificial Sequence: Synthetic peptide
  Seed: MQMNVINTY (MAGC3_HUMAN)
MLMNVINTR

SEQ ID NO: 107857 - protein, 10 aa, Artificial Sequence
  Description of Artificial Sequence: Synthetic peptide
  Seed: ILFGISLTEV (MAGC3_HUMAN)
ILFGISLTEI

SEQ ID NO: 107858 - protein, 9 aa, Artificial Sequence
  Description of Artificial Sequence: Synthetic peptide
  Seed: EMLTTVIKK (MAGC3_HUMAN)
ETLTTVIKK

SEQ ID NO: 107859 - protein, 9 aa, Artificial Sequence
  Description of Artificial Sequence: Synthetic peptide
  Seed: SESLPRYAL (MAGC3_HUMAN)
SHSLPRYAL

SEQ ID NO: 107860 - protein, 9 aa, Artificial Sequence
  Description of Artificial Sequence: Synthetic peptide
  Seed: KAHEFIELI (MAGC3_HUMAN)
KGHEFIELV

SEQ ID NO: 107861 - protein, 10 aa, Artificial Sequence
  Description of Artificial Sequence: Synthetic peptide
  Seed: KYQAKEPLTR (MAGC3_HUMAN)
KTQAKEPLTR

SEQ ID NO: 107862 - protein, 10 aa, Artificial Sequence
  Description of Artificial Sequence: Synthetic peptide
  Seed: LILILSMIFI (MAGC3_HUMAN)
LQLILSMIFV

SEQ ID NO: 107863 - protein, 9 aa, Artificial Sequence
  Description of Artificial Sequence: Synthetic peptide
  Seed: FSDGSLGQW (MAGC3_HUMAN)
FGDGSLGQV

SEQ ID NO: 107864 - protein, 9 aa, Artificial Sequence
  Description of Artificial Sequence: Synthetic peptide
  Seed: SLGQWVKNT (MAGC3_HUMAN)
SLGQWVKNV

SEQ ID NO: 107865 - protein, 9 aa, Artificial Sequence
  Description of Artificial Sequence: Synthetic peptide
  Seed: DQRMDSLVL (MAGC3_HUMAN)
DMRMDSLVF

SEQ ID NO: 107866 - protein, 11 aa, Artificial Sequence
  Description of Artificial Sequence: Synthetic peptide
  Seed: FPMIFGKAHEF (MAGC3_HUMAN)
FPMIFGKAHEY

SEQ ID NO: 107867 - protein, 9 aa, Artificial Sequence
  Description of Artificial Sequence: Synthetic peptide
  Seed: EAFCEESGL (MAGC3_HUMAN)
ETFCEESGK

SEQ ID NO: 107868 - protein, 9 aa, Artificial Sequence
  Description of Artificial Sequence: Synthetic peptide
  Seed: MLLPCHWVL (MAGC3_HUMAN)
MKLPCHWVL

SEQ ID NO: 107869 - protein, 10 aa, Artificial Sequence
  Description of Artificial Sequence: Synthetic peptide
  Seed: MIFRKAREFI (MAGC3_HUMAN)
MVFRKAREFV

SEQ ID NO: 107870 - protein, 10 aa, Artificial Sequence
  Description of Artificial Sequence: Synthetic peptide
  Seed: TYFKLWRTLS (MAGC3_HUMAN)
TWFKLWRTLF

SEQ ID NO: 107871 - protein, 9 aa, Artificial Sequence
  Description of Artificial Sequence: Synthetic peptide
  Seed: NTYTGYFPM (MAGC3_HUMAN)
NTYTGYFPV

SEQ ID NO: 107872 - protein, 9 aa, Artificial Sequence
  Description of Artificial Sequence: Synthetic peptide
  Seed: LSSIIPSAF (MAGC3_HUMAN)
LSSIIPSAL

SEQ ID NO: 107873 - protein, 9 aa, Artificial Sequence
  Description of Artificial Sequence: Synthetic peptide
  Seed: FFEDTLDLT (MAGC3_HUMAN)
FFEDTLDLM

SEQ ID NO: 107874 - protein, 9 aa, Artificial Sequence
  Description of Artificial Sequence: Synthetic peptide
  Seed: VLCPTYFKL (MAGC3_HUMAN)
VSCPTYFKW

SEQ ID NO: 107875 - protein, 10 aa, Artificial Sequence
  Description of Artificial Sequence: Synthetic peptide
  Seed: AEMLTTVIKK (MAGC3_HUMAN)
ATMLTTVIKY

SEQ ID NO: 107876 - protein, 9 aa, Artificial Sequence
  Description of Artificial Sequence: Synthetic peptide
  Seed: MQMNVINTY (MAGC3_HUMAN)
MYMNVINTM

SEQ ID NO: 107877 - protein, 11 aa, Artificial Sequence
  Description of Artificial Sequence: Synthetic peptide
  Seed: AIGPWSALAGF (MAGC3_HUMAN)
AMGPWSALAGY

SEQ ID NO: 107878 - protein, 9 aa, Artificial Sequence
  Description of Artificial Sequence: Synthetic peptide
  Seed: FHLGHLREV (MAGC3_HUMAN)
FELGHLREL

SEQ ID NO: 107879 - protein, 9 aa, Artificial Sequence
  Description of Artificial Sequence: Synthetic peptide
  Seed: ASEEVIWEV (MAGC3_HUMAN)
ATEEVIWEM

SEQ ID NO: 107880 - protein, 9 aa, Artificial Sequence
  Description of Artificial Sequence: Synthetic peptide
  Seed: LIDDQGMPK (MAGC3_HUMAN)
LTDDQGMPL

SEQ ID NO: 107881 - protein, 11 aa, Artificial Sequence
  Description of Artificial Sequence: Synthetic peptide
  Seed: RTLSGSPGLQL (MAGC3_HUMAN)
RTLSGSPGLQI

SEQ ID NO: 107882 - protein, 9 aa, Artificial Sequence
  Description of Artificial Sequence: Synthetic peptide
  Seed: YFFEDTLDL (MAGC3_HUMAN)
YGFEDTLDL

SEQ ID NO: 107883 - protein, 9 aa, Artificial Sequence
  Description of Artificial Sequence: Synthetic peptide
  Seed: EVLSAIGPI (MAGC3_HUMAN)
ELLSAIGPY

SEQ ID NO: 107884 - protein, 9 aa, Artificial Sequence
  Description of Artificial Sequence: Synthetic peptide
  Seed: SIIPSAFPS (MAGC3_HUMAN)
SVIPSAFPI

SEQ ID NO: 107885 - protein, 10 aa, Artificial Sequence
  Description of Artificial Sequence: Synthetic peptide
  Seed: EVIWEVLNAI (MAGC3_HUMAN)
ETIWEVLNAY

SEQ ID NO: 107886 - protein, 10 aa, Artificial Sequence
  Description of Artificial Sequence: Synthetic peptide
  Seed: KKYKDYFPMI (MAGC3_HUMAN)
KVYKDYFPMK

SEQ ID NO: 107887 - protein, 10 aa, Artificial Sequence
  Description of Artificial Sequence: Synthetic peptide
  Seed: TYTGYFPMIF (MAGC3_HUMAN)
TWTGYFPMIF

SEQ ID NO: 107888 - protein, 10 aa, Artificial Sequence
  Description of Artificial Sequence: Synthetic peptide
  Seed: ALWESEGPEA (MAGC3_HUMAN)
ALWESEGPEM

SEQ ID NO: 107889 - protein, 10 aa, Artificial Sequence
  Description of Artificial Sequence: Synthetic peptide
  Seed: EKVAELVQFL (MAGC3_HUMAN)
ESVAELVQFY

SEQ ID NO: 107890 - protein, 10 aa, Artificial Sequence
  Description of Artificial Sequence: Synthetic peptide
  Seed: MQMNVINTYT (MAGC3_HUMAN)
MCMNVINTYI

SEQ ID NO: 107891 - protein, 9 aa, Artificial Sequence
  Description of Artificial Sequence: Synthetic peptide
  Seed: MDPDNHSYF (MAGC3_HUMAN)
MGPDNHSYM

SEQ ID NO: 107892 - protein, 9 aa, Artificial Sequence
  Description of Artificial Sequence: Synthetic peptide
  Seed: MIFRKAREF (MAGC3_HUMAN)
MTFRKAREV

SEQ ID NO: 107893 - protein, 9 aa, Artificial Sequence
  Description of Artificial Sequence: Synthetic peptide
  Seed: DSLVLCPTY (MAGC3_HUMAN)
DALVLCPTY

SEQ ID NO: 107894 - protein, 9 aa, Artificial Sequence
  Description of Artificial Sequence: Synthetic peptide
  Seed: KKYKDYFPM (MAGC3_HUMAN)
KKYKDYFPY

SEQ ID NO: 107895 - protein, 9 aa, Artificial Sequence
  Description of Artificial Sequence: Synthetic peptide
  Seed: ALAGFADVL (MAGC3_HUMAN)
ALAGFADVI

SEQ ID NO: 107896 - protein, 9 aa, Artificial Sequence
  Description of Artificial Sequence: Synthetic peptide
  Seed: SLPESEPLF (MAGC3_HUMAN)
SYPESEPLM

SEQ ID NO: 107897 - protein, 9 aa, Artificial Sequence
  Description of Artificial Sequence: Synthetic peptide
  Seed: HLREVRLFL (MAGC3_HUMAN)
HTREVRLFN

SEQ ID NO: 107898 - protein, 10 aa, Artificial Sequence
  Description of Artificial Sequence: Synthetic peptide
  Seed: FKLWRTLSGS (MAGC3_HUMAN)
FKLWRTLSGL

SEQ ID NO: 107899 - protein, 10 aa, Artificial Sequence
  Description of Artificial Sequence: Synthetic peptide
  Seed: SKLSSIIPSA (MAGC3_HUMAN)
SSLSSIIPSL

SEQ ID NO: 107900 - protein, 9 aa, Artificial Sequence
  Description of Artificial Sequence: Synthetic peptide
  Seed: EVLEFLSKL (MAGC3_HUMAN)
EPLEFLSKR

SEQ ID NO: 107901 - protein, 10 aa, Artificial Sequence
  Description of Artificial Sequence: Synthetic peptide
  Seed: WVKNTCATYA (MAGC3_HUMAN)
WLKNTCATYF

SEQ ID NO: 107902 - protein, 11 aa, Artificial Sequence
  Description of Artificial Sequence: Synthetic peptide
  Seed: TDMDPDNHSYF (MAGC3_HUMAN)
TGMDPDNHSYY

SEQ ID NO: 107903 - protein, 9 aa, Artificial Sequence
  Description of Artificial Sequence: Synthetic peptide
  Seed: DTTDDATAM (MAGC3_HUMAN)
DVTDDATAY

SEQ ID NO: 107904 - protein, 10 aa, Artificial Sequence
  Description of Artificial Sequence: Synthetic peptide
  Seed: AEMLTTVIKK (MAGC3_HUMAN)
AGMLTTVIKK

SEQ ID NO: 107905 - protein, 9 aa, Artificial Sequence
  Description of Artificial Sequence: Synthetic peptide
  Seed: SLVLCPTYF (MAGC3_HUMAN)
SMVLCPTYR

SEQ ID NO: 107906 - protein, 9 aa, Artificial Sequence
  Description of Artificial Sequence: Synthetic peptide
  Seed: KLVQFLLLK (MAGC3_HUMAN)
KMVQFLLLR

SEQ ID NO: 107907 - protein, 9 aa, Artificial Sequence
  Description of Artificial Sequence: Synthetic peptide
  Seed: HALPESESL (MAGC3_HUMAN)
HTLPESESM

SEQ ID NO: 107908 - protein, 9 aa, Artificial Sequence
  Description of Artificial Sequence: Synthetic peptide
  Seed: MIFGKAHEF (MAGC3_HUMAN)
MSFGKAHEH

SEQ ID NO: 107909 - protein, 11 aa, Artificial Sequence
  Description of Artificial Sequence: Synthetic peptide
  Seed: ALWESEGPEAF (MAGC3_HUMAN)
AQWESEGPEAL

SEQ ID NO: 107910 - protein, 10 aa, Artificial Sequence
  Description of Artificial Sequence: Synthetic peptide
  Seed: KAHEFIELIF (MAGC3_HUMAN)
KTHEFIELIM

SEQ ID NO: 107911 - protein, 9 aa, Artificial Sequence
  Description of Artificial Sequence: Synthetic peptide
  Seed: GYFPMIFRK (MAGC3_HUMAN)
GMFPMIFRK

SEQ ID NO: 107912 - protein, 9 aa, Artificial Sequence
  Description of Artificial Sequence: Synthetic peptide
  Seed: ALDEKVAEL (MAGC3_HUMAN)
ATDEKVAEW

SEQ ID NO: 107913 - protein, 9 aa, Artificial Sequence
  Description of Artificial Sequence: Synthetic peptide
  Seed: FSLRRAVSV (MAGC3_HUMAN)
FALRRAVSI

SEQ ID NO: 107914 - protein, 9 aa, Artificial Sequence
  Description of Artificial Sequence: Synthetic peptide
  Seed: SAFHLGHLR (MAGC3_HUMAN)
SGFHLGHLY

SEQ ID NO: 107915 - protein, 11 aa, Artificial Sequence
  Description of Artificial Sequence: Synthetic peptide
  Seed: FLSKLSSIIPS (MAGC3_HUMAN)
FQSKLSSIIPL

SEQ ID NO: 107916 - protein, 9 aa, Artificial Sequence
  Description of Artificial Sequence: Synthetic peptide
  Seed: MQMNVINTY (MAGC3_HUMAN)
MMMNVINTL

SEQ ID NO: 107917 - protein, 9 aa, Artificial Sequence
  Description of Artificial Sequence: Synthetic peptide
  Seed: MPAAGMPPL (MAGC3_HUMAN)
MSAAGMPPM

SEQ ID NO: 107918 - protein, 9 aa, Artificial Sequence
  Description of Artificial Sequence: Synthetic peptide
  Seed: MIFGKAHEF (MAGC3_HUMAN)
MPFGKAHEF

SEQ ID NO: 107919 - protein, 9 aa, Artificial Sequence
  Description of Artificial Sequence: Synthetic peptide
  Seed: LVQFLLLKY (MAGC3_HUMAN)
LWQFLLLKY

SEQ ID NO: 107920 - protein, 9 aa, Artificial Sequence
  Description of Artificial Sequence: Synthetic peptide
  Seed: MIFGKAHEF (MAGC3_HUMAN)
MTFGKAHEY

SEQ ID NO: 107921 - protein, 9 aa, Artificial Sequence
  Description of Artificial Sequence: Synthetic peptide
  Seed: KKYKDYFPM (MAGC3_HUMAN)
KSYKDYFPM

SEQ ID NO: 107922 - protein, 10 aa, Artificial Sequence
  Description of Artificial Sequence: Synthetic peptide
  Seed: FKLWRTLSGS (MAGC3_HUMAN)
FPLWRTLSGL

SEQ ID NO: 107923 - protein, 9 aa, Artificial Sequence
  Description of Artificial Sequence: Synthetic peptide
  Seed: MPAAGMPPL (MAGC3_HUMAN)
MCAAGMPPF

SEQ ID NO: 107924 - protein, 9 aa, Artificial Sequence
  Description of Artificial Sequence: Synthetic peptide
  Seed: NVINTYTGY (MAGC3_HUMAN)
NKINTYTGY

SEQ ID NO: 107925 - protein, 10 aa, Artificial Sequence
  Description of Artificial Sequence: Synthetic peptide
  Seed: REVLEFLSKL (MAGC3_HUMAN)
RHVLEFLSKV

SEQ ID NO: 107926 - protein, 9 aa, Artificial Sequence
  Description of Artificial Sequence: Synthetic peptide
  Seed: SIIPSAFPS (MAGC3_HUMAN)
SVIPSAFPL

SEQ ID NO: 107927 - protein, 10 aa, Artificial Sequence
  Description of Artificial Sequence: Synthetic peptide
  Seed: SLVLCPTYFK (MAGC3_HUMAN)
SSVLCPTYFR

SEQ ID NO: 107928 - protein, 9 aa, Artificial Sequence
  Description of Artificial Sequence: Synthetic peptide
  Seed: HFYVFVNTL (MAGC3_HUMAN)
HRYVFVNTI

SEQ ID NO: 107929 - protein, 9 aa, Artificial Sequence
  Description of Artificial Sequence: Synthetic peptide
  Seed: MLTTVIKKY (MAGC3_HUMAN)
MFTTVIKKY

SEQ ID NO: 107930 - protein, 9 aa, Artificial Sequence
  Description of Artificial Sequence: Synthetic peptide
  Seed: VLCPTYFKL (MAGC3_HUMAN)
VNCPTYFKY

SEQ ID NO: 107931 - protein, 10 aa, Artificial Sequence
  Description of Artificial Sequence: Synthetic peptide
  Seed: IPSAFPSWYM (MAGC3_HUMAN)
IASAFPSWYY

SEQ ID NO: 107932 - protein, 9 aa, Artificial Sequence
  Description of Artificial Sequence: Synthetic peptide
  Seed: MIFGKAHEF (MAGC3_HUMAN)
MFFGKAHEM

SEQ ID NO: 107933 - protein, 9 aa, Artificial Sequence
  Description of Artificial Sequence: Synthetic peptide
  Seed: NTYTGYFPM (MAGC3_HUMAN)
NIYTGYFPM

SEQ ID NO: 107934 - protein, 10 aa, Artificial Sequence
  Description of Artificial Sequence: Synthetic peptide
  Seed: LVLCPTYFKL (MAGC3_HUMAN)
LLLCPTYFKL

SEQ ID NO: 107935 - protein, 10 aa, Artificial Sequence
  Description of Artificial Sequence: Synthetic peptide
  Seed: SESLPRYALD (MAGC3_HUMAN)
SESLPRYALM

SEQ ID NO: 107936 - protein, 9 aa, Artificial Sequence
  Description of Artificial Sequence: Synthetic peptide
  Seed: KLSSIIPSA (MAGC3_HUMAN)
KMSSIIPSI

SEQ ID NO: 107937 - protein, 9 aa, Artificial Sequence
  Description of Artificial Sequence: Synthetic peptide
  Seed: KAHEFIELI (MAGC3_HUMAN)
KSHEFIELW

SEQ ID NO: 107938 - protein, 10 aa, Artificial Sequence
  Description of Artificial Sequence: Synthetic peptide
  Seed: IIDTTDDATA (MAGC3_HUMAN)
ILDTTDDATM

SEQ ID NO: 107939 - protein, 9 aa, Artificial Sequence
  Description of Artificial Sequence: Synthetic peptide
  Seed: QPQPRKKAT (MAGC3_HUMAN)
QMQPRKKAV

SEQ ID NO: 107940 - protein, 10 aa, Artificial Sequence
  Description of Artificial Sequence: Synthetic peptide
  Seed: SLVLCPTYFK (MAGC3_HUMAN)
SIVLCPTYFK

SEQ ID NO: 107941 - protein, 10 aa, Artificial Sequence
  Description of Artificial Sequence: Synthetic peptide
  Seed: ATYALSPVVL (MAGC3_HUMAN)
AMYALSPVVV

SEQ ID NO: 107942 - protein, 8 aa, Artificial Sequence
  Description of Artificial Sequence: Synthetic peptide
  Seed: TTDDATAM (MAGC3_HUMAN)
TVDDATAV

SEQ ID NO: 107943 - protein, 9 aa, Artificial Sequence
  Description of Artificial Sequence: Synthetic peptide
  Seed: TSDQRMDSL (MAGC3_HUMAN)
TVDQRMDSY

SEQ ID NO: 107944 - protein, 11 aa, Artificial Sequence
  Description of Artificial Sequence: Synthetic peptide
  Seed: KKYKDYFPMIF (MAGC3_HUMAN)
KKYKDYFPMIY

SEQ ID NO: 107945 - protein, 9 aa, Artificial Sequence
  Description of Artificial Sequence: Synthetic peptide
  Seed: QAKEPLTRA (MAGC3_HUMAN)
QTKEPLTRY

SEQ ID NO: 107946 - protein, 9 aa, Artificial Sequence
  Description of Artificial Sequence: Synthetic peptide
  Seed: MASASPSVM (MAGC3_HUMAN)
MASASPSVW

SEQ ID NO: 107947 - protein, 10 aa, Artificial Sequence
  Description of Artificial Sequence: Synthetic peptide
  Seed: LDSCSSPLLW (MAGC3_HUMAN)
LFSCSSPLLW

SEQ ID NO: 107948 - protein, 10 aa, Artificial Sequence
  Description of Artificial Sequence: Synthetic peptide
  Seed: MQMNVINTYT (MAGC3_HUMAN)
MLMNVINTYV

SEQ ID NO: 107949 - protein, 9 aa, Artificial Sequence
  Description of Artificial Sequence: Synthetic peptide
  Seed: MDPDNHSYF (MAGC3_HUMAN)
MTPDNHSYI

SEQ ID NO: 107950 - protein, 11 aa, Artificial Sequence
  Description of Artificial Sequence: Synthetic peptide
  Seed: LSKLSSIIPSA (MAGC3_HUMAN)
LIKLSSIIPSV

SEQ ID NO: 107951 - protein, 10 aa, Artificial Sequence
  Description of Artificial Sequence: Synthetic peptide
  Seed: MQMNVINTYT (MAGC3_HUMAN)
MFMNVINTYL

SEQ ID NO: 107952 - protein, 9 aa, Artificial Sequence
  Description of Artificial Sequence: Synthetic peptide
  Seed: AGFADVLSR (MAGC3_HUMAN)
AAFADVLSL

SEQ ID NO: 107953 - protein, 10 aa, Artificial Sequence
  Description of Artificial Sequence: Synthetic peptide
  Seed: ATDKDYSAFH (MAGC3_HUMAN)
ATDKDYSAFY

SEQ ID NO: 107954 - protein, 10 aa, Artificial Sequence
  Description of Artificial Sequence: Synthetic peptide
  Seed: EVIWEVLNAI (MAGC3_HUMAN)
EGIWEVLNAV

SEQ ID NO: 107955 - protein, 9 aa, Artificial Sequence
  Description of Artificial Sequence: Synthetic peptide
  Seed: YSAFHLGHL (MAGC3_HUMAN)
YTAFHLGHF

SEQ ID NO: 107956 - protein, 9 aa, Artificial Sequence
  Description of Artificial Sequence: Synthetic peptide
  Seed: MIFIKGSCV (MAGC3_HUMAN)
MQFIKGSCI

SEQ ID NO: 107957 - protein, 9 aa, Artificial Sequence
  Description of Artificial Sequence: Synthetic peptide
  Seed: ASEEVIWEV (MAGC3_HUMAN)
ALEEVIWEF

SEQ ID NO: 107958 - protein, 9 aa, Artificial Sequence
  Description of Artificial Sequence: Synthetic peptide
  Seed: EVLEFLSKL (MAGC3_HUMAN)
EQLEFLSKK

SEQ ID NO: 107959 - protein, 9 aa, Artificial Sequence
  Description of Artificial Sequence: Synthetic peptide
  Seed: AMASASPSV (MAGC3_HUMAN)
AQASASPSI

SEQ ID NO: 107960 - protein, 9 aa, Artificial Sequence
  Description of Artificial Sequence: Synthetic peptide
  Seed: MLLPCHWVL (MAGC3_HUMAN)
MVLPCHWVK

SEQ ID NO: 107961 - protein, 11 aa, Artificial Sequence
  Description of Artificial Sequence: Synthetic peptide
  Seed: MPAAGMPPLPQ (MAGC3_HUMAN)
MPAAGMPPLPC

SEQ ID NO: 107962 - protein, 9 aa, Artificial Sequence
  Description of Artificial Sequence: Synthetic peptide
  Seed: YALDEKVAE (MAGC3_HUMAN)
YVLDEKVAY

SEQ ID NO: 107963 - protein, 10 aa, Artificial Sequence
  Description of Artificial Sequence: Synthetic peptide
  Seed: FFEDTLDLTY (MAGC3_HUMAN)
FVEDTLDLTY

SEQ ID NO: 107964 - protein, 11 aa, Artificial Sequence
  Description of Artificial Sequence: Synthetic peptide
  Seed: YKDYFPMIFGK (MAGC3_HUMAN)
YVDYFPMIFGR

SEQ ID NO: 107965 - protein, 9 aa, Artificial Sequence
  Description of Artificial Sequence: Synthetic peptide
  Seed: SLPESEPLF (MAGC3_HUMAN)
SVPESEPLF

SEQ ID NO: 107966 - protein, 10 aa, Artificial Sequence
  Description of Artificial Sequence: Synthetic peptide
  Seed: WPLNEKRTLW (MAGC3_HUMAN)
WSLNEKRTLW

SEQ ID NO: 107967 - protein, 9 aa, Artificial Sequence
  Description of Artificial Sequence: Synthetic peptide
  Seed: AMASASPSV (MAGC3_HUMAN)
AQASASPSL

SEQ ID NO: 107968 - protein, 10 aa, Artificial Sequence
  Description of Artificial Sequence: Synthetic peptide
  Seed: FPSWYMDALK (MAGC3_HUMAN)
FPSWYMDALH

SEQ ID NO: 107969 - protein, 11 aa, Artificial Sequence
  Description of Artificial Sequence: Synthetic peptide
  Seed: IIDTTDDATAM (MAGC3_HUMAN)
ICDTTDDATAF

SEQ ID NO: 107970 - protein, 10 aa, Artificial Sequence
  Description of Artificial Sequence: Synthetic peptide
  Seed: LIFGIALTDM (MAGC3_HUMAN)
LMFGIALTDV

SEQ ID NO: 107971 - protein, 9 aa, Artificial Sequence
  Description of Artificial Sequence: Synthetic peptide
  Seed: SLRRAVSVK (MAGC3_HUMAN)
SWRRAVSVK

SEQ ID NO: 107972 - protein, 10 aa, Artificial Sequence
  Description of Artificial Sequence: Synthetic peptide
  Seed: TDMDPDNHSY (MAGC3_HUMAN)
TPMDPDNHSF

SEQ ID NO: 107973 - protein, 8 aa, Artificial Sequence
  Description of Artificial Sequence: Synthetic peptide
  Seed: KAHEFIEL (MAGC3_HUMAN)
KYHEFIEM

SEQ ID NO: 107974 - protein, 10 aa, Artificial Sequence
  Description of Artificial Sequence: Synthetic peptide
  Seed: FKLWRTLSGS (MAGC3_HUMAN)
FHLWRTLSGA

SEQ ID NO: 107975 - protein, 10 aa, Artificial Sequence
  Description of Artificial Sequence: Synthetic peptide
  Seed: MQMNVINTYT (MAGC3_HUMAN)
MLMNVINTYI

SEQ ID NO: 107976 - protein, 9 aa, Artificial Sequence
  Description of Artificial Sequence: Synthetic peptide
  Seed: SEEEDTATW (MAGC3_HUMAN)
SQEEDTATF

SEQ ID NO: 107977 - protein, 9 aa, Artificial Sequence
  Description of Artificial Sequence: Synthetic peptide
  Seed: KLWRTLSGS (MAGC3_HUMAN)
KVWRTLSGL

SEQ ID NO: 107978 - protein, 9 aa, Artificial Sequence
  Description of Artificial Sequence: Synthetic peptide
  Seed: FKLWRTLSG (MAGC3_HUMAN)
FQLWRTLSF

SEQ ID NO: 107979 - protein, 10 aa, Artificial Sequence
  Description of Artificial Sequence: Synthetic peptide
  Seed: KATDKDYSAF (MAGC3_HUMAN)
KTTDKDYSAW

SEQ ID NO: 107980 - protein, 10 aa, Artificial Sequence
  Description of Artificial Sequence: Synthetic peptide
  Seed: SQPEGKFSLR (MAGC3_HUMAN)
SIPEGKFSLR

SEQ ID NO: 107981 - protein, 9 aa, Artificial Sequence
  Description of Artificial Sequence: Synthetic peptide
  Seed: MIFRKAREF (MAGC3_HUMAN)
MQFRKAREH

SEQ ID NO: 107982 - protein, 10 aa, Artificial Sequence
  Description of Artificial Sequence: Synthetic peptide
  Seed: MDPDNHSYFF (MAGC3_HUMAN)
MAPDNHSYFF

SEQ ID NO: 107983 - protein, 10 aa, Artificial Sequence
  Description of Artificial Sequence: Synthetic peptide
  Seed: SCSSPLLWTR (MAGC3_HUMAN)
SGSSPLLWTR

SEQ ID NO: 107984 - protein, 9 aa, Artificial Sequence
  Description of Artificial Sequence: Synthetic peptide
  Seed: QTKEPVTKA (MAGC3_HUMAN)
QGKEPVTKF

SEQ ID NO: 107985 - protein, 10 aa, Artificial Sequence
  Description of Artificial Sequence: Synthetic peptide
  Seed: WSALAGFADV (MAGC3_HUMAN)
WTALAGFADV

SEQ ID NO: 107986 - protein, 9 aa, Artificial Sequence
  Description of Artificial Sequence: Synthetic peptide
  Seed: MQMNVINTY (MAGC3_HUMAN)
MTMNVINTR

SEQ ID NO: 107987 - protein, 9 aa, Artificial Sequence
  Description of Artificial Sequence: Synthetic peptide
  Seed: TYALSPVVL (MAGC3_HUMAN)
TSALSPVVY

SEQ ID NO: 107988 - protein, 10 aa, Artificial Sequence
  Description of Artificial Sequence: Synthetic peptide
  Seed: TTDDATAMAS (MAGC3_HUMAN)
TQDDATAMAI

SEQ ID NO: 107989 - protein, 10 aa, Artificial Sequence
  Description of Artificial Sequence: Synthetic peptide
  Seed: RSAEGSVLDL (MAGC3_HUMAN)
RQAEGSVLDF

SEQ ID NO: 107990 - protein, 10 aa, Artificial Sequence
  Description of Artificial Sequence: Synthetic peptide
  Seed: IELIFGIALT (MAGC3_HUMAN)
IRLIFGIALI

SEQ ID NO: 107991 - protein, 10 aa, Artificial Sequence
  Description of Artificial Sequence: Synthetic peptide
  Seed: SKLSSIIPSA (MAGC3_HUMAN)
SLLSSIIPSL

SEQ ID NO: 107992 - protein, 10 aa, Artificial Sequence
  Description of Artificial Sequence: Synthetic peptide
  Seed: KVAELVQFLL (MAGC3_HUMAN)
KMAELVQFLT

SEQ ID NO: 107993 - protein, 9 aa, Artificial Sequence
  Description of Artificial Sequence: Synthetic peptide
  Seed: SQPEGKFSL (MAGC3_HUMAN)
SYPEGKFSF

SEQ ID NO: 107994 - protein, 9 aa, Artificial Sequence
  Description of Artificial Sequence: Synthetic peptide
  Seed: NVINTYTGY (MAGC3_HUMAN)
NYINTYTGY

SEQ ID NO: 107995 - protein, 11 aa, Artificial Sequence
  Description of Artificial Sequence: Synthetic peptide
  Seed: SLPESEPLFTY (MAGC3_HUMAN)
SLPESEPLFTL

SEQ ID NO: 107996 - protein, 9 aa, Artificial Sequence
  Description of Artificial Sequence: Synthetic peptide
  Seed: VDPDHFYVF (MAGC3_HUMAN)
VYPDHFYVW

SEQ ID NO: 107997 - protein, 9 aa, Artificial Sequence
  Description of Artificial Sequence: Synthetic peptide
  Seed: MASASPSVM (MAGC3_HUMAN)
MKSASPSVY

SEQ ID NO: 107998 - protein, 10 aa, Artificial Sequence
  Description of Artificial Sequence: Synthetic peptide
  Seed: KVAELVQFLL (MAGC3_HUMAN)
KMAELVQFLF

SEQ ID NO: 107999 - protein, 9 aa, Artificial Sequence
  Description of Artificial Sequence: Synthetic peptide
  Seed: RPAREVLEF (MAGC3_HUMAN)
RSAREVLEM

SEQ ID NO: 108000 - protein, 10 aa, Artificial Sequence
  Description of Artificial Sequence: Synthetic peptide
  Seed: SALAGFADVL (MAGC3_HUMAN)
SVLAGFADVV

SEQ ID NO: 108001 - protein, 9 aa, Artificial Sequence
  Description of Artificial Sequence: Synthetic peptide
  Seed: RTLSGSPGL (MAGC3_HUMAN)
RSLSGSPGY

SEQ ID NO: 108002 - protein, 9 aa, Artificial Sequence
  Description of Artificial Sequence: Synthetic peptide
  Seed: YALDEKVAE (MAGC3_HUMAN)
YSLDEKVAY

SEQ ID NO: 108003 - protein, 9 aa, Artificial Sequence
  Description of Artificial Sequence: Synthetic peptide
  Seed: GSLPESEPL (MAGC3_HUMAN)
GILPESEPL

SEQ ID NO: 108004 - protein, 9 aa, Artificial Sequence
  Description of Artificial Sequence: Synthetic peptide
  Seed: LSSIIPSAF (MAGC3_HUMAN)
LASIIPSAV

SEQ ID NO: 108005 - protein, 9 aa, Artificial Sequence
  Description of Artificial Sequence: Synthetic peptide
  Seed: RGTGYTLSL (MAGC3_HUMAN)
RGTGYTLSY

SEQ ID NO: 108006 - protein, 9 aa, Artificial Sequence
  Description of Artificial Sequence: Synthetic peptide
  Seed: YTGYFPMIF (MAGC3_HUMAN)
YIGYFPMIY

SEQ ID NO: 108007 - protein, 9 aa, Artificial Sequence
  Description of Artificial Sequence: Synthetic peptide
  Seed: MDPDNHSYF (MAGC3_HUMAN)
MVPDNHSYY

SEQ ID NO: 108008 - protein, 9 aa, Artificial Sequence
  Description of Artificial Sequence: Synthetic peptide
  Seed: SLRRAVSVK (MAGC3_HUMAN)
SIRRAVSVA

SEQ ID NO: 108009 - protein, 10 aa, Artificial Sequence
  Description of Artificial Sequence: Synthetic peptide
  Seed: YALDEKVAEL (MAGC3_HUMAN)
YMLDEKVAEC

SEQ ID NO: 108010 - protein, 9 aa, Artificial Sequence
  Description of Artificial Sequence: Synthetic peptide
  Seed: MASASPSVM (MAGC3_HUMAN)
MPSASPSVI

SEQ ID NO: 108011 - protein, 8 aa, Artificial Sequence
  Description of Artificial Sequence: Synthetic peptide
  Seed: KVAELVQF (MAGC3_HUMAN)
KSAELVQW

SEQ ID NO: 108012 - protein, 9 aa, Artificial Sequence
  Description of Artificial Sequence: Synthetic peptide
  Seed: TGYFPMIFR (MAGC3_HUMAN)
TAYFPMIFK

SEQ ID NO: 108013 - protein, 9 aa, Artificial Sequence
  Description of Artificial Sequence: Synthetic peptide
  Seed: ALSPVVLPP (MAGC3_HUMAN)
AVSPVVLPI

SEQ ID NO: 108014 - protein, 9 aa, Artificial Sequence
  Description of Artificial Sequence: Synthetic peptide
  Seed: EFLSKLSSI (MAGC3_HUMAN)
EILSKLSSL

SEQ ID NO: 108015 - protein, 9 aa, Artificial Sequence
  Description of Artificial Sequence: Synthetic peptide
  Seed: FPSWYMDAL (MAGC3_HUMAN)
FQSWYMDAY

SEQ ID NO: 108016 - protein, 10 aa, Artificial Sequence
  Description of Artificial Sequence: Synthetic peptide
  Seed: MDSLVLCPTY (MAGC3_HUMAN)
MKSLVLCPTY

SEQ ID NO: 108017 - protein, 9 aa, Artificial Sequence
  Description of Artificial Sequence: Synthetic peptide
  Seed: LSSIIPSAF (MAGC3_HUMAN)
LISIIPSAF

SEQ ID NO: 108018 - protein, 9 aa, Artificial Sequence
  Description of Artificial Sequence: Synthetic peptide
  Seed: MLLPCHWVL (MAGC3_HUMAN)
MMLPCHWVW

SEQ ID NO: 108019 - protein, 9 aa, Artificial Sequence
  Description of Artificial Sequence: Synthetic peptide
  Seed: KVAELVQFL (MAGC3_HUMAN)
KTAELVQFM

SEQ ID NO: 108020 - protein, 10 aa, Artificial Sequence
  Description of Artificial Sequence: Synthetic peptide
  Seed: YALSPVVLPP (MAGC3_HUMAN)
YPLSPVVLPI

SEQ ID NO: 108021 - protein, 9 aa, Artificial Sequence
  Description of Artificial Sequence: Synthetic peptide
  Seed: YFFEDTLDL (MAGC3_HUMAN)
YMFEDTLDM

SEQ ID NO: 108022 - protein, 11 aa, Artificial Sequence
  Description of Artificial Sequence: Synthetic peptide
  Seed: IIDTTDDATAM (MAGC3_HUMAN)
INDTTDDATAL

SEQ ID NO: 108023 - protein, 10 aa, Artificial Sequence
  Description of Artificial Sequence: Synthetic peptide
  Seed: EKVAELVQFL (MAGC3_HUMAN)
ETVAELVQFF

SEQ ID NO: 108024 - protein, 9 aa, Artificial Sequence
  Description of Artificial Sequence: Synthetic peptide
  Seed: MPAAGMPPL (MAGC3_HUMAN)
MAAAGMPPA

SEQ ID NO: 108025 - protein, 10 aa, Artificial Sequence
  Description of Artificial Sequence: Synthetic peptide
  Seed: ANPQGLAGHR (MAGC3_HUMAN)
ATPQGLAGHR

SEQ ID NO: 108026 - protein, 9 aa, Artificial Sequence
  Description of Artificial Sequence: Synthetic peptide
  Seed: VLCPTYFKL (MAGC3_HUMAN)
VQCPTYFKI

SEQ ID NO: 108027 - protein, 9 aa, Artificial Sequence
  Description of Artificial Sequence: Synthetic peptide
  Seed: YALDEKVAE (MAGC3_HUMAN)
YVLDEKVAF

SEQ ID NO: 108028 - protein, 9 aa, Artificial Sequence
  Description of Artificial Sequence: Synthetic peptide
  Seed: EVDPDHFYV (MAGC3_HUMAN)
EFDPDHFYY

SEQ ID NO: 108029 - protein, 9 aa, Artificial Sequence
  Description of Artificial Sequence: Synthetic peptide
  Seed: EVIWEVLSA (MAGC3_HUMAN)
ESIWEVLSV

SEQ ID NO: 108030 - protein, 9 aa, Artificial Sequence
  Description of Artificial Sequence: Synthetic peptide
  Seed: HALPESESL (MAGC3_HUMAN)
HQLPESESA

SEQ ID NO: 108031 - protein, 9 aa, Artificial Sequence
  Description of Artificial Sequence: Synthetic peptide
  Seed: FHLGHLREV (MAGC3_HUMAN)
FHLGHLREI

SEQ ID NO: 108032 - protein, 10 aa, Artificial Sequence
  Description of Artificial Sequence: Synthetic peptide
  Seed: ATYALSPVVL (MAGC3_HUMAN)
AYYALSPVVF

SEQ ID NO: 108033 - protein, 10 aa, Artificial Sequence
  Description of Artificial Sequence: Synthetic peptide
  Seed: LLKYQAKEPL (MAGC3_HUMAN)
LKKYQAKEPY

SEQ ID NO: 108034 - protein, 9 aa, Artificial Sequence
  Description of Artificial Sequence: Synthetic peptide
  Seed: MIFRKAREF (MAGC3_HUMAN)
MEFRKAREM

SEQ ID NO: 108035 - protein, 10 aa, Artificial Sequence
  Description of Artificial Sequence: Synthetic peptide
  Seed: FSDGSLGQWV (MAGC3_HUMAN)
FMDGSLGQWM

SEQ ID NO: 108036 - protein, 10 aa, Artificial Sequence
  Description of Artificial Sequence: Synthetic peptide
  Seed: FFEDTLDLTY (MAGC3_HUMAN)
FWEDTLDLTM

SEQ ID NO: 108037 - protein, 11 aa, Artificial Sequence
  Description of Artificial Sequence: Synthetic peptide
  Seed: AELVQFLLLKY (MAGC3_HUMAN)
AELVQFLLLKW

SEQ ID NO: 108038 - protein, 11 aa, Artificial Sequence
  Description of Artificial Sequence: Synthetic peptide
  Seed: LIDDQGMPKNC (MAGC3_HUMAN)
LIDDQGMPKNL

SEQ ID NO: 108039 - protein, 9 aa, Artificial Sequence
  Description of Artificial Sequence: Synthetic peptide
  Seed: HFYVFVNTL (MAGC3_HUMAN)
HFYVFVNTI

SEQ ID NO: 108040 - protein, 10 aa, Artificial Sequence
  Description of Artificial Sequence: Synthetic peptide
  Seed: MLLPCHWVLD (MAGC3_HUMAN)
MKLPCHWVLV

SEQ ID NO: 108041 - protein, 11 aa, Artificial Sequence
  Description of Artificial Sequence: Synthetic peptide
  Seed: DSCSSPLLWTR (MAGC3_HUMAN)
DFCSSPLLWTR

SEQ ID NO: 108042 - protein, 9 aa, Artificial Sequence
  Description of Artificial Sequence: Synthetic peptide
  Seed: VLPPQPQPR (MAGC3_HUMAN)
VGPPQPQPF

SEQ ID NO: 108043 - protein, 10 aa, Artificial Sequence
  Description of Artificial Sequence: Synthetic peptide
  Seed: REVLEFLSKL (MAGC3_HUMAN)
RDVLEFLSKV

SEQ ID NO: 108044 - protein, 9 aa, Artificial Sequence
  Description of Artificial Sequence: Synthetic peptide
  Seed: HLREVRLFL (MAGC3_HUMAN)
HIREVRLFS

SEQ ID NO: 108045 - protein, 11 aa, Artificial Sequence
  Description of Artificial Sequence: Synthetic peptide
  Seed: FIELIFGIALT (MAGC3_HUMAN)
FSELIFGIALV

SEQ ID NO: 108046 - protein, 10 aa, Artificial Sequence
  Description of Artificial Sequence: Synthetic peptide
  Seed: EVIWEVLNAI (MAGC3_HUMAN)
ESIWEVLNAF

SEQ ID NO: 108047 - protein, 9 aa, Artificial Sequence
  Description of Artificial Sequence: Synthetic peptide
  Seed: WVKNTCATY (MAGC3_HUMAN)
WWKNTCATM

SEQ ID NO: 108048 - protein, 9 aa, Artificial Sequence
  Description of Artificial Sequence: Synthetic peptide
  Seed: HSYFFEDTL (MAGC3_HUMAN)
HDYFFEDTM

SEQ ID NO: 108049 - protein, 9 aa, Artificial Sequence
  Description of Artificial Sequence: Synthetic peptide
  Seed: KVDKLVQFL (MAGC3_HUMAN)
KADKLVQFV

SEQ ID NO: 108050 - protein, 9 aa, Artificial Sequence
  Description of Artificial Sequence: Synthetic peptide
  Seed: QGMPQNRLL (MAGC3_HUMAN)
QSMPQNRLY

SEQ ID NO: 108051 - protein, 10 aa, Artificial Sequence
  Description of Artificial Sequence: Synthetic peptide
  Seed: RSAEGSVLDL (MAGC3_HUMAN)
RQAEGSVLDW

SEQ ID NO: 108052 - protein, 10 aa, Artificial Sequence
  Description of Artificial Sequence: Synthetic peptide
  Seed: SQPEGKFSLR (MAGC3_HUMAN)
SAPEGKFSLL

SEQ ID NO: 108053 - protein, 9 aa, Artificial Sequence
  Description of Artificial Sequence: Synthetic peptide
  Seed: GEDEDMPAA (MAGC3_HUMAN)
GEDEDMPAI

SEQ ID NO: 108054 - protein, 11 aa, Artificial Sequence
  Description of Artificial Sequence: Synthetic peptide
  Seed: ILFGISLTEVD (MAGC3_HUMAN)
IMFGISLTEVE

SEQ ID NO: 108055 - protein, 10 aa, Artificial Sequence
  Description of Artificial Sequence: Synthetic peptide
  Seed: CATYALSPVV (MAGC3_HUMAN)
CLTYALSPVV

SEQ ID NO: 108056 - protein, 10 aa, Artificial Sequence
  Description of Artificial Sequence: Synthetic peptide
  Seed: LIFGIALTDM (MAGC3_HUMAN)
LLFGIALTDI

SEQ ID NO: 108057 - protein, 10 aa, Artificial Sequence
  Description of Artificial Sequence: Synthetic peptide
  Seed: WVKNTCATYA (MAGC3_HUMAN)
WIKNTCATYF

SEQ ID NO: 108058 - protein, 10 aa, Artificial Sequence
  Description of Artificial Sequence: Synthetic peptide
  Seed: YALDEKVAEL (MAGC3_HUMAN)
YALDEKVAEY

SEQ ID NO: 108059 - protein, 9 aa, Artificial Sequence
  Description of Artificial Sequence: Synthetic peptide
  Seed: DYSAFHLGH (MAGC3_HUMAN)
DVSAFHLGR

SEQ ID NO: 108060 - protein, 10 aa, Artificial Sequence
  Description of Artificial Sequence: Synthetic peptide
  Seed: TEVDPDHFYV (MAGC3_HUMAN)
TYVDPDHFYV

SEQ ID NO: 108061 - protein, 10 aa, Artificial Sequence
  Description of Artificial Sequence: Synthetic peptide
  Seed: REVLEFLSKL (MAGC3_HUMAN)
RYVLEFLSKI

SEQ ID NO: 108062 - protein, 9 aa, Artificial Sequence
  Description of Artificial Sequence: Synthetic peptide
  Seed: TSDQRMDSL (MAGC3_HUMAN)
TSDQRMDSM

SEQ ID NO: 108063 - protein, 9 aa, Artificial Sequence
  Description of Artificial Sequence: Synthetic peptide
  Seed: VIWEVLNAI (MAGC3_HUMAN)
VMWEVLNAW

SEQ ID NO: 108064 - protein, 9 aa, Artificial Sequence
  Description of Artificial Sequence: Synthetic peptide
  Seed: HSYFFEDTL (MAGC3_HUMAN)
HMYFFEDTW

SEQ ID NO: 108065 - protein, 10 aa, Artificial Sequence
  Description of Artificial Sequence: Synthetic peptide
  Seed: LILILSMIFI (MAGC3_HUMAN)
LSLILSMIFV

SEQ ID NO: 108066 - protein, 9 aa, Artificial Sequence
  Description of Artificial Sequence: Synthetic peptide
  Seed: LSDEQGMPQ (MAGC3_HUMAN)
LGDEQGMPI

SEQ ID NO: 108067 - protein, 9 aa, Artificial Sequence
  Description of Artificial Sequence: Synthetic peptide
  Seed: GKAHEFIEL (MAGC3_HUMAN)
GRAHEFIEY

SEQ ID NO: 108068 - protein, 9 aa, Artificial Sequence
  Description of Artificial Sequence: Synthetic peptide
  Seed: FKLWRTLSG (MAGC3_HUMAN)
FGLWRTLSF

SEQ ID NO: 108069 - protein, 10 aa, Artificial Sequence
  Description of Artificial Sequence: Synthetic peptide
  Seed: SLIDDQGMPK (MAGC3_HUMAN)
SAIDDQGMPK

SEQ ID NO: 108070 - protein, 9 aa, Artificial Sequence
  Description of Artificial Sequence: Synthetic peptide
  Seed: FVNTLDLTC (MAGC3_HUMAN)
FINTLDLTL

SEQ ID NO: 108071 - protein, 9 aa, Artificial Sequence
  Description of Artificial Sequence: Synthetic peptide
  Seed: QAKEPLTRA (MAGC3_HUMAN)
QTKEPLTRF

SEQ ID NO: 108072 - protein, 11 aa, Artificial Sequence
  Description of Artificial Sequence: Synthetic peptide
  Seed: TAMASASPSVM (MAGC3_HUMAN)
TAMASASPSVY

SEQ ID NO: 108073 - protein, 10 aa, Artificial Sequence
  Description of Artificial Sequence: Synthetic peptide
  Seed: MDSLVLCPTY (MAGC3_HUMAN)
MHSLVLCPTY

SEQ ID NO: 108074 - protein, 10 aa, Artificial Sequence
  Description of Artificial Sequence: Synthetic peptide
  Seed: ILILSMIFIK (MAGC3_HUMAN)
IFILSMIFIR

SEQ ID NO: 108075 - protein, 10 aa, Artificial Sequence
  Description of Artificial Sequence: Synthetic peptide
  Seed: MQMNVINTYT (MAGC3_HUMAN)
MMMNVINTYW

SEQ ID NO: 108076 - protein, 9 aa, Artificial Sequence
  Description of Artificial Sequence: Synthetic peptide
  Seed: SALAGFADV (MAGC3_HUMAN)
SMLAGFADV

SEQ ID NO: 108077 - protein, 11 aa, Artificial Sequence
  Description of Artificial Sequence: Synthetic peptide
  Seed: SSSEEEDTATW (MAGC3_HUMAN)
SVSEEEDTATW

SEQ ID NO: 108078 - protein, 9 aa, Artificial Sequence
  Description of Artificial Sequence: Synthetic peptide
  Seed: ISPQGPPQS (MAGC3_HUMAN)
IIPQGPPQI

SEQ ID NO: 108079 - protein, 10 aa, Artificial Sequence
  Description of Artificial Sequence: Synthetic peptide
  Seed: MDPDNHSYFF (MAGC3_HUMAN)
MQPDNHSYFW

SEQ ID NO: 108080 - protein, 9 aa, Artificial Sequence
  Description of Artificial Sequence: Synthetic peptide
  Seed: ATDKDYSAF (MAGC3_HUMAN)
AYDKDYSAI

SEQ ID NO: 108081 - protein, 9 aa, Artificial Sequence
  Description of Artificial Sequence: Synthetic peptide
  Seed: IIPSAFPSW (MAGC3_HUMAN)
IQPSAFPSM

SEQ ID NO: 108082 - protein, 11 aa, Artificial Sequence
  Description of Artificial Sequence: Synthetic peptide
  Seed: RYALDEKVAEL (MAGC3_HUMAN)
RMALDEKVAEL

SEQ ID NO: 108083 - protein, 9 aa, Artificial Sequence
  Description of Artificial Sequence: Synthetic peptide
  Seed: IPPQGPPKI (MAGC3_HUMAN)
ISPQGPPKI

SEQ ID NO: 108084 - protein, 9 aa, Artificial Sequence
  Description of Artificial Sequence: Synthetic peptide
  Seed: FSLRRAVSV (MAGC3_HUMAN)
FSLRRAVSL

SEQ ID NO: 108085 - protein, 9 aa, Artificial Sequence
  Description of Artificial Sequence: Synthetic peptide
  Seed: VIWEVLNAI (MAGC3_HUMAN)
VTWEVLNAA

SEQ ID NO: 108086 - protein, 9 aa, Artificial Sequence
  Description of Artificial Sequence: Synthetic peptide
  Seed: FSDGSLGQW (MAGC3_HUMAN)
FWDGSLGQV

SEQ ID NO: 108087 - protein, 9 aa, Artificial Sequence
  Description of Artificial Sequence: Synthetic peptide
  Seed: WRRGTGYTL (MAGC3_HUMAN)
WKRGTGYTM

SEQ ID NO: 108088 - protein, 9 aa, Artificial Sequence
  Description of Artificial Sequence: Synthetic peptide
  Seed: EVLSAIGPI (MAGC3_HUMAN)
EALSAIGPV

SEQ ID NO: 108089 - protein, 10 aa, Artificial Sequence
  Description of Artificial Sequence: Synthetic peptide
  Seed: TEVDPDHFYV (MAGC3_HUMAN)
TMVDPDHFYL

SEQ ID NO: 108090 - protein, 10 aa, Artificial Sequence
  Description of Artificial Sequence: Synthetic peptide
  Seed: YALSPVVLPP (MAGC3_HUMAN)
YDLSPVVLPT

SEQ ID NO: 108091 - protein, 9 aa, Artificial Sequence
  Description of Artificial Sequence: Synthetic peptide
  Seed: LIDDQGMPK (MAGC3_HUMAN)
LSDDQGMPL

SEQ ID NO: 108092 - protein, 10 aa, Artificial Sequence
  Description of Artificial Sequence: Synthetic peptide
  Seed: AFPSWYMDAL (MAGC3_HUMAN)
AFPSWYMDAY

SEQ ID NO: 108093 - protein, 10 aa, Artificial Sequence
  Description of Artificial Sequence: Synthetic peptide
  Seed: SKLSSIIPSA (MAGC3_HUMAN)
SHLSSIIPSA

SEQ ID NO: 108094 - protein, 10 aa, Artificial Sequence
  Description of Artificial Sequence: Synthetic peptide
  Seed: LILILSVIFI (MAGC3_HUMAN)
LMLILSVIFL

SEQ ID NO: 108095 - protein, 9 aa, Artificial Sequence
  Description of Artificial Sequence: Synthetic peptide
  Seed: WEVLSAIGP (MAGC3_HUMAN)
WEVLSAIGL

SEQ ID NO: 108096 - protein, 10 aa, Artificial Sequence
  Description of Artificial Sequence: Synthetic peptide
  Seed: YSAFHLGHLR (MAGC3_HUMAN)
YVAFHLGHLR

SEQ ID NO: 108097 - protein, 9 aa, Artificial Sequence
  Description of Artificial Sequence: Synthetic peptide
  Seed: HALPESESL (MAGC3_HUMAN)
HELPESESY

SEQ ID NO: 108098 - protein, 9 aa, Artificial Sequence
  Description of Artificial Sequence: Synthetic peptide
  Seed: LSSIIPSAF (MAGC3_HUMAN)
LSSIIPSAV

SEQ ID NO: 108099 - protein, 10 aa, Artificial Sequence
  Description of Artificial Sequence: Synthetic peptide
  Seed: MLTTVIKKYK (MAGC3_HUMAN)
MVTTVIKKYK

SEQ ID NO: 108100 - protein, 8 aa, Artificial Sequence
  Description of Artificial Sequence: Synthetic peptide
  Seed: SCSSPLLW (MAGC3_HUMAN)
SSSSPLLW

SEQ ID NO: 108101 - protein, 9 aa, Artificial Sequence
  Description of Artificial Sequence: Synthetic peptide
  Seed: HLREVRLFL (MAGC3_HUMAN)
HGREVRLFY

SEQ ID NO: 108102 - protein, 9 aa, Artificial Sequence
  Description of Artificial Sequence: Synthetic peptide
  Seed: MPKNCLLIL (MAGC3_HUMAN)
MVKNCLLIY

SEQ ID NO: 108103 - protein, 10 aa, Artificial Sequence
  Description of Artificial Sequence: Synthetic peptide
  Seed: RSAEGSVLDL (MAGC3_HUMAN)
RSAEGSVLDY

SEQ ID NO: 108104 - protein, 9 aa, Artificial Sequence
  Description of Artificial Sequence: Synthetic peptide
  Seed: YSAFHLGHL (MAGC3_HUMAN)
YAAFHLGHL

SEQ ID NO: 108105 - protein, 11 aa, Artificial Sequence
  Description of Artificial Sequence: Synthetic peptide
  Seed: ATFSDGSLGQW (MAGC3_HUMAN)
ALFSDGSLGQW

SEQ ID NO: 108106 - protein, 10 aa, Artificial Sequence
  Description of Artificial Sequence: Synthetic peptide
  Seed: TDMDPDNHSY (MAGC3_HUMAN)
TMMDPDNHSM

SEQ ID NO: 108107 - protein, 9 aa, Artificial Sequence
  Description of Artificial Sequence: Synthetic peptide
  Seed: MIFRKAREF (MAGC3_HUMAN)
MHFRKAREF

SEQ ID NO: 108108 - protein, 9 aa, Artificial Sequence
  Description of Artificial Sequence: Synthetic peptide
  Seed: LSDEQGMPQ (MAGC3_HUMAN)
LTDEQGMPI

SEQ ID NO: 108109 - protein, 9 aa, Artificial Sequence
  Description of Artificial Sequence: Synthetic peptide
  Seed: EVIWEVLSA (MAGC3_HUMAN)
ESIWEVLSI

SEQ ID NO: 108110 - protein, 10 aa, Artificial Sequence
  Description of Artificial Sequence: Synthetic peptide
  Seed: MIFGKAHEFI (MAGC3_HUMAN)
MTFGKAHEFM

SEQ ID NO: 108111 - protein, 9 aa, Artificial Sequence
  Description of Artificial Sequence: Synthetic peptide
  Seed: NAIGPWSAL (MAGC3_HUMAN)
NGIGPWSAY

SEQ ID NO: 108112 - protein, 9 aa, Artificial Sequence
  Description of Artificial Sequence: Synthetic peptide
  Seed: VLPPQPQPR (MAGC3_HUMAN)
VVPPQPQPL

SEQ ID NO: 108113 - protein, 9 aa, Artificial Sequence
  Description of Artificial Sequence: Synthetic peptide
  Seed: YQTKEPVTK (MAGC3_HUMAN)
YTTKEPVTK

SEQ ID NO: 108114 - protein, 9 aa, Artificial Sequence
  Description of Artificial Sequence: Synthetic peptide
  Seed: SIIPSAFPS (MAGC3_HUMAN)
SSIPSAFPA

SEQ ID NO: 108115 - protein, 11 aa, Artificial Sequence
  Description of Artificial Sequence: Synthetic peptide
  Seed: ATFSDGSLGQW (MAGC3_HUMAN)
AAFSDGSLGQL

SEQ ID NO: 108116 - protein, 9 aa, Artificial Sequence
  Description of Artificial Sequence: Synthetic peptide
  Seed: NAIGPWSAL (MAGC3_HUMAN)
NIIGPWSAM

SEQ ID NO: 108117 - protein, 8 aa, Artificial Sequence
  Description of Artificial Sequence: Synthetic peptide
  Seed: YFKLWRTL (MAGC3_HUMAN)
YYKLWRTY

SEQ ID NO: 108118 - protein, 9 aa, Artificial Sequence
  Description of Artificial Sequence: Synthetic peptide
  Seed: NTYTGYFPM (MAGC3_HUMAN)
NIYTGYFPF

SEQ ID NO: 108119 - protein, 10 aa, Artificial Sequence
  Description of Artificial Sequence: Synthetic peptide
  Seed: TEVDPDHFYV (MAGC3_HUMAN)
TTVDPDHFYI

SEQ ID NO: 108120 - protein, 9 aa, Artificial Sequence
  Description of Artificial Sequence: Synthetic peptide
  Seed: DMDPDNHSY (MAGC3_HUMAN)
DIDPDNHSF

SEQ ID NO: 108121 - protein, 10 aa, Artificial Sequence
  Description of Artificial Sequence: Synthetic peptide
  Seed: REVRLFLRGG (MAGC3_HUMAN)
REVRLFLRGA

SEQ ID NO: 108122 - protein, 9 aa, Artificial Sequence
  Description of Artificial Sequence: Synthetic peptide
  Seed: SQPEGKFSL (MAGC3_HUMAN)
SPPEGKFSM

SEQ ID NO: 108123 - protein, 10 aa, Artificial Sequence
  Description of Artificial Sequence: Synthetic peptide
  Seed: MDPDNHSYFF (MAGC3_HUMAN)
MEPDNHSYFL

SEQ ID NO: 108124 - protein, 10 aa, Artificial Sequence
  Description of Artificial Sequence: Synthetic peptide
  Seed: FKLWRTLSGS (MAGC3_HUMAN)
FKLWRTLSGA

SEQ ID NO: 108125 - protein, 9 aa, Artificial Sequence
  Description of Artificial Sequence: Synthetic peptide
  Seed: QTKEPVTKA (MAGC3_HUMAN)
QAKEPVTKM

SEQ ID NO: 108126 - protein, 10 aa, Artificial Sequence
  Description of Artificial Sequence: Synthetic peptide
  Seed: LTRAEMQMNV (MAGC3_HUMAN)
LLRAEMQMNA

SEQ ID NO: 108127 - protein, 9 aa, Artificial Sequence
  Description of Artificial Sequence: Synthetic peptide
  Seed: MPAAGMPPL (MAGC3_HUMAN)
MTAAGMPPI

SEQ ID NO: 108128 - protein, 9 aa, Artificial Sequence
  Description of Artificial Sequence: Synthetic peptide
  Seed: MPAAGMPPL (MAGC3_HUMAN)
MLAAGMPPL

SEQ ID NO: 108129 - protein, 10 aa, Artificial Sequence
  Description of Artificial Sequence: Synthetic peptide
  Seed: REVRLFLRGG (MAGC3_HUMAN)
RGVRLFLRGV

SEQ ID NO: 108130 - protein, 9 aa, Artificial Sequence
  Description of Artificial Sequence: Synthetic peptide
  Seed: GYTLSLPAV (MAGC3_HUMAN)
GYTLSLPAI

SEQ ID NO: 108131 - protein, 10 aa, Artificial Sequence
  Description of Artificial Sequence: Synthetic peptide
  Seed: MDSLVLCPTY (MAGC3_HUMAN)
MMSLVLCPTY

SEQ ID NO: 108132 - protein, 9 aa, Artificial Sequence
  Description of Artificial Sequence: Synthetic peptide
  Seed: EVIWEVLSA (MAGC3_HUMAN)
EGIWEVLSR

SEQ ID NO: 108133 - protein, 10 aa, Artificial Sequence
  Description of Artificial Sequence: Synthetic peptide
  Seed: ATYALSPVVL (MAGC3_HUMAN)
ASYALSPVVY

SEQ ID NO: 108134 - protein, 9 aa, Artificial Sequence
  Description of Artificial Sequence: Synthetic peptide
  Seed: DYSAFHLGH (MAGC3_HUMAN)
DQSAFHLGR

SEQ ID NO: 108135 - protein, 9 aa, Artificial Sequence
  Description of Artificial Sequence: Synthetic peptide
  Seed: GYFPMIFRK (MAGC3_HUMAN)
GFFPMIFRY

SEQ ID NO: 108136 - protein, 10 aa, Artificial Sequence
  Description of Artificial Sequence: Synthetic peptide
  Seed: RLWGEKAGSL (MAGC3_HUMAN)
RQWGEKAGSV

SEQ ID NO: 108137 - protein, 9 aa, Artificial Sequence
  Description of Artificial Sequence: Synthetic peptide
  Seed: YSAFHLGHL (MAGC3_HUMAN)
YLAFHLGHT

SEQ ID NO: 108138 - protein, 10 aa, Artificial Sequence
  Description of Artificial Sequence: Synthetic peptide
  Seed: SKLSSIIPSA (MAGC3_HUMAN)
SHLSSIIPSV

SEQ ID NO: 108139 - protein, 9 aa, Artificial Sequence
  Description of Artificial Sequence: Synthetic peptide
  Seed: YFFEDTLDL (MAGC3_HUMAN)
YYFEDTLDW

SEQ ID NO: 108140 - protein, 9 aa, Artificial Sequence
  Description of Artificial Sequence: Synthetic peptide
  Seed: GYFPMIFRK (MAGC3_HUMAN)
GNFPMIFRY

SEQ ID NO: 108141 - protein, 9 aa, Artificial Sequence
  Description of Artificial Sequence: Synthetic peptide
  Seed: ALDEKVAEL (MAGC3_HUMAN)
AVDEKVAEL

SEQ ID NO: 108142 - protein, 9 aa, Artificial Sequence
  Description of Artificial Sequence: Synthetic peptide
  Seed: ALDEKVAEL (MAGC3_HUMAN)
AADEKVAEF

SEQ ID NO: 108143 - protein, 10 aa, Artificial Sequence
  Description of Artificial Sequence: Synthetic peptide
  Seed: ATYALSPVVL (MAGC3_HUMAN)
AYYALSPVVI

SEQ ID NO: 108144 - protein, 9 aa, Artificial Sequence
  Description of Artificial Sequence: Synthetic peptide
  Seed: MIFGKAHEF (MAGC3_HUMAN)
MSFGKAHER

SEQ ID NO: 108145 - protein, 10 aa, Artificial Sequence
  Description of Artificial Sequence: Synthetic peptide
  Seed: TTDDATAMAS (MAGC3_HUMAN)
TTDDATAMAF

SEQ ID NO: 108146 - protein, 9 aa, Artificial Sequence
  Description of Artificial Sequence: Synthetic peptide
  Seed: MLLPCHWVL (MAGC3_HUMAN)
MVLPCHWVV

SEQ ID NO: 108147 - protein, 9 aa, Artificial Sequence
  Description of Artificial Sequence: Synthetic peptide
  Seed: MLLPCHWVL (MAGC3_HUMAN)
MSLPCHWVI

SEQ ID NO: 108148 - protein, 10 aa, Artificial Sequence
  Description of Artificial Sequence: Synthetic peptide
  Seed: FPSWYMDALK (MAGC3_HUMAN)
FKSWYMDALR

SEQ ID NO: 108149 - protein, 9 aa, Artificial Sequence
  Description of Artificial Sequence: Synthetic peptide
  Seed: FPSWYMDAL (MAGC3_HUMAN)
FPSWYMDAP

SEQ ID NO: 108150 - protein, 9 aa, Artificial Sequence
  Description of Artificial Sequence: Synthetic peptide
  Seed: GYFPMIFRK (MAGC3_HUMAN)
GAFPMIFRY

SEQ ID NO: 108151 - protein, 9 aa, Artificial Sequence
  Description of Artificial Sequence: Synthetic peptide
  Seed: REVLEFLSK (MAGC3_HUMAN)
RDVLEFLSM

SEQ ID NO: 108152 - protein, 10 aa, Artificial Sequence
  Description of Artificial Sequence: Synthetic peptide
  Seed: VVLPPQPQPR (MAGC3_HUMAN)
VALPPQPQPF

SEQ ID NO: 108153 - protein, 9 aa, Artificial Sequence
  Description of Artificial Sequence: Synthetic peptide
  Seed: FSDGSLGQW (MAGC3_HUMAN)
FIDGSLGQL

SEQ ID NO: 108154 - protein, 10 aa, Artificial Sequence
  Description of Artificial Sequence: Synthetic peptide
  Seed: SIIPSAFPSW (MAGC3_HUMAN)
SAIPSAFPSM

SEQ ID NO: 108155 - protein, 9 aa, Artificial Sequence
  Description of Artificial Sequence: Synthetic peptide
  Seed: TLDEKVDKL (MAGC3_HUMAN)
TNDEKVDKF

SEQ ID NO: 108156 - protein, 11 aa, Artificial Sequence
  Description of Artificial Sequence: Synthetic peptide
  Seed: FIELIFGIALT (MAGC3_HUMAN)
FHELIFGIALL

SEQ ID NO: 108157 - protein, 9 aa, Artificial Sequence
  Description of Artificial Sequence: Synthetic peptide
  Seed: HSYFFEDTL (MAGC3_HUMAN)
HTYFFEDTL

SEQ ID NO: 108158 - protein, 10 aa, Artificial Sequence
  Description of Artificial Sequence: Synthetic peptide
  Seed: IELIFGIALT (MAGC3_HUMAN)
IKLIFGIALV

SEQ ID NO: 108159 - protein, 9 aa, Artificial Sequence
  Description of Artificial Sequence: Synthetic peptide
  Seed: QLSDLHFGS (MAGC3_HUMAN)
QISDLHFGI

SEQ ID NO: 108160 - protein, 9 aa, Artificial Sequence
  Description of Artificial Sequence: Synthetic peptide
  Seed: FSLRRAVSV (MAGC3_HUMAN)
FQLRRAVSA

SEQ ID NO: 108161 - protein, 9 aa, Artificial Sequence
  Description of Artificial Sequence: Synthetic peptide
  Seed: MLLPCHWVL (MAGC3_HUMAN)
MELPCHWVM

SEQ ID NO: 108162 - protein, 11 aa, Artificial Sequence
  Description of Artificial Sequence: Synthetic peptide
  Seed: TLWKDSDLPTW (MAGC3_HUMAN)
TQWKDSDLPTF

SEQ ID NO: 108163 - protein, 9 aa, Artificial Sequence
  Description of Artificial Sequence: Synthetic peptide
  Seed: SQPEGKFSL (MAGC3_HUMAN)
SIPEGKFSF

SEQ ID NO: 108164 - protein, 9 aa, Artificial Sequence
  Description of Artificial Sequence: Synthetic peptide
  Seed: YFFEDTLDL (MAGC3_HUMAN)
YTFEDTLDA

SEQ ID NO: 108165 - protein, 10 aa, Artificial Sequence
  Description of Artificial Sequence: Synthetic peptide
  Seed: LNAIGPWSAL (MAGC3_HUMAN)
LLAIGPWSAF

SEQ ID NO: 108166 - protein, 10 aa, Artificial Sequence
  Description of Artificial Sequence: Synthetic peptide
  Seed: KLVQFLLLKY (MAGC3_HUMAN)
KSVQFLLLKR

SEQ ID NO: 108167 - protein, 11 aa, Artificial Sequence
  Description of Artificial Sequence: Synthetic peptide
  Seed: FSDGSLGQWVK (MAGC3_HUMAN)
FTDGSLGQWVY

SEQ ID NO: 108168 - protein, 9 aa, Artificial Sequence
  Description of Artificial Sequence: Synthetic peptide
  Seed: MDPDNHSYF (MAGC3_HUMAN)
MLPDNHSYF

SEQ ID NO: 108169 - protein, 9 aa, Artificial Sequence
  Description of Artificial Sequence: Synthetic peptide
  Seed: KAHEFIELI (MAGC3_HUMAN)
KDHEFIELI

SEQ ID NO: 108170 - protein, 9 aa, Artificial Sequence
  Description of Artificial Sequence: Synthetic peptide
  Seed: MASASPSVM (MAGC3_HUMAN)
MKSASPSVM

SEQ ID NO: 108171 - protein, 10 aa, Artificial Sequence
  Description of Artificial Sequence: Synthetic peptide
  Seed: YALDEKVAEL (MAGC3_HUMAN)
YILDEKVAEM

SEQ ID NO: 108172 - protein, 11 aa, Artificial Sequence
  Description of Artificial Sequence: Synthetic peptide
  Seed: AGSLPESEPLF (MAGC3_HUMAN)
ASSLPESEPLW

SEQ ID NO: 108173 - protein, 10 aa, Artificial Sequence
  Description of Artificial Sequence: Synthetic peptide
  Seed: LVLCPTYFKL (MAGC3_HUMAN)
LILCPTYFKV

SEQ ID NO: 108174 - protein, 10 aa, Artificial Sequence
  Description of Artificial Sequence: Synthetic peptide
  Seed: RLLILILSVI (MAGC3_HUMAN)
RFLILILSVA

SEQ ID NO: 108175 - protein, 9 aa, Artificial Sequence
  Description of Artificial Sequence: Synthetic peptide
  Seed: IIDTTDDAT (MAGC3_HUMAN)
IVDTTDDAM

SEQ ID NO: 108176 - protein, 9 aa, Artificial Sequence
  Description of Artificial Sequence: Synthetic peptide
  Seed: VDPDHFYVF (MAGC3_HUMAN)
VIPDHFYVY

SEQ ID NO: 108177 - protein, 11 aa, Artificial Sequence
  Description of Artificial Sequence: Synthetic peptide
  Seed: RTLSGSPGLQL (MAGC3_HUMAN)
RILSGSPGLQR

SEQ ID NO: 108178 - protein, 10 aa, Artificial Sequence
  Description of Artificial Sequence: Synthetic peptide
  Seed: INTYTGYFPM (MAGC3_HUMAN)
IYTYTGYFPY

SEQ ID NO: 108179 - protein, 10 aa, Artificial Sequence
  Description of Artificial Sequence: Synthetic peptide
  Seed: YFPMIFRKAR (MAGC3_HUMAN)
YVPMIFRKAR

SEQ ID NO: 108180 - protein, 10 aa, Artificial Sequence
  Description of Artificial Sequence: Synthetic peptide
  Seed: LILILSVIFI (MAGC3_HUMAN)
LYLILSVIFV

SEQ ID NO: 108181 - protein, 10 aa, Artificial Sequence
  Description of Artificial Sequence: Synthetic peptide
  Seed: VLSAIGPIQR (MAGC3_HUMAN)
VSSAIGPIQR

SEQ ID NO: 108182 - protein, 10 aa, Artificial Sequence
  Description of Artificial Sequence: Synthetic peptide
  Seed: MDSLVLCPTY (MAGC3_HUMAN)
MKSLVLCPTW

SEQ ID NO: 108183 - protein, 11 aa, Artificial Sequence
  Description of Artificial Sequence: Synthetic peptide
  Seed: KVAELVQFLLL (MAGC3_HUMAN)
KLAELVQFLLN

SEQ ID NO: 108184 - protein, 9 aa, Artificial Sequence
  Description of Artificial Sequence: Synthetic peptide
  Seed: FHLGHLREV (MAGC3_HUMAN)
FILGHLREI

SEQ ID NO: 108185 - protein, 9 aa, Artificial Sequence
  Description of Artificial Sequence: Synthetic peptide
  Seed: KDSDLPTWR (MAGC3_HUMAN)
KTSDLPTWK

SEQ ID NO: 108186 - protein, 9 aa, Artificial Sequence
  Description of Artificial Sequence: Synthetic peptide
  Seed: FPSWYMDAL (MAGC3_HUMAN)
FSSWYMDAF

SEQ ID NO: 108187 - protein, 9 aa, Artificial Sequence
  Description of Artificial Sequence: Synthetic peptide
  Seed: NTYTGYFPM (MAGC3_HUMAN)
NLYTGYFPA

SEQ ID NO: 108188 - protein, 11 aa, Artificial Sequence
  Description of Artificial Sequence: Synthetic peptide
  Seed: EILFGISLTEV (MAGC3_HUMAN)
EFLFGISLTEL

SEQ ID NO: 108189 - protein, 9 aa, Artificial Sequence
  Description of Artificial Sequence: Synthetic peptide
  Seed: AIGPIQRPA (MAGC3_HUMAN)
AAGPIQRPL

SEQ ID NO: 108190 - protein, 10 aa, Artificial Sequence
  Description of Artificial Sequence: Synthetic peptide
  Seed: ALDEKVAELV (MAGC3_HUMAN)
AIDEKVAELF

SEQ ID NO: 108191 - protein, 10 aa, Artificial Sequence
  Description of Artificial Sequence: Synthetic peptide
  Seed: EIPPQGPPKI (MAGC3_HUMAN)
EVPPQGPPKR

SEQ ID NO: 108192 - protein, 9 aa, Artificial Sequence
  Description of Artificial Sequence: Synthetic peptide
  Seed: HFYVFVNTL (MAGC3_HUMAN)
HPYVFVNTL

SEQ ID NO: 108193 - protein, 9 aa, Artificial Sequence
  Description of Artificial Sequence: Synthetic peptide
  Seed: MDPDNHSYF (MAGC3_HUMAN)
MAPDNHSYL

SEQ ID NO: 108194 - protein, 9 aa, Artificial Sequence
  Description of Artificial Sequence: Synthetic peptide
  Seed: KLSSIIPSA (MAGC3_HUMAN)
KLSSIIPSY

SEQ ID NO: 108195 - protein, 10 aa, Artificial Sequence
  Description of Artificial Sequence: Synthetic peptide
  Seed: IKKYKDYFPM (MAGC3_HUMAN)
IVKYKDYFPY

SEQ ID NO: 108196 - protein, 9 aa, Artificial Sequence
  Description of Artificial Sequence: Synthetic peptide
  Seed: IIPSAFPSW (MAGC3_HUMAN)
IAPSAFPSM

SEQ ID NO: 108197 - protein, 9 aa, Artificial Sequence
  Description of Artificial Sequence: Synthetic peptide
  Seed: LSDEQGMPQ (MAGC3_HUMAN)
LCDEQGMPM

SEQ ID NO: 108198 - protein, 9 aa, Artificial Sequence
  Description of Artificial Sequence: Synthetic peptide
  Seed: NAIGPWSAL (MAGC3_HUMAN)
NFIGPWSAY

SEQ ID NO: 108199 - protein, 9 aa, Artificial Sequence
  Description of Artificial Sequence: Synthetic peptide
  Seed: WVKNTCATY (MAGC3_HUMAN)
WPKNTCATF

SEQ ID NO: 108200 - protein, 9 aa, Artificial Sequence
  Description of Artificial Sequence: Synthetic peptide
  Seed: EVDPDHFYV (MAGC3_HUMAN)
EMDPDHFYL

SEQ ID NO: 108201 - protein, 9 aa, Artificial Sequence
  Description of Artificial Sequence: Synthetic peptide
  Seed: REVLEFLSK (MAGC3_HUMAN)
REVLEFLSP

SEQ ID NO: 108202 - protein, 11 aa, Artificial Sequence
  Description of Artificial Sequence: Synthetic peptide
  Seed: RTLSGSPGLQL (MAGC3_HUMAN)
RTLSGSPGLQR

SEQ ID NO: 108203 - protein, 9 aa, Artificial Sequence
  Description of Artificial Sequence: Synthetic peptide
  Seed: SASPSVMST (MAGC3_HUMAN)
SNSPSVMSM

SEQ ID NO: 108204 - protein, 10 aa, Artificial Sequence
  Description of Artificial Sequence: Synthetic peptide
  Seed: TAMASASPSV (MAGC3_HUMAN)
TYMASASPSL

SEQ ID NO: 108205 - protein, 10 aa, Artificial Sequence
  Description of Artificial Sequence: Synthetic peptide
  Seed: FKLWRTLSGS (MAGC3_HUMAN)
FTLWRTLSGI

SEQ ID NO: 108206 - protein, 8 aa, Artificial Sequence
  Description of Artificial Sequence: Synthetic peptide
  Seed: FIELIFGI (MAGC3_HUMAN)
FLELIFGL

SEQ ID NO: 108207 - protein, 9 aa, Artificial Sequence
  Description of Artificial Sequence: Synthetic peptide
  Seed: KVAELVQFL (MAGC3_HUMAN)
KSAELVQFM

SEQ ID NO: 108208 - protein, 9 aa, Artificial Sequence
  Description of Artificial Sequence: Synthetic peptide
  Seed: REVLEFLSK (MAGC3_HUMAN)
RMVLEFLSK

SEQ ID NO: 108209 - protein, 11 aa, Artificial Sequence
  Description of Artificial Sequence: Synthetic peptide
  Seed: EILFGISLTEV (MAGC3_HUMAN)
EFLFGISLTEV

SEQ ID NO: 108210 - protein, 9 aa, Artificial Sequence
  Description of Artificial Sequence: Synthetic peptide
  Seed: ATYALSPVV (MAGC3_HUMAN)
AIYALSPVV

SEQ ID NO: 108211 - protein, 9 aa, Artificial Sequence
  Description of Artificial Sequence: Synthetic peptide
  Seed: HALPESESL (MAGC3_HUMAN)
HALPESESM

SEQ ID NO: 108212 - protein, 9 aa, Artificial Sequence
  Description of Artificial Sequence: Synthetic peptide
  Seed: LSSIIPSAF (MAGC3_HUMAN)
LQSIIPSAL

SEQ ID NO: 108213 - protein, 9 aa, Artificial Sequence
  Description of Artificial Sequence: Synthetic peptide
  Seed: SLVLCPTYF (MAGC3_HUMAN)
SFVLCPTYY

SEQ ID NO: 108214 - protein, 9 aa, Artificial Sequence
  Description of Artificial Sequence: Synthetic peptide
  Seed: SAIGPIQRP (MAGC3_HUMAN)
SVIGPIQRL

SEQ ID NO: 108215 - protein, 9 aa, Artificial Sequence
  Description of Artificial Sequence: Synthetic peptide
  Seed: ILILSVIFI (MAGC3_HUMAN)
IIILSVIFV

SEQ ID NO: 108216 - protein, 9 aa, Artificial Sequence
  Description of Artificial Sequence: Synthetic peptide
  Seed: WYMDALKDM (MAGC3_HUMAN)
WFMDALKDY

SEQ ID NO: 108217 - protein, 11 aa, Artificial Sequence
  Description of Artificial Sequence: Synthetic peptide
  Seed: FLSKLSSIIPS (MAGC3_HUMAN)
FQSKLSSIIPV

SEQ ID NO: 108218 - protein, 9 aa, Artificial Sequence
  Description of Artificial Sequence: Synthetic peptide
  Seed: AGFADVLSR (MAGC3_HUMAN)
ASFADVLSH

SEQ ID NO: 108219 - protein, 9 aa, Artificial Sequence
  Description of Artificial Sequence: Synthetic peptide
  Seed: EKVDKLVQF (MAGC3_HUMAN)
ERVDKLVQV

SEQ ID NO: 108220 - protein, 11 aa, Artificial Sequence
  Description of Artificial Sequence: Synthetic peptide
  Seed: ALAGFADVLSR (MAGC3_HUMAN)
AMAGFADVLSK

SEQ ID NO: 108221 - protein, 9 aa, Artificial Sequence
  Description of Artificial Sequence: Synthetic peptide
  Seed: MQMNVINTY (MAGC3_HUMAN)
MYMNVINTH

SEQ ID NO: 108222 - protein, 9 aa, Artificial Sequence
  Description of Artificial Sequence: Synthetic peptide
  Seed: LRSAEGSVL (MAGC3_HUMAN)
LRSAEGSVM

SEQ ID NO: 108223 - protein, 9 aa, Artificial Sequence
  Description of Artificial Sequence: Synthetic peptide
  Seed: SPVVLPPQP (MAGC3_HUMAN)
SPVVLPPQI

SEQ ID NO: 108224 - protein, 9 aa, Artificial Sequence
  Description of Artificial Sequence: Synthetic peptide
  Seed: VPEEVIWEV (MAGC3_HUMAN)
VAEEVIWEY

SEQ ID NO: 108225 - protein, 9 aa, Artificial Sequence
  Description of Artificial Sequence: Synthetic peptide
  Seed: KVAELVQFL (MAGC3_HUMAN)
KGAELVQFV

SEQ ID NO: 108226 - protein, 9 aa, Artificial Sequence
  Description of Artificial Sequence: Synthetic peptide
  Seed: ASEEVIWEV (MAGC3_HUMAN)
AIEEVIWEM

SEQ ID NO: 108227 - protein, 11 aa, Artificial Sequence
  Description of Artificial Sequence: Synthetic peptide
  Seed: FIELIFGIALT (MAGC3_HUMAN)
FKELIFGIALL

SEQ ID NO: 108228 - protein, 9 aa, Artificial Sequence
  Description of Artificial Sequence: Synthetic peptide
  Seed: SLVLCPTYF (MAGC3_HUMAN)
SFVLCPTYF

SEQ ID NO: 108229 - protein, 10 aa, Artificial Sequence
  Description of Artificial Sequence: Synthetic peptide
  Seed: SCSSPLLWTR (MAGC3_HUMAN)
STSSPLLWTK

SEQ ID NO: 108230 - protein, 9 aa, Artificial Sequence
  Description of Artificial Sequence: Synthetic peptide
  Seed: MPKNCLLIL (MAGC3_HUMAN)
MPKNCLLIT

SEQ ID NO: 108231 - protein, 9 aa, Artificial Sequence
  Description of Artificial Sequence: Synthetic peptide
  Seed: MQMNVINTY (MAGC3_HUMAN)
MSMNVINTM

SEQ ID NO: 108232 - protein, 10 aa, Artificial Sequence
  Description of Artificial Sequence: Synthetic peptide
  Seed: YALDEKVAEL (MAGC3_HUMAN)
YILDEKVAEC

SEQ ID NO: 108233 - protein, 9 aa, Artificial Sequence
  Description of Artificial Sequence: Synthetic peptide
  Seed: IPPQGPPKI (MAGC3_HUMAN)
ISPQGPPKY

SEQ ID NO: 108234 - protein, 9 aa, Artificial Sequence
  Description of Artificial Sequence: Synthetic peptide
  Seed: IQRPAREVL (MAGC3_HUMAN)
IARPAREVM

SEQ ID NO: 108235 - protein, 9 aa, Artificial Sequence
  Description of Artificial Sequence: Synthetic peptide
  Seed: GFADVLSRL (MAGC3_HUMAN)
GLADVLSRL

SEQ ID NO: 108236 - protein, 10 aa, Artificial Sequence
  Description of Artificial Sequence: Synthetic peptide
  Seed: FADVLSRLAL (MAGC3_HUMAN)
FTDVLSRLAF

SEQ ID NO: 108237 - protein, 10 aa, Artificial Sequence
  Description of Artificial Sequence: Synthetic peptide
  Seed: RSAEGSVLDL (MAGC3_HUMAN)
RLAEGSVLDF

SEQ ID NO: 108238 - protein, 9 aa, Artificial Sequence
  Description of Artificial Sequence: Synthetic peptide
  Seed: SQPEGKFSL (MAGC3_HUMAN)
SPPEGKFSY

SEQ ID NO: 108239 - protein, 9 aa, Artificial Sequence
  Description of Artificial Sequence: Synthetic peptide
  Seed: SLRRAVSVK (MAGC3_HUMAN)
SSRRAVSVG

SEQ ID NO: 108240 - protein, 9 aa, Artificial Sequence
  Description of Artificial Sequence: Synthetic peptide
  Seed: ISPQGPPQS (MAGC3_HUMAN)
ICPQGPPQM

SEQ ID NO: 108241 - protein, 9 aa, Artificial Sequence
  Description of Artificial Sequence: Synthetic peptide
  Seed: FADVLSRLA (MAGC3_HUMAN)
FSDVLSRLV

SEQ ID NO: 108242 - protein, 9 aa, Artificial Sequence
  Description of Artificial Sequence: Synthetic peptide
  Seed: IPPQGPPKI (MAGC3_HUMAN)
IYPQGPPKI

SEQ ID NO: 108243 - protein, 9 aa, Artificial Sequence
  Description of Artificial Sequence: Synthetic peptide
  Seed: SQPEGKFSL (MAGC3_HUMAN)
SIPEGKFSM

SEQ ID NO: 108244 - protein, 10 aa, Artificial Sequence
  Description of Artificial Sequence: Synthetic peptide
  Seed: NAIGPWSALA (MAGC3_HUMAN)
NAIGPWSALV

SEQ ID NO: 108245 - protein, 9 aa, Artificial Sequence
  Description of Artificial Sequence: Synthetic peptide
  Seed: HALPESESL (MAGC3_HUMAN)
HVLPESESY

SEQ ID NO: 108246 - protein, 10 aa, Artificial Sequence
  Description of Artificial Sequence: Synthetic peptide
  Seed: EKVAELVQFL (MAGC3_HUMAN)
ETVAELVQFI

SEQ ID NO: 108247 - protein, 9 aa, Artificial Sequence
  Description of Artificial Sequence: Synthetic peptide
  Seed: IQRPAREVL (MAGC3_HUMAN)
IVRPAREVF

SEQ ID NO: 108248 - protein, 10 aa, Artificial Sequence
  Description of Artificial Sequence: Synthetic peptide
  Seed: KVAELVQFLL (MAGC3_HUMAN)
KSAELVQFLL

SEQ ID NO: 108249 - protein, 9 aa, Artificial Sequence
  Description of Artificial Sequence: Synthetic peptide
  Seed: SAFHLGHLR (MAGC3_HUMAN)
SQFHLGHLF

SEQ ID NO: 108250 - protein, 9 aa, Artificial Sequence
  Description of Artificial Sequence: Synthetic peptide
  Seed: SPSVMSTNF (MAGC3_HUMAN)
SASVMSTNY

SEQ ID NO: 108251 - protein, 9 aa, Artificial Sequence
  Description of Artificial Sequence: Synthetic peptide
  Seed: TGYFPMIFR (MAGC3_HUMAN)
TPYFPMIFK

SEQ ID NO: 108252 - protein, 10 aa, Artificial Sequence
  Description of Artificial Sequence: Synthetic peptide
  Seed: FSDGSLGQWV (MAGC3_HUMAN)
FSDGSLGQWL

SEQ ID NO: 108253 - protein, 9 aa, Artificial Sequence
  Description of Artificial Sequence: Synthetic peptide
  Seed: MPAAGMPPL (MAGC3_HUMAN)
MHAAGMPPI

SEQ ID NO: 108254 - protein, 9 aa, Artificial Sequence
  Description of Artificial Sequence: Synthetic peptide
  Seed: FSLRRAVSV (MAGC3_HUMAN)
FLLRRAVSY

SEQ ID NO: 108255 - protein, 9 aa, Artificial Sequence
  Description of Artificial Sequence: Synthetic peptide
  Seed: LILSMIFIK (MAGC3_HUMAN)
LALSMIFIR

SEQ ID NO: 108256 - protein, 9 aa, Artificial Sequence
  Description of Artificial Sequence: Synthetic peptide
  Seed: HLREVRLFL (MAGC3_HUMAN)
HPREVRLFI

SEQ ID NO: 108257 - protein, 10 aa, Artificial Sequence
  Description of Artificial Sequence: Synthetic peptide
  Seed: TYTGYFPMIF (MAGC3_HUMAN)
TTTGYFPMIW

SEQ ID NO: 108258 - protein, 11 aa, Artificial Sequence
  Description of Artificial Sequence: Synthetic peptide
  Seed: LDSCSSPLLWT (MAGC3_HUMAN)
LSSCSSPLLWW

SEQ ID NO: 108259 - protein, 9 aa, Artificial Sequence
  Description of Artificial Sequence: Synthetic peptide
  Seed: HFYVFVNTL (MAGC3_HUMAN)
HAYVFVNTM

SEQ ID NO: 108260 - protein, 10 aa, Artificial Sequence
  Description of Artificial Sequence: Synthetic peptide
  Seed: MDPDNHSYFF (MAGC3_HUMAN)
MPPDNHSYFW

SEQ ID NO: 108261 - protein, 9 aa, Artificial Sequence
  Description of Artificial Sequence: Synthetic peptide
  Seed: ISPQGPPQS (MAGC3_HUMAN)
IAPQGPPQF

SEQ ID NO: 108262 - protein, 10 aa, Artificial Sequence
  Description of Artificial Sequence: Synthetic peptide
  Seed: MLTTVIKKYK (MAGC3_HUMAN)
MDTTVIKKYK

SEQ ID NO: 108263 - protein, 10 aa, Artificial Sequence
  Description of Artificial Sequence: Synthetic peptide
  Seed: FSDGSLGQWV (MAGC3_HUMAN)
FTDGSLGQWL

SEQ ID NO: 108264 - protein, 10 aa, Artificial Sequence
  Description of Artificial Sequence: Synthetic peptide
  Seed: LDLANPQGLA (MAGC3_HUMAN)
LALANPQGLV

SEQ ID NO: 108265 - protein, 9 aa, Artificial Sequence
  Description of Artificial Sequence: Synthetic peptide
  Seed: IIPSAFPSW (MAGC3_HUMAN)
IIPSAFPSV

SEQ ID NO: 108266 - protein, 10 aa, Artificial Sequence
  Description of Artificial Sequence: Synthetic peptide
  Seed: LNAIGPWSAL (MAGC3_HUMAN)
LAAIGPWSAL

SEQ ID NO: 108267 - protein, 9 aa, Artificial Sequence
  Description of Artificial Sequence: Synthetic peptide
  Seed: HFYVFVNTL (MAGC3_HUMAN)
HRYVFVNTV

SEQ ID NO: 108268 - protein, 10 aa, Artificial Sequence
  Description of Artificial Sequence: Synthetic peptide
  Seed: VKNTCATYAL (MAGC3_HUMAN)
VMNTCATYAY

SEQ ID NO: 108269 - protein, 11 aa, Artificial Sequence
  Description of Artificial Sequence: Synthetic peptide
  Seed: ATFSDGSLGQW (MAGC3_HUMAN)
ATFSDGSLGQY

SEQ ID NO: 108270 - protein, 10 aa, Artificial Sequence
  Description of Artificial Sequence: Synthetic peptide
  Seed: TTDDATAMAS (MAGC3_HUMAN)
TWDDATAMAL

SEQ ID NO: 108271 - protein, 9 aa, Artificial Sequence
  Description of Artificial Sequence: Synthetic peptide
  Seed: WRRGTGYTL (MAGC3_HUMAN)
WMRGTGYTW

SEQ ID NO: 108272 - protein, 9 aa, Artificial Sequence
  Description of Artificial Sequence: Synthetic peptide
  Seed: YSAFHLGHL (MAGC3_HUMAN)
YAAFHLGHR

SEQ ID NO: 108273 - protein, 9 aa, Artificial Sequence
  Description of Artificial Sequence: Synthetic peptide
  Seed: KAHEFIELI (MAGC3_HUMAN)
KTHEFIELW

SEQ ID NO: 108274 - protein, 9 aa, Artificial Sequence
  Description of Artificial Sequence: Synthetic peptide
  Seed: VINTYTGYF (MAGC3_HUMAN)
VANTYTGYW

SEQ ID NO: 108275 - protein, 10 aa, Artificial Sequence
  Description of Artificial Sequence: Synthetic peptide
  Seed: YSAFHLGHLR (MAGC3_HUMAN)
YYAFHLGHLR

SEQ ID NO: 108276 - protein, 9 aa, Artificial Sequence
  Description of Artificial Sequence: Synthetic peptide
  Seed: TEVDPDHFY (MAGC3_HUMAN)
TSVDPDHFY

SEQ ID NO: 108277 - protein, 9 aa, Artificial Sequence
  Description of Artificial Sequence: Synthetic peptide
  Seed: VPEEVIWEV (MAGC3_HUMAN)
VCEEVIWEL

SEQ ID NO: 108278 - protein, 9 aa, Artificial Sequence
  Description of Artificial Sequence: Synthetic peptide
  Seed: EVLEFLSKL (MAGC3_HUMAN)
ESLEFLSKY

SEQ ID NO: 108279 - protein, 10 aa, Artificial Sequence
  Description of Artificial Sequence: Synthetic peptide
  Seed: GEDEDMPAAG (MAGC3_HUMAN)
GEDEDMPAAI

SEQ ID NO: 108280 - protein, 9 aa, Artificial Sequence
  Description of Artificial Sequence: Synthetic peptide
  Seed: NAIGPWSAL (MAGC3_HUMAN)
NSIGPWSAV

SEQ ID NO: 108281 - protein, 9 aa, Artificial Sequence
  Description of Artificial Sequence: Synthetic peptide
  Seed: ATDKDYSAF (MAGC3_HUMAN)
ASDKDYSAV

SEQ ID NO: 108282 - protein, 9 aa, Artificial Sequence
  Description of Artificial Sequence: Synthetic peptide
  Seed: HALPESESL (MAGC3_HUMAN)
HMLPESESL

SEQ ID NO: 108283 - protein, 10 aa, Artificial Sequence
  Description of Artificial Sequence: Synthetic peptide
  Seed: FSDGSLGQWV (MAGC3_HUMAN)
FTDGSLGQWM

SEQ ID NO: 108284 - protein, 9 aa, Artificial Sequence
  Description of Artificial Sequence: Synthetic peptide
  Seed: FPSWYMDAL (MAGC3_HUMAN)
FHSWYMDAV

SEQ ID NO: 108285 - protein, 9 aa, Artificial Sequence
  Description of Artificial Sequence: Synthetic peptide
  Seed: IPPQGPPKI (MAGC3_HUMAN)
IHPQGPPKI

SEQ ID NO: 108286 - protein, 9 aa, Artificial Sequence
  Description of Artificial Sequence: Synthetic peptide
  Seed: KLWRTLSGS (MAGC3_HUMAN)
KMWRTLSGT

SEQ ID NO: 108287 - protein, 9 aa, Artificial Sequence
  Description of Artificial Sequence: Synthetic peptide
  Seed: WESEGPEAF (MAGC3_HUMAN)
WESEGPEAV

SEQ ID NO: 108288 - protein, 9 aa, Artificial Sequence
  Description of Artificial Sequence: Synthetic peptide
  Seed: NAIGPWSAL (MAGC3_HUMAN)
NTIGPWSAI

SEQ ID NO: 108289 - protein, 9 aa, Artificial Sequence
  Description of Artificial Sequence: Synthetic peptide
  Seed: YSAFHLGHL (MAGC3_HUMAN)
YVAFHLGHM

SEQ ID NO: 108290 - protein, 9 aa, Artificial Sequence
  Description of Artificial Sequence: Synthetic peptide
  Seed: KVAELVQFL (MAGC3_HUMAN)
KFAELVQFR

SEQ ID NO: 108291 - protein, 10 aa, Artificial Sequence
  Description of Artificial Sequence: Synthetic peptide
  Seed: EEVIWEVLNA (MAGC3_HUMAN)
ERVIWEVLNV

SEQ ID NO: 108292 - protein, 9 aa, Artificial Sequence
  Description of Artificial Sequence: Synthetic peptide
  Seed: LKYQTKEPV (MAGC3_HUMAN)
LMYQTKEPI

SEQ ID NO: 108293 - protein, 10 aa, Artificial Sequence
  Description of Artificial Sequence: Synthetic peptide
  Seed: ELVQFLLLKY (MAGC3_HUMAN)
ELVQFLLLKK

SEQ ID NO: 108294 - protein, 10 aa, Artificial Sequence
  Description of Artificial Sequence: Synthetic peptide
  Seed: MQMNVINTYT (MAGC3_HUMAN)
MKMNVINTYH

SEQ ID NO: 108295 - protein, 9 aa, Artificial Sequence
  Description of Artificial Sequence: Synthetic peptide
  Seed: LSAIGPIQR (MAGC3_HUMAN)
LLAIGPIQR

SEQ ID NO: 108296 - protein, 10 aa, Artificial Sequence
  Description of Artificial Sequence: Synthetic peptide
  Seed: MQMNVINTYT (MAGC3_HUMAN)
MFMNVINTYM

SEQ ID NO: 108297 - protein, 9 aa, Artificial Sequence
  Description of Artificial Sequence: Synthetic peptide
  Seed: IIPSAFPSW (MAGC3_HUMAN)
ICPSAFPSL

SEQ ID NO: 108298 - protein, 11 aa, Artificial Sequence
  Description of Artificial Sequence: Synthetic peptide
  Seed: RTLSGSPGLQL (MAGC3_HUMAN)
RQLSGSPGLQW

SEQ ID NO: 108299 - protein, 9 aa, Artificial Sequence
  Description of Artificial Sequence: Synthetic peptide
  Seed: TSDQRMDSL (MAGC3_HUMAN)
TFDQRMDSL

SEQ ID NO: 108300 - protein, 11 aa, Artificial Sequence
  Description of Artificial Sequence: Synthetic peptide
  Seed: LIDDQGMPKNC (MAGC3_HUMAN)
LADDQGMPKNL

SEQ ID NO: 108301 - protein, 10 aa, Artificial Sequence
  Description of Artificial Sequence: Synthetic peptide
  Seed: TDMDPDNHSY (MAGC3_HUMAN)
TEMDPDNHSY

SEQ ID NO: 108302 - protein, 10 aa, Artificial Sequence
  Description of Artificial Sequence: Synthetic peptide
  Seed: FADVLSRLAL (MAGC3_HUMAN)
FIDVLSRLAL

SEQ ID NO: 108303 - protein, 10 aa, Artificial Sequence
  Description of Artificial Sequence: Synthetic peptide
  Seed: ILILSMIFIK (MAGC3_HUMAN)
IMILSMIFIR

SEQ ID NO: 108304 - protein, 10 aa, Artificial Sequence
  Description of Artificial Sequence: Synthetic peptide
  Seed: TYFKLWRTLS (MAGC3_HUMAN)
TWFKLWRTLL

SEQ ID NO: 108305 - protein, 10 aa, Artificial Sequence
  Description of Artificial Sequence: Synthetic peptide
  Seed: EMQMNVINTY (MAGC3_HUMAN)
ECQMNVINTY

SEQ ID NO: 108306 - protein, 9 aa, Artificial Sequence
  Description of Artificial Sequence: Synthetic peptide
  Seed: RGTGYTLSL (MAGC3_HUMAN)
RMTGYTLSI

SEQ ID NO: 108307 - protein, 9 aa, Artificial Sequence
  Description of Artificial Sequence: Synthetic peptide
  Seed: HALPESESL (MAGC3_HUMAN)
HILPESESF

SEQ ID NO: 108308 - protein, 9 aa, Artificial Sequence
  Description of Artificial Sequence: Synthetic peptide
  Seed: MIFRKAREF (MAGC3_HUMAN)
MRFRKAREI

SEQ ID NO: 108309 - protein, 9 aa, Artificial Sequence
  Description of Artificial Sequence: Synthetic peptide
  Seed: RGTGYTLSL (MAGC3_HUMAN)
RTTGYTLSI

SEQ ID NO: 108310 - protein, 11 aa, Artificial Sequence
  Description of Artificial Sequence: Synthetic peptide
  Seed: YALDEKVAELV (MAGC3_HUMAN)
YLLDEKVAELK

SEQ ID NO: 108311 - protein, 9 aa, Artificial Sequence
  Description of Artificial Sequence: Synthetic peptide
  Seed: YTGYFPMIF (MAGC3_HUMAN)
YSGYFPMIL

SEQ ID NO: 108312 - protein, 9 aa, Artificial Sequence
  Description of Artificial Sequence: Synthetic peptide
  Seed: DVLSRLALW (MAGC3_HUMAN)
DSLSRLALF

SEQ ID NO: 108313 - protein, 8 aa, Artificial Sequence
  Description of Artificial Sequence: Synthetic peptide
  Seed: FGISLTEV (MAGC3_HUMAN)
FQISLTEI

SEQ ID NO: 108314 - protein, 9 aa, Artificial Sequence
  Description of Artificial Sequence: Synthetic peptide
  Seed: IPPQGPPKI (MAGC3_HUMAN)
ITPQGPPKV

SEQ ID NO: 108315 - protein, 9 aa, Artificial Sequence
  Description of Artificial Sequence: Synthetic peptide
  Seed: KLSSIIPSA (MAGC3_HUMAN)
KESSIIPSI

SEQ ID NO: 108316 - protein, 11 aa, Artificial Sequence
  Description of Artificial Sequence: Synthetic peptide
  Seed: RTLSGSPGLQL (MAGC3_HUMAN)
RSLSGSPGLQK

SEQ ID NO: 108317 - protein, 11 aa, Artificial Sequence
  Description of Artificial Sequence: Synthetic peptide
  Seed: FIKGNCASEEV (MAGC3_HUMAN)
FLKGNCASEEV

SEQ ID NO: 108318 - protein, 10 aa, Artificial Sequence
  Description of Artificial Sequence: Synthetic peptide
  Seed: EVIWEVLNAI (MAGC3_HUMAN)
EAIWEVLNAR

SEQ ID NO: 108319 - protein, 11 aa, Artificial Sequence
  Description of Artificial Sequence: Synthetic peptide
  Seed: RTLSGSPGLQL (MAGC3_HUMAN)
RVLSGSPGLQW

SEQ ID NO: 108320 - protein, 10 aa, Artificial Sequence
  Description of Artificial Sequence: Synthetic peptide
  Seed: SALAGFADVL (MAGC3_HUMAN)
SKLAGFADVV

SEQ ID NO: 108321 - protein, 10 aa, Artificial Sequence
  Description of Artificial Sequence: Synthetic peptide
  Seed: HLREVRLFLR (MAGC3_HUMAN)
HIREVRLFLR

SEQ ID NO: 108322 - protein, 10 aa, Artificial Sequence
  Description of Artificial Sequence: Synthetic peptide
  Seed: LILILSMIFI (MAGC3_HUMAN)
LKLILSMIFV

SEQ ID NO: 108323 - protein, 9 aa, Artificial Sequence
  Description of Artificial Sequence: Synthetic peptide
  Seed: WRRGTGYTL (MAGC3_HUMAN)
WFRGTGYTV

SEQ ID NO: 108324 - protein, 10 aa, Artificial Sequence
  Description of Artificial Sequence: Synthetic peptide
  Seed: LPTWRRGTGY (MAGC3_HUMAN)
LVTWRRGTGF

SEQ ID NO: 108325 - protein, 10 aa, Artificial Sequence
  Description of Artificial Sequence: Synthetic peptide
  Seed: KLVQFLLLKY (MAGC3_HUMAN)
KFVQFLLLKK

SEQ ID NO: 108326 - protein, 9 aa, Artificial Sequence
  Description of Artificial Sequence: Synthetic peptide
  Seed: KVDKLVQFL (MAGC3_HUMAN)
KLDKLVQFM

SEQ ID NO: 108327 - protein, 9 aa, Artificial Sequence
  Description of Artificial Sequence: Synthetic peptide
  Seed: NAIGPWSAL (MAGC3_HUMAN)
NIIGPWSAV

SEQ ID NO: 108328 - protein, 11 aa, Artificial Sequence
  Description of Artificial Sequence: Synthetic peptide
  Seed: YALDEKVAELV (MAGC3_HUMAN)
YMLDEKVAELP

SEQ ID NO: 108329 - protein, 9 aa, Artificial Sequence
  Description of Artificial Sequence: Synthetic peptide
  Seed: VIWEVLSAI (MAGC3_HUMAN)
VMWEVLSAK

SEQ ID NO: 108330 - protein, 10 aa, Artificial Sequence
  Description of Artificial Sequence: Synthetic peptide
  Seed: SPLDSCSSPL (MAGC3_HUMAN)
SRLDSCSSPV

SEQ ID NO: 108331 - protein, 11 aa, Artificial Sequence
  Description of Artificial Sequence: Synthetic peptide
  Seed: LSKLSSIIPSA (MAGC3_HUMAN)
LFKLSSIIPSL

SEQ ID NO: 108332 - protein, 9 aa, Artificial Sequence
  Description of Artificial Sequence: Synthetic peptide
  Seed: HFYVFVNTL (MAGC3_HUMAN)
HCYVFVNTY

SEQ ID NO: 108333 - protein, 9 aa, Artificial Sequence
  Description of Artificial Sequence: Synthetic peptide
  Seed: NTYTGYFPM (MAGC3_HUMAN)
NFYTGYFPL

SEQ ID NO: 108334 - protein, 10 aa, Artificial Sequence
  Description of Artificial Sequence: Synthetic peptide
  Seed: MDSLVLCPTY (MAGC3_HUMAN)
MCSLVLCPTW

SEQ ID NO: 108335 - protein, 11 aa, Artificial Sequence
  Description of Artificial Sequence: Synthetic peptide
  Seed: SSIIPSAFPSW (MAGC3_HUMAN)
SSIIPSAFPSY

SEQ ID NO: 108336 - protein, 9 aa, Artificial Sequence
  Description of Artificial Sequence: Synthetic peptide
  Seed: HFYVFVNTL (MAGC3_HUMAN)
HMYVFVNTY

SEQ ID NO: 108337 - protein, 10 aa, Artificial Sequence
  Description of Artificial Sequence: Synthetic peptide
  Seed: IELIFGIALT (MAGC3_HUMAN)
IKLIFGIALL

SEQ ID NO: 108338 - protein, 9 aa, Artificial Sequence
  Description of Artificial Sequence: Synthetic peptide
  Seed: LVLCPTYFK (MAGC3_HUMAN)
LTLCPTYFK

SEQ ID NO: 108339 - protein, 9 aa, Artificial Sequence
  Description of Artificial Sequence: Synthetic peptide
  Seed: FPSWYMDAL (MAGC3_HUMAN)
FASWYMDAM

SEQ ID NO: 108340 - protein, 9 aa, Artificial Sequence
  Description of Artificial Sequence: Synthetic peptide
  Seed: KVAELVQFL (MAGC3_HUMAN)
KAAELVQFL

SEQ ID NO: 108341 - protein, 10 aa, Artificial Sequence
  Description of Artificial Sequence: Synthetic peptide
  Seed: SLVLCPTYFK (MAGC3_HUMAN)
SYVLCPTYFK

SEQ ID NO: 108342 - protein, 10 aa, Artificial Sequence
  Description of Artificial Sequence: Synthetic peptide
  Seed: ALDEKVAELV (MAGC3_HUMAN)
AADEKVAELF

SEQ ID NO: 108343 - protein, 9 aa, Artificial Sequence
  Description of Artificial Sequence: Synthetic peptide
  Seed: SAIGPIQRP (MAGC3_HUMAN)
SSIGPIQRL

SEQ ID NO: 108344 - protein, 11 aa, Artificial Sequence
  Description of Artificial Sequence: Synthetic peptide
  Seed: TTDDATAMASA (MAGC3_HUMAN)
TADDATAMASY

SEQ ID NO: 108345 - protein, 9 aa, Artificial Sequence
  Description of Artificial Sequence: Synthetic peptide
  Seed: YSAFHLGHL (MAGC3_HUMAN)
YKAFHLGHL

SEQ ID NO: 108346 - protein, 10 aa, Artificial Sequence
  Description of Artificial Sequence: Synthetic peptide
  Seed: SKLSSIIPSA (MAGC3_HUMAN)
SMLSSIIPSA

SEQ ID NO: 108347 - protein, 10 aa, Artificial Sequence
  Description of Artificial Sequence: Synthetic peptide
  Seed: YALDEKVAEL (MAGC3_HUMAN)
YALDEKVAEV

SEQ ID NO: 108348 - protein, 9 aa, Artificial Sequence
  Description of Artificial Sequence: Synthetic peptide
  Seed: SQPEGKFSL (MAGC3_HUMAN)
SFPEGKFSI

SEQ ID NO: 108349 - protein, 11 aa, Artificial Sequence
  Description of Artificial Sequence: Synthetic peptide
  Seed: TTDDATAMASA (MAGC3_HUMAN)
TMDDATAMASV

SEQ ID NO: 108350 - protein, 9 aa, Artificial Sequence
  Description of Artificial Sequence: Synthetic peptide
  Seed: EKVDKLVQF (MAGC3_HUMAN)
EEVDKLVQM

SEQ ID NO: 108351 - protein, 9 aa, Artificial Sequence
  Description of Artificial Sequence: Synthetic peptide
  Seed: TGYTLSLPA (MAGC3_HUMAN)
TPYTLSLPP

SEQ ID NO: 108352 - protein, 9 aa, Artificial Sequence
  Description of Artificial Sequence: Synthetic peptide
  Seed: KAHEFIELI (MAGC3_HUMAN)
KEHEFIELY

SEQ ID NO: 108353 - protein, 9 aa, Artificial Sequence
  Description of Artificial Sequence: Synthetic peptide
  Seed: FSLRRAVSV (MAGC3_HUMAN)
FRLRRAVSL

SEQ ID NO: 108354 - protein, 11 aa, Artificial Sequence
  Description of Artificial Sequence: Synthetic peptide
  Seed: ATFSDGSLGQW (MAGC3_HUMAN)
AMFSDGSLGQF

SEQ ID NO: 108355 - protein, 10 aa, Artificial Sequence
  Description of Artificial Sequence: Synthetic peptide
  Seed: MDPDNHSYFF (MAGC3_HUMAN)
MPPDNHSYFF

SEQ ID NO: 108356 - protein, 9 aa, Artificial Sequence
  Description of Artificial Sequence: Synthetic peptide
  Seed: LIDDQGMPK (MAGC3_HUMAN)
LCDDQGMPM

SEQ ID NO: 108357 - protein, 9 aa, Artificial Sequence
  Description of Artificial Sequence: Synthetic peptide
  Seed: HSYFFEDTL (MAGC3_HUMAN)
HQYFFEDTM

SEQ ID NO: 108358 - protein, 9 aa, Artificial Sequence
  Description of Artificial Sequence: Synthetic peptide
  Seed: SAEGSVLDL (MAGC3_HUMAN)
SWEGSVLDL

SEQ ID NO: 108359 - protein, 8 aa, Artificial Sequence
  Description of Artificial Sequence: Synthetic peptide
  Seed: KVDKLVQF (MAGC3_HUMAN)
KTDKLVQL

SEQ ID NO: 108360 - protein, 10 aa, Artificial Sequence
  Description of Artificial Sequence: Synthetic peptide
  Seed: EVIWEVLSAI (MAGC3_HUMAN)
ETIWEVLSAK

SEQ ID NO: 108361 - protein, 9 aa, Artificial Sequence
  Description of Artificial Sequence: Synthetic peptide
  Seed: YKDYFPMIF (MAGC3_HUMAN)
YVDYFPMIL

SEQ ID NO: 108362 - protein, 9 aa, Artificial Sequence
  Description of Artificial Sequence: Synthetic peptide
  Seed: LSDEQGMPQ (MAGC3_HUMAN)
LIDEQGMPV

SEQ ID NO: 108363 - protein, 9 aa, Artificial Sequence
  Description of Artificial Sequence: Synthetic peptide
  Seed: RGTGYTLSL (MAGC3_HUMAN)
RSTGYTLSL

SEQ ID NO: 108364 - protein, 10 aa, Artificial Sequence
  Description of Artificial Sequence: Synthetic peptide
  Seed: YTGYFPMIFR (MAGC3_HUMAN)
YHGYFPMIFR

SEQ ID NO: 108365 - protein, 10 aa, Artificial Sequence
  Description of Artificial Sequence: Synthetic peptide
  Seed: AMASASPSVM (MAGC3_HUMAN)
ARASASPSVY

SEQ ID NO: 108366 - protein, 10 aa, Artificial Sequence
  Description of Artificial Sequence: Synthetic peptide
  Seed: TTDDATAMAS (MAGC3_HUMAN)
TNDDATAMAF

SEQ ID NO: 108367 - protein, 10 aa, Artificial Sequence
  Description of Artificial Sequence: Synthetic peptide
  Seed: SKLSSIIPSA (MAGC3_HUMAN)
SWLSSIIPSV

SEQ ID NO: 108368 - protein, 10 aa, Artificial Sequence
  Description of Artificial Sequence: Synthetic peptide
  Seed: ATYALSPVVL (MAGC3_HUMAN)
AFYALSPVVM

SEQ ID NO: 108369 - protein, 9 aa, Artificial Sequence
  Description of Artificial Sequence: Synthetic peptide
  Seed: LIDDQGMPK (MAGC3_HUMAN)
LIDDQGMPI

SEQ ID NO: 108370 - protein, 10 aa, Artificial Sequence
  Description of Artificial Sequence: Synthetic peptide
  Seed: ASPSVMSTNF (MAGC3_HUMAN)
AAPSVMSTNW

SEQ ID NO: 108371 - protein, 11 aa, Artificial Sequence
  Description of Artificial Sequence: Synthetic peptide
  Seed: FIELIFGIALT (MAGC3_HUMAN)
FSELIFGIALI

SEQ ID NO: 108372 - protein, 9 aa, Artificial Sequence
  Description of Artificial Sequence: Synthetic peptide
  Seed: YFFEDTLDL (MAGC3_HUMAN)
YQFEDTLDV

SEQ ID NO: 108373 - protein, 10 aa, Artificial Sequence
  Description of Artificial Sequence: Synthetic peptide
  Seed: MQMNVINTYT (MAGC3_HUMAN)
MMMNVINTYH

SEQ ID NO: 108374 - protein, 9 aa, Artificial Sequence
  Description of Artificial Sequence: Synthetic peptide
  Seed: WVKNTCATY (MAGC3_HUMAN)
WQKNTCATF

SEQ ID NO: 108375 - protein, 9 aa, Artificial Sequence
  Description of Artificial Sequence: Synthetic peptide
  Seed: ILILSVIFI (MAGC3_HUMAN)
IVILSVIFV

SEQ ID NO: 108376 - protein, 10 aa, Artificial Sequence
  Description of Artificial Sequence: Synthetic peptide
  Seed: LTEASPQQKK (MAGC3_HUMAN)
LIEASPQQKY

SEQ ID NO: 108377 - protein, 9 aa, Artificial Sequence
  Description of Artificial Sequence: Synthetic peptide
  Seed: VDPDHFYVF (MAGC3_HUMAN)
VVPDHFYVL

SEQ ID NO: 108378 - protein, 9 aa, Artificial Sequence
  Description of Artificial Sequence: Synthetic peptide
  Seed: TEASPQQKK (MAGC3_HUMAN)
TIASPQQKK

SEQ ID NO: 108379 - protein, 10 aa, Artificial Sequence
  Description of Artificial Sequence: Synthetic peptide
  Seed: IIDTTDDATA (MAGC3_HUMAN)
ISDTTDDATL

SEQ ID NO: 108380 - protein, 9 aa, Artificial Sequence
  Description of Artificial Sequence: Synthetic peptide
  Seed: VLPPQPQPR (MAGC3_HUMAN)
VMPPQPQPY

SEQ ID NO: 108381 - protein, 9 aa, Artificial Sequence
  Description of Artificial Sequence: Synthetic peptide
  Seed: AGFADVLSR (MAGC3_HUMAN)
AAFADVLSF

SEQ ID NO: 108382 - protein, 10 aa, Artificial Sequence
  Description of Artificial Sequence: Synthetic peptide
  Seed: AMASASPSVM (MAGC3_HUMAN)
AMASASPSVL

SEQ ID NO: 108383 - protein, 9 aa, Artificial Sequence
  Description of Artificial Sequence: Synthetic peptide
  Seed: TTDDATAMA (MAGC3_HUMAN)
TYDDATAMI

SEQ ID NO: 108384 - protein, 10 aa, Artificial Sequence
  Description of Artificial Sequence: Synthetic peptide
  Seed: MQMNVINTYT (MAGC3_HUMAN)
MLMNVINTYC

SEQ ID NO: 108385 - protein, 10 aa, Artificial Sequence
  Description of Artificial Sequence: Synthetic peptide
  Seed: MDSLVLCPTY (MAGC3_HUMAN)
MRSLVLCPTY

SEQ ID NO: 108386 - protein, 9 aa, Artificial Sequence
  Description of Artificial Sequence: Synthetic peptide
  Seed: VDPDHFYVF (MAGC3_HUMAN)
VFPDHFYVW

SEQ ID NO: 108387 - protein, 10 aa, Artificial Sequence
  Description of Artificial Sequence: Synthetic peptide
  Seed: MNVINTYTGY (MAGC3_HUMAN)
MVVINTYTGF

SEQ ID NO: 108388 - protein, 10 aa, Artificial Sequence
  Description of Artificial Sequence: Synthetic peptide
  Seed: EMQMNVINTY (MAGC3_HUMAN)
EKQMNVINTY

SEQ ID NO: 108389 - protein, 9 aa, Artificial Sequence
  Description of Artificial Sequence: Synthetic peptide
  Seed: FHLGHLREV (MAGC3_HUMAN)
FMLGHLREM

SEQ ID NO: 108390 - protein, 9 aa, Artificial Sequence
  Description of Artificial Sequence: Synthetic peptide
  Seed: FPMIFGKAH (MAGC3_HUMAN)
FPMIFGKAA

SEQ ID NO: 108391 - protein, 9 aa, Artificial Sequence
  Description of Artificial Sequence: Synthetic peptide
  Seed: LIDDQGMPK (MAGC3_HUMAN)
LMDDQGMPM

SEQ ID NO: 108392 - protein, 9 aa, Artificial Sequence
  Description of Artificial Sequence: Synthetic peptide
  Seed: LSDEQGMPQ (MAGC3_HUMAN)
LFDEQGMPL

SEQ ID NO: 108393 - protein, 9 aa, Artificial Sequence
  Description of Artificial Sequence: Synthetic peptide
  Seed: TYALSPVVL (MAGC3_HUMAN)
TTALSPVVF

SEQ ID NO: 108394 - protein, 10 aa, Artificial Sequence
  Description of Artificial Sequence: Synthetic peptide
  Seed: INTYTGYFPM (MAGC3_HUMAN)
INTYTGYFPF

SEQ ID NO: 108395 - protein, 9 aa, Artificial Sequence
  Description of Artificial Sequence: Synthetic peptide
  Seed: KVAELVQFL (MAGC3_HUMAN)
KLAELVQFM

SEQ ID NO: 108396 - protein, 10 aa, Artificial Sequence
  Description of Artificial Sequence: Synthetic peptide
  Seed: MQMNVINTYT (MAGC3_HUMAN)
MAMNVINTYM

SEQ ID NO: 108397 - protein, 9 aa, Artificial Sequence
  Description of Artificial Sequence: Synthetic peptide
  Seed: NAIGPWSAL (MAGC3_HUMAN)
NPIGPWSAF

SEQ ID NO: 108398 - protein, 9 aa, Artificial Sequence
  Description of Artificial Sequence: Synthetic peptide
  Seed: KVAELVQFL (MAGC3_HUMAN)
KEAELVQFL

SEQ ID NO: 108399 - protein, 9 aa, Artificial Sequence
  Description of Artificial Sequence: Synthetic peptide
  Seed: TAMASASPS (MAGC3_HUMAN)
TAMASASPM

SEQ ID NO: 108400 - protein, 9 aa, Artificial Sequence
  Description of Artificial Sequence: Synthetic peptide
  Seed: MASASPSVM (MAGC3_HUMAN)
MISASPSVY

SEQ ID NO: 108401 - protein, 9 aa, Artificial Sequence
  Description of Artificial Sequence: Synthetic peptide
  Seed: KEPVTKAEM (MAGC3_HUMAN)
KRPVTKAEM

SEQ ID NO: 108402 - protein, 10 aa, Artificial Sequence
  Description of Artificial Sequence: Synthetic peptide
  Seed: KYKDYFPMIF (MAGC3_HUMAN)
KQKDYFPMIM

SEQ ID NO: 108403 - protein, 11 aa, Artificial Sequence
  Description of Artificial Sequence: Synthetic peptide
  Seed: TAMASASPSVM (MAGC3_HUMAN)
TKMASASPSVM

SEQ ID NO: 108404 - protein, 9 aa, Artificial Sequence
  Description of Artificial Sequence: Synthetic peptide
  Seed: YQTKEPVTK (MAGC3_HUMAN)
YTTKEPVTV

SEQ ID NO: 108405 - protein, 9 aa, Artificial Sequence
  Description of Artificial Sequence: Synthetic peptide
  Seed: LVLCPTYFK (MAGC3_HUMAN)
LPLCPTYFR

SEQ ID NO: 108406 - protein, 9 aa, Artificial Sequence
  Description of Artificial Sequence: Synthetic peptide
  Seed: LILSVIFIK (MAGC3_HUMAN)
LQLSVIFIR

SEQ ID NO: 108407 - protein, 10 aa, Artificial Sequence
  Description of Artificial Sequence: Synthetic peptide
  Seed: REVLEFLSKL (MAGC3_HUMAN)
RQVLEFLSKA

SEQ ID NO: 108408 - protein, 9 aa, Artificial Sequence
  Description of Artificial Sequence: Synthetic peptide
  Seed: AMASASPSV (MAGC3_HUMAN)
AKASASPSY

SEQ ID NO: 108409 - protein, 9 aa, Artificial Sequence
  Description of Artificial Sequence: Synthetic peptide
  Seed: RTLSGSPGL (MAGC3_HUMAN)
RVLSGSPGY

SEQ ID NO: 108410 - protein, 10 aa, Artificial Sequence
  Description of Artificial Sequence: Synthetic peptide
  Seed: MQMNVINTYT (MAGC3_HUMAN)
MQMNVINTYC

SEQ ID NO: 108411 - protein, 9 aa, Artificial Sequence
  Description of Artificial Sequence: Synthetic peptide
  Seed: FPSWYMDAL (MAGC3_HUMAN)
FSSWYMDAV

SEQ ID NO: 108412 - protein, 9 aa, Artificial Sequence
  Description of Artificial Sequence: Synthetic peptide
  Seed: KAHEFIELI (MAGC3_HUMAN)
KMHEFIELY

SEQ ID NO: 108413 - protein, 11 aa, Artificial Sequence
  Description of Artificial Sequence: Synthetic peptide
  Seed: LTDMDPDNHSY (MAGC3_HUMAN)
LTDMDPDNHSF

SEQ ID NO: 108414 - protein, 9 aa, Artificial Sequence
  Description of Artificial Sequence: Synthetic peptide
  Seed: SLVLCPTYF (MAGC3_HUMAN)
SFVLCPTYM

SEQ ID NO: 108415 - protein, 9 aa, Artificial Sequence
  Description of Artificial Sequence: Synthetic peptide
  Seed: YALSPVVLP (MAGC3_HUMAN)
YSLSPVVLY

SEQ ID NO: 108416 - protein, 9 aa, Artificial Sequence
  Description of Artificial Sequence: Synthetic peptide
  Seed: LSDEQGMPQ (MAGC3_HUMAN)
LVDEQGMPM

SEQ ID NO: 108417 - protein, 9 aa, Artificial Sequence
  Description of Artificial Sequence: Synthetic peptide
  Seed: VLPPQPQPR (MAGC3_HUMAN)
VIPPQPQPV

SEQ ID NO: 108418 - protein, 10 aa, Artificial Sequence
  Description of Artificial Sequence: Synthetic peptide
  Seed: KLSSIIPSAF (MAGC3_HUMAN)
KVSSIIPSAV

SEQ ID NO: 108419 - protein, 10 aa, Artificial Sequence
  Description of Artificial Sequence: Synthetic peptide
  Seed: MPAAGMPPLP (MAGC3_HUMAN)
MPAAGMPPLC

SEQ ID NO: 108420 - protein, 9 aa, Artificial Sequence
  Description of Artificial Sequence: Synthetic peptide
  Seed: VPEEVIWEV (MAGC3_HUMAN)
VPEEVIWEM

SEQ ID NO: 108421 - protein, 9 aa, Artificial Sequence
  Description of Artificial Sequence: Synthetic peptide
  Seed: EIPPQGPPK (MAGC3_HUMAN)
EAPPQGPPM

SEQ ID NO: 108422 - protein, 9 aa, Artificial Sequence
  Description of Artificial Sequence: Synthetic peptide
  Seed: LANPQGLAG (MAGC3_HUMAN)
LLNPQGLAL

SEQ ID NO: 108423 - protein, 10 aa, Artificial Sequence
  Description of Artificial Sequence: Synthetic peptide
  Seed: DMDPDNHSYF (MAGC3_HUMAN)
DMDPDNHSYL

SEQ ID NO: 108424 - protein, 9 aa, Artificial Sequence
  Description of Artificial Sequence: Synthetic peptide
  Seed: FLSKLSSII (MAGC3_HUMAN)
FMSKLSSIW

SEQ ID NO: 108425 - protein, 9 aa, Artificial Sequence
  Description of Artificial Sequence: Synthetic peptide
  Seed: MQMNVINTY (MAGC3_HUMAN)
MDMNVINTF

SEQ ID NO: 108426 - protein, 9 aa, Artificial Sequence
  Description of Artificial Sequence: Synthetic peptide
  Seed: YQAKEPLTR (MAGC3_HUMAN)
YFAKEPLTR

SEQ ID NO: 108427 - protein, 9 aa, Artificial Sequence
  Description of Artificial Sequence: Synthetic peptide
  Seed: YSAFHLGHL (MAGC3_HUMAN)
YKAFHLGHY

SEQ ID NO: 108428 - protein, 10 aa, Artificial Sequence
  Description of Artificial Sequence: Synthetic peptide
  Seed: MQMNVINTYT (MAGC3_HUMAN)
MQMNVINTYY

SEQ ID NO: 108429 - protein, 9 aa, Artificial Sequence
  Description of Artificial Sequence: Synthetic peptide
  Seed: IPPQGPPKI (MAGC3_HUMAN)
IHPQGPPKL

SEQ ID NO: 108430 - protein, 9 aa, Artificial Sequence
  Description of Artificial Sequence: Synthetic peptide
  Seed: MIFGKAHEF (MAGC3_HUMAN)
MVFGKAHEI

SEQ ID NO: 108431 - protein, 8 aa, Artificial Sequence
  Description of Artificial Sequence: Synthetic peptide
  Seed: TTDDATAM (MAGC3_HUMAN)
TADDATAV

SEQ ID NO: 108432 - protein, 10 aa, Artificial Sequence
  Description of Artificial Sequence: Synthetic peptide
  Seed: KAHEFIELIF (MAGC3_HUMAN)
KVHEFIELIW

SEQ ID NO: 108433 - protein, 9 aa, Artificial Sequence
  Description of Artificial Sequence: Synthetic peptide
  Seed: MQMNVINTY (MAGC3_HUMAN)
MLMNVINTM

SEQ ID NO: 108434 - protein, 9 aa, Artificial Sequence
  Description of Artificial Sequence: Synthetic peptide
  Seed: TTDDATAMA (MAGC3_HUMAN)
TMDDATAMV

SEQ ID NO: 108435 - protein, 11 aa, Artificial Sequence
  Description of Artificial Sequence: Synthetic peptide
  Seed: ALAGFADVLSR (MAGC3_HUMAN)
AVAGFADVLSK

SEQ ID NO: 108436 - protein, 9 aa, Artificial Sequence
  Description of Artificial Sequence: Synthetic peptide
  Seed: FPMIFRKAR (MAGC3_HUMAN)
FWMIFRKAR

SEQ ID NO: 108437 - protein, 9 aa, Artificial Sequence
  Description of Artificial Sequence: Synthetic peptide
  Seed: KLSSIIPSA (MAGC3_HUMAN)
KVSSIIPSL

SEQ ID NO: 108438 - protein, 9 aa, Artificial Sequence
  Description of Artificial Sequence: Synthetic peptide
  Seed: LKYQTKEPV (MAGC3_HUMAN)
LMYQTKEPW

SEQ ID NO: 108439 - protein, 9 aa, Artificial Sequence
  Description of Artificial Sequence: Synthetic peptide
  Seed: RTLSGSPGL (MAGC3_HUMAN)
RVLSGSPGV

SEQ ID NO: 108440 - protein, 10 aa, Artificial Sequence
  Description of Artificial Sequence: Synthetic peptide
  Seed: VTKAEMLTTV (MAGC3_HUMAN)
VMKAEMLTTV

SEQ ID NO: 108441 - protein, 10 aa, Artificial Sequence
  Description of Artificial Sequence: Synthetic peptide
  Seed: WRTLSGSPGL (MAGC3_HUMAN)
WRTLSGSPGM

SEQ ID NO: 108442 - protein, 10 aa, Artificial Sequence
  Description of Artificial Sequence: Synthetic peptide
  Seed: MDSLVLCPTY (MAGC3_HUMAN)
MFSLVLCPTW

SEQ ID NO: 108443 - protein, 10 aa, Artificial Sequence
  Description of Artificial Sequence: Synthetic peptide
  Seed: SAFHLGHLRE (MAGC3_HUMAN)
STFHLGHLRM

SEQ ID NO: 108444 - protein, 11 aa, Artificial Sequence
  Description of Artificial Sequence: Synthetic peptide
  Seed: GSQPEGKFSLR (MAGC3_HUMAN)
GTQPEGKFSLY

SEQ ID NO: 108445 - protein, 9 aa, Artificial Sequence
  Description of Artificial Sequence: Synthetic peptide
  Seed: LLILILSMI (MAGC3_HUMAN)
LMILILSMA

SEQ ID NO: 108446 - protein, 9 aa, Artificial Sequence
  Description of Artificial Sequence: Synthetic peptide
  Seed: NAIGPWSAL (MAGC3_HUMAN)
NIIGPWSAY

SEQ ID NO: 108447 - protein, 10 aa, Artificial Sequence
  Description of Artificial Sequence: Synthetic peptide
  Seed: REVRLFLRGG (MAGC3_HUMAN)
RTVRLFLRGI

SEQ ID NO: 108448 - protein, 10 aa, Artificial Sequence
  Description of Artificial Sequence: Synthetic peptide
  Seed: KVDKLVQFLL (MAGC3_HUMAN)
KQDKLVQFLF

SEQ ID NO: 108449 - protein, 9 aa, Artificial Sequence
  Description of Artificial Sequence: Synthetic peptide
  Seed: TLDEKVDKL (MAGC3_HUMAN)
TVDEKVDKI

SEQ ID NO: 108450 - protein, 11 aa, Artificial Sequence
  Description of Artificial Sequence: Synthetic peptide
  Seed: ATFSDGSLGQW (MAGC3_HUMAN)
AEFSDGSLGQY

SEQ ID NO: 108451 - protein, 10 aa, Artificial Sequence
  Description of Artificial Sequence: Synthetic peptide
  Seed: KKYKDYFPMI (MAGC3_HUMAN)
KFYKDYFPMI

SEQ ID NO: 108452 - protein, 11 aa, Artificial Sequence
  Description of Artificial Sequence: Synthetic peptide
  Seed: KVAELVQFLLL (MAGC3_HUMAN)
KSAELVQFLLW

SEQ ID NO: 108453 - protein, 9 aa, Artificial Sequence
  Description of Artificial Sequence: Synthetic peptide
  Seed: SLPESEPLF (MAGC3_HUMAN)
SSPESEPLM

SEQ ID NO: 108454 - protein, 9 aa, Artificial Sequence
  Description of Artificial Sequence: Synthetic peptide
  Seed: ILILSVIFI (MAGC3_HUMAN)
IQILSVIFL

SEQ ID NO: 108455 - protein, 10 aa, Artificial Sequence
  Description of Artificial Sequence: Synthetic peptide
  Seed: ILFGISLTEV (MAGC3_HUMAN)
IVFGISLTEL

SEQ ID NO: 108456 - protein, 9 aa, Artificial Sequence
  Description of Artificial Sequence: Synthetic peptide
  Seed: EMLTTVIKK (MAGC3_HUMAN)
EVLTTVIKK

SEQ ID NO: 108457 - protein, 11 aa, Artificial Sequence
  Description of Artificial Sequence: Synthetic peptide
  Seed: ALWESEGPEAF (MAGC3_HUMAN)
ALWESEGPEAV

SEQ ID NO: 108458 - protein, 10 aa, Artificial Sequence
  Description of Artificial Sequence: Synthetic peptide
  Seed: MLLPCHWVLD (MAGC3_HUMAN)
MVLPCHWVLL

SEQ ID NO: 108459 - protein, 9 aa, Artificial Sequence
  Description of Artificial Sequence: Synthetic peptide
  Seed: KEPLTRAEM (MAGC3_HUMAN)
KVPLTRAEY

SEQ ID NO: 108460 - protein, 9 aa, Artificial Sequence
  Description of Artificial Sequence: Synthetic peptide
  Seed: LPQSPPEIP (MAGC3_HUMAN)
LPQSPPEIA

SEQ ID NO: 108461 - protein, 10 aa, Artificial Sequence
  Description of Artificial Sequence: Synthetic peptide
  Seed: IELIFGIALT (MAGC3_HUMAN)
INLIFGIALA

SEQ ID NO: 108462 - protein, 9 aa, Artificial Sequence
  Description of Artificial Sequence: Synthetic peptide
  Seed: LGHLREVRL (MAGC3_HUMAN)
LAHLREVRY

SEQ ID NO: 108463 - protein, 9 aa, Artificial Sequence
  Description of Artificial Sequence: Synthetic peptide
  Seed: FEDTLDLTY (MAGC3_HUMAN)
FFDTLDLTF

SEQ ID NO: 108464 - protein, 9 aa, Artificial Sequence
  Description of Artificial Sequence: Synthetic peptide
  Seed: MASASPSVM (MAGC3_HUMAN)
MQSASPSVF

SEQ ID NO: 108465 - protein, 11 aa, Artificial Sequence
  Description of Artificial Sequence: Synthetic peptide
  Seed: LSKLSSIIPSA (MAGC3_HUMAN)
LWKLSSIIPSV

SEQ ID NO: 108466 - protein, 9 aa, Artificial Sequence
  Description of Artificial Sequence: Synthetic peptide
  Seed: SCVPEEVIW (MAGC3_HUMAN)
SAVPEEVIW

SEQ ID NO: 108467 - protein, 9 aa, Artificial Sequence
  Description of Artificial Sequence: Synthetic peptide
  Seed: YKDYFPMIF (MAGC3_HUMAN)
YSDYFPMIY

SEQ ID NO: 108468 - protein, 9 aa, Artificial Sequence
  Description of Artificial Sequence: Synthetic peptide
  Seed: GYFPMIFRK (MAGC3_HUMAN)
GGFPMIFRY

SEQ ID NO: 108469 - protein, 9 aa, Artificial Sequence
  Description of Artificial Sequence: Synthetic peptide
  Seed: HFYVFVNTL (MAGC3_HUMAN)
HMYVFVNTL

SEQ ID NO: 108470 - protein, 10 aa, Artificial Sequence
  Description of Artificial Sequence: Synthetic peptide
  Seed: KAHEFIELIF (MAGC3_HUMAN)
KRHEFIELIY

SEQ ID NO: 108471 - protein, 9 aa, Artificial Sequence
  Description of Artificial Sequence: Synthetic peptide
  Seed: FPMIFRKAR (MAGC3_HUMAN)
FFMIFRKAR

SEQ ID NO: 108472 - protein, 8 aa, Artificial Sequence
  Description of Artificial Sequence: Synthetic peptide
  Seed: FIELIFGI (MAGC3_HUMAN)
FMELIFGV

SEQ ID NO: 108473 - protein, 9 aa, Artificial Sequence
  Description of Artificial Sequence: Synthetic peptide
  Seed: IPPQGPPKI (MAGC3_HUMAN)
ICPQGPPKL

SEQ ID NO: 108474 - protein, 10 aa, Artificial Sequence
  Description of Artificial Sequence: Synthetic peptide
  Seed: KVAELVQFLL (MAGC3_HUMAN)
KQAELVQFLL

SEQ ID NO: 108475 - protein, 9 aa, Artificial Sequence
  Description of Artificial Sequence: Synthetic peptide
  Seed: GFADVLSRL (MAGC3_HUMAN)
GLADVLSRS

SEQ ID NO: 108476 - protein, 10 aa, Artificial Sequence
  Description of Artificial Sequence: Synthetic peptide
  Seed: MQMNVINTYT (MAGC3_HUMAN)
MTMNVINTYA

SEQ ID NO: 108477 - protein, 8 aa, Artificial Sequence
  Description of Artificial Sequence: Synthetic peptide
  Seed: SLRRAVSV (MAGC3_HUMAN)
SMRRAVSL

SEQ ID NO: 108478 - protein, 9 aa, Artificial Sequence
  Description of Artificial Sequence: Synthetic peptide
  Seed: SEEEDTATW (MAGC3_HUMAN)
SQEEDTATI

SEQ ID NO: 108479 - protein, 9 aa, Artificial Sequence
  Description of Artificial Sequence: Synthetic peptide
  Seed: SIIPSAFPS (MAGC3_HUMAN)
SMIPSAFPI

SEQ ID NO: 108480 - protein, 10 aa, Artificial Sequence
  Description of Artificial Sequence: Synthetic peptide
  Seed: MDSLVLCPTY (MAGC3_HUMAN)
MSSLVLCPTM

SEQ ID NO: 108481 - protein, 9 aa, Artificial Sequence
  Description of Artificial Sequence: Synthetic peptide
  Seed: HALPESESL (MAGC3_HUMAN)
HLLPESESM

SEQ ID NO: 108482 - protein, 9 aa, Artificial Sequence
  Description of Artificial Sequence: Synthetic peptide
  Seed: MQMNVINTY (MAGC3_HUMAN)
MQMNVINTF

SEQ ID NO: 108483 - protein, 9 aa, Artificial Sequence
  Description of Artificial Sequence: Synthetic peptide
  Seed: FLSKLSSII (MAGC3_HUMAN)
FHSKLSSIF

SEQ ID NO: 108484 - protein, 9 aa, Artificial Sequence
  Description of Artificial Sequence: Synthetic peptide
  Seed: NAIGPWSAL (MAGC3_HUMAN)
NAIGPWSAR

SEQ ID NO: 108485 - protein, 10 aa, Artificial Sequence
  Description of Artificial Sequence: Synthetic peptide
  Seed: INTYTGYFPM (MAGC3_HUMAN)
IATYTGYFPW

SEQ ID NO: 108486 - protein, 9 aa, Artificial Sequence
  Description of Artificial Sequence: Synthetic peptide
  Seed: EVIWEVLNA (MAGC3_HUMAN)
EIIWEVLNV

SEQ ID NO: 108487 - protein, 9 aa, Artificial Sequence
  Description of Artificial Sequence: Synthetic peptide
  Seed: LIDDQGMPK (MAGC3_HUMAN)
LFDDQGMPV

SEQ ID NO: 108488 - protein, 9 aa, Artificial Sequence
  Description of Artificial Sequence: Synthetic peptide
  Seed: VLCPTYFKL (MAGC3_HUMAN)
VYCPTYFKI

SEQ ID NO: 108489 - protein, 9 aa, Artificial Sequence
  Description of Artificial Sequence: Synthetic peptide
  Seed: YQTKEPVTK (MAGC3_HUMAN)
YRTKEPVTF

SEQ ID NO: 108490 - protein, 9 aa, Artificial Sequence
  Description of Artificial Sequence: Synthetic peptide
  Seed: IQRPAREVL (MAGC3_HUMAN)
IARPAREVL

SEQ ID NO: 108491 - protein, 10 aa, Artificial Sequence
  Description of Artificial Sequence: Synthetic peptide
  Seed: FPSWYMDALK (MAGC3_HUMAN)
FDSWYMDALK

SEQ ID NO: 108492 - protein, 10 aa, Artificial Sequence
  Description of Artificial Sequence: Synthetic peptide
  Seed: INTYTGYFPM (MAGC3_HUMAN)
IMTYTGYFPM

SEQ ID NO: 108493 - protein, 9 aa, Artificial Sequence
  Description of Artificial Sequence: Synthetic peptide
  Seed: LLILILSVI (MAGC3_HUMAN)
LVILILSVV

SEQ ID NO: 108494 - protein, 10 aa, Artificial Sequence
  Description of Artificial Sequence: Synthetic peptide
  Seed: INTYTGYFPM (MAGC3_HUMAN)
IYTYTGYFPW

SEQ ID NO: 108495 - protein, 9 aa, Artificial Sequence
  Description of Artificial Sequence: Synthetic peptide
  Seed: MLLPCHWVL (MAGC3_HUMAN)
MQLPCHWVY

SEQ ID NO: 108496 - protein, 9 aa, Artificial Sequence
  Description of Artificial Sequence: Synthetic peptide
  Seed: GSLPESEPL (MAGC3_HUMAN)
GTLPESEPY

SEQ ID NO: 108497 - protein, 10 aa, Artificial Sequence
  Description of Artificial Sequence: Synthetic peptide
  Seed: SALAGFADVL (MAGC3_HUMAN)
STLAGFADVL

SEQ ID NO: 108498 - protein, 11 aa, Artificial Sequence
  Description of Artificial Sequence: Synthetic peptide
  Seed: EPQDWPLNEKR (MAGC3_HUMAN)
EYQDWPLNEKR

SEQ ID NO: 108499 - protein, 10 aa, Artificial Sequence
  Description of Artificial Sequence: Synthetic peptide
  Seed: TAMASASPSV (MAGC3_HUMAN)
TRMASASPSV

SEQ ID NO: 108500 - protein, 9 aa, Artificial Sequence
  Description of Artificial Sequence: Synthetic peptide
  Seed: LSDEQGMPQ (MAGC3_HUMAN)
LWDEQGMPL

SEQ ID NO: 108501 - protein, 10 aa, Artificial Sequence
  Description of Artificial Sequence: Synthetic peptide
  Seed: LILILSVIFI (MAGC3_HUMAN)
LTLILSVIFV

SEQ ID NO: 108502 - protein, 10 aa, Artificial Sequence
  Description of Artificial Sequence: Synthetic peptide
  Seed: TLDEKVDKLV (MAGC3_HUMAN)
TWDEKVDKLL

SEQ ID NO: 108503 - protein, 9 aa, Artificial Sequence
  Description of Artificial Sequence: Synthetic peptide
  Seed: MDPDNHSYF (MAGC3_HUMAN)
MMPDNHSYI

SEQ ID NO: 108504 - protein, 9 aa, Artificial Sequence
  Description of Artificial Sequence: Synthetic peptide
  Seed: MASASPSVM (MAGC3_HUMAN)
MESASPSVL

SEQ ID NO: 108505 - protein, 11 aa, Artificial Sequence
  Description of Artificial Sequence: Synthetic peptide
  Seed: SIIPSAFPSWY (MAGC3_HUMAN)
STIPSAFPSWK

SEQ ID NO: 108506 - protein, 10 aa, Artificial Sequence
  Description of Artificial Sequence: Synthetic peptide
  Seed: MDPDNHSYFF (MAGC3_HUMAN)
MNPDNHSYFM

SEQ ID NO: 108507 - protein, 9 aa, Artificial Sequence
  Description of Artificial Sequence: Synthetic peptide
  Seed: MASASPSVM (MAGC3_HUMAN)
MSSASPSVL

SEQ ID NO: 108508 - protein, 9 aa, Artificial Sequence
  Description of Artificial Sequence: Synthetic peptide
  Seed: RGTGYTLSL (MAGC3_HUMAN)
RLTGYTLSF

SEQ ID NO: 108509 - protein, 9 aa, Artificial Sequence
  Description of Artificial Sequence: Synthetic peptide
  Seed: SVLDLANPQ (MAGC3_HUMAN)
SILDLANPR

SEQ ID NO: 108510 - protein, 10 aa, Artificial Sequence
  Description of Artificial Sequence: Synthetic peptide
  Seed: LIFGIALTDM (MAGC3_HUMAN)
LIFGIALTDY

SEQ ID NO: 108511 - protein, 9 aa, Artificial Sequence
  Description of Artificial Sequence: Synthetic peptide
  Seed: LEFLSKLSS (MAGC3_HUMAN)
LEFLSKLSA

SEQ ID NO: 108512 - protein, 9 aa, Artificial Sequence
  Description of Artificial Sequence: Synthetic peptide
  Seed: ISPQGPPQS (MAGC3_HUMAN)
ICPQGPPQL

SEQ ID NO: 108513 - protein, 9 aa, Artificial Sequence
  Description of Artificial Sequence: Synthetic peptide
  Seed: FSLRRAVSV (MAGC3_HUMAN)
FFLRRAVSV

SEQ ID NO: 108514 - protein, 9 aa, Artificial Sequence
  Description of Artificial Sequence: Synthetic peptide
  Seed: MIFGKAHEF (MAGC3_HUMAN)
MQFGKAHEM

SEQ ID NO: 108515 - protein, 10 aa, Artificial Sequence
  Description of Artificial Sequence: Synthetic peptide
  Seed: WVKNTCATYA (MAGC3_HUMAN)
WIKNTCATYY

SEQ ID NO: 108516 - protein, 9 aa, Artificial Sequence
  Description of Artificial Sequence: Synthetic peptide
  Seed: VLCPTYFKL (MAGC3_HUMAN)
VSCPTYFKY

SEQ ID NO: 108517 - protein, 10 aa, Artificial Sequence
  Description of Artificial Sequence: Synthetic peptide
  Seed: AMASASPSVM (MAGC3_HUMAN)
AYASASPSVL

SEQ ID NO: 108518 - protein, 9 aa, Artificial Sequence
  Description of Artificial Sequence: Synthetic peptide
  Seed: GLQLSDLHF (MAGC3_HUMAN)
GQQLSDLHF

SEQ ID NO: 108519 - protein, 9 aa, Artificial Sequence
  Description of Artificial Sequence: Synthetic peptide
  Seed: HALPESESL (MAGC3_HUMAN)
HPLPESESF

SEQ ID NO: 108520 - protein, 9 aa, Artificial Sequence
  Description of Artificial Sequence: Synthetic peptide
  Seed: MQMNVINTY (MAGC3_HUMAN)
MIMNVINTF

SEQ ID NO: 108521 - protein, 9 aa, Artificial Sequence
  Description of Artificial Sequence: Synthetic peptide
  Seed: MASASPSVM (MAGC3_HUMAN)
MTSASPSVW

SEQ ID NO: 108522 - protein, 10 aa, Artificial Sequence
  Description of Artificial Sequence: Synthetic peptide
  Seed: TYTGYFPMIF (MAGC3_HUMAN)
TYTGYFPMIY

SEQ ID NO: 108523 - protein, 10 aa, Artificial Sequence
  Description of Artificial Sequence: Synthetic peptide
  Seed: AMASASPSVM (MAGC3_HUMAN)
AAASASPSVF

SEQ ID NO: 108524 - protein, 9 aa, Artificial Sequence
  Description of Artificial Sequence: Synthetic peptide
  Seed: IPPQGPPKI (MAGC3_HUMAN)
IRPQGPPKL

SEQ ID NO: 108525 - protein, 9 aa, Artificial Sequence
  Description of Artificial Sequence: Synthetic peptide
  Seed: LDEKVAELV (MAGC3_HUMAN)
LEEKVAELF

SEQ ID NO: 108526 - protein, 10 aa, Artificial Sequence
  Description of Artificial Sequence: Synthetic peptide
  Seed: VLDLANPQGL (MAGC3_HUMAN)
VADLANPQGL

SEQ ID NO: 108527 - protein, 10 aa, Artificial Sequence
  Description of Artificial Sequence: Synthetic peptide
  Seed: VVLPPQPQPR (MAGC3_HUMAN)
VLLPPQPQPK

SEQ ID NO: 108528 - protein, 8 aa, Artificial Sequence
  Description of Artificial Sequence: Synthetic peptide
  Seed: TTDDATAM (MAGC3_HUMAN)
TYDDATAF

SEQ ID NO: 108529 - protein, 9 aa, Artificial Sequence
  Description of Artificial Sequence: Synthetic peptide
  Seed: HSYFFEDTL (MAGC3_HUMAN)
HRYFFEDTL

SEQ ID NO: 108530 - protein, 10 aa, Artificial Sequence
  Description of Artificial Sequence: Synthetic peptide
  Seed: VLSAIGPIQR (MAGC3_HUMAN)
VTSAIGPIQY

SEQ ID NO: 108531 - protein, 9 aa, Artificial Sequence
  Description of Artificial Sequence: Synthetic peptide
  Seed: FHLGHLREV (MAGC3_HUMAN)
FNLGHLREV

SEQ ID NO: 108532 - protein, 10 aa, Artificial Sequence
  Description of Artificial Sequence: Synthetic peptide
  Seed: LILILSMIFI (MAGC3_HUMAN)
LRLILSMIFV

SEQ ID NO: 108533 - protein, 8 aa, Artificial Sequence
  Description of Artificial Sequence: Synthetic peptide
  Seed: YALSPVVL (MAGC3_HUMAN)
YALSPVVF

SEQ ID NO: 108534 - protein, 9 aa, Artificial Sequence
  Description of Artificial Sequence: Synthetic peptide
  Seed: TKAEMLTTV (MAGC3_HUMAN)
TQAEMLTTM

SEQ ID NO: 108535 - protein, 10 aa, Artificial Sequence
  Description of Artificial Sequence: Synthetic peptide
  Seed: CSSPLLWTRL (MAGC3_HUMAN)
CSSPLLWTRF

SEQ ID NO: 108536 - protein, 9 aa, Artificial Sequence
  Description of Artificial Sequence: Synthetic peptide
  Seed: SASPSVMST (MAGC3_HUMAN)
SNSPSVMSY

SEQ ID NO: 108537 - protein, 11 aa, Artificial Sequence
  Description of Artificial Sequence: Synthetic peptide
  Seed: GHLREVRLFLR (MAGC3_HUMAN)
GMLREVRLFLR

SEQ ID NO: 108538 - protein, 9 aa, Artificial Sequence
  Description of Artificial Sequence: Synthetic peptide
  Seed: FEDTLDLTY (MAGC3_HUMAN)
FWDTLDLTF

SEQ ID NO: 108539 - protein, 9 aa, Artificial Sequence
  Description of Artificial Sequence: Synthetic peptide
  Seed: HSYFFEDTL (MAGC3_HUMAN)
HTYFFEDTV

SEQ ID NO: 108540 - protein, 9 aa, Artificial Sequence
  Description of Artificial Sequence: Synthetic peptide
  Seed: DMDPDNHSY (MAGC3_HUMAN)
DMDPDNHSI

SEQ ID NO: 108541 - protein, 10 aa, Artificial Sequence
  Description of Artificial Sequence: Synthetic peptide
  Seed: IELIFGIALT (MAGC3_HUMAN)
IMLIFGIALL

SEQ ID NO: 108542 - protein, 9 aa, Artificial Sequence
  Description of Artificial Sequence: Synthetic peptide
  Seed: SIIPSAFPS (MAGC3_HUMAN)
SQIPSAFPF

SEQ ID NO: 108543 - protein, 9 aa, Artificial Sequence
  Description of Artificial Sequence: Synthetic peptide
  Seed: WVKNTCATY (MAGC3_HUMAN)
WIKNTCATF

SEQ ID NO: 108544 - protein, 10 aa, Artificial Sequence
  Description of Artificial Sequence: Synthetic peptide
  Seed: MQMNVINTYT (MAGC3_HUMAN)
MDMNVINTYY

SEQ ID NO: 108545 - protein, 9 aa, Artificial Sequence
  Description of Artificial Sequence: Synthetic peptide
  Seed: YFFEDTLDL (MAGC3_HUMAN)
YVFEDTLDY

SEQ ID NO: 108546 - protein, 9 aa, Artificial Sequence
  Description of Artificial Sequence: Synthetic peptide
  Seed: FSLRRAVSV (MAGC3_HUMAN)
FELRRAVSL

SEQ ID NO: 108547 - protein, 10 aa, Artificial Sequence
  Description of Artificial Sequence: Synthetic peptide
  Seed: GSLPESEPLF (MAGC3_HUMAN)
GMLPESEPLY

SEQ ID NO: 108548 - protein, 8 aa, Artificial Sequence
  Description of Artificial Sequence: Synthetic peptide
  Seed: IFGKAHEF (MAGC3_HUMAN)
ITGKAHEF

SEQ ID NO: 108549 - protein, 8 aa, Artificial Sequence
  Description of Artificial Sequence: Synthetic peptide
  Seed: KVDKLVQF (MAGC3_HUMAN)
KSDKLVQL

SEQ ID NO: 108550 - protein, 10 aa, Artificial Sequence
  Description of Artificial Sequence: Synthetic peptide
  Seed: KKYKDYFPMI (MAGC3_HUMAN)
KMYKDYFPMK

SEQ ID NO: 108551 - protein, 9 aa, Artificial Sequence
  Description of Artificial Sequence: Synthetic peptide
  Seed: VIWEVLNAI (MAGC3_HUMAN)
VMWEVLNAT

SEQ ID NO: 108552 - protein, 10 aa, Artificial Sequence
  Description of Artificial Sequence: Synthetic peptide
  Seed: MQMNVINTYT (MAGC3_HUMAN)
MRMNVINTYI

SEQ ID NO: 108553 - protein, 10 aa, Artificial Sequence
  Description of Artificial Sequence: Synthetic peptide
  Seed: FADVLSRLAL (MAGC3_HUMAN)
FVDVLSRLAL

SEQ ID NO: 108554 - protein, 9 aa, Artificial Sequence
  Description of Artificial Sequence: Synthetic peptide
  Seed: RTLSGSPGL (MAGC3_HUMAN)
RLLSGSPGF

SEQ ID NO: 108555 - protein, 9 aa, Artificial Sequence
  Description of Artificial Sequence: Synthetic peptide
  Seed: EKVAELVQF (MAGC3_HUMAN)
ELVAELVQY

SEQ ID NO: 108556 - protein, 10 aa, Artificial Sequence
  Description of Artificial Sequence: Synthetic peptide
  Seed: TDMDPDNHSY (MAGC3_HUMAN)
TAMDPDNHSH

SEQ ID NO: 108557 - protein, 9 aa, Artificial Sequence
  Description of Artificial Sequence: Synthetic peptide
  Seed: EVLEFLSKL (MAGC3_HUMAN)
ETLEFLSKW

SEQ ID NO: 108558 - protein, 9 aa, Artificial Sequence
  Description of Artificial Sequence: Synthetic peptide
  Seed: SLPESEPLF (MAGC3_HUMAN)
SGPESEPLL

SEQ ID NO: 108559 - protein, 9 aa, Artificial Sequence
  Description of Artificial Sequence: Synthetic peptide
  Seed: VIWEVLNAI (MAGC3_HUMAN)
VLWEVLNAF

SEQ ID NO: 108560 - protein, 10 aa, Artificial Sequence
  Description of Artificial Sequence: Synthetic peptide
  Seed: SDQRMDSLVL (MAGC3_HUMAN)
SSQRMDSLVL

SEQ ID NO: 108561 - protein, 9 aa, Artificial Sequence
  Description of Artificial Sequence: Synthetic peptide
  Seed: MIFIKGSCV (MAGC3_HUMAN)
MSFIKGSCF

SEQ ID NO: 108562 - protein, 9 aa, Artificial Sequence
  Description of Artificial Sequence: Synthetic peptide
  Seed: LTTVIKKYK (MAGC3_HUMAN)
LSTVIKKYR

SEQ ID NO: 108563 - protein, 9 aa, Artificial Sequence
  Description of Artificial Sequence: Synthetic peptide
  Seed: KVAELVQFL (MAGC3_HUMAN)
KIAELVQFI

SEQ ID NO: 108564 - protein, 9 aa, Artificial Sequence
  Description of Artificial Sequence: Synthetic peptide
  Seed: VLCPTYFKL (MAGC3_HUMAN)
VMCPTYFKK

SEQ ID NO: 108565 - protein, 10 aa, Artificial Sequence
  Description of Artificial Sequence: Synthetic peptide
  Seed: HEFIELIFGI (MAGC3_HUMAN)
HEFIELIFGW

SEQ ID NO: 108566 - protein, 9 aa, Artificial Sequence
  Description of Artificial Sequence: Synthetic peptide
  Seed: MPAAGMPPL (MAGC3_HUMAN)
MTAAGMPPY

SEQ ID NO: 108567 - protein, 9 aa, Artificial Sequence
  Description of Artificial Sequence: Synthetic peptide
  Seed: FLSKLSSII (MAGC3_HUMAN)
FLSKLSSIM

SEQ ID NO: 108568 - protein, 10 aa, Artificial Sequence
  Description of Artificial Sequence: Synthetic peptide
  Seed: TCATYALSPV (MAGC3_HUMAN)
TSATYALSPV

SEQ ID NO: 108569 - protein, 9 aa, Artificial Sequence
  Description of Artificial Sequence: Synthetic peptide
  Seed: IIDTTDDAT (MAGC3_HUMAN)
IMDTTDDAI

SEQ ID NO: 108570 - protein, 10 aa, Artificial Sequence
  Description of Artificial Sequence: Synthetic peptide
  Seed: AEMLTTVIKK (MAGC3_HUMAN)
AHMLTTVIKK

SEQ ID NO: 108571 - protein, 9 aa, Artificial Sequence
  Description of Artificial Sequence: Synthetic peptide
  Seed: SPQGPPQSP (MAGC3_HUMAN)
SHQGPPQSA

SEQ ID NO: 108572 - protein, 10 aa, Artificial Sequence
  Description of Artificial Sequence: Synthetic peptide
  Seed: TTDDATAMAS (MAGC3_HUMAN)
TFDDATAMAI

SEQ ID NO: 108573 - protein, 9 aa, Artificial Sequence
  Description of Artificial Sequence: Synthetic peptide
  Seed: VIWEVLSAI (MAGC3_HUMAN)
VMWEVLSAA

SEQ ID NO: 108574 - protein, 9 aa, Artificial Sequence
  Description of Artificial Sequence: Synthetic peptide
  Seed: FEDTLDLTY (MAGC3_HUMAN)
FPDTLDLTW

SEQ ID NO: 108575 - protein, 9 aa, Artificial Sequence
  Description of Artificial Sequence: Synthetic peptide
  Seed: SEEEDTATW (MAGC3_HUMAN)
SEEEDTATC

SEQ ID NO: 108576 - protein, 11 aa, Artificial Sequence
  Description of Artificial Sequence: Synthetic peptide
  Seed: SSSEEEDTATW (MAGC3_HUMAN)
SASEEEDTATW

SEQ ID NO: 108577 - protein, 9 aa, Artificial Sequence
  Description of Artificial Sequence: Synthetic peptide
  Seed: KYKDYFPMI (MAGC3_HUMAN)
KAKDYFPMK

SEQ ID NO: 108578 - protein, 11 aa, Artificial Sequence
  Description of Artificial Sequence: Synthetic peptide
  Seed: DSCSSPLLWTR (MAGC3_HUMAN)
DLCSSPLLWTR

SEQ ID NO: 108579 - protein, 8 aa, Artificial Sequence
  Description of Artificial Sequence: Synthetic peptide
  Seed: SLVLCPTY (MAGC3_HUMAN)
SQVLCPTY

SEQ ID NO: 108580 - protein, 11 aa, Artificial Sequence
  Description of Artificial Sequence: Synthetic peptide
  Seed: TEVDPDHFYVF (MAGC3_HUMAN)
TEVDPDHFYVY

SEQ ID NO: 108581 - protein, 10 aa, Artificial Sequence
  Description of Artificial Sequence: Synthetic peptide
  Seed: FPSWYMDALK (MAGC3_HUMAN)
FPSWYMDALY

SEQ ID NO: 108582 - protein, 9 aa, Artificial Sequence
  Description of Artificial Sequence: Synthetic peptide
  Seed: IIPSAFPSW (MAGC3_HUMAN)
ITPSAFPSL

SEQ ID NO: 108583 - protein, 10 aa, Artificial Sequence
  Description of Artificial Sequence: Synthetic peptide
  Seed: YTLDEKVDKL (MAGC3_HUMAN)
YILDEKVDKV

SEQ ID NO: 108584 - protein, 9 aa, Artificial Sequence
  Description of Artificial Sequence: Synthetic peptide
  Seed: ATDKDYSAF (MAGC3_HUMAN)
ALDKDYSAY

SEQ ID NO: 108585 - protein, 11 aa, Artificial Sequence
  Description of Artificial Sequence: Synthetic peptide
  Seed: AFPSWYMDALK (MAGC3_HUMAN)
AMPSWYMDALR

SEQ ID NO: 108586 - protein, 9 aa, Artificial Sequence
  Description of Artificial Sequence: Synthetic peptide
  Seed: MQMNVINTY (MAGC3_HUMAN)
MPMNVINTE

SEQ ID NO: 108587 - protein, 9 aa, Artificial Sequence
  Description of Artificial Sequence: Synthetic peptide
  Seed: HLREVRLFL (MAGC3_HUMAN)
HWREVRLFA

SEQ ID NO: 108588 - protein, 10 aa, Artificial Sequence
  Description of Artificial Sequence: Synthetic peptide
  Seed: SCSSPLLWTR (MAGC3_HUMAN)
SMSSPLLWTR

SEQ ID NO: 108589 - protein, 11 aa, Artificial Sequence
  Description of Artificial Sequence: Synthetic peptide
  Seed: MLLPCHWVLDA (MAGC3_HUMAN)
MLLPCHWVLDL

SEQ ID NO: 108590 - protein, 10 aa, Artificial Sequence
  Description of Artificial Sequence: Synthetic peptide
  Seed: ADVLSRLALW (MAGC3_HUMAN)
AEVLSRLALY

SEQ ID NO: 108591 - protein, 8 aa, Artificial Sequence
  Description of Artificial Sequence: Synthetic peptide
  Seed: AEMLTTVI (MAGC3_HUMAN)
AEMLTTVM

SEQ ID NO: 108592 - protein, 9 aa, Artificial Sequence
  Description of Artificial Sequence: Synthetic peptide
  Seed: KVDKLVQFL (MAGC3_HUMAN)
KQDKLVQFV

SEQ ID NO: 108593 - protein, 10 aa, Artificial Sequence
  Description of Artificial Sequence: Synthetic peptide
  Seed: VLCPTYFKLW (MAGC3_HUMAN)
VTCPTYFKLW

SEQ ID NO: 108594 - protein, 10 aa, Artificial Sequence
  Description of Artificial Sequence: Synthetic peptide
  Seed: MDSLVLCPTY (MAGC3_HUMAN)
MNSLVLCPTW

SEQ ID NO: 108595 - protein, 9 aa, Artificial Sequence
  Description of Artificial Sequence: Synthetic peptide
  Seed: SALAGFADV (MAGC3_HUMAN)
SVLAGFADV

SEQ ID NO: 108596 - protein, 10 aa, Artificial Sequence
  Description of Artificial Sequence: Synthetic peptide
  Seed: EVIWEVLSAI (MAGC3_HUMAN)
EIIWEVLSAY

SEQ ID NO: 108597 - protein, 10 aa, Artificial Sequence
  Description of Artificial Sequence: Synthetic peptide
  Seed: KVAELVQFLL (MAGC3_HUMAN)
KWAELVQFLW

SEQ ID NO: 108598 - protein, 10 aa, Artificial Sequence
  Description of Artificial Sequence: Synthetic peptide
  Seed: TCATYALSPV (MAGC3_HUMAN)
TVATYALSPI

SEQ ID NO: 108599 - protein, 9 aa, Artificial Sequence
  Description of Artificial Sequence: Synthetic peptide
  Seed: ALDEKVAEL (MAGC3_HUMAN)
AVDEKVAEC

SEQ ID NO: 108600 - protein, 9 aa, Artificial Sequence
  Description of Artificial Sequence: Synthetic peptide
  Seed: HALPESESL (MAGC3_HUMAN)
HILPESESW

SEQ ID NO: 108601 - protein, 9 aa, Artificial Sequence
  Description of Artificial Sequence: Synthetic peptide
  Seed: FHLGHLREV (MAGC3_HUMAN)
FVLGHLREI

SEQ ID NO: 108602 - protein, 9 aa, Artificial Sequence
  Description of Artificial Sequence: Synthetic peptide
  Seed: KVAELVQFL (MAGC3_HUMAN)
KMAELVQFT

SEQ ID NO: 108603 - protein, 9 aa, Artificial Sequence
  Description of Artificial Sequence: Synthetic peptide
  Seed: DTTDDATAM (MAGC3_HUMAN)
DLTDDATAY

SEQ ID NO: 108604 - protein, 9 aa, Artificial Sequence
  Description of Artificial Sequence: Synthetic peptide
  Seed: IELIFGIAL (MAGC3_HUMAN)
IHLIFGIAL

SEQ ID NO: 108605 - protein, 9 aa, Artificial Sequence
  Description of Artificial Sequence: Synthetic peptide
  Seed: KAHEFIELI (MAGC3_HUMAN)
KFHEFIELM

SEQ ID NO: 108606 - protein, 10 aa, Artificial Sequence
  Description of Artificial Sequence: Synthetic peptide
  Seed: LNAIGPWSAL (MAGC3_HUMAN)
LWAIGPWSAL

SEQ ID NO: 108607 - protein, 9 aa, Artificial Sequence
  Description of Artificial Sequence: Synthetic peptide
  Seed: ALDEKVAEL (MAGC3_HUMAN)
AIDEKVAEW

SEQ ID NO: 108608 - protein, 9 aa, Artificial Sequence
  Description of Artificial Sequence: Synthetic peptide
  Seed: MPAAGMPPL (MAGC3_HUMAN)
MEAAGMPPL

SEQ ID NO: 108609 - protein, 10 aa, Artificial Sequence
  Description of Artificial Sequence: Synthetic peptide
  Seed: TYTGYFPMIF (MAGC3_HUMAN)
TITGYFPMIY

SEQ ID NO: 108610 - protein, 9 aa, Artificial Sequence
  Description of Artificial Sequence: Synthetic peptide
  Seed: LIDDQGMPK (MAGC3_HUMAN)
LYDDQGMPL

SEQ ID NO: 108611 - protein, 10 aa, Artificial Sequence
  Description of Artificial Sequence: Synthetic peptide
  Seed: SLIDDQGMPK (MAGC3_HUMAN)
SRIDDQGMPF

SEQ ID NO: 108612 - protein, 11 aa, Artificial Sequence
  Description of Artificial Sequence: Synthetic peptide
  Seed: TLWKDSDLPTW (MAGC3_HUMAN)
TGWKDSDLPTW

SEQ ID NO: 108613 - protein, 9 aa, Artificial Sequence
  Description of Artificial Sequence: Synthetic peptide
  Seed: EVLEFLSKL (MAGC3_HUMAN)
ELLEFLSKV

SEQ ID NO: 108614 - protein, 11 aa, Artificial Sequence
  Description of Artificial Sequence: Synthetic peptide
  Seed: ALAGFADVLSR (MAGC3_HUMAN)
ATAGFADVLSK

SEQ ID NO: 108615 - protein, 11 aa, Artificial Sequence
  Description of Artificial Sequence: Synthetic peptide
  Seed: ALWESEGPEAF (MAGC3_HUMAN)
AVWESEGPEAF

SEQ ID NO: 108616 - protein, 9 aa, Artificial Sequence
  Description of Artificial Sequence: Synthetic peptide
  Seed: TLDEKVDKL (MAGC3_HUMAN)
TGDEKVDKM

SEQ ID NO: 108617 - protein, 9 aa, Artificial Sequence
  Description of Artificial Sequence: Synthetic peptide
  Seed: TGYFPMIFR (MAGC3_HUMAN)
TVYFPMIFK

SEQ ID NO: 108618 - protein, 10 aa, Artificial Sequence
  Description of Artificial Sequence: Synthetic peptide
  Seed: KDSDLPTWRR (MAGC3_HUMAN)
KSSDLPTWRR

SEQ ID NO: 108619 - protein, 9 aa, Artificial Sequence
  Description of Artificial Sequence: Synthetic peptide
  Seed: ISPQGPPQS (MAGC3_HUMAN)
IYPQGPPQL

SEQ ID NO: 108620 - protein, 9 aa, Artificial Sequence
  Description of Artificial Sequence: Synthetic peptide
  Seed: VINTYTGYF (MAGC3_HUMAN)
VANTYTGYM

SEQ ID NO: 108621 - protein, 11 aa, Artificial Sequence
  Description of Artificial Sequence: Synthetic peptide
  Seed: LSKLSSIIPSA (MAGC3_HUMAN)
LYKLSSIIPSL

SEQ ID NO: 108622 - protein, 11 aa, Artificial Sequence
  Description of Artificial Sequence: Synthetic peptide
  Seed: RYALDEKVAEL (MAGC3_HUMAN)
RNALDEKVAEV

SEQ ID NO: 108623 - protein, 9 aa, Artificial Sequence
  Description of Artificial Sequence: Synthetic peptide
  Seed: IELIFGIAL (MAGC3_HUMAN)
IKLIFGIAF

SEQ ID NO: 108624 - protein, 10 aa, Artificial Sequence
  Description of Artificial Sequence: Synthetic peptide
  Seed: MDPDNHSYFF (MAGC3_HUMAN)
MSPDNHSYFW

SEQ ID NO: 108625 - protein, 9 aa, Artificial Sequence
  Description of Artificial Sequence: Synthetic peptide
  Seed: FVNTLDLTC (MAGC3_HUMAN)
FSNTLDLTL

SEQ ID NO: 108626 - protein, 9 aa, Artificial Sequence
  Description of Artificial Sequence: Synthetic peptide
  Seed: MLLPCHWVL (MAGC3_HUMAN)
MRLPCHWVV

SEQ ID NO: 108627 - protein, 9 aa, Artificial Sequence
  Description of Artificial Sequence: Synthetic peptide
  Seed: EAFCEESGL (MAGC3_HUMAN)
EVFCEESGI

SEQ ID NO: 108628 - protein, 10 aa, Artificial Sequence
  Description of Artificial Sequence: Synthetic peptide
  Seed: SAFHLGHLRE (MAGC3_HUMAN)
SMFHLGHLRG

SEQ ID NO: 108629 - protein, 11 aa, Artificial Sequence
  Description of Artificial Sequence: Synthetic peptide
  Seed: TSDQRMDSLVL (MAGC3_HUMAN)
TCDQRMDSLVY

SEQ ID NO: 108630 - protein, 10 aa, Artificial Sequence
  Description of Artificial Sequence: Synthetic peptide
  Seed: MDPDNHSYFF (MAGC3_HUMAN)
MEPDNHSYFW

SEQ ID NO: 108631 - protein, 10 aa, Artificial Sequence
  Description of Artificial Sequence: Synthetic peptide
  Seed: VLDLANPQGL (MAGC3_HUMAN)
VIDLANPQGF

SEQ ID NO: 108632 - protein, 10 aa, Artificial Sequence
  Description of Artificial Sequence: Synthetic peptide
  Seed: ILFGISLTEV (MAGC3_HUMAN)
IMFGISLTEV

SEQ ID NO: 108633 - protein, 11 aa, Artificial Sequence
  Description of Artificial Sequence: Synthetic peptide
  Seed: RGLTEASPQQK (MAGC3_HUMAN)
RMLTEASPQQR

SEQ ID NO: 108634 - protein, 9 aa, Artificial Sequence
  Description of Artificial Sequence: Synthetic peptide
  Seed: YALDEKVAE (MAGC3_HUMAN)
YTLDEKVAF

SEQ ID NO: 108635 - protein, 10 aa, Artificial Sequence
  Description of Artificial Sequence: Synthetic peptide
  Seed: FKLWRTLSGS (MAGC3_HUMAN)
FQLWRTLSGV

SEQ ID NO: 108636 - protein, 9 aa, Artificial Sequence
  Description of Artificial Sequence: Synthetic peptide
  Seed: NAIGPWSAL (MAGC3_HUMAN)
NHIGPWSAI

SEQ ID NO: 108637 - protein, 9 aa, Artificial Sequence
  Description of Artificial Sequence: Synthetic peptide
  Seed: NAIGPWSAL (MAGC3_HUMAN)
NHIGPWSAL

SEQ ID NO: 108638 - protein, 9 aa, Artificial Sequence
  Description of Artificial Sequence: Synthetic peptide
  Seed: MIFGKAHEF (MAGC3_HUMAN)
MMFGKAHEY

SEQ ID NO: 108639 - protein, 9 aa, Artificial Sequence
  Description of Artificial Sequence: Synthetic peptide
  Seed: KGSCVPEEV (MAGC3_HUMAN)
KISCVPEEM

SEQ ID NO: 108640 - protein, 9 aa, Artificial Sequence
  Description of Artificial Sequence: Synthetic peptide
  Seed: RTLSGSPGL (MAGC3_HUMAN)
RMLSGSPGV

SEQ ID NO: 108641 - protein, 9 aa, Artificial Sequence
  Description of Artificial Sequence: Synthetic peptide
  Seed: NTYTGYFPM (MAGC3_HUMAN)
NTYTGYFPH

SEQ ID NO: 108642 - protein, 9 aa, Artificial Sequence
  Description of Artificial Sequence: Synthetic peptide
  Seed: ILILSVIFI (MAGC3_HUMAN)
ITILSVIFV

SEQ ID NO: 108643 - protein, 9 aa, Artificial Sequence
  Description of Artificial Sequence: Synthetic peptide
  Seed: FPSWYMDAL (MAGC3_HUMAN)
FISWYMDAF

SEQ ID NO: 108644 - protein, 11 aa, Artificial Sequence
  Description of Artificial Sequence: Synthetic peptide
  Seed: ATFSDGSLGQW (MAGC3_HUMAN)
ASFSDGSLGQY

SEQ ID NO: 108645 - protein, 9 aa, Artificial Sequence
  Description of Artificial Sequence: Synthetic peptide
  Seed: DEQGMPQNR (MAGC3_HUMAN)
DMQGMPQNR

SEQ ID NO: 108646 - protein, 9 aa, Artificial Sequence
  Description of Artificial Sequence: Synthetic peptide
  Seed: DSDLPTWRR (MAGC3_HUMAN)
DIDLPTWRR

SEQ ID NO: 108647 - protein, 11 aa, Artificial Sequence
  Description of Artificial Sequence: Synthetic peptide
  Seed: IIDTTDDATAM (MAGC3_HUMAN)
IMDTTDDATAY

SEQ ID NO: 108648 - protein, 10 aa, Artificial Sequence
  Description of Artificial Sequence: Synthetic peptide
  Seed: FYVFVNTLDL (MAGC3_HUMAN)
FWVFVNTLDF

SEQ ID NO: 108649 - protein, 9 aa, Artificial Sequence
  Description of Artificial Sequence: Synthetic peptide
  Seed: YALSPVVLP (MAGC3_HUMAN)
YVLSPVVLL

SEQ ID NO: 108650 - protein, 9 aa, Artificial Sequence
  Description of Artificial Sequence: Synthetic peptide
  Seed: RGTGYTLSL (MAGC3_HUMAN)
RNTGYTLSM

SEQ ID NO: 108651 - protein, 10 aa, Artificial Sequence
  Description of Artificial Sequence: Synthetic peptide
  Seed: TLSGSPGLQL (MAGC3_HUMAN)
TQSGSPGLQF

SEQ ID NO: 108652 - protein, 9 aa, Artificial Sequence
  Description of Artificial Sequence: Synthetic peptide
  Seed: DYFPMIFGK (MAGC3_HUMAN)
DVFPMIFGK

SEQ ID NO: 108653 - protein, 9 aa, Artificial Sequence
  Description of Artificial Sequence: Synthetic peptide
  Seed: FLSKLSSII (MAGC3_HUMAN)
FLSKLSSIV

SEQ ID NO: 108654 - protein, 10 aa, Artificial Sequence
  Description of Artificial Sequence: Synthetic peptide
  Seed: NAIGPWSALA (MAGC3_HUMAN)
NTIGPWSALI

SEQ ID NO: 108655 - protein, 10 aa, Artificial Sequence
  Description of Artificial Sequence: Synthetic peptide
  Seed: MQMNVINTYT (MAGC3_HUMAN)
MFMNVINTYF

SEQ ID NO: 108656 - protein, 9 aa, Artificial Sequence
  Description of Artificial Sequence: Synthetic peptide
  Seed: KAHEFIELI (MAGC3_HUMAN)
KVHEFIELV

SEQ ID NO: 108657 - protein, 9 aa, Artificial Sequence
  Description of Artificial Sequence: Synthetic peptide
  Seed: LLILILSMI (MAGC3_HUMAN)
LLILILSML

SEQ ID NO: 108658 - protein, 9 aa, Artificial Sequence
  Description of Artificial Sequence: Synthetic peptide
  Seed: TGYFPMIFR (MAGC3_HUMAN)
TMYFPMIFR

SEQ ID NO: 108659 - protein, 10 aa, Artificial Sequence
  Description of Artificial Sequence: Synthetic peptide
  Seed: TWRRGTGYTL (MAGC3_HUMAN)
TYRRGTGYTL

SEQ ID NO: 108660 - protein, 10 aa, Artificial Sequence
  Description of Artificial Sequence: Synthetic peptide
  Seed: MPAAGMPPLP (MAGC3_HUMAN)
MPAAGMPPLI

SEQ ID NO: 108661 - protein, 9 aa, Artificial Sequence
  Description of Artificial Sequence: Synthetic peptide
  Seed: SLRRAVSVK (MAGC3_HUMAN)
SVRRAVSVL

SEQ ID NO: 108662 - protein, 9 aa, Artificial Sequence
  Description of Artificial Sequence: Synthetic peptide
  Seed: WVKNTCATY (MAGC3_HUMAN)
WAKNTCATW

SEQ ID NO: 108663 - protein, 9 aa, Artificial Sequence
  Description of Artificial Sequence: Synthetic peptide
  Seed: YQTKEPVTK (MAGC3_HUMAN)
YFTKEPVTL

SEQ ID NO: 108664 - protein, 10 aa, Artificial Sequence
  Description of Artificial Sequence: Synthetic peptide
  Seed: MPKNCLLILI (MAGC3_HUMAN)
MPKNCLLILA

SEQ ID NO: 108665 - protein, 8 aa, Artificial Sequence
  Description of Artificial Sequence: Synthetic peptide
  Seed: FFEDTLDL (MAGC3_HUMAN)
FAEDTLDL

SEQ ID NO: 108666 - protein, 10 aa, Artificial Sequence
  Description of Artificial Sequence: Synthetic peptide
  Seed: MQMNVINTYT (MAGC3_HUMAN)
MDMNVINTYA

SEQ ID NO: 108667 - protein, 9 aa, Artificial Sequence
  Description of Artificial Sequence: Synthetic peptide
  Seed: HFYVFVNTL (MAGC3_HUMAN)
HSYVFVNTV

SEQ ID NO: 108668 - protein, 10 aa, Artificial Sequence
  Description of Artificial Sequence: Synthetic peptide
  Seed: ILILSVIFIK (MAGC3_HUMAN)
ITILSVIFIK

SEQ ID NO: 108669 - protein, 10 aa, Artificial Sequence
  Description of Artificial Sequence: Synthetic peptide
  Seed: EKVAELVQFL (MAGC3_HUMAN)
EIVAELVQFV

SEQ ID NO: 108670 - protein, 9 aa, Artificial Sequence
  Description of Artificial Sequence: Synthetic peptide
  Seed: FLSKLSSII (MAGC3_HUMAN)
FQSKLSSII

SEQ ID NO: 108671 - protein, 10 aa, Artificial Sequence
  Description of Artificial Sequence: Synthetic peptide
  Seed: TAMASASPSV (MAGC3_HUMAN)
TWMASASPSI

SEQ ID NO: 108672 - protein, 9 aa, Artificial Sequence
  Description of Artificial Sequence: Synthetic peptide
  Seed: MASASPSVM (MAGC3_HUMAN)
MCSASPSVY

SEQ ID NO: 108673 - protein, 9 aa, Artificial Sequence
  Description of Artificial Sequence: Synthetic peptide
  Seed: EVLEFLSKL (MAGC3_HUMAN)
ESLEFLSKK

SEQ ID NO: 108674 - protein, 9 aa, Artificial Sequence
  Description of Artificial Sequence: Synthetic peptide
  Seed: NTYTGYFPM (MAGC3_HUMAN)
NSYTGYFPF

SEQ ID NO: 108675 - protein, 9 aa, Artificial Sequence
  Description of Artificial Sequence: Synthetic peptide
  Seed: YTLDEKVDK (MAGC3_HUMAN)
YALDEKVDL

SEQ ID NO: 108676 - protein, 9 aa, Artificial Sequence
  Description of Artificial Sequence: Synthetic peptide
  Seed: YALSPVVLP (MAGC3_HUMAN)
YTLSPVVLM

SEQ ID NO: 108677 - protein, 9 aa, Artificial Sequence
  Description of Artificial Sequence: Synthetic peptide
  Seed: TTDDATAMA (MAGC3_HUMAN)
TYDDATAMV

SEQ ID NO: 108678 - protein, 9 aa, Artificial Sequence
  Description of Artificial Sequence: Synthetic peptide
  Seed: WRRGTGYTL (MAGC3_HUMAN)
WHRGTGYTA

SEQ ID NO: 108679 - protein, 9 aa, Artificial Sequence
  Description of Artificial Sequence: Synthetic peptide
  Seed: AGFADVLSR (MAGC3_HUMAN)
ASFADVLSR

SEQ ID NO: 108680 - protein, 10 aa, Artificial Sequence
  Description of Artificial Sequence: Synthetic peptide
  Seed: INTYTGYFPM (MAGC3_HUMAN)
IATYTGYFPY

SEQ ID NO: 108681 - protein, 10 aa, Artificial Sequence
  Description of Artificial Sequence: Synthetic peptide
  Seed: INTYTGYFPM (MAGC3_HUMAN)
ITTYTGYFPW

SEQ ID NO: 108682 - protein, 9 aa, Artificial Sequence
  Description of Artificial Sequence: Synthetic peptide
  Seed: EDTATWHAL (MAGC3_HUMAN)
EETATWHAV

SEQ ID NO: 108683 - protein, 9 aa, Artificial Sequence
  Description of Artificial Sequence: Synthetic peptide
  Seed: HALPESESL (MAGC3_HUMAN)
HFLPESESY

SEQ ID NO: 108684 - protein, 9 aa, Artificial Sequence
  Description of Artificial Sequence: Synthetic peptide
  Seed: QPQPRKKAT (MAGC3_HUMAN)
QMQPRKKAM

SEQ ID NO: 108685 - protein, 9 aa, Artificial Sequence
  Description of Artificial Sequence: Synthetic peptide
  Seed: FHLGHLREV (MAGC3_HUMAN)
FTLGHLREI

SEQ ID NO: 108686 - protein, 11 aa, Artificial Sequence
  Description of Artificial Sequence: Synthetic peptide
  Seed: INTYTGYFPMI (MAGC3_HUMAN)
IITYTGYFPMF

SEQ ID NO: 108687 - protein, 10 aa, Artificial Sequence
  Description of Artificial Sequence: Synthetic peptide
  Seed: SPLDSCSSPL (MAGC3_HUMAN)
SKLDSCSSPV

SEQ ID NO: 108688 - protein, 10 aa, Artificial Sequence
  Description of Artificial Sequence: Synthetic peptide
  Seed: MPAAGMPPLP (MAGC3_HUMAN)
MYAAGMPPLY

SEQ ID NO: 108689 - protein, 9 aa, Artificial Sequence
  Description of Artificial Sequence: Synthetic peptide
  Seed: LIDDQGMPK (MAGC3_HUMAN)
LVDDQGMPF

SEQ ID NO: 108690 - protein, 9 aa, Artificial Sequence
  Description of Artificial Sequence: Synthetic peptide
  Seed: WVKNTCATY (MAGC3_HUMAN)
WTKNTCATK

SEQ ID NO: 108691 - protein, 10 aa, Artificial Sequence
  Description of Artificial Sequence: Synthetic peptide
  Seed: SKLSSIIPSA (MAGC3_HUMAN)
SVLSSIIPSL

SEQ ID NO: 108692 - protein, 11 aa, Artificial Sequence
  Description of Artificial Sequence: Synthetic peptide
  Seed: KVAELVQFLLL (MAGC3_HUMAN)
KMAELVQFLLD

SEQ ID NO: 108693 - protein, 10 aa, Artificial Sequence
  Description of Artificial Sequence: Synthetic peptide
  Seed: MLLPCHWVLD (MAGC3_HUMAN)
MLLPCHWVLA

SEQ ID NO: 108694 - protein, 9 aa, Artificial Sequence
  Description of Artificial Sequence: Synthetic peptide
  Seed: KYKDYFPMI (MAGC3_HUMAN)
KRKDYFPMF

SEQ ID NO: 108695 - protein, 9 aa, Artificial Sequence
  Description of Artificial Sequence: Synthetic peptide
  Seed: RPAREVLEF (MAGC3_HUMAN)
RPAREVLEA

SEQ ID NO: 108696 - protein, 9 aa, Artificial Sequence
  Description of Artificial Sequence: Synthetic peptide
  Seed: AVSPGKRLW (MAGC3_HUMAN)
AVSPGKRLF

SEQ ID NO: 108697 - protein, 9 aa, Artificial Sequence
  Description of Artificial Sequence: Synthetic peptide
  Seed: MLLPCHWVL (MAGC3_HUMAN)
MWLPCHWVY

SEQ ID NO: 108698 - protein, 9 aa, Artificial Sequence
  Description of Artificial Sequence: Synthetic peptide
  Seed: FEDTLDLTY (MAGC3_HUMAN)
FEDTLDLTM

SEQ ID NO: 108699 - protein, 9 aa, Artificial Sequence
  Description of Artificial Sequence: Synthetic peptide
  Seed: VLPPQPQPR (MAGC3_HUMAN)
VSPPQPQPM

SEQ ID NO: 108700 - protein, 9 aa, Artificial Sequence
  Description of Artificial Sequence: Synthetic peptide
  Seed: RGTGYTLSL (MAGC3_HUMAN)
RRTGYTLSL

SEQ ID NO: 108701 - protein, 9 aa, Artificial Sequence
  Description of Artificial Sequence: Synthetic peptide
  Seed: HSYFFEDTL (MAGC3_HUMAN)
HVYFFEDTF

SEQ ID NO: 108702 - protein, 10 aa, Artificial Sequence
  Description of Artificial Sequence: Synthetic peptide
  Seed: YALSPVVLPP (MAGC3_HUMAN)
YNLSPVVLPT

SEQ ID NO: 108703 - protein, 10 aa, Artificial Sequence
  Description of Artificial Sequence: Synthetic peptide
  Seed: ILFGISLTEV (MAGC3_HUMAN)
IIFGISLTEI

SEQ ID NO: 108704 - protein, 9 aa, Artificial Sequence
  Description of Artificial Sequence: Synthetic peptide
  Seed: DVLSRLALW (MAGC3_HUMAN)
DTLSRLALF

SEQ ID NO: 108705 - protein, 9 aa, Artificial Sequence
  Description of Artificial Sequence: Synthetic peptide
  Seed: LANPQGLAG (MAGC3_HUMAN)
LSNPQGLAI

SEQ ID NO: 108706 - protein, 11 aa, Artificial Sequence
  Description of Artificial Sequence: Synthetic peptide
  Seed: MLLPCHWVLDA (MAGC3_HUMAN)
MMLPCHWVLDI

SEQ ID NO: 108707 - protein, 9 aa, Artificial Sequence
  Description of Artificial Sequence: Synthetic peptide
  Seed: VLPPQPQPR (MAGC3_HUMAN)
VLPPQPQPM

SEQ ID NO: 108708 - protein, 9 aa, Artificial Sequence
  Description of Artificial Sequence: Synthetic peptide
  Seed: TLDEKVDKL (MAGC3_HUMAN)
THDEKVDKM

SEQ ID NO: 108709 - protein, 11 aa, Artificial Sequence
  Description of Artificial Sequence: Synthetic peptide
  Seed: IIDTTDDATAM (MAGC3_HUMAN)
IVDTTDDATAL

SEQ ID NO: 108710 - protein, 8 aa, Artificial Sequence
  Description of Artificial Sequence: Synthetic peptide
  Seed: FLSKLSSI (MAGC3_HUMAN)
FISKLSSV

SEQ ID NO: 108711 - protein, 9 aa, Artificial Sequence
  Description of Artificial Sequence: Synthetic peptide
  Seed: KVAELVQFL (MAGC3_HUMAN)
KYAELVQFL

SEQ ID NO: 108712 - protein, 10 aa, Artificial Sequence
  Description of Artificial Sequence: Synthetic peptide
  Seed: FPSWYMDALK (MAGC3_HUMAN)
FPSWYMDALR

SEQ ID NO: 108713 - protein, 9 aa, Artificial Sequence
  Description of Artificial Sequence: Synthetic peptide
  Seed: AEMQMNVIN (MAGC3_HUMAN)
AEMQMNVIL

SEQ ID NO: 108714 - protein, 10 aa, Artificial Sequence
  Description of Artificial Sequence: Synthetic peptide
  Seed: FFEDTLDLTY (MAGC3_HUMAN)
FAEDTLDLTF

SEQ ID NO: 108715 - protein, 9 aa, Artificial Sequence
  Description of Artificial Sequence: Synthetic peptide
  Seed: VLCPTYFKL (MAGC3_HUMAN)
VGCPTYFKY

SEQ ID NO: 108716 - protein, 9 aa, Artificial Sequence
  Description of Artificial Sequence: Synthetic peptide
  Seed: YQAKEPLTR (MAGC3_HUMAN)
YEAKEPLTF

SEQ ID NO: 108717 - protein, 9 aa, Artificial Sequence
  Description of Artificial Sequence: Synthetic peptide
  Seed: GSLPESEPL (MAGC3_HUMAN)
GMLPESEPF

SEQ ID NO: 108718 - protein, 10 aa, Artificial Sequence
  Description of Artificial Sequence: Synthetic peptide
  Seed: KLVQFLLLKY (MAGC3_HUMAN)
KQVQFLLLKR

SEQ ID NO: 108719 - protein, 9 aa, Artificial Sequence
  Description of Artificial Sequence: Synthetic peptide
  Seed: NAIGPWSAL (MAGC3_HUMAN)
NAIGPWSAK

SEQ ID NO: 108720 - protein, 10 aa, Artificial Sequence
  Description of Artificial Sequence: Synthetic peptide
  Seed: ALDEKVAELV (MAGC3_HUMAN)
AMDEKVAELV

SEQ ID NO: 108721 - protein, 9 aa, Artificial Sequence
  Description of Artificial Sequence: Synthetic peptide
  Seed: MQMNVINTY (MAGC3_HUMAN)
MSMNVINTA

SEQ ID NO: 108722 - protein, 11 aa, Artificial Sequence
  Description of Artificial Sequence: Synthetic peptide
  Seed: INTYTGYFPMI (MAGC3_HUMAN)
IVTYTGYFPMF

SEQ ID NO: 108723 - protein, 9 aa, Artificial Sequence
  Description of Artificial Sequence: Synthetic peptide
  Seed: KAHEFIELI (MAGC3_HUMAN)
KWHEFIELF

SEQ ID NO: 108724 - protein, 9 aa, Artificial Sequence
  Description of Artificial Sequence: Synthetic peptide
  Seed: MLTTVIKKY (MAGC3_HUMAN)
MLTTVIKKF

SEQ ID NO: 108725 - protein, 9 aa, Artificial Sequence
  Description of Artificial Sequence: Synthetic peptide
  Seed: YALSPVVLP (MAGC3_HUMAN)
YALSPVVLH

SEQ ID NO: 108726 - protein, 10 aa, Artificial Sequence
  Description of Artificial Sequence: Synthetic peptide
  Seed: IPSAFPSWYM (MAGC3_HUMAN)
IASAFPSWYW

SEQ ID NO: 108727 - protein, 10 aa, Artificial Sequence
  Description of Artificial Sequence: Synthetic peptide
  Seed: KKYKDYFPMI (MAGC3_HUMAN)
KCYKDYFPMK

SEQ ID NO: 108728 - protein, 9 aa, Artificial Sequence
  Description of Artificial Sequence: Synthetic peptide
  Seed: KVAELVQFL (MAGC3_HUMAN)
KLAELVQFI

SEQ ID NO: 108729 - protein, 10 aa, Artificial Sequence
  Description of Artificial Sequence: Synthetic peptide
  Seed: KKYKDYFPMI (MAGC3_HUMAN)
KQYKDYFPMW

SEQ ID NO: 108730 - protein, 9 aa, Artificial Sequence
  Description of Artificial Sequence: Synthetic peptide
  Seed: SALAGFADV (MAGC3_HUMAN)
SMLAGFADM

SEQ ID NO: 108731 - protein, 9 aa, Artificial Sequence
  Description of Artificial Sequence: Synthetic peptide
  Seed: MIFGKAHEF (MAGC3_HUMAN)
MMFGKAHEI

SEQ ID NO: 108732 - protein, 9 aa, Artificial Sequence
  Description of Artificial Sequence: Synthetic peptide
  Seed: ALAGFADVL (MAGC3_HUMAN)
AIAGFADVY

SEQ ID NO: 108733 - protein, 9 aa, Artificial Sequence
  Description of Artificial Sequence: Synthetic peptide
  Seed: HFYVFVNTL (MAGC3_HUMAN)
HLYVFVNTL

SEQ ID NO: 108734 - protein, 9 aa, Artificial Sequence
  Description of Artificial Sequence: Synthetic peptide
  Seed: YQTKEPVTK (MAGC3_HUMAN)
YTTKEPVTL

SEQ ID NO: 108735 - protein, 11 aa, Artificial Sequence
  Description of Artificial Sequence: Synthetic peptide
  Seed: EILFGISLTEV (MAGC3_HUMAN)
EYLFGISLTEL

SEQ ID NO: 108736 - protein, 10 aa, Artificial Sequence
  Description of Artificial Sequence: Synthetic peptide
  Seed: FFEDTLDLTY (MAGC3_HUMAN)
FWEDTLDLTL

SEQ ID NO: 108737 - protein, 9 aa, Artificial Sequence
  Description of Artificial Sequence: Synthetic peptide
  Seed: IPPQGPPKI (MAGC3_HUMAN)
IAPQGPPKM

SEQ ID NO: 108738 - protein, 9 aa, Artificial Sequence
  Description of Artificial Sequence: Synthetic peptide
  Seed: TKAEMLTTV (MAGC3_HUMAN)
TYAEMLTTL

SEQ ID NO: 108739 - protein, 10 aa, Artificial Sequence
  Description of Artificial Sequence: Synthetic peptide
  Seed: ILFGISLTEV (MAGC3_HUMAN)
ITFGISLTEA

SEQ ID NO: 108740 - protein, 9 aa, Artificial Sequence
  Description of Artificial Sequence: Synthetic peptide
  Seed: LSAIGPIQR (MAGC3_HUMAN)
LTAIGPIQY

SEQ ID NO: 108741 - protein, 9 aa, Artificial Sequence
  Description of Artificial Sequence: Synthetic peptide
  Seed: MASASPSVM (MAGC3_HUMAN)
MPSASPSVY

SEQ ID NO: 108742 - protein, 10 aa, Artificial Sequence
  Description of Artificial Sequence: Synthetic peptide
  Seed: MIFGKAHEFI (MAGC3_HUMAN)
MSFGKAHEFA

SEQ ID NO: 108743 - protein, 9 aa, Artificial Sequence
  Description of Artificial Sequence: Synthetic peptide
  Seed: SALAGFADV (MAGC3_HUMAN)
SVLAGFADI

SEQ ID NO: 108744 - protein, 11 aa, Artificial Sequence
  Description of Artificial Sequence: Synthetic peptide
  Seed: LPQSPPEIPPQ (MAGC3_HUMAN)
LPQSPPEIPPL

SEQ ID NO: 108745 - protein, 9 aa, Artificial Sequence
  Description of Artificial Sequence: Synthetic peptide
  Seed: TLDEKVDKL (MAGC3_HUMAN)
TSDEKVDKM

SEQ ID NO: 108746 - protein, 10 aa, Artificial Sequence
  Description of Artificial Sequence: Synthetic peptide
  Seed: TTDDATAMAS (MAGC3_HUMAN)
TWDDATAMAM

SEQ ID NO: 108747 - protein, 10 aa, Artificial Sequence
  Description of Artificial Sequence: Synthetic peptide
  Seed: SALAGFADVL (MAGC3_HUMAN)
SKLAGFADVL

SEQ ID NO: 108748 - protein, 10 aa, Artificial Sequence
  Description of Artificial Sequence: Synthetic peptide
  Seed: YTLDEKVDKL (MAGC3_HUMAN)
YVLDEKVDKI

SEQ ID NO: 108749 - protein, 9 aa, Artificial Sequence
  Description of Artificial Sequence: Synthetic peptide
  Seed: EVLEFLSKL (MAGC3_HUMAN)
EALEFLSKK

SEQ ID NO: 108750 - protein, 9 aa, Artificial Sequence
  Description of Artificial Sequence: Synthetic peptide
  Seed: EVIWEVLSA (MAGC3_HUMAN)
ETIWEVLSR

SEQ ID NO: 108751 - protein, 9 aa, Artificial Sequence
  Description of Artificial Sequence: Synthetic peptide
  Seed: TEVDPDHFY (MAGC3_HUMAN)
TEVDPDHFL

SEQ ID NO: 108752 - protein, 10 aa, Artificial Sequence
  Description of Artificial Sequence: Synthetic peptide
  Seed: ALDEKVAELV (MAGC3_HUMAN)
AMDEKVAELM

SEQ ID NO: 108753 - protein, 9 aa, Artificial Sequence
  Description of Artificial Sequence: Synthetic peptide
  Seed: VIWEVLNAI (MAGC3_HUMAN)
VTWEVLNAL

SEQ ID NO: 108754 - protein, 8 aa, Artificial Sequence
  Description of Artificial Sequence: Synthetic peptide
  Seed: SGSPGLQL (MAGC3_HUMAN)
SASPGLQM

SEQ ID NO: 108755 - protein, 9 aa, Artificial Sequence
  Description of Artificial Sequence: Synthetic peptide
  Seed: KLVQFLLLK (MAGC3_HUMAN)
KLVQFLLLT

SEQ ID NO: 108756 - protein, 10 aa, Artificial Sequence
  Description of Artificial Sequence: Synthetic peptide
  Seed: MDPDNHSYFF (MAGC3_HUMAN)
MCPDNHSYFL

SEQ ID NO: 108757 - protein, 10 aa, Artificial Sequence
  Description of Artificial Sequence: Synthetic peptide
  Seed: NAIGPWSALA (MAGC3_HUMAN)
NVIGPWSALA

SEQ ID NO: 108758 - protein, 9 aa, Artificial Sequence
  Description of Artificial Sequence: Synthetic peptide
  Seed: TLDEKVDKL (MAGC3_HUMAN)
TLDEKVDKV

SEQ ID NO: 108759 - protein, 10 aa, Artificial Sequence
  Description of Artificial Sequence: Synthetic peptide
  Seed: YALSPVVLPP (MAGC3_HUMAN)
YELSPVVLPV

SEQ ID NO: 108760 - protein, 10 aa, Artificial Sequence
  Description of Artificial Sequence: Synthetic peptide
  Seed: FPSWYMDALK (MAGC3_HUMAN)
FGSWYMDALK

SEQ ID NO: 108761 - protein, 9 aa, Artificial Sequence
  Description of Artificial Sequence: Synthetic peptide
  Seed: MASASPSVM (MAGC3_HUMAN)
MMSASPSVM

SEQ ID NO: 108762 - protein, 9 aa, Artificial Sequence
  Description of Artificial Sequence: Synthetic peptide
  Seed: MPAAGMPPL (MAGC3_HUMAN)
MHAAGMPPV

SEQ ID NO: 108763 - protein, 9 aa, Artificial Sequence
  Description of Artificial Sequence: Synthetic peptide
  Seed: HSYFFEDTL (MAGC3_HUMAN)
HPYFFEDTV

SEQ ID NO: 108764 - protein, 9 aa, Artificial Sequence
  Description of Artificial Sequence: Synthetic peptide
  Seed: GFADVLSRL (MAGC3_HUMAN)
GIADVLSRT

SEQ ID NO: 108765 - protein, 9 aa, Artificial Sequence
  Description of Artificial Sequence: Synthetic peptide
  Seed: TEVDPDHFY (MAGC3_HUMAN)
TYVDPDHFY

SEQ ID NO: 108766 - protein, 9 aa, Artificial Sequence
  Description of Artificial Sequence: Synthetic peptide
  Seed: NTYTGYFPM (MAGC3_HUMAN)
NMYTGYFPC

SEQ ID NO: 108767 - protein, 10 aa, Artificial Sequence
  Description of Artificial Sequence: Synthetic peptide
  Seed: SLVLCPTYFK (MAGC3_HUMAN)
SMVLCPTYFR

SEQ ID NO: 108768 - protein, 9 aa, Artificial Sequence
  Description of Artificial Sequence: Synthetic peptide
  Seed: VLCPTYFKL (MAGC3_HUMAN)
VMCPTYFKA

SEQ ID NO: 108769 - protein, 9 aa, Artificial Sequence
  Description of Artificial Sequence: Synthetic peptide
  Seed: EVLEFLSKL (MAGC3_HUMAN)
EGLEFLSKK

SEQ ID NO: 108770 - protein, 10 aa, Artificial Sequence
  Description of Artificial Sequence: Synthetic peptide
  Seed: YSAFHLGHLR (MAGC3_HUMAN)
YQAFHLGHLK

SEQ ID NO: 108771 - protein, 9 aa, Artificial Sequence
  Description of Artificial Sequence: Synthetic peptide
  Seed: FHLGHLREV (MAGC3_HUMAN)
FALGHLREL

SEQ ID NO: 108772 - protein, 9 aa, Artificial Sequence
  Description of Artificial Sequence: Synthetic peptide
  Seed: FLSKLSSII (MAGC3_HUMAN)
FISKLSSII

SEQ ID NO: 108773 - protein, 9 aa, Artificial Sequence
  Description of Artificial Sequence: Synthetic peptide
  Seed: LILSVIFIK (MAGC3_HUMAN)
LFLSVIFIK

SEQ ID NO: 108774 - protein, 9 aa, Artificial Sequence
  Description of Artificial Sequence: Synthetic peptide
  Seed: SEEEDTATW (MAGC3_HUMAN)
SLEEDTATF

SEQ ID NO: 108775 - protein, 9 aa, Artificial Sequence
  Description of Artificial Sequence: Synthetic peptide
  Seed: FADVLSRLA (MAGC3_HUMAN)
FMDVLSRLM

SEQ ID NO: 108776 - protein, 10 aa, Artificial Sequence
  Description of Artificial Sequence: Synthetic peptide
  Seed: SCSSPLLWTR (MAGC3_HUMAN)
SSSSPLLWTK

SEQ ID NO: 108777 - protein, 9 aa, Artificial Sequence
  Description of Artificial Sequence: Synthetic peptide
  Seed: TTDDATAMA (MAGC3_HUMAN)
TFDDATAMM

SEQ ID NO: 108778 - protein, 9 aa, Artificial Sequence
  Description of Artificial Sequence: Synthetic peptide
  Seed: HFYVFVNTL (MAGC3_HUMAN)
HYYVFVNTV

SEQ ID NO: 108779 - protein, 9 aa, Artificial Sequence
  Description of Artificial Sequence: Synthetic peptide
  Seed: AVSPGKRLW (MAGC3_HUMAN)
ALSPGKRLL

SEQ ID NO: 108780 - protein, 10 aa, Artificial Sequence
  Description of Artificial Sequence: Synthetic peptide
  Seed: KATDKDYSAF (MAGC3_HUMAN)
KATDKDYSAW

SEQ ID NO: 108781 - protein, 9 aa, Artificial Sequence
  Description of Artificial Sequence: Synthetic peptide
  Seed: ATYALSPVV (MAGC3_HUMAN)
ASYALSPVV

SEQ ID NO: 108782 - protein, 9 aa, Artificial Sequence
  Description of Artificial Sequence: Synthetic peptide
  Seed: HLREVRLFL (MAGC3_HUMAN)
HMREVRLFV

SEQ ID NO: 108783 - protein, 9 aa, Artificial Sequence
  Description of Artificial Sequence: Synthetic peptide
  Seed: MQMNVINTY (MAGC3_HUMAN)
MKMNVINTM

SEQ ID NO: 108784 - protein, 9 aa, Artificial Sequence
  Description of Artificial Sequence: Synthetic peptide
  Seed: HFYVFVNTL (MAGC3_HUMAN)
HHYVFVNTI

SEQ ID NO: 108785 - protein, 10 aa, Artificial Sequence
  Description of Artificial Sequence: Synthetic peptide
  Seed: SIIPSAFPSW (MAGC3_HUMAN)
SPIPSAFPSW

SEQ ID NO: 108786 - protein, 10 aa, Artificial Sequence
  Description of Artificial Sequence: Synthetic peptide
  Seed: RPAREVLEFL (MAGC3_HUMAN)
RWAREVLEFK

SEQ ID NO: 108787 - protein, 9 aa, Artificial Sequence
  Description of Artificial Sequence: Synthetic peptide
  Seed: FSDGSLGQW (MAGC3_HUMAN)
FNDGSLGQV

SEQ ID NO: 108788 - protein, 9 aa, Artificial Sequence
  Description of Artificial Sequence: Synthetic peptide
  Seed: ILILSVIFI (MAGC3_HUMAN)
IMILSVIFV

SEQ ID NO: 108789 - protein, 10 aa, Artificial Sequence
  Description of Artificial Sequence: Synthetic peptide
  Seed: TLDEKVDKLV (MAGC3_HUMAN)
TFDEKVDKLM

SEQ ID NO: 108790 - protein, 9 aa, Artificial Sequence
  Description of Artificial Sequence: Synthetic peptide
  Seed: SQPEGKFSL (MAGC3_HUMAN)
SEPEGKFSA

SEQ ID NO: 108791 - protein, 9 aa, Artificial Sequence
  Description of Artificial Sequence: Synthetic peptide
  Seed: MLLPCHWVL (MAGC3_HUMAN)
MSLPCHWVW

SEQ ID NO: 108792 - protein, 11 aa, Artificial Sequence
  Description of Artificial Sequence: Synthetic peptide
  Seed: LSLPAVSPGKR (MAGC3_HUMAN)
LVLPAVSPGKR

SEQ ID NO: 108793 - protein, 9 aa, Artificial Sequence
  Description of Artificial Sequence: Synthetic peptide
  Seed: MPAAGMPPL (MAGC3_HUMAN)
MHAAGMPPF

SEQ ID NO: 108794 - protein, 9 aa, Artificial Sequence
  Description of Artificial Sequence: Synthetic peptide
  Seed: LANPQGLAG (MAGC3_HUMAN)
LSNPQGLAL

SEQ ID NO: 108795 - protein, 9 aa, Artificial Sequence
  Description of Artificial Sequence: Synthetic peptide
  Seed: VDPDHFYVF (MAGC3_HUMAN)
VGPDHFYVM

SEQ ID NO: 108796 - protein, 9 aa, Artificial Sequence
  Description of Artificial Sequence: Synthetic peptide
  Seed: TTDDATAMA (MAGC3_HUMAN)
TNDDATAMM

SEQ ID NO: 108797 - protein, 9 aa, Artificial Sequence
  Description of Artificial Sequence: Synthetic peptide
  Seed: KVAELVQFL (MAGC3_HUMAN)
KAAELVQFF

SEQ ID NO: 108798 - protein, 10 aa, Artificial Sequence
  Description of Artificial Sequence: Synthetic peptide
  Seed: LDLANPQGLA (MAGC3_HUMAN)
LFLANPQGLV

SEQ ID NO: 108799 - protein, 11 aa, Artificial Sequence
  Description of Artificial Sequence: Synthetic peptide
  Seed: SIIPSAFPSWY (MAGC3_HUMAN)
SMIPSAFPSWY

SEQ ID NO: 108800 - protein, 10 aa, Artificial Sequence
  Description of Artificial Sequence: Synthetic peptide
  Seed: GPPQSPPQSP (MAGC3_HUMAN)
GPPQSPPQSF

SEQ ID NO: 108801 - protein, 9 aa, Artificial Sequence
  Description of Artificial Sequence: Synthetic peptide
  Seed: SEEEDTATW (MAGC3_HUMAN)
SMEEDTATY

SEQ ID NO: 108802 - protein, 9 aa, Artificial Sequence
  Description of Artificial Sequence: Synthetic peptide
  Seed: TEASPQQKK (MAGC3_HUMAN)
TAASPQQKV

SEQ ID NO: 108803 - protein, 9 aa, Artificial Sequence
  Description of Artificial Sequence: Synthetic peptide
  Seed: AVSPGKRLW (MAGC3_HUMAN)
AMSPGKRLW

SEQ ID NO: 108804 - protein, 9 aa, Artificial Sequence
  Description of Artificial Sequence: Synthetic peptide
  Seed: MPAAGMPPL (MAGC3_HUMAN)
MVAAGMPPM

SEQ ID NO: 108805 - protein, 11 aa, Artificial Sequence
  Description of Artificial Sequence: Synthetic peptide
  Seed: LDSCSSPLLWT (MAGC3_HUMAN)
LASCSSPLLWF

SEQ ID NO: 108806 - protein, 10 aa, Artificial Sequence
  Description of Artificial Sequence: Synthetic peptide
  Seed: VLDLANPQGL (MAGC3_HUMAN)
VMDLANPQGV

SEQ ID NO: 108807 - protein, 10 aa, Artificial Sequence
  Description of Artificial Sequence: Synthetic peptide
  Seed: KDYFPMIFGK (MAGC3_HUMAN)
KLYFPMIFGR

SEQ ID NO: 108808 - protein, 11 aa, Artificial Sequence
  Description of Artificial Sequence: Synthetic peptide
  Seed: YTGYFPMIFRK (MAGC3_HUMAN)
YSGYFPMIFRR

SEQ ID NO: 108809 - protein, 9 aa, Artificial Sequence
  Description of Artificial Sequence: Synthetic peptide
  Seed: ALDEKVAEL (MAGC3_HUMAN)
AHDEKVAEM

SEQ ID NO: 108810 - protein, 10 aa, Artificial Sequence
  Description of Artificial Sequence: Synthetic peptide
  Seed: SQPEGKFSLR (MAGC3_HUMAN)
SIPEGKFSLY

SEQ ID NO: 108811 - protein, 11 aa, Artificial Sequence
  Description of Artificial Sequence: Synthetic peptide
  Seed: MQMNVINTYTG (MAGC3_HUMAN)
MQMNVINTYTI

SEQ ID NO: 108812 - protein, 10 aa, Artificial Sequence
  Description of Artificial Sequence: Synthetic peptide
  Seed: KVAELVQFLL (MAGC3_HUMAN)
KTAELVQFLI

SEQ ID NO: 108813 - protein, 9 aa, Artificial Sequence
  Description of Artificial Sequence: Synthetic peptide
  Seed: MQMNVINTY (MAGC3_HUMAN)
MLMNVINTA

SEQ ID NO: 108814 - protein, 10 aa, Artificial Sequence
  Description of Artificial Sequence: Synthetic peptide
  Seed: TCATYALSPV (MAGC3_HUMAN)
TNATYALSPV

SEQ ID NO: 108815 - protein, 10 aa, Artificial Sequence
  Description of Artificial Sequence: Synthetic peptide
  Seed: LWKDSDLPTW (MAGC3_HUMAN)
LSKDSDLPTW

SEQ ID NO: 108816 - protein, 10 aa, Artificial Sequence
  Description of Artificial Sequence: Synthetic peptide
  Seed: GEDEDMPAAG (MAGC3_HUMAN)
GEDEDMPAAL

SEQ ID NO: 108817 - protein, 9 aa, Artificial Sequence
  Description of Artificial Sequence: Synthetic peptide
  Seed: GSLPESEPL (MAGC3_HUMAN)
GSLPESEPW

SEQ ID NO: 108818 - protein, 10 aa, Artificial Sequence
  Description of Artificial Sequence: Synthetic peptide
  Seed: ILILSMIFIK (MAGC3_HUMAN)
IHILSMIFIR

SEQ ID NO: 108819 - protein, 9 aa, Artificial Sequence
  Description of Artificial Sequence: Synthetic peptide
  Seed: KVDKLVQFL (MAGC3_HUMAN)
KMDKLVQFL

SEQ ID NO: 108820 - protein, 8 aa, Artificial Sequence
  Description of Artificial Sequence: Synthetic peptide
  Seed: FYVFVNTL (MAGC3_HUMAN)
FYVFVNTF

SEQ ID NO: 108821 - protein, 9 aa, Artificial Sequence
  Description of Artificial Sequence: Synthetic peptide
  Seed: ASEEVIWEV (MAGC3_HUMAN)
ASEEVIWEW

SEQ ID NO: 108822 - protein, 10 aa, Artificial Sequence
  Description of Artificial Sequence: Synthetic peptide
  Seed: IKKYKDYFPM (MAGC3_HUMAN)
IMKYKDYFPF

SEQ ID NO: 108823 - protein, 9 aa, Artificial Sequence
  Description of Artificial Sequence: Synthetic peptide
  Seed: HFYVFVNTL (MAGC3_HUMAN)
HTYVFVNTL

SEQ ID NO: 108824 - protein, 9 aa, Artificial Sequence
  Description of Artificial Sequence: Synthetic peptide
  Seed: YSAFHLGHL (MAGC3_HUMAN)
YTAFHLGHM

SEQ ID NO: 108825 - protein, 9 aa, Artificial Sequence
  Description of Artificial Sequence: Synthetic peptide
  Seed: ALDEKVAEL (MAGC3_HUMAN)
AGDEKVAEI

SEQ ID NO: 108826 - protein, 9 aa, Artificial Sequence
  Description of Artificial Sequence: Synthetic peptide
  Seed: NTYTGYFPM (MAGC3_HUMAN)
NFYTGYFPR

SEQ ID NO: 108827 - protein, 9 aa, Artificial Sequence
  Description of Artificial Sequence: Synthetic peptide
  Seed: KDMEDRAQA (MAGC3_HUMAN)
KEMEDRAQT

SEQ ID NO: 108828 - protein, 8 aa, Artificial Sequence
  Description of Artificial Sequence: Synthetic peptide
  Seed: TTDDATAM (MAGC3_HUMAN)
TSDDATAV

SEQ ID NO: 108829 - protein, 10 aa, Artificial Sequence
  Description of Artificial Sequence: Synthetic peptide
  Seed: ATYALSPVVL (MAGC3_HUMAN)
AVYALSPVVW

SEQ ID NO: 108830 - protein, 10 aa, Artificial Sequence
  Description of Artificial Sequence: Synthetic peptide
  Seed: EEVIWEVLSA (MAGC3_HUMAN)
ETVIWEVLSI

SEQ ID NO: 108831 - protein, 10 aa, Artificial Sequence
  Description of Artificial Sequence: Synthetic peptide
  Seed: VLSAIGPIQR (MAGC3_HUMAN)
VTSAIGPIQK

SEQ ID NO: 108832 - protein, 9 aa, Artificial Sequence
  Description of Artificial Sequence: Synthetic peptide
  Seed: IPPQGPPKI (MAGC3_HUMAN)
ITPQGPPKL

SEQ ID NO: 108833 - protein, 9 aa, Artificial Sequence
  Description of Artificial Sequence: Synthetic peptide
  Seed: EFIELIFGI (MAGC3_HUMAN)
ETIELIFGC

SEQ ID NO: 108834 - protein, 10 aa, Artificial Sequence
  Description of Artificial Sequence: Synthetic peptide
  Seed: SAFHLGHLRE (MAGC3_HUMAN)
STFHLGHLRC

SEQ ID NO: 108835 - protein, 9 aa, Artificial Sequence
  Description of Artificial Sequence: Synthetic peptide
  Seed: NAIGPWSAL (MAGC3_HUMAN)
NVIGPWSAF

SEQ ID NO: 108836 - protein, 10 aa, Artificial Sequence
  Description of Artificial Sequence: Synthetic peptide
  Seed: AFPSWYMDAL (MAGC3_HUMAN)
AWPSWYMDAY

SEQ ID NO: 108837 - protein, 10 aa, Artificial Sequence
  Description of Artificial Sequence: Synthetic peptide
  Seed: IPSAFPSWYM (MAGC3_HUMAN)
IPSAFPSWYF

SEQ ID NO: 108838 - protein, 9 aa, Artificial Sequence
  Description of Artificial Sequence: Synthetic peptide
  Seed: YSAFHLGHL (MAGC3_HUMAN)
YIAFHLGHV

SEQ ID NO: 108839 - protein, 9 aa, Artificial Sequence
  Description of Artificial Sequence: Synthetic peptide
  Seed: MQMNVINTY (MAGC3_HUMAN)
MGMNVINTY

SEQ ID NO: 108840 - protein, 10 aa, Artificial Sequence
  Description of Artificial Sequence: Synthetic peptide
  Seed: MIFRKAREFI (MAGC3_HUMAN)
MFFRKAREFK

SEQ ID NO: 108841 - protein, 10 aa, Artificial Sequence
  Description of Artificial Sequence: Synthetic peptide
  Seed: ALDEKVAELV (MAGC3_HUMAN)
ASDEKVAELL

SEQ ID NO: 108842 - protein, 9 aa, Artificial Sequence
  Description of Artificial Sequence: Synthetic peptide
  Seed: FADVLSRLA (MAGC3_HUMAN)
FQDVLSRLL

SEQ ID NO: 108843 - protein, 10 aa, Artificial Sequence
  Description of Artificial Sequence: Synthetic peptide
  Seed: EVIWEVLSAI (MAGC3_HUMAN)
ETIWEVLSAR

SEQ ID NO: 108844 - protein, 9 aa, Artificial Sequence
  Description of Artificial Sequence: Synthetic peptide
  Seed: SASPSVMST (MAGC3_HUMAN)
SISPSVMSL

SEQ ID NO: 108845 - protein, 9 aa, Artificial Sequence
  Description of Artificial Sequence: Synthetic peptide
  Seed: YSAFHLGHL (MAGC3_HUMAN)
YHAFHLGHY

SEQ ID NO: 108846 - protein, 10 aa, Artificial Sequence
  Description of Artificial Sequence: Synthetic peptide
  Seed: AFPSWYMDAL (MAGC3_HUMAN)
AFPSWYMDAW

SEQ ID NO: 108847 - protein, 9 aa, Artificial Sequence
  Description of Artificial Sequence: Synthetic peptide
  Seed: IFGKAHEFI (MAGC3_HUMAN)
IMGKAHEFF

SEQ ID NO: 108848 - protein, 10 aa, Artificial Sequence
  Description of Artificial Sequence: Synthetic peptide
  Seed: KLSSIIPSAF (MAGC3_HUMAN)
KYSSIIPSAW

SEQ ID NO: 108849 - protein, 9 aa, Artificial Sequence
  Description of Artificial Sequence: Synthetic peptide
  Seed: ATYALSPVV (MAGC3_HUMAN)
ATYALSPVF

SEQ ID NO: 108850 - protein, 9 aa, Artificial Sequence
  Description of Artificial Sequence: Synthetic peptide
  Seed: KLVQFLLLK (MAGC3_HUMAN)
KIVQFLLLY

SEQ ID NO: 108851 - protein, 10 aa, Artificial Sequence
  Description of Artificial Sequence: Synthetic peptide
  Seed: TLSGSPGLQL (MAGC3_HUMAN)
TISGSPGLQY

SEQ ID NO: 108852 - protein, 9 aa, Artificial Sequence
  Description of Artificial Sequence: Synthetic peptide
  Seed: VLCPTYFKL (MAGC3_HUMAN)
VTCPTYFKW

SEQ ID NO: 108853 - protein, 9 aa, Artificial Sequence
  Description of Artificial Sequence: Synthetic peptide
  Seed: VDPDHFYVF (MAGC3_HUMAN)
VIPDHFYVI

SEQ ID NO: 108854 - protein, 9 aa, Artificial Sequence
  Description of Artificial Sequence: Synthetic peptide
  Seed: ATDKDYSAF (MAGC3_HUMAN)
ATDKDYSAL

SEQ ID NO: 108855 - protein, 9 aa, Artificial Sequence
  Description of Artificial Sequence: Synthetic peptide
  Seed: EDMPAAGMP (MAGC3_HUMAN)
EEMPAAGMA

SEQ ID NO: 108856 - protein, 10 aa, Artificial Sequence
  Description of Artificial Sequence: Synthetic peptide
  Seed: IIDTTDDATA (MAGC3_HUMAN)
IMDTTDDATL

SEQ ID NO: 108857 - protein, 9 aa, Artificial Sequence
  Description of Artificial Sequence: Synthetic peptide
  Seed: LVLCPTYFK (MAGC3_HUMAN)
LALCPTYFR

SEQ ID NO: 108858 - protein, 10 aa, Artificial Sequence
  Description of Artificial Sequence: Synthetic peptide
  Seed: FSDGSLGQWV (MAGC3_HUMAN)
FIDGSLGQWF

SEQ ID NO: 108859 - protein, 9 aa, Artificial Sequence
  Description of Artificial Sequence: Synthetic peptide
  Seed: DMDPDNHSY (MAGC3_HUMAN)
DPDPDNHSF

SEQ ID NO: 108860 - protein, 9 aa, Artificial Sequence
  Description of Artificial Sequence: Synthetic peptide
  Seed: HLREVRLFL (MAGC3_HUMAN)
HSREVRLFR

SEQ ID NO: 108861 - protein, 9 aa, Artificial Sequence
  Description of Artificial Sequence: Synthetic peptide
  Seed: NTYTGYFPM (MAGC3_HUMAN)
NYYTGYFPI

SEQ ID NO: 108862 - protein, 9 aa, Artificial Sequence
  Description of Artificial Sequence: Synthetic peptide
  Seed: KVDKLVQFL (MAGC3_HUMAN)
KGDKLVQFI

SEQ ID NO: 108863 - protein, 10 aa, Artificial Sequence
  Description of Artificial Sequence: Synthetic peptide
  Seed: IPSAFPSWYM (MAGC3_HUMAN)
IASAFPSWYF

SEQ ID NO: 108864 - protein, 11 aa, Artificial Sequence
  Description of Artificial Sequence: Synthetic peptide
  Seed: MQMNVINTYTG (MAGC3_HUMAN)
MQMNVINTYTF

SEQ ID NO: 108865 - protein, 9 aa, Artificial Sequence
  Description of Artificial Sequence: Synthetic peptide
  Seed: ASEEVIWEV (MAGC3_HUMAN)
AQEEVIWEF

SEQ ID NO: 108866 - protein, 9 aa, Artificial Sequence
  Description of Artificial Sequence: Synthetic peptide
  Seed: KAHEFIELI (MAGC3_HUMAN)
KAHEFIELY

SEQ ID NO: 108867 - protein, 9 aa, Artificial Sequence
  Description of Artificial Sequence: Synthetic peptide
  Seed: FKLWRTLSG (MAGC3_HUMAN)
FVLWRTLSY

SEQ ID NO: 108868 - protein, 10 aa, Artificial Sequence
  Description of Artificial Sequence: Synthetic peptide
  Seed: KDYFPMIFGK (MAGC3_HUMAN)
KVYFPMIFGR

SEQ ID NO: 108869 - protein, 11 aa, Artificial Sequence
  Description of Artificial Sequence: Synthetic peptide
  Seed: KVAELVQFLLL (MAGC3_HUMAN)
KAAELVQFLLF

SEQ ID NO: 108870 - protein, 9 aa, Artificial Sequence
  Description of Artificial Sequence: Synthetic peptide
  Seed: MLLPCHWVL (MAGC3_HUMAN)
MHLPCHWVI

SEQ ID NO: 108871 - protein, 10 aa, Artificial Sequence
  Description of Artificial Sequence: Synthetic peptide
  Seed: IPSAFPSWYM (MAGC3_HUMAN)
IPSAFPSWYY

SEQ ID NO: 108872 - protein, 9 aa, Artificial Sequence
  Description of Artificial Sequence: Synthetic peptide
  Seed: AMASASPSV (MAGC3_HUMAN)
AIASASPSV

SEQ ID NO: 108873 - protein, 11 aa, Artificial Sequence
  Description of Artificial Sequence: Synthetic peptide
  Seed: SSIIPSAFPSW (MAGC3_HUMAN)
STIIPSAFPSW

SEQ ID NO: 108874 - protein, 9 aa, Artificial Sequence
  Description of Artificial Sequence: Synthetic peptide
  Seed: GFADVLSRL (MAGC3_HUMAN)
GMADVLSRT

SEQ ID NO: 108875 - protein, 10 aa, Artificial Sequence
  Description of Artificial Sequence: Synthetic peptide
  Seed: REVRLFLRGG (MAGC3_HUMAN)
RAVRLFLRGI

SEQ ID NO: 108876 - protein, 9 aa, Artificial Sequence
  Description of Artificial Sequence: Synthetic peptide
  Seed: RTLSGSPGL (MAGC3_HUMAN)
RSLSGSPGF

SEQ ID NO: 108877 - protein, 9 aa, Artificial Sequence
  Description of Artificial Sequence: Synthetic peptide
  Seed: SLRRAVSVK (MAGC3_HUMAN)
SARRAVSVK

SEQ ID NO: 108878 - protein, 9 aa, Artificial Sequence
  Description of Artificial Sequence: Synthetic peptide
  Seed: MPPLPQSPP (MAGC3_HUMAN)
MPPLPQSPA

SEQ ID NO: 108879 - protein, 10 aa, Artificial Sequence
  Description of Artificial Sequence: Synthetic peptide
  Seed: MPQNRLLILI (MAGC3_HUMAN)
MPQNRLLILW

SEQ ID NO: 108880 - protein, 9 aa, Artificial Sequence
  Description of Artificial Sequence: Synthetic peptide
  Seed: RGTGYTLSL (MAGC3_HUMAN)
RSTGYTLSW

SEQ ID NO: 108881 - protein, 10 aa, Artificial Sequence
  Description of Artificial Sequence: Synthetic peptide
  Seed: SLVLCPTYFK (MAGC3_HUMAN)
SKVLCPTYFK

SEQ ID NO: 108882 - protein, 9 aa, Artificial Sequence
  Description of Artificial Sequence: Synthetic peptide
  Seed: VLCPTYFKL (MAGC3_HUMAN)
VICPTYFKR

SEQ ID NO: 108883 - protein, 9 aa, Artificial Sequence
  Description of Artificial Sequence: Synthetic peptide
  Seed: ALSPVVLPP (MAGC3_HUMAN)
ATSPVVLPI

SEQ ID NO: 108884 - protein, 10 aa, Artificial Sequence
  Description of Artificial Sequence: Synthetic peptide
  Seed: RPAREVLEFL (MAGC3_HUMAN)
RNAREVLEFK

SEQ ID NO: 108885 - protein, 8 aa, Artificial Sequence
  Description of Artificial Sequence: Synthetic peptide
  Seed: VLSRLALW (MAGC3_HUMAN)
VTSRLALW

SEQ ID NO: 108886 - protein, 9 aa, Artificial Sequence
  Description of Artificial Sequence: Synthetic peptide
  Seed: TEVDPDHFY (MAGC3_HUMAN)
TFVDPDHFY

SEQ ID NO: 108887 - protein, 9 aa, Artificial Sequence
  Description of Artificial Sequence: Synthetic peptide
  Seed: VDPDHFYVF (MAGC3_HUMAN)
VVPDHFYVM

SEQ ID NO: 108888 - protein, 9 aa, Artificial Sequence
  Description of Artificial Sequence: Synthetic peptide
  Seed: EVDPDHFYV (MAGC3_HUMAN)
ETDPDHFYV

SEQ ID NO: 108889 - protein, 11 aa, Artificial Sequence
  Description of Artificial Sequence: Synthetic peptide
  Seed: SAFPSWYMDAL (MAGC3_HUMAN)
SPFPSWYMDAL

SEQ ID NO: 108890 - protein, 9 aa, Artificial Sequence
  Description of Artificial Sequence: Synthetic peptide
  Seed: FKLWRTLSG (MAGC3_HUMAN)
FKLWRTLSI

SEQ ID NO: 108891 - protein, 9 aa, Artificial Sequence
  Description of Artificial Sequence: Synthetic peptide
  Seed: LWGEKAGSL (MAGC3_HUMAN)
LYGEKAGSL

SEQ ID NO: 108892 - protein, 9 aa, Artificial Sequence
  Description of Artificial Sequence: Synthetic peptide
  Seed: ALAGFADVL (MAGC3_HUMAN)
AIAGFADVL

SEQ ID NO: 108893 - protein, 9 aa, Artificial Sequence
  Description of Artificial Sequence: Synthetic peptide
  Seed: LKYQAKEPL (MAGC3_HUMAN)
LQYQAKEPM

SEQ ID NO: 108894 - protein, 9 aa, Artificial Sequence
  Description of Artificial Sequence: Synthetic peptide
  Seed: DYFPMIFGK (MAGC3_HUMAN)
DIFPMIFGK

SEQ ID NO: 108895 - protein, 10 aa, Artificial Sequence
  Description of Artificial Sequence: Synthetic peptide
  Seed: LNAIGPWSAL (MAGC3_HUMAN)
LPAIGPWSAL

SEQ ID NO: 108896 - protein, 9 aa, Artificial Sequence
  Description of Artificial Sequence: Synthetic peptide
  Seed: ATDKDYSAF (MAGC3_HUMAN)
ALDKDYSAI

SEQ ID NO: 108897 - protein, 9 aa, Artificial Sequence
  Description of Artificial Sequence: Synthetic peptide
  Seed: ATDKDYSAF (MAGC3_HUMAN)
AMDKDYSAF

SEQ ID NO: 108898 - protein, 10 aa, Artificial Sequence
  Description of Artificial Sequence: Synthetic peptide
  Seed: NHSYFFEDTL (MAGC3_HUMAN)
NHSYFFEDTF

SEQ ID NO: 108899 - protein, 9 aa, Artificial Sequence
  Description of Artificial Sequence: Synthetic peptide
  Seed: MLLPCHWVL (MAGC3_HUMAN)
MLLPCHWVK

SEQ ID NO: 108900 - protein, 9 aa, Artificial Sequence
  Description of Artificial Sequence: Synthetic peptide
  Seed: SAEGSVLDL (MAGC3_HUMAN)
SVEGSVLDL

SEQ ID NO: 108901 - protein, 10 aa, Artificial Sequence
  Description of Artificial Sequence: Synthetic peptide
  Seed: CATYALSPVV (MAGC3_HUMAN)
CMTYALSPVV

SEQ ID NO: 108902 - protein, 9 aa, Artificial Sequence
  Description of Artificial Sequence: Synthetic peptide
  Seed: RGTGYTLSL (MAGC3_HUMAN)
RMTGYTLSL

SEQ ID NO: 108903 - protein, 9 aa, Artificial Sequence
  Description of Artificial Sequence: Synthetic peptide
  Seed: WRRGTGYTL (MAGC3_HUMAN)
WKRGTGYTF

SEQ ID NO: 108904 - protein, 11 aa, Artificial Sequence
  Description of Artificial Sequence: Synthetic peptide
  Seed: EEEDTATWHAL (MAGC3_HUMAN)
EEEDTATWHAW

SEQ ID NO: 108905 - protein, 10 aa, Artificial Sequence
  Description of Artificial Sequence: Synthetic peptide
  Seed: FPSWYMDALK (MAGC3_HUMAN)
FISWYMDALR

SEQ ID NO: 108906 - protein, 9 aa, Artificial Sequence
  Description of Artificial Sequence: Synthetic peptide
  Seed: MIFRKAREF (MAGC3_HUMAN)
MVFRKAREL

SEQ ID NO: 108907 - protein, 9 aa, Artificial Sequence
  Description of Artificial Sequence: Synthetic peptide
  Seed: SASPSVMST (MAGC3_HUMAN)
SPSPSVMSI

SEQ ID NO: 108908 - protein, 9 aa, Artificial Sequence
  Description of Artificial Sequence: Synthetic peptide
  Seed: YQTKEPVTK (MAGC3_HUMAN)
YSTKEPVTL

SEQ ID NO: 108909 - protein, 10 aa, Artificial Sequence
  Description of Artificial Sequence: Synthetic peptide
  Seed: LNAIGPWSAL (MAGC3_HUMAN)
LNAIGPWSAM

SEQ ID NO: 108910 - protein, 10 aa, Artificial Sequence
  Description of Artificial Sequence: Synthetic peptide
  Seed: MQMNVINTYT (MAGC3_HUMAN)
MVMNVINTYL

SEQ ID NO: 108911 - protein, 10 aa, Artificial Sequence
  Description of Artificial Sequence: Synthetic peptide
  Seed: PTYFKLWRTL (MAGC3_HUMAN)
PYYFKLWRTI

SEQ ID NO: 108912 - protein, 11 aa, Artificial Sequence
  Description of Artificial Sequence: Synthetic peptide
  Seed: IPPQGPPKISP (MAGC3_HUMAN)
IPPQGPPKISA

SEQ ID NO: 108913 - protein, 9 aa, Artificial Sequence
  Description of Artificial Sequence: Synthetic peptide
  Seed: RPAREVLEF (MAGC3_HUMAN)
RVAREVLEW

SEQ ID NO: 108914 - protein, 9 aa, Artificial Sequence
  Description of Artificial Sequence: Synthetic peptide
  Seed: VDPDHFYVF (MAGC3_HUMAN)
VNPDHFYVL

SEQ ID NO: 108915 - protein, 9 aa, Artificial Sequence
  Description of Artificial Sequence: Synthetic peptide
  Seed: HSYFFEDTL (MAGC3_HUMAN)
HLYFFEDTI

SEQ ID NO: 108916 - protein, 11 aa, Artificial Sequence
  Description of Artificial Sequence: Synthetic peptide
  Seed: ATFSDGSLGQW (MAGC3_HUMAN)
AVFSDGSLGQK

SEQ ID NO: 108917 - protein, 10 aa, Artificial Sequence
  Description of Artificial Sequence: Synthetic peptide
  Seed: EVIWEVLNAI (MAGC3_HUMAN)
EIIWEVLNAR

SEQ ID NO: 108918 - protein, 9 aa, Artificial Sequence
  Description of Artificial Sequence: Synthetic peptide
  Seed: IELIFGIAL (MAGC3_HUMAN)
IMLIFGIAF

SEQ ID NO: 108919 - protein, 9 aa, Artificial Sequence
  Description of Artificial Sequence: Synthetic peptide
  Seed: KAHEFIELI (MAGC3_HUMAN)
KHHEFIELY

SEQ ID NO: 108920 - protein, 11 aa, Artificial Sequence
  Description of Artificial Sequence: Synthetic peptide
  Seed: RTLSGSPGLQL (MAGC3_HUMAN)
RRLSGSPGLQF

SEQ ID NO: 108921 - protein, 10 aa, Artificial Sequence
  Description of Artificial Sequence: Synthetic peptide
  Seed: ADVLSRLALW (MAGC3_HUMAN)
AEVLSRLALF

SEQ ID NO: 108922 - protein, 9 aa, Artificial Sequence
  Description of Artificial Sequence: Synthetic peptide
  Seed: DMDPDNHSY (MAGC3_HUMAN)
DFDPDNHSM

SEQ ID NO: 108923 - protein, 11 aa, Artificial Sequence
  Description of Artificial Sequence: Synthetic peptide
  Seed: ATFSDGSLGQW (MAGC3_HUMAN)
AIFSDGSLGQF

SEQ ID NO: 108924 - protein, 9 aa, Artificial Sequence
  Description of Artificial Sequence: Synthetic peptide
  Seed: LSSIIPSAF (MAGC3_HUMAN)
LSSIIPSAY

SEQ ID NO: 108925 - protein, 9 aa, Artificial Sequence
  Description of Artificial Sequence: Synthetic peptide
  Seed: WRRGTGYTL (MAGC3_HUMAN)
WWRGTGYTF

SEQ ID NO: 108926 - protein, 9 aa, Artificial Sequence
  Description of Artificial Sequence: Synthetic peptide
  Seed: KVAELVQFL (MAGC3_HUMAN)
KRAELVQFF

SEQ ID NO: 108927 - protein, 10 aa, Artificial Sequence
  Description of Artificial Sequence: Synthetic peptide
  Seed: KDYFPMIFGK (MAGC3_HUMAN)
KTYFPMIFGR

SEQ ID NO: 108928 - protein, 9 aa, Artificial Sequence
  Description of Artificial Sequence: Synthetic peptide
  Seed: WVKNTCATY (MAGC3_HUMAN)
WYKNTCATL

SEQ ID NO: 108929 - protein, 9 aa, Artificial Sequence
  Description of Artificial Sequence: Synthetic peptide
  Seed: MIFRKAREF (MAGC3_HUMAN)
MRFRKAREV

SEQ ID NO: 108930 - protein, 11 aa, Artificial Sequence
  Description of Artificial Sequence: Synthetic peptide
  Seed: TSDQRMDSLVL (MAGC3_HUMAN)
TYDQRMDSLVY

SEQ ID NO: 108931 - protein, 9 aa, Artificial Sequence
  Description of Artificial Sequence: Synthetic peptide
  Seed: YKDYFPMIF (MAGC3_HUMAN)
YMDYFPMIL

SEQ ID NO: 108932 - protein, 9 aa, Artificial Sequence
  Description of Artificial Sequence: Synthetic peptide
  Seed: IQRPAREVL (MAGC3_HUMAN)
IFRPAREVL

SEQ ID NO: 108933 - protein, 10 aa, Artificial Sequence
  Description of Artificial Sequence: Synthetic peptide
  Seed: NTYTGYFPMI (MAGC3_HUMAN)
NFYTGYFPMW

SEQ ID NO: 108934 - protein, 10 aa, Artificial Sequence
  Description of Artificial Sequence: Synthetic peptide
  Seed: KVDKLVQFLL (MAGC3_HUMAN)
KLDKLVQFLV

SEQ ID NO: 108935 - protein, 10 aa, Artificial Sequence
  Description of Artificial Sequence: Synthetic peptide
  Seed: REVRLFLRGG (MAGC3_HUMAN)
RAVRLFLRGK

SEQ ID NO: 108936 - protein, 9 aa, Artificial Sequence
  Description of Artificial Sequence: Synthetic peptide
  Seed: RRAVSVKQR (MAGC3_HUMAN)
RRAVSVKQF

SEQ ID NO: 108937 - protein, 10 aa, Artificial Sequence
  Description of Artificial Sequence: Synthetic peptide
  Seed: LPTWRRGTGY (MAGC3_HUMAN)
LSTWRRGTGF

SEQ ID NO: 108938 - protein, 9 aa, Artificial Sequence
  Description of Artificial Sequence: Synthetic peptide
  Seed: ALDEKVAEL (MAGC3_HUMAN)
ADDEKVAEI

SEQ ID NO: 108939 - protein, 11 aa, Artificial Sequence
  Description of Artificial Sequence: Synthetic peptide
  Seed: LDSCSSPLLWT (MAGC3_HUMAN)
LSSCSSPLLWL

SEQ ID NO: 108940 - protein, 10 aa, Artificial Sequence
  Description of Artificial Sequence: Synthetic peptide
  Seed: MQMNVINTYT (MAGC3_HUMAN)
MRMNVINTYM

SEQ ID NO: 108941 - protein, 9 aa, Artificial Sequence
  Description of Artificial Sequence: Synthetic peptide
  Seed: TYTGYFPMI (MAGC3_HUMAN)
TYTGYFPMV

SEQ ID NO: 108942 - protein, 10 aa, Artificial Sequence
  Description of Artificial Sequence: Synthetic peptide
  Seed: SAIGPIQRPA (MAGC3_HUMAN)
SSIGPIQRPY

SEQ ID NO: 108943 - protein, 9 aa, Artificial Sequence
  Description of Artificial Sequence: Synthetic peptide
  Seed: SPQGPPQSP (MAGC3_HUMAN)
SHQGPPQSV

SEQ ID NO: 108944 - protein, 10 aa, Artificial Sequence
  Description of Artificial Sequence: Synthetic peptide
  Seed: IELIFGIALT (MAGC3_HUMAN)
ISLIFGIALI

SEQ ID NO: 108945 - protein, 10 aa, Artificial Sequence
  Description of Artificial Sequence: Synthetic peptide
  Seed: IKKYKDYFPM (MAGC3_HUMAN)
IMKYKDYFPY

SEQ ID NO: 108946 - protein, 9 aa, Artificial Sequence
  Description of Artificial Sequence: Synthetic peptide
  Seed: LLILILSMI (MAGC3_HUMAN)
LMILILSML

SEQ ID NO: 108947 - protein, 10 aa, Artificial Sequence
  Description of Artificial Sequence: Synthetic peptide
  Seed: VLNAIGPWSA (MAGC3_HUMAN)
VVNAIGPWSV

SEQ ID NO: 108948 - protein, 8 aa, Artificial Sequence
  Description of Artificial Sequence: Synthetic peptide
  Seed: MEDRAQAI (MAGC3_HUMAN)
MNDRAQAL

SEQ ID NO: 108949 - protein, 9 aa, Artificial Sequence
  Description of Artificial Sequence: Synthetic peptide
  Seed: YQTKEPVTK (MAGC3_HUMAN)
YTTKEPVTF

SEQ ID NO: 108950 - protein, 9 aa, Artificial Sequence
  Description of Artificial Sequence: Synthetic peptide
  Seed: TYALSPVVL (MAGC3_HUMAN)
TFALSPVVF

SEQ ID NO: 108951 - protein, 9 aa, Artificial Sequence
  Description of Artificial Sequence: Synthetic peptide
  Seed: SESLPRYAL (MAGC3_HUMAN)
SDSLPRYAM

SEQ ID NO: 108952 - protein, 9 aa, Artificial Sequence
  Description of Artificial Sequence: Synthetic peptide
  Seed: TYALSPVVL (MAGC3_HUMAN)
TYALSPVVM

SEQ ID NO: 108953 - protein, 9 aa, Artificial Sequence
  Description of Artificial Sequence: Synthetic peptide
  Seed: FLSKLSSII (MAGC3_HUMAN)
FRSKLSSIY

SEQ ID NO: 108954 - protein, 11 aa, Artificial Sequence
  Description of Artificial Sequence: Synthetic peptide
  Seed: MLLPCHWVLDA (MAGC3_HUMAN)
MMLPCHWVLDL

SEQ ID NO: 108955 - protein, 9 aa, Artificial Sequence
  Description of Artificial Sequence: Synthetic peptide
  Seed: ALDEKVAEL (MAGC3_HUMAN)
AFDEKVAEI

SEQ ID NO: 108956 - protein, 9 aa, Artificial Sequence
  Description of Artificial Sequence: Synthetic peptide
  Seed: KVDKLVQFL (MAGC3_HUMAN)
KMDKLVQFV

SEQ ID NO: 108957 - protein, 9 aa, Artificial Sequence
  Description of Artificial Sequence: Synthetic peptide
  Seed: EMLTTVIKK (MAGC3_HUMAN)
ELLTTVIKK

SEQ ID NO: 108958 - protein, 9 aa, Artificial Sequence
  Description of Artificial Sequence: Synthetic peptide
  Seed: VIWEVLSAI (MAGC3_HUMAN)
VVWEVLSAL

SEQ ID NO: 108959 - protein, 8 aa, Artificial Sequence
  Description of Artificial Sequence: Synthetic peptide
  Seed: TTDDATAM (MAGC3_HUMAN)
TLDDATAV

SEQ ID NO: 108960 - protein, 9 aa, Artificial Sequence
  Description of Artificial Sequence: Synthetic peptide
  Seed: ELIFGIALT (MAGC3_HUMAN)
ESIFGIALT

SEQ ID NO: 108961 - protein, 10 aa, Artificial Sequence
  Description of Artificial Sequence: Synthetic peptide
  Seed: MQMNVINTYT (MAGC3_HUMAN)
MMMNVINTYE

SEQ ID NO: 108962 - protein, 9 aa, Artificial Sequence
  Description of Artificial Sequence: Synthetic peptide
  Seed: RTLSGSPGL (MAGC3_HUMAN)
RQLSGSPGM

SEQ ID NO: 108963 - protein, 9 aa, Artificial Sequence
  Description of Artificial Sequence: Synthetic peptide
  Seed: TTDDATAMA (MAGC3_HUMAN)
TQDDATAMI

SEQ ID NO: 108964 - protein, 8 aa, Artificial Sequence
  Description of Artificial Sequence: Synthetic peptide
  Seed: TTDDATAM (MAGC3_HUMAN)
TLDDATAL

SEQ ID NO: 108965 - protein, 9 aa, Artificial Sequence
  Description of Artificial Sequence: Synthetic peptide
  Seed: TYTGYFPMI (MAGC3_HUMAN)
TFTGYFPMM

SEQ ID NO: 108966 - protein, 11 aa, Artificial Sequence
  Description of Artificial Sequence: Synthetic peptide
  Seed: KVAELVQFLLL (MAGC3_HUMAN)
KMAELVQFLLW

SEQ ID NO: 108967 - protein, 10 aa, Artificial Sequence
  Description of Artificial Sequence: Synthetic peptide
  Seed: SLIDDQGMPK (MAGC3_HUMAN)
STIDDQGMPR

SEQ ID NO: 108968 - protein, 9 aa, Artificial Sequence
  Description of Artificial Sequence: Synthetic peptide
  Seed: LKYQAKEPL (MAGC3_HUMAN)
LEYQAKEPF

SEQ ID NO: 108969 - protein, 9 aa, Artificial Sequence
  Description of Artificial Sequence: Synthetic peptide
  Seed: KLSSIIPSA (MAGC3_HUMAN)
KISSIIPSR

SEQ ID NO: 108970 - protein, 9 aa, Artificial Sequence
  Description of Artificial Sequence: Synthetic peptide
  Seed: MLLPCHWVL (MAGC3_HUMAN)
MPLPCHWVL

SEQ ID NO: 108971 - protein, 10 aa, Artificial Sequence
  Description of Artificial Sequence: Synthetic peptide
  Seed: MDPDNHSYFF (MAGC3_HUMAN)
MDPDNHSYFW

SEQ ID NO: 108972 - protein, 9 aa, Artificial Sequence
  Description of Artificial Sequence: Synthetic peptide
  Seed: TTDDATAMA (MAGC3_HUMAN)
TIDDATAMV

SEQ ID NO: 108973 - protein, 11 aa, Artificial Sequence
  Description of Artificial Sequence: Synthetic peptide
  Seed: FIKGNCASEEV (MAGC3_HUMAN)
FLKGNCASEEI

SEQ ID NO: 108974 - protein, 9 aa, Artificial Sequence
  Description of Artificial Sequence: Synthetic peptide
  Seed: VLCPTYFKL (MAGC3_HUMAN)
VFCPTYFKM

SEQ ID NO: 108975 - protein, 10 aa, Artificial Sequence
  Description of Artificial Sequence: Synthetic peptide
  Seed: LNAIGPWSAL (MAGC3_HUMAN)
LYAIGPWSAM

SEQ ID NO: 108976 - protein, 9 aa, Artificial Sequence
  Description of Artificial Sequence: Synthetic peptide
  Seed: TLDEKVDKL (MAGC3_HUMAN)
TMDEKVDKI

SEQ ID NO: 108977 - protein, 10 aa, Artificial Sequence
  Description of Artificial Sequence: Synthetic peptide
  Seed: YTLDEKVDKL (MAGC3_HUMAN)
YMLDEKVDKV

SEQ ID NO: 108978 - protein, 10 aa, Artificial Sequence
  Description of Artificial Sequence: Synthetic peptide
  Seed: MNVINTYTGY (MAGC3_HUMAN)
MHVINTYTGR

SEQ ID NO: 108979 - protein, 9 aa, Artificial Sequence
  Description of Artificial Sequence: Synthetic peptide
  Seed: MQMNVINTY (MAGC3_HUMAN)
MEMNVINTA

SEQ ID NO: 108980 - protein, 9 aa, Artificial Sequence
  Description of Artificial Sequence: Synthetic peptide
  Seed: KAHEFIELI (MAGC3_HUMAN)
KDHEFIELV

SEQ ID NO: 108981 - protein, 10 aa, Artificial Sequence
  Description of Artificial Sequence: Synthetic peptide
  Seed: YALDEKVAEL (MAGC3_HUMAN)
YGLDEKVAEV

SEQ ID NO: 108982 - protein, 11 aa, Artificial Sequence
  Description of Artificial Sequence: Synthetic peptide
  Seed: MQMNVINTYTG (MAGC3_HUMAN)
MLMNVINTYTF

SEQ ID NO: 108983 - protein, 9 aa, Artificial Sequence
  Description of Artificial Sequence: Synthetic peptide
  Seed: FPMIFRKAR (MAGC3_HUMAN)
FNMIFRKAR

SEQ ID NO: 108984 - protein, 10 aa, Artificial Sequence
  Description of Artificial Sequence: Synthetic peptide
  Seed: LSLPAVSPGK (MAGC3_HUMAN)
LMLPAVSPGR

SEQ ID NO: 108985 - protein, 9 aa, Artificial Sequence
  Description of Artificial Sequence: Synthetic peptide
  Seed: SALAGFADV (MAGC3_HUMAN)
STLAGFADI

SEQ ID NO: 108986 - protein, 10 aa, Artificial Sequence
  Description of Artificial Sequence: Synthetic peptide
  Seed: MIFRKAREFI (MAGC3_HUMAN)
MMFRKAREFI

SEQ ID NO: 108987 - protein, 10 aa, Artificial Sequence
  Description of Artificial Sequence: Synthetic peptide
  Seed: LNAIGPWSAL (MAGC3_HUMAN)
LVAIGPWSAF

SEQ ID NO: 108988 - protein, 9 aa, Artificial Sequence
  Description of Artificial Sequence: Synthetic peptide
  Seed: GPWSALAGF (MAGC3_HUMAN)
GMWSALAGF

SEQ ID NO: 108989 - protein, 9 aa, Artificial Sequence
  Description of Artificial Sequence: Synthetic peptide
  Seed: TEASPQQKK (MAGC3_HUMAN)
TTASPQQKR

SEQ ID NO: 108990 - protein, 10 aa, Artificial Sequence
  Description of Artificial Sequence: Synthetic peptide
  Seed: MDPDNHSYFF (MAGC3_HUMAN)
MGPDNHSYFM

SEQ ID NO: 108991 - protein, 9 aa, Artificial Sequence
  Description of Artificial Sequence: Synthetic peptide
  Seed: VINTYTGYF (MAGC3_HUMAN)
VKNTYTGYF

SEQ ID NO: 108992 - protein, 11 aa, Artificial Sequence
  Description of Artificial Sequence: Synthetic peptide
  Seed: SSSEEEDTATW (MAGC3_HUMAN)
SMSEEEDTATW

SEQ ID NO: 108993 - protein, 10 aa, Artificial Sequence
  Description of Artificial Sequence: Synthetic peptide
  Seed: LWKDSDLPTW (MAGC3_HUMAN)
LYKDSDLPTW

SEQ ID NO: 108994 - protein, 10 aa, Artificial Sequence
  Description of Artificial Sequence: Synthetic peptide
  Seed: QWVKNTCATY (MAGC3_HUMAN)
QTVKNTCATY

SEQ ID NO: 108995 - protein, 10 aa, Artificial Sequence
  Description of Artificial Sequence: Synthetic peptide
  Seed: YTLDEKVDKL (MAGC3_HUMAN)
YNLDEKVDKV

SEQ ID NO: 108996 - protein, 10 aa, Artificial Sequence
  Description of Artificial Sequence: Synthetic peptide
  Seed: KLVQFLLLKY (MAGC3_HUMAN)
KGVQFLLLKY

SEQ ID NO: 108997 - protein, 10 aa, Artificial Sequence
  Description of Artificial Sequence: Synthetic peptide
  Seed: KVAELVQFLL (MAGC3_HUMAN)
KKAELVQFLW

SEQ ID NO: 108998 - protein, 10 aa, Artificial Sequence
  Description of Artificial Sequence: Synthetic peptide
  Seed: EVLSAIGPIQ (MAGC3_HUMAN)
ESLSAIGPIR

SEQ ID NO: 108999 - protein, 10 aa, Artificial Sequence
  Description of Artificial Sequence: Synthetic peptide
  Seed: SDQRMDSLVL (MAGC3_HUMAN)
SNQRMDSLVM

SEQ ID NO: 109000 - protein, 9 aa, Artificial Sequence
  Description of Artificial Sequence: Synthetic peptide
  Seed: DTTDDATAM (MAGC3_HUMAN)
DVTDDATAF

SEQ ID NO: 109001 - protein, 9 aa, Artificial Sequence
  Description of Artificial Sequence: Synthetic peptide
  Seed: DMDPDNHSY (MAGC3_HUMAN)
DIDPDNHSY

SEQ ID NO: 109002 - protein, 9 aa, Artificial Sequence
  Description of Artificial Sequence: Synthetic peptide
  Seed: MIFGKAHEF (MAGC3_HUMAN)
MCFGKAHEY

SEQ ID NO: 109003 - protein, 10 aa, Artificial Sequence
  Description of Artificial Sequence: Synthetic peptide
  Seed: GSLPESEPLF (MAGC3_HUMAN)
GQLPESEPLF

SEQ ID NO: 109004 - protein, 9 aa, Artificial Sequence
  Description of Artificial Sequence: Synthetic peptide
  Seed: ASEEVIWEV (MAGC3_HUMAN)
AFEEVIWEV

SEQ ID NO: 109005 - protein, 9 aa, Artificial Sequence
  Description of Artificial Sequence: Synthetic peptide
  Seed: MEDRAQAII (MAGC3_HUMAN)
MFDRAQAIM

SEQ ID NO: 109006 - protein, 10 aa, Artificial Sequence
  Description of Artificial Sequence: Synthetic peptide
  Seed: IPSAFPSWYM (MAGC3_HUMAN)
IDSAFPSWYF

SEQ ID NO: 109007 - protein, 9 aa, Artificial Sequence
  Description of Artificial Sequence: Synthetic peptide
  Seed: FPMIFRKAR (MAGC3_HUMAN)
FPMIFRKAI

SEQ ID NO: 109008 - protein, 11 aa, Artificial Sequence
  Description of Artificial Sequence: Synthetic peptide
  Seed: VLDATFSDGSL (MAGC3_HUMAN)
VTDATFSDGSL

SEQ ID NO: 109009 - protein, 10 aa, Artificial Sequence
  Description of Artificial Sequence: Synthetic peptide
  Seed: DMPAAGMPPL (MAGC3_HUMAN)
DRPAAGMPPL

SEQ ID NO: 109010 - protein, 9 aa, Artificial Sequence
  Description of Artificial Sequence: Synthetic peptide
  Seed: EVDPDHFYV (MAGC3_HUMAN)
EWDPDHFYL

SEQ ID NO: 109011 - protein, 9 aa, Artificial Sequence
  Description of Artificial Sequence: Synthetic peptide
  Seed: ISPQGPPQS (MAGC3_HUMAN)
IIPQGPPQM

SEQ ID NO: 109012 - protein, 9 aa, Artificial Sequence
  Description of Artificial Sequence: Synthetic peptide
  Seed: YQAKEPLTR (MAGC3_HUMAN)
YMAKEPLTK

SEQ ID NO: 109013 - protein, 9 aa, Artificial Sequence
  Description of Artificial Sequence: Synthetic peptide
  Seed: MQMNVINTY (MAGC3_HUMAN)
MAMNVINTA

SEQ ID NO: 109014 - protein, 9 aa, Artificial Sequence
  Description of Artificial Sequence: Synthetic peptide
  Seed: KGSCVPEEV (MAGC3_HUMAN)
KTSCVPEEV

SEQ ID NO: 109015 - protein, 10 aa, Artificial Sequence
  Description of Artificial Sequence: Synthetic peptide
  Seed: LILILSVIFI (MAGC3_HUMAN)
LWLILSVIFV

SEQ ID NO: 109016 - protein, 9 aa, Artificial Sequence
  Description of Artificial Sequence: Synthetic peptide
  Seed: ATYALSPVV (MAGC3_HUMAN)
AQYALSPVV

SEQ ID NO: 109017 - protein, 9 aa, Artificial Sequence
  Description of Artificial Sequence: Synthetic peptide
  Seed: LSDEQGMPQ (MAGC3_HUMAN)
LCDEQGMPV

SEQ ID NO: 109018 - protein, 10 aa, Artificial Sequence
  Description of Artificial Sequence: Synthetic peptide
  Seed: SLIDDQGMPK (MAGC3_HUMAN)
SSIDDQGMPR

SEQ ID NO: 109019 - protein, 9 aa, Artificial Sequence
  Description of Artificial Sequence: Synthetic peptide
  Seed: EIPPQGPPK (MAGC3_HUMAN)
EYPPQGPPR

SEQ ID NO: 109020 - protein, 9 aa, Artificial Sequence
  Description of Artificial Sequence: Synthetic peptide
  Seed: IIPSAFPSW (MAGC3_HUMAN)
IPPSAFPSF

SEQ ID NO: 109021 - protein, 9 aa, Artificial Sequence
  Description of Artificial Sequence: Synthetic peptide
  Seed: ALDEKVAEL (MAGC3_HUMAN)
AWDEKVAEV

SEQ ID NO: 109022 - protein, 9 aa, Artificial Sequence
  Description of Artificial Sequence: Synthetic peptide
  Seed: CATYALSPV (MAGC3_HUMAN)
CLTYALSPV

SEQ ID NO: 109023 - protein, 9 aa, Artificial Sequence
  Description of Artificial Sequence: Synthetic peptide
  Seed: TTDDATAMA (MAGC3_HUMAN)
TTDDATAML

SEQ ID NO: 109024 - protein, 9 aa, Artificial Sequence
  Description of Artificial Sequence: Synthetic peptide
  Seed: FHLGHLREV (MAGC3_HUMAN)
FFLGHLREF

SEQ ID NO: 109025 - protein, 9 aa, Artificial Sequence
  Description of Artificial Sequence: Synthetic peptide
  Seed: SASPSVMST (MAGC3_HUMAN)
SRSPSVMSL

SEQ ID NO: 109026 - protein, 9 aa, Artificial Sequence
  Description of Artificial Sequence: Synthetic peptide
  Seed: TSDQRMDSL (MAGC3_HUMAN)
TIDQRMDSV

SEQ ID NO: 109027 - protein, 10 aa, Artificial Sequence
  Description of Artificial Sequence: Synthetic peptide
  Seed: LLKYQAKEPL (MAGC3_HUMAN)
LVKYQAKEPF

SEQ ID NO: 109028 - protein, 9 aa, Artificial Sequence
  Description of Artificial Sequence: Synthetic peptide
  Seed: NTYTGYFPM (MAGC3_HUMAN)
NKYTGYFPM

SEQ ID NO: 109029 - protein, 8 aa, Artificial Sequence
  Description of Artificial Sequence: Synthetic peptide
  Seed: AEMQMNVI (MAGC3_HUMAN)
AQMQMNVI

SEQ ID NO: 109030 - protein, 9 aa, Artificial Sequence
  Description of Artificial Sequence: Synthetic peptide
  Seed: DMDPDNHSY (MAGC3_HUMAN)
DWDPDNHSV

SEQ ID NO: 109031 - protein, 9 aa, Artificial Sequence
  Description of Artificial Sequence: Synthetic peptide
  Seed: FPMIFGKAH (MAGC3_HUMAN)
FTMIFGKAY

SEQ ID NO: 109032 - protein, 10 aa, Artificial Sequence
  Description of Artificial Sequence: Synthetic peptide
  Seed: VLDLANPQGL (MAGC3_HUMAN)
VVDLANPQGF

SEQ ID NO: 109033 - protein, 9 aa, Artificial Sequence
  Description of Artificial Sequence: Synthetic peptide
  Seed: KAHEFIELI (MAGC3_HUMAN)
KNHEFIELL

SEQ ID NO: 109034 - protein, 10 aa, Artificial Sequence
  Description of Artificial Sequence: Synthetic peptide
  Seed: CASEEVIWEV (MAGC3_HUMAN)
CLSEEVIWEL

SEQ ID NO: 109035 - protein, 10 aa, Artificial Sequence
  Description of Artificial Sequence: Synthetic peptide
  Seed: LLKYQAKEPL (MAGC3_HUMAN)
LMKYQAKEPY

SEQ ID NO: 109036 - protein, 9 aa, Artificial Sequence
  Description of Artificial Sequence: Synthetic peptide
  Seed: SLVLCPTYF (MAGC3_HUMAN)
SQVLCPTYM

SEQ ID NO: 109037 - protein, 10 aa, Artificial Sequence
  Description of Artificial Sequence: Synthetic peptide
  Seed: EVIWEVLNAI (MAGC3_HUMAN)
EAIWEVLNAY

SEQ ID NO: 109038 - protein, 9 aa, Artificial Sequence
  Description of Artificial Sequence: Synthetic peptide
  Seed: ALDEKVAEL (MAGC3_HUMAN)
ARDEKVAEI

SEQ ID NO: 109039 - protein, 9 aa, Artificial Sequence
  Description of Artificial Sequence: Synthetic peptide
  Seed: IQRPAREVL (MAGC3_HUMAN)
IPRPAREVV

SEQ ID NO: 109040 - protein, 9 aa, Artificial Sequence
  Description of Artificial Sequence: Synthetic peptide
  Seed: YSAFHLGHL (MAGC3_HUMAN)
YWAFHLGHL

SEQ ID NO: 109041 - protein, 10 aa, Artificial Sequence
  Description of Artificial Sequence: Synthetic peptide
  Seed: YTLDEKVDKL (MAGC3_HUMAN)
YELDEKVDKV

SEQ ID NO: 109042 - protein, 10 aa, Artificial Sequence
  Description of Artificial Sequence: Synthetic peptide
  Seed: SDQRMDSLVL (MAGC3_HUMAN)
SFQRMDSLVL

SEQ ID NO: 109043 - protein, 10 aa, Artificial Sequence
  Description of Artificial Sequence: Synthetic peptide
  Seed: YALDEKVAEL (MAGC3_HUMAN)
YELDEKVAET

SEQ ID NO: 109044 - protein, 9 aa, Artificial Sequence
  Description of Artificial Sequence: Synthetic peptide
  Seed: AVSPGKRLW (MAGC3_HUMAN)
AMSPGKRLF

SEQ ID NO: 109045 - protein, 10 aa, Artificial Sequence
  Description of Artificial Sequence: Synthetic peptide
  Seed: EVLSAIGPIQ (MAGC3_HUMAN)
EVLSAIGPIK

SEQ ID NO: 109046 - protein, 10 aa, Artificial Sequence
  Description of Artificial Sequence: Synthetic peptide
  Seed: YFPMIFGKAH (MAGC3_HUMAN)
YFPMIFGKAF

SEQ ID NO: 109047 - protein, 10 aa, Artificial Sequence
  Description of Artificial Sequence: Synthetic peptide
  Seed: TYTGYFPMIF (MAGC3_HUMAN)
TFTGYFPMIF

SEQ ID NO: 109048 - protein, 10 aa, Artificial Sequence
  Description of Artificial Sequence: Synthetic peptide
  Seed: FKLWRTLSGS (MAGC3_HUMAN)
FTLWRTLSGM

SEQ ID NO: 109049 - protein, 10 aa, Artificial Sequence
  Description of Artificial Sequence: Synthetic peptide
  Seed: MIFGKAHEFI (MAGC3_HUMAN)
MSFGKAHEFV

SEQ ID NO: 109050 - protein, 9 aa, Artificial Sequence
  Description of Artificial Sequence: Synthetic peptide
  Seed: RPAREVLEF (MAGC3_HUMAN)
RIAREVLEY

SEQ ID NO: 109051 - protein, 11 aa, Artificial Sequence
  Description of Artificial Sequence: Synthetic peptide
  Seed: SSIIPSAFPSW (MAGC3_HUMAN)
SAIIPSAFPSW

SEQ ID NO: 109052 - protein, 9 aa, Artificial Sequence
  Description of Artificial Sequence: Synthetic peptide
  Seed: HALPESESL (MAGC3_HUMAN)
HILPESESM

SEQ ID NO: 109053 - protein, 10 aa, Artificial Sequence
  Description of Artificial Sequence: Synthetic peptide
  Seed: YALDEKVAEL (MAGC3_HUMAN)
YELDEKVAEV

SEQ ID NO: 109054 - protein, 9 aa, Artificial Sequence
  Description of Artificial Sequence: Synthetic peptide
  Seed: IIDTTDDAT (MAGC3_HUMAN)
ISDTTDDAI

SEQ ID NO: 109055 - protein, 10 aa, Artificial Sequence
  Description of Artificial Sequence: Synthetic peptide
  Seed: YTGYFPMIFR (MAGC3_HUMAN)
YNGYFPMIFR

SEQ ID NO: 109056 - protein, 9 aa, Artificial Sequence
  Description of Artificial Sequence: Synthetic peptide
  Seed: LTEASPQQK (MAGC3_HUMAN)
LAEASPQQM

SEQ ID NO: 109057 - protein, 9 aa, Artificial Sequence
  Description of Artificial Sequence: Synthetic peptide
  Seed: TYALSPVVL (MAGC3_HUMAN)
TWALSPVVM

SEQ ID NO: 109058 - protein, 10 aa, Artificial Sequence
  Description of Artificial Sequence: Synthetic peptide
  Seed: YALSPVVLPP (MAGC3_HUMAN)
YGLSPVVLPM

SEQ ID NO: 109059 - protein, 10 aa, Artificial Sequence
  Description of Artificial Sequence: Synthetic peptide
  Seed: MQMNVINTYT (MAGC3_HUMAN)
MIMNVINTYI

SEQ ID NO: 109060 - protein, 9 aa, Artificial Sequence
  Description of Artificial Sequence: Synthetic peptide
  Seed: TLDEKVDKL (MAGC3_HUMAN)
TSDEKVDKF

SEQ ID NO: 109061 - protein, 9 aa, Artificial Sequence
  Description of Artificial Sequence: Synthetic peptide
  Seed: LILSMIFIK (MAGC3_HUMAN)
LYLSMIFIR

SEQ ID NO: 109062 - protein, 9 aa, Artificial Sequence
  Description of Artificial Sequence: Synthetic peptide
  Seed: VPEEVIWEV (MAGC3_HUMAN)
VLEEVIWEM

SEQ ID NO: 109063 - protein, 9 aa, Artificial Sequence
  Description of Artificial Sequence: Synthetic peptide
  Seed: ELIFGIALT (MAGC3_HUMAN)
ETIFGIALL

SEQ ID NO: 109064 - protein, 10 aa, Artificial Sequence
  Description of Artificial Sequence: Synthetic peptide
  Seed: EVIWEVLSAI (MAGC3_HUMAN)
ESIWEVLSAY

SEQ ID NO: 109065 - protein, 10 aa, Artificial Sequence
  Description of Artificial Sequence: Synthetic peptide
  Seed: VLDLANPQGL (MAGC3_HUMAN)
VVDLANPQGM

SEQ ID NO: 109066 - protein, 9 aa, Artificial Sequence
  Description of Artificial Sequence: Synthetic peptide
  Seed: LSSIIPSAF (MAGC3_HUMAN)
LLSIIPSAM

SEQ ID NO: 109067 - protein, 9 aa, Artificial Sequence
  Description of Artificial Sequence: Synthetic peptide
  Seed: MEDRAQAII (MAGC3_HUMAN)
MLDRAQAIV

SEQ ID NO: 109068 - protein, 10 aa, Artificial Sequence
  Description of Artificial Sequence: Synthetic peptide
  Seed: YALDEKVAEL (MAGC3_HUMAN)
YRLDEKVAEI

SEQ ID NO: 109069 - protein, 9 aa, Artificial Sequence
  Description of Artificial Sequence: Synthetic peptide
  Seed: ASEEVIWEV (MAGC3_HUMAN)
AQEEVIWEA

SEQ ID NO: 109070 - protein, 9 aa, Artificial Sequence
  Description of Artificial Sequence: Synthetic peptide
  Seed: REEPQDWPL (MAGC3_HUMAN)
REEPQDWPI

SEQ ID NO: 109071 - protein, 9 aa, Artificial Sequence
  Description of Artificial Sequence: Synthetic peptide
  Seed: GMPKNCLLI (MAGC3_HUMAN)
GVPKNCLLL

SEQ ID NO: 109072 - protein, 10 aa, Artificial Sequence
  Description of Artificial Sequence: Synthetic peptide
  Seed: REVLEFLSKL (MAGC3_HUMAN)
REVLEFLSKW

SEQ ID NO: 109073 - protein, 9 aa, Artificial Sequence
  Description of Artificial Sequence: Synthetic peptide
  Seed: SAEGSVLDL (MAGC3_HUMAN)
SIEGSVLDL

SEQ ID NO: 109074 - protein, 10 aa, Artificial Sequence
  Description of Artificial Sequence: Synthetic peptide
  Seed: SLIDDQGMPK (MAGC3_HUMAN)
SIIDDQGMPY

SEQ ID NO: 109075 - protein, 10 aa, Artificial Sequence
  Description of Artificial Sequence: Synthetic peptide
  Seed: SAIGPIQRPA (MAGC3_HUMAN)
SPIGPIQRPA

SEQ ID NO: 109076 - protein, 9 aa, Artificial Sequence
  Description of Artificial Sequence: Synthetic peptide
  Seed: FADVLSRLA (MAGC3_HUMAN)
FTDVLSRLM

SEQ ID NO: 109077 - protein, 9 aa, Artificial Sequence
  Description of Artificial Sequence: Synthetic peptide
  Seed: SASPSVMST (MAGC3_HUMAN)
SSSPSVMSH

SEQ ID NO: 109078 - protein, 10 aa, Artificial Sequence
  Description of Artificial Sequence: Synthetic peptide
  Seed: KDSDLPTWRR (MAGC3_HUMAN)
KYSDLPTWRR

SEQ ID NO: 109079 - protein, 9 aa, Artificial Sequence
  Description of Artificial Sequence: Synthetic peptide
  Seed: YKDYFPMIF (MAGC3_HUMAN)
YADYFPMII

SEQ ID NO: 109080 - protein, 9 aa, Artificial Sequence
  Description of Artificial Sequence: Synthetic peptide
  Seed: KVAELVQFL (MAGC3_HUMAN)
KMAELVQFV

SEQ ID NO: 109081 - protein, 11 aa, Artificial Sequence
  Description of Artificial Sequence: Synthetic peptide
  Seed: EILFGISLTEV (MAGC3_HUMAN)
EKLFGISLTEV

SEQ ID NO: 109082 - protein, 9 aa, Artificial Sequence
  Description of Artificial Sequence: Synthetic peptide
  Seed: TYFKLWRTL (MAGC3_HUMAN)
TYFKLWRTV

SEQ ID NO: 109083 - protein, 10 aa, Artificial Sequence
  Description of Artificial Sequence: Synthetic peptide
  Seed: IPSAFPSWYM (MAGC3_HUMAN)
ISSAFPSWYI

SEQ ID NO: 109084 - protein, 9 aa, Artificial Sequence
  Description of Artificial Sequence: Synthetic peptide
  Seed: NTYTGYFPM (MAGC3_HUMAN)
NIYTGYFPY

SEQ ID NO: 109085 - protein, 10 aa, Artificial Sequence
  Description of Artificial Sequence: Synthetic peptide
  Seed: KVAELVQFLL (MAGC3_HUMAN)
KMAELVQFLD

SEQ ID NO: 109086 - protein, 10 aa, Artificial Sequence
  Description of Artificial Sequence: Synthetic peptide
  Seed: SALAGFADVL (MAGC3_HUMAN)
SQLAGFADVV

SEQ ID NO: 109087 - protein, 9 aa, Artificial Sequence
  Description of Artificial Sequence: Synthetic peptide
  Seed: TRAEMQMNV (MAGC3_HUMAN)
TRAEMQMNY

SEQ ID NO: 109088 - protein, 10 aa, Artificial Sequence
  Description of Artificial Sequence: Synthetic peptide
  Seed: LILILSVIFI (MAGC3_HUMAN)
LPLILSVIFV

SEQ ID NO: 109089 - protein, 10 aa, Artificial Sequence
  Description of Artificial Sequence: Synthetic peptide
  Seed: MQMNVINTYT (MAGC3_HUMAN)
MRMNVINTYA

SEQ ID NO: 109090 - protein, 9 aa, Artificial Sequence
  Description of Artificial Sequence: Synthetic peptide
  Seed: MIFGKAHEF (MAGC3_HUMAN)
MYFGKAHEW

SEQ ID NO: 109091 - protein, 11 aa, Artificial Sequence
  Description of Artificial Sequence: Synthetic peptide
  Seed: LSKLSSIIPSA (MAGC3_HUMAN)
LHKLSSIIPSL

SEQ ID NO: 109092 - protein, 10 aa, Artificial Sequence
  Description of Artificial Sequence: Synthetic peptide
  Seed: MPAAGMPPLP (MAGC3_HUMAN)
MCAAGMPPLY

SEQ ID NO: 109093 - protein, 8 aa, Artificial Sequence
  Description of Artificial Sequence: Synthetic peptide
  Seed: ILILSMIF (MAGC3_HUMAN)
IMILSMIF

SEQ ID NO: 109094 - protein, 9 aa, Artificial Sequence
  Description of Artificial Sequence: Synthetic peptide
  Seed: EAFCEESGL (MAGC3_HUMAN)
EAFCEESGK

SEQ ID NO: 109095 - protein, 10 aa, Artificial Sequence
  Description of Artificial Sequence: Synthetic peptide
  Seed: FSDGSLGQWV (MAGC3_HUMAN)
FQDGSLGQWY

SEQ ID NO: 109096 - protein, 8 aa, Artificial Sequence
  Description of Artificial Sequence: Synthetic peptide
  Seed: IFGKAHEF (MAGC3_HUMAN)
IYGKAHEL

SEQ ID NO: 109097 - protein, 10 aa, Artificial Sequence
  Description of Artificial Sequence: Synthetic peptide
  Seed: SIIPSAFPSW (MAGC3_HUMAN)
SMIPSAFPSL

SEQ ID NO: 109098 - protein, 10 aa, Artificial Sequence
  Description of Artificial Sequence: Synthetic peptide
  Seed: YSAFHLGHLR (MAGC3_HUMAN)
YDAFHLGHLR

SEQ ID NO: 109099 - protein, 9 aa, Artificial Sequence
  Description of Artificial Sequence: Synthetic peptide
  Seed: YSAFHLGHL (MAGC3_HUMAN)
YVAFHLGHY

SEQ ID NO: 109100 - protein, 9 aa, Artificial Sequence
  Description of Artificial Sequence: Synthetic peptide
  Seed: YKDYFPMIF (MAGC3_HUMAN)
YWDYFPMIM

SEQ ID NO: 109101 - protein, 8 aa, Artificial Sequence
  Description of Artificial Sequence: Synthetic peptide
  Seed: TTDDATAM (MAGC3_HUMAN)
TFDDATAL

SEQ ID NO: 109102 - protein, 10 aa, Artificial Sequence
  Description of Artificial Sequence: Synthetic peptide
  Seed: YALDEKVAEL (MAGC3_HUMAN)
YLLDEKVAEI

SEQ ID NO: 109103 - protein, 9 aa, Artificial Sequence
  Description of Artificial Sequence: Synthetic peptide
  Seed: VDPDHFYVF (MAGC3_HUMAN)
VTPDHFYVV

SEQ ID NO: 109104 - protein, 9 aa, Artificial Sequence
  Description of Artificial Sequence: Synthetic peptide
  Seed: TTDDATAMA (MAGC3_HUMAN)
TPDDATAML

SEQ ID NO: 109105 - protein, 11 aa, Artificial Sequence
  Description of Artificial Sequence: Synthetic peptide
  Seed: SLPESEPLFTY (MAGC3_HUMAN)
SIPESEPLFTI

SEQ ID NO: 109106 - protein, 9 aa, Artificial Sequence
  Description of Artificial Sequence: Synthetic peptide
  Seed: KLVQFLLLK (MAGC3_HUMAN)
KVVQFLLLI

SEQ ID NO: 109107 - protein, 10 aa, Artificial Sequence
  Description of Artificial Sequence: Synthetic peptide
  Seed: LNAIGPWSAL (MAGC3_HUMAN)
LCAIGPWSAY

SEQ ID NO: 109108 - protein, 9 aa, Artificial Sequence
  Description of Artificial Sequence: Synthetic peptide
  Seed: ILILSMIFI (MAGC3_HUMAN)
IVILSMIFV

SEQ ID NO: 109109 - protein, 10 aa, Artificial Sequence
  Description of Artificial Sequence: Synthetic peptide
  Seed: LLKYQAKEPL (MAGC3_HUMAN)
LTKYQAKEPY

SEQ ID NO: 109110 - protein, 10 aa, Artificial Sequence
  Description of Artificial Sequence: Synthetic peptide
  Seed: MQMNVINTYT (MAGC3_HUMAN)
MMMNVINTYT

SEQ ID NO: 109111 - protein, 9 aa, Artificial Sequence
  Description of Artificial Sequence: Synthetic peptide
  Seed: MPKNCLLIL (MAGC3_HUMAN)
MQKNCLLIY

SEQ ID NO: 109112 - protein, 10 aa, Artificial Sequence
  Description of Artificial Sequence: Synthetic peptide
  Seed: FIELIFGIAL (MAGC3_HUMAN)
FRELIFGIAL

SEQ ID NO: 109113 - protein, 9 aa, Artificial Sequence
  Description of Artificial Sequence: Synthetic peptide
  Seed: KVAELVQFL (MAGC3_HUMAN)
KQAELVQFC

SEQ ID NO: 109114 - protein, 9 aa, Artificial Sequence
  Description of Artificial Sequence: Synthetic peptide
  Seed: LTEVDPDHF (MAGC3_HUMAN)
LTEVDPDHY

SEQ ID NO: 109115 - protein, 9 aa, Artificial Sequence
  Description of Artificial Sequence: Synthetic peptide
  Seed: TYALSPVVL (MAGC3_HUMAN)
TAALSPVVL

SEQ ID NO: 109116 - protein, 10 aa, Artificial Sequence
  Description of Artificial Sequence: Synthetic peptide
  Seed: VVLPPQPQPR (MAGC3_HUMAN)
VTLPPQPQPL

SEQ ID NO: 109117 - protein, 11 aa, Artificial Sequence
  Description of Artificial Sequence: Synthetic peptide
  Seed: SLPESEPLFTY (MAGC3_HUMAN)
SVPESEPLFTL

SEQ ID NO: 109118 - protein, 8 aa, Artificial Sequence
  Description of Artificial Sequence: Synthetic peptide
  Seed: IFGKAHEF (MAGC3_HUMAN)
ISGKAHEM

SEQ ID NO: 109119 - protein, 11 aa, Artificial Sequence
  Description of Artificial Sequence: Synthetic peptide
  Seed: FGSQPEGKFSL (MAGC3_HUMAN)
FASQPEGKFSM

SEQ ID NO: 109120 - protein, 10 aa, Artificial Sequence
  Description of Artificial Sequence: Synthetic peptide
  Seed: MNVINTYTGY (MAGC3_HUMAN)
MKVINTYTGK

SEQ ID NO: 109121 - protein, 11 aa, Artificial Sequence
  Description of Artificial Sequence: Synthetic peptide
  Seed: TSDQRMDSLVL (MAGC3_HUMAN)
TLDQRMDSLVF

SEQ ID NO: 109122 - protein, 9 aa, Artificial Sequence
  Description of Artificial Sequence: Synthetic peptide
  Seed: FSLRRAVSV (MAGC3_HUMAN)
FPLRRAVSV

SEQ ID NO: 109123 - protein, 9 aa, Artificial Sequence
  Description of Artificial Sequence: Synthetic peptide
  Seed: RGTGYTLSL (MAGC3_HUMAN)
RSTGYTLSI

SEQ ID NO: 109124 - protein, 11 aa, Artificial Sequence
  Description of Artificial Sequence: Synthetic peptide
  Seed: MLLPCHWVLDA (MAGC3_HUMAN)
MLLPCHWVLDV

SEQ ID NO: 109125 - protein, 9 aa, Artificial Sequence
  Description of Artificial Sequence: Synthetic peptide
  Seed: MQMNVINTY (MAGC3_HUMAN)
MDMNVINTM

SEQ ID NO: 109126 - protein, 10 aa, Artificial Sequence
  Description of Artificial Sequence: Synthetic peptide
  Seed: SLIDDQGMPK (MAGC3_HUMAN)
SAIDDQGMPL

SEQ ID NO: 109127 - protein, 10 aa, Artificial Sequence
  Description of Artificial Sequence: Synthetic peptide
  Seed: LWKDSDLPTW (MAGC3_HUMAN)
LMKDSDLPTW

SEQ ID NO: 109128 - protein, 10 aa, Artificial Sequence
  Description of Artificial Sequence: Synthetic peptide
  Seed: YQAKEPLTRA (MAGC3_HUMAN)
YMAKEPLTRA

SEQ ID NO: 109129 - protein, 10 aa, Artificial Sequence
  Description of Artificial Sequence: Synthetic peptide
  Seed: KVAELVQFLL (MAGC3_HUMAN)
KMAELVQFLN

SEQ ID NO: 109130 - protein, 9 aa, Artificial Sequence
  Description of Artificial Sequence: Synthetic peptide
  Seed: KNCLLILIL (MAGC3_HUMAN)
KQCLLILIV

SEQ ID NO: 109131 - protein, 10 aa, Artificial Sequence
  Description of Artificial Sequence: Synthetic peptide
  Seed: IKKYKDYFPM (MAGC3_HUMAN)
IPKYKDYFPY

SEQ ID NO: 109132 - protein, 10 aa, Artificial Sequence
  Description of Artificial Sequence: Synthetic peptide
  Seed: LLKYQAKEPL (MAGC3_HUMAN)
LEKYQAKEPF

SEQ ID NO: 109133 - protein, 9 aa, Artificial Sequence
  Description of Artificial Sequence: Synthetic peptide
  Seed: KVDKLVQFL (MAGC3_HUMAN)
KADKLVQFM

SEQ ID NO: 109134 - protein, 9 aa, Artificial Sequence
  Description of Artificial Sequence: Synthetic peptide
  Seed: QRMDSLVLC (MAGC3_HUMAN)
QHMDSLVLT

SEQ ID NO: 109135 - protein, 9 aa, Artificial Sequence
  Description of Artificial Sequence: Synthetic peptide
  Seed: KAHEFIELI (MAGC3_HUMAN)
KTHEFIELY

SEQ ID NO: 109136 - protein, 10 aa, Artificial Sequence
  Description of Artificial Sequence: Synthetic peptide
  Seed: KLSSIIPSAF (MAGC3_HUMAN)
KISSIIPSAF

SEQ ID NO: 109137 - protein, 9 aa, Artificial Sequence
  Description of Artificial Sequence: Synthetic peptide
  Seed: MIFIKGSCV (MAGC3_HUMAN)
MSFIKGSCM

SEQ ID NO: 109138 - protein, 9 aa, Artificial Sequence
  Description of Artificial Sequence: Synthetic peptide
  Seed: TTDDATAMA (MAGC3_HUMAN)
TVDDATAMV

SEQ ID NO: 109139 - protein, 9 aa, Artificial Sequence
  Description of Artificial Sequence: Synthetic peptide
  Seed: SAEGSVLDL (MAGC3_HUMAN)
SFEGSVLDF

SEQ ID NO: 109140 - protein, 9 aa, Artificial Sequence
  Description of Artificial Sequence: Synthetic peptide
  Seed: ALDEKVAEL (MAGC3_HUMAN)
AYDEKVAEA

SEQ ID NO: 109141 - protein, 11 aa, Artificial Sequence
  Description of Artificial Sequence: Synthetic peptide
  Seed: LSKLSSIIPSA (MAGC3_HUMAN)
LVKLSSIIPSL

SEQ ID NO: 109142 - protein, 11 aa, Artificial Sequence
  Description of Artificial Sequence: Synthetic peptide
  Seed: LTDMDPDNHSY (MAGC3_HUMAN)
LADMDPDNHSM

SEQ ID NO: 109143 - protein, 9 aa, Artificial Sequence
  Description of Artificial Sequence: Synthetic peptide
  Seed: KQREEPQDW (MAGC3_HUMAN)
KMREEPQDF

SEQ ID NO: 109144 - protein, 9 aa, Artificial Sequence
  Description of Artificial Sequence: Synthetic peptide
  Seed: VLPPQPQPR (MAGC3_HUMAN)
VVPPQPQPV

SEQ ID NO: 109145 - protein, 9 aa, Artificial Sequence
  Description of Artificial Sequence: Synthetic peptide
  Seed: RTLSGSPGL (MAGC3_HUMAN)
RALSGSPGF

SEQ ID NO: 109146 - protein, 9 aa, Artificial Sequence
  Description of Artificial Sequence: Synthetic peptide
  Seed: MLLPCHWVL (MAGC3_HUMAN)
MQLPCHWVL

SEQ ID NO: 109147 - protein, 9 aa, Artificial Sequence
  Description of Artificial Sequence: Synthetic peptide
  Seed: AMASASPSV (MAGC3_HUMAN)
AAASASPSI

SEQ ID NO: 109148 - protein, 9 aa, Artificial Sequence
  Description of Artificial Sequence: Synthetic peptide
  Seed: EKVDKLVQF (MAGC3_HUMAN)
EIVDKLVQY

SEQ ID NO: 109149 - protein, 9 aa, Artificial Sequence
  Description of Artificial Sequence: Synthetic peptide
  Seed: HFYVFVNTL (MAGC3_HUMAN)
HTYVFVNTM

SEQ ID NO: 109150 - protein, 11 aa, Artificial Sequence
  Description of Artificial Sequence: Synthetic peptide
  Seed: DSLVLCPTYFK (MAGC3_HUMAN)
DTLVLCPTYFR

SEQ ID NO: 109151 - protein, 10 aa, Artificial Sequence
  Description of Artificial Sequence: Synthetic peptide
  Seed: MIFRKAREFI (MAGC3_HUMAN)
MIFRKAREFK

SEQ ID NO: 109152 - protein, 9 aa, Artificial Sequence
  Description of Artificial Sequence: Synthetic peptide
  Seed: SALAGFADV (MAGC3_HUMAN)
SLLAGFADM

SEQ ID NO: 109153 - protein, 9 aa, Artificial Sequence
  Description of Artificial Sequence: Synthetic peptide
  Seed: KLSSIIPSA (MAGC3_HUMAN)
KVSSIIPST

SEQ ID NO: 109154 - protein, 10 aa, Artificial Sequence
  Description of Artificial Sequence: Synthetic peptide
  Seed: MDSLVLCPTY (MAGC3_HUMAN)
MMSLVLCPTW

SEQ ID NO: 109155 - protein, 9 aa, Artificial Sequence
  Description of Artificial Sequence: Synthetic peptide
  Seed: IELIFGIAL (MAGC3_HUMAN)
IALIFGIAY

SEQ ID NO: 109156 - protein, 10 aa, Artificial Sequence
  Description of Artificial Sequence: Synthetic peptide
  Seed: SDQRMDSLVL (MAGC3_HUMAN)
SLQRMDSLVL

SEQ ID NO: 109157 - protein, 9 aa, Artificial Sequence
  Description of Artificial Sequence: Synthetic peptide
  Seed: SDQRMDSLV (MAGC3_HUMAN)
SEQRMDSLF

SEQ ID NO: 109158 - protein, 9 aa, Artificial Sequence
  Description of Artificial Sequence: Synthetic peptide
  Seed: YKDYFPMIF (MAGC3_HUMAN)
YADYFPMIM

SEQ ID NO: 109159 - protein, 10 aa, Artificial Sequence
  Description of Artificial Sequence: Synthetic peptide
  Seed: RLWGEKAGSL (MAGC3_HUMAN)
RLWGEKAGSF

SEQ ID NO: 109160 - protein, 11 aa, Artificial Sequence
  Description of Artificial Sequence: Synthetic peptide
  Seed: AEMQMNVINTY (MAGC3_HUMAN)
AAMQMNVINTY

SEQ ID NO: 109161 - protein, 9 aa, Artificial Sequence
  Description of Artificial Sequence: Synthetic peptide
  Seed: MIFIKGSCV (MAGC3_HUMAN)
MSFIKGSCV

SEQ ID NO: 109162 - protein, 11 aa, Artificial Sequence
  Description of Artificial Sequence: Synthetic peptide
  Seed: ESLPRYALDEK (MAGC3_HUMAN)
ETLPRYALDEK

SEQ ID NO: 109163 - protein, 10 aa, Artificial Sequence
  Description of Artificial Sequence: Synthetic peptide
  Seed: KYKDYFPMIF (MAGC3_HUMAN)
KHKDYFPMIY

SEQ ID NO: 109164 - protein, 9 aa, Artificial Sequence
  Description of Artificial Sequence: Synthetic peptide
  Seed: GSLPESEPL (MAGC3_HUMAN)
GVLPESEPI

SEQ ID NO: 109165 - protein, 10 aa, Artificial Sequence
  Description of Artificial Sequence: Synthetic peptide
  Seed: YALSPVVLPP (MAGC3_HUMAN)
YRLSPVVLPI

SEQ ID NO: 109166 - protein, 9 aa, Artificial Sequence
  Description of Artificial Sequence: Synthetic peptide
  Seed: TSDQRMDSL (MAGC3_HUMAN)
TIDQRMDSI

SEQ ID NO: 109167 - protein, 9 aa, Artificial Sequence
  Description of Artificial Sequence: Synthetic peptide
  Seed: ATYALSPVV (MAGC3_HUMAN)
ALYALSPVM

SEQ ID NO: 109168 - protein, 9 aa, Artificial Sequence
  Description of Artificial Sequence: Synthetic peptide
  Seed: DMDPDNHSY (MAGC3_HUMAN)
DGDPDNHSL

SEQ ID NO: 109169 - protein, 10 aa, Artificial Sequence
  Description of Artificial Sequence: Synthetic peptide
  Seed: AFPSWYMDAL (MAGC3_HUMAN)
AYPSWYMDAL

SEQ ID NO: 109170 - protein, 9 aa, Artificial Sequence
  Description of Artificial Sequence: Synthetic peptide
  Seed: ELIFGIALT (MAGC3_HUMAN)
ESIFGIALL

SEQ ID NO: 109171 - protein, 9 aa, Artificial Sequence
  Description of Artificial Sequence: Synthetic peptide
  Seed: EAFCEESGL (MAGC3_HUMAN)
ESFCEESGR

SEQ ID NO: 109172 - protein, 10 aa, Artificial Sequence
  Description of Artificial Sequence: Synthetic peptide
  Seed: YTGYFPMIFR (MAGC3_HUMAN)
YMGYFPMIFR

SEQ ID NO: 109173 - protein, 10 aa, Artificial Sequence
  Description of Artificial Sequence: Synthetic peptide
  Seed: WEVLSAIGPI (MAGC3_HUMAN)
WMVLSAIGPL

SEQ ID NO: 109174 - protein, 9 aa, Artificial Sequence
  Description of Artificial Sequence: Synthetic peptide
  Seed: YFFEDTLDL (MAGC3_HUMAN)
YTFEDTLDV

SEQ ID NO: 109175 - protein, 10 aa, Artificial Sequence
  Description of Artificial Sequence: Synthetic peptide
  Seed: KVDKLVQFLL (MAGC3_HUMAN)
KMDKLVQFLM

SEQ ID NO: 109176 - protein, 9 aa, Artificial Sequence
  Description of Artificial Sequence: Synthetic peptide
  Seed: RPAREVLEF (MAGC3_HUMAN)
RSAREVLEF

SEQ ID NO: 109177 - protein, 10 aa, Artificial Sequence
  Description of Artificial Sequence: Synthetic peptide
  Seed: MNVINTYTGY (MAGC3_HUMAN)
MRVINTYTGY

SEQ ID NO: 109178 - protein, 9 aa, Artificial Sequence
  Description of Artificial Sequence: Synthetic peptide
  Seed: FSDGSLGQW (MAGC3_HUMAN)
FFDGSLGQF

SEQ ID NO: 109179 - protein, 9 aa, Artificial Sequence
  Description of Artificial Sequence: Synthetic peptide
  Seed: MPKNCLLIL (MAGC3_HUMAN)
MAKNCLLIM

SEQ ID NO: 109180 - protein, 11 aa, Artificial Sequence
  Description of Artificial Sequence: Synthetic peptide
  Seed: LTDMDPDNHSY (MAGC3_HUMAN)
LMDMDPDNHSL

SEQ ID NO: 109181 - protein, 10 aa, Artificial Sequence
  Description of Artificial Sequence: Synthetic peptide
  Seed: LIFGIALTDM (MAGC3_HUMAN)
LVFGIALTDV

SEQ ID NO: 109182 - protein, 10 aa, Artificial Sequence
  Description of Artificial Sequence: Synthetic peptide
  Seed: YALSPVVLPP (MAGC3_HUMAN)
YWLSPVVLPA

SEQ ID NO: 109183 - protein, 8 aa, Artificial Sequence
  Description of Artificial Sequence: Synthetic peptide
  Seed: LTYEGSLI (MAGC3_HUMAN)
LTYEGSLF

SEQ ID NO: 109184 - protein, 9 aa, Artificial Sequence
  Description of Artificial Sequence: Synthetic peptide
  Seed: YFFEDTLDL (MAGC3_HUMAN)
YIFEDTLDL

SEQ ID NO: 109185 - protein, 10 aa, Artificial Sequence
  Description of Artificial Sequence: Synthetic peptide
  Seed: SWYMDALKDM (MAGC3_HUMAN)
SLYMDALKDF

SEQ ID NO: 109186 - protein, 9 aa, Artificial Sequence
  Description of Artificial Sequence: Synthetic peptide
  Seed: SLPESEPLF (MAGC3_HUMAN)
SVPESEPLL

SEQ ID NO: 109187 - protein, 10 aa, Artificial Sequence
  Description of Artificial Sequence: Synthetic peptide
  Seed: MNVINTYTGY (MAGC3_HUMAN)
MKVINTYTGR

SEQ ID NO: 109188 - protein, 9 aa, Artificial Sequence
  Description of Artificial Sequence: Synthetic peptide
  Seed: MIFGKAHEF (MAGC3_HUMAN)
MAFGKAHEY

SEQ ID NO: 109189 - protein, 10 aa, Artificial Sequence
  Description of Artificial Sequence: Synthetic peptide
  Seed: TTDDATAMAS (MAGC3_HUMAN)
TCDDATAMAL

SEQ ID NO: 109190 - protein, 9 aa, Artificial Sequence
  Description of Artificial Sequence: Synthetic peptide
  Seed: FLSKLSSII (MAGC3_HUMAN)
FMSKLSSIT

SEQ ID NO: 109191 - protein, 9 aa, Artificial Sequence
  Description of Artificial Sequence: Synthetic peptide
  Seed: IIPSAFPSW (MAGC3_HUMAN)
IWPSAFPSL

SEQ ID NO: 109192 - protein, 9 aa, Artificial Sequence
  Description of Artificial Sequence: Synthetic peptide
  Seed: TYFKLWRTL (MAGC3_HUMAN)
TRFKLWRTY

SEQ ID NO: 109193 - protein, 9 aa, Artificial Sequence
  Description of Artificial Sequence: Synthetic peptide
  Seed: EAFCEESGL (MAGC3_HUMAN)
ETFCEESGL

SEQ ID NO: 109194 - protein, 10 aa, Artificial Sequence
  Description of Artificial Sequence: Synthetic peptide
  Seed: SCSSPLLWTR (MAGC3_HUMAN)
STSSPLLWTR

SEQ ID NO: 109195 - protein, 9 aa, Artificial Sequence
  Description of Artificial Sequence: Synthetic peptide
  Seed: YFFEDTLDL (MAGC3_HUMAN)
YMFEDTLDC

SEQ ID NO: 109196 - protein, 9 aa, Artificial Sequence
  Description of Artificial Sequence: Synthetic peptide
  Seed: MLTTVIKKY (MAGC3_HUMAN)
MWTTVIKKY

SEQ ID NO: 109197 - protein, 9 aa, Artificial Sequence
  Description of Artificial Sequence: Synthetic peptide
  Seed: HALPESESL (MAGC3_HUMAN)
HFLPESESF

SEQ ID NO: 109198 - protein, 10 aa, Artificial Sequence
  Description of Artificial Sequence: Synthetic peptide
  Seed: MQMNVINTYT (MAGC3_HUMAN)
MHMNVINTYA

SEQ ID NO: 109199 - protein, 10 aa, Artificial Sequence
  Description of Artificial Sequence: Synthetic peptide
  Seed: TWRRGTGYTL (MAGC3_HUMAN)
TYRRGTGYTF

SEQ ID NO: 109200 - protein, 10 aa, Artificial Sequence
  Description of Artificial Sequence: Synthetic peptide
  Seed: YSAFHLGHLR (MAGC3_HUMAN)
YMAFHLGHLR

SEQ ID NO: 109201 - protein, 10 aa, Artificial Sequence
  Description of Artificial Sequence: Synthetic peptide
  Seed: YQAKEPLTRA (MAGC3_HUMAN)
YMAKEPLTRL

SEQ ID NO: 109202 - protein, 9 aa, Artificial Sequence
  Description of Artificial Sequence: Synthetic peptide
  Seed: QGMPQNRLL (MAGC3_HUMAN)
QLMPQNRLW

SEQ ID NO: 109203 - protein, 9 aa, Artificial Sequence
  Description of Artificial Sequence: Synthetic peptide
  Seed: QDWPLNEKR (MAGC3_HUMAN)
QVWPLNEKR

SEQ ID NO: 109204 - protein, 8 aa, Artificial Sequence
  Description of Artificial Sequence: Synthetic peptide
  Seed: YMDALKDM (MAGC3_HUMAN)
YTDALKDV

SEQ ID NO: 109205 - protein, 9 aa, Artificial Sequence
  Description of Artificial Sequence: Synthetic peptide
  Seed: YFFEDTLDL (MAGC3_HUMAN)
YNFEDTLDY

SEQ ID NO: 109206 - protein, 10 aa, Artificial Sequence
  Description of Artificial Sequence: Synthetic peptide
  Seed: MIFGKAHEFI (MAGC3_HUMAN)
MMFGKAHEFA

SEQ ID NO: 109207 - protein, 9 aa, Artificial Sequence
  Description of Artificial Sequence: Synthetic peptide
  Seed: VIWEVLNAI (MAGC3_HUMAN)
VSWEVLNAV

SEQ ID NO: 109208 - protein, 10 aa, Artificial Sequence
  Description of Artificial Sequence: Synthetic peptide
  Seed: MIFRKAREFI (MAGC3_HUMAN)
MTFRKAREFA

SEQ ID NO: 109209 - protein, 10 aa, Artificial Sequence
  Description of Artificial Sequence: Synthetic peptide
  Seed: RSAEGSVLDL (MAGC3_HUMAN)
RQAEGSVLDL

SEQ ID NO: 109210 - protein, 11 aa, Artificial Sequence
  Description of Artificial Sequence: Synthetic peptide
  Seed: LLLKYQTKEPV (MAGC3_HUMAN)
LMLKYQTKEPV

SEQ ID NO: 109211 - protein, 9 aa, Artificial Sequence
  Description of Artificial Sequence: Synthetic peptide
  Seed: KAHEFIELI (MAGC3_HUMAN)
KQHEFIELA

SEQ ID NO: 109212 - protein, 9 aa, Artificial Sequence
  Description of Artificial Sequence: Synthetic peptide
  Seed: LRSAEGSVL (MAGC3_HUMAN)
LQSAEGSVF

SEQ ID NO: 109213 - protein, 9 aa, Artificial Sequence
  Description of Artificial Sequence: Synthetic peptide
  Seed: AEMQMNVIN (MAGC3_HUMAN)
AEMQMNVIW

SEQ ID NO: 109214 - protein, 9 aa, Artificial Sequence
  Description of Artificial Sequence: Synthetic peptide
  Seed: RPAREVLEF (MAGC3_HUMAN)
RQAREVLEY

SEQ ID NO: 109215 - protein, 9 aa, Artificial Sequence
  Description of Artificial Sequence: Synthetic peptide
  Seed: HLREVRLFL (MAGC3_HUMAN)
HMREVRLFW

SEQ ID NO: 109216 - protein, 10 aa, Artificial Sequence
  Description of Artificial Sequence: Synthetic peptide
  Seed: SIIPSAFPSW (MAGC3_HUMAN)
SQIPSAFPSY

SEQ ID NO: 109217 - protein, 9 aa, Artificial Sequence
  Description of Artificial Sequence: Synthetic peptide
  Seed: FSLRRAVSV (MAGC3_HUMAN)
FSLRRAVSM

SEQ ID NO: 109218 - protein, 11 aa, Artificial Sequence
  Description of Artificial Sequence: Synthetic peptide
  Seed: ALWESEGPEAF (MAGC3_HUMAN)
AQWESEGPEAY

SEQ ID NO: 109219 - protein, 10 aa, Artificial Sequence
  Description of Artificial Sequence: Synthetic peptide
  Seed: LPTWRRGTGY (MAGC3_HUMAN)
LVTWRRGTGW

SEQ ID NO: 109220 - protein, 10 aa, Artificial Sequence
  Description of Artificial Sequence: Synthetic peptide
  Seed: MDPDNHSYFF (MAGC3_HUMAN)
MGPDNHSYFL

SEQ ID NO: 109221 - protein, 11 aa, Artificial Sequence
  Description of Artificial Sequence: Synthetic peptide
  Seed: DLANPQGLAGH (MAGC3_HUMAN)
DAANPQGLAGK

SEQ ID NO: 109222 - protein, 10 aa, Artificial Sequence
  Description of Artificial Sequence: Synthetic peptide
  Seed: MDPDNHSYFF (MAGC3_HUMAN)
MTPDNHSYFM

SEQ ID NO: 109223 - protein, 9 aa, Artificial Sequence
  Description of Artificial Sequence: Synthetic peptide
  Seed: TYALSPVVL (MAGC3_HUMAN)
TYALSPVVI

SEQ ID NO: 109224 - protein, 9 aa, Artificial Sequence
  Description of Artificial Sequence: Synthetic peptide
  Seed: MLLPCHWVL (MAGC3_HUMAN)
MGLPCHWVF

SEQ ID NO: 109225 - protein, 11 aa, Artificial Sequence
  Description of Artificial Sequence: Synthetic peptide
  Seed: LDSCSSPLLWT (MAGC3_HUMAN)
LSSCSSPLLWM

SEQ ID NO: 109226 - protein, 9 aa, Artificial Sequence
  Description of Artificial Sequence: Synthetic peptide
  Seed: NTYTGYFPM (MAGC3_HUMAN)
NVYTGYFPM

SEQ ID NO: 109227 - protein, 10 aa, Artificial Sequence
  Description of Artificial Sequence: Synthetic peptide
  Seed: VTKAEMLTTV (MAGC3_HUMAN)
VLKAEMLTTA

SEQ ID NO: 109228 - protein, 9 aa, Artificial Sequence
  Description of Artificial Sequence: Synthetic peptide
  Seed: YFFEDTLDL (MAGC3_HUMAN)
YGFEDTLDY

SEQ ID NO: 109229 - protein, 9 aa, Artificial Sequence
  Description of Artificial Sequence: Synthetic peptide
  Seed: FSLRRAVSV (MAGC3_HUMAN)
FMLRRAVSY

SEQ ID NO: 109230 - protein, 9 aa, Artificial Sequence
  Description of Artificial Sequence: Synthetic peptide
  Seed: QPQPRKKAT (MAGC3_HUMAN)
QPQPRKKAA

SEQ ID NO: 109231 - protein, 9 aa, Artificial Sequence
  Description of Artificial Sequence: Synthetic peptide
  Seed: KVDKLVQFL (MAGC3_HUMAN)
KEDKLVQFL

SEQ ID NO: 109232 - protein, 9 aa, Artificial Sequence
  Description of Artificial Sequence: Synthetic peptide
  Seed: FPSWYMDAL (MAGC3_HUMAN)
FSSWYMDAL

SEQ ID NO: 109233 - protein, 10 aa, Artificial Sequence
  Description of Artificial Sequence: Synthetic peptide
  Seed: TGYFPMIFRK (MAGC3_HUMAN)
TVYFPMIFRQ

SEQ ID NO: 109234 - protein, 11 aa, Artificial Sequence
  Description of Artificial Sequence: Synthetic peptide
  Seed: AEMQMNVINTY (MAGC3_HUMAN)
AQMQMNVINTM

SEQ ID NO: 109235 - protein, 9 aa, Artificial Sequence
  Description of Artificial Sequence: Synthetic peptide
  Seed: WYMDALKDM (MAGC3_HUMAN)
WWMDALKDF

SEQ ID NO: 109236 - protein, 10 aa, Artificial Sequence
  Description of Artificial Sequence: Synthetic peptide
  Seed: LPTWRRGTGY (MAGC3_HUMAN)
LFTWRRGTGF

SEQ ID NO: 109237 - protein, 10 aa, Artificial Sequence
  Description of Artificial Sequence: Synthetic peptide
  Seed: SKLSSIIPSA (MAGC3_HUMAN)
SVLSSIIPSI

SEQ ID NO: 109238 - protein, 9 aa, Artificial Sequence
  Description of Artificial Sequence: Synthetic peptide
  Seed: EVLEFLSKL (MAGC3_HUMAN)
EWLEFLSKK

SEQ ID NO: 109239 - protein, 10 aa, Artificial Sequence
  Description of Artificial Sequence: Synthetic peptide
  Seed: KATDKDYSAF (MAGC3_HUMAN)
KMTDKDYSAY

SEQ ID NO: 109240 - protein, 11 aa, Artificial Sequence
  Description of Artificial Sequence: Synthetic peptide
  Seed: IIDTTDDATAM (MAGC3_HUMAN)
IIDTTDDATAY

SEQ ID NO: 109241 - protein, 10 aa, Artificial Sequence
  Description of Artificial Sequence: Synthetic peptide
  Seed: ATYALSPVVL (MAGC3_HUMAN)
ARYALSPVVF

SEQ ID NO: 109242 - protein, 9 aa, Artificial Sequence
  Description of Artificial Sequence: Synthetic peptide
  Seed: IIPSAFPSW (MAGC3_HUMAN)
IPPSAFPSW

SEQ ID NO: 109243 - protein, 8 aa, Artificial Sequence
  Description of Artificial Sequence: Synthetic peptide
  Seed: MEDRAQAI (MAGC3_HUMAN)
MADRAQAF

SEQ ID NO: 109244 - protein, 11 aa, Artificial Sequence
  Description of Artificial Sequence: Synthetic peptide
  Seed: ILFGISLTEVD (MAGC3_HUMAN)
IMFGISLTEVH

SEQ ID NO: 109245 - protein, 9 aa, Artificial Sequence
  Description of Artificial Sequence: Synthetic peptide
  Seed: DMDPDNHSY (MAGC3_HUMAN)
DTDPDNHSV

SEQ ID NO: 109246 - protein, 9 aa, Artificial Sequence
  Description of Artificial Sequence: Synthetic peptide
  Seed: KVDKLVQFL (MAGC3_HUMAN)
KWDKLVQFL

SEQ ID NO: 109247 - protein, 9 aa, Artificial Sequence
  Description of Artificial Sequence: Synthetic peptide
  Seed: QDWPLNEKR (MAGC3_HUMAN)
QFWPLNEKR

SEQ ID NO: 109248 - protein, 10 aa, Artificial Sequence
  Description of Artificial Sequence: Synthetic peptide
  Seed: LNAIGPWSAL (MAGC3_HUMAN)
LEAIGPWSAF

SEQ ID NO: 109249 - protein, 9 aa, Artificial Sequence
  Description of Artificial Sequence: Synthetic peptide
  Seed: MIFGKAHEF (MAGC3_HUMAN)
MAFGKAHEM

SEQ ID NO: 109250 - protein, 9 aa, Artificial Sequence
  Description of Artificial Sequence: Synthetic peptide
  Seed: VLPPQPQPR (MAGC3_HUMAN)
VTPPQPQPV

SEQ ID NO: 109251 - protein, 10 aa, Artificial Sequence
  Description of Artificial Sequence: Synthetic peptide
  Seed: CLLILILSMI (MAGC3_HUMAN)
CKLILILSMV

SEQ ID NO: 109252 - protein, 9 aa, Artificial Sequence
  Description of Artificial Sequence: Synthetic peptide
  Seed: VIWEVLSAI (MAGC3_HUMAN)
VQWEVLSAM

SEQ ID NO: 109253 - protein, 9 aa, Artificial Sequence
  Description of Artificial Sequence: Synthetic peptide
  Seed: WESEGPEAF (MAGC3_HUMAN)
WQSEGPEAY

SEQ ID NO: 109254 - protein, 9 aa, Artificial Sequence
  Description of Artificial Sequence: Synthetic peptide
  Seed: SASPSVMST (MAGC3_HUMAN)
SVSPSVMSY

SEQ ID NO: 109255 - protein, 10 aa, Artificial Sequence
  Description of Artificial Sequence: Synthetic peptide
  Seed: ATYALSPVVL (MAGC3_HUMAN)
ATYALSPVVF

SEQ ID NO: 109256 - protein, 10 aa, Artificial Sequence
  Description of Artificial Sequence: Synthetic peptide
  Seed: IELIFGIALT (MAGC3_HUMAN)
IWLIFGIALA

SEQ ID NO: 109257 - protein, 10 aa, Artificial Sequence
  Description of Artificial Sequence: Synthetic peptide
  Seed: KLVQFLLLKY (MAGC3_HUMAN)
KLVQFLLLKF

SEQ ID NO: 109258 - protein, 9 aa, Artificial Sequence
  Description of Artificial Sequence: Synthetic peptide
  Seed: LKYQTKEPV (MAGC3_HUMAN)
LIYQTKEPY

SEQ ID NO: 109259 - protein, 9 aa, Artificial Sequence
  Description of Artificial Sequence: Synthetic peptide
  Seed: KVDKLVQFL (MAGC3_HUMAN)
KVDKLVQFY

SEQ ID NO: 109260 - protein, 9 aa, Artificial Sequence
  Description of Artificial Sequence: Synthetic peptide
  Seed: LSAIGPIQR (MAGC3_HUMAN)
LVAIGPIQL

SEQ ID NO: 109261 - protein, 10 aa, Artificial Sequence
  Description of Artificial Sequence: Synthetic peptide
  Seed: VLDLANPQGL (MAGC3_HUMAN)
VYDLANPQGM

SEQ ID NO: 109262 - protein, 9 aa, Artificial Sequence
  Description of Artificial Sequence: Synthetic peptide
  Seed: YQAKEPLTR (MAGC3_HUMAN)
YVAKEPLTK

SEQ ID NO: 109263 - protein, 9 aa, Artificial Sequence
  Description of Artificial Sequence: Synthetic peptide
  Seed: ISPQGPPQS (MAGC3_HUMAN)
IGPQGPPQF

SEQ ID NO: 109264 - protein, 9 aa, Artificial Sequence
  Description of Artificial Sequence: Synthetic peptide
  Seed: YQTKEPVTK (MAGC3_HUMAN)
YATKEPVTY

SEQ ID NO: 109265 - protein, 9 aa, Artificial Sequence
  Description of Artificial Sequence: Synthetic peptide
  Seed: AVSPGKRLW (MAGC3_HUMAN)
AVSPGKRLM

SEQ ID NO: 109266 - protein, 8 aa, Artificial Sequence
  Description of Artificial Sequence: Synthetic peptide
  Seed: LDEKVAEL (MAGC3_HUMAN)
LAEKVAEL

SEQ ID NO: 109267 - protein, 10 aa, Artificial Sequence
  Description of Artificial Sequence: Synthetic peptide
  Seed: ALWESEGPEA (MAGC3_HUMAN)
AMWESEGPEA

SEQ ID NO: 109268 - protein, 10 aa, Artificial Sequence
  Description of Artificial Sequence: Synthetic peptide
  Seed: DMPAAGMPPL (MAGC3_HUMAN)
DWPAAGMPPF

SEQ ID NO: 109269 - protein, 11 aa, Artificial Sequence
  Description of Artificial Sequence: Synthetic peptide
  Seed: QGMPQNRLLIL (MAGC3_HUMAN)
QPMPQNRLLIL

SEQ ID NO: 109270 - protein, 9 aa, Artificial Sequence
  Description of Artificial Sequence: Synthetic peptide
  Seed: RTLSGSPGL (MAGC3_HUMAN)
RSLSGSPGA

SEQ ID NO: 109271 - protein, 10 aa, Artificial Sequence
  Description of Artificial Sequence: Synthetic peptide
  Seed: FADVLSRLAL (MAGC3_HUMAN)
FLDVLSRLAV

SEQ ID NO: 109272 - protein, 10 aa, Artificial Sequence
  Description of Artificial Sequence: Synthetic peptide
  Seed: EVIWEVLNAI (MAGC3_HUMAN)
ECIWEVLNAV

SEQ ID NO: 109273 - protein, 9 aa, Artificial Sequence
  Description of Artificial Sequence: Synthetic peptide
  Seed: MPAAGMPPL (MAGC3_HUMAN)
MTAAGMPPF

SEQ ID NO: 109274 - protein, 11 aa, Artificial Sequence
  Description of Artificial Sequence: Synthetic peptide
  Seed: DSCSSPLLWTR (MAGC3_HUMAN)
DMCSSPLLWTR

SEQ ID NO: 109275 - protein, 10 aa, Artificial Sequence
  Description of Artificial Sequence: Synthetic peptide
  Seed: EKVAELVQFL (MAGC3_HUMAN)
ESVAELVQFV

SEQ ID NO: 109276 - protein, 9 aa, Artificial Sequence
  Description of Artificial Sequence: Synthetic peptide
  Seed: LILILSMIF (MAGC3_HUMAN)
LKLILSMIY

SEQ ID NO: 109277 - protein, 9 aa, Artificial Sequence
  Description of Artificial Sequence: Synthetic peptide
  Seed: VIWEVLSAI (MAGC3_HUMAN)
VVWEVLSAI

SEQ ID NO: 109278 - protein, 10 aa, Artificial Sequence
  Description of Artificial Sequence: Synthetic peptide
  Seed: KKYKDYFPMI (MAGC3_HUMAN)
KFYKDYFPMF

SEQ ID NO: 109279 - protein, 10 aa, Artificial Sequence
  Description of Artificial Sequence: Synthetic peptide
  Seed: YQAKEPLTRA (MAGC3_HUMAN)
YMAKEPLTRI

SEQ ID NO: 109280 - protein, 9 aa, Artificial Sequence
  Description of Artificial Sequence: Synthetic peptide
  Seed: KAHEFIELI (MAGC3_HUMAN)
KVHEFIELR

SEQ ID NO: 109281 - protein, 11 aa, Artificial Sequence
  Description of Artificial Sequence: Synthetic peptide
  Seed: TLWKDSDLPTW (MAGC3_HUMAN)
TMWKDSDLPTF

SEQ ID NO: 109282 - protein, 9 aa, Artificial Sequence
  Description of Artificial Sequence: Synthetic peptide
  Seed: AMASASPSV (MAGC3_HUMAN)
AQASASPSW

SEQ ID NO: 109283 - protein, 9 aa, Artificial Sequence
  Description of Artificial Sequence: Synthetic peptide
  Seed: EVLNAIGPW (MAGC3_HUMAN)
ETLNAIGPR

SEQ ID NO: 109284 - protein, 9 aa, Artificial Sequence
  Description of Artificial Sequence: Synthetic peptide
  Seed: SLRRAVSVK (MAGC3_HUMAN)
SIRRAVSVV

SEQ ID NO: 109285 - protein, 8 aa, Artificial Sequence
  Description of Artificial Sequence: Synthetic peptide
  Seed: FADVLSRL (MAGC3_HUMAN)
FVDVLSRV

SEQ ID NO: 109286 - protein, 9 aa, Artificial Sequence
  Description of Artificial Sequence: Synthetic peptide
  Seed: RGTGYTLSL (MAGC3_HUMAN)
RMTGYTLSH

SEQ ID NO: 109287 - protein, 11 aa, Artificial Sequence
  Description of Artificial Sequence: Synthetic peptide
  Seed: RTLSGSPGLQL (MAGC3_HUMAN)
RSLSGSPGLQF

SEQ ID NO: 109288 - protein, 10 aa, Artificial Sequence
  Description of Artificial Sequence: Synthetic peptide
  Seed: MQMNVINTYT (MAGC3_HUMAN)
MGMNVINTYM

SEQ ID NO: 109289 - protein, 9 aa, Artificial Sequence
  Description of Artificial Sequence: Synthetic peptide
  Seed: FSLRRAVSV (MAGC3_HUMAN)
FGLRRAVSL

SEQ ID NO: 109290 - protein, 9 aa, Artificial Sequence
  Description of Artificial Sequence: Synthetic peptide
  Seed: LRSAEGSVL (MAGC3_HUMAN)
LASAEGSVM

SEQ ID NO: 109291 - protein, 9 aa, Artificial Sequence
  Description of Artificial Sequence: Synthetic peptide
  Seed: IPPQGPPKI (MAGC3_HUMAN)
IMPQGPPKF

SEQ ID NO: 109292 - protein, 9 aa, Artificial Sequence
  Description of Artificial Sequence: Synthetic peptide
  Seed: KVDKLVQFL (MAGC3_HUMAN)
KFDKLVQFL

SEQ ID NO: 109293 - protein, 10 aa, Artificial Sequence
  Description of Artificial Sequence: Synthetic peptide
  Seed: AMASASPSVM (MAGC3_HUMAN)
AVASASPSVM

SEQ ID NO: 109294 - protein, 10 aa, Artificial Sequence
  Description of Artificial Sequence: Synthetic peptide
  Seed: LSLPAVSPGK (MAGC3_HUMAN)
LSLPAVSPGR

SEQ ID NO: 109295 - protein, 10 aa, Artificial Sequence
  Description of Artificial Sequence: Synthetic peptide
  Seed: EVIWEVLSAI (MAGC3_HUMAN)
EYIWEVLSAV

SEQ ID NO: 109296 - protein, 9 aa, Artificial Sequence
  Description of Artificial Sequence: Synthetic peptide
  Seed: QDWPLNEKR (MAGC3_HUMAN)
QTWPLNEKR

SEQ ID NO: 109297 - protein, 10 aa, Artificial Sequence
  Description of Artificial Sequence: Synthetic peptide
  Seed: FPSWYMDALK (MAGC3_HUMAN)
FFSWYMDALK

SEQ ID NO: 109298 - protein, 10 aa, Artificial Sequence
  Description of Artificial Sequence: Synthetic peptide
  Seed: MIFGKAHEFI (MAGC3_HUMAN)
MIFGKAHEFL

SEQ ID NO: 109299 - protein, 9 aa, Artificial Sequence
  Description of Artificial Sequence: Synthetic peptide
  Seed: EFIELIFGI (MAGC3_HUMAN)
ELIELIFGL

SEQ ID NO: 109300 - protein, 10 aa, Artificial Sequence
  Description of Artificial Sequence: Synthetic peptide
  Seed: EVIWEVLNAI (MAGC3_HUMAN)
ETIWEVLNAM

SEQ ID NO: 109301 - protein, 10 aa, Artificial Sequence
  Description of Artificial Sequence: Synthetic peptide
  Seed: KLSSIIPSAF (MAGC3_HUMAN)
KRSSIIPSAW

SEQ ID NO: 109302 - protein, 9 aa, Artificial Sequence
  Description of Artificial Sequence: Synthetic peptide
  Seed: LIDDQGMPK (MAGC3_HUMAN)
LLDDQGMPI

SEQ ID NO: 109303 - protein, 11 aa, Artificial Sequence
  Description of Artificial Sequence: Synthetic peptide
  Seed: YKDYFPMIFGK (MAGC3_HUMAN)
YMDYFPMIFGR

SEQ ID NO: 109304 - protein, 10 aa, Artificial Sequence
  Description of Artificial Sequence: Synthetic peptide
  Seed: SKLSSIIPSA (MAGC3_HUMAN)
SNLSSIIPSL

SEQ ID NO: 109305 - protein, 9 aa, Artificial Sequence
  Description of Artificial Sequence: Synthetic peptide
  Seed: EKVDKLVQF (MAGC3_HUMAN)
EQVDKLVQF

SEQ ID NO: 109306 - protein, 9 aa, Artificial Sequence
  Description of Artificial Sequence: Synthetic peptide
  Seed: MDPDNHSYF (MAGC3_HUMAN)
MTPDNHSYM

SEQ ID NO: 109307 - protein, 10 aa, Artificial Sequence
  Description of Artificial Sequence: Synthetic peptide
  Seed: MDPDNHSYFF (MAGC3_HUMAN)
MMPDNHSYFF

SEQ ID NO: 109308 - protein, 10 aa, Artificial Sequence
  Description of Artificial Sequence: Synthetic peptide
  Seed: VLSAIGPIQR (MAGC3_HUMAN)
VVSAIGPIQK

SEQ ID NO: 109309 - protein, 11 aa, Artificial Sequence
  Description of Artificial Sequence: Synthetic peptide
  Seed: ATFSDGSLGQW (MAGC3_HUMAN)
AQFSDGSLGQM

SEQ ID NO: 109310 - protein, 11 aa, Artificial Sequence
  Description of Artificial Sequence: Synthetic peptide
  Seed: FIELIFGIALT (MAGC3_HUMAN)
FQELIFGIALI

SEQ ID NO: 109311 - protein, 9 aa, Artificial Sequence
  Description of Artificial Sequence: Synthetic peptide
  Seed: HFYVFVNTL (MAGC3_HUMAN)
HIYVFVNTF

SEQ ID NO: 109312 - protein, 9 aa, Artificial Sequence
  Description of Artificial Sequence: Synthetic peptide
  Seed: IQRPAREVL (MAGC3_HUMAN)
IERPAREVF

SEQ ID NO: 109313 - protein, 9 aa, Artificial Sequence
  Description of Artificial Sequence: Synthetic peptide
  Seed: TEASPQQKK (MAGC3_HUMAN)
TVASPQQKY

SEQ ID NO: 109314 - protein, 9 aa, Artificial Sequence
  Description of Artificial Sequence: Synthetic peptide
  Seed: ADVLSRLAL (MAGC3_HUMAN)
AEVLSRLAM

SEQ ID NO: 109315 - protein, 9 aa, Artificial Sequence
  Description of Artificial Sequence: Synthetic peptide
  Seed: FADVLSRLA (MAGC3_HUMAN)
FTDVLSRLL

SEQ ID NO: 109316 - protein, 10 aa, Artificial Sequence
  Description of Artificial Sequence: Synthetic peptide
  Seed: MLTTVIKKYK (MAGC3_HUMAN)
MMTTVIKKYR

SEQ ID NO: 109317 - protein, 10 aa, Artificial Sequence
  Description of Artificial Sequence: Synthetic peptide
  Seed: YTLDEKVDKL (MAGC3_HUMAN)
YALDEKVDKV

SEQ ID NO: 109318 - protein, 10 aa, Artificial Sequence
  Description of Artificial Sequence: Synthetic peptide
  Seed: VLCPTYFKLW (MAGC3_HUMAN)
VYCPTYFKLW

SEQ ID NO: 109319 - protein, 9 aa, Artificial Sequence
  Description of Artificial Sequence: Synthetic peptide
  Seed: FADVLSRLA (MAGC3_HUMAN)
FIDVLSRLI

SEQ ID NO: 109320 - protein, 9 aa, Artificial Sequence
  Description of Artificial Sequence: Synthetic peptide
  Seed: TYTGYFPMI (MAGC3_HUMAN)
TWTGYFPMI

SEQ ID NO: 109321 - protein, 9 aa, Artificial Sequence
  Description of Artificial Sequence: Synthetic peptide
  Seed: SLPESEPLF (MAGC3_HUMAN)
SLPESEPLV

SEQ ID NO: 109322 - protein, 9 aa, Artificial Sequence
  Description of Artificial Sequence: Synthetic peptide
  Seed: EVLSAIGPI (MAGC3_HUMAN)
EILSAIGPV

SEQ ID NO: 109323 - protein, 10 aa, Artificial Sequence
  Description of Artificial Sequence: Synthetic peptide
  Seed: SLVLCPTYFK (MAGC3_HUMAN)
SWVLCPTYFK

SEQ ID NO: 109324 - protein, 9 aa, Artificial Sequence
  Description of Artificial Sequence: Synthetic peptide
  Seed: ATDKDYSAF (MAGC3_HUMAN)
AGDKDYSAM

SEQ ID NO: 109325 - protein, 9 aa, Artificial Sequence
  Description of Artificial Sequence: Synthetic peptide
  Seed: IFGKAHEFI (MAGC3_HUMAN)
IWGKAHEFM

SEQ ID NO: 109326 - protein, 11 aa, Artificial Sequence
  Description of Artificial Sequence: Synthetic peptide
  Seed: ATFSDGSLGQW (MAGC3_HUMAN)
ATFSDGSLGQF

SEQ ID NO: 109327 - protein, 9 aa, Artificial Sequence
  Description of Artificial Sequence: Synthetic peptide
  Seed: MDPDNHSYF (MAGC3_HUMAN)
MCPDNHSYL

SEQ ID NO: 109328 - protein, 9 aa, Artificial Sequence
  Description of Artificial Sequence: Synthetic peptide
  Seed: REEPQDWPL (MAGC3_HUMAN)
REEPQDWPA

SEQ ID NO: 109329 - protein, 9 aa, Artificial Sequence
  Description of Artificial Sequence: Synthetic peptide
  Seed: YFFEDTLDL (MAGC3_HUMAN)
YPFEDTLDV

SEQ ID NO: 109330 - protein, 9 aa, Artificial Sequence
  Description of Artificial Sequence: Synthetic peptide
  Seed: SAEGSVLDL (MAGC3_HUMAN)
SYEGSVLDM

SEQ ID NO: 109331 - protein, 9 aa, Artificial Sequence
  Description of Artificial Sequence: Synthetic peptide
  Seed: KKYKDYFPM (MAGC3_HUMAN)
KIYKDYFPM

SEQ ID NO: 109332 - protein, 9 aa, Artificial Sequence
  Description of Artificial Sequence: Synthetic peptide
  Seed: ELIFGIALT (MAGC3_HUMAN)
ETIFGIALA

SEQ ID NO: 109333 - protein, 9 aa, Artificial Sequence
  Description of Artificial Sequence: Synthetic peptide
  Seed: MPAAGMPPL (MAGC3_HUMAN)
MPAAGMPPA

SEQ ID NO: 109334 - protein, 10 aa, Artificial Sequence
  Description of Artificial Sequence: Synthetic peptide
  Seed: RLLILILSVI (MAGC3_HUMAN)
RMLILILSVI

SEQ ID NO: 109335 - protein, 10 aa, Artificial Sequence
  Description of Artificial Sequence: Synthetic peptide
  Seed: MQMNVINTYT (MAGC3_HUMAN)
MQMNVINTYM

SEQ ID NO: 109336 - protein, 9 aa, Artificial Sequence
  Description of Artificial Sequence: Synthetic peptide
  Seed: KKYKDYFPM (MAGC3_HUMAN)
KTYKDYFPM

SEQ ID NO: 109337 - protein, 9 aa, Artificial Sequence
  Description of Artificial Sequence: Synthetic peptide
  Seed: YQAKEPLTR (MAGC3_HUMAN)
YQAKEPLTL

SEQ ID NO: 109338 - protein, 10 aa, Artificial Sequence
  Description of Artificial Sequence: Synthetic peptide
  Seed: MDSLVLCPTY (MAGC3_HUMAN)
MQSLVLCPTM

SEQ ID NO: 109339 - protein, 9 aa, Artificial Sequence
  Description of Artificial Sequence: Synthetic peptide
  Seed: LTDMDPDNH (MAGC3_HUMAN)
LSDMDPDNY

SEQ ID NO: 109340 - protein, 9 aa, Artificial Sequence
  Description of Artificial Sequence: Synthetic peptide
  Seed: MPQNRLLIL (MAGC3_HUMAN)
MPQNRLLIY

SEQ ID NO: 109341 - protein, 9 aa, Artificial Sequence
  Description of Artificial Sequence: Synthetic peptide
  Seed: VIWEVLSAI (MAGC3_HUMAN)
VTWEVLSAI

SEQ ID NO: 109342 - protein, 8 aa, Artificial Sequence
  Description of Artificial Sequence: Synthetic peptide
  Seed: TTDDATAM (MAGC3_HUMAN)
TVDDATAM

SEQ ID NO: 109343 - protein, 8 aa, Artificial Sequence
  Description of Artificial Sequence: Synthetic peptide
  Seed: AEMQMNVI (MAGC3_HUMAN)
AEMQMNVL

SEQ ID NO: 109344 - protein, 9 aa, Artificial Sequence
  Description of Artificial Sequence: Synthetic peptide
  Seed: VPEEVIWEV (MAGC3_HUMAN)
VPEEVIWEW

SEQ ID NO: 109345 - protein, 9 aa, Artificial Sequence
  Description of Artificial Sequence: Synthetic peptide
  Seed: SESLPRYAL (MAGC3_HUMAN)
SKSLPRYAY

SEQ ID NO: 109346 - protein, 10 aa, Artificial Sequence
  Description of Artificial Sequence: Synthetic peptide
  Seed: FPSWYMDALK (MAGC3_HUMAN)
FYSWYMDALK

SEQ ID NO: 109347 - protein, 9 aa, Artificial Sequence
  Description of Artificial Sequence: Synthetic peptide
  Seed: HSYFFEDTL (MAGC3_HUMAN)
HAYFFEDTY

SEQ ID NO: 109348 - protein, 10 aa, Artificial Sequence
  Description of Artificial Sequence: Synthetic peptide
  Seed: YALDEKVAEL (MAGC3_HUMAN)
YSLDEKVAEC

SEQ ID NO: 109349 - protein, 9 aa, Artificial Sequence
  Description of Artificial Sequence: Synthetic peptide
  Seed: IPPQGPPKI (MAGC3_HUMAN)
IIPQGPPKV

SEQ ID NO: 109350 - protein, 9 aa, Artificial Sequence
  Description of Artificial Sequence: Synthetic peptide
  Seed: MIFIKGSCV (MAGC3_HUMAN)
MAFIKGSCI

SEQ ID NO: 109351 - protein, 10 aa, Artificial Sequence
  Description of Artificial Sequence: Synthetic peptide
  Seed: EVIWEVLSAI (MAGC3_HUMAN)
EVIWEVLSAV

SEQ ID NO: 109352 - protein, 11 aa, Artificial Sequence
  Description of Artificial Sequence: Synthetic peptide
  Seed: SASPSVMSTNF (MAGC3_HUMAN)
STSPSVMSTNY

SEQ ID NO: 109353 - protein, 9 aa, Artificial Sequence
  Description of Artificial Sequence: Synthetic peptide
  Seed: CATYALSPV (MAGC3_HUMAN)
CMTYALSPV

SEQ ID NO: 109354 - protein, 10 aa, Artificial Sequence
  Description of Artificial Sequence: Synthetic peptide
  Seed: LIFGIALTDM (MAGC3_HUMAN)
LQFGIALTDV

SEQ ID NO: 109355 - protein, 10 aa, Artificial Sequence
  Description of Artificial Sequence: Synthetic peptide
  Seed: YALDEKVAEL (MAGC3_HUMAN)
YKLDEKVAEL

SEQ ID NO: 109356 - protein, 9 aa, Artificial Sequence
  Description of Artificial Sequence: Synthetic peptide
  Seed: FADVLSRLA (MAGC3_HUMAN)
FVDVLSRLI

SEQ ID NO: 109357 - protein, 10 aa, Artificial Sequence
  Description of Artificial Sequence: Synthetic peptide
  Seed: SDQRMDSLVL (MAGC3_HUMAN)
SKQRMDSLVL

SEQ ID NO: 109358 - protein, 9 aa, Artificial Sequence
  Description of Artificial Sequence: Synthetic peptide
  Seed: YTGYFPMIF (MAGC3_HUMAN)
YYGYFPMIM

SEQ ID NO: 109359 - protein, 11 aa, Artificial Sequence
  Description of Artificial Sequence: Synthetic peptide
  Seed: LSKLSSIIPSA (MAGC3_HUMAN)
LAKLSSIIPSV

SEQ ID NO: 109360 - protein, 9 aa, Artificial Sequence
  Description of Artificial Sequence: Synthetic peptide
  Seed: ALSPVVLPP (MAGC3_HUMAN)
ALSPVVLPM

SEQ ID NO: 109361 - protein, 9 aa, Artificial Sequence
  Description of Artificial Sequence: Synthetic peptide
  Seed: KLVQFLLLK (MAGC3_HUMAN)
KQVQFLLLF

SEQ ID NO: 109362 - protein, 10 aa, Artificial Sequence
  Description of Artificial Sequence: Synthetic peptide
  Seed: WRTLSGSPGL (MAGC3_HUMAN)
WLTLSGSPGV

SEQ ID NO: 109363 - protein, 9 aa, Artificial Sequence
  Description of Artificial Sequence: Synthetic peptide
  Seed: GYFPMIFRK (MAGC3_HUMAN)
GTFPMIFRR

SEQ ID NO: 109364 - protein, 9 aa, Artificial Sequence
  Description of Artificial Sequence: Synthetic peptide
  Seed: VDPDHFYVF (MAGC3_HUMAN)
VRPDHFYVL

SEQ ID NO: 109365 - protein, 10 aa, Artificial Sequence
  Description of Artificial Sequence: Synthetic peptide
  Seed: YSAFHLGHLR (MAGC3_HUMAN)
YRAFHLGHLR

SEQ ID NO: 109366 - protein, 11 aa, Artificial Sequence
  Description of Artificial Sequence: Synthetic peptide
  Seed: FIKGSCVPEEV (MAGC3_HUMAN)
FLKGSCVPEEV

SEQ ID NO: 109367 - protein, 9 aa, Artificial Sequence
  Description of Artificial Sequence: Synthetic peptide
  Seed: ASEEVIWEV (MAGC3_HUMAN)
AQEEVIWEW

SEQ ID NO: 109368 - protein, 9 aa, Artificial Sequence
  Description of Artificial Sequence: Synthetic peptide
  Seed: MIFGKAHEF (MAGC3_HUMAN)
MGFGKAHEW

SEQ ID NO: 109369 - protein, 9 aa, Artificial Sequence
  Description of Artificial Sequence: Synthetic peptide
  Seed: WVKNTCATY (MAGC3_HUMAN)
WYKNTCATM

SEQ ID NO: 109370 - protein, 9 aa, Artificial Sequence
  Description of Artificial Sequence: Synthetic peptide
  Seed: QPQPRKKAT (MAGC3_HUMAN)
QLQPRKKAV

SEQ ID NO: 109371 - protein, 10 aa, Artificial Sequence
  Description of Artificial Sequence: Synthetic peptide
  Seed: LWKDSDLPTW (MAGC3_HUMAN)
LYKDSDLPTF

SEQ ID NO: 109372 - protein, 9 aa, Artificial Sequence
  Description of Artificial Sequence: Synthetic peptide
  Seed: HSYFFEDTL (MAGC3_HUMAN)
HIYFFEDTW

SEQ ID NO: 109373 - protein, 10 aa, Artificial Sequence
  Description of Artificial Sequence: Synthetic peptide
  Seed: MNVINTYTGY (MAGC3_HUMAN)
MIVINTYTGF

SEQ ID NO: 109374 - protein, 9 aa, Artificial Sequence
  Description of Artificial Sequence: Synthetic peptide
  Seed: RGTGYTLSL (MAGC3_HUMAN)
RYTGYTLSF

SEQ ID NO: 109375 - protein, 10 aa, Artificial Sequence
  Description of Artificial Sequence: Synthetic peptide
  Seed: MQMNVINTYT (MAGC3_HUMAN)
MMMNVINTYV

SEQ ID NO: 109376 - protein, 10 aa, Artificial Sequence
  Description of Artificial Sequence: Synthetic peptide
  Seed: EFLSKLSSII (MAGC3_HUMAN)
EYLSKLSSIV

SEQ ID NO: 109377 - protein, 10 aa, Artificial Sequence
  Description of Artificial Sequence: Synthetic peptide
  Seed: KLSSIIPSAF (MAGC3_HUMAN)
KPSSIIPSAW

SEQ ID NO: 109378 - protein, 9 aa, Artificial Sequence
  Description of Artificial Sequence: Synthetic peptide
  Seed: MQMNVINTY (MAGC3_HUMAN)
MVMNVINTI

SEQ ID NO: 109379 - protein, 10 aa, Artificial Sequence
  Description of Artificial Sequence: Synthetic peptide
  Seed: IIDTTDDATA (MAGC3_HUMAN)
IADTTDDATM

SEQ ID NO: 109380 - protein, 11 aa, Artificial Sequence
  Description of Artificial Sequence: Synthetic peptide
  Seed: ALWESEGPEAF (MAGC3_HUMAN)
ARWESEGPEAF

SEQ ID NO: 109381 - protein, 10 aa, Artificial Sequence
  Description of Artificial Sequence: Synthetic peptide
  Seed: LDLANPQGLA (MAGC3_HUMAN)
LKLANPQGLV

SEQ ID NO: 109382 - protein, 10 aa, Artificial Sequence
  Description of Artificial Sequence: Synthetic peptide
  Seed: KVAELVQFLL (MAGC3_HUMAN)
KIAELVQFLM

SEQ ID NO: 109383 - protein, 10 aa, Artificial Sequence
  Description of Artificial Sequence: Synthetic peptide
  Seed: ILFGISLTEV (MAGC3_HUMAN)
IMFGISLTEA

SEQ ID NO: 109384 - protein, 9 aa, Artificial Sequence
  Description of Artificial Sequence: Synthetic peptide
  Seed: YTGYFPMIF (MAGC3_HUMAN)
YLGYFPMIF

SEQ ID NO: 109385 - protein, 9 aa, Artificial Sequence
  Description of Artificial Sequence: Synthetic peptide
  Seed: KVAELVQFL (MAGC3_HUMAN)
KIAELVQFL

SEQ ID NO: 109386 - protein, 8 aa, Artificial Sequence
  Description of Artificial Sequence: Synthetic peptide
  Seed: FADVLSRL (MAGC3_HUMAN)
FTDVLSRF

SEQ ID NO: 109387 - protein, 9 aa, Artificial Sequence
  Description of Artificial Sequence: Synthetic peptide
  Seed: ISPQGPPQS (MAGC3_HUMAN)
IYPQGPPQM

SEQ ID NO: 109388 - protein, 9 aa, Artificial Sequence
  Description of Artificial Sequence: Synthetic peptide
  Seed: TYALSPVVL (MAGC3_HUMAN)
TTALSPVVM

SEQ ID NO: 109389 - protein, 9 aa, Artificial Sequence
  Description of Artificial Sequence: Synthetic peptide
  Seed: MLTTVIKKY (MAGC3_HUMAN)
MSTTVIKKF

SEQ ID NO: 109390 - protein, 9 aa, Artificial Sequence
  Description of Artificial Sequence: Synthetic peptide
  Seed: SLRRAVSVK (MAGC3_HUMAN)
SSRRAVSVL

SEQ ID NO: 109391 - protein, 10 aa, Artificial Sequence
  Description of Artificial Sequence: Synthetic peptide
  Seed: LNAIGPWSAL (MAGC3_HUMAN)
LAAIGPWSAM

SEQ ID NO: 109392 - protein, 9 aa, Artificial Sequence
  Description of Artificial Sequence: Synthetic peptide
  Seed: RGTGYTLSL (MAGC3_HUMAN)
RQTGYTLSW

SEQ ID NO: 109393 - protein, 9 aa, Artificial Sequence
  Description of Artificial Sequence: Synthetic peptide
  Seed: RGTGYTLSL (MAGC3_HUMAN)
RGTGYTLSW

SEQ ID NO: 109394 - protein, 10 aa, Artificial Sequence
  Description of Artificial Sequence: Synthetic peptide
  Seed: KAHEFIELIF (MAGC3_HUMAN)
KHHEFIELIY

SEQ ID NO: 109395 - protein, 9 aa, Artificial Sequence
  Description of Artificial Sequence: Synthetic peptide
  Seed: YFFEDTLDL (MAGC3_HUMAN)
YEFEDTLDY

SEQ ID NO: 109396 - protein, 11 aa, Artificial Sequence
  Description of Artificial Sequence: Synthetic peptide
  Seed: AEMLTTVIKKY (MAGC3_HUMAN)
AEMLTTVIKKW

SEQ ID NO: 109397 - protein, 9 aa, Artificial Sequence
  Description of Artificial Sequence: Synthetic peptide
  Seed: LWGEKAGSL (MAGC3_HUMAN)
LYGEKAGSF

SEQ ID NO: 109398 - protein, 9 aa, Artificial Sequence
  Description of Artificial Sequence: Synthetic peptide
  Seed: EVLEFLSKL (MAGC3_HUMAN)
EGLEFLSKR

SEQ ID NO: 109399 - protein, 9 aa, Artificial Sequence
  Description of Artificial Sequence: Synthetic peptide
  Seed: KDSDLPTWR (MAGC3_HUMAN)
KLSDLPTWR

SEQ ID NO: 109400 - protein, 9 aa, Artificial Sequence
  Description of Artificial Sequence: Synthetic peptide
  Seed: KLWRTLSGS (MAGC3_HUMAN)
KLWRTLSGI

SEQ ID NO: 109401 - protein, 9 aa, Artificial Sequence
  Description of Artificial Sequence: Synthetic peptide
  Seed: MLLPCHWVL (MAGC3_HUMAN)
MNLPCHWVF

SEQ ID NO: 109402 - protein, 9 aa, Artificial Sequence
  Description of Artificial Sequence: Synthetic peptide
  Seed: HFYVFVNTL (MAGC3_HUMAN)
HMYVFVNTV

SEQ ID NO: 109403 - protein, 9 aa, Artificial Sequence
  Description of Artificial Sequence: Synthetic peptide
  Seed: AVSPGKRLW (MAGC3_HUMAN)
AASPGKRLY

SEQ ID NO: 109404 - protein, 9 aa, Artificial Sequence
  Description of Artificial Sequence: Synthetic peptide
  Seed: ISPQGPPQS (MAGC3_HUMAN)
ITPQGPPQF

SEQ ID NO: 109405 - protein, 9 aa, Artificial Sequence
  Description of Artificial Sequence: Synthetic peptide
  Seed: TLDEKVDKL (MAGC3_HUMAN)
TVDEKVDKF

SEQ ID NO: 109406 - protein, 9 aa, Artificial Sequence
  Description of Artificial Sequence: Synthetic peptide
  Seed: MASASPSVM (MAGC3_HUMAN)
MQSASPSVY

SEQ ID NO: 109407 - protein, 10 aa, Artificial Sequence
  Description of Artificial Sequence: Synthetic peptide
  Seed: YALDEKVAEL (MAGC3_HUMAN)
YMLDEKVAEM

SEQ ID NO: 109408 - protein, 9 aa, Artificial Sequence
  Description of Artificial Sequence: Synthetic peptide
  Seed: MIFRKAREF (MAGC3_HUMAN)
MEFRKAREY

SEQ ID NO: 109409 - protein, 10 aa, Artificial Sequence
  Description of Artificial Sequence: Synthetic peptide
  Seed: YALDEKVAEL (MAGC3_HUMAN)
YQLDEKVAEF

SEQ ID NO: 109410 - protein, 9 aa, Artificial Sequence
  Description of Artificial Sequence: Synthetic peptide
  Seed: VLCPTYFKL (MAGC3_HUMAN)
VLCPTYFKM

SEQ ID NO: 109411 - protein, 9 aa, Artificial Sequence
  Description of Artificial Sequence: Synthetic peptide
  Seed: SASPSVMST (MAGC3_HUMAN)
SQSPSVMSF

SEQ ID NO: 109412 - protein, 11 aa, Artificial Sequence
  Description of Artificial Sequence: Synthetic peptide
  Seed: LTDMDPDNHSY (MAGC3_HUMAN)
LLDMDPDNHSM

SEQ ID NO: 109413 - protein, 10 aa, Artificial Sequence
  Description of Artificial Sequence: Synthetic peptide
  Seed: EKVAELVQFL (MAGC3_HUMAN)
ERVAELVQFI

SEQ ID NO: 109414 - protein, 11 aa, Artificial Sequence
  Description of Artificial Sequence: Synthetic peptide
  Seed: YFFEDTLDLTY (MAGC3_HUMAN)
YKFEDTLDLTM

SEQ ID NO: 109415 - protein, 11 aa, Artificial Sequence
  Description of Artificial Sequence: Synthetic peptide
  Seed: LDSCSSPLLWT (MAGC3_HUMAN)
LSSCSSPLLWP

SEQ ID NO: 109416 - protein, 8 aa, Artificial Sequence
  Description of Artificial Sequence: Synthetic peptide
  Seed: TTDDATAM (MAGC3_HUMAN)
TYDDATAM

SEQ ID NO: 109417 - protein, 11 aa, Artificial Sequence
  Description of Artificial Sequence: Synthetic peptide
  Seed: YALDEKVAELV (MAGC3_HUMAN)
YLLDEKVAELF

SEQ ID NO: 109418 - protein, 10 aa, Artificial Sequence
  Description of Artificial Sequence: Synthetic peptide
  Seed: SPLDSCSSPL (MAGC3_HUMAN)
SWLDSCSSPV

SEQ ID NO: 109419 - protein, 10 aa, Artificial Sequence
  Description of Artificial Sequence: Synthetic peptide
  Seed: WVKNTCATYA (MAGC3_HUMAN)
WLKNTCATYY

SEQ ID NO: 109420 - protein, 10 aa, Artificial Sequence
  Description of Artificial Sequence: Synthetic peptide
  Seed: FSDGSLGQWV (MAGC3_HUMAN)
FADGSLGQWY

SEQ ID NO: 109421 - protein, 10 aa, Artificial Sequence
  Description of Artificial Sequence: Synthetic peptide
  Seed: WPLNEKRTLW (MAGC3_HUMAN)
WTLNEKRTLW

SEQ ID NO: 109422 - protein, 9 aa, Artificial Sequence
  Description of Artificial Sequence: Synthetic peptide
  Seed: VAELVQFLL (MAGC3_HUMAN)
VAELVQFLF

SEQ ID NO: 109423 - protein, 9 aa, Artificial Sequence
  Description of Artificial Sequence: Synthetic peptide
  Seed: NVINTYTGY (MAGC3_HUMAN)
NAINTYTGR

SEQ ID NO: 109424 - protein, 9 aa, Artificial Sequence
  Description of Artificial Sequence: Synthetic peptide
  Seed: AVSPGKRLW (MAGC3_HUMAN)
AGSPGKRLW

SEQ ID NO: 109425 - protein, 10 aa, Artificial Sequence
  Description of Artificial Sequence: Synthetic peptide
  Seed: MDSLVLCPTY (MAGC3_HUMAN)
MSSLVLCPTI

SEQ ID NO: 109426 - protein, 9 aa, Artificial Sequence
  Description of Artificial Sequence: Synthetic peptide
  Seed: VIWEVLNAI (MAGC3_HUMAN)
VQWEVLNAI

SEQ ID NO: 109427 - protein, 11 aa, Artificial Sequence
  Description of Artificial Sequence: Synthetic peptide
  Seed: TTDDATAMASA (MAGC3_HUMAN)
TGDDATAMASL

SEQ ID NO: 109428 - protein, 11 aa, Artificial Sequence
  Description of Artificial Sequence: Synthetic peptide
  Seed: RTLSGSPGLQL (MAGC3_HUMAN)
RFLSGSPGLQY

SEQ ID NO: 109429 - protein, 9 aa, Artificial Sequence
  Description of Artificial Sequence: Synthetic peptide
  Seed: TTDDATAMA (MAGC3_HUMAN)
TLDDATAMY

SEQ ID NO: 109430 - protein, 10 aa, Artificial Sequence
  Description of Artificial Sequence: Synthetic peptide
  Seed: EMQMNVINTY (MAGC3_HUMAN)
EWQMNVINTY

SEQ ID NO: 109431 - protein, 10 aa, Artificial Sequence
  Description of Artificial Sequence: Synthetic peptide
  Seed: KKYKDYFPMI (MAGC3_HUMAN)
KTYKDYFPMK

SEQ ID NO: 109432 - protein, 9 aa, Artificial Sequence
  Description of Artificial Sequence: Synthetic peptide
  Seed: TYFKLWRTL (MAGC3_HUMAN)
TFFKLWRTM

SEQ ID NO: 109433 - protein, 9 aa, Artificial Sequence
  Description of Artificial Sequence: Synthetic peptide
  Seed: YSAFHLGHL (MAGC3_HUMAN)
YAAFHLGHY

SEQ ID NO: 109434 - protein, 8 aa, Artificial Sequence
  Description of Artificial Sequence: Synthetic peptide
  Seed: YMDALKDM (MAGC3_HUMAN)
YYDALKDM

SEQ ID NO: 109435 - protein, 9 aa, Artificial Sequence
  Description of Artificial Sequence: Synthetic peptide
  Seed: IIPSAFPSW (MAGC3_HUMAN)
IYPSAFPSY

SEQ ID NO: 109436 - protein, 9 aa, Artificial Sequence
  Description of Artificial Sequence: Synthetic peptide
  Seed: MPAAGMPPL (MAGC3_HUMAN)
MVAAGMPPA

SEQ ID NO: 109437 - protein, 9 aa, Artificial Sequence
  Description of Artificial Sequence: Synthetic peptide
  Seed: AVSPGKRLW (MAGC3_HUMAN)
AISPGKRLF

SEQ ID NO: 109438 - protein, 9 aa, Artificial Sequence
  Description of Artificial Sequence: Synthetic peptide
  Seed: EFLSKLSSI (MAGC3_HUMAN)
EYLSKLSSF

SEQ ID NO: 109439 - protein, 9 aa, Artificial Sequence
  Description of Artificial Sequence: Synthetic peptide
  Seed: MIFGKAHEF (MAGC3_HUMAN)
MYFGKAHEL

SEQ ID NO: 109440 - protein, 10 aa, Artificial Sequence
  Description of Artificial Sequence: Synthetic peptide
  Seed: MPAAGMPPLP (MAGC3_HUMAN)
MKAAGMPPLY

SEQ ID NO: 109441 - protein, 9 aa, Artificial Sequence
  Description of Artificial Sequence: Synthetic peptide
  Seed: EAFCEESGL (MAGC3_HUMAN)
ELFCEESGR

SEQ ID NO: 109442 - protein, 10 aa, Artificial Sequence
  Description of Artificial Sequence: Synthetic peptide
  Seed: LLKYQAKEPL (MAGC3_HUMAN)
LMKYQAKEPF

SEQ ID NO: 109443 - protein, 9 aa, Artificial Sequence
  Description of Artificial Sequence: Synthetic peptide
  Seed: TTDDATAMA (MAGC3_HUMAN)
TVDDATAMF

SEQ ID NO: 109444 - protein, 10 aa, Artificial Sequence
  Description of Artificial Sequence: Synthetic peptide
  Seed: REVRLFLRGG (MAGC3_HUMAN)
RSVRLFLRGV

SEQ ID NO: 109445 - protein, 10 aa, Artificial Sequence
  Description of Artificial Sequence: Synthetic peptide
  Seed: SKLSSIIPSA (MAGC3_HUMAN)
SFLSSIIPSI

SEQ ID NO: 109446 - protein, 9 aa, Artificial Sequence
  Description of Artificial Sequence: Synthetic peptide
  Seed: KGSCVPEEV (MAGC3_HUMAN)
KISCVPEEV

SEQ ID NO: 109447 - protein, 9 aa, Artificial Sequence
  Description of Artificial Sequence: Synthetic peptide
  Seed: LTEASPQQK (MAGC3_HUMAN)
LIEASPQQY

SEQ ID NO: 109448 - protein, 9 aa, Artificial Sequence
  Description of Artificial Sequence: Synthetic peptide
  Seed: LVQFLLLKY (MAGC3_HUMAN)
LYQFLLLKY

SEQ ID NO: 109449 - protein, 9 aa, Artificial Sequence
  Description of Artificial Sequence: Synthetic peptide
  Seed: EVLEFLSKL (MAGC3_HUMAN)
EALEFLSKI

SEQ ID NO: 109450 - protein, 9 aa, Artificial Sequence
  Description of Artificial Sequence: Synthetic peptide
  Seed: SAFHLGHLR (MAGC3_HUMAN)
SMFHLGHLF

SEQ ID NO: 109451 - protein, 9 aa, Artificial Sequence
  Description of Artificial Sequence: Synthetic peptide
  Seed: KEPLTRAEM (MAGC3_HUMAN)
KAPLTRAEM

SEQ ID NO: 109452 - protein, 10 aa, Artificial Sequence
  Description of Artificial Sequence: Synthetic peptide
  Seed: SAIGPIQRPA (MAGC3_HUMAN)
SAIGPIQRPL

SEQ ID NO: 109453 - protein, 9 aa, Artificial Sequence
  Description of Artificial Sequence: Synthetic peptide
  Seed: LIDDQGMPK (MAGC3_HUMAN)
LCDDQGMPI

SEQ ID NO: 109454 - protein, 9 aa, Artificial Sequence
  Description of Artificial Sequence: Synthetic peptide
  Seed: ELVQFLLLK (MAGC3_HUMAN)
EAVQFLLLR

SEQ ID NO: 109455 - protein, 9 aa, Artificial Sequence
  Description of Artificial Sequence: Synthetic peptide
  Seed: QTKEPVTKA (MAGC3_HUMAN)
QIKEPVTKF

SEQ ID NO: 109456 - protein, 9 aa, Artificial Sequence
  Description of Artificial Sequence: Synthetic peptide
  Seed: YALDEKVAE (MAGC3_HUMAN)
YALDEKVAF

SEQ ID NO: 109457 - protein, 8 aa, Artificial Sequence
  Description of Artificial Sequence: Synthetic peptide
  Seed: FADVLSRL (MAGC3_HUMAN)
FYDVLSRM

SEQ ID NO: 109458 - protein, 10 aa, Artificial Sequence
  Description of Artificial Sequence: Synthetic peptide
  Seed: FPSWYMDALK (MAGC3_HUMAN)
FASWYMDALK

SEQ ID NO: 109459 - protein, 10 aa, Artificial Sequence
  Description of Artificial Sequence: Synthetic peptide
  Seed: YALDEKVAEL (MAGC3_HUMAN)
YILDEKVAEA

SEQ ID NO: 109460 - protein, 9 aa, Artificial Sequence
  Description of Artificial Sequence: Synthetic peptide
  Seed: QTKEPVTKA (MAGC3_HUMAN)
QLKEPVTKR

SEQ ID NO: 109461 - protein, 9 aa, Artificial Sequence
  Description of Artificial Sequence: Synthetic peptide
  Seed: EVLNAIGPW (MAGC3_HUMAN)
EVLNAIGPR

SEQ ID NO: 109462 - protein, 9 aa, Artificial Sequence
  Description of Artificial Sequence: Synthetic peptide
  Seed: SPSVMSTNF (MAGC3_HUMAN)
SQSVMSTNF

SEQ ID NO: 109463 - protein, 10 aa, Artificial Sequence
  Description of Artificial Sequence: Synthetic peptide
  Seed: LNAIGPWSAL (MAGC3_HUMAN)
LIAIGPWSAL

SEQ ID NO: 109464 - protein, 9 aa, Artificial Sequence
  Description of Artificial Sequence: Synthetic peptide
  Seed: LDLANPQGL (MAGC3_HUMAN)
LELANPQGL

SEQ ID NO: 109465 - protein, 10 aa, Artificial Sequence
  Description of Artificial Sequence: Synthetic peptide
  Seed: RRGTGYTLSL (MAGC3_HUMAN)
RRGTGYTLSV

SEQ ID NO: 109466 - protein, 9 aa, Artificial Sequence
  Description of Artificial Sequence: Synthetic peptide
  Seed: QDWPLNEKR (MAGC3_HUMAN)
QYWPLNEKR

SEQ ID NO: 109467 - protein, 10 aa, Artificial Sequence
  Description of Artificial Sequence: Synthetic peptide
  Seed: SALAGFADVL (MAGC3_HUMAN)
SNLAGFADVV

SEQ ID NO: 109468 - protein, 10 aa, Artificial Sequence
  Description of Artificial Sequence: Synthetic peptide
  Seed: WEVLSAIGPI (MAGC3_HUMAN)
WMVLSAIGPI

SEQ ID NO: 109469 - protein, 10 aa, Artificial Sequence
  Description of Artificial Sequence: Synthetic peptide
  Seed: AMASASPSVM (MAGC3_HUMAN)
AVASASPSVF

SEQ ID NO: 109470 - protein, 9 aa, Artificial Sequence
  Description of Artificial Sequence: Synthetic peptide
  Seed: ISPQGPPQS (MAGC3_HUMAN)
IIPQGPPQV

SEQ ID NO: 109471 - protein, 9 aa, Artificial Sequence
  Description of Artificial Sequence: Synthetic peptide
  Seed: EVLSAIGPI (MAGC3_HUMAN)
EVLSAIGPY

SEQ ID NO: 109472 - protein, 9 aa, Artificial Sequence
  Description of Artificial Sequence: Synthetic peptide
  Seed: FADVLSRLA (MAGC3_HUMAN)
FWDVLSRLF

SEQ ID NO: 109473 - protein, 10 aa, Artificial Sequence
  Description of Artificial Sequence: Synthetic peptide
  Seed: MIFRKAREFI (MAGC3_HUMAN)
MLFRKAREFK

SEQ ID NO: 109474 - protein, 10 aa, Artificial Sequence
  Description of Artificial Sequence: Synthetic peptide
  Seed: MNVINTYTGY (MAGC3_HUMAN)
MQVINTYTGM

SEQ ID NO: 109475 - protein, 9 aa, Artificial Sequence
  Description of Artificial Sequence: Synthetic peptide
  Seed: TLDEKVDKL (MAGC3_HUMAN)
TYDEKVDKC

SEQ ID NO: 109476 - protein, 9 aa, Artificial Sequence
  Description of Artificial Sequence: Synthetic peptide
  Seed: FFEDTLDLT (MAGC3_HUMAN)
FYEDTLDLF

SEQ ID NO: 109477 - protein, 9 aa, Artificial Sequence
  Description of Artificial Sequence: Synthetic peptide
  Seed: MDPDNHSYF (MAGC3_HUMAN)
MVPDNHSYM

SEQ ID NO: 109478 - protein, 9 aa, Artificial Sequence
  Description of Artificial Sequence: Synthetic peptide
  Seed: NAIGPWSAL (MAGC3_HUMAN)
NQIGPWSAV

SEQ ID NO: 109479 - protein, 10 aa, Artificial Sequence
  Description of Artificial Sequence: Synthetic peptide
  Seed: HLREVRLFLR (MAGC3_HUMAN)
HVREVRLFLR

SEQ ID NO: 109480 - protein, 10 aa, Artificial Sequence
  Description of Artificial Sequence: Synthetic peptide
  Seed: MDPDNHSYFF (MAGC3_HUMAN)
MRPDNHSYFW

SEQ ID NO: 109481 - protein, 9 aa, Artificial Sequence
  Description of Artificial Sequence: Synthetic peptide
  Seed: SAFHLGHLR (MAGC3_HUMAN)
SYFHLGHLF

SEQ ID NO: 109482 - protein, 10 aa, Artificial Sequence
  Description of Artificial Sequence: Synthetic peptide
  Seed: YALSPVVLPP (MAGC3_HUMAN)
YKLSPVVLPL

SEQ ID NO: 109483 - protein, 10 aa, Artificial Sequence
  Description of Artificial Sequence: Synthetic peptide
  Seed: YTGYFPMIFR (MAGC3_HUMAN)
YRGYFPMIFR

SEQ ID NO: 109484 - protein, 9 aa, Artificial Sequence
  Description of Artificial Sequence: Synthetic peptide
  Seed: TTDDATAMA (MAGC3_HUMAN)
TFDDATAMF

SEQ ID NO: 109485 - protein, 9 aa, Artificial Sequence
  Description of Artificial Sequence: Synthetic peptide
  Seed: KVAELVQFL (MAGC3_HUMAN)
KNAELVQFI

SEQ ID NO: 109486 - protein, 10 aa, Artificial Sequence
  Description of Artificial Sequence: Synthetic peptide
  Seed: MNVINTYTGY (MAGC3_HUMAN)
MTVINTYTGY

SEQ ID NO: 109487 - protein, 10 aa, Artificial Sequence
  Description of Artificial Sequence: Synthetic peptide
  Seed: TAMASASPSV (MAGC3_HUMAN)
TVMASASPSI

SEQ ID NO: 109488 - protein, 10 aa, Artificial Sequence
  Description of Artificial Sequence: Synthetic peptide
  Seed: GHLREVRLFL (MAGC3_HUMAN)
GLLREVRLFV

SEQ ID NO: 109489 - protein, 9 aa, Artificial Sequence
  Description of Artificial Sequence: Synthetic peptide
  Seed: FSLRRAVSV (MAGC3_HUMAN)
FMLRRAVSV

SEQ ID NO: 109490 - protein, 10 aa, Artificial Sequence
  Description of Artificial Sequence: Synthetic peptide
  Seed: MPAAGMPPLP (MAGC3_HUMAN)
MAAAGMPPLY

SEQ ID NO: 109491 - protein, 9 aa, Artificial Sequence
  Description of Artificial Sequence: Synthetic peptide
  Seed: VDPDHFYVF (MAGC3_HUMAN)
VEPDHFYVL

SEQ ID NO: 109492 - protein, 10 aa, Artificial Sequence
  Description of Artificial Sequence: Synthetic peptide
  Seed: SDQRMDSLVL (MAGC3_HUMAN)
SHQRMDSLVF

SEQ ID NO: 109493 - protein, 10 aa, Artificial Sequence
  Description of Artificial Sequence: Synthetic peptide
  Seed: MDPDNHSYFF (MAGC3_HUMAN)
MIPDNHSYFW

SEQ ID NO: 109494 - protein, 10 aa, Artificial Sequence
  Description of Artificial Sequence: Synthetic peptide
  Seed: LDSCSSPLLW (MAGC3_HUMAN)
LNSCSSPLLF

SEQ ID NO: 109495 - protein, 11 aa, Artificial Sequence
  Description of Artificial Sequence: Synthetic peptide
  Seed: REVLEFLSKLS (MAGC3_HUMAN)
REVLEFLSKLL

SEQ ID NO: 109496 - protein, 9 aa, Artificial Sequence
  Description of Artificial Sequence: Synthetic peptide
  Seed: LWGEKAGSL (MAGC3_HUMAN)
LIGEKAGSL

SEQ ID NO: 109497 - protein, 9 aa, Artificial Sequence
  Description of Artificial Sequence: Synthetic peptide
  Seed: VDPDHFYVF (MAGC3_HUMAN)
VMPDHFYVI

SEQ ID NO: 109498 - protein, 9 aa, Artificial Sequence
  Description of Artificial Sequence: Synthetic peptide
  Seed: TLDEKVDKL (MAGC3_HUMAN)
TLDEKVDKI

SEQ ID NO: 109499 - protein, 10 aa, Artificial Sequence
  Description of Artificial Sequence: Synthetic peptide
  Seed: KLSSIIPSAF (MAGC3_HUMAN)
KMSSIIPSAF

SEQ ID NO: 109500 - protein, 9 aa, Artificial Sequence
  Description of Artificial Sequence: Synthetic peptide
  Seed: ALDEKVAEL (MAGC3_HUMAN)
AGDEKVAEF

SEQ ID NO: 109501 - protein, 9 aa, Artificial Sequence
  Description of Artificial Sequence: Synthetic peptide
  Seed: IELIFGIAL (MAGC3_HUMAN)
IQLIFGIAV

SEQ ID NO: 109502 - protein, 11 aa, Artificial Sequence
  Description of Artificial Sequence: Synthetic peptide
  Seed: FPMIFGKAHEF (MAGC3_HUMAN)
FPMIFGKAHEI

SEQ ID NO: 109503 - protein, 9 aa, Artificial Sequence
  Description of Artificial Sequence: Synthetic peptide
  Seed: TSDQRMDSL (MAGC3_HUMAN)
TEDQRMDSL

SEQ ID NO: 109504 - protein, 9 aa, Artificial Sequence
  Description of Artificial Sequence: Synthetic peptide
  Seed: YTGYFPMIF (MAGC3_HUMAN)
YPGYFPMIM

SEQ ID NO: 109505 - protein, 10 aa, Artificial Sequence
  Description of Artificial Sequence: Synthetic peptide
  Seed: CSSPLLWTRL (MAGC3_HUMAN)
CTSPLLWTRW

SEQ ID NO: 109506 - protein, 11 aa, Artificial Sequence
  Description of Artificial Sequence: Synthetic peptide
  Seed: LTDMDPDNHSY (MAGC3_HUMAN)
LVDMDPDNHSL

SEQ ID NO: 109507 - protein, 10 aa, Artificial Sequence
  Description of Artificial Sequence: Synthetic peptide
  Seed: EVIWEVLNAI (MAGC3_HUMAN)
EVIWEVLNAW

SEQ ID NO: 109508 - protein, 9 aa, Artificial Sequence
  Description of Artificial Sequence: Synthetic peptide
  Seed: KVDKLVQFL (MAGC3_HUMAN)
KMDKLVQFA

SEQ ID NO: 109509 - protein, 9 aa, Artificial Sequence
  Description of Artificial Sequence: Synthetic peptide
  Seed: FPMIFGKAH (MAGC3_HUMAN)
FPMIFGKAP

SEQ ID NO: 109510 - protein, 11 aa, Artificial Sequence
  Description of Artificial Sequence: Synthetic peptide
  Seed: KGNCASEEVIW (MAGC3_HUMAN)
KSNCASEEVIW

SEQ ID NO: 109511 - protein, 10 aa, Artificial Sequence
  Description of Artificial Sequence: Synthetic peptide
  Seed: RSAEGSVLDL (MAGC3_HUMAN)
RTAEGSVLDY

SEQ ID NO: 109512 - protein, 9 aa, Artificial Sequence
  Description of Artificial Sequence: Synthetic peptide
  Seed: HSYFFEDTL (MAGC3_HUMAN)
HRYFFEDTF

SEQ ID NO: 109513 - protein, 9 aa, Artificial Sequence
  Description of Artificial Sequence: Synthetic peptide
  Seed: MIFRKAREF (MAGC3_HUMAN)
MIFRKAREM

SEQ ID NO: 109514 - protein, 9 aa, Artificial Sequence
  Description of Artificial Sequence: Synthetic peptide
  Seed: MPAAGMPPL (MAGC3_HUMAN)
MSAAGMPPV

SEQ ID NO: 109515 - protein, 11 aa, Artificial Sequence
  Description of Artificial Sequence: Synthetic peptide
  Seed: TSDQRMDSLVL (MAGC3_HUMAN)
TPDQRMDSLVF

SEQ ID NO: 109516 - protein, 9 aa, Artificial Sequence
  Description of Artificial Sequence: Synthetic peptide
  Seed: GKFSLRRAV (MAGC3_HUMAN)
GMFSLRRAF

SEQ ID NO: 109517 - protein, 11 aa, Artificial Sequence
  Description of Artificial Sequence: Synthetic peptide
  Seed: HALPESESLPR (MAGC3_HUMAN)
HALPESESLPL

SEQ ID NO: 109518 - protein, 9 aa, Artificial Sequence
  Description of Artificial Sequence: Synthetic peptide
  Seed: QTKEPVTKA (MAGC3_HUMAN)
QSKEPVTKF

SEQ ID NO: 109519 - protein, 9 aa, Artificial Sequence
  Description of Artificial Sequence: Synthetic peptide
  Seed: MPAAGMPPL (MAGC3_HUMAN)
MMAAGMPPI

SEQ ID NO: 109520 - protein, 9 aa, Artificial Sequence
  Description of Artificial Sequence: Synthetic peptide
  Seed: SQPEGKFSL (MAGC3_HUMAN)
SLPEGKFSA

SEQ ID NO: 109521 - protein, 9 aa, Artificial Sequence
  Description of Artificial Sequence: Synthetic peptide
  Seed: SASPSVMST (MAGC3_HUMAN)
SLSPSVMSL

SEQ ID NO: 109522 - protein, 9 aa, Artificial Sequence
  Description of Artificial Sequence: Synthetic peptide
  Seed: LSAIGPIQR (MAGC3_HUMAN)
LMAIGPIQK

SEQ ID NO: 109523 - protein, 9 aa, Artificial Sequence
  Description of Artificial Sequence: Synthetic peptide
  Seed: LILILSMIF (MAGC3_HUMAN)
LQLILSMIF

SEQ ID NO: 109524 - protein, 10 aa, Artificial Sequence
  Description of Artificial Sequence: Synthetic peptide
  Seed: NVINTYTGYF (MAGC3_HUMAN)
NQINTYTGYY

SEQ ID NO: 109525 - protein, 10 aa, Artificial Sequence
  Description of Artificial Sequence: Synthetic peptide
  Seed: EKVAELVQFL (MAGC3_HUMAN)
EMVAELVQFI

SEQ ID NO: 109526 - protein, 9 aa, Artificial Sequence
  Description of Artificial Sequence: Synthetic peptide
  Seed: HLREVRLFL (MAGC3_HUMAN)
HTREVRLFK

SEQ ID NO: 109527 - protein, 9 aa, Artificial Sequence
  Description of Artificial Sequence: Synthetic peptide
  Seed: MIFRKAREF (MAGC3_HUMAN)
MQFRKAREL

SEQ ID NO: 109528 - protein, 9 aa, Artificial Sequence
  Description of Artificial Sequence: Synthetic peptide
  Seed: QTKEPVTKA (MAGC3_HUMAN)
QMKEPVTKL

SEQ ID NO: 109529 - protein, 10 aa, Artificial Sequence
  Description of Artificial Sequence: Synthetic peptide
  Seed: SYFFEDTLDL (MAGC3_HUMAN)
SYFFEDTLDI

SEQ ID NO: 109530 - protein, 11 aa, Artificial Sequence
  Description of Artificial Sequence: Synthetic peptide
  Seed: LIDDQGMPKNC (MAGC3_HUMAN)
LVDDQGMPKNM

SEQ ID NO: 109531 - protein, 10 aa, Artificial Sequence
  Description of Artificial Sequence: Synthetic peptide
  Seed: YALSPVVLPP (MAGC3_HUMAN)
YQLSPVVLPM

SEQ ID NO: 109532 - protein, 9 aa, Artificial Sequence
  Description of Artificial Sequence: Synthetic peptide
  Seed: FADVLSRLA (MAGC3_HUMAN)
FSDVLSRLI

SEQ ID NO: 109533 - protein, 9 aa, Artificial Sequence
  Description of Artificial Sequence: Synthetic peptide
  Seed: KVDKLVQFL (MAGC3_HUMAN)
KQDKLVQFF

SEQ ID NO: 109534 - protein, 8 aa, Artificial Sequence
  Description of Artificial Sequence: Synthetic peptide
  Seed: YMDALKDM (MAGC3_HUMAN)
YVDALKDI

SEQ ID NO: 109535 - protein, 9 aa, Artificial Sequence
  Description of Artificial Sequence: Synthetic peptide
  Seed: QTKEPVTKA (MAGC3_HUMAN)
QSKEPVTKR

SEQ ID NO: 109536 - protein, 9 aa, Artificial Sequence
  Description of Artificial Sequence: Synthetic peptide
  Seed: EVLEFLSKL (MAGC3_HUMAN)
EMLEFLSKL

SEQ ID NO: 109537 - protein, 10 aa, Artificial Sequence
  Description of Artificial Sequence: Synthetic peptide
  Seed: TGYFPMIFRK (MAGC3_HUMAN)
TRYFPMIFRR

SEQ ID NO: 109538 - protein, 10 aa, Artificial Sequence
  Description of Artificial Sequence: Synthetic peptide
  Seed: VVLPPQPQPR (MAGC3_HUMAN)
VALPPQPQPL

SEQ ID NO: 109539 - protein, 8 aa, Artificial Sequence
  Description of Artificial Sequence: Synthetic peptide
  Seed: YMDALKDM (MAGC3_HUMAN)
YADALKDV

SEQ ID NO: 109540 - protein, 11 aa, Artificial Sequence
  Description of Artificial Sequence: Synthetic peptide
  Seed: LHFGSQPEGKF (MAGC3_HUMAN)
LMFGSQPEGKF

SEQ ID NO: 109541 - protein, 9 aa, Artificial Sequence
  Description of Artificial Sequence: Synthetic peptide
  Seed: FSDGSLGQW (MAGC3_HUMAN)
FNDGSLGQF

SEQ ID NO: 109542 - protein, 9 aa, Artificial Sequence
  Description of Artificial Sequence: Synthetic peptide
  Seed: SLPESEPLF (MAGC3_HUMAN)
SFPESEPLL

SEQ ID NO: 109543 - protein, 9 aa, Artificial Sequence
  Description of Artificial Sequence: Synthetic peptide
  Seed: MIFRKAREF (MAGC3_HUMAN)
MMFRKAREM

SEQ ID NO: 109544 - protein, 8 aa, Artificial Sequence
  Description of Artificial Sequence: Synthetic peptide
  Seed: SGSPGLQL (MAGC3_HUMAN)
SASPGLQI

SEQ ID NO: 109545 - protein, 9 aa, Artificial Sequence
  Description of Artificial Sequence: Synthetic peptide
  Seed: ATDKDYSAF (MAGC3_HUMAN)
AADKDYSAW

SEQ ID NO: 109546 - protein, 11 aa, Artificial Sequence
  Description of Artificial Sequence: Synthetic peptide
  Seed: KKYKDYFPMIF (MAGC3_HUMAN)
KMYKDYFPMIY

SEQ ID NO: 109547 - protein, 9 aa, Artificial Sequence
  Description of Artificial Sequence: Synthetic peptide
  Seed: TSDQRMDSL (MAGC3_HUMAN)
TQDQRMDSL

SEQ ID NO: 109548 - protein, 9 aa, Artificial Sequence
  Description of Artificial Sequence: Synthetic peptide
  Seed: KAHEFIELI (MAGC3_HUMAN)
KLHEFIELF

SEQ ID NO: 109549 - protein, 11 aa, Artificial Sequence
  Description of Artificial Sequence: Synthetic peptide
  Seed: LSKLSSIIPSA (MAGC3_HUMAN)
LGKLSSIIPSI

SEQ ID NO: 109550 - protein, 9 aa, Artificial Sequence
  Description of Artificial Sequence: Synthetic peptide
  Seed: IPPQGPPKI (MAGC3_HUMAN)
IFPQGPPKM

SEQ ID NO: 109551 - protein, 10 aa, Artificial Sequence
  Description of Artificial Sequence: Synthetic peptide
  Seed: IELIFGIALT (MAGC3_HUMAN)
IDLIFGIALI

SEQ ID NO: 109552 - protein, 9 aa, Artificial Sequence
  Description of Artificial Sequence: Synthetic peptide
  Seed: KDSDLPTWR (MAGC3_HUMAN)
KISDLPTWR

SEQ ID NO: 109553 - protein, 8 aa, Artificial Sequence
  Description of Artificial Sequence: Synthetic peptide
  Seed: KAHEFIEL (MAGC3_HUMAN)
KTHEFIEW

SEQ ID NO: 109554 - protein, 9 aa, Artificial Sequence
  Description of Artificial Sequence: Synthetic peptide
  Seed: NAIGPWSAL (MAGC3_HUMAN)
NFIGPWSAL

SEQ ID NO: 109555 - protein, 9 aa, Artificial Sequence
  Description of Artificial Sequence: Synthetic peptide
  Seed: MDPDNHSYF (MAGC3_HUMAN)
MGPDNHSYL

SEQ ID NO: 109556 - protein, 9 aa, Artificial Sequence
  Description of Artificial Sequence: Synthetic peptide
  Seed: GKFSLRRAV (MAGC3_HUMAN)
GKFSLRRAY

SEQ ID NO: 109557 - protein, 9 aa, Artificial Sequence
  Description of Artificial Sequence: Synthetic peptide
  Seed: VIWEVLSAI (MAGC3_HUMAN)
VSWEVLSAF

SEQ ID NO: 109558 - protein, 9 aa, Artificial Sequence
  Description of Artificial Sequence: Synthetic peptide
  Seed: ATDKDYSAF (MAGC3_HUMAN)
AVDKDYSAV

SEQ ID NO: 109559 - protein, 9 aa, Artificial Sequence
  Description of Artificial Sequence: Synthetic peptide
  Seed: EVIWEVLNA (MAGC3_HUMAN)
ETIWEVLNT

SEQ ID NO: 109560 - protein, 9 aa, Artificial Sequence
  Description of Artificial Sequence: Synthetic peptide
  Seed: SASPSVMST (MAGC3_HUMAN)
STSPSVMSH

SEQ ID NO: 109561 - protein, 9 aa, Artificial Sequence
  Description of Artificial Sequence: Synthetic peptide
  Seed: KLVQFLLLK (MAGC3_HUMAN)
KTVQFLLLH

SEQ ID NO: 109562 - protein, 9 aa, Artificial Sequence
  Description of Artificial Sequence: Synthetic peptide
  Seed: MPKNCLLIL (MAGC3_HUMAN)
MAKNCLLIF

SEQ ID NO: 109563 - protein, 9 aa, Artificial Sequence
  Description of Artificial Sequence: Synthetic peptide
  Seed: GLQLSDLHF (MAGC3_HUMAN)
GMQLSDLHY

SEQ ID NO: 109564 - protein, 9 aa, Artificial Sequence
  Description of Artificial Sequence: Synthetic peptide
  Seed: YALSPVVLP (MAGC3_HUMAN)
YSLSPVVLM

SEQ ID NO: 109565 - protein, 10 aa, Artificial Sequence
  Description of Artificial Sequence: Synthetic peptide
  Seed: RMDSLVLCPT (MAGC3_HUMAN)
RLDSLVLCPL

SEQ ID NO: 109566 - protein, 9 aa, Artificial Sequence
  Description of Artificial Sequence: Synthetic peptide
  Seed: YFFEDTLDL (MAGC3_HUMAN)
YYFEDTLDM

SEQ ID NO: 109567 - protein, 10 aa, Artificial Sequence
  Description of Artificial Sequence: Synthetic peptide
  Seed: ALDEKVAELV (MAGC3_HUMAN)
ASDEKVAELM

SEQ ID NO: 109568 - protein, 9 aa, Artificial Sequence
  Description of Artificial Sequence: Synthetic peptide
  Seed: MLTTVIKKY (MAGC3_HUMAN)
MATTVIKKM

SEQ ID NO: 109569 - protein, 10 aa, Artificial Sequence
  Description of Artificial Sequence: Synthetic peptide
  Seed: SSEEEDTATW (MAGC3_HUMAN)
SLEEEDTATY

SEQ ID NO: 109570 - protein, 10 aa, Artificial Sequence
  Description of Artificial Sequence: Synthetic peptide
  Seed: ALDEKVAELV (MAGC3_HUMAN)
AIDEKVAELI

SEQ ID NO: 109571 - protein, 10 aa, Artificial Sequence
  Description of Artificial Sequence: Synthetic peptide
  Seed: MNVINTYTGY (MAGC3_HUMAN)
MRVINTYTGR

SEQ ID NO: 109572 - protein, 10 aa, Artificial Sequence
  Description of Artificial Sequence: Synthetic peptide
  Seed: MPAAGMPPLP (MAGC3_HUMAN)
MLAAGMPPLY

SEQ ID NO: 109573 - protein, 10 aa, Artificial Sequence
  Description of Artificial Sequence: Synthetic peptide
  Seed: MDPDNHSYFF (MAGC3_HUMAN)
MVPDNHSYFY

SEQ ID NO: 109574 - protein, 10 aa, Artificial Sequence
  Description of Artificial Sequence: Synthetic peptide
  Seed: YALDEKVAEL (MAGC3_HUMAN)
YNLDEKVAEI

SEQ ID NO: 109575 - protein, 10 aa, Artificial Sequence
  Description of Artificial Sequence: Synthetic peptide
  Seed: YQAKEPLTRA (MAGC3_HUMAN)
YLAKEPLTRM

SEQ ID NO: 109576 - protein, 9 aa, Artificial Sequence
  Description of Artificial Sequence: Synthetic peptide
  Seed: LKYQTKEPV (MAGC3_HUMAN)
LQYQTKEPH

SEQ ID NO: 109577 - protein, 10 aa, Artificial Sequence
  Description of Artificial Sequence: Synthetic peptide
  Seed: RLWGEKAGSL (MAGC3_HUMAN)
RQWGEKAGSM

SEQ ID NO: 109578 - protein, 9 aa, Artificial Sequence
  Description of Artificial Sequence: Synthetic peptide
  Seed: AIGPWSALA (MAGC3_HUMAN)
AQGPWSALV

SEQ ID NO: 109579 - protein, 9 aa, Artificial Sequence
  Description of Artificial Sequence: Synthetic peptide
  Seed: IQRPAREVL (MAGC3_HUMAN)
ILRPAREVF

SEQ ID NO: 109580 - protein, 8 aa, Artificial Sequence
  Description of Artificial Sequence: Synthetic peptide
  Seed: KVDKLVQF (MAGC3_HUMAN)
KTDKLVQM

SEQ ID NO: 109581 - protein, 11 aa, Artificial Sequence
  Description of Artificial Sequence: Synthetic peptide
  Seed: ATFSDGSLGQW (MAGC3_HUMAN)
AQFSDGSLGQW

SEQ ID NO: 109582 - protein, 10 aa, Artificial Sequence
  Description of Artificial Sequence: Synthetic peptide
  Seed: LILILSMIFI (MAGC3_HUMAN)
LTLILSMIFV

SEQ ID NO: 109583 - protein, 9 aa, Artificial Sequence
  Description of Artificial Sequence: Synthetic peptide
  Seed: LIDDQGMPK (MAGC3_HUMAN)
LNDDQGMPV

SEQ ID NO: 109584 - protein, 9 aa, Artificial Sequence
  Description of Artificial Sequence: Synthetic peptide
  Seed: YALDEKVAE (MAGC3_HUMAN)
YALDEKVAL

SEQ ID NO: 109585 - protein, 10 aa, Artificial Sequence
  Description of Artificial Sequence: Synthetic peptide
  Seed: LPTWRRGTGY (MAGC3_HUMAN)
LQTWRRGTGW

SEQ ID NO: 109586 - protein, 10 aa, Artificial Sequence
  Description of Artificial Sequence: Synthetic peptide
  Seed: YSAFHLGHLR (MAGC3_HUMAN)
YTAFHLGHLR

SEQ ID NO: 109587 - protein, 9 aa, Artificial Sequence
  Description of Artificial Sequence: Synthetic peptide
  Seed: KVDKLVQFL (MAGC3_HUMAN)
KADKLVQFL

SEQ ID NO: 109588 - protein, 9 aa, Artificial Sequence
  Description of Artificial Sequence: Synthetic peptide
  Seed: RPAREVLEF (MAGC3_HUMAN)
RYAREVLEF

SEQ ID NO: 109589 - protein, 9 aa, Artificial Sequence
  Description of Artificial Sequence: Synthetic peptide
  Seed: HLREVRLFL (MAGC3_HUMAN)
HAREVRLFL

SEQ ID NO: 109590 - protein, 9 aa, Artificial Sequence
  Description of Artificial Sequence: Synthetic peptide
  Seed: MDPDNHSYF (MAGC3_HUMAN)
MTPDNHSYL

SEQ ID NO: 109591 - protein, 9 aa, Artificial Sequence
  Description of Artificial Sequence: Synthetic peptide
  Seed: TGYTLSLPA (MAGC3_HUMAN)
TPYTLSLPS

SEQ ID NO: 109592 - protein, 10 aa, Artificial Sequence
  Description of Artificial Sequence: Synthetic peptide
  Seed: FKLWRTLSGS (MAGC3_HUMAN)
FALWRTLSGM

SEQ ID NO: 109593 - protein, 10 aa, Artificial Sequence
  Description of Artificial Sequence: Synthetic peptide
  Seed: REVRLFLRGG (MAGC3_HUMAN)
RNVRLFLRGI

SEQ ID NO: 109594 - protein, 10 aa, Artificial Sequence
  Description of Artificial Sequence: Synthetic peptide
  Seed: YSAFHLGHLR (MAGC3_HUMAN)
YGAFHLGHLK

SEQ ID NO: 109595 - protein, 9 aa, Artificial Sequence
  Description of Artificial Sequence: Synthetic peptide
  Seed: AEMQMNVIN (MAGC3_HUMAN)
AEMQMNVIT

SEQ ID NO: 109596 - protein, 10 aa, Artificial Sequence
  Description of Artificial Sequence: Synthetic peptide
  Seed: MQMNVINTYT (MAGC3_HUMAN)
MNMNVINTYL

SEQ ID NO: 109597 - protein, 9 aa, Artificial Sequence
  Description of Artificial Sequence: Synthetic peptide
  Seed: MQMNVINTY (MAGC3_HUMAN)
MTMNVINTV

SEQ ID NO: 109598 - protein, 9 aa, Artificial Sequence
  Description of Artificial Sequence: Synthetic peptide
  Seed: HSYFFEDTL (MAGC3_HUMAN)
HHYFFEDTL

SEQ ID NO: 109599 - protein, 9 aa, Artificial Sequence
  Description of Artificial Sequence: Synthetic peptide
  Seed: KGSCVPEEV (MAGC3_HUMAN)
KQSCVPEEM

SEQ ID NO: 109600 - protein, 9 aa, Artificial Sequence
  Description of Artificial Sequence: Synthetic peptide
  Seed: YKDYFPMIF (MAGC3_HUMAN)
YKDYFPMIM

SEQ ID NO: 109601 - protein, 11 aa, Artificial Sequence
  Description of Artificial Sequence: Synthetic peptide
  Seed: LTDMDPDNHSY (MAGC3_HUMAN)
LTDMDPDNHSW

SEQ ID NO: 109602 - protein, 9 aa, Artificial Sequence
  Description of Artificial Sequence: Synthetic peptide
  Seed: QGMPKNCLL (MAGC3_HUMAN)
QAMPKNCLL

SEQ ID NO: 109603 - protein, 9 aa, Artificial Sequence
  Description of Artificial Sequence: Synthetic peptide
  Seed: NTYTGYFPM (MAGC3_HUMAN)
NQYTGYFPM

SEQ ID NO: 109604 - protein, 10 aa, Artificial Sequence
  Description of Artificial Sequence: Synthetic peptide
  Seed: KLSSIIPSAF (MAGC3_HUMAN)
KWSSIIPSAW

SEQ ID NO: 109605 - protein, 10 aa, Artificial Sequence
  Description of Artificial Sequence: Synthetic peptide
  Seed: SLVLCPTYFK (MAGC3_HUMAN)
SEVLCPTYFR

SEQ ID NO: 109606 - protein, 9 aa, Artificial Sequence
  Description of Artificial Sequence: Synthetic peptide
  Seed: DTTDDATAM (MAGC3_HUMAN)
DTTDDATAF

SEQ ID NO: 109607 - protein, 11 aa, Artificial Sequence
  Description of Artificial Sequence: Synthetic peptide
  Seed: KVAELVQFLLL (MAGC3_HUMAN)
KLAELVQFLLD

SEQ ID NO: 109608 - protein, 10 aa, Artificial Sequence
  Description of Artificial Sequence: Synthetic peptide
  Seed: SDQRMDSLVL (MAGC3_HUMAN)
SPQRMDSLVY

SEQ ID NO: 109609 - protein, 9 aa, Artificial Sequence
  Description of Artificial Sequence: Synthetic peptide
  Seed: LIDDQGMPK (MAGC3_HUMAN)
LFDDQGMPL

SEQ ID NO: 109610 - protein, 9 aa, Artificial Sequence
  Description of Artificial Sequence: Synthetic peptide
  Seed: WRRGTGYTL (MAGC3_HUMAN)
WRRGTGYTY

SEQ ID NO: 109611 - protein, 9 aa, Artificial Sequence
  Description of Artificial Sequence: Synthetic peptide
  Seed: MIFGKAHEF (MAGC3_HUMAN)
MMFGKAHER

SEQ ID NO: 109612 - protein, 9 aa, Artificial Sequence
  Description of Artificial Sequence: Synthetic peptide
  Seed: YFFEDTLDL (MAGC3_HUMAN)
YMFEDTLDV

SEQ ID NO: 109613 - protein, 8 aa, Artificial Sequence
  Description of Artificial Sequence: Synthetic peptide
  Seed: FADVLSRL (MAGC3_HUMAN)
FADVLSRF

SEQ ID NO: 109614 - protein, 11 aa, Artificial Sequence
  Description of Artificial Sequence: Synthetic peptide
  Seed: SSEEEDTATWH (MAGC3_HUMAN)
SAEEEDTATWY

SEQ ID NO: 109615 - protein, 10 aa, Artificial Sequence
  Description of Artificial Sequence: Synthetic peptide
  Seed: SIIPSAFPSW (MAGC3_HUMAN)
SYIPSAFPSL

SEQ ID NO: 109616 - protein, 9 aa, Artificial Sequence
  Description of Artificial Sequence: Synthetic peptide
  Seed: VDPDHFYVF (MAGC3_HUMAN)
VCPDHFYVM

SEQ ID NO: 109617 - protein, 10 aa, Artificial Sequence
  Description of Artificial Sequence: Synthetic peptide
  Seed: LPRYALDEKV (MAGC3_HUMAN)
LPRYALDEKM

SEQ ID NO: 109618 - protein, 9 aa, Artificial Sequence
  Description of Artificial Sequence: Synthetic peptide
  Seed: NTYTGYFPM (MAGC3_HUMAN)
NPYTGYFPY

SEQ ID NO: 109619 - protein, 10 aa, Artificial Sequence
  Description of Artificial Sequence: Synthetic peptide
  Seed: MNVINTYTGY (MAGC3_HUMAN)
MHVINTYTGF

SEQ ID NO: 109620 - protein, 9 aa, Artificial Sequence
  Description of Artificial Sequence: Synthetic peptide
  Seed: WRRGTGYTL (MAGC3_HUMAN)
WERGTGYTF

SEQ ID NO: 109621 - protein, 9 aa, Artificial Sequence
  Description of Artificial Sequence: Synthetic peptide
  Seed: FPSWYMDAL (MAGC3_HUMAN)
FVSWYMDAA

SEQ ID NO: 109622 - protein, 9 aa, Artificial Sequence
  Description of Artificial Sequence: Synthetic peptide
  Seed: ATYALSPVV (MAGC3_HUMAN)
AGYALSPVW

SEQ ID NO: 109623 - protein, 9 aa, Artificial Sequence
  Description of Artificial Sequence: Synthetic peptide
  Seed: KYKDYFPMI (MAGC3_HUMAN)
KTKDYFPMT

SEQ ID NO: 109624 - protein, 10 aa, Artificial Sequence
  Description of Artificial Sequence: Synthetic peptide
  Seed: KDYFPMIFGK (MAGC3_HUMAN)
KWYFPMIFGK

SEQ ID NO: 109625 - protein, 9 aa, Artificial Sequence
  Description of Artificial Sequence: Synthetic peptide
  Seed: EVLEFLSKL (MAGC3_HUMAN)
EMLEFLSKF

SEQ ID NO: 109626 - protein, 9 aa, Artificial Sequence
  Description of Artificial Sequence: Synthetic peptide
  Seed: EMLTTVIKK (MAGC3_HUMAN)
EWLTTVIKR

SEQ ID NO: 109627 - protein, 9 aa, Artificial Sequence
  Description of Artificial Sequence: Synthetic peptide
  Seed: IPPQGPPKI (MAGC3_HUMAN)
IPPQGPPKA

SEQ ID NO: 109628 - protein, 9 aa, Artificial Sequence
  Description of Artificial Sequence: Synthetic peptide
  Seed: NVINTYTGY (MAGC3_HUMAN)
NTINTYTGY

SEQ ID NO: 109629 - protein, 9 aa, Artificial Sequence
  Description of Artificial Sequence: Synthetic peptide
  Seed: VLCPTYFKL (MAGC3_HUMAN)
VQCPTYFKL

SEQ ID NO: 109630 - protein, 9 aa, Artificial Sequence
  Description of Artificial Sequence: Synthetic peptide
  Seed: MQMNVINTY (MAGC3_HUMAN)
MVMNVINTF

SEQ ID NO: 109631 - protein, 10 aa, Artificial Sequence
  Description of Artificial Sequence: Synthetic peptide
  Seed: REVLEFLSKL (MAGC3_HUMAN)
RRVLEFLSKV

SEQ ID NO: 109632 - protein, 8 aa, Artificial Sequence
  Description of Artificial Sequence: Synthetic peptide
  Seed: MEDRAQAI (MAGC3_HUMAN)
MLDRAQAM

SEQ ID NO: 109633 - protein, 9 aa, Artificial Sequence
  Description of Artificial Sequence: Synthetic peptide
  Seed: RGTGYTLSL (MAGC3_HUMAN)
RLTGYTLSI

SEQ ID NO: 109634 - protein, 10 aa, Artificial Sequence
  Description of Artificial Sequence: Synthetic peptide
  Seed: KDYFPMIFGK (MAGC3_HUMAN)
KGYFPMIFGR

SEQ ID NO: 109635 - protein, 10 aa, Artificial Sequence
  Description of Artificial Sequence: Synthetic peptide
  Seed: EVIWEVLNAI (MAGC3_HUMAN)
ETIWEVLNAL

SEQ ID NO: 109636 - protein, 9 aa, Artificial Sequence
  Description of Artificial Sequence: Synthetic peptide
  Seed: FADVLSRLA (MAGC3_HUMAN)
FFDVLSRLL

SEQ ID NO: 109637 - protein, 11 aa, Artificial Sequence
  Description of Artificial Sequence: Synthetic peptide
  Seed: YTGYFPMIFRK (MAGC3_HUMAN)
YIGYFPMIFRR

SEQ ID NO: 109638 - protein, 9 aa, Artificial Sequence
  Description of Artificial Sequence: Synthetic peptide
  Seed: EIPPQGPPK (MAGC3_HUMAN)
ETPPQGPPK

SEQ ID NO: 109639 - protein, 10 aa, Artificial Sequence
  Description of Artificial Sequence: Synthetic peptide
  Seed: EEDTATWHAL (MAGC3_HUMAN)
EEDTATWHAW

SEQ ID NO: 109640 - protein, 10 aa, Artificial Sequence
  Description of Artificial Sequence: Synthetic peptide
  Seed: MQMNVINTYT (MAGC3_HUMAN)
MPMNVINTYV

SEQ ID NO: 109641 - protein, 9 aa, Artificial Sequence
  Description of Artificial Sequence: Synthetic peptide
  Seed: KGSCVPEEV (MAGC3_HUMAN)
KMSCVPEEM

SEQ ID NO: 109642 - protein, 9 aa, Artificial Sequence
  Description of Artificial Sequence: Synthetic peptide
  Seed: KVAELVQFL (MAGC3_HUMAN)
KIAELVQFF

SEQ ID NO: 109643 - protein, 9 aa, Artificial Sequence
  Description of Artificial Sequence: Synthetic peptide
  Seed: IQRPAREVL (MAGC3_HUMAN)
IQRPAREVM

SEQ ID NO: 109644 - protein, 8 aa, Artificial Sequence
  Description of Artificial Sequence: Synthetic peptide
  Seed: IQRPAREV (MAGC3_HUMAN)
IARPAREM

SEQ ID NO: 109645 - protein, 9 aa, Artificial Sequence
  Description of Artificial Sequence: Synthetic peptide
  Seed: AIIDTTDDA (MAGC3_HUMAN)
ALIDTTDDL

SEQ ID NO: 109646 - protein, 9 aa, Artificial Sequence
  Description of Artificial Sequence: Synthetic peptide
  Seed: KVAELVQFL (MAGC3_HUMAN)
KTAELVQFY

SEQ ID NO: 109647 - protein, 9 aa, Artificial Sequence
  Description of Artificial Sequence: Synthetic peptide
  Seed: SASPSVMST (MAGC3_HUMAN)
SSSPSVMSV

SEQ ID NO: 109648 - protein, 9 aa, Artificial Sequence
  Description of Artificial Sequence: Synthetic peptide
  Seed: KVAELVQFL (MAGC3_HUMAN)
KTAELVQFW

SEQ ID NO: 109649 - protein, 8 aa, Artificial Sequence
  Description of Artificial Sequence: Synthetic peptide
  Seed: ADVLSRLA (MAGC3_HUMAN)
AEVLSRLV

SEQ ID NO: 109650 - protein, 9 aa, Artificial Sequence
  Description of Artificial Sequence: Synthetic peptide
  Seed: VDPDHFYVF (MAGC3_HUMAN)
VYPDHFYVM

SEQ ID NO: 109651 - protein, 10 aa, Artificial Sequence
  Description of Artificial Sequence: Synthetic peptide
  Seed: MNVINTYTGY (MAGC3_HUMAN)
MAVINTYTGR

SEQ ID NO: 109652 - protein, 9 aa, Artificial Sequence
  Description of Artificial Sequence: Synthetic peptide
  Seed: LSSIIPSAF (MAGC3_HUMAN)
LTSIIPSAF

SEQ ID NO: 109653 - protein, 9 aa, Artificial Sequence
  Description of Artificial Sequence: Synthetic peptide
  Seed: MIFGKAHEF (MAGC3_HUMAN)
MSFGKAHEK

SEQ ID NO: 109654 - protein, 9 aa, Artificial Sequence
  Description of Artificial Sequence: Synthetic peptide
  Seed: SLVLCPTYF (MAGC3_HUMAN)
SQVLCPTYF

SEQ ID NO: 109655 - protein, 10 aa, Artificial Sequence
  Description of Artificial Sequence: Synthetic peptide
  Seed: CVPEEVIWEV (MAGC3_HUMAN)
CMPEEVIWEL

SEQ ID NO: 109656 - protein, 11 aa, Artificial Sequence
  Description of Artificial Sequence: Synthetic peptide
  Seed: YTGYFPMIFRK (MAGC3_HUMAN)
YRGYFPMIFRR

SEQ ID NO: 109657 - protein, 9 aa, Artificial Sequence
  Description of Artificial Sequence: Synthetic peptide
  Seed: MQMNVINTY (MAGC3_HUMAN)
MTMNVINTI

SEQ ID NO: 109658 - protein, 11 aa, Artificial Sequence
  Description of Artificial Sequence: Synthetic peptide
  Seed: GYFPMIFRKAR (MAGC3_HUMAN)
GFFPMIFRKAR

SEQ ID NO: 109659 - protein, 11 aa, Artificial Sequence
  Description of Artificial Sequence: Synthetic peptide
  Seed: ILFGISLTEVD (MAGC3_HUMAN)
ILFGISLTEVK

SEQ ID NO: 109660 - protein, 9 aa, Artificial Sequence
  Description of Artificial Sequence: Synthetic peptide
  Seed: FSDGSLGQW (MAGC3_HUMAN)
FIDGSLGQI

SEQ ID NO: 109661 - protein, 10 aa, Artificial Sequence
  Description of Artificial Sequence: Synthetic peptide
  Seed: SLPESEPLFT (MAGC3_HUMAN)
SLPESEPLFI

SEQ ID NO: 109662 - protein, 10 aa, Artificial Sequence
  Description of Artificial Sequence: Synthetic peptide
  Seed: IELIFGIALT (MAGC3_HUMAN)
IHLIFGIALI

SEQ ID NO: 109663 - protein, 10 aa, Artificial Sequence
  Description of Artificial Sequence: Synthetic peptide
  Seed: MNVINTYTGY (MAGC3_HUMAN)
MKVINTYTGM

SEQ ID NO: 109664 - protein, 10 aa, Artificial Sequence
  Description of Artificial Sequence: Synthetic peptide
  Seed: NTYTGYFPMI (MAGC3_HUMAN)
NYYTGYFPMM

SEQ ID NO: 109665 - protein, 10 aa, Artificial Sequence
  Description of Artificial Sequence: Synthetic peptide
  Seed: FKLWRTLSGS (MAGC3_HUMAN)
FELWRTLSGA

SEQ ID NO: 109666 - protein, 9 aa, Artificial Sequence
  Description of Artificial Sequence: Synthetic peptide
  Seed: RGTGYTLSL (MAGC3_HUMAN)
RQTGYTLSM

SEQ ID NO: 109667 - protein, 10 aa, Artificial Sequence
  Description of Artificial Sequence: Synthetic peptide
  Seed: EEVIWEVLSA (MAGC3_HUMAN)
ETVIWEVLSV

SEQ ID NO: 109668 - protein, 9 aa, Artificial Sequence
  Description of Artificial Sequence: Synthetic peptide
  Seed: HLREVRLFL (MAGC3_HUMAN)
HFREVRLFI

SEQ ID NO: 109669 - protein, 10 aa, Artificial Sequence
  Description of Artificial Sequence: Synthetic peptide
  Seed: MPAAGMPPLP (MAGC3_HUMAN)
MPAAGMPPLE

SEQ ID NO: 109670 - protein, 9 aa, Artificial Sequence
  Description of Artificial Sequence: Synthetic peptide
  Seed: VLPPQPQPR (MAGC3_HUMAN)
VGPPQPQPL

SEQ ID NO: 109671 - protein, 8 aa, Artificial Sequence
  Description of Artificial Sequence: Synthetic peptide
  Seed: YFKLWRTL (MAGC3_HUMAN)
YYKLWRTL

SEQ ID NO: 109672 - protein, 9 aa, Artificial Sequence
  Description of Artificial Sequence: Synthetic peptide
  Seed: MLLPCHWVL (MAGC3_HUMAN)
MSLPCHWVV

SEQ ID NO: 109673 - protein, 10 aa, Artificial Sequence
  Description of Artificial Sequence: Synthetic peptide
  Seed: LNAIGPWSAL (MAGC3_HUMAN)
LIAIGPWSAY

SEQ ID NO: 109674 - protein, 8 aa, Artificial Sequence
  Description of Artificial Sequence: Synthetic peptide
  Seed: FADVLSRL (MAGC3_HUMAN)
FGDVLSRL

SEQ ID NO: 109675 - protein, 11 aa, Artificial Sequence
  Description of Artificial Sequence: Synthetic peptide
  Seed: IIDTTDDATAM (MAGC3_HUMAN)
IFDTTDDATAL

SEQ ID NO: 109676 - protein, 9 aa, Artificial Sequence
  Description of Artificial Sequence: Synthetic peptide
  Seed: KAHEFIELI (MAGC3_HUMAN)
KPHEFIELV

SEQ ID NO: 109677 - protein, 9 aa, Artificial Sequence
  Description of Artificial Sequence: Synthetic peptide
  Seed: LSGSPGLQL (MAGC3_HUMAN)
LVGSPGLQL

SEQ ID NO: 109678 - protein, 9 aa, Artificial Sequence
  Description of Artificial Sequence: Synthetic peptide
  Seed: AGFADVLSR (MAGC3_HUMAN)
AQFADVLSR

SEQ ID NO: 109679 - protein, 9 aa, Artificial Sequence
  Description of Artificial Sequence: Synthetic peptide
  Seed: KYKDYFPMI (MAGC3_HUMAN)
KWKDYFPMI

SEQ ID NO: 109680 - protein, 10 aa, Artificial Sequence
  Description of Artificial Sequence: Synthetic peptide
  Seed: LIFGIALTDM (MAGC3_HUMAN)
LSFGIALTDY

SEQ ID NO: 109681 - protein, 10 aa, Artificial Sequence
  Description of Artificial Sequence: Synthetic peptide
  Seed: WEVLNAIGPW (MAGC3_HUMAN)
WTVLNAIGPW

SEQ ID NO: 109682 - protein, 9 aa, Artificial Sequence
  Description of Artificial Sequence: Synthetic peptide
  Seed: MASASPSVM (MAGC3_HUMAN)
MHSASPSVM

SEQ ID NO: 109683 - protein, 10 aa, Artificial Sequence
  Description of Artificial Sequence: Synthetic peptide
  Seed: YALSPVVLPP (MAGC3_HUMAN)
YNLSPVVLPM

SEQ ID NO: 109684 - protein, 11 aa, Artificial Sequence
  Description of Artificial Sequence: Synthetic peptide
  Seed: LSKLSSIIPSA (MAGC3_HUMAN)
LEKLSSIIPSL

SEQ ID NO: 109685 - protein, 9 aa, Artificial Sequence
  Description of Artificial Sequence: Synthetic peptide
  Seed: FHLGHLREV (MAGC3_HUMAN)
FRLGHLREI

SEQ ID NO: 109686 - protein, 9 aa, Artificial Sequence
  Description of Artificial Sequence: Synthetic peptide
  Seed: GQWVKNTCA (MAGC3_HUMAN)
GEWVKNTCI

SEQ ID NO: 109687 - protein, 9 aa, Artificial Sequence
  Description of Artificial Sequence: Synthetic peptide
  Seed: MASASPSVM (MAGC3_HUMAN)
MPSASPSVF

SEQ ID NO: 109688 - protein, 11 aa, Artificial Sequence
  Description of Artificial Sequence: Synthetic peptide
  Seed: EILFGISLTEV (MAGC3_HUMAN)
EGLFGISLTEV

SEQ ID NO: 109689 - protein, 10 aa, Artificial Sequence
  Description of Artificial Sequence: Synthetic peptide
  Seed: YALSPVVLPP (MAGC3_HUMAN)
YRLSPVVLPV

SEQ ID NO: 109690 - protein, 9 aa, Artificial Sequence
  Description of Artificial Sequence: Synthetic peptide
  Seed: ATDKDYSAF (MAGC3_HUMAN)
AMDKDYSAL

SEQ ID NO: 109691 - protein, 10 aa, Artificial Sequence
  Description of Artificial Sequence: Synthetic peptide
  Seed: ATYALSPVVL (MAGC3_HUMAN)
APYALSPVVF

SEQ ID NO: 109692 - protein, 10 aa, Artificial Sequence
  Description of Artificial Sequence: Synthetic peptide
  Seed: KVAELVQFLL (MAGC3_HUMAN)
KLAELVQFLL

SEQ ID NO: 109693 - protein, 10 aa, Artificial Sequence
  Description of Artificial Sequence: Synthetic peptide
  Seed: SKLSSIIPSA (MAGC3_HUMAN)
SKLSSIIPSL

SEQ ID NO: 109694 - protein, 10 aa, Artificial Sequence
  Description of Artificial Sequence: Synthetic peptide
  Seed: RLWGEKAGSL (MAGC3_HUMAN)
RMWGEKAGSW

SEQ ID NO: 109695 - protein, 9 aa, Artificial Sequence
  Description of Artificial Sequence: Synthetic peptide
  Seed: MQMNVINTY (MAGC3_HUMAN)
MRMNVINTY

SEQ ID NO: 109696 - protein, 9 aa, Artificial Sequence
  Description of Artificial Sequence: Synthetic peptide
  Seed: YKDYFPMIF (MAGC3_HUMAN)
YFDYFPMIV

SEQ ID NO: 109697 - protein, 10 aa, Artificial Sequence
  Description of Artificial Sequence: Synthetic peptide
  Seed: ALDEKVAELV (MAGC3_HUMAN)
AQDEKVAELL

SEQ ID NO: 109698 - protein, 9 aa, Artificial Sequence
  Description of Artificial Sequence: Synthetic peptide
  Seed: ALDEKVAEL (MAGC3_HUMAN)
AVDEKVAEI

SEQ ID NO: 109699 - protein, 9 aa, Artificial Sequence
  Description of Artificial Sequence: Synthetic peptide
  Seed: HSYFFEDTL (MAGC3_HUMAN)
HIYFFEDTV

SEQ ID NO: 109700 - protein, 10 aa, Artificial Sequence
  Description of Artificial Sequence: Synthetic peptide
  Seed: MQMNVINTYT (MAGC3_HUMAN)
MLMNVINTYM

SEQ ID NO: 109701 - protein, 9 aa, Artificial Sequence
  Description of Artificial Sequence: Synthetic peptide
  Seed: SAEGSVLDL (MAGC3_HUMAN)
SLEGSVLDL

SEQ ID NO: 109702 - protein, 10 aa, Artificial Sequence
  Description of Artificial Sequence: Synthetic peptide
  Seed: KVAELVQFLL (MAGC3_HUMAN)
KIAELVQFLI

SEQ ID NO: 109703 - protein, 10 aa, Artificial Sequence
  Description of Artificial Sequence: Synthetic peptide
  Seed: NTYTGYFPMI (MAGC3_HUMAN)
NVYTGYFPMV

SEQ ID NO: 109704 - protein, 9 aa, Artificial Sequence
  Description of Artificial Sequence: Synthetic peptide
  Seed: YALDEKVAE (MAGC3_HUMAN)
YILDEKVAF

SEQ ID NO: 109705 - protein, 10 aa, Artificial Sequence
  Description of Artificial Sequence: Synthetic peptide
  Seed: YQAKEPLTRA (MAGC3_HUMAN)
YLAKEPLTRI

SEQ ID NO: 109706 - protein, 9 aa, Artificial Sequence
  Description of Artificial Sequence: Synthetic peptide
  Seed: LSSIIPSAF (MAGC3_HUMAN)
LYSIIPSAF

SEQ ID NO: 109707 - protein, 9 aa, Artificial Sequence
  Description of Artificial Sequence: Synthetic peptide
  Seed: RGTGYTLSL (MAGC3_HUMAN)
RQTGYTLSA

SEQ ID NO: 109708 - protein, 9 aa, Artificial Sequence
  Description of Artificial Sequence: Synthetic peptide
  Seed: REVLEFLSK (MAGC3_HUMAN)
REVLEFLSL

SEQ ID NO: 109709 - protein, 10 aa, Artificial Sequence
  Description of Artificial Sequence: Synthetic peptide
  Seed: EEVIWEVLNA (MAGC3_HUMAN)
EQVIWEVLNV

SEQ ID NO: 109710 - protein, 9 aa, Artificial Sequence
  Description of Artificial Sequence: Synthetic peptide
  Seed: NTYTGYFPM (MAGC3_HUMAN)
NLYTGYFPS

SEQ ID NO: 109711 - protein, 10 aa, Artificial Sequence
  Description of Artificial Sequence: Synthetic peptide
  Seed: REVRLFLRGG (MAGC3_HUMAN)
RMVRLFLRGA

SEQ ID NO: 109712 - protein, 10 aa, Artificial Sequence
  Description of Artificial Sequence: Synthetic peptide
  Seed: MLTTVIKKYK (MAGC3_HUMAN)
MYTTVIKKYK

SEQ ID NO: 109713 - protein, 9 aa, Artificial Sequence
  Description of Artificial Sequence: Synthetic peptide
  Seed: ELIFGIALT (MAGC3_HUMAN)
EAIFGIALA

SEQ ID NO: 109714 - protein, 9 aa, Artificial Sequence
  Description of Artificial Sequence: Synthetic peptide
  Seed: MIFGKAHEF (MAGC3_HUMAN)
MWFGKAHEF

SEQ ID NO: 109715 - protein, 9 aa, Artificial Sequence
  Description of Artificial Sequence: Synthetic peptide
  Seed: KVAELVQFL (MAGC3_HUMAN)
KTAELVQFK

SEQ ID NO: 109716 - protein, 9 aa, Artificial Sequence
  Description of Artificial Sequence: Synthetic peptide
  Seed: ALDEKVAEL (MAGC3_HUMAN)
AMDEKVAEF

SEQ ID NO: 109717 - protein, 9 aa, Artificial Sequence
  Description of Artificial Sequence: Synthetic peptide
  Seed: RTLSGSPGL (MAGC3_HUMAN)
RLLSGSPGA

SEQ ID NO: 109718 - protein, 11 aa, Artificial Sequence
  Description of Artificial Sequence: Synthetic peptide
  Seed: TDMDPDNHSYF (MAGC3_HUMAN)
TVMDPDNHSYL

SEQ ID NO: 109719 - protein, 9 aa, Artificial Sequence
  Description of Artificial Sequence: Synthetic peptide
  Seed: FFEDTLDLT (MAGC3_HUMAN)
FYEDTLDLL

SEQ ID NO: 109720 - protein, 9 aa, Artificial Sequence
  Description of Artificial Sequence: Synthetic peptide
  Seed: SLPESEPLF (MAGC3_HUMAN)
SRPESEPLF

SEQ ID NO: 109721 - protein, 10 aa, Artificial Sequence
  Description of Artificial Sequence: Synthetic peptide
  Seed: NTYTGYFPMI (MAGC3_HUMAN)
NVYTGYFPMI

SEQ ID NO: 109722 - protein, 9 aa, Artificial Sequence
  Description of Artificial Sequence: Synthetic peptide
  Seed: SALAGFADV (MAGC3_HUMAN)
SSLAGFADY

SEQ ID NO: 109723 - protein, 10 aa, Artificial Sequence
  Description of Artificial Sequence: Synthetic peptide
  Seed: IELIFGIALT (MAGC3_HUMAN)
ILLIFGIALI

SEQ ID NO: 109724 - protein, 9 aa, Artificial Sequence
  Description of Artificial Sequence: Synthetic peptide
  Seed: LKYQAKEPL (MAGC3_HUMAN)
LQYQAKEPH

SEQ ID NO: 109725 - protein, 10 aa, Artificial Sequence
  Description of Artificial Sequence: Synthetic peptide
  Seed: YSAFHLGHLR (MAGC3_HUMAN)
YIAFHLGHLR

SEQ ID NO: 109726 - protein, 9 aa, Artificial Sequence
  Description of Artificial Sequence: Synthetic peptide
  Seed: DMDPDNHSY (MAGC3_HUMAN)
DSDPDNHSI

SEQ ID NO: 109727 - protein, 11 aa, Artificial Sequence
  Description of Artificial Sequence: Synthetic peptide
  Seed: SAIGPIQRPAR (MAGC3_HUMAN)
STIGPIQRPAR

SEQ ID NO: 109728 - protein, 9 aa, Artificial Sequence
  Description of Artificial Sequence: Synthetic peptide
  Seed: TGYTLSLPA (MAGC3_HUMAN)
TPYTLSLPV

SEQ ID NO: 109729 - protein, 10 aa, Artificial Sequence
  Description of Artificial Sequence: Synthetic peptide
  Seed: SLVLCPTYFK (MAGC3_HUMAN)
SFVLCPTYFK

SEQ ID NO: 109730 - protein, 10 aa, Artificial Sequence
  Description of Artificial Sequence: Synthetic peptide
  Seed: ALWESEGPEA (MAGC3_HUMAN)
ALWESEGPEL

SEQ ID NO: 109731 - protein, 9 aa, Artificial Sequence
  Description of Artificial Sequence: Synthetic peptide
  Seed: MIFIKGSCV (MAGC3_HUMAN)
MMFIKGSCF

SEQ ID NO: 109732 - protein, 9 aa, Artificial Sequence
  Description of Artificial Sequence: Synthetic peptide
  Seed: KLSSIIPSA (MAGC3_HUMAN)
KLSSIIPSC

SEQ ID NO: 109733 - protein, 10 aa, Artificial Sequence
  Description of Artificial Sequence: Synthetic peptide
  Seed: SAFHLGHLRE (MAGC3_HUMAN)
SMFHLGHLRL

SEQ ID NO: 109734 - protein, 11 aa, Artificial Sequence
  Description of Artificial Sequence: Synthetic peptide
  Seed: TDMDPDNHSYF (MAGC3_HUMAN)
TIMDPDNHSYM

SEQ ID NO: 109735 - protein, 10 aa, Artificial Sequence
  Description of Artificial Sequence: Synthetic peptide
  Seed: LSLPAVSPGK (MAGC3_HUMAN)
LVLPAVSPGK

SEQ ID NO: 109736 - protein, 9 aa, Artificial Sequence
  Description of Artificial Sequence: Synthetic peptide
  Seed: KAHEFIELI (MAGC3_HUMAN)
KGHEFIELF

SEQ ID NO: 109737 - protein, 9 aa, Artificial Sequence
  Description of Artificial Sequence: Synthetic peptide
  Seed: FVNTLDLTC (MAGC3_HUMAN)
FANTLDLTF

SEQ ID NO: 109738 - protein, 10 aa, Artificial Sequence
  Description of Artificial Sequence: Synthetic peptide
  Seed: KVAELVQFLL (MAGC3_HUMAN)
KVAELVQFLI

SEQ ID NO: 109739 - protein, 9 aa, Artificial Sequence
  Description of Artificial Sequence: Synthetic peptide
  Seed: IIDTTDDAT (MAGC3_HUMAN)
IVDTTDDAV

SEQ ID NO: 109740 - protein, 9 aa, Artificial Sequence
  Description of Artificial Sequence: Synthetic peptide
  Seed: LVLCPTYFK (MAGC3_HUMAN)
LALCPTYFK

SEQ ID NO: 109741 - protein, 10 aa, Artificial Sequence
  Description of Artificial Sequence: Synthetic peptide
  Seed: LNAIGPWSAL (MAGC3_HUMAN)
LDAIGPWSAM

SEQ ID NO: 109742 - protein, 9 aa, Artificial Sequence
  Description of Artificial Sequence: Synthetic peptide
  Seed: AMASASPSV (MAGC3_HUMAN)
AVASASPSI

SEQ ID NO: 109743 - protein, 9 aa, Artificial Sequence
  Description of Artificial Sequence: Synthetic peptide
  Seed: IIPSAFPSW (MAGC3_HUMAN)
IIPSAFPSL

SEQ ID NO: 109744 - protein, 9 aa, Artificial Sequence
  Description of Artificial Sequence: Synthetic peptide
  Seed: KYKDYFPMI (MAGC3_HUMAN)
KAKDYFPMF

SEQ ID NO: 109745 - protein, 10 aa, Artificial Sequence
  Description of Artificial Sequence: Synthetic peptide
  Seed: ATYALSPVVL (MAGC3_HUMAN)
AYYALSPVVW

SEQ ID NO: 109746 - protein, 10 aa, Artificial Sequence
  Description of Artificial Sequence: Synthetic peptide
  Seed: SCSSPLLWTR (MAGC3_HUMAN)
SVSSPLLWTR

SEQ ID NO: 109747 - protein, 10 aa, Artificial Sequence
  Description of Artificial Sequence: Synthetic peptide
  Seed: TGYFPMIFRK (MAGC3_HUMAN)
TMYFPMIFRN

SEQ ID NO: 109748 - protein, 9 aa, Artificial Sequence
  Description of Artificial Sequence: Synthetic peptide
  Seed: EVDPDHFYV (MAGC3_HUMAN)
EFDPDHFYF

SEQ ID NO: 109749 - protein, 10 aa, Artificial Sequence
  Description of Artificial Sequence: Synthetic peptide
  Seed: TLDEKVDKLV (MAGC3_HUMAN)
TADEKVDKLL

SEQ ID NO: 109750 - protein, 10 aa, Artificial Sequence
  Description of Artificial Sequence: Synthetic peptide
  Seed: LLKYQAKEPL (MAGC3_HUMAN)
LYKYQAKEPF

SEQ ID NO: 109751 - protein, 9 aa, Artificial Sequence
  Description of Artificial Sequence: Synthetic peptide
  Seed: MIFGKAHEF (MAGC3_HUMAN)
MPFGKAHEI

SEQ ID NO: 109752 - protein, 9 aa, Artificial Sequence
  Description of Artificial Sequence: Synthetic peptide
  Seed: VIWEVLNAI (MAGC3_HUMAN)
VQWEVLNAF

SEQ ID NO: 109753 - protein, 10 aa, Artificial Sequence
  Description of Artificial Sequence: Synthetic peptide
  Seed: KKYKDYFPMI (MAGC3_HUMAN)
KWYKDYFPML

SEQ ID NO: 109754 - protein, 9 aa, Artificial Sequence
  Description of Artificial Sequence: Synthetic peptide
  Seed: DGSLGQWVK (MAGC3_HUMAN)
DASLGQWVK

SEQ ID NO: 109755 - protein, 9 aa, Artificial Sequence
  Description of Artificial Sequence: Synthetic peptide
  Seed: FLSKLSSII (MAGC3_HUMAN)
FMSKLSSIM

SEQ ID NO: 109756 - protein, 11 aa, Artificial Sequence
  Description of Artificial Sequence: Synthetic peptide
  Seed: ALAGFADVLSR (MAGC3_HUMAN)
AAAGFADVLSF

SEQ ID NO: 109757 - protein, 9 aa, Artificial Sequence
  Description of Artificial Sequence: Synthetic peptide
  Seed: ALAGFADVL (MAGC3_HUMAN)
AMAGFADVF

SEQ ID NO: 109758 - protein, 10 aa, Artificial Sequence
  Description of Artificial Sequence: Synthetic peptide
  Seed: ALDEKVAELV (MAGC3_HUMAN)
AVDEKVAELV

SEQ ID NO: 109759 - protein, 9 aa, Artificial Sequence
  Description of Artificial Sequence: Synthetic peptide
  Seed: FSDGSLGQW (MAGC3_HUMAN)
FVDGSLGQI

SEQ ID NO: 109760 - protein, 9 aa, Artificial Sequence
  Description of Artificial Sequence: Synthetic peptide
  Seed: SLPESEPLF (MAGC3_HUMAN)
SIPESEPLI

SEQ ID NO: 109761 - protein, 9 aa, Artificial Sequence
  Description of Artificial Sequence: Synthetic peptide
  Seed: VDPDHFYVF (MAGC3_HUMAN)
VYPDHFYVY

SEQ ID NO: 109762 - protein, 9 aa, Artificial Sequence
  Description of Artificial Sequence: Synthetic peptide
  Seed: ASEEVIWEV (MAGC3_HUMAN)
AMEEVIWEL

SEQ ID NO: 109763 - protein, 10 aa, Artificial Sequence
  Description of Artificial Sequence: Synthetic peptide
  Seed: LVLCPTYFKL (MAGC3_HUMAN)
LALCPTYFKV

SEQ ID NO: 109764 - protein, 10 aa, Artificial Sequence
  Description of Artificial Sequence: Synthetic peptide
  Seed: SPLDSCSSPL (MAGC3_HUMAN)
SPLDSCSSPV

SEQ ID NO: 109765 - protein, 10 aa, Artificial Sequence
  Description of Artificial Sequence: Synthetic peptide
  Seed: EVIWEVLSAI (MAGC3_HUMAN)
EAIWEVLSAY

SEQ ID NO: 109766 - protein, 9 aa, Artificial Sequence
  Description of Artificial Sequence: Synthetic peptide
  Seed: QGMPQNRLL (MAGC3_HUMAN)
QRMPQNRLL

SEQ ID NO: 109767 - protein, 10 aa, Artificial Sequence
  Description of Artificial Sequence: Synthetic peptide
  Seed: YTGYFPMIFR (MAGC3_HUMAN)
YAGYFPMIFK

SEQ ID NO: 109768 - protein, 10 aa, Artificial Sequence
  Description of Artificial Sequence: Synthetic peptide
  Seed: TDMDPDNHSY (MAGC3_HUMAN)
TQMDPDNHSW

SEQ ID NO: 109769 - protein, 9 aa, Artificial Sequence
  Description of Artificial Sequence: Synthetic peptide
  Seed: NAIGPWSAL (MAGC3_HUMAN)
NSIGPWSAA

SEQ ID NO: 109770 - protein, 10 aa, Artificial Sequence
  Description of Artificial Sequence: Synthetic peptide
  Seed: GMPKNCLLIL (MAGC3_HUMAN)
GMPKNCLLIV

SEQ ID NO: 109771 - protein, 9 aa, Artificial Sequence
  Description of Artificial Sequence: Synthetic peptide
  Seed: MQMNVINTY (MAGC3_HUMAN)
MLMNVINTK

SEQ ID NO: 109772 - protein, 10 aa, Artificial Sequence
  Description of Artificial Sequence: Synthetic peptide
  Seed: YALDEKVAEL (MAGC3_HUMAN)
YFLDEKVAEA

SEQ ID NO: 109773 - protein, 10 aa, Artificial Sequence
  Description of Artificial Sequence: Synthetic peptide
  Seed: REVRLFLRGG (MAGC3_HUMAN)
RSVRLFLRGL

SEQ ID NO: 109774 - protein, 9 aa, Artificial Sequence
  Description of Artificial Sequence: Synthetic peptide
  Seed: EVLEFLSKL (MAGC3_HUMAN)
EILEFLSKF

SEQ ID NO: 109775 - protein, 9 aa, Artificial Sequence
  Description of Artificial Sequence: Synthetic peptide
  Seed: LILSVIFIK (MAGC3_HUMAN)
LVLSVIFIK

SEQ ID NO: 109776 - protein, 9 aa, Artificial Sequence
  Description of Artificial Sequence: Synthetic peptide
  Seed: KQREEPQDW (MAGC3_HUMAN)
KVREEPQDW

SEQ ID NO: 109777 - protein, 10 aa, Artificial Sequence
  Description of Artificial Sequence: Synthetic peptide
  Seed: IELIFGIALT (MAGC3_HUMAN)
IILIFGIALA

SEQ ID NO: 109778 - protein, 10 aa, Artificial Sequence
  Description of Artificial Sequence: Synthetic peptide
  Seed: RRGTGYTLSL (MAGC3_HUMAN)
RRGTGYTLSM

SEQ ID NO: 109779 - protein, 11 aa, Artificial Sequence
  Description of Artificial Sequence: Synthetic peptide
  Seed: LDSCSSPLLWT (MAGC3_HUMAN)
LSSCSSPLLWV

SEQ ID NO: 109780 - protein, 9 aa, Artificial Sequence
  Description of Artificial Sequence: Synthetic peptide
  Seed: VDPDHFYVF (MAGC3_HUMAN)
VAPDHFYVM

SEQ ID NO: 109781 - protein, 8 aa, Artificial Sequence
  Description of Artificial Sequence: Synthetic peptide
  Seed: FLSKLSSI (MAGC3_HUMAN)
FMSKLSSI

SEQ ID NO: 109782 - protein, 10 aa, Artificial Sequence
  Description of Artificial Sequence: Synthetic peptide
  Seed: FFEDTLDLTY (MAGC3_HUMAN)
FLEDTLDLTF

SEQ ID NO: 109783 - protein, 9 aa, Artificial Sequence
  Description of Artificial Sequence: Synthetic peptide
  Seed: MPAAGMPPL (MAGC3_HUMAN)
MPAAGMPPP

SEQ ID NO: 109784 - protein, 9 aa, Artificial Sequence
  Description of Artificial Sequence: Synthetic peptide
  Seed: VDPDHFYVF (MAGC3_HUMAN)
VVPDHFYVI

SEQ ID NO: 109785 - protein, 9 aa, Artificial Sequence
  Description of Artificial Sequence: Synthetic peptide
  Seed: MIFGKAHEF (MAGC3_HUMAN)
MFFGKAHEL

SEQ ID NO: 109786 - protein, 9 aa, Artificial Sequence
  Description of Artificial Sequence: Synthetic peptide
  Seed: LANPQGLAG (MAGC3_HUMAN)
LANPQGLAI

SEQ ID NO: 109787 - protein, 9 aa, Artificial Sequence
  Description of Artificial Sequence: Synthetic peptide
  Seed: TKAEMLTTV (MAGC3_HUMAN)
TQAEMLTTI

SEQ ID NO: 109788 - protein, 9 aa, Artificial Sequence
  Description of Artificial Sequence: Synthetic peptide
  Seed: SEEVIWEVL (MAGC3_HUMAN)
SHEVIWEVV

SEQ ID NO: 109789 - protein, 9 aa, Artificial Sequence
  Description of Artificial Sequence: Synthetic peptide
  Seed: AIIDTTDDA (MAGC3_HUMAN)
AQIDTTDDL

SEQ ID NO: 109790 - protein, 9 aa, Artificial Sequence
  Description of Artificial Sequence: Synthetic peptide
  Seed: ATYALSPVV (MAGC3_HUMAN)
ALYALSPVY

SEQ ID NO: 109791 - protein, 9 aa, Artificial Sequence
  Description of Artificial Sequence: Synthetic peptide
  Seed: DMDPDNHSY (MAGC3_HUMAN)
DSDPDNHSV

SEQ ID NO: 109792 - protein, 9 aa, Artificial Sequence
  Description of Artificial Sequence: Synthetic peptide
  Seed: FSLRRAVSV (MAGC3_HUMAN)
FVLRRAVSV

SEQ ID NO: 109793 - protein, 10 aa, Artificial Sequence
  Description of Artificial Sequence: Synthetic peptide
  Seed: YALDEKVAEL (MAGC3_HUMAN)
YCLDEKVAET

SEQ ID NO: 109794 - protein, 9 aa, Artificial Sequence
  Description of Artificial Sequence: Synthetic peptide
  Seed: LDEKVAELV (MAGC3_HUMAN)
LEEKVAELI

SEQ ID NO: 109795 - protein, 10 aa, Artificial Sequence
  Description of Artificial Sequence: Synthetic peptide
  Seed: YSAFHLGHLR (MAGC3_HUMAN)
YWAFHLGHLR

SEQ ID NO: 109796 - protein, 9 aa, Artificial Sequence
  Description of Artificial Sequence: Synthetic peptide
  Seed: TLDEKVDKL (MAGC3_HUMAN)
TTDEKVDKF

SEQ ID NO: 109797 - protein, 10 aa, Artificial Sequence
  Description of Artificial Sequence: Synthetic peptide
  Seed: FLSKLSSIIP (MAGC3_HUMAN)
FMSKLSSIIA

SEQ ID NO: 109798 - protein, 11 aa, Artificial Sequence
  Description of Artificial Sequence: Synthetic peptide
  Seed: AEMQMNVINTY (MAGC3_HUMAN)
ALMQMNVINTY

SEQ ID NO: 109799 - protein, 9 aa, Artificial Sequence
  Description of Artificial Sequence: Synthetic peptide
  Seed: EFIELIFGI (MAGC3_HUMAN)
EAIELIFGI

SEQ ID NO: 109800 - protein, 9 aa, Artificial Sequence
  Description of Artificial Sequence: Synthetic peptide
  Seed: EVLNAIGPW (MAGC3_HUMAN)
ETLNAIGPM

SEQ ID NO: 109801 - protein, 9 aa, Artificial Sequence
  Description of Artificial Sequence: Synthetic peptide
  Seed: GYTLSLPAV (MAGC3_HUMAN)
GWTLSLPAF

SEQ ID NO: 109802 - protein, 10 aa, Artificial Sequence
  Description of Artificial Sequence: Synthetic peptide
  Seed: REVRLFLRGG (MAGC3_HUMAN)
RVVRLFLRGI

SEQ ID NO: 109803 - protein, 11 aa, Artificial Sequence
  Description of Artificial Sequence: Synthetic peptide
  Seed: EPQDWPLNEKR (MAGC3_HUMAN)
EFQDWPLNEKR

SEQ ID NO: 109804 - protein, 8 aa, Artificial Sequence
  Description of Artificial Sequence: Synthetic peptide
  Seed: KVAELVQF (MAGC3_HUMAN)
KQAELVQY

SEQ ID NO: 109805 - protein, 11 aa, Artificial Sequence
  Description of Artificial Sequence: Synthetic peptide
  Seed: RTLSGSPGLQL (MAGC3_HUMAN)
RMLSGSPGLQV

SEQ ID NO: 109806 - protein, 8 aa, Artificial Sequence
  Description of Artificial Sequence: Synthetic peptide
  Seed: FADVLSRL (MAGC3_HUMAN)
FNDVLSRL

SEQ ID NO: 109807 - protein, 9 aa, Artificial Sequence
  Description of Artificial Sequence: Synthetic peptide
  Seed: FADVLSRLA (MAGC3_HUMAN)
FQDVLSRLV

SEQ ID NO: 109808 - protein, 9 aa, Artificial Sequence
  Description of Artificial Sequence: Synthetic peptide
  Seed: TRAEMQMNV (MAGC3_HUMAN)
THAEMQMNA

SEQ ID NO: 109809 - protein, 10 aa, Artificial Sequence
  Description of Artificial Sequence: Synthetic peptide
  Seed: SAFHLGHLRE (MAGC3_HUMAN)
SMFHLGHLRW

SEQ ID NO: 109810 - protein, 10 aa, Artificial Sequence
  Description of Artificial Sequence: Synthetic peptide
  Seed: EKVAELVQFL (MAGC3_HUMAN)
EAVAELVQFV

SEQ ID NO: 109811 - protein, 10 aa, Artificial Sequence
  Description of Artificial Sequence: Synthetic peptide
  Seed: SAFHLGHLRE (MAGC3_HUMAN)
SIFHLGHLRK

SEQ ID NO: 109812 - protein, 9 aa, Artificial Sequence
  Description of Artificial Sequence: Synthetic peptide
  Seed: AIGPIQRPA (MAGC3_HUMAN)
ALGPIQRPI

SEQ ID NO: 109813 - protein, 9 aa, Artificial Sequence
  Description of Artificial Sequence: Synthetic peptide
  Seed: LANPQGLAG (MAGC3_HUMAN)
LLNPQGLAY

SEQ ID NO: 109814 - protein, 11 aa, Artificial Sequence
  Description of Artificial Sequence: Synthetic peptide
  Seed: SPQGPPQSPPQ (MAGC3_HUMAN)
SPQGPPQSPPC

SEQ ID NO: 109815 - protein, 9 aa, Artificial Sequence
  Description of Artificial Sequence: Synthetic peptide
  Seed: ALDEKVAEL (MAGC3_HUMAN)
AFDEKVAEF

SEQ ID NO: 109816 - protein, 9 aa, Artificial Sequence
  Description of Artificial Sequence: Synthetic peptide
  Seed: GSLPESEPL (MAGC3_HUMAN)
GVLPESEPV

SEQ ID NO: 109817 - protein, 10 aa, Artificial Sequence
  Description of Artificial Sequence: Synthetic peptide
  Seed: VVLPPQPQPR (MAGC3_HUMAN)
VTLPPQPQPY

SEQ ID NO: 109818 - protein, 11 aa, Artificial Sequence
  Description of Artificial Sequence: Synthetic peptide
  Seed: YALDEKVAELV (MAGC3_HUMAN)
YLLDEKVAELD

SEQ ID NO: 109819 - protein, 10 aa, Artificial Sequence
  Description of Artificial Sequence: Synthetic peptide
  Seed: MIFGKAHEFI (MAGC3_HUMAN)
MQFGKAHEFV

SEQ ID NO: 109820 - protein, 10 aa, Artificial Sequence
  Description of Artificial Sequence: Synthetic peptide
  Seed: LPTWRRGTGY (MAGC3_HUMAN)
LETWRRGTGF

SEQ ID NO: 109821 - protein, 8 aa, Artificial Sequence
  Description of Artificial Sequence: Synthetic peptide
  Seed: TTDDATAM (MAGC3_HUMAN)
TTDDATAI

SEQ ID NO: 109822 - protein, 9 aa, Artificial Sequence
  Description of Artificial Sequence: Synthetic peptide
  Seed: NTYTGYFPM (MAGC3_HUMAN)
NNYTGYFPR

SEQ ID NO: 109823 - protein, 9 aa, Artificial Sequence
  Description of Artificial Sequence: Synthetic peptide
  Seed: KVDKLVQFL (MAGC3_HUMAN)
KVDKLVQFV

SEQ ID NO: 109824 - protein, 11 aa, Artificial Sequence
  Description of Artificial Sequence: Synthetic peptide
  Seed: MQMNVINTYTG (MAGC3_HUMAN)
MKMNVINTYTY

SEQ ID NO: 109825 - protein, 9 aa, Artificial Sequence
  Description of Artificial Sequence: Synthetic peptide
  Seed: MDPDNHSYF (MAGC3_HUMAN)
MAPDNHSYF

SEQ ID NO: 109826 - protein, 10 aa, Artificial Sequence
  Description of Artificial Sequence: Synthetic peptide
  Seed: TAMASASPSV (MAGC3_HUMAN)
TAMASASPSF

SEQ ID NO: 109827 - protein, 9 aa, Artificial Sequence
  Description of Artificial Sequence: Synthetic peptide
  Seed: IELIFGIAL (MAGC3_HUMAN)
IRLIFGIAL

SEQ ID NO: 109828 - protein, 8 aa, Artificial Sequence
  Description of Artificial Sequence: Synthetic peptide
  Seed: IQRPAREV (MAGC3_HUMAN)
ISRPAREL

SEQ ID NO: 109829 - protein, 10 aa, Artificial Sequence
  Description of Artificial Sequence: Synthetic peptide
  Seed: TAMASASPSV (MAGC3_HUMAN)
TEMASASPSL

SEQ ID NO: 109830 - protein, 9 aa, Artificial Sequence
  Description of Artificial Sequence: Synthetic peptide
  Seed: TLDEKVDKL (MAGC3_HUMAN)
TVDEKVDKY

SEQ ID NO: 109831 - protein, 10 aa, Artificial Sequence
  Description of Artificial Sequence: Synthetic peptide
  Seed: AMASASPSVM (MAGC3_HUMAN)
AQASASPSVM

SEQ ID NO: 109832 - protein, 9 aa, Artificial Sequence
  Description of Artificial Sequence: Synthetic peptide
  Seed: EVLNAIGPW (MAGC3_HUMAN)
ESLNAIGPK

SEQ ID NO: 109833 - protein, 9 aa, Artificial Sequence
  Description of Artificial Sequence: Synthetic peptide
  Seed: FGSQPEGKF (MAGC3_HUMAN)
FASQPEGKW

SEQ ID NO: 109834 - protein, 10 aa, Artificial Sequence
  Description of Artificial Sequence: Synthetic peptide
  Seed: EVIWEVLSAI (MAGC3_HUMAN)
ELIWEVLSAY

SEQ ID NO: 109835 - protein, 9 aa, Artificial Sequence
  Description of Artificial Sequence: Synthetic peptide
  Seed: MIFGKAHEF (MAGC3_HUMAN)
MVFGKAHEL

SEQ ID NO: 109836 - protein, 9 aa, Artificial Sequence
  Description of Artificial Sequence: Synthetic peptide
  Seed: RTLSGSPGL (MAGC3_HUMAN)
RMLSGSPGA

SEQ ID NO: 109837 - protein, 9 aa, Artificial Sequence
  Description of Artificial Sequence: Synthetic peptide
  Seed: QGMPKNCLL (MAGC3_HUMAN)
QAMPKNCLW

SEQ ID NO: 109838 - protein, 9 aa, Artificial Sequence
  Description of Artificial Sequence: Synthetic peptide
  Seed: EVLEFLSKL (MAGC3_HUMAN)
EQLEFLSKF

SEQ ID NO: 109839 - protein, 9 aa, Artificial Sequence
  Description of Artificial Sequence: Synthetic peptide
  Seed: AMASASPSV (MAGC3_HUMAN)
AIASASPSY

SEQ ID NO: 109840 - protein, 9 aa, Artificial Sequence
  Description of Artificial Sequence: Synthetic peptide
  Seed: MLLPCHWVL (MAGC3_HUMAN)
MMLPCHWVL

SEQ ID NO: 109841 - protein, 9 aa, Artificial Sequence
  Description of Artificial Sequence: Synthetic peptide
  Seed: FLSKLSSII (MAGC3_HUMAN)
FLSKLSSIY

SEQ ID NO: 109842 - protein, 10 aa, Artificial Sequence
  Description of Artificial Sequence: Synthetic peptide
  Seed: LDLANPQGLA (MAGC3_HUMAN)
LPLANPQGLV

SEQ ID NO: 109843 - protein, 11 aa, Artificial Sequence
  Description of Artificial Sequence: Synthetic peptide
  Seed: DYSAFHLGHLR (MAGC3_HUMAN)
DFSAFHLGHLR

SEQ ID NO: 109844 - protein, 10 aa, Artificial Sequence
  Description of Artificial Sequence: Synthetic peptide
  Seed: KLVQFLLLKY (MAGC3_HUMAN)
KDVQFLLLKK

SEQ ID NO: 109845 - protein, 11 aa, Artificial Sequence
  Description of Artificial Sequence: Synthetic peptide
  Seed: TSDQRMDSLVL (MAGC3_HUMAN)
TSDQRMDSLVY

SEQ ID NO: 109846 - protein, 11 aa, Artificial Sequence
  Description of Artificial Sequence: Synthetic peptide
  Seed: RTLSGSPGLQL (MAGC3_HUMAN)
RELSGSPGLQL

SEQ ID NO: 109847 - protein, 9 aa, Artificial Sequence
  Description of Artificial Sequence: Synthetic peptide
  Seed: QMNVINTYT (MAGC3_HUMAN)
QVNVINTYI

SEQ ID NO: 109848 - protein, 10 aa, Artificial Sequence
  Description of Artificial Sequence: Synthetic peptide
  Seed: GEKAGSLPES (MAGC3_HUMAN)
GEKAGSLPEL

SEQ ID NO: 109849 - protein, 9 aa, Artificial Sequence
  Description of Artificial Sequence: Synthetic peptide
  Seed: TAMASASPS (MAGC3_HUMAN)
TIMASASPY

SEQ ID NO: 109850 - protein, 10 aa, Artificial Sequence
  Description of Artificial Sequence: Synthetic peptide
  Seed: TLWKDSDLPT (MAGC3_HUMAN)
TMWKDSDLPA

SEQ ID NO: 109851 - protein, 9 aa, Artificial Sequence
  Description of Artificial Sequence: Synthetic peptide
  Seed: GKFSLRRAV (MAGC3_HUMAN)
GEFSLRRAY

SEQ ID NO: 109852 - protein, 9 aa, Artificial Sequence
  Description of Artificial Sequence: Synthetic peptide
  Seed: LSAIGPIQR (MAGC3_HUMAN)
LAAIGPIQF

SEQ ID NO: 109853 - protein, 10 aa, Artificial Sequence
  Description of Artificial Sequence: Synthetic peptide
  Seed: KVDKLVQFLL (MAGC3_HUMAN)
KTDKLVQFLA

SEQ ID NO: 109854 - protein, 11 aa, Artificial Sequence
  Description of Artificial Sequence: Synthetic peptide
  Seed: AEMQMNVINTY (MAGC3_HUMAN)
ATMQMNVINTF

SEQ ID NO: 109855 - protein, 10 aa, Artificial Sequence
  Description of Artificial Sequence: Synthetic peptide
  Seed: LNAIGPWSAL (MAGC3_HUMAN)
LIAIGPWSAM

SEQ ID NO: 109856 - protein, 9 aa, Artificial Sequence
  Description of Artificial Sequence: Synthetic peptide
  Seed: FGSQPEGKF (MAGC3_HUMAN)
FASQPEGKF

SEQ ID NO: 109857 - protein, 9 aa, Artificial Sequence
  Description of Artificial Sequence: Synthetic peptide
  Seed: SLVLCPTYF (MAGC3_HUMAN)
SWVLCPTYF

SEQ ID NO: 109858 - protein, 11 aa, Artificial Sequence
  Description of Artificial Sequence: Synthetic peptide
  Seed: TDMDPDNHSYF (MAGC3_HUMAN)
TAMDPDNHSYF

SEQ ID NO: 109859 - protein, 10 aa, Artificial Sequence
  Description of Artificial Sequence: Synthetic peptide
  Seed: KLSSIIPSAF (MAGC3_HUMAN)
KLSSIIPSAY

SEQ ID NO: 109860 - protein, 9 aa, Artificial Sequence
  Description of Artificial Sequence: Synthetic peptide
  Seed: TLDEKVDKL (MAGC3_HUMAN)
TVDEKVDKV

SEQ ID NO: 109861 - protein, 10 aa, Artificial Sequence
  Description of Artificial Sequence: Synthetic peptide
  Seed: SKLSSIIPSA (MAGC3_HUMAN)
SKLSSIIPSV

SEQ ID NO: 109862 - protein, 11 aa, Artificial Sequence
  Description of Artificial Sequence: Synthetic peptide
  Seed: TLWKDSDLPTW (MAGC3_HUMAN)
TQWKDSDLPTY

SEQ ID NO: 109863 - protein, 9 aa, Artificial Sequence
  Description of Artificial Sequence: Synthetic peptide
  Seed: HLREVRLFL (MAGC3_HUMAN)
HSREVRLFM

SEQ ID NO: 109864 - protein, 9 aa, Artificial Sequence
  Description of Artificial Sequence: Synthetic peptide
  Seed: IFGKAHEFI (MAGC3_HUMAN)
IYGKAHEFM

SEQ ID NO: 109865 - protein, 9 aa, Artificial Sequence
  Description of Artificial Sequence: Synthetic peptide
  Seed: MASASPSVM (MAGC3_HUMAN)
MSSASPSVW

SEQ ID NO: 109866 - protein, 9 aa, Artificial Sequence
  Description of Artificial Sequence: Synthetic peptide
  Seed: LRSAEGSVL (MAGC3_HUMAN)
LSSAEGSVF

SEQ ID NO: 109867 - protein, 9 aa, Artificial Sequence
  Description of Artificial Sequence: Synthetic peptide
  Seed: MDPDNHSYF (MAGC3_HUMAN)
MSPDNHSYV

SEQ ID NO: 109868 - protein, 9 aa, Artificial Sequence
  Description of Artificial Sequence: Synthetic peptide
  Seed: NAIGPWSAL (MAGC3_HUMAN)
NIIGPWSAK

SEQ ID NO: 109869 - protein, 9 aa, Artificial Sequence
  Description of Artificial Sequence: Synthetic peptide
  Seed: YALSPVVLP (MAGC3_HUMAN)
YALSPVVLY

SEQ ID NO: 109870 - protein, 10 aa, Artificial Sequence
  Description of Artificial Sequence: Synthetic peptide
  Seed: ILILSVIFIK (MAGC3_HUMAN)
IYILSVIFIR

SEQ ID NO: 109871 - protein, 11 aa, Artificial Sequence
  Description of Artificial Sequence: Synthetic peptide
  Seed: KVAELVQFLLL (MAGC3_HUMAN)
KLAELVQFLLL

SEQ ID NO: 109872 - protein, 10 aa, Artificial Sequence
  Description of Artificial Sequence: Synthetic peptide
  Seed: RSAEGSVLDL (MAGC3_HUMAN)
RSAEGSVLDF

SEQ ID NO: 109873 - protein, 10 aa, Artificial Sequence
  Description of Artificial Sequence: Synthetic peptide
  Seed: SALAGFADVL (MAGC3_HUMAN)
SILAGFADVL

SEQ ID NO: 109874 - protein, 9 aa, Artificial Sequence
  Description of Artificial Sequence: Synthetic peptide
  Seed: SQPEGKFSL (MAGC3_HUMAN)
SMPEGKFSA

SEQ ID NO: 109875 - protein, 9 aa, Artificial Sequence
  Description of Artificial Sequence: Synthetic peptide
  Seed: GSLPESEPL (MAGC3_HUMAN)
GILPESEPV

SEQ ID NO: 109876 - protein, 9 aa, Artificial Sequence
  Description of Artificial Sequence: Synthetic peptide
  Seed: GFADVLSRL (MAGC3_HUMAN)
GRADVLSRY

SEQ ID NO: 109877 - protein, 10 aa, Artificial Sequence
  Description of Artificial Sequence: Synthetic peptide
  Seed: ILFGISLTEV (MAGC3_HUMAN)
ITFGISLTEI

SEQ ID NO: 109878 - protein, 9 aa, Artificial Sequence
  Description of Artificial Sequence: Synthetic peptide
  Seed: FKLWRTLSG (MAGC3_HUMAN)
FGLWRTLSY

SEQ ID NO: 109879 - protein, 11 aa, Artificial Sequence
  Description of Artificial Sequence: Synthetic peptide
  Seed: EVLSAIGPIQR (MAGC3_HUMAN)
ESLSAIGPIQK

SEQ ID NO: 109880 - protein, 9 aa, Artificial Sequence
  Description of Artificial Sequence: Synthetic peptide
  Seed: EVDPDHFYV (MAGC3_HUMAN)
EFDPDHFYV

SEQ ID NO: 109881 - protein, 9 aa, Artificial Sequence
  Description of Artificial Sequence: Synthetic peptide
  Seed: FSDGSLGQW (MAGC3_HUMAN)
FLDGSLGQL

SEQ ID NO: 109882 - protein, 9 aa, Artificial Sequence
  Description of Artificial Sequence: Synthetic peptide
  Seed: IIDTTDDAT (MAGC3_HUMAN)
IFDTTDDAV

SEQ ID NO: 109883 - protein, 9 aa, Artificial Sequence
  Description of Artificial Sequence: Synthetic peptide
  Seed: FLSKLSSII (MAGC3_HUMAN)
FASKLSSIF

SEQ ID NO: 109884 - protein, 10 aa, Artificial Sequence
  Description of Artificial Sequence: Synthetic peptide
  Seed: YALDEKVAEL (MAGC3_HUMAN)
YFLDEKVAEY

SEQ ID NO: 109885 - protein, 11 aa, Artificial Sequence
  Description of Artificial Sequence: Synthetic peptide
  Seed: AEMQMNVINTY (MAGC3_HUMAN)
AEMQMNVINTW

SEQ ID NO: 109886 - protein, 9 aa, Artificial Sequence
  Description of Artificial Sequence: Synthetic peptide
  Seed: SEEEDTATW (MAGC3_HUMAN)
SMEEDTATI

SEQ ID NO: 109887 - protein, 9 aa, Artificial Sequence
  Description of Artificial Sequence: Synthetic peptide
  Seed: SIIPSAFPS (MAGC3_HUMAN)
SAIPSAFPA

SEQ ID NO: 109888 - protein, 10 aa, Artificial Sequence
  Description of Artificial Sequence: Synthetic peptide
  Seed: TYFKLWRTLS (MAGC3_HUMAN)
TYFKLWRTLM

SEQ ID NO: 109889 - protein, 10 aa, Artificial Sequence
  Description of Artificial Sequence: Synthetic peptide
  Seed: TGYFPMIFRK (MAGC3_HUMAN)
TMYFPMIFRM

SEQ ID NO: 109890 - protein, 8 aa, Artificial Sequence
  Description of Artificial Sequence: Synthetic peptide
  Seed: FADVLSRL (MAGC3_HUMAN)
FGDVLSRV

SEQ ID NO: 109891 - protein, 9 aa, Artificial Sequence
  Description of Artificial Sequence: Synthetic peptide
  Seed: ISPQGPPQS (MAGC3_HUMAN)
IAPQGPPQM

SEQ ID NO: 109892 - protein, 10 aa, Artificial Sequence
  Description of Artificial Sequence: Synthetic peptide
  Seed: REVRLFLRGG (MAGC3_HUMAN)
RAVRLFLRGV

SEQ ID NO: 109893 - protein, 10 aa, Artificial Sequence
  Description of Artificial Sequence: Synthetic peptide
  Seed: SKLSSIIPSA (MAGC3_HUMAN)
SKLSSIIPSM

SEQ ID NO: 109894 - protein, 9 aa, Artificial Sequence
  Description of Artificial Sequence: Synthetic peptide
  Seed: EKVDKLVQF (MAGC3_HUMAN)
EVVDKLVQF

SEQ ID NO: 109895 - protein, 9 aa, Artificial Sequence
  Description of Artificial Sequence: Synthetic peptide
  Seed: KLWRTLSGS (MAGC3_HUMAN)
KMWRTLSGM

SEQ ID NO: 109896 - protein, 9 aa, Artificial Sequence
  Description of Artificial Sequence: Synthetic peptide
  Seed: RTLSGSPGL (MAGC3_HUMAN)
RVLSGSPGR

SEQ ID NO: 109897 - protein, 10 aa, Artificial Sequence
  Description of Artificial Sequence: Synthetic peptide
  Seed: LNAIGPWSAL (MAGC3_HUMAN)
LHAIGPWSAY

SEQ ID NO: 109898 - protein, 9 aa, Artificial Sequence
  Description of Artificial Sequence: Synthetic peptide
  Seed: LSSIIPSAF (MAGC3_HUMAN)
LESIIPSAY

SEQ ID NO: 109899 - protein, 9 aa, Artificial Sequence
  Description of Artificial Sequence: Synthetic peptide
  Seed: LILSVIFIK (MAGC3_HUMAN)
LGLSVIFIR

SEQ ID NO: 109900 - protein, 9 aa, Artificial Sequence
  Description of Artificial Sequence: Synthetic peptide
  Seed: WEVLSAIGP (MAGC3_HUMAN)
WEVLSAIGV

SEQ ID NO: 109901 - protein, 9 aa, Artificial Sequence
  Description of Artificial Sequence: Synthetic peptide
  Seed: VIWEVLNAI (MAGC3_HUMAN)
VIWEVLNAL

SEQ ID NO: 109902 - protein, 11 aa, Artificial Sequence
  Description of Artificial Sequence: Synthetic peptide
  Seed: RYALDEKVAEL (MAGC3_HUMAN)
RTALDEKVAEV

SEQ ID NO: 109903 - protein, 10 aa, Artificial Sequence
  Description of Artificial Sequence: Synthetic peptide
  Seed: EKVAELVQFL (MAGC3_HUMAN)
EYVAELVQFI

SEQ ID NO: 109904 - protein, 9 aa, Artificial Sequence
  Description of Artificial Sequence: Synthetic peptide
  Seed: LTEVDPDHF (MAGC3_HUMAN)
LSEVDPDHY

SEQ ID NO: 109905 - protein, 8 aa, Artificial Sequence
  Description of Artificial Sequence: Synthetic peptide
  Seed: LDEKVAEL (MAGC3_HUMAN)
LFEKVAEL

SEQ ID NO: 109906 - protein, 9 aa, Artificial Sequence
  Description of Artificial Sequence: Synthetic peptide
  Seed: RTLSGSPGL (MAGC3_HUMAN)
RILSGSPGR

SEQ ID NO: 109907 - protein, 10 aa, Artificial Sequence
  Description of Artificial Sequence: Synthetic peptide
  Seed: LTEVDPDHFY (MAGC3_HUMAN)
LIEVDPDHFY

SEQ ID NO: 109908 - protein, 11 aa, Artificial Sequence
  Description of Artificial Sequence: Synthetic peptide
  Seed: LDSCSSPLLWT (MAGC3_HUMAN)
LASCSSPLLWY

SEQ ID NO: 109909 - protein, 10 aa, Artificial Sequence
  Description of Artificial Sequence: Synthetic peptide
  Seed: KLVQFLLLKY (MAGC3_HUMAN)
KQVQFLLLKK

SEQ ID NO: 109910 - protein, 8 aa, Artificial Sequence
  Description of Artificial Sequence: Synthetic peptide
  Seed: DEKVAELV (MAGC3_HUMAN)
DEKVAELY

SEQ ID NO: 109911 - protein, 10 aa, Artificial Sequence
  Description of Artificial Sequence: Synthetic peptide
  Seed: MQMNVINTYT (MAGC3_HUMAN)
MMMNVINTYK

SEQ ID NO: 109912 - protein, 9 aa, Artificial Sequence
  Description of Artificial Sequence: Synthetic peptide
  Seed: QTKEPVTKA (MAGC3_HUMAN)
QGKEPVTKY

SEQ ID NO: 109913 - protein, 9 aa, Artificial Sequence
  Description of Artificial Sequence: Synthetic peptide
  Seed: IIPSAFPSW (MAGC3_HUMAN)
IMPSAFPSY

SEQ ID NO: 109914 - protein, 9 aa, Artificial Sequence
  Description of Artificial Sequence: Synthetic peptide
  Seed: RGTGYTLSL (MAGC3_HUMAN)
RHTGYTLSM

SEQ ID NO: 109915 - protein, 10 aa, Artificial Sequence
  Description of Artificial Sequence: Synthetic peptide
  Seed: EVIWEVLNAI (MAGC3_HUMAN)
ETIWEVLNAW

SEQ ID NO: 109916 - protein, 10 aa, Artificial Sequence
  Description of Artificial Sequence: Synthetic peptide
  Seed: YQAKEPLTRA (MAGC3_HUMAN)
YLAKEPLTRV

SEQ ID NO: 109917 - protein, 9 aa, Artificial Sequence
  Description of Artificial Sequence: Synthetic peptide
  Seed: FPMIFRKAR (MAGC3_HUMAN)
FSMIFRKAR

SEQ ID NO: 109918 - protein, 9 aa, Artificial Sequence
  Description of Artificial Sequence: Synthetic peptide
  Seed: SIIPSAFPS (MAGC3_HUMAN)
SLIPSAFPM

SEQ ID NO: 109919 - protein, 9 aa, Artificial Sequence
  Description of Artificial Sequence: Synthetic peptide
  Seed: VLCPTYFKL (MAGC3_HUMAN)
VMCPTYFKF

SEQ ID NO: 109920 - protein, 9 aa, Artificial Sequence
  Description of Artificial Sequence: Synthetic peptide
  Seed: FADVLSRLA (MAGC3_HUMAN)
FSDVLSRLF

SEQ ID NO: 109921 - protein, 8 aa, Artificial Sequence
  Description of Artificial Sequence: Synthetic peptide
  Seed: MEDRAQAI (MAGC3_HUMAN)
MGDRAQAL

SEQ ID NO: 109922 - protein, 9 aa, Artificial Sequence
  Description of Artificial Sequence: Synthetic peptide
  Seed: MLLPCHWVL (MAGC3_HUMAN)
MALPCHWVM

SEQ ID NO: 109923 - protein, 10 aa, Artificial Sequence
  Description of Artificial Sequence: Synthetic peptide
  Seed: TGYFPMIFRK (MAGC3_HUMAN)
TMYFPMIFRW

SEQ ID NO: 109924 - protein, 9 aa, Artificial Sequence
  Description of Artificial Sequence: Synthetic peptide
  Seed: TTDDATAMA (MAGC3_HUMAN)
TGDDATAML

SEQ ID NO: 109925 - protein, 10 aa, Artificial Sequence
  Description of Artificial Sequence: Synthetic peptide
  Seed: TTDDATAMAS (MAGC3_HUMAN)
TSDDATAMAL

SEQ ID NO: 109926 - protein, 9 aa, Artificial Sequence
  Description of Artificial Sequence: Synthetic peptide
  Seed: FPMIFGKAH (MAGC3_HUMAN)
FAMIFGKAM

SEQ ID NO: 109927 - protein, 10 aa, Artificial Sequence
  Description of Artificial Sequence: Synthetic peptide
  Seed: LTRAEMQMNV (MAGC3_HUMAN)
LIRAEMQMNV

SEQ ID NO: 109928 - protein, 9 aa, Artificial Sequence
  Description of Artificial Sequence: Synthetic peptide
  Seed: SLPESEPLF (MAGC3_HUMAN)
SAPESEPLL

SEQ ID NO: 109929 - protein, 9 aa, Artificial Sequence
  Description of Artificial Sequence: Synthetic peptide
  Seed: REVLEFLSK (MAGC3_HUMAN)
RTVLEFLSR

SEQ ID NO: 109930 - protein, 9 aa, Artificial Sequence
  Description of Artificial Sequence: Synthetic peptide
  Seed: KKYKDYFPM (MAGC3_HUMAN)
KQYKDYFPM

SEQ ID NO: 109931 - protein, 11 aa, Artificial Sequence
  Description of Artificial Sequence: Synthetic peptide
  Seed: FPMIFRKAREF (MAGC3_HUMAN)
FPMIFRKAREM

SEQ ID NO: 109932 - protein, 9 aa, Artificial Sequence
  Description of Artificial Sequence: Synthetic peptide
  Seed: DYFPMIFGK (MAGC3_HUMAN)
DFFPMIFGR

SEQ ID NO: 109933 - protein, 11 aa, Artificial Sequence
  Description of Artificial Sequence: Synthetic peptide
  Seed: VLDATFSDGSL (MAGC3_HUMAN)
VVDATFSDGSL

SEQ ID NO: 109934 - protein, 9 aa, Artificial Sequence
  Description of Artificial Sequence: Synthetic peptide
  Seed: AGFADVLSR (MAGC3_HUMAN)
AAFADVLSK

SEQ ID NO: 109935 - protein, 10 aa, Artificial Sequence
  Description of Artificial Sequence: Synthetic peptide
  Seed: CASEEVIWEV (MAGC3_HUMAN)
CVSEEVIWEI

SEQ ID NO: 109936 - protein, 10 aa, Artificial Sequence
  Description of Artificial Sequence: Synthetic peptide
  Seed: MLTTVIKKYK (MAGC3_HUMAN)
MKTTVIKKYR

SEQ ID NO: 109937 - protein, 10 aa, Artificial Sequence
  Description of Artificial Sequence: Synthetic peptide
  Seed: KLSSIIPSAF (MAGC3_HUMAN)
KMSSIIPSAR

SEQ ID NO: 109938 - protein, 9 aa, Artificial Sequence
  Description of Artificial Sequence: Synthetic peptide
  Seed: HALPESESL (MAGC3_HUMAN)
HPLPESESM

SEQ ID NO: 109939 - protein, 10 aa, Artificial Sequence
  Description of Artificial Sequence: Synthetic peptide
  Seed: LPTWRRGTGY (MAGC3_HUMAN)
LYTWRRGTGW

SEQ ID NO: 109940 - protein, 11 aa, Artificial Sequence
  Description of Artificial Sequence: Synthetic peptide
  Seed: FPMIFGKAHEF (MAGC3_HUMAN)
FPMIFGKAHEA

SEQ ID NO: 109941 - protein, 10 aa, Artificial Sequence
  Description of Artificial Sequence: Synthetic peptide
  Seed: MNVINTYTGY (MAGC3_HUMAN)
MYVINTYTGY

SEQ ID NO: 109942 - protein, 11 aa, Artificial Sequence
  Description of Artificial Sequence: Synthetic peptide
  Seed: ILFGISLTEVD (MAGC3_HUMAN)
ILFGISLTEVS

SEQ ID NO: 109943 - protein, 10 aa, Artificial Sequence
  Description of Artificial Sequence: Synthetic peptide
  Seed: AFPSWYMDAL (MAGC3_HUMAN)
AWPSWYMDAF

SEQ ID NO: 109944 - protein, 10 aa, Artificial Sequence
  Description of Artificial Sequence: Synthetic peptide
  Seed: YTLDEKVDKL (MAGC3_HUMAN)
YSLDEKVDKF

SEQ ID NO: 109945 - protein, 8 aa, Artificial Sequence
  Description of Artificial Sequence: Synthetic peptide
  Seed: ILILSMIF (MAGC3_HUMAN)
IMILSMIY

SEQ ID NO: 109946 - protein, 9 aa, Artificial Sequence
  Description of Artificial Sequence: Synthetic peptide
  Seed: ILILSVIFI (MAGC3_HUMAN)
ILILSVIFL

SEQ ID NO: 109947 - protein, 9 aa, Artificial Sequence
  Description of Artificial Sequence: Synthetic peptide
  Seed: MLLPCHWVL (MAGC3_HUMAN)
MMLPCHWVA

SEQ ID NO: 109948 - protein, 9 aa, Artificial Sequence
  Description of Artificial Sequence: Synthetic peptide
  Seed: TAMASASPS (MAGC3_HUMAN)
TTMASASPF

SEQ ID NO: 109949 - protein, 9 aa, Artificial Sequence
  Description of Artificial Sequence: Synthetic peptide
  Seed: TEASPQQKK (MAGC3_HUMAN)
TLASPQQKK

SEQ ID NO: 109950 - protein, 9 aa, Artificial Sequence
  Description of Artificial Sequence: Synthetic peptide
  Seed: IIPSAFPSW (MAGC3_HUMAN)
IGPSAFPSM

SEQ ID NO: 109951 - protein, 10 aa, Artificial Sequence
  Description of Artificial Sequence: Synthetic peptide
  Seed: SDQRMDSLVL (MAGC3_HUMAN)
STQRMDSLVF

SEQ ID NO: 109952 - protein, 10 aa, Artificial Sequence
  Description of Artificial Sequence: Synthetic peptide
  Seed: SCSSPLLWTR (MAGC3_HUMAN)
SQSSPLLWTR

SEQ ID NO: 109953 - protein, 9 aa, Artificial Sequence
  Description of Artificial Sequence: Synthetic peptide
  Seed: KLVQFLLLK (MAGC3_HUMAN)
KIVQFLLLR

SEQ ID NO: 109954 - protein, 10 aa, Artificial Sequence
  Description of Artificial Sequence: Synthetic peptide
  Seed: RLLILILSVI (MAGC3_HUMAN)
RGLILILSVV

SEQ ID NO: 109955 - protein, 10 aa, Artificial Sequence
  Description of Artificial Sequence: Synthetic peptide
  Seed: SLPRYALDEK (MAGC3_HUMAN)
SVPRYALDEK

SEQ ID NO: 109956 - protein, 11 aa, Artificial Sequence
  Description of Artificial Sequence: Synthetic peptide
  Seed: YALDEKVAELV (MAGC3_HUMAN)
YMLDEKVAELY

SEQ ID NO: 109957 - protein, 8 aa, Artificial Sequence
  Description of Artificial Sequence: Synthetic peptide
  Seed: SLRRAVSV (MAGC3_HUMAN)
SLRRAVSL

SEQ ID NO: 109958 - protein, 11 aa, Artificial Sequence
  Description of Artificial Sequence: Synthetic peptide
  Seed: FSDGSLGQWVK (MAGC3_HUMAN)
FADGSLGQWVY

SEQ ID NO: 109959 - protein, 10 aa, Artificial Sequence
  Description of Artificial Sequence: Synthetic peptide
  Seed: GLRSAEGSVL (MAGC3_HUMAN)
GMRSAEGSVF

SEQ ID NO: 109960 - protein, 10 aa, Artificial Sequence
  Description of Artificial Sequence: Synthetic peptide
  Seed: REVRLFLRGG (MAGC3_HUMAN)
RKVRLFLRGK

SEQ ID NO: 109961 - protein, 9 aa, Artificial Sequence
  Description of Artificial Sequence: Synthetic peptide
  Seed: AIGPWSALA (MAGC3_HUMAN)
ALGPWSALT

SEQ ID NO: 109962 - protein, 11 aa, Artificial Sequence
  Description of Artificial Sequence: Synthetic peptide
  Seed: SASPSVMSTNF (MAGC3_HUMAN)
SPSPSVMSTNW

SEQ ID NO: 109963 - protein, 9 aa, Artificial Sequence
  Description of Artificial Sequence: Synthetic peptide
  Seed: TTDDATAMA (MAGC3_HUMAN)
TWDDATAMM

SEQ ID NO: 109964 - protein, 9 aa, Artificial Sequence
  Description of Artificial Sequence: Synthetic peptide
  Seed: SAIGPIQRP (MAGC3_HUMAN)
SVIGPIQRF

SEQ ID NO: 109965 - protein, 9 aa, Artificial Sequence
  Description of Artificial Sequence: Synthetic peptide
  Seed: KLSSIIPSA (MAGC3_HUMAN)
KMSSIIPSV

SEQ ID NO: 109966 - protein, 9 aa, Artificial Sequence
  Description of Artificial Sequence: Synthetic peptide
  Seed: SLRRAVSVK (MAGC3_HUMAN)
SYRRAVSVA

SEQ ID NO: 109967 - protein, 11 aa, Artificial Sequence
  Description of Artificial Sequence: Synthetic peptide
  Seed: TAMASASPSVM (MAGC3_HUMAN)
TPMASASPSVL

SEQ ID NO: 109968 - protein, 9 aa, Artificial Sequence
  Description of Artificial Sequence: Synthetic peptide
  Seed: REEPQDWPL (MAGC3_HUMAN)
RQEPQDWPW

SEQ ID NO: 109969 - protein, 11 aa, Artificial Sequence
  Description of Artificial Sequence: Synthetic peptide
  Seed: TSDQRMDSLVL (MAGC3_HUMAN)
TKDQRMDSLVF

SEQ ID NO: 109970 - protein, 9 aa, Artificial Sequence
  Description of Artificial Sequence: Synthetic peptide
  Seed: YSAFHLGHL (MAGC3_HUMAN)
YIAFHLGHY

SEQ ID NO: 109971 - protein, 9 aa, Artificial Sequence
  Description of Artificial Sequence: Synthetic peptide
  Seed: GMPKNCLLI (MAGC3_HUMAN)
GAPKNCLLL

SEQ ID NO: 109972 - protein, 9 aa, Artificial Sequence
  Description of Artificial Sequence: Synthetic peptide
  Seed: LILSMIFIK (MAGC3_HUMAN)
LFLSMIFIR

SEQ ID NO: 109973 - protein, 9 aa, Artificial Sequence
  Description of Artificial Sequence: Synthetic peptide
  Seed: KYKDYFPMI (MAGC3_HUMAN)
KAKDYFPMI

SEQ ID NO: 109974 - protein, 9 aa, Artificial Sequence
  Description of Artificial Sequence: Synthetic peptide
  Seed: FLSKLSSII (MAGC3_HUMAN)
FVSKLSSII

SEQ ID NO: 109975 - protein, 9 aa, Artificial Sequence
  Description of Artificial Sequence: Synthetic peptide
  Seed: IIPSAFPSW (MAGC3_HUMAN)
IAPSAFPSY

SEQ ID NO: 109976 - protein, 9 aa, Artificial Sequence
  Description of Artificial Sequence: Synthetic peptide
  Seed: IIDTTDDAT (MAGC3_HUMAN)
IMDTTDDAL

SEQ ID NO: 109977 - protein, 9 aa, Artificial Sequence
  Description of Artificial Sequence: Synthetic peptide
  Seed: EVIWEVLNA (MAGC3_HUMAN)
EVIWEVLNI

SEQ ID NO: 109978 - protein, 9 aa, Artificial Sequence
  Description of Artificial Sequence: Synthetic peptide
  Seed: FSLRRAVSV (MAGC3_HUMAN)
FVLRRAVSW

SEQ ID NO: 109979 - protein, 9 aa, Artificial Sequence
  Description of Artificial Sequence: Synthetic peptide
  Seed: EVLSAIGPI (MAGC3_HUMAN)
ETLSAIGPM

SEQ ID NO: 109980 - protein, 9 aa, Artificial Sequence
  Description of Artificial Sequence: Synthetic peptide
  Seed: QPQPRKKAT (MAGC3_HUMAN)
QPQPRKKAM

SEQ ID NO: 109981 - protein, 10 aa, Artificial Sequence
  Description of Artificial Sequence: Synthetic peptide
  Seed: YALSPVVLPP (MAGC3_HUMAN)
YHLSPVVLPI

SEQ ID NO: 109982 - protein, 9 aa, Artificial Sequence
  Description of Artificial Sequence: Synthetic peptide
  Seed: KVDKLVQFL (MAGC3_HUMAN)
KFDKLVQFM

SEQ ID NO: 109983 - protein, 9 aa, Artificial Sequence
  Description of Artificial Sequence: Synthetic peptide
  Seed: KEPLTRAEM (MAGC3_HUMAN)
KAPLTRAEL

SEQ ID NO: 109984 - protein, 9 aa, Artificial Sequence
  Description of Artificial Sequence: Synthetic peptide
  Seed: TLDEKVDKL (MAGC3_HUMAN)
TVDEKVDKL

SEQ ID NO: 109985 - protein, 10 aa, Artificial Sequence
  Description of Artificial Sequence: Synthetic peptide
  Seed: FKLWRTLSGS (MAGC3_HUMAN)
FYLWRTLSGI

SEQ ID NO: 109986 - protein, 10 aa, Artificial Sequence
  Description of Artificial Sequence: Synthetic peptide
  Seed: YALDEKVAEL (MAGC3_HUMAN)
YYLDEKVAEI

SEQ ID NO: 109987 - protein, 9 aa, Artificial Sequence
  Description of Artificial Sequence: Synthetic peptide
  Seed: KQREEPQDW (MAGC3_HUMAN)
KTREEPQDW

SEQ ID NO: 109988 - protein, 10 aa, Artificial Sequence
  Description of Artificial Sequence: Synthetic peptide
  Seed: ILILSMIFIK (MAGC3_HUMAN)
IRILSMIFIR

SEQ ID NO: 109989 - protein, 9 aa, Artificial Sequence
  Description of Artificial Sequence: Synthetic peptide
  Seed: ALSPVVLPP (MAGC3_HUMAN)
AVSPVVLPM

SEQ ID NO: 109990 - protein, 9 aa, Artificial Sequence
  Description of Artificial Sequence: Synthetic peptide
  Seed: HLREVRLFL (MAGC3_HUMAN)
HRREVRLFM

SEQ ID NO: 109991 - protein, 10 aa, Artificial Sequence
  Description of Artificial Sequence: Synthetic peptide
  Seed: RPAREVLEFL (MAGC3_HUMAN)
RQAREVLEFK

SEQ ID NO: 109992 - protein, 9 aa, Artificial Sequence
  Description of Artificial Sequence: Synthetic peptide
  Seed: KAHEFIELI (MAGC3_HUMAN)
KFHEFIELY

SEQ ID NO: 109993 - protein, 9 aa, Artificial Sequence
  Description of Artificial Sequence: Synthetic peptide
  Seed: KDMEDRAQA (MAGC3_HUMAN)
KEMEDRAQV

SEQ ID NO: 109994 - protein, 10 aa, Artificial Sequence
  Description of Artificial Sequence: Synthetic peptide
  Seed: IKKYKDYFPM (MAGC3_HUMAN)
IKKYKDYFPY

SEQ ID NO: 109995 - protein, 9 aa, Artificial Sequence
  Description of Artificial Sequence: Synthetic peptide
  Seed: YTGYFPMIF (MAGC3_HUMAN)
YKGYFPMIL

SEQ ID NO: 109996 - protein, 10 aa, Artificial Sequence
  Description of Artificial Sequence: Synthetic peptide
  Seed: KYKDYFPMIF (MAGC3_HUMAN)
KQKDYFPMIF

SEQ ID NO: 109997 - protein, 9 aa, Artificial Sequence
  Description of Artificial Sequence: Synthetic peptide
  Seed: VLCPTYFKL (MAGC3_HUMAN)
VYCPTYFKL

SEQ ID NO: 109998 - protein, 9 aa, Artificial Sequence
  Description of Artificial Sequence: Synthetic peptide
  Seed: KVAELVQFL (MAGC3_HUMAN)
KSAELVQFL

SEQ ID NO: 109999 - protein, 9 aa, Artificial Sequence
  Description of Artificial Sequence: Synthetic peptide
  Seed: CSSPLLWTR (MAGC3_HUMAN)
CASPLLWTR

SEQ ID NO: 110000 - protein, 9 aa, Artificial Sequence
  Description of Artificial Sequence: Synthetic peptide
  Seed: KVAELVQFL (MAGC3_HUMAN)
KVAELVQFF

SEQ ID NO: 110001 - protein, 9 aa, Artificial Sequence
  Description of Artificial Sequence: Synthetic peptide
  Seed: LSAIGPIQR (MAGC3_HUMAN)
LIAIGPIQR

SEQ ID NO: 110002 - protein, 10 aa, Artificial Sequence
  Description of Artificial Sequence: Synthetic peptide
  Seed: SALAGFADVL (MAGC3_HUMAN)
SDLAGFADVL

SEQ ID NO: 110003 - protein, 9 aa, Artificial Sequence
  Description of Artificial Sequence: Synthetic peptide
  Seed: MPKNCLLIL (MAGC3_HUMAN)
MVKNCLLIF

SEQ ID NO: 110004 - protein, 11 aa, Artificial Sequence
  Description of Artificial Sequence: Synthetic peptide
  Seed: ATFSDGSLGQW (MAGC3_HUMAN)
AFFSDGSLGQY

SEQ ID NO: 110005 - protein, 9 aa, Artificial Sequence
  Description of Artificial Sequence: Synthetic peptide
  Seed: TTDDATAMA (MAGC3_HUMAN)
TLDDATAMF

SEQ ID NO: 110006 - protein, 11 aa, Artificial Sequence
  Description of Artificial Sequence: Synthetic peptide
  Seed: FIELIFGIALT (MAGC3_HUMAN)
FLELIFGIALI

SEQ ID NO: 110007 - protein, 11 aa, Artificial Sequence
  Description of Artificial Sequence: Synthetic peptide
  Seed: SSSEEEDTATW (MAGC3_HUMAN)
STSEEEDTATF

SEQ ID NO: 110008 - protein, 9 aa, Artificial Sequence
  Description of Artificial Sequence: Synthetic peptide
  Seed: FSDGSLGQW (MAGC3_HUMAN)
FLDGSLGQF

SEQ ID NO: 110009 - protein, 9 aa, Artificial Sequence
  Description of Artificial Sequence: Synthetic peptide
  Seed: LKYQAKEPL (MAGC3_HUMAN)
LGYQAKEPY

SEQ ID NO: 110010 - protein, 11 aa, Artificial Sequence
  Description of Artificial Sequence: Synthetic peptide
  Seed: SSEEEDTATWH (MAGC3_HUMAN)
SVEEEDTATWY

SEQ ID NO: 110011 - protein, 9 aa, Artificial Sequence
  Description of Artificial Sequence: Synthetic peptide
  Seed: LVLCPTYFK (MAGC3_HUMAN)
LFLCPTYFR

SEQ ID NO: 110012 - protein, 9 aa, Artificial Sequence
  Description of Artificial Sequence: Synthetic peptide
  Seed: YTLDEKVDK (MAGC3_HUMAN)
YVLDEKVDL

SEQ ID NO: 110013 - protein, 10 aa, Artificial Sequence
  Description of Artificial Sequence: Synthetic peptide
  Seed: KAHEFIELIF (MAGC3_HUMAN)
KKHEFIELIY

SEQ ID NO: 110014 - protein, 9 aa, Artificial Sequence
  Description of Artificial Sequence: Synthetic peptide
  Seed: SALAGFADV (MAGC3_HUMAN)
SILAGFADI

SEQ ID NO: 110015 - protein, 9 aa, Artificial Sequence
  Description of Artificial Sequence: Synthetic peptide
  Seed: MLLPCHWVL (MAGC3_HUMAN)
MILPCHWVK

SEQ ID NO: 110016 - protein, 9 aa, Artificial Sequence
  Description of Artificial Sequence: Synthetic peptide
  Seed: VDPDHFYVF (MAGC3_HUMAN)
VHPDHFYVY

SEQ ID NO: 110017 - protein, 9 aa, Artificial Sequence
  Description of Artificial Sequence: Synthetic peptide
  Seed: FEDTLDLTY (MAGC3_HUMAN)
FADTLDLTF

SEQ ID NO: 110018 - protein, 8 aa, Artificial Sequence
  Description of Artificial Sequence: Synthetic peptide
  Seed: YMDALKDM (MAGC3_HUMAN)
YWDALKDM

SEQ ID NO: 110019 - protein, 9 aa, Artificial Sequence
  Description of Artificial Sequence: Synthetic peptide
  Seed: YTGYFPMIF (MAGC3_HUMAN)
YYGYFPMIY

SEQ ID NO: 110020 - protein, 10 aa, Artificial Sequence
  Description of Artificial Sequence: Synthetic peptide
  Seed: MQMNVINTYT (MAGC3_HUMAN)
MQMNVINTYV

SEQ ID NO: 110021 - protein, 9 aa, Artificial Sequence
  Description of Artificial Sequence: Synthetic peptide
  Seed: LRSAEGSVL (MAGC3_HUMAN)
LISAEGSVF

SEQ ID NO: 110022 - protein, 9 aa, Artificial Sequence
  Description of Artificial Sequence: Synthetic peptide
  Seed: VIKKYKDYF (MAGC3_HUMAN)
VTKKYKDYY

SEQ ID NO: 110023 - protein, 9 aa, Artificial Sequence
  Description of Artificial Sequence: Synthetic peptide
  Seed: ISPQGPPQS (MAGC3_HUMAN)
ISPQGPPQF

SEQ ID NO: 110024 - protein, 9 aa, Artificial Sequence
  Description of Artificial Sequence: Synthetic peptide
  Seed: ATYALSPVV (MAGC3_HUMAN)
AQYALSPVW

SEQ ID NO: 110025 - protein, 10 aa, Artificial Sequence
  Description of Artificial Sequence: Synthetic peptide
  Seed: SALAGFADVL (MAGC3_HUMAN)
SRLAGFADVV

SEQ ID NO: 110026 - protein, 10 aa, Artificial Sequence
  Description of Artificial Sequence: Synthetic peptide
  Seed: SALAGFADVL (MAGC3_HUMAN)
SELAGFADVL

SEQ ID NO: 110027 - protein, 9 aa, Artificial Sequence
  Description of Artificial Sequence: Synthetic peptide
  Seed: KAHEFIELI (MAGC3_HUMAN)
KHHEFIELF

SEQ ID NO: 110028 - protein, 9 aa, Artificial Sequence
  Description of Artificial Sequence: Synthetic peptide
  Seed: VINTYTGYF (MAGC3_HUMAN)
VSNTYTGYF

SEQ ID NO: 110029 - protein, 9 aa, Artificial Sequence
  Description of Artificial Sequence: Synthetic peptide
  Seed: TLDEKVDKL (MAGC3_HUMAN)
TRDEKVDKL

SEQ ID NO: 110030 - protein, 9 aa, Artificial Sequence
  Description of Artificial Sequence: Synthetic peptide
  Seed: WVKNTCATY (MAGC3_HUMAN)
WQKNTCATM

SEQ ID NO: 110031 - protein, 10 aa, Artificial Sequence
  Description of Artificial Sequence: Synthetic peptide
  Seed: MIFGKAHEFI (MAGC3_HUMAN)
MTFGKAHEFI

SEQ ID NO: 110032 - protein, 10 aa, Artificial Sequence
  Description of Artificial Sequence: Synthetic peptide
  Seed: YALSPVVLPP (MAGC3_HUMAN)
YTLSPVVLPI

SEQ ID NO: 110033 - protein, 9 aa, Artificial Sequence
  Description of Artificial Sequence: Synthetic peptide
  Seed: KAHEFIELI (MAGC3_HUMAN)
KLHEFIELA

SEQ ID NO: 110034 - protein, 10 aa, Artificial Sequence
  Description of Artificial Sequence: Synthetic peptide
  Seed: KDYFPMIFGK (MAGC3_HUMAN)
KPYFPMIFGR

SEQ ID NO: 110035 - protein, 9 aa, Artificial Sequence
  Description of Artificial Sequence: Synthetic peptide
  Seed: SASPSVMST (MAGC3_HUMAN)
SSSPSVMSF

SEQ ID NO: 110036 - protein, 9 aa, Artificial Sequence
  Description of Artificial Sequence: Synthetic peptide
  Seed: SAEGSVLDL (MAGC3_HUMAN)
SAEGSVLDM

SEQ ID NO: 110037 - protein, 10 aa, Artificial Sequence
  Description of Artificial Sequence: Synthetic peptide
  Seed: MQMNVINTYT (MAGC3_HUMAN)
MQMNVINTYR

SEQ ID NO: 110038 - protein, 9 aa, Artificial Sequence
  Description of Artificial Sequence: Synthetic peptide
  Seed: TYFKLWRTL (MAGC3_HUMAN)
TYFKLWRTM

SEQ ID NO: 110039 - protein, 11 aa, Artificial Sequence
  Description of Artificial Sequence: Synthetic peptide
  Seed: AEMQMNVINTY (MAGC3_HUMAN)
AGMQMNVINTF

SEQ ID NO: 110040 - protein, 9 aa, Artificial Sequence
  Description of Artificial Sequence: Synthetic peptide
  Seed: HLREVRLFL (MAGC3_HUMAN)
HAREVRLFF

SEQ ID NO: 110041 - protein, 10 aa, Artificial Sequence
  Description of Artificial Sequence: Synthetic peptide
  Seed: TTDDATAMAS (MAGC3_HUMAN)
TQDDATAMAM

SEQ ID NO: 110042 - protein, 10 aa, Artificial Sequence
  Description of Artificial Sequence: Synthetic peptide
  Seed: AMASASPSVM (MAGC3_HUMAN)
AIASASPSVY

SEQ ID NO: 110043 - protein, 8 aa, Artificial Sequence
  Description of Artificial Sequence: Synthetic peptide
  Seed: FADVLSRL (MAGC3_HUMAN)
FYDVLSRV

SEQ ID NO: 110044 - protein, 9 aa, Artificial Sequence
  Description of Artificial Sequence: Synthetic peptide
  Seed: ALAGFADVL (MAGC3_HUMAN)
AQAGFADVW

SEQ ID NO: 110045 - protein, 9 aa, Artificial Sequence
  Description of Artificial Sequence: Synthetic peptide
  Seed: NVINTYTGY (MAGC3_HUMAN)
NLINTYTGK

SEQ ID NO: 110046 - protein, 9 aa, Artificial Sequence
  Description of Artificial Sequence: Synthetic peptide
  Seed: MLLPCHWVL (MAGC3_HUMAN)
MILPCHWVA

SEQ ID NO: 110047 - protein, 10 aa, Artificial Sequence
  Description of Artificial Sequence: Synthetic peptide
  Seed: SCSSPLLWTR (MAGC3_HUMAN)
SWSSPLLWTK

SEQ ID NO: 110048 - protein, 9 aa, Artificial Sequence
  Description of Artificial Sequence: Synthetic peptide
  Seed: VLPPQPQPR (MAGC3_HUMAN)
VFPPQPQPL

SEQ ID NO: 110049 - protein, 9 aa, Artificial Sequence
  Description of Artificial Sequence: Synthetic peptide
  Seed: KLSSIIPSA (MAGC3_HUMAN)
KASSIIPSI

SEQ ID NO: 110050 - protein, 10 aa, Artificial Sequence
  Description of Artificial Sequence: Synthetic peptide
  Seed: TTDDATAMAS (MAGC3_HUMAN)
TWDDATAMAF

SEQ ID NO: 110051 - protein, 10 aa, Artificial Sequence
  Description of Artificial Sequence: Synthetic peptide
  Seed: KLSSIIPSAF (MAGC3_HUMAN)
KQSSIIPSAV

SEQ ID NO: 110052 - protein, 9 aa, Artificial Sequence
  Description of Artificial Sequence: Synthetic peptide
  Seed: MEDRAQAII (MAGC3_HUMAN)
MHDRAQAIL

SEQ ID NO: 110053 - protein, 10 aa, Artificial Sequence
  Description of Artificial Sequence: Synthetic peptide
  Seed: LNAIGPWSAL (MAGC3_HUMAN)
LSAIGPWSAF

SEQ ID NO: 110054 - protein, 9 aa, Artificial Sequence
  Description of Artificial Sequence: Synthetic peptide
  Seed: GYFPMIFRK (MAGC3_HUMAN)
GSFPMIFRK

SEQ ID NO: 110055 - protein, 9 aa, Artificial Sequence
  Description of Artificial Sequence: Synthetic peptide
  Seed: MPAAGMPPL (MAGC3_HUMAN)
MTAAGMPPA

SEQ ID NO: 110056 - protein, 10 aa, Artificial Sequence
  Description of Artificial Sequence: Synthetic peptide
  Seed: SAFHLGHLRE (MAGC3_HUMAN)
SMFHLGHLRT

SEQ ID NO: 110057 - protein, 10 aa, Artificial Sequence
  Description of Artificial Sequence: Synthetic peptide
  Seed: VLNAIGPWSA (MAGC3_HUMAN)
VMNAIGPWSV

SEQ ID NO: 110058 - protein, 9 aa, Artificial Sequence
  Description of Artificial Sequence: Synthetic peptide
  Seed: TTDDATAMA (MAGC3_HUMAN)
TVDDATAML

SEQ ID NO: 110059 - protein, 10 aa, Artificial Sequence
  Description of Artificial Sequence: Synthetic peptide
  Seed: SPPEIPPQGP (MAGC3_HUMAN)
SPPEIPPQGA

SEQ ID NO: 110060 - protein, 9 aa, Artificial Sequence
  Description of Artificial Sequence: Synthetic peptide
  Seed: VLPPQPQPR (MAGC3_HUMAN)
VMPPQPQPM

SEQ ID NO: 110061 - protein, 9 aa, Artificial Sequence
  Description of Artificial Sequence: Synthetic peptide
  Seed: SEEVIWEVL (MAGC3_HUMAN)
SEEVIWEVM

SEQ ID NO: 110062 - protein, 11 aa, Artificial Sequence
  Description of Artificial Sequence: Synthetic peptide
  Seed: RTLSGSPGLQL (MAGC3_HUMAN)
RILSGSPGLQY

SEQ ID NO: 110063 - protein, 10 aa, Artificial Sequence
  Description of Artificial Sequence: Synthetic peptide
  Seed: TAMASASPSV (MAGC3_HUMAN)
TKMASASPSL

SEQ ID NO: 110064 - protein, 10 aa, Artificial Sequence
  Description of Artificial Sequence: Synthetic peptide
  Seed: MDSLVLCPTY (MAGC3_HUMAN)
MGSLVLCPTW

SEQ ID NO: 110065 - protein, 9 aa, Artificial Sequence
  Description of Artificial Sequence: Synthetic peptide
  Seed: NAIGPWSAL (MAGC3_HUMAN)
NVIGPWSAW

SEQ ID NO: 110066 - protein, 9 aa, Artificial Sequence
  Description of Artificial Sequence: Synthetic peptide
  Seed: FKLWRTLSG (MAGC3_HUMAN)
FTLWRTLSF

SEQ ID NO: 110067 - protein, 10 aa, Artificial Sequence
  Description of Artificial Sequence: Synthetic peptide
  Seed: KVAELVQFLL (MAGC3_HUMAN)
KIAELVQFLR

SEQ ID NO: 110068 - protein, 9 aa, Artificial Sequence
  Description of Artificial Sequence: Synthetic peptide
  Seed: VDPDHFYVF (MAGC3_HUMAN)
VSPDHFYVL

SEQ ID NO: 110069 - protein, 9 aa, Artificial Sequence
  Description of Artificial Sequence: Synthetic peptide
  Seed: ELVQFLLLK (MAGC3_HUMAN)
ETVQFLLLK

SEQ ID NO: 110070 - protein, 9 aa, Artificial Sequence
  Description of Artificial Sequence: Synthetic peptide
  Seed: MQMNVINTY (MAGC3_HUMAN)
MAMNVINTW

SEQ ID NO: 110071 - protein, 8 aa, Artificial Sequence
  Description of Artificial Sequence: Synthetic peptide
  Seed: FIELIFGI (MAGC3_HUMAN)
FIELIFGV

SEQ ID NO: 110072 - protein, 11 aa, Artificial Sequence
  Description of Artificial Sequence: Synthetic peptide
  Seed: DYSAFHLGHLR (MAGC3_HUMAN)
DISAFHLGHLR

SEQ ID NO: 110073 - protein, 9 aa, Artificial Sequence
  Description of Artificial Sequence: Synthetic peptide
  Seed: FLSKLSSII (MAGC3_HUMAN)
FISKLSSIA

SEQ ID NO: 110074 - protein, 9 aa, Artificial Sequence
  Description of Artificial Sequence: Synthetic peptide
  Seed: RRAVSVKQR (MAGC3_HUMAN)
RRAVSVKQM

SEQ ID NO: 110075 - protein, 9 aa, Artificial Sequence
  Description of Artificial Sequence: Synthetic peptide
  Seed: MQMNVINTY (MAGC3_HUMAN)
MPMNVINTM

SEQ ID NO: 110076 - protein, 9 aa, Artificial Sequence
  Description of Artificial Sequence: Synthetic peptide
  Seed: SDLHFGSQP (MAGC3_HUMAN)
SELHFGSQL

SEQ ID NO: 110077 - protein, 10 aa, Artificial Sequence
  Description of Artificial Sequence: Synthetic peptide
  Seed: FPSWYMDALK (MAGC3_HUMAN)
FFSWYMDALR

SEQ ID NO: 110078 - protein, 10 aa, Artificial Sequence
  Description of Artificial Sequence: Synthetic peptide
  Seed: SDQRMDSLVL (MAGC3_HUMAN)
SMQRMDSLVL

SEQ ID NO: 110079 - protein, 9 aa, Artificial Sequence
  Description of Artificial Sequence: Synthetic peptide
  Seed: TAMASASPS (MAGC3_HUMAN)
TVMASASPF

SEQ ID NO: 110080 - protein, 10 aa, Artificial Sequence
  Description of Artificial Sequence: Synthetic peptide
  Seed: IELIFGIALT (MAGC3_HUMAN)
IELIFGIALA

SEQ ID NO: 110081 - protein, 9 aa, Artificial Sequence
  Description of Artificial Sequence: Synthetic peptide
  Seed: KVDKLVQFL (MAGC3_HUMAN)
KLDKLVQFF

SEQ ID NO: 110082 - protein, 10 aa, Artificial Sequence
  Description of Artificial Sequence: Synthetic peptide
  Seed: MDPDNHSYFF (MAGC3_HUMAN)
MNPDNHSYFL

SEQ ID NO: 110083 - protein, 9 aa, Artificial Sequence
  Description of Artificial Sequence: Synthetic peptide
  Seed: KLWRTLSGS (MAGC3_HUMAN)
KVWRTLSGV

SEQ ID NO: 110084 - protein, 9 aa, Artificial Sequence
  Description of Artificial Sequence: Synthetic peptide
  Seed: YFFEDTLDL (MAGC3_HUMAN)
YAFEDTLDL

SEQ ID NO: 110085 - protein, 9 aa, Artificial Sequence
  Description of Artificial Sequence: Synthetic peptide
  Seed: LSSIIPSAF (MAGC3_HUMAN)
LKSIIPSAL

SEQ ID NO: 110086 - protein, 9 aa, Artificial Sequence
  Description of Artificial Sequence: Synthetic peptide
  Seed: RGTGYTLSL (MAGC3_HUMAN)
RLTGYTLSL

SEQ ID NO: 110087 - protein, 10 aa, Artificial Sequence
  Description of Artificial Sequence: Synthetic peptide
  Seed: RSAEGSVLDL (MAGC3_HUMAN)
RIAEGSVLDF

SEQ ID NO: 110088 - protein, 9 aa, Artificial Sequence
  Description of Artificial Sequence: Synthetic peptide
  Seed: YQTKEPVTK (MAGC3_HUMAN)
YITKEPVTY

SEQ ID NO: 110089 - protein, 9 aa, Artificial Sequence
  Description of Artificial Sequence: Synthetic peptide
  Seed: YFFEDTLDL (MAGC3_HUMAN)
YQFEDTLDW

SEQ ID NO: 110090 - protein, 11 aa, Artificial Sequence
  Description of Artificial Sequence: Synthetic peptide
  Seed: FPMIFGKAHEF (MAGC3_HUMAN)
FPMIFGKAHEC

SEQ ID NO: 110091 - protein, 9 aa, Artificial Sequence
  Description of Artificial Sequence: Synthetic peptide
  Seed: EVLEFLSKL (MAGC3_HUMAN)
EMLEFLSKI

SEQ ID NO: 110092 - protein, 11 aa, Artificial Sequence
  Description of Artificial Sequence: Synthetic peptide
  Seed: MPAAGMPPLPQ (MAGC3_HUMAN)
MPAAGMPPLPF

SEQ ID NO: 110093 - protein, 9 aa, Artificial Sequence
  Description of Artificial Sequence: Synthetic peptide
  Seed: MASASPSVM (MAGC3_HUMAN)
MVSASPSVY

SEQ ID NO: 110094 - protein, 10 aa, Artificial Sequence
  Description of Artificial Sequence: Synthetic peptide
  Seed: REVLEFLSKL (MAGC3_HUMAN)
REVLEFLSKA

SEQ ID NO: 110095 - protein, 9 aa, Artificial Sequence
  Description of Artificial Sequence: Synthetic peptide
  Seed: ATDKDYSAF (MAGC3_HUMAN)
APDKDYSAF

SEQ ID NO: 110096 - protein, 11 aa, Artificial Sequence
  Description of Artificial Sequence: Synthetic peptide
  Seed: IIDTTDDATAM (MAGC3_HUMAN)
IGDTTDDATAL

SEQ ID NO: 110097 - protein, 11 aa, Artificial Sequence
  Description of Artificial Sequence: Synthetic peptide
  Seed: EILFGISLTEV (MAGC3_HUMAN)
EWLFGISLTEV

SEQ ID NO: 110098 - protein, 9 aa, Artificial Sequence
  Description of Artificial Sequence: Synthetic peptide
  Seed: MIFGKAHEF (MAGC3_HUMAN)
MLFGKAHEW

SEQ ID NO: 110099 - protein, 11 aa, Artificial Sequence
  Description of Artificial Sequence: Synthetic peptide
  Seed: FSDGSLGQWVK (MAGC3_HUMAN)
FMDGSLGQWVY

SEQ ID NO: 110100 - protein, 9 aa, Artificial Sequence
  Description of Artificial Sequence: Synthetic peptide
  Seed: TEVDPDHFY (MAGC3_HUMAN)
TEVDPDHFP

SEQ ID NO: 110101 - protein, 9 aa, Artificial Sequence
  Description of Artificial Sequence: Synthetic peptide
  Seed: TEASPQQKK (MAGC3_HUMAN)
TVASPQQKF

SEQ ID NO: 110102 - protein, 9 aa, Artificial Sequence
  Description of Artificial Sequence: Synthetic peptide
  Seed: SLVLCPTYF (MAGC3_HUMAN)
SVVLCPTYF

SEQ ID NO: 110103 - protein, 10 aa, Artificial Sequence
  Description of Artificial Sequence: Synthetic peptide
  Seed: TLDEKVDKLV (MAGC3_HUMAN)
TLDEKVDKLM

SEQ ID NO: 110104 - protein, 10 aa, Artificial Sequence
  Description of Artificial Sequence: Synthetic peptide
  Seed: IKKYKDYFPM (MAGC3_HUMAN)
IHKYKDYFPF

SEQ ID NO: 110105 - protein, 9 aa, Artificial Sequence
  Description of Artificial Sequence: Synthetic peptide
  Seed: RPAREVLEF (MAGC3_HUMAN)
RMAREVLEF

SEQ ID NO: 110106 - protein, 9 aa, Artificial Sequence
  Description of Artificial Sequence: Synthetic peptide
  Seed: YKDYFPMIF (MAGC3_HUMAN)
YHDYFPMIL

SEQ ID NO: 110107 - protein, 9 aa, Artificial Sequence
  Description of Artificial Sequence: Synthetic peptide
  Seed: ISPQGPPQS (MAGC3_HUMAN)
IWPQGPPQL

SEQ ID NO: 110108 - protein, 10 aa, Artificial Sequence
  Description of Artificial Sequence: Synthetic peptide
  Seed: ATYALSPVVL (MAGC3_HUMAN)
AAYALSPVVY

SEQ ID NO: 110109 - protein, 9 aa, Artificial Sequence
  Description of Artificial Sequence: Synthetic peptide
  Seed: ALKDMEDRA (MAGC3_HUMAN)
ALKDMEDRV

SEQ ID NO: 110110 - protein, 9 aa, Artificial Sequence
  Description of Artificial Sequence: Synthetic peptide
  Seed: LSSIIPSAF (MAGC3_HUMAN)
LLSIIPSAY

SEQ ID NO: 110111 - protein, 9 aa, Artificial Sequence
  Description of Artificial Sequence: Synthetic peptide
  Seed: IQRPAREVL (MAGC3_HUMAN)
ISRPAREVF

SEQ ID NO: 110112 - protein, 9 aa, Artificial Sequence
  Description of Artificial Sequence: Synthetic peptide
  Seed: VIWEVLNAI (MAGC3_HUMAN)
VVWEVLNAM

SEQ ID NO: 110113 - protein, 9 aa, Artificial Sequence
  Description of Artificial Sequence: Synthetic peptide
  Seed: GFADVLSRL (MAGC3_HUMAN)
GQADVLSRA

SEQ ID NO: 110114 - protein, 9 aa, Artificial Sequence
  Description of Artificial Sequence: Synthetic peptide
  Seed: MQMNVINTY (MAGC3_HUMAN)
MLMNVINTL

SEQ ID NO: 110115 - protein, 10 aa, Artificial Sequence
  Description of Artificial Sequence: Synthetic peptide
  Seed: MDPDNHSYFF (MAGC3_HUMAN)
MHPDNHSYFW

SEQ ID NO: 110116 - protein, 9 aa, Artificial Sequence
  Description of Artificial Sequence: Synthetic peptide
  Seed: KYKDYFPMI (MAGC3_HUMAN)
KGKDYFPMK

SEQ ID NO: 110117 - protein, 9 aa, Artificial Sequence
  Description of Artificial Sequence: Synthetic peptide
  Seed: VLPPQPQPR (MAGC3_HUMAN)
VPPPQPQPL

SEQ ID NO: 110118 - protein, 9 aa, Artificial Sequence
  Description of Artificial Sequence: Synthetic peptide
  Seed: VIWEVLNAI (MAGC3_HUMAN)
VLWEVLNAL

SEQ ID NO: 110119 - protein, 9 aa, Artificial Sequence
  Description of Artificial Sequence: Synthetic peptide
  Seed: FPMIFGKAH (MAGC3_HUMAN)
FPMIFGKAF

SEQ ID NO: 110120 - protein, 10 aa, Artificial Sequence
  Description of Artificial Sequence: Synthetic peptide
  Seed: LAGFADVLSR (MAGC3_HUMAN)
LTGFADVLSR

SEQ ID NO: 110121 - protein, 9 aa, Artificial Sequence
  Description of Artificial Sequence: Synthetic peptide
  Seed: MIFGKAHEF (MAGC3_HUMAN)
MSFGKAHEM

SEQ ID NO: 110122 - protein, 9 aa, Artificial Sequence
  Description of Artificial Sequence: Synthetic peptide
  Seed: LSDEQGMPQ (MAGC3_HUMAN)
LGDEQGMPV

SEQ ID NO: 110123 - protein, 10 aa, Artificial Sequence
  Description of Artificial Sequence: Synthetic peptide
  Seed: MDSLVLCPTY (MAGC3_HUMAN)
MQSLVLCPTW

SEQ ID NO: 110124 - protein, 9 aa, Artificial Sequence
  Description of Artificial Sequence: Synthetic peptide
  Seed: VIWEVLNAI (MAGC3_HUMAN)
VVWEVLNAY

SEQ ID NO: 110125 - protein, 9 aa, Artificial Sequence
  Description of Artificial Sequence: Synthetic peptide
  Seed: ASEEVIWEV (MAGC3_HUMAN)
AYEEVIWEL

SEQ ID NO: 110126 - protein, 9 aa, Artificial Sequence
  Description of Artificial Sequence: Synthetic peptide
  Seed: EKVDKLVQF (MAGC3_HUMAN)
ELVDKLVQF

SEQ ID NO: 110127 - protein, 9 aa, Artificial Sequence
  Description of Artificial Sequence: Synthetic peptide
  Seed: MIFIKGSCV (MAGC3_HUMAN)
MMFIKGSCL

SEQ ID NO: 110128 - protein, 11 aa, Artificial Sequence
  Description of Artificial Sequence: Synthetic peptide
  Seed: ALAGFADVLSR (MAGC3_HUMAN)
ATAGFADVLSR

SEQ ID NO: 110129 - protein, 9 aa, Artificial Sequence
  Description of Artificial Sequence: Synthetic peptide
  Seed: FKLWRTLSG (MAGC3_HUMAN)
FRLWRTLSM

SEQ ID NO: 110130 - protein, 9 aa, Artificial Sequence
  Description of Artificial Sequence: Synthetic peptide
  Seed: VLPPQPQPR (MAGC3_HUMAN)
VAPPQPQPI

SEQ ID NO: 110131 - protein, 9 aa, Artificial Sequence
  Description of Artificial Sequence: Synthetic peptide
  Seed: KVAELVQFL (MAGC3_HUMAN)
KMAELVQFK

SEQ ID NO: 110132 - protein, 9 aa, Artificial Sequence
  Description of Artificial Sequence: Synthetic peptide
  Seed: IPPQGPPKI (MAGC3_HUMAN)
ISPQGPPKM

SEQ ID NO: 110133 - protein, 9 aa, Artificial Sequence
  Description of Artificial Sequence: Synthetic peptide
  Seed: KLSSIIPSA (MAGC3_HUMAN)
KWSSIIPSK

SEQ ID NO: 110134 - protein, 9 aa, Artificial Sequence
  Description of Artificial Sequence: Synthetic peptide
  Seed: SPSVMSTNF (MAGC3_HUMAN)
SLSVMSTNY

SEQ ID NO: 110135 - protein, 10 aa, Artificial Sequence
  Description of Artificial Sequence: Synthetic peptide
  Seed: SALAGFADVL (MAGC3_HUMAN)
SNLAGFADVL

SEQ ID NO: 110136 - protein, 9 aa, Artificial Sequence
  Description of Artificial Sequence: Synthetic peptide
  Seed: HLREVRLFL (MAGC3_HUMAN)
HIREVRLFY

SEQ ID NO: 110137 - protein, 10 aa, Artificial Sequence
  Description of Artificial Sequence: Synthetic peptide
  Seed: FKLWRTLSGS (MAGC3_HUMAN)
FQLWRTLSGI

SEQ ID NO: 110138 - protein, 9 aa, Artificial Sequence
  Description of Artificial Sequence: Synthetic peptide
  Seed: EVLEFLSKL (MAGC3_HUMAN)
EFLEFLSKK

SEQ ID NO: 110139 - protein, 9 aa, Artificial Sequence
  Description of Artificial Sequence: Synthetic peptide
  Seed: KVDKLVQFL (MAGC3_HUMAN)
KADKLVQFI

SEQ ID NO: 110140 - protein, 9 aa, Artificial Sequence
  Description of Artificial Sequence: Synthetic peptide
  Seed: KYKDYFPMI (MAGC3_HUMAN)
KNKDYFPMY

SEQ ID NO: 110141 - protein, 9 aa, Artificial Sequence
  Description of Artificial Sequence: Synthetic peptide
  Seed: LKYQTKEPV (MAGC3_HUMAN)
LAYQTKEPM

SEQ ID NO: 110142 - protein, 9 aa, Artificial Sequence
  Description of Artificial Sequence: Synthetic peptide
  Seed: KLSSIIPSA (MAGC3_HUMAN)
KLSSIIPSV

SEQ ID NO: 110143 - protein, 10 aa, Artificial Sequence
  Description of Artificial Sequence: Synthetic peptide
  Seed: TDMDPDNHSY (MAGC3_HUMAN)
TAMDPDNHSF

SEQ ID NO: 110144 - protein, 9 aa, Artificial Sequence
  Description of Artificial Sequence: Synthetic peptide
  Seed: HSYFFEDTL (MAGC3_HUMAN)
HLYFFEDTV

SEQ ID NO: 110145 - protein, 9 aa, Artificial Sequence
  Description of Artificial Sequence: Synthetic peptide
  Seed: HLREVRLFL (MAGC3_HUMAN)
HPREVRLFV

SEQ ID NO: 110146 - protein, 8 aa, Artificial Sequence
  Description of Artificial Sequence: Synthetic peptide
  Seed: TTDDATAM (MAGC3_HUMAN)
TYDDATAL

SEQ ID NO: 110147 - protein, 9 aa, Artificial Sequence
  Description of Artificial Sequence: Synthetic peptide
  Seed: MPAAGMPPL (MAGC3_HUMAN)
MPAAGMPPS

SEQ ID NO: 110148 - protein, 9 aa, Artificial Sequence
  Description of Artificial Sequence: Synthetic peptide
  Seed: SQPEGKFSL (MAGC3_HUMAN)
SMPEGKFSI

SEQ ID NO: 110149 - protein, 9 aa, Artificial Sequence
  Description of Artificial Sequence: Synthetic peptide
  Seed: MQMNVINTY (MAGC3_HUMAN)
MSMNVINTI

SEQ ID NO: 110150 - protein, 9 aa, Artificial Sequence
  Description of Artificial Sequence: Synthetic peptide
  Seed: AMASASPSV (MAGC3_HUMAN)
ARASASPSM

SEQ ID NO: 110151 - protein, 10 aa, Artificial Sequence
  Description of Artificial Sequence: Synthetic peptide
  Seed: IPSAFPSWYM (MAGC3_HUMAN)
IWSAFPSWYW

SEQ ID NO: 110152 - protein, 9 aa, Artificial Sequence
  Description of Artificial Sequence: Synthetic peptide
  Seed: AVSPGKRLW (MAGC3_HUMAN)
ATSPGKRLW

SEQ ID NO: 110153 - protein, 9 aa, Artificial Sequence
  Description of Artificial Sequence: Synthetic peptide
  Seed: AVSPGKRLW (MAGC3_HUMAN)
AQSPGKRLM

SEQ ID NO: 110154 - protein, 9 aa, Artificial Sequence
  Description of Artificial Sequence: Synthetic peptide
  Seed: ATYALSPVV (MAGC3_HUMAN)
AFYALSPVK

SEQ ID NO: 110155 - protein, 9 aa, Artificial Sequence
  Description of Artificial Sequence: Synthetic peptide
  Seed: FEDTLDLTY (MAGC3_HUMAN)
FWDTLDLTY

SEQ ID NO: 110156 - protein, 9 aa, Artificial Sequence
  Description of Artificial Sequence: Synthetic peptide
  Seed: KAHEFIELI (MAGC3_HUMAN)
KAHEFIELF

SEQ ID NO: 110157 - protein, 9 aa, Artificial Sequence
  Description of Artificial Sequence: Synthetic peptide
  Seed: NTYTGYFPM (MAGC3_HUMAN)
NQYTGYFPA

SEQ ID NO: 110158 - protein, 9 aa, Artificial Sequence
  Description of Artificial Sequence: Synthetic peptide
  Seed: TYFKLWRTL (MAGC3_HUMAN)
TYFKLWRTF

SEQ ID NO: 110159 - protein, 9 aa, Artificial Sequence
  Description of Artificial Sequence: Synthetic peptide
  Seed: EKVDKLVQF (MAGC3_HUMAN)
EHVDKLVQV

SEQ ID NO: 110160 - protein, 9 aa, Artificial Sequence
  Description of Artificial Sequence: Synthetic peptide
  Seed: EVIWEVLSA (MAGC3_HUMAN)
EVIWEVLSR

SEQ ID NO: 110161 - protein, 10 aa, Artificial Sequence
  Description of Artificial Sequence: Synthetic peptide
  Seed: VLCPTYFKLW (MAGC3_HUMAN)
VMCPTYFKLW

SEQ ID NO: 110162 - protein, 10 aa, Artificial Sequence
  Description of Artificial Sequence: Synthetic peptide
  Seed: KYKDYFPMIF (MAGC3_HUMAN)
KRKDYFPMIF

SEQ ID NO: 110163 - protein, 9 aa, Artificial Sequence
  Description of Artificial Sequence: Synthetic peptide
  Seed: LWGEKAGSL (MAGC3_HUMAN)
LFGEKAGSL

SEQ ID NO: 110164 - protein, 9 aa, Artificial Sequence
  Description of Artificial Sequence: Synthetic peptide
  Seed: VIWEVLSAI (MAGC3_HUMAN)
VIWEVLSAK

SEQ ID NO: 110165 - protein, 9 aa, Artificial Sequence
  Description of Artificial Sequence: Synthetic peptide
  Seed: ADVLSRLAL (MAGC3_HUMAN)
AEVLSRLAC

SEQ ID NO: 110166 - protein, 9 aa, Artificial Sequence
  Description of Artificial Sequence: Synthetic peptide
  Seed: LKYQAKEPL (MAGC3_HUMAN)
LKYQAKEPY

SEQ ID NO: 110167 - protein, 9 aa, Artificial Sequence
  Description of Artificial Sequence: Synthetic peptide
  Seed: LSSIIPSAF (MAGC3_HUMAN)
LSSIIPSAI

SEQ ID NO: 110168 - protein, 9 aa, Artificial Sequence
  Description of Artificial Sequence: Synthetic peptide
  Seed: YSAFHLGHL (MAGC3_HUMAN)
YSAFHLGHY

SEQ ID NO: 110169 - protein, 9 aa, Artificial Sequence
  Description of Artificial Sequence: Synthetic peptide
  Seed: KGSCVPEEV (MAGC3_HUMAN)
KVSCVPEEI

SEQ ID NO: 110170 - protein, 9 aa, Artificial Sequence
  Description of Artificial Sequence: Synthetic peptide
  Seed: YSAFHLGHL (MAGC3_HUMAN)
YFAFHLGHF

SEQ ID NO: 110171 - protein, 9 aa, Artificial Sequence
  Description of Artificial Sequence: Synthetic peptide
  Seed: CSSPLLWTR (MAGC3_HUMAN)
CMSPLLWTK

SEQ ID NO: 110172 - protein, 9 aa, Artificial Sequence
  Description of Artificial Sequence: Synthetic peptide
  Seed: FLSKLSSII (MAGC3_HUMAN)
FQSKLSSIL

SEQ ID NO: 110173 - protein, 9 aa, Artificial Sequence
  Description of Artificial Sequence: Synthetic peptide
  Seed: IIPSAFPSW (MAGC3_HUMAN)
IFPSAFPSF

SEQ ID NO: 110174 - protein, 10 aa, Artificial Sequence
  Description of Artificial Sequence: Synthetic peptide
  Seed: LILILSVIFI (MAGC3_HUMAN)
LALILSVIFV

SEQ ID NO: 110175 - protein, 10 aa, Artificial Sequence
  Description of Artificial Sequence: Synthetic peptide
  Seed: DMPAAGMPPL (MAGC3_HUMAN)
DLPAAGMPPY

SEQ ID NO: 110176 - protein, 9 aa, Artificial Sequence
  Description of Artificial Sequence: Synthetic peptide
  Seed: SLRRAVSVK (MAGC3_HUMAN)
SSRRAVSVK

SEQ ID NO: 110177 - protein, 8 aa, Artificial Sequence
  Description of Artificial Sequence: Synthetic peptide
  Seed: KYKDYFPM (MAGC3_HUMAN)
KYKDYFPF

SEQ ID NO: 110178 - protein, 10 aa, Artificial Sequence
  Description of Artificial Sequence: Synthetic peptide
  Seed: MLLPCHWVLD (MAGC3_HUMAN)
MILPCHWVLV

SEQ ID NO: 110179 - protein, 11 aa, Artificial Sequence
  Description of Artificial Sequence: Synthetic peptide
  Seed: YALDEKVAELV (MAGC3_HUMAN)
YMLDEKVAELL

SEQ ID NO: 110180 - protein, 9 aa, Artificial Sequence
  Description of Artificial Sequence: Synthetic peptide
  Seed: MIFRKAREF (MAGC3_HUMAN)
MTFRKAREI

SEQ ID NO: 110181 - protein, 10 aa, Artificial Sequence
  Description of Artificial Sequence: Synthetic peptide
  Seed: EMQMNVINTY (MAGC3_HUMAN)
ESQMNVINTY

SEQ ID NO: 110182 - protein, 9 aa, Artificial Sequence
  Description of Artificial Sequence: Synthetic peptide
  Seed: VLPPQPQPR (MAGC3_HUMAN)
VGPPQPQPI

SEQ ID NO: 110183 - protein, 11 aa, Artificial Sequence
  Description of Artificial Sequence: Synthetic peptide
  Seed: TYTGYFPMIFR (MAGC3_HUMAN)
TVTGYFPMIFK

SEQ ID NO: 110184 - protein, 9 aa, Artificial Sequence
  Description of Artificial Sequence: Synthetic peptide
  Seed: KLSSIIPSA (MAGC3_HUMAN)
KQSSIIPSM

SEQ ID NO: 110185 - protein, 9 aa, Artificial Sequence
  Description of Artificial Sequence: Synthetic peptide
  Seed: TLDEKVDKL (MAGC3_HUMAN)
TTDEKVDKI

SEQ ID NO: 110186 - protein, 11 aa, Artificial Sequence
  Description of Artificial Sequence: Synthetic peptide
  Seed: KGSCVPEEVIW (MAGC3_HUMAN)
KVSCVPEEVIW

SEQ ID NO: 110187 - protein, 8 aa, Artificial Sequence
  Description of Artificial Sequence: Synthetic peptide
  Seed: TYALSPVV (MAGC3_HUMAN)
TYALSPVM

SEQ ID NO: 110188 - protein, 11 aa, Artificial Sequence
  Description of Artificial Sequence: Synthetic peptide
  Seed: IIDTTDDATAM (MAGC3_HUMAN)
IWDTTDDATAI

SEQ ID NO: 110189 - protein, 9 aa, Artificial Sequence
  Description of Artificial Sequence: Synthetic peptide
  Seed: KAHEFIELI (MAGC3_HUMAN)
KMHEFIELT

SEQ ID NO: 110190 - protein, 9 aa, Artificial Sequence
  Description of Artificial Sequence: Synthetic peptide
  Seed: MLLPCHWVL (MAGC3_HUMAN)
MWLPCHWVM

SEQ ID NO: 110191 - protein, 9 aa, Artificial Sequence
  Description of Artificial Sequence: Synthetic peptide
  Seed: NTYTGYFPM (MAGC3_HUMAN)
NWYTGYFPM

SEQ ID NO: 110192 - protein, 10 aa, Artificial Sequence
  Description of Artificial Sequence: Synthetic peptide
  Seed: ALDEKVAELV (MAGC3_HUMAN)
ATDEKVAELL

SEQ ID NO: 110193 - protein, 9 aa, Artificial Sequence
  Description of Artificial Sequence: Synthetic peptide
  Seed: MASASPSVM (MAGC3_HUMAN)
MHSASPSVI

SEQ ID NO: 110194 - protein, 11 aa, Artificial Sequence
  Description of Artificial Sequence: Synthetic peptide
  Seed: TDMDPDNHSYF (MAGC3_HUMAN)
TSMDPDNHSYM

SEQ ID NO: 110195 - protein, 10 aa, Artificial Sequence
  Description of Artificial Sequence: Synthetic peptide
  Seed: MDPDNHSYFF (MAGC3_HUMAN)
MWPDNHSYFL

SEQ ID NO: 110196 - protein, 11 aa, Artificial Sequence
  Description of Artificial Sequence: Synthetic peptide
  Seed: KVAELVQFLLL (MAGC3_HUMAN)
KLAELVQFLLV

SEQ ID NO: 110197 - protein, 11 aa, Artificial Sequence
  Description of Artificial Sequence: Synthetic peptide
  Seed: LVLCPTYFKLW (MAGC3_HUMAN)
LTLCPTYFKLW

SEQ ID NO: 110198 - protein, 9 aa, Artificial Sequence
  Description of Artificial Sequence: Synthetic peptide
  Seed: SASPSVMST (MAGC3_HUMAN)
SMSPSVMSV

SEQ ID NO: 110199 - protein, 10 aa, Artificial Sequence
  Description of Artificial Sequence: Synthetic peptide
  Seed: KFSLRRAVSV (MAGC3_HUMAN)
KVSLRRAVSK

SEQ ID NO: 110200 - protein, 9 aa, Artificial Sequence
  Description of Artificial Sequence: Synthetic peptide
  Seed: VIWEVLNAI (MAGC3_HUMAN)
VMWEVLNAF

SEQ ID NO: 110201 - protein, 9 aa, Artificial Sequence
  Description of Artificial Sequence: Synthetic peptide
  Seed: HALPESESL (MAGC3_HUMAN)
HRLPESESA

SEQ ID NO: 110202 - protein, 9 aa, Artificial Sequence
  Description of Artificial Sequence: Synthetic peptide
  Seed: IPPQGPPKI (MAGC3_HUMAN)
IIPQGPPKM

SEQ ID NO: 110203 - protein, 10 aa, Artificial Sequence
  Description of Artificial Sequence: Synthetic peptide
  Seed: ALWESEGPEA (MAGC3_HUMAN)
AQWESEGPEL

SEQ ID NO: 110204 - protein, 9 aa, Artificial Sequence
  Description of Artificial Sequence: Synthetic peptide
  Seed: FKLWRTLSG (MAGC3_HUMAN)
FALWRTLSM

SEQ ID NO: 110205 - protein, 10 aa, Artificial Sequence
  Description of Artificial Sequence: Synthetic peptide
  Seed: INTYTGYFPM (MAGC3_HUMAN)
INTYTGYFPY

SEQ ID NO: 110206 - protein, 9 aa, Artificial Sequence
  Description of Artificial Sequence: Synthetic peptide
  Seed: WVKNTCATY (MAGC3_HUMAN)
WLKNTCATY

SEQ ID NO: 110207 - protein, 10 aa, Artificial Sequence
  Description of Artificial Sequence: Synthetic peptide
  Seed: KVAELVQFLL (MAGC3_HUMAN)
KMAELVQFLP

SEQ ID NO: 110208 - protein, 9 aa, Artificial Sequence
  Description of Artificial Sequence: Synthetic peptide
  Seed: KAHEFIELI (MAGC3_HUMAN)
KQHEFIELY

SEQ ID NO: 110209 - protein, 10 aa, Artificial Sequence
  Description of Artificial Sequence: Synthetic peptide
  Seed: SAFHLGHLRE (MAGC3_HUMAN)
SMFHLGHLRE

SEQ ID NO: 110210 - protein, 10 aa, Artificial Sequence
  Description of Artificial Sequence: Synthetic peptide
  Seed: TLWKDSDLPT (MAGC3_HUMAN)
TMWKDSDLPI

SEQ ID NO: 110211 - protein, 9 aa, Artificial Sequence
  Description of Artificial Sequence: Synthetic peptide
  Seed: EVLEFLSKL (MAGC3_HUMAN)
EFLEFLSKR

SEQ ID NO: 110212 - protein, 11 aa, Artificial Sequence
  Description of Artificial Sequence: Synthetic peptide
  Seed: GPPQSPPQSPL (MAGC3_HUMAN)
GRPQSPPQSPL

SEQ ID NO: 110213 - protein, 10 aa, Artificial Sequence
  Description of Artificial Sequence: Synthetic peptide
  Seed: KFSLRRAVSV (MAGC3_HUMAN)
KQSLRRAVSK

SEQ ID NO: 110214 - protein, 11 aa, Artificial Sequence
  Description of Artificial Sequence: Synthetic peptide
  Seed: ISLTEVDPDHF (MAGC3_HUMAN)
ISLTEVDPDHW

SEQ ID NO: 110215 - protein, 9 aa, Artificial Sequence
  Description of Artificial Sequence: Synthetic peptide
  Seed: MIFGKAHEF (MAGC3_HUMAN)
MWFGKAHEY

SEQ ID NO: 110216 - protein, 9 aa, Artificial Sequence
  Description of Artificial Sequence: Synthetic peptide
  Seed: NAIGPWSAL (MAGC3_HUMAN)
NLIGPWSAR

SEQ ID NO: 110217 - protein, 10 aa, Artificial Sequence
  Description of Artificial Sequence: Synthetic peptide
  Seed: LNAIGPWSAL (MAGC3_HUMAN)
LQAIGPWSAL

SEQ ID NO: 110218 - protein, 10 aa, Artificial Sequence
  Description of Artificial Sequence: Synthetic peptide
  Seed: FKLWRTLSGS (MAGC3_HUMAN)
FPLWRTLSGA

SEQ ID NO: 110219 - protein, 9 aa, Artificial Sequence
  Description of Artificial Sequence: Synthetic peptide
  Seed: KLVQFLLLK (MAGC3_HUMAN)
KVVQFLLLA

SEQ ID NO: 110220 - protein, 9 aa, Artificial Sequence
  Description of Artificial Sequence: Synthetic peptide
  Seed: RTLSGSPGL (MAGC3_HUMAN)
RQLSGSPGF

SEQ ID NO: 110221 - protein, 10 aa, Artificial Sequence
  Description of Artificial Sequence: Synthetic peptide
  Seed: DMPAAGMPPL (MAGC3_HUMAN)
DHPAAGMPPY

SEQ ID NO: 110222 - protein, 10 aa, Artificial Sequence
  Description of Artificial Sequence: Synthetic peptide
  Seed: VLNAIGPWSA (MAGC3_HUMAN)
VLNAIGPWSI

SEQ ID NO: 110223 - protein, 9 aa, Artificial Sequence
  Description of Artificial Sequence: Synthetic peptide
  Seed: IIDTTDDAT (MAGC3_HUMAN)
ITDTTDDAL

SEQ ID NO: 110224 - protein, 9 aa, Artificial Sequence
  Description of Artificial Sequence: Synthetic peptide
  Seed: FGSQPEGKF (MAGC3_HUMAN)
FPSQPEGKF

SEQ ID NO: 110225 - protein, 11 aa, Artificial Sequence
  Description of Artificial Sequence: Synthetic peptide
  Seed: FIELIFGIALT (MAGC3_HUMAN)
FLELIFGIALL

SEQ ID NO: 110226 - protein, 9 aa, Artificial Sequence
  Description of Artificial Sequence: Synthetic peptide
  Seed: MIFGKAHEF (MAGC3_HUMAN)
MAFGKAHEH

SEQ ID NO: 110227 - protein, 10 aa, Artificial Sequence
  Description of Artificial Sequence: Synthetic peptide
  Seed: MQMNVINTYT (MAGC3_HUMAN)
MHMNVINTYL

SEQ ID NO: 110228 - protein, 9 aa, Artificial Sequence
  Description of Artificial Sequence: Synthetic peptide
  Seed: KYKDYFPMI (MAGC3_HUMAN)
KQKDYFPMY

SEQ ID NO: 110229 - protein, 10 aa, Artificial Sequence
  Description of Artificial Sequence: Synthetic peptide
  Seed: GEDEDMPAAG (MAGC3_HUMAN)
GEDEDMPAAA

SEQ ID NO: 110230 - protein, 9 aa, Artificial Sequence
  Description of Artificial Sequence: Synthetic peptide
  Seed: MLTTVIKKY (MAGC3_HUMAN)
MQTTVIKKM

SEQ ID NO: 110231 - protein, 9 aa, Artificial Sequence
  Description of Artificial Sequence: Synthetic peptide
  Seed: IELIFGIAL (MAGC3_HUMAN)
IQLIFGIAY

SEQ ID NO: 110232 - protein, 9 aa, Artificial Sequence
  Description of Artificial Sequence: Synthetic peptide
  Seed: LSGSPGLQL (MAGC3_HUMAN)
LTGSPGLQL

SEQ ID NO: 110233 - protein, 10 aa, Artificial Sequence
  Description of Artificial Sequence: Synthetic peptide
  Seed: MDPDNHSYFF (MAGC3_HUMAN)
MKPDNHSYFY

SEQ ID NO: 110234 - protein, 10 aa, Artificial Sequence
  Description of Artificial Sequence: Synthetic peptide
  Seed: MQMNVINTYT (MAGC3_HUMAN)
MMMNVINTYP

SEQ ID NO: 110235 - protein, 9 aa, Artificial Sequence
  Description of Artificial Sequence: Synthetic peptide
  Seed: SAIGPIQRP (MAGC3_HUMAN)
SAIGPIQRH

SEQ ID NO: 110236 - protein, 9 aa, Artificial Sequence
  Description of Artificial Sequence: Synthetic peptide
  Seed: ELIFGIALT (MAGC3_HUMAN)
EVIFGIALM

SEQ ID NO: 110237 - protein, 9 aa, Artificial Sequence
  Description of Artificial Sequence: Synthetic peptide
  Seed: IELIFGIAL (MAGC3_HUMAN)
IELIFGIAA

SEQ ID NO: 110238 - protein, 9 aa, Artificial Sequence
  Description of Artificial Sequence: Synthetic peptide
  Seed: KYKDYFPMI (MAGC3_HUMAN)
KWKDYFPMF

SEQ ID NO: 110239 - protein, 9 aa, Artificial Sequence
  Description of Artificial Sequence: Synthetic peptide
  Seed: TTDDATAMA (MAGC3_HUMAN)
TVDDATAMM

SEQ ID NO: 110240 - protein, 9 aa, Artificial Sequence
  Description of Artificial Sequence: Synthetic peptide
  Seed: TLDEKVDKL (MAGC3_HUMAN)
TTDEKVDKV

SEQ ID NO: 110241 - protein, 9 aa, Artificial Sequence
  Description of Artificial Sequence: Synthetic peptide
  Seed: ELIFGIALT (MAGC3_HUMAN)
EIIFGIALM

SEQ ID NO: 110242 - protein, 10 aa, Artificial Sequence
  Description of Artificial Sequence: Synthetic peptide
  Seed: TGYFPMIFRK (MAGC3_HUMAN)
TVYFPMIFRV

SEQ ID NO: 110243 - protein, 9 aa, Artificial Sequence
  Description of Artificial Sequence: Synthetic peptide
  Seed: MIFGKAHEF (MAGC3_HUMAN)
MEFGKAHEL

SEQ ID NO: 110244 - protein, 10 aa, Artificial Sequence
  Description of Artificial Sequence: Synthetic peptide
  Seed: LNAIGPWSAL (MAGC3_HUMAN)
LWAIGPWSAM

SEQ ID NO: 110245 - protein, 9 aa, Artificial Sequence
  Description of Artificial Sequence: Synthetic peptide
  Seed: MIFGKAHEF (MAGC3_HUMAN)
MGFGKAHEF

SEQ ID NO: 110246 - protein, 9 aa, Artificial Sequence
  Description of Artificial Sequence: Synthetic peptide
  Seed: YQTKEPVTK (MAGC3_HUMAN)
YRTKEPVTM

SEQ ID NO: 110247 - protein, 10 aa, Artificial Sequence
  Description of Artificial Sequence: Synthetic peptide
  Seed: LDSCSSPLLW (MAGC3_HUMAN)
LYSCSSPLLF

SEQ ID NO: 110248 - protein, 9 aa, Artificial Sequence
  Description of Artificial Sequence: Synthetic peptide
  Seed: KAHEFIELI (MAGC3_HUMAN)
KLHEFIELK

SEQ ID NO: 110249 - protein, 9 aa, Artificial Sequence
  Description of Artificial Sequence: Synthetic peptide
  Seed: QTKEPVTKA (MAGC3_HUMAN)
QVKEPVTKY

SEQ ID NO: 110250 - protein, 8 aa, Artificial Sequence
  Description of Artificial Sequence: Synthetic peptide
  Seed: SGSPGLQL (MAGC3_HUMAN)
SLSPGLQL

SEQ ID NO: 110251 - protein, 9 aa, Artificial Sequence
  Description of Artificial Sequence: Synthetic peptide
  Seed: VIWEVLSAI (MAGC3_HUMAN)
VKWEVLSAY

SEQ ID NO: 110252 - protein, 10 aa, Artificial Sequence
  Description of Artificial Sequence: Synthetic peptide
  Seed: IKKYKDYFPM (MAGC3_HUMAN)
IPKYKDYFPF

SEQ ID NO: 110253 - protein, 9 aa, Artificial Sequence
  Description of Artificial Sequence: Synthetic peptide
  Seed: LSGSPGLQL (MAGC3_HUMAN)
LVGSPGLQY

SEQ ID NO: 110254 - protein, 10 aa, Artificial Sequence
  Description of Artificial Sequence: Synthetic peptide
  Seed: EIPPQGPPKI (MAGC3_HUMAN)
EAPPQGPPKL

SEQ ID NO: 110255 - protein, 9 aa, Artificial Sequence
  Description of Artificial Sequence: Synthetic peptide
  Seed: SDLHFGSQP (MAGC3_HUMAN)
SELHFGSQM

SEQ ID NO: 110256 - protein, 10 aa, Artificial Sequence
  Description of Artificial Sequence: Synthetic peptide
  Seed: EVIWEVLSAI (MAGC3_HUMAN)
EAIWEVLSAR

SEQ ID NO: 110257 - protein, 10 aa, Artificial Sequence
  Description of Artificial Sequence: Synthetic peptide
  Seed: YTLDEKVDKL (MAGC3_HUMAN)
YRLDEKVDKL

SEQ ID NO: 110258 - protein, 9 aa, Artificial Sequence
  Description of Artificial Sequence: Synthetic peptide
  Seed: IQRPAREVL (MAGC3_HUMAN)
ITRPAREVM

SEQ ID NO: 110259 - protein, 9 aa, Artificial Sequence
  Description of Artificial Sequence: Synthetic peptide
  Seed: ADVLSRLAL (MAGC3_HUMAN)
AEVLSRLAL

SEQ ID NO: 110260 - protein, 10 aa, Artificial Sequence
  Description of Artificial Sequence: Synthetic peptide
  Seed: TTDDATAMAS (MAGC3_HUMAN)
TFDDATAMAF

SEQ ID NO: 110261 - protein, 10 aa, Artificial Sequence
  Description of Artificial Sequence: Synthetic peptide
  Seed: REVLEFLSKL (MAGC3_HUMAN)
RQVLEFLSKV

SEQ ID NO: 110262 - protein, 9 aa, Artificial Sequence
  Description of Artificial Sequence: Synthetic peptide
  Seed: EVDPDHFYV (MAGC3_HUMAN)
ELDPDHFYI

SEQ ID NO: 110263 - protein, 10 aa, Artificial Sequence
  Description of Artificial Sequence: Synthetic peptide
  Seed: WEVLSAIGPI (MAGC3_HUMAN)
WTVLSAIGPI

SEQ ID NO: 110264 - protein, 10 aa, Artificial Sequence
  Description of Artificial Sequence: Synthetic peptide
  Seed: LSLPAVSPGK (MAGC3_HUMAN)
LMLPAVSPGK

SEQ ID NO: 110265 - protein, 9 aa, Artificial Sequence
  Description of Artificial Sequence: Synthetic peptide
  Seed: NTYTGYFPM (MAGC3_HUMAN)
NLYTGYFPF

SEQ ID NO: 110266 - protein, 9 aa, Artificial Sequence
  Description of Artificial Sequence: Synthetic peptide
  Seed: YKDYFPMIF (MAGC3_HUMAN)
YIDYFPMIM

SEQ ID NO: 110267 - protein, 9 aa, Artificial Sequence
  Description of Artificial Sequence: Synthetic peptide
  Seed: KVDKLVQFL (MAGC3_HUMAN)
KTDKLVQFF

SEQ ID NO: 110268 - protein, 9 aa, Artificial Sequence
  Description of Artificial Sequence: Synthetic peptide
  Seed: VLCPTYFKL (MAGC3_HUMAN)
VWCPTYFKY

SEQ ID NO: 110269 - protein, 9 aa, Artificial Sequence
  Description of Artificial Sequence: Synthetic peptide
  Seed: SLPESEPLF (MAGC3_HUMAN)
SIPESEPLV

SEQ ID NO: 110270 - protein, 9 aa, Artificial Sequence
  Description of Artificial Sequence: Synthetic peptide
  Seed: TLDEKVDKL (MAGC3_HUMAN)
TFDEKVDKL

SEQ ID NO: 110271 - protein, 9 aa, Artificial Sequence
  Description of Artificial Sequence: Synthetic peptide
  Seed: SLVLCPTYF (MAGC3_HUMAN)
SLVLCPTYV

SEQ ID NO: 110272 - protein, 10 aa, Artificial Sequence
  Description of Artificial Sequence: Synthetic peptide
  Seed: TYTGYFPMIF (MAGC3_HUMAN)
TFTGYFPMIY

SEQ ID NO: 110273 - protein, 9 aa, Artificial Sequence
  Description of Artificial Sequence: Synthetic peptide
  Seed: EKVAELVQF (MAGC3_HUMAN)
EVVAELVQY

SEQ ID NO: 110274 - protein, 9 aa, Artificial Sequence
  Description of Artificial Sequence: Synthetic peptide
  Seed: SASPSVMST (MAGC3_HUMAN)
SGSPSVMSI

SEQ ID NO: 110275 - protein, 11 aa, Artificial Sequence
  Description of Artificial Sequence: Synthetic peptide
  Seed: ALWESEGPEAF (MAGC3_HUMAN)
AQWESEGPEAW

SEQ ID NO: 110276 - protein, 9 aa, Artificial Sequence
  Description of Artificial Sequence: Synthetic peptide
  Seed: VDPDHFYVF (MAGC3_HUMAN)
VHPDHFYVF

SEQ ID NO: 110277 - protein, 10 aa, Artificial Sequence
  Description of Artificial Sequence: Synthetic peptide
  Seed: YTLDEKVDKL (MAGC3_HUMAN)
YVLDEKVDKV

SEQ ID NO: 110278 - protein, 10 aa, Artificial Sequence
  Description of Artificial Sequence: Synthetic peptide
  Seed: ALDEKVAELV (MAGC3_HUMAN)
AVDEKVAELF

SEQ ID NO: 110279 - protein, 11 aa, Artificial Sequence
  Description of Artificial Sequence: Synthetic peptide
  Seed: TSDQRMDSLVL (MAGC3_HUMAN)
TWDQRMDSLVF

SEQ ID NO: 110280 - protein, 10 aa, Artificial Sequence
  Description of Artificial Sequence: Synthetic peptide
  Seed: YFPMIFRKAR (MAGC3_HUMAN)
YTPMIFRKAR

SEQ ID NO: 110281 - protein, 11 aa, Artificial Sequence
  Description of Artificial Sequence: Synthetic peptide
  Seed: ALWESEGPEAF (MAGC3_HUMAN)
AVWESEGPEAL

SEQ ID NO: 110282 - protein, 9 aa, Artificial Sequence
  Description of Artificial Sequence: Synthetic peptide
  Seed: DVLSRLALW (MAGC3_HUMAN)
DILSRLALF

SEQ ID NO: 110283 - protein, 11 aa, Artificial Sequence
  Description of Artificial Sequence: Synthetic peptide
  Seed: MQMNVINTYTG (MAGC3_HUMAN)
MRMNVINTYTY

SEQ ID NO: 110284 - protein, 9 aa, Artificial Sequence
  Description of Artificial Sequence: Synthetic peptide
  Seed: YKDYFPMIF (MAGC3_HUMAN)
YGDYFPMIM

SEQ ID NO: 110285 - protein, 10 aa, Artificial Sequence
  Description of Artificial Sequence: Synthetic peptide
  Seed: TTDDATAMAS (MAGC3_HUMAN)
TADDATAMAY

SEQ ID NO: 110286 - protein, 9 aa, Artificial Sequence
  Description of Artificial Sequence: Synthetic peptide
  Seed: SLRRAVSVK (MAGC3_HUMAN)
SMRRAVSVS

SEQ ID NO: 110287 - protein, 8 aa, Artificial Sequence
  Description of Artificial Sequence: Synthetic peptide
  Seed: IFGKAHEF (MAGC3_HUMAN)
ISGKAHEL

SEQ ID NO: 110288 - protein, 10 aa, Artificial Sequence
  Description of Artificial Sequence: Synthetic peptide
  Seed: IIDTTDDATA (MAGC3_HUMAN)
IADTTDDATF

SEQ ID NO: 110289 - protein, 10 aa, Artificial Sequence
  Description of Artificial Sequence: Synthetic peptide
  Seed: YALDEKVAEL (MAGC3_HUMAN)
YGLDEKVAEY

SEQ ID NO: 110290 - protein, 10 aa, Artificial Sequence
  Description of Artificial Sequence: Synthetic peptide
  Seed: MLTTVIKKYK (MAGC3_HUMAN)
MITTVIKKYK

SEQ ID NO: 110291 - protein, 9 aa, Artificial Sequence
  Description of Artificial Sequence: Synthetic peptide
  Seed: NAIGPWSAL (MAGC3_HUMAN)
NTIGPWSAM

SEQ ID NO: 110292 - protein, 10 aa, Artificial Sequence
  Description of Artificial Sequence: Synthetic peptide
  Seed: IELIFGIALT (MAGC3_HUMAN)
ITLIFGIALL

SEQ ID NO: 110293 - protein, 8 aa, Artificial Sequence
  Description of Artificial Sequence: Synthetic peptide
  Seed: YMDALKDM (MAGC3_HUMAN)
YFDALKDL

SEQ ID NO: 110294 - protein, 10 aa, Artificial Sequence
  Description of Artificial Sequence: Synthetic peptide
  Seed: CVPEEVIWEV (MAGC3_HUMAN)
CMPEEVIWEA

SEQ ID NO: 110295 - protein, 9 aa, Artificial Sequence
  Description of Artificial Sequence: Synthetic peptide
  Seed: NAIGPWSAL (MAGC3_HUMAN)
NAIGPWSAW

SEQ ID NO: 110296 - protein, 9 aa, Artificial Sequence
  Description of Artificial Sequence: Synthetic peptide
  Seed: SALAGFADV (MAGC3_HUMAN)
SQLAGFADM

SEQ ID NO: 110297 - protein, 9 aa, Artificial Sequence
  Description of Artificial Sequence: Synthetic peptide
  Seed: MIFRKAREF (MAGC3_HUMAN)
MTFRKAREW

SEQ ID NO: 110298 - protein, 10 aa, Artificial Sequence
  Description of Artificial Sequence: Synthetic peptide
  Seed: TAMASASPSV (MAGC3_HUMAN)
TGMASASPSI

SEQ ID NO: 110299 - protein, 10 aa, Artificial Sequence
  Description of Artificial Sequence: Synthetic peptide
  Seed: MDPDNHSYFF (MAGC3_HUMAN)
MIPDNHSYFY

SEQ ID NO: 110300 - protein, 11 aa, Artificial Sequence
  Description of Artificial Sequence: Synthetic peptide
  Seed: KDMEDRAQAII (MAGC3_HUMAN)
KEMEDRAQAIM

SEQ ID NO: 110301 - protein, 10 aa, Artificial Sequence
  Description of Artificial Sequence: Synthetic peptide
  Seed: YALDEKVAEL (MAGC3_HUMAN)
YLLDEKVAEY

SEQ ID NO: 110302 - protein, 10 aa, Artificial Sequence
  Description of Artificial Sequence: Synthetic peptide
  Seed: KLSSIIPSAF (MAGC3_HUMAN)
KQSSIIPSAF

SEQ ID NO: 110303 - protein, 11 aa, Artificial Sequence
  Description of Artificial Sequence: Synthetic peptide
  Seed: YFFEDTLDLTY (MAGC3_HUMAN)
YWFEDTLDLTY

SEQ ID NO: 110304 - protein, 11 aa, Artificial Sequence
  Description of Artificial Sequence: Synthetic peptide
  Seed: ILFGISLTEVD (MAGC3_HUMAN)
IMFGISLTEVW

SEQ ID NO: 110305 - protein, 9 aa, Artificial Sequence
  Description of Artificial Sequence: Synthetic peptide
  Seed: MLLPCHWVL (MAGC3_HUMAN)
MQLPCHWVH

SEQ ID NO: 110306 - protein, 9 aa, Artificial Sequence
  Description of Artificial Sequence: Synthetic peptide
  Seed: MASASPSVM (MAGC3_HUMAN)
MWSASPSVM

SEQ ID NO: 110307 - protein, 9 aa, Artificial Sequence
  Description of Artificial Sequence: Synthetic peptide
  Seed: DMDPDNHSY (MAGC3_HUMAN)
DLDPDNHSF

SEQ ID NO: 110308 - protein, 9 aa, Artificial Sequence
  Description of Artificial Sequence: Synthetic peptide
  Seed: ALDEKVAEL (MAGC3_HUMAN)
ADDEKVAEV

SEQ ID NO: 110309 - protein, 11 aa, Artificial Sequence
  Description of Artificial Sequence: Synthetic peptide
  Seed: ATFSDGSLGQW (MAGC3_HUMAN)
AQFSDGSLGQY

SEQ ID NO: 110310 - protein, 9 aa, Artificial Sequence
  Description of Artificial Sequence: Synthetic peptide
  Seed: FLSKLSSII (MAGC3_HUMAN)
FKSKLSSIM

SEQ ID NO: 110311 - protein, 9 aa, Artificial Sequence
  Description of Artificial Sequence: Synthetic peptide
  Seed: IQRPAREVL (MAGC3_HUMAN)
IARPAREVY

SEQ ID NO: 110312 - protein, 10 aa, Artificial Sequence
  Description of Artificial Sequence: Synthetic peptide
  Seed: KVDKLVQFLL (MAGC3_HUMAN)
KIDKLVQFLV

SEQ ID NO: 110313 - protein, 8 aa, Artificial Sequence
  Description of Artificial Sequence: Synthetic peptide
  Seed: FIELIFGI (MAGC3_HUMAN)
FLELIFGI

SEQ ID NO: 110314 - protein, 11 aa, Artificial Sequence
  Description of Artificial Sequence: Synthetic peptide
  Seed: LPAVSPGKRLW (MAGC3_HUMAN)
LAAVSPGKRLW

SEQ ID NO: 110315 - protein, 9 aa, Artificial Sequence
  Description of Artificial Sequence: Synthetic peptide
  Seed: LSDEQGMPQ (MAGC3_HUMAN)
LSDEQGMPF

SEQ ID NO: 110316 - protein, 9 aa, Artificial Sequence
  Description of Artificial Sequence: Synthetic peptide
  Seed: ISPQGPPQS (MAGC3_HUMAN)
IMPQGPPQM

SEQ ID NO: 110317 - protein, 9 aa, Artificial Sequence
  Description of Artificial Sequence: Synthetic peptide
  Seed: QTKEPVTKA (MAGC3_HUMAN)
QTKEPVTKM

SEQ ID NO: 110318 - protein, 9 aa, Artificial Sequence
  Description of Artificial Sequence: Synthetic peptide
  Seed: DSDLPTWRR (MAGC3_HUMAN)
DADLPTWRR

SEQ ID NO: 110319 - protein, 9 aa, Artificial Sequence
  Description of Artificial Sequence: Synthetic peptide
  Seed: GFADVLSRL (MAGC3_HUMAN)
GLADVLSRC

SEQ ID NO: 110320 - protein, 9 aa, Artificial Sequence
  Description of Artificial Sequence: Synthetic peptide
  Seed: GFADVLSRL (MAGC3_HUMAN)
GSADVLSRI

SEQ ID NO: 110321 - protein, 11 aa, Artificial Sequence
  Description of Artificial Sequence: Synthetic peptide
  Seed: ATAMASASPSV (MAGC3_HUMAN)
AKAMASASPSV

SEQ ID NO: 110322 - protein, 9 aa, Artificial Sequence
  Description of Artificial Sequence: Synthetic peptide
  Seed: KLSSIIPSA (MAGC3_HUMAN)
KTSSIIPSR

SEQ ID NO: 110323 - protein, 9 aa, Artificial Sequence
  Description of Artificial Sequence: Synthetic peptide
  Seed: SLPAVSPGK (MAGC3_HUMAN)
SSPAVSPGM

SEQ ID NO: 110324 - protein, 10 aa, Artificial Sequence
  Description of Artificial Sequence: Synthetic peptide
  Seed: EMQMNVINTY (MAGC3_HUMAN)
EIQMNVINTF

SEQ ID NO: 110325 - protein, 10 aa, Artificial Sequence
  Description of Artificial Sequence: Synthetic peptide
  Seed: TLSGSPGLQL (MAGC3_HUMAN)
TLSGSPGLQY

SEQ ID NO: 110326 - protein, 9 aa, Artificial Sequence
  Description of Artificial Sequence: Synthetic peptide
  Seed: KNCLLILIL (MAGC3_HUMAN)
KSCLLILIL

SEQ ID NO: 110327 - protein, 10 aa, Artificial Sequence
  Description of Artificial Sequence: Synthetic peptide
  Seed: YALDEKVAEL (MAGC3_HUMAN)
YMLDEKVAET

SEQ ID NO: 110328 - protein, 9 aa, Artificial Sequence
  Description of Artificial Sequence: Synthetic peptide
  Seed: TLDEKVDKL (MAGC3_HUMAN)
TRDEKVDKF

SEQ ID NO: 110329 - protein, 9 aa, Artificial Sequence
  Description of Artificial Sequence: Synthetic peptide
  Seed: VIWEVLNAI (MAGC3_HUMAN)
VMWEVLNAL

SEQ ID NO: 110330 - protein, 9 aa, Artificial Sequence
  Description of Artificial Sequence: Synthetic peptide
  Seed: HFYVFVNTL (MAGC3_HUMAN)
HWYVFVNTF

SEQ ID NO: 110331 - protein, 10 aa, Artificial Sequence
  Description of Artificial Sequence: Synthetic peptide
  Seed: SWYMDALKDM (MAGC3_HUMAN)
SYYMDALKDF

SEQ ID NO: 110332 - protein, 10 aa, Artificial Sequence
  Description of Artificial Sequence: Synthetic peptide
  Seed: YFPMIFGKAH (MAGC3_HUMAN)
YFPMIFGKAL

SEQ ID NO: 110333 - protein, 10 aa, Artificial Sequence
  Description of Artificial Sequence: Synthetic peptide
  Seed: MPAAGMPPLP (MAGC3_HUMAN)
MIAAGMPPLY

SEQ ID NO: 110334 - protein, 9 aa, Artificial Sequence
  Description of Artificial Sequence: Synthetic peptide
  Seed: LSSIIPSAF (MAGC3_HUMAN)
LCSIIPSAW

SEQ ID NO: 110335 - protein, 10 aa, Artificial Sequence
  Description of Artificial Sequence: Synthetic peptide
  Seed: IKKYKDYFPM (MAGC3_HUMAN)
ILKYKDYFPF

SEQ ID NO: 110336 - protein, 10 aa, Artificial Sequence
  Description of Artificial Sequence: Synthetic peptide
  Seed: YALDEKVAEL (MAGC3_HUMAN)
YPLDEKVAEA

SEQ ID NO: 110337 - protein, 9 aa, Artificial Sequence
  Description of Artificial Sequence: Synthetic peptide
  Seed: LIDDQGMPK (MAGC3_HUMAN)
LQDDQGMPF

SEQ ID NO: 110338 - protein, 9 aa, Artificial Sequence
  Description of Artificial Sequence: Synthetic peptide
  Seed: SAFHLGHLR (MAGC3_HUMAN)
SNFHLGHLY

SEQ ID NO: 110339 - protein, 9 aa, Artificial Sequence
  Description of Artificial Sequence: Synthetic peptide
  Seed: YFFEDTLDL (MAGC3_HUMAN)
YCFEDTLDY

SEQ ID NO: 110340 - protein, 10 aa, Artificial Sequence
  Description of Artificial Sequence: Synthetic peptide
  Seed: ALDEKVAELV (MAGC3_HUMAN)
ASDEKVAELF

SEQ ID NO: 110341 - protein, 9 aa, Artificial Sequence
  Description of Artificial Sequence: Synthetic peptide
  Seed: LILSMIFIK (MAGC3_HUMAN)
LVLSMIFIR

SEQ ID NO: 110342 - protein, 9 aa, Artificial Sequence
  Description of Artificial Sequence: Synthetic peptide
  Seed: DVLSRLALW (MAGC3_HUMAN)
DSLSRLALY

SEQ ID NO: 110343 - protein, 10 aa, Artificial Sequence
  Description of Artificial Sequence: Synthetic peptide
  Seed: KAHEFIELIF (MAGC3_HUMAN)
KMHEFIELIY

SEQ ID NO: 110344 - protein, 9 aa, Artificial Sequence
  Description of Artificial Sequence: Synthetic peptide
  Seed: HLREVRLFL (MAGC3_HUMAN)
HAREVRLFY

SEQ ID NO: 110345 - protein, 9 aa, Artificial Sequence
  Description of Artificial Sequence: Synthetic peptide
  Seed: ELVQFLLLK (MAGC3_HUMAN)
EQVQFLLLR

SEQ ID NO: 110346 - protein, 9 aa, Artificial Sequence
  Description of Artificial Sequence: Synthetic peptide
  Seed: LIDDQGMPK (MAGC3_HUMAN)
LFDDQGMPM

SEQ ID NO: 110347 - protein, 10 aa, Artificial Sequence
  Description of Artificial Sequence: Synthetic peptide
  Seed: TAMASASPSV (MAGC3_HUMAN)
TQMASASPSL

SEQ ID NO: 110348 - protein, 9 aa, Artificial Sequence
  Description of Artificial Sequence: Synthetic peptide
  Seed: LSGSPGLQL (MAGC3_HUMAN)
LMGSPGLQM

SEQ ID NO: 110349 - protein, 10 aa, Artificial Sequence
  Description of Artificial Sequence: Synthetic peptide
  Seed: KKYKDYFPMI (MAGC3_HUMAN)
KDYKDYFPMK

SEQ ID NO: 110350 - protein, 9 aa, Artificial Sequence
  Description of Artificial Sequence: Synthetic peptide
  Seed: ALAGFADVL (MAGC3_HUMAN)
AMAGFADVI

SEQ ID NO: 110351 - protein, 10 aa, Artificial Sequence
  Description of Artificial Sequence: Synthetic peptide
  Seed: YQAKEPLTRA (MAGC3_HUMAN)
YVAKEPLTRV

SEQ ID NO: 110352 - protein, 10 aa, Artificial Sequence
  Description of Artificial Sequence: Synthetic peptide
  Seed: REVRLFLRGG (MAGC3_HUMAN)
RQVRLFLRGK

SEQ ID NO: 110353 - protein, 9 aa, Artificial Sequence
  Description of Artificial Sequence: Synthetic peptide
  Seed: RPAREVLEF (MAGC3_HUMAN)
RRAREVLEL

SEQ ID NO: 110354 - protein, 10 aa, Artificial Sequence
  Description of Artificial Sequence: Synthetic peptide
  Seed: YALSPVVLPP (MAGC3_HUMAN)
YNLSPVVLPA

SEQ ID NO: 110355 - protein, 9 aa, Artificial Sequence
  Description of Artificial Sequence: Synthetic peptide
  Seed: LILSVIFIK (MAGC3_HUMAN)
LLLSVIFIK

SEQ ID NO: 110356 - protein, 9 aa, Artificial Sequence
  Description of Artificial Sequence: Synthetic peptide
  Seed: ALSPVVLPP (MAGC3_HUMAN)
AVSPVVLPV

SEQ ID NO: 110357 - protein, 9 aa, Artificial Sequence
  Description of Artificial Sequence: Synthetic peptide
  Seed: LKYQAKEPL (MAGC3_HUMAN)
LMYQAKEPW

SEQ ID NO: 110358 - protein, 10 aa, Artificial Sequence
  Description of Artificial Sequence: Synthetic peptide
  Seed: CASEEVIWEV (MAGC3_HUMAN)
CLSEEVIWET

SEQ ID NO: 110359 - protein, 11 aa, Artificial Sequence
  Description of Artificial Sequence: Synthetic peptide
  Seed: VLCPTYFKLWR (MAGC3_HUMAN)
VMCPTYFKLWR

SEQ ID NO: 110360 - protein, 10 aa, Artificial Sequence
  Description of Artificial Sequence: Synthetic peptide
  Seed: TAMASASPSV (MAGC3_HUMAN)
TDMASASPSV

SEQ ID NO: 110361 - protein, 9 aa, Artificial Sequence
  Description of Artificial Sequence: Synthetic peptide
  Seed: AMASASPSV (MAGC3_HUMAN)
ATASASPSR

SEQ ID NO: 110362 - protein, 9 aa, Artificial Sequence
  Description of Artificial Sequence: Synthetic peptide
  Seed: MLLPCHWVL (MAGC3_HUMAN)
MPLPCHWVA

SEQ ID NO: 110363 - protein, 10 aa, Artificial Sequence
  Description of Artificial Sequence: Synthetic peptide
  Seed: NTYTGYFPMI (MAGC3_HUMAN)
NKYTGYFPMF

SEQ ID NO: 110364 - protein, 9 aa, Artificial Sequence
  Description of Artificial Sequence: Synthetic peptide
  Seed: KVAELVQFL (MAGC3_HUMAN)
KLAELVQFK

SEQ ID NO: 110365 - protein, 8 aa, Artificial Sequence
  Description of Artificial Sequence: Synthetic peptide
  Seed: KVDKLVQF (MAGC3_HUMAN)
KFDKLVQF

SEQ ID NO: 110366 - protein, 9 aa, Artificial Sequence
  Description of Artificial Sequence: Synthetic peptide
  Seed: ASEEVIWEV (MAGC3_HUMAN)
AQEEVIWEM

SEQ ID NO: 110367 - protein, 9 aa, Artificial Sequence
  Description of Artificial Sequence: Synthetic peptide
  Seed: VIWEVLNAI (MAGC3_HUMAN)
VLWEVLNAT

SEQ ID NO: 110368 - protein, 9 aa, Artificial Sequence
  Description of Artificial Sequence: Synthetic peptide
  Seed: AGFADVLSR (MAGC3_HUMAN)
AGFADVLSY

SEQ ID NO: 110369 - protein, 9 aa, Artificial Sequence
  Description of Artificial Sequence: Synthetic peptide
  Seed: NAIGPWSAL (MAGC3_HUMAN)
NAIGPWSAF

SEQ ID NO: 110370 - protein, 9 aa, Artificial Sequence
  Description of Artificial Sequence: Synthetic peptide
  Seed: KAHEFIELI (MAGC3_HUMAN)
KRHEFIELL

SEQ ID NO: 110371 - protein, 9 aa, Artificial Sequence
  Description of Artificial Sequence: Synthetic peptide
  Seed: MIFGKAHEF (MAGC3_HUMAN)
MMFGKAHEH

SEQ ID NO: 110372 - protein, 9 aa, Artificial Sequence
  Description of Artificial Sequence: Synthetic peptide
  Seed: SEEEDTATW (MAGC3_HUMAN)
SEEEDTATP

SEQ ID NO: 110373 - protein, 9 aa, Artificial Sequence
  Description of Artificial Sequence: Synthetic peptide
  Seed: EVDPDHFYV (MAGC3_HUMAN)
EADPDHFYV

SEQ ID NO: 110374 - protein, 9 aa, Artificial Sequence
  Description of Artificial Sequence: Synthetic peptide
  Seed: KVAELVQFL (MAGC3_HUMAN)
KQAELVQFR

SEQ ID NO: 110375 - protein, 9 aa, Artificial Sequence
  Description of Artificial Sequence: Synthetic peptide
  Seed: MLLPCHWVL (MAGC3_HUMAN)
MYLPCHWVV

SEQ ID NO: 110376 - protein, 10 aa, Artificial Sequence
  Description of Artificial Sequence: Synthetic peptide
  Seed: YTLDEKVDKL (MAGC3_HUMAN)
YFLDEKVDKL

SEQ ID NO: 110377 - protein, 9 aa, Artificial Sequence
  Description of Artificial Sequence: Synthetic peptide
  Seed: FLSKLSSII (MAGC3_HUMAN)
FSSKLSSIV

SEQ ID NO: 110378 - protein, 10 aa, Artificial Sequence
  Description of Artificial Sequence: Synthetic peptide
  Seed: MIFRKAREFI (MAGC3_HUMAN)
MTFRKAREFV

SEQ ID NO: 110379 - protein, 9 aa, Artificial Sequence
  Description of Artificial Sequence: Synthetic peptide
  Seed: SQPEGKFSL (MAGC3_HUMAN)
SFPEGKFSV

SEQ ID NO: 110380 - protein, 9 aa, Artificial Sequence
  Description of Artificial Sequence: Synthetic peptide
  Seed: DEQGMPQNR (MAGC3_HUMAN)
DTQGMPQNK

SEQ ID NO: 110381 - protein, 9 aa, Artificial Sequence
  Description of Artificial Sequence: Synthetic peptide
  Seed: YQTKEPVTK (MAGC3_HUMAN)
YYTKEPVTL

SEQ ID NO: 110382 - protein, 10 aa, Artificial Sequence
  Description of Artificial Sequence: Synthetic peptide
  Seed: MLTTVIKKYK (MAGC3_HUMAN)
MWTTVIKKYK

SEQ ID NO: 110383 - protein, 9 aa, Artificial Sequence
  Description of Artificial Sequence: Synthetic peptide
  Seed: SESLPRYAL (MAGC3_HUMAN)
SQSLPRYAM

SEQ ID NO: 110384 - protein, 8 aa, Artificial Sequence
  Description of Artificial Sequence: Synthetic peptide
  Seed: IFGKAHEF (MAGC3_HUMAN)
IFGKAHEY

SEQ ID NO: 110385 - protein, 10 aa, Artificial Sequence
  Description of Artificial Sequence: Synthetic peptide
  Seed: SAFHLGHLRE (MAGC3_HUMAN)
STFHLGHLRR

SEQ ID NO: 110386 - protein, 10 aa, Artificial Sequence
  Description of Artificial Sequence: Synthetic peptide
  Seed: VTKAEMLTTV (MAGC3_HUMAN)
VMKAEMLTTL

SEQ ID NO: 110387 - protein, 9 aa, Artificial Sequence
  Description of Artificial Sequence: Synthetic peptide
  Seed: HFYVFVNTL (MAGC3_HUMAN)
HVYVFVNTV

SEQ ID NO: 110388 - protein, 9 aa, Artificial Sequence
  Description of Artificial Sequence: Synthetic peptide
  Seed: FLSKLSSII (MAGC3_HUMAN)
FESKLSSIF

SEQ ID NO: 110389 - protein, 9 aa, Artificial Sequence
  Description of Artificial Sequence: Synthetic peptide
  Seed: VIWEVLNAI (MAGC3_HUMAN)
VLWEVLNAA

SEQ ID NO: 110390 - protein, 9 aa, Artificial Sequence
  Description of Artificial Sequence: Synthetic peptide
  Seed: EDMPAAGMP (MAGC3_HUMAN)
EEMPAAGMP

SEQ ID NO: 110391 - protein, 9 aa, Artificial Sequence
  Description of Artificial Sequence: Synthetic peptide
  Seed: NTYTGYFPM (MAGC3_HUMAN)
NQYTGYFPR

SEQ ID NO: 110392 - protein, 11 aa, Artificial Sequence
  Description of Artificial Sequence: Synthetic peptide
  Seed: GYFPMIFRKAR (MAGC3_HUMAN)
GSFPMIFRKAR

SEQ ID NO: 110393 - protein, 10 aa, Artificial Sequence
  Description of Artificial Sequence: Synthetic peptide
  Seed: YSAFHLGHLR (MAGC3_HUMAN)
YPAFHLGHLR

SEQ ID NO: 110394 - protein, 9 aa, Artificial Sequence
  Description of Artificial Sequence: Synthetic peptide
  Seed: HALPESESL (MAGC3_HUMAN)
HHLPESESL

SEQ ID NO: 110395 - protein, 9 aa, Artificial Sequence
  Description of Artificial Sequence: Synthetic peptide
  Seed: KAEMLTTVI (MAGC3_HUMAN)
KVEMLTTVW

SEQ ID NO: 110396 - protein, 10 aa, Artificial Sequence
  Description of Artificial Sequence: Synthetic peptide
  Seed: ALDEKVAELV (MAGC3_HUMAN)
AVDEKVAELL

SEQ ID NO: 110397 - protein, 10 aa, Artificial Sequence
  Description of Artificial Sequence: Synthetic peptide
  Seed: LPQSPPEIPP (MAGC3_HUMAN)
LPQSPPEIPA

SEQ ID NO: 110398 - protein, 9 aa, Artificial Sequence
  Description of Artificial Sequence: Synthetic peptide
  Seed: AGFADVLSR (MAGC3_HUMAN)
ASFADVLSV

SEQ ID NO: 110399 - protein, 9 aa, Artificial Sequence
  Description of Artificial Sequence: Synthetic peptide
  Seed: SQPEGKFSL (MAGC3_HUMAN)
SPPEGKFSL

SEQ ID NO: 110400 - protein, 9 aa, Artificial Sequence
  Description of Artificial Sequence: Synthetic peptide
  Seed: FPMIFGKAH (MAGC3_HUMAN)
FPMIFGKAW

SEQ ID NO: 110401 - protein, 10 aa, Artificial Sequence
  Description of Artificial Sequence: Synthetic peptide
  Seed: TGYFPMIFRK (MAGC3_HUMAN)
TAYFPMIFRQ

SEQ ID NO: 110402 - protein, 10 aa, Artificial Sequence
  Description of Artificial Sequence: Synthetic peptide
  Seed: SLPAVSPGKR (MAGC3_HUMAN)
STPAVSPGKK

SEQ ID NO: 110403 - protein, 9 aa, Artificial Sequence
  Description of Artificial Sequence: Synthetic peptide
  Seed: LKYQAKEPL (MAGC3_HUMAN)
LLYQAKEPY

SEQ ID NO: 110404 - protein, 9 aa, Artificial Sequence
  Description of Artificial Sequence: Synthetic peptide
  Seed: KVAELVQFL (MAGC3_HUMAN)
KMAELVQFF

SEQ ID NO: 110405 - protein, 10 aa, Artificial Sequence
  Description of Artificial Sequence: Synthetic peptide
  Seed: EKVAELVQFL (MAGC3_HUMAN)
ETVAELVQFV

SEQ ID NO: 110406 - protein, 10 aa, Artificial Sequence
  Description of Artificial Sequence: Synthetic peptide
  Seed: LNAIGPWSAL (MAGC3_HUMAN)
LMAIGPWSAY

SEQ ID NO: 110407 - protein, 9 aa, Artificial Sequence
  Description of Artificial Sequence: Synthetic peptide
  Seed: MLLPCHWVL (MAGC3_HUMAN)
MQLPCHWVI

SEQ ID NO: 110408 - protein, 10 aa, Artificial Sequence
  Description of Artificial Sequence: Synthetic peptide
  Seed: LSKLSSIIPS (MAGC3_HUMAN)
LMKLSSIIPK

SEQ ID NO: 110409 - protein, 9 aa, Artificial Sequence
  Description of Artificial Sequence: Synthetic peptide
  Seed: SASPSVMST (MAGC3_HUMAN)
SQSPSVMSL

SEQ ID NO: 110410 - protein, 9 aa, Artificial Sequence
  Description of Artificial Sequence: Synthetic peptide
  Seed: FLSKLSSII (MAGC3_HUMAN)
FLSKLSSIF

SEQ ID NO: 110411 - protein, 10 aa, Artificial Sequence
  Description of Artificial Sequence: Synthetic peptide
  Seed: YALDEKVAEL (MAGC3_HUMAN)
YDLDEKVAEL

SEQ ID NO: 110412 - protein, 9 aa, Artificial Sequence
  Description of Artificial Sequence: Synthetic peptide
  Seed: NTYTGYFPM (MAGC3_HUMAN)
NQYTGYFPF

SEQ ID NO: 110413 - protein, 11 aa, Artificial Sequence
  Description of Artificial Sequence: Synthetic peptide
  Seed: CPTYFKLWRTL (MAGC3_HUMAN)
CYTYFKLWRTF

SEQ ID NO: 110414 - protein, 10 aa, Artificial Sequence
  Description of Artificial Sequence: Synthetic peptide
  Seed: EKVAELVQFL (MAGC3_HUMAN)
EPVAELVQFV

SEQ ID NO: 110415 - protein, 9 aa, Artificial Sequence
  Description of Artificial Sequence: Synthetic peptide
  Seed: ATDKDYSAF (MAGC3_HUMAN)
AIDKDYSAF

SEQ ID NO: 110416 - protein, 9 aa, Artificial Sequence
  Description of Artificial Sequence: Synthetic peptide
  Seed: PESEPLFTY (MAGC3_HUMAN)
PFSEPLFTY

SEQ ID NO: 110417 - protein, 9 aa, Artificial Sequence
  Description of Artificial Sequence: Synthetic peptide
  Seed: VIWEVLSAI (MAGC3_HUMAN)
VLWEVLSAC

SEQ ID NO: 110418 - protein, 10 aa, Artificial Sequence
  Description of Artificial Sequence: Synthetic peptide
  Seed: VTKAEMLTTV (MAGC3_HUMAN)
VMKAEMLTTA

SEQ ID NO: 110419 - protein, 11 aa, Artificial Sequence
  Description of Artificial Sequence: Synthetic peptide
  Seed: KVAELVQFLLL (MAGC3_HUMAN)
KLAELVQFLLM

SEQ ID NO: 110420 - protein, 9 aa, Artificial Sequence
  Description of Artificial Sequence: Synthetic peptide
  Seed: SIIPSAFPS (MAGC3_HUMAN)
STIPSAFPV

SEQ ID NO: 110421 - protein, 9 aa, Artificial Sequence
  Description of Artificial Sequence: Synthetic peptide
  Seed: HALPESESL (MAGC3_HUMAN)
HQLPESESY

SEQ ID NO: 110422 - protein, 10 aa, Artificial Sequence
  Description of Artificial Sequence: Synthetic peptide
  Seed: FKLWRTLSGS (MAGC3_HUMAN)
FFLWRTLSGL

SEQ ID NO: 110423 - protein, 9 aa, Artificial Sequence
  Description of Artificial Sequence: Synthetic peptide
  Seed: ISPQGPPQS (MAGC3_HUMAN)
IGPQGPPQV

SEQ ID NO: 110424 - protein, 10 aa, Artificial Sequence
  Description of Artificial Sequence: Synthetic peptide
  Seed: ADVLSRLALW (MAGC3_HUMAN)
ASVLSRLALY

SEQ ID NO: 110425 - protein, 9 aa, Artificial Sequence
  Description of Artificial Sequence: Synthetic peptide
  Seed: ATDKDYSAF (MAGC3_HUMAN)
ALDKDYSAW

SEQ ID NO: 110426 - protein, 10 aa, Artificial Sequence
  Description of Artificial Sequence: Synthetic peptide
  Seed: YALDEKVAEL (MAGC3_HUMAN)
YILDEKVAEF

SEQ ID NO: 110427 - protein, 11 aa, Artificial Sequence
  Description of Artificial Sequence: Synthetic peptide
  Seed: MPAAGMPPLPQ (MAGC3_HUMAN)
MPAAGMPPLPA

SEQ ID NO: 110428 - protein, 9 aa, Artificial Sequence
  Description of Artificial Sequence: Synthetic peptide
  Seed: WVKNTCATY (MAGC3_HUMAN)
WMKNTCATF

SEQ ID NO: 110429 - protein, 9 aa, Artificial Sequence
  Description of Artificial Sequence: Synthetic peptide
  Seed: SLVLCPTYF (MAGC3_HUMAN)
SYVLCPTYL

SEQ ID NO: 110430 - protein, 9 aa, Artificial Sequence
  Description of Artificial Sequence: Synthetic peptide
  Seed: VDPDHFYVF (MAGC3_HUMAN)
VGPDHFYVY

SEQ ID NO: 110431 - protein, 10 aa, Artificial Sequence
  Description of Artificial Sequence: Synthetic peptide
  Seed: KAEMLTTVIK (MAGC3_HUMAN)
KYEMLTTVIR

SEQ ID NO: 110432 - protein, 10 aa, Artificial Sequence
  Description of Artificial Sequence: Synthetic peptide
  Seed: MQMNVINTYT (MAGC3_HUMAN)
MLMNVINTYS

SEQ ID NO: 110433 - protein, 9 aa, Artificial Sequence
  Description of Artificial Sequence: Synthetic peptide
  Seed: GYFPMIFRK (MAGC3_HUMAN)
GIFPMIFRR

SEQ ID NO: 110434 - protein, 9 aa, Artificial Sequence
  Description of Artificial Sequence: Synthetic peptide
  Seed: KDSDLPTWR (MAGC3_HUMAN)
KQSDLPTWR

SEQ ID NO: 110435 - protein, 10 aa, Artificial Sequence
  Description of Artificial Sequence: Synthetic peptide
  Seed: YALSPVVLPP (MAGC3_HUMAN)
YVLSPVVLPV

SEQ ID NO: 110436 - protein, 9 aa, Artificial Sequence
  Description of Artificial Sequence: Synthetic peptide
  Seed: DEKVDKLVQ (MAGC3_HUMAN)
DEKVDKLVF

SEQ ID NO: 110437 - protein, 10 aa, Artificial Sequence
  Description of Artificial Sequence: Synthetic peptide
  Seed: TDMDPDNHSY (MAGC3_HUMAN)
TGMDPDNHSY

SEQ ID NO: 110438 - protein, 9 aa, Artificial Sequence
  Description of Artificial Sequence: Synthetic peptide
  Seed: REVLEFLSK (MAGC3_HUMAN)
RMVLEFLSR

SEQ ID NO: 110439 - protein, 9 aa, Artificial Sequence
  Description of Artificial Sequence: Synthetic peptide
  Seed: EVIWEVLSA (MAGC3_HUMAN)
EVIWEVLSY

SEQ ID NO: 110440 - protein, 9 aa, Artificial Sequence
  Description of Artificial Sequence: Synthetic peptide
  Seed: SAFHLGHLR (MAGC3_HUMAN)
SNFHLGHLR

SEQ ID NO: 110441 - protein, 9 aa, Artificial Sequence
  Description of Artificial Sequence: Synthetic peptide
  Seed: YSAFHLGHL (MAGC3_HUMAN)
YVAFHLGHR

SEQ ID NO: 110442 - protein, 10 aa, Artificial Sequence
  Description of Artificial Sequence: Synthetic peptide
  Seed: MPKNCLLILI (MAGC3_HUMAN)
MPKNCLLILV

SEQ ID NO: 110443 - protein, 9 aa, Artificial Sequence
  Description of Artificial Sequence: Synthetic peptide
  Seed: LKYQAKEPL (MAGC3_HUMAN)
LRYQAKEPY

SEQ ID NO: 110444 - protein, 11 aa, Artificial Sequence
  Description of Artificial Sequence: Synthetic peptide
  Seed: TSDQRMDSLVL (MAGC3_HUMAN)
TIDQRMDSLVY

SEQ ID NO: 110445 - protein, 11 aa, Artificial Sequence
  Description of Artificial Sequence: Synthetic peptide
  Seed: LSKLSSIIPSA (MAGC3_HUMAN)
LRKLSSIIPSI

SEQ ID NO: 110446 - protein, 10 aa, Artificial Sequence
  Description of Artificial Sequence: Synthetic peptide
  Seed: LILILSVIFI (MAGC3_HUMAN)
LCLILSVIFV

SEQ ID NO: 110447 - protein, 10 aa, Artificial Sequence
  Description of Artificial Sequence: Synthetic peptide
  Seed: KAHEFIELIF (MAGC3_HUMAN)
KSHEFIELIW

SEQ ID NO: 110448 - protein, 11 aa, Artificial Sequence
  Description of Artificial Sequence: Synthetic peptide
  Seed: SSSEEEDTATW (MAGC3_HUMAN)
SQSEEEDTATL

SEQ ID NO: 110449 - protein, 9 aa, Artificial Sequence
  Description of Artificial Sequence: Synthetic peptide
  Seed: DMDPDNHSY (MAGC3_HUMAN)
DWDPDNHSI

SEQ ID NO: 110450 - protein, 9 aa, Artificial Sequence
  Description of Artificial Sequence: Synthetic peptide
  Seed: IIPSAFPSW (MAGC3_HUMAN)
IWPSAFPSM

SEQ ID NO: 110451 - protein, 10 aa, Artificial Sequence
  Description of Artificial Sequence: Synthetic peptide
  Seed: VLDLANPQGL (MAGC3_HUMAN)
VADLANPQGV

SEQ ID NO: 110452 - protein, 10 aa, Artificial Sequence
  Description of Artificial Sequence: Synthetic peptide
  Seed: TLDEKVDKLV (MAGC3_HUMAN)
TFDEKVDKLF

SEQ ID NO: 110453 - protein, 9 aa, Artificial Sequence
  Description of Artificial Sequence: Synthetic peptide
  Seed: VDPDHFYVF (MAGC3_HUMAN)
VWPDHFYVF

SEQ ID NO: 110454 - protein, 9 aa, Artificial Sequence
  Description of Artificial Sequence: Synthetic peptide
  Seed: MIFGKAHEF (MAGC3_HUMAN)
MTFGKAHEV

SEQ ID NO: 110455 - protein, 10 aa, Artificial Sequence
  Description of Artificial Sequence: Synthetic peptide
  Seed: SCSSPLLWTR (MAGC3_HUMAN)
SLSSPLLWTR

SEQ ID NO: 110456 - protein, 10 aa, Artificial Sequence
  Description of Artificial Sequence: Synthetic peptide
  Seed: RLWGEKAGSL (MAGC3_HUMAN)
RVWGEKAGSW

SEQ ID NO: 110457 - protein, 9 aa, Artificial Sequence
  Description of Artificial Sequence: Synthetic peptide
  Seed: NTYTGYFPM (MAGC3_HUMAN)
NMYTGYFPW

SEQ ID NO: 110458 - protein, 10 aa, Artificial Sequence
  Description of Artificial Sequence: Synthetic peptide
  Seed: LLILILSVIF (MAGC3_HUMAN)
LQILILSVIM

SEQ ID NO: 110459 - protein, 10 aa, Artificial Sequence
  Description of Artificial Sequence: Synthetic peptide
  Seed: LVLCPTYFKL (MAGC3_HUMAN)
LVLCPTYFKK

SEQ ID NO: 110460 - protein, 9 aa, Artificial Sequence
  Description of Artificial Sequence: Synthetic peptide
  Seed: MQMNVINTY (MAGC3_HUMAN)
MAMNVINTV

SEQ ID NO: 110461 - protein, 8 aa, Artificial Sequence
  Description of Artificial Sequence: Synthetic peptide
  Seed: TTDDATAM (MAGC3_HUMAN)
TMDDATAI

SEQ ID NO: 110462 - protein, 9 aa, Artificial Sequence
  Description of Artificial Sequence: Synthetic peptide
  Seed: ASEEVIWEV (MAGC3_HUMAN)
AMEEVIWEI

SEQ ID NO: 110463 - protein, 11 aa, Artificial Sequence
  Description of Artificial Sequence: Synthetic peptide
  Seed: LVLCPTYFKLW (MAGC3_HUMAN)
LSLCPTYFKLW

SEQ ID NO: 110464 - protein, 10 aa, Artificial Sequence
  Description of Artificial Sequence: Synthetic peptide
  Seed: YALDEKVAEL (MAGC3_HUMAN)
YVLDEKVAEI

SEQ ID NO: 110465 - protein, 10 aa, Artificial Sequence
  Description of Artificial Sequence: Synthetic peptide
  Seed: YTGYFPMIFR (MAGC3_HUMAN)
YYGYFPMIFK

SEQ ID NO: 110466 - protein, 11 aa, Artificial Sequence
  Description of Artificial Sequence: Synthetic peptide
  Seed: IIDTTDDATAM (MAGC3_HUMAN)
ISDTTDDATAM

SEQ ID NO: 110467 - protein, 10 aa, Artificial Sequence
  Description of Artificial Sequence: Synthetic peptide
  Seed: MLLPCHWVLD (MAGC3_HUMAN)
MMLPCHWVLV

SEQ ID NO: 110468 - protein, 10 aa, Artificial Sequence
  Description of Artificial Sequence: Synthetic peptide
  Seed: EMQMNVINTY (MAGC3_HUMAN)
EYQMNVINTF

SEQ ID NO: 110469 - protein, 9 aa, Artificial Sequence
  Description of Artificial Sequence: Synthetic peptide
  Seed: WVKNTCATY (MAGC3_HUMAN)
WRKNTCATF

SEQ ID NO: 110470 - protein, 10 aa, Artificial Sequence
  Description of Artificial Sequence: Synthetic peptide
  Seed: LILILSVIFI (MAGC3_HUMAN)
LMLILSVIFV

SEQ ID NO: 110471 - protein, 9 aa, Artificial Sequence
  Description of Artificial Sequence: Synthetic peptide
  Seed: MQMNVINTY (MAGC3_HUMAN)
MEMNVINTF

SEQ ID NO: 110472 - protein, 9 aa, Artificial Sequence
  Description of Artificial Sequence: Synthetic peptide
  Seed: TLDEKVDKL (MAGC3_HUMAN)
THDEKVDKF

SEQ ID NO: 110473 - protein, 8 aa, Artificial Sequence
  Description of Artificial Sequence: Synthetic peptide
  Seed: FPMIFRKA (MAGC3_HUMAN)
FPMIFRKM

SEQ ID NO: 110474 - protein, 9 aa, Artificial Sequence
  Description of Artificial Sequence: Synthetic peptide
  Seed: HSYFFEDTL (MAGC3_HUMAN)
HTYFFEDTI

SEQ ID NO: 110475 - protein, 9 aa, Artificial Sequence
  Description of Artificial Sequence: Synthetic peptide
  Seed: FGSQPEGKF (MAGC3_HUMAN)
FMSQPEGKF

SEQ ID NO: 110476 - protein, 10 aa, Artificial Sequence
  Description of Artificial Sequence: Synthetic peptide
  Seed: SLVLCPTYFK (MAGC3_HUMAN)
SHVLCPTYFK

SEQ ID NO: 110477 - protein, 10 aa, Artificial Sequence
  Description of Artificial Sequence: Synthetic peptide
  Seed: YQAKEPLTRA (MAGC3_HUMAN)
YQAKEPLTRI

SEQ ID NO: 110478 - protein, 10 aa, Artificial Sequence
  Description of Artificial Sequence: Synthetic peptide
  Seed: DEQGMPQNRL (MAGC3_HUMAN)
DEQGMPQNRW

SEQ ID NO: 110479 - protein, 10 aa, Artificial Sequence
  Description of Artificial Sequence: Synthetic peptide
  Seed: EVIWEVLNAI (MAGC3_HUMAN)
EAIWEVLNAF

SEQ ID NO: 110480 - protein, 9 aa, Artificial Sequence
  Description of Artificial Sequence: Synthetic peptide
  Seed: YFFEDTLDL (MAGC3_HUMAN)
YTFEDTLDY

SEQ ID NO: 110481 - protein, 9 aa, Artificial Sequence
  Description of Artificial Sequence: Synthetic peptide
  Seed: LKYQAKEPL (MAGC3_HUMAN)
LHYQAKEPY

SEQ ID NO: 110482 - protein, 9 aa, Artificial Sequence
  Description of Artificial Sequence: Synthetic peptide
  Seed: SLRRAVSVK (MAGC3_HUMAN)
SFRRAVSVK

SEQ ID NO: 110483 - protein, 10 aa, Artificial Sequence
  Description of Artificial Sequence: Synthetic peptide
  Seed: SKLSSIIPSA (MAGC3_HUMAN)
SELSSIIPSA

SEQ ID NO: 110484 - protein, 9 aa, Artificial Sequence
  Description of Artificial Sequence: Synthetic peptide
  Seed: YKDYFPMIF (MAGC3_HUMAN)
YSDYFPMIF

SEQ ID NO: 110485 - protein, 11 aa, Artificial Sequence
  Description of Artificial Sequence: Synthetic peptide
  Seed: SSIIPSAFPSW (MAGC3_HUMAN)
SSIIPSAFPSF

SEQ ID NO: 110486 - protein, 9 aa, Artificial Sequence
  Description of Artificial Sequence: Synthetic peptide
  Seed: SASPSVMST (MAGC3_HUMAN)
SISPSVMSV

SEQ ID NO: 110487 - protein, 10 aa, Artificial Sequence
  Description of Artificial Sequence: Synthetic peptide
  Seed: IELIFGIALT (MAGC3_HUMAN)
ICLIFGIALV

SEQ ID NO: 110488 - protein, 9 aa, Artificial Sequence
  Description of Artificial Sequence: Synthetic peptide
  Seed: VDPDHFYVF (MAGC3_HUMAN)
VAPDHFYVF

SEQ ID NO: 110489 - protein, 11 aa, Artificial Sequence
  Description of Artificial Sequence: Synthetic peptide
  Seed: KYKDYFPMIFG (MAGC3_HUMAN)
KYKDYFPMIFL

SEQ ID NO: 110490 - protein, 9 aa, Artificial Sequence
  Description of Artificial Sequence: Synthetic peptide
  Seed: KATDKDYSA (MAGC3_HUMAN)
KSTDKDYSL

SEQ ID NO: 110491 - protein, 9 aa, Artificial Sequence
  Description of Artificial Sequence: Synthetic peptide
  Seed: AMASASPSV (MAGC3_HUMAN)
ATASASPSM

SEQ ID NO: 110492 - protein, 9 aa, Artificial Sequence
  Description of Artificial Sequence: Synthetic peptide
  Seed: LILSVIFIK (MAGC3_HUMAN)
LTLSVIFIK

SEQ ID NO: 110493 - protein, 9 aa, Artificial Sequence
  Description of Artificial Sequence: Synthetic peptide
  Seed: IPPQGPPKI (MAGC3_HUMAN)
IVPQGPPKL

SEQ ID NO: 110494 - protein, 9 aa, Artificial Sequence
  Description of Artificial Sequence: Synthetic peptide
  Seed: FPMIFGKAH (MAGC3_HUMAN)
FPMIFGKAM

SEQ ID NO: 110495 - protein, 10 aa, Artificial Sequence
  Description of Artificial Sequence: Synthetic peptide
  Seed: SAFHLGHLRE (MAGC3_HUMAN)
STFHLGHLRY

SEQ ID NO: 110496 - protein, 9 aa, Artificial Sequence
  Description of Artificial Sequence: Synthetic peptide
  Seed: EVLSAIGPI (MAGC3_HUMAN)
ELLSAIGPK

SEQ ID NO: 110497 - protein, 9 aa, Artificial Sequence
  Description of Artificial Sequence: Synthetic peptide
  Seed: KVDKLVQFL (MAGC3_HUMAN)
KRDKLVQFM

SEQ ID NO: 110498 - protein, 9 aa, Artificial Sequence
  Description of Artificial Sequence: Synthetic peptide
  Seed: YFFEDTLDL (MAGC3_HUMAN)
YSFEDTLDV

SEQ ID NO: 110499 - protein, 10 aa, Artificial Sequence
  Description of Artificial Sequence: Synthetic peptide
  Seed: IGPWSALAGF (MAGC3_HUMAN)
IMPWSALAGW

SEQ ID NO: 110500 - protein, 11 aa, Artificial Sequence
  Description of Artificial Sequence: Synthetic peptide
  Seed: ATAMASASPSV (MAGC3_HUMAN)
ADAMASASPSV

SEQ ID NO: 110501 - protein, 9 aa, Artificial Sequence
  Description of Artificial Sequence: Synthetic peptide
  Seed: NTYTGYFPM (MAGC3_HUMAN)
NSYTGYFPR

SEQ ID NO: 110502 - protein, 9 aa, Artificial Sequence
  Description of Artificial Sequence: Synthetic peptide
  Seed: RPAREVLEF (MAGC3_HUMAN)
RPAREVLEL

SEQ ID NO: 110503 - protein, 11 aa, Artificial Sequence
  Description of Artificial Sequence: Synthetic peptide
  Seed: ALWESEGPEAF (MAGC3_HUMAN)
ALWESEGPEAL

SEQ ID NO: 110504 - protein, 9 aa, Artificial Sequence
  Description of Artificial Sequence: Synthetic peptide
  Seed: MPAAGMPPL (MAGC3_HUMAN)
MTAAGMPPM

SEQ ID NO: 110505 - protein, 9 aa, Artificial Sequence
  Description of Artificial Sequence: Synthetic peptide
  Seed: KKYKDYFPM (MAGC3_HUMAN)
KSYKDYFPY

SEQ ID NO: 110506 - protein, 9 aa, Artificial Sequence
  Description of Artificial Sequence: Synthetic peptide
  Seed: QGMPKNCLL (MAGC3_HUMAN)
QRMPKNCLL

SEQ ID NO: 110507 - protein, 9 aa, Artificial Sequence
  Description of Artificial Sequence: Synthetic peptide
  Seed: HLREVRLFL (MAGC3_HUMAN)
HPREVRLFL

SEQ ID NO: 110508 - protein, 9 aa, Artificial Sequence
  Description of Artificial Sequence: Synthetic peptide
  Seed: DMDPDNHSY (MAGC3_HUMAN)
DYDPDNHSF

SEQ ID NO: 110509 - protein, 9 aa, Artificial Sequence
  Description of Artificial Sequence: Synthetic peptide
  Seed: HFYVFVNTL (MAGC3_HUMAN)
HTYVFVNTF

SEQ ID NO: 110510 - protein, 10 aa, Artificial Sequence
  Description of Artificial Sequence: Synthetic peptide
  Seed: TDDATAMASA (MAGC3_HUMAN)
TEDATAMASA

SEQ ID NO: 110511 - protein, 9 aa, Artificial Sequence
  Description of Artificial Sequence: Synthetic peptide
  Seed: NAIGPWSAL (MAGC3_HUMAN)
NLIGPWSAI

SEQ ID NO: 110512 - protein, 9 aa, Artificial Sequence
  Description of Artificial Sequence: Synthetic peptide
  Seed: GMPKNCLLI (MAGC3_HUMAN)
GAPKNCLLM

SEQ ID NO: 110513 - protein, 10 aa, Artificial Sequence
  Description of Artificial Sequence: Synthetic peptide
  Seed: MQMNVINTYT (MAGC3_HUMAN)
MGMNVINTYF

SEQ ID NO: 110514 - protein, 9 aa, Artificial Sequence
  Description of Artificial Sequence: Synthetic peptide
  Seed: SLPESEPLF (MAGC3_HUMAN)
SSPESEPLL

SEQ ID NO: 110515 - protein, 9 aa, Artificial Sequence
  Description of Artificial Sequence: Synthetic peptide
  Seed: TAMASASPS (MAGC3_HUMAN)
TSMASASPM

SEQ ID NO: 110516 - protein, 10 aa, Artificial Sequence
  Description of Artificial Sequence: Synthetic peptide
  Seed: KVDKLVQFLL (MAGC3_HUMAN)
KMDKLVQFLA

SEQ ID NO: 110517 - protein, 11 aa, Artificial Sequence
  Description of Artificial Sequence: Synthetic peptide
  Seed: SSSEEEDTATW (MAGC3_HUMAN)
SASEEEDTATY

SEQ ID NO: 110518 - protein, 9 aa, Artificial Sequence
  Description of Artificial Sequence: Synthetic peptide
  Seed: YSAFHLGHL (MAGC3_HUMAN)
YQAFHLGHW

SEQ ID NO: 110519 - protein, 9 aa, Artificial Sequence
  Description of Artificial Sequence: Synthetic peptide
  Seed: MEDRAQAII (MAGC3_HUMAN)
MCDRAQAIL

SEQ ID NO: 110520 - protein, 10 aa, Artificial Sequence
  Description of Artificial Sequence: Synthetic peptide
  Seed: TEVDPDHFYV (MAGC3_HUMAN)
TEVDPDHFYI

SEQ ID NO: 110521 - protein, 9 aa, Artificial Sequence
  Description of Artificial Sequence: Synthetic peptide
  Seed: SCVPEEVIW (MAGC3_HUMAN)
SSVPEEVIW

SEQ ID NO: 110522 - protein, 9 aa, Artificial Sequence
  Description of Artificial Sequence: Synthetic peptide
  Seed: SAIGPIQRP (MAGC3_HUMAN)
SSIGPIQRM

SEQ ID NO: 110523 - protein, 11 aa, Artificial Sequence
  Description of Artificial Sequence: Synthetic peptide
  Seed: IIDTTDDATAM (MAGC3_HUMAN)
IADTTDDATAF

SEQ ID NO: 110524 - protein, 10 aa, Artificial Sequence
  Description of Artificial Sequence: Synthetic peptide
  Seed: EVIWEVLSAI (MAGC3_HUMAN)
EYIWEVLSAI

SEQ ID NO: 110525 - protein, 8 aa, Artificial Sequence
  Description of Artificial Sequence: Synthetic peptide
  Seed: KVDKLVQF (MAGC3_HUMAN)
KFDKLVQI

SEQ ID NO: 110526 - protein, 10 aa, Artificial Sequence
  Description of Artificial Sequence: Synthetic peptide
  Seed: KYQAKEPLTR (MAGC3_HUMAN)
KLQAKEPLTR

SEQ ID NO: 110527 - protein, 10 aa, Artificial Sequence
  Description of Artificial Sequence: Synthetic peptide
  Seed: RSAEGSVLDL (MAGC3_HUMAN)
RIAEGSVLDW

SEQ ID NO: 110528 - protein, 8 aa, Artificial Sequence
  Description of Artificial Sequence: Synthetic peptide
  Seed: FADVLSRL (MAGC3_HUMAN)
FWDVLSRI

SEQ ID NO: 110529 - protein, 10 aa, Artificial Sequence
  Description of Artificial Sequence: Synthetic peptide
  Seed: RLWGEKAGSL (MAGC3_HUMAN)
RMWGEKAGSY

SEQ ID NO: 110530 - protein, 10 aa, Artificial Sequence
  Description of Artificial Sequence: Synthetic peptide
  Seed: LLKYQAKEPL (MAGC3_HUMAN)
LSKYQAKEPY

SEQ ID NO: 110531 - protein, 9 aa, Artificial Sequence
  Description of Artificial Sequence: Synthetic peptide
  Seed: AGFADVLSR (MAGC3_HUMAN)
ATFADVLSR

SEQ ID NO: 110532 - protein, 10 aa, Artificial Sequence
  Description of Artificial Sequence: Synthetic peptide
  Seed: LIFGIALTDM (MAGC3_HUMAN)
LLFGIALTDF

SEQ ID NO: 110533 - protein, 9 aa, Artificial Sequence
  Description of Artificial Sequence: Synthetic peptide
  Seed: EVDPDHFYV (MAGC3_HUMAN)
ESDPDHFYL

SEQ ID NO: 110534 - protein, 10 aa, Artificial Sequence
  Description of Artificial Sequence: Synthetic peptide
  Seed: IELIFGIALT (MAGC3_HUMAN)
IHLIFGIALL

SEQ ID NO: 110535 - protein, 9 aa, Artificial Sequence
  Description of Artificial Sequence: Synthetic peptide
  Seed: YQTKEPVTK (MAGC3_HUMAN)
YVTKEPVTY

SEQ ID NO: 110536 - protein, 9 aa, Artificial Sequence
  Description of Artificial Sequence: Synthetic peptide
  Seed: AGFADVLSR (MAGC3_HUMAN)
AAFADVLSH

SEQ ID NO: 110537 - protein, 10 aa, Artificial Sequence
  Description of Artificial Sequence: Synthetic peptide
  Seed: MLTTVIKKYK (MAGC3_HUMAN)
MDTTVIKKYR

SEQ ID NO: 110538 - protein, 10 aa, Artificial Sequence
  Description of Artificial Sequence: Synthetic peptide
  Seed: SLIDDQGMPK (MAGC3_HUMAN)
SVIDDQGMPY

SEQ ID NO: 110539 - protein, 9 aa, Artificial Sequence
  Description of Artificial Sequence: Synthetic peptide
  Seed: IQRPAREVL (MAGC3_HUMAN)
IQRPAREVW

SEQ ID NO: 110540 - protein, 9 aa, Artificial Sequence
  Description of Artificial Sequence: Synthetic peptide
  Seed: KYKDYFPMI (MAGC3_HUMAN)
KAKDYFPMA

SEQ ID NO: 110541 - protein, 9 aa, Artificial Sequence
  Description of Artificial Sequence: Synthetic peptide
  Seed: AIGPWSALA (MAGC3_HUMAN)
AVGPWSALI

SEQ ID NO: 110542 - protein, 10 aa, Artificial Sequence
  Description of Artificial Sequence: Synthetic peptide
  Seed: YSAFHLGHLR (MAGC3_HUMAN)
YFAFHLGHLR

SEQ ID NO: 110543 - protein, 9 aa, Artificial Sequence
  Description of Artificial Sequence: Synthetic peptide
  Seed: EVLEFLSKL (MAGC3_HUMAN)
EMLEFLSKW

SEQ ID NO: 110544 - protein, 10 aa, Artificial Sequence
  Description of Artificial Sequence: Synthetic peptide
  Seed: INTYTGYFPM (MAGC3_HUMAN)
IQTYTGYFPY

SEQ ID NO: 110545 - protein, 9 aa, Artificial Sequence
  Description of Artificial Sequence: Synthetic peptide
  Seed: VLPPQPQPR (MAGC3_HUMAN)
VAPPQPQPH

SEQ ID NO: 110546 - protein, 10 aa, Artificial Sequence
  Description of Artificial Sequence: Synthetic peptide
  Seed: SKLSSIIPSA (MAGC3_HUMAN)
SLLSSIIPST

SEQ ID NO: 110547 - protein, 11 aa, Artificial Sequence
  Description of Artificial Sequence: Synthetic peptide
  Seed: KGNCASEEVIW (MAGC3_HUMAN)
KANCASEEVIW

SEQ ID NO: 110548 - protein, 9 aa, Artificial Sequence
  Description of Artificial Sequence: Synthetic peptide
  Seed: FHLGHLREV (MAGC3_HUMAN)
FYLGHLREF

SEQ ID NO: 110549 - protein, 9 aa, Artificial Sequence
  Description of Artificial Sequence: Synthetic peptide
  Seed: WVKNTCATY (MAGC3_HUMAN)
WPKNTCATY

SEQ ID NO: 110550 - protein, 11 aa, Artificial Sequence
  Description of Artificial Sequence: Synthetic peptide
  Seed: FIELIFGIALT (MAGC3_HUMAN)
FMELIFGIALI

SEQ ID NO: 110551 - protein, 10 aa, Artificial Sequence
  Description of Artificial Sequence: Synthetic peptide
  Seed: TTDDATAMAS (MAGC3_HUMAN)
TVDDATAMAY

SEQ ID NO: 110552 - protein, 10 aa, Artificial Sequence
  Description of Artificial Sequence: Synthetic peptide
  Seed: FKLWRTLSGS (MAGC3_HUMAN)
FHLWRTLSGV

SEQ ID NO: 110553 - protein, 10 aa, Artificial Sequence
  Description of Artificial Sequence: Synthetic peptide
  Seed: TDDATAMASA (MAGC3_HUMAN)
TEDATAMASV

SEQ ID NO: 110554 - protein, 9 aa, Artificial Sequence
  Description of Artificial Sequence: Synthetic peptide
  Seed: KVDKLVQFL (MAGC3_HUMAN)
KIDKLVQFF

SEQ ID NO: 110555 - protein, 9 aa, Artificial Sequence
  Description of Artificial Sequence: Synthetic peptide
  Seed: NPQGLAGHR (MAGC3_HUMAN)
NVQGLAGHR

SEQ ID NO: 110556 - protein, 9 aa, Artificial Sequence
  Description of Artificial Sequence: Synthetic peptide
  Seed: KGSCVPEEV (MAGC3_HUMAN)
KASCVPEEL

SEQ ID NO: 110557 - protein, 9 aa, Artificial Sequence
  Description of Artificial Sequence: Synthetic peptide
  Seed: SCVPEEVIW (MAGC3_HUMAN)
SSVPEEVIF

SEQ ID NO: 110558 - protein, 9 aa, Artificial Sequence
  Description of Artificial Sequence: Synthetic peptide
  Seed: LLILILSMI (MAGC3_HUMAN)
LLILILSMV

SEQ ID NO: 110559 - protein, 10 aa, Artificial Sequence
  Description of Artificial Sequence: Synthetic peptide
  Seed: YALSPVVLPP (MAGC3_HUMAN)
YILSPVVLPL

SEQ ID NO: 110560 - protein, 9 aa, Artificial Sequence
  Description of Artificial Sequence: Synthetic peptide
  Seed: MPAAGMPPL (MAGC3_HUMAN)
MRAAGMPPI

SEQ ID NO: 110561 - protein, 9 aa, Artificial Sequence
  Description of Artificial Sequence: Synthetic peptide
  Seed: SQPEGKFSL (MAGC3_HUMAN)
SMPEGKFSF

SEQ ID NO: 110562 - protein, 9 aa, Artificial Sequence
  Description of Artificial Sequence: Synthetic peptide
  Seed: FSDGSLGQW (MAGC3_HUMAN)
FYDGSLGQV

SEQ ID NO: 110563 - protein, 9 aa, Artificial Sequence
  Description of Artificial Sequence: Synthetic peptide
  Seed: AGFADVLSR (MAGC3_HUMAN)
AVFADVLSR

SEQ ID NO: 110564 - protein, 9 aa, Artificial Sequence
  Description of Artificial Sequence: Synthetic peptide
  Seed: SLRRAVSVK (MAGC3_HUMAN)
STRRAVSVM

SEQ ID NO: 110565 - protein, 9 aa, Artificial Sequence
  Description of Artificial Sequence: Synthetic peptide
  Seed: FSDGSLGQW (MAGC3_HUMAN)
FTDGSLGQM

SEQ ID NO: 110566 - protein, 10 aa, Artificial Sequence
  Description of Artificial Sequence: Synthetic peptide
  Seed: ALDEKVAELV (MAGC3_HUMAN)
AFDEKVAELM

SEQ ID NO: 110567 - protein, 10 aa, Artificial Sequence
  Description of Artificial Sequence: Synthetic peptide
  Seed: EEVIWEVLSA (MAGC3_HUMAN)
ENVIWEVLSV

SEQ ID NO: 110568 - protein, 10 aa, Artificial Sequence
  Description of Artificial Sequence: Synthetic peptide
  Seed: EVIWEVLSAI (MAGC3_HUMAN)
ESIWEVLSAT

SEQ ID NO: 110569 - protein, 9 aa, Artificial Sequence
  Description of Artificial Sequence: Synthetic peptide
  Seed: VIWEVLNAI (MAGC3_HUMAN)
VTWEVLNAI

SEQ ID NO: 110570 - protein, 10 aa, Artificial Sequence
  Description of Artificial Sequence: Synthetic peptide
  Seed: RSAEGSVLDL (MAGC3_HUMAN)
RMAEGSVLDW

SEQ ID NO: 110571 - protein, 10 aa, Artificial Sequence
  Description of Artificial Sequence: Synthetic peptide
  Seed: CASEEVIWEV (MAGC3_HUMAN)
CISEEVIWEI

SEQ ID NO: 110572 - protein, 9 aa, Artificial Sequence
  Description of Artificial Sequence: Synthetic peptide
  Seed: TLDEKVDKL (MAGC3_HUMAN)
TSDEKVDKL

SEQ ID NO: 110573 - protein, 9 aa, Artificial Sequence
  Description of Artificial Sequence: Synthetic peptide
  Seed: LSAIGPIQR (MAGC3_HUMAN)
LTAIGPIQR

SEQ ID NO: 110574 - protein, 9 aa, Artificial Sequence
  Description of Artificial Sequence: Synthetic peptide
  Seed: REVLEFLSK (MAGC3_HUMAN)
REVLEFLSM

SEQ ID NO: 110575 - protein, 9 aa, Artificial Sequence
  Description of Artificial Sequence: Synthetic peptide
  Seed: SAFHLGHLR (MAGC3_HUMAN)
SYFHLGHLY

SEQ ID NO: 110576 - protein, 9 aa, Artificial Sequence
  Description of Artificial Sequence: Synthetic peptide
  Seed: MLTTVIKKY (MAGC3_HUMAN)
MKTTVIKKF

SEQ ID NO: 110577 - protein, 9 aa, Artificial Sequence
  Description of Artificial Sequence: Synthetic peptide
  Seed: GYFPMIFRK (MAGC3_HUMAN)
GAFPMIFRK

SEQ ID NO: 110578 - protein, 10 aa, Artificial Sequence
  Description of Artificial Sequence: Synthetic peptide
  Seed: LVLCPTYFKL (MAGC3_HUMAN)
LFLCPTYFKV

SEQ ID NO: 110579 - protein, 9 aa, Artificial Sequence
  Description of Artificial Sequence: Synthetic peptide
  Seed: WRRGTGYTL (MAGC3_HUMAN)
WQRGTGYTV

SEQ ID NO: 110580 - protein, 9 aa, Artificial Sequence
  Description of Artificial Sequence: Synthetic peptide
  Seed: RGTGYTLSL (MAGC3_HUMAN)
RQTGYTLSY

SEQ ID NO: 110581 - protein, 11 aa, Artificial Sequence
  Description of Artificial Sequence: Synthetic peptide
  Seed: IQRPAREVLEF (MAGC3_HUMAN)
IMRPAREVLEY

SEQ ID NO: 110582 - protein, 9 aa, Artificial Sequence
  Description of Artificial Sequence: Synthetic peptide
  Seed: SALAGFADV (MAGC3_HUMAN)
SALAGFADL

SEQ ID NO: 110583 - protein, 9 aa, Artificial Sequence
  Description of Artificial Sequence: Synthetic peptide
  Seed: EQGMPQNRL (MAGC3_HUMAN)
EHGMPQNRL

SEQ ID NO: 110584 - protein, 9 aa, Artificial Sequence
  Description of Artificial Sequence: Synthetic peptide
  Seed: KVDKLVQFL (MAGC3_HUMAN)
KYDKLVQFI

SEQ ID NO: 110585 - protein, 9 aa, Artificial Sequence
  Description of Artificial Sequence: Synthetic peptide
  Seed: SAFHLGHLR (MAGC3_HUMAN)
SLFHLGHLY

SEQ ID NO: 110586 - protein, 9 aa, Artificial Sequence
  Description of Artificial Sequence: Synthetic peptide
  Seed: ILILSVIFI (MAGC3_HUMAN)
ILILSVIFM

SEQ ID NO: 110587 - protein, 11 aa, Artificial Sequence
  Description of Artificial Sequence: Synthetic peptide
  Seed: RYALDEKVAEL (MAGC3_HUMAN)
RAALDEKVAEV

SEQ ID NO: 110588 - protein, 9 aa, Artificial Sequence
  Description of Artificial Sequence: Synthetic peptide
  Seed: DYFPMIFGK (MAGC3_HUMAN)
DQFPMIFGR

SEQ ID NO: 110589 - protein, 10 aa, Artificial Sequence
  Description of Artificial Sequence: Synthetic peptide
  Seed: YALDEKVAEL (MAGC3_HUMAN)
YVLDEKVAEV

SEQ ID NO: 110590 - protein, 9 aa, Artificial Sequence
  Description of Artificial Sequence: Synthetic peptide
  Seed: LSSIIPSAF (MAGC3_HUMAN)
LMSIIPSAY

SEQ ID NO: 110591 - protein, 10 aa, Artificial Sequence
  Description of Artificial Sequence: Synthetic peptide
  Seed: REVRLFLRGG (MAGC3_HUMAN)
RCVRLFLRGA

SEQ ID NO: 110592 - protein, 9 aa, Artificial Sequence
  Description of Artificial Sequence: Synthetic peptide
  Seed: EIPPQGPPK (MAGC3_HUMAN)
ETPPQGPPR

SEQ ID NO: 110593 - protein, 9 aa, Artificial Sequence
  Description of Artificial Sequence: Synthetic peptide
  Seed: FSDGSLGQW (MAGC3_HUMAN)
FNDGSLGQY

SEQ ID NO: 110594 - protein, 9 aa, Artificial Sequence
  Description of Artificial Sequence: Synthetic peptide
  Seed: MPAAGMPPL (MAGC3_HUMAN)
MQAAGMPPY

SEQ ID NO: 110595 - protein, 9 aa, Artificial Sequence
  Description of Artificial Sequence: Synthetic peptide
  Seed: MASASPSVM (MAGC3_HUMAN)
MESASPSVF

SEQ ID NO: 110596 - protein, 9 aa, Artificial Sequence
  Description of Artificial Sequence: Synthetic peptide
  Seed: SLVLCPTYF (MAGC3_HUMAN)
SIVLCPTYR

SEQ ID NO: 110597 - protein, 11 aa, Artificial Sequence
  Description of Artificial Sequence: Synthetic peptide
  Seed: IIDTTDDATAM (MAGC3_HUMAN)
IGDTTDDATAI

SEQ ID NO: 110598 - protein, 10 aa, Artificial Sequence
  Description of Artificial Sequence: Synthetic peptide
  Seed: LTRAEMQMNV (MAGC3_HUMAN)
LMRAEMQMNA

SEQ ID NO: 110599 - protein, 9 aa, Artificial Sequence
  Description of Artificial Sequence: Synthetic peptide
  Seed: YQTKEPVTK (MAGC3_HUMAN)
YRTKEPVTL

SEQ ID NO: 110600 - protein, 9 aa, Artificial Sequence
  Description of Artificial Sequence: Synthetic peptide
  Seed: SIIPSAFPS (MAGC3_HUMAN)
SLIPSAFPT

SEQ ID NO: 110601 - protein, 9 aa, Artificial Sequence
  Description of Artificial Sequence: Synthetic peptide
  Seed: MIFGKAHEF (MAGC3_HUMAN)
MRFGKAHEY

SEQ ID NO: 110602 - protein, 10 aa, Artificial Sequence
  Description of Artificial Sequence: Synthetic peptide
  Seed: TGYFPMIFRK (MAGC3_HUMAN)
TYYFPMIFRR

SEQ ID NO: 110603 - protein, 10 aa, Artificial Sequence
  Description of Artificial Sequence: Synthetic peptide
  Seed: GEDEDMPAAG (MAGC3_HUMAN)
GEDEDMPAAM

SEQ ID NO: 110604 - protein, 9 aa, Artificial Sequence
  Description of Artificial Sequence: Synthetic peptide
  Seed: KGSCVPEEV (MAGC3_HUMAN)
KMSCVPEEL

SEQ ID NO: 110605 - protein, 9 aa, Artificial Sequence
  Description of Artificial Sequence: Synthetic peptide
  Seed: VLCPTYFKL (MAGC3_HUMAN)
VSCPTYFKI

SEQ ID NO: 110606 - protein, 9 aa, Artificial Sequence
  Description of Artificial Sequence: Synthetic peptide
  Seed: ATYALSPVV (MAGC3_HUMAN)
ASYALSPVM

SEQ ID NO: 110607 - protein, 9 aa, Artificial Sequence
  Description of Artificial Sequence: Synthetic peptide
  Seed: TLDEKVDKL (MAGC3_HUMAN)
TTDEKVDKL

SEQ ID NO: 110608 - protein, 9 aa, Artificial Sequence
  Description of Artificial Sequence: Synthetic peptide
  Seed: FHLGHLREV (MAGC3_HUMAN)
FSLGHLREI

SEQ ID NO: 110609 - protein, 10 aa, Artificial Sequence
  Description of Artificial Sequence: Synthetic peptide
  Seed: MQMNVINTYT (MAGC3_HUMAN)
MVMNVINTYT

SEQ ID NO: 110610 - protein, 10 aa, Artificial Sequence
  Description of Artificial Sequence: Synthetic peptide
  Seed: ALWESEGPEA (MAGC3_HUMAN)
AMWESEGPEL

SEQ ID NO: 110611 - protein, 9 aa, Artificial Sequence
  Description of Artificial Sequence: Synthetic peptide
  Seed: KEPVTKAEM (MAGC3_HUMAN)
KAPVTKAEF

SEQ ID NO: 110612 - protein, 10 aa, Artificial Sequence
  Description of Artificial Sequence: Synthetic peptide
  Seed: MPAAGMPPLP (MAGC3_HUMAN)
MTAAGMPPLY

SEQ ID NO: 110613 - protein, 9 aa, Artificial Sequence
  Description of Artificial Sequence: Synthetic peptide
  Seed: FSLRRAVSV (MAGC3_HUMAN)
FALRRAVSM

SEQ ID NO: 110614 - protein, 9 aa, Artificial Sequence
  Description of Artificial Sequence: Synthetic peptide
  Seed: MASASPSVM (MAGC3_HUMAN)
MFSASPSVM

SEQ ID NO: 110615 - protein, 11 aa, Artificial Sequence
  Description of Artificial Sequence: Synthetic peptide
  Seed: TDMDPDNHSYF (MAGC3_HUMAN)
TTMDPDNHSYW

SEQ ID NO: 110616 - protein, 9 aa, Artificial Sequence
  Description of Artificial Sequence: Synthetic peptide
  Seed: HALPESESL (MAGC3_HUMAN)
HDLPESESF

SEQ ID NO: 110617 - protein, 9 aa, Artificial Sequence
  Description of Artificial Sequence: Synthetic peptide
  Seed: SQPEGKFSL (MAGC3_HUMAN)
SVPEGKFSL

SEQ ID NO: 110618 - protein, 9 aa, Artificial Sequence
  Description of Artificial Sequence: Synthetic peptide
  Seed: LSDEQGMPQ (MAGC3_HUMAN)
LIDEQGMPL

SEQ ID NO: 110619 - protein, 9 aa, Artificial Sequence
  Description of Artificial Sequence: Synthetic peptide
  Seed: VLCPTYFKL (MAGC3_HUMAN)
VVCPTYFKR

SEQ ID NO: 110620 - protein, 9 aa, Artificial Sequence
  Description of Artificial Sequence: Synthetic peptide
  Seed: CATYALSPV (MAGC3_HUMAN)
CTTYALSPI

SEQ ID NO: 110621 - protein, 9 aa, Artificial Sequence
  Description of Artificial Sequence: Synthetic peptide
  Seed: KYKDYFPMI (MAGC3_HUMAN)
KMKDYFPMI

SEQ ID NO: 110622 - protein, 9 aa, Artificial Sequence
  Description of Artificial Sequence: Synthetic peptide
  Seed: YQTKEPVTK (MAGC3_HUMAN)
YTTKEPVTM

SEQ ID NO: 110623 - protein, 10 aa, Artificial Sequence
  Description of Artificial Sequence: Synthetic peptide
  Seed: SALAGFADVL (MAGC3_HUMAN)
SPLAGFADVV

SEQ ID NO: 110624 - protein, 8 aa, Artificial Sequence
  Description of Artificial Sequence: Synthetic peptide
  Seed: TTDDATAM (MAGC3_HUMAN)
TYDDATAI

SEQ ID NO: 110625 - protein, 9 aa, Artificial Sequence
  Description of Artificial Sequence: Synthetic peptide
  Seed: KDSDLPTWR (MAGC3_HUMAN)
KVSDLPTWK

SEQ ID NO: 110626 - protein, 9 aa, Artificial Sequence
  Description of Artificial Sequence: Synthetic peptide
  Seed: KAEMLTTVI (MAGC3_HUMAN)
KAEMLTTVM

SEQ ID NO: 110627 - protein, 11 aa, Artificial Sequence
  Description of Artificial Sequence: Synthetic peptide
  Seed: LTEVDPDHFYV (MAGC3_HUMAN)
LMEVDPDHFYL

SEQ ID NO: 110628 - protein, 9 aa, Artificial Sequence
  Description of Artificial Sequence: Synthetic peptide
  Seed: YFFEDTLDL (MAGC3_HUMAN)
YWFEDTLDM

SEQ ID NO: 110629 - protein, 9 aa, Artificial Sequence
  Description of Artificial Sequence: Synthetic peptide
  Seed: IPPQGPPKI (MAGC3_HUMAN)
IVPQGPPKF

SEQ ID NO: 110630 - protein, 9 aa, Artificial Sequence
  Description of Artificial Sequence: Synthetic peptide
  Seed: TSDQRMDSL (MAGC3_HUMAN)
TEDQRMDSF

SEQ ID NO: 110631 - protein, 9 aa, Artificial Sequence
  Description of Artificial Sequence: Synthetic peptide
  Seed: DYFPMIFGK (MAGC3_HUMAN)
DSFPMIFGR

SEQ ID NO: 110632 - protein, 9 aa, Artificial Sequence
  Description of Artificial Sequence: Synthetic peptide
  Seed: KLWRTLSGS (MAGC3_HUMAN)
KTWRTLSGV

SEQ ID NO: 110633 - protein, 9 aa, Artificial Sequence
  Description of Artificial Sequence: Synthetic peptide
  Seed: TTDDATAMA (MAGC3_HUMAN)
TLDDATAML

SEQ ID NO: 110634 - protein, 10 aa, Artificial Sequence
  Description of Artificial Sequence: Synthetic peptide
  Seed: YSAFHLGHLR (MAGC3_HUMAN)
YTAFHLGHLY

SEQ ID NO: 110635 - protein, 10 aa, Artificial Sequence
  Description of Artificial Sequence: Synthetic peptide
  Seed: MQMNVINTYT (MAGC3_HUMAN)
MGMNVINTYA

SEQ ID NO: 110636 - protein, 11 aa, Artificial Sequence
  Description of Artificial Sequence: Synthetic peptide
  Seed: YFFEDTLDLTY (MAGC3_HUMAN)
YLFEDTLDLTF

SEQ ID NO: 110637 - protein, 9 aa, Artificial Sequence
  Description of Artificial Sequence: Synthetic peptide
  Seed: KVDKLVQFL (MAGC3_HUMAN)
KGDKLVQFM

SEQ ID NO: 110638 - protein, 9 aa, Artificial Sequence
  Description of Artificial Sequence: Synthetic peptide
  Seed: SLVLCPTYF (MAGC3_HUMAN)
SLVLCPTYL

SEQ ID NO: 110639 - protein, 9 aa, Artificial Sequence
  Description of Artificial Sequence: Synthetic peptide
  Seed: DTTDDATAM (MAGC3_HUMAN)
DTTDDATAY

SEQ ID NO: 110640 - protein, 9 aa, Artificial Sequence
  Description of Artificial Sequence: Synthetic peptide
  Seed: MASASPSVM (MAGC3_HUMAN)
MISASPSVL

SEQ ID NO: 110641 - protein, 9 aa, Artificial Sequence
  Description of Artificial Sequence: Synthetic peptide
  Seed: LKYQTKEPV (MAGC3_HUMAN)
LHYQTKEPF

SEQ ID NO: 110642 - protein, 11 aa, Artificial Sequence
  Description of Artificial Sequence: Synthetic peptide
  Seed: FIELIFGIALT (MAGC3_HUMAN)
FWELIFGIALI

SEQ ID NO: 110643 - protein, 10 aa, Artificial Sequence
  Description of Artificial Sequence: Synthetic peptide
  Seed: MDPDNHSYFF (MAGC3_HUMAN)
MWPDNHSYFM

SEQ ID NO: 110644 - protein, 10 aa, Artificial Sequence
  Description of Artificial Sequence: Synthetic peptide
  Seed: EVIWEVLNAI (MAGC3_HUMAN)
EMIWEVLNAR

SEQ ID NO: 110645 - protein, 9 aa, Artificial Sequence
  Description of Artificial Sequence: Synthetic peptide
  Seed: AMASASPSV (MAGC3_HUMAN)
ATASASPSF

SEQ ID NO: 110646 - protein, 10 aa, Artificial Sequence
  Description of Artificial Sequence: Synthetic peptide
  Seed: TTDDATAMAS (MAGC3_HUMAN)
TCDDATAMAI

SEQ ID NO: 110647 - protein, 9 aa, Artificial Sequence
  Description of Artificial Sequence: Synthetic peptide
  Seed: ALDEKVAEL (MAGC3_HUMAN)
ARDEKVAEF

SEQ ID NO: 110648 - protein, 10 aa, Artificial Sequence
  Description of Artificial Sequence: Synthetic peptide
  Seed: TGYFPMIFRK (MAGC3_HUMAN)
TTYFPMIFRC

SEQ ID NO: 110649 - protein, 9 aa, Artificial Sequence
  Description of Artificial Sequence: Synthetic peptide
  Seed: SLVLCPTYF (MAGC3_HUMAN)
SIVLCPTYY

SEQ ID NO: 110650 - protein, 10 aa, Artificial Sequence
  Description of Artificial Sequence: Synthetic peptide
  Seed: EEVIWEVLSA (MAGC3_HUMAN)
EHVIWEVLSV

SEQ ID NO: 110651 - protein, 9 aa, Artificial Sequence
  Description of Artificial Sequence: Synthetic peptide
  Seed: FADVLSRLA (MAGC3_HUMAN)
FLDVLSRLM

SEQ ID NO: 110652 - protein, 10 aa, Artificial Sequence
  Description of Artificial Sequence: Synthetic peptide
  Seed: SAFHLGHLRE (MAGC3_HUMAN)
SAFHLGHLRK

SEQ ID NO: 110653 - protein, 10 aa, Artificial Sequence
  Description of Artificial Sequence: Synthetic peptide
  Seed: KKYKDYFPMI (MAGC3_HUMAN)
KSYKDYFPMW

SEQ ID NO: 110654 - protein, 9 aa, Artificial Sequence
  Description of Artificial Sequence: Synthetic peptide
  Seed: ISPQGPPQS (MAGC3_HUMAN)
IAPQGPPQI

SEQ ID NO: 110655 - protein, 9 aa, Artificial Sequence
  Description of Artificial Sequence: Synthetic peptide
  Seed: LSGSPGLQL (MAGC3_HUMAN)
LQGSPGLQF

SEQ ID NO: 110656 - protein, 11 aa, Artificial Sequence
  Description of Artificial Sequence: Synthetic peptide
  Seed: LSDEQGMPQNR (MAGC3_HUMAN)
LSDEQGMPQNY

SEQ ID NO: 110657 - protein, 9 aa, Artificial Sequence
  Description of Artificial Sequence: Synthetic peptide
  Seed: SQPEGKFSL (MAGC3_HUMAN)
SYPEGKFSM

SEQ ID NO: 110658 - protein, 9 aa, Artificial Sequence
  Description of Artificial Sequence: Synthetic peptide
  Seed: VIWEVLSAI (MAGC3_HUMAN)
VAWEVLSAL

SEQ ID NO: 110659 - protein, 9 aa, Artificial Sequence
  Description of Artificial Sequence: Synthetic peptide
  Seed: KVDKLVQFL (MAGC3_HUMAN)
KWDKLVQFF

SEQ ID NO: 110660 - protein, 11 aa, Artificial Sequence
  Description of Artificial Sequence: Synthetic peptide
  Seed: SKLSSIIPSAF (MAGC3_HUMAN)
SQLSSIIPSAF

SEQ ID NO: 110661 - protein, 10 aa, Artificial Sequence
  Description of Artificial Sequence: Synthetic peptide
  Seed: MDSLVLCPTY (MAGC3_HUMAN)
MMSLVLCPTM

SEQ ID NO: 110662 - protein, 9 aa, Artificial Sequence
  Description of Artificial Sequence: Synthetic peptide
  Seed: EFIELIFGI (MAGC3_HUMAN)
EIIELIFGL

SEQ ID NO: 110663 - protein, 9 aa, Artificial Sequence
  Description of Artificial Sequence: Synthetic peptide
  Seed: LVLCPTYFK (MAGC3_HUMAN)
LLLCPTYFK

SEQ ID NO: 110664 - protein, 10 aa, Artificial Sequence
  Description of Artificial Sequence: Synthetic peptide
  Seed: SYFFEDTLDL (MAGC3_HUMAN)
SYFFEDTLDF

SEQ ID NO: 110665 - protein, 11 aa, Artificial Sequence
  Description of Artificial Sequence: Synthetic peptide
  Seed: YFFEDTLDLTY (MAGC3_HUMAN)
YPFEDTLDLTY

SEQ ID NO: 110666 - protein, 10 aa, Artificial Sequence
  Description of Artificial Sequence: Synthetic peptide
  Seed: TEVDPDHFYV (MAGC3_HUMAN)
TIVDPDHFYV

SEQ ID NO: 110667 - protein, 9 aa, Artificial Sequence
  Description of Artificial Sequence: Synthetic peptide
  Seed: YFFEDTLDL (MAGC3_HUMAN)
YYFEDTLDY

SEQ ID NO: 110668 - protein, 10 aa, Artificial Sequence
  Description of Artificial Sequence: Synthetic peptide
  Seed: KAHEFIELIF (MAGC3_HUMAN)
KSHEFIELIF

SEQ ID NO: 110669 - protein, 9 aa, Artificial Sequence
  Description of Artificial Sequence: Synthetic peptide
  Seed: NAIGPWSAL (MAGC3_HUMAN)
NFIGPWSAM

SEQ ID NO: 110670 - protein, 10 aa, Artificial Sequence
  Description of Artificial Sequence: Synthetic peptide
  Seed: SPLDSCSSPL (MAGC3_HUMAN)
SDLDSCSSPV

SEQ ID NO: 110671 - protein, 9 aa, Artificial Sequence
  Description of Artificial Sequence: Synthetic peptide
  Seed: KDSDLPTWR (MAGC3_HUMAN)
KVSDLPTWR

SEQ ID NO: 110672 - protein, 10 aa, Artificial Sequence
  Description of Artificial Sequence: Synthetic peptide
  Seed: REVRLFLRGG (MAGC3_HUMAN)
RSVRLFLRGM

SEQ ID NO: 110673 - protein, 9 aa, Artificial Sequence
  Description of Artificial Sequence: Synthetic peptide
  Seed: TLDEKVDKL (MAGC3_HUMAN)
TYDEKVDKA

SEQ ID NO: 110674 - protein, 9 aa, Artificial Sequence
  Description of Artificial Sequence: Synthetic peptide
  Seed: ALDEKVAEL (MAGC3_HUMAN)
AIDEKVAEA

SEQ ID NO: 110675 - protein, 9 aa, Artificial Sequence
  Description of Artificial Sequence: Synthetic peptide
  Seed: IPSAFPSWY (MAGC3_HUMAN)
IPSAFPSWM

SEQ ID NO: 110676 - protein, 10 aa, Artificial Sequence
  Description of Artificial Sequence: Synthetic peptide
  Seed: TLDEKVDKLV (MAGC3_HUMAN)
TYDEKVDKLL

SEQ ID NO: 110677 - protein, 11 aa, Artificial Sequence
  Description of Artificial Sequence: Synthetic peptide
  Seed: FIELIFGIALT (MAGC3_HUMAN)
FIELIFGIALL

SEQ ID NO: 110678 - protein, 9 aa, Artificial Sequence
  Description of Artificial Sequence: Synthetic peptide
  Seed: LTEVDPDHF (MAGC3_HUMAN)
LAEVDPDHL

SEQ ID NO: 110679 - protein, 10 aa, Artificial Sequence
  Description of Artificial Sequence: Synthetic peptide
  Seed: MNVINTYTGY (MAGC3_HUMAN)
MDVINTYTGF

SEQ ID NO: 110680 - protein, 11 aa, Artificial Sequence
  Description of Artificial Sequence: Synthetic peptide
  Seed: AEMQMNVINTY (MAGC3_HUMAN)
ANMQMNVINTF

SEQ ID NO: 110681 - protein, 9 aa, Artificial Sequence
  Description of Artificial Sequence: Synthetic peptide
  Seed: EVDPDHFYV (MAGC3_HUMAN)
EADPDHFYF

SEQ ID NO: 110682 - protein, 10 aa, Artificial Sequence
  Description of Artificial Sequence: Synthetic peptide
  Seed: EKVAELVQFL (MAGC3_HUMAN)
EQVAELVQFL

SEQ ID NO: 110683 - protein, 9 aa, Artificial Sequence
  Description of Artificial Sequence: Synthetic peptide
  Seed: EVIWEVLSA (MAGC3_HUMAN)
EIIWEVLSI

SEQ ID NO: 110684 - protein, 10 aa, Artificial Sequence
  Description of Artificial Sequence: Synthetic peptide
  Seed: MPAAGMPPLP (MAGC3_HUMAN)
MMAAGMPPLY

SEQ ID NO: 110685 - protein, 9 aa, Artificial Sequence
  Description of Artificial Sequence: Synthetic peptide
  Seed: WEVLNAIGP (MAGC3_HUMAN)
WEVLNAIGI

SEQ ID NO: 110686 - protein, 9 aa, Artificial Sequence
  Description of Artificial Sequence: Synthetic peptide
  Seed: GPWSALAGF (MAGC3_HUMAN)
GPWSALAGY

SEQ ID NO: 110687 - protein, 9 aa, Artificial Sequence
  Description of Artificial Sequence: Synthetic peptide
  Seed: LVQFLLLKY (MAGC3_HUMAN)
LIQFLLLKY

SEQ ID NO: 110688 - protein, 10 aa, Artificial Sequence
  Description of Artificial Sequence: Synthetic peptide
  Seed: LTRAEMQMNV (MAGC3_HUMAN)
LMRAEMQMNV

SEQ ID NO: 110689 - protein, 11 aa, Artificial Sequence
  Description of Artificial Sequence: Synthetic peptide
  Seed: VLDATFSDGSL (MAGC3_HUMAN)
VADATFSDGSL

SEQ ID NO: 110690 - protein, 9 aa, Artificial Sequence
  Description of Artificial Sequence: Synthetic peptide
  Seed: ELIFGIALT (MAGC3_HUMAN)
ELIFGIALV

SEQ ID NO: 110691 - protein, 10 aa, Artificial Sequence
  Description of Artificial Sequence: Synthetic peptide
  Seed: LDSCSSPLLW (MAGC3_HUMAN)
LLSCSSPLLW

SEQ ID NO: 110692 - protein, 9 aa, Artificial Sequence
  Description of Artificial Sequence: Synthetic peptide
  Seed: VLPPQPQPR (MAGC3_HUMAN)
VMPPQPQPR

SEQ ID NO: 110693 - protein, 10 aa, Artificial Sequence
  Description of Artificial Sequence: Synthetic peptide
  Seed: CVPEEVIWEV (MAGC3_HUMAN)
CLPEEVIWEV

SEQ ID NO: 110694 - protein, 9 aa, Artificial Sequence
  Description of Artificial Sequence: Synthetic peptide
  Seed: DEQGMPQNR (MAGC3_HUMAN)
DLQGMPQNR

SEQ ID NO: 110695 - protein, 10 aa, Artificial Sequence
  Description of Artificial Sequence: Synthetic peptide
  Seed: IKKYKDYFPM (MAGC3_HUMAN)
ILKYKDYFPY

SEQ ID NO: 110696 - protein, 9 aa, Artificial Sequence
  Description of Artificial Sequence: Synthetic peptide
  Seed: IELIFGIAL (MAGC3_HUMAN)
IRLIFGIAY

SEQ ID NO: 110697 - protein, 9 aa, Artificial Sequence
  Description of Artificial Sequence: Synthetic peptide
  Seed: ATDKDYSAF (MAGC3_HUMAN)
AQDKDYSAF

SEQ ID NO: 110698 - protein, 9 aa, Artificial Sequence
  Description of Artificial Sequence: Synthetic peptide
  Seed: FPMIFGKAH (MAGC3_HUMAN)
FPMIFGKAS

SEQ ID NO: 110699 - protein, 9 aa, Artificial Sequence
  Description of Artificial Sequence: Synthetic peptide
  Seed: MQMNVINTY (MAGC3_HUMAN)
MFMNVINTI

SEQ ID NO: 110700 - protein, 10 aa, Artificial Sequence
  Description of Artificial Sequence: Synthetic peptide
  Seed: IIDTTDDATA (MAGC3_HUMAN)
IIDTTDDATM

SEQ ID NO: 110701 - protein, 9 aa, Artificial Sequence
  Description of Artificial Sequence: Synthetic peptide
  Seed: SAIGPIQRP (MAGC3_HUMAN)
SAIGPIQRV

SEQ ID NO: 110702 - protein, 9 aa, Artificial Sequence
  Description of Artificial Sequence: Synthetic peptide
  Seed: SASPSVMST (MAGC3_HUMAN)
SISPSVMSF

SEQ ID NO: 110703 - protein, 10 aa, Artificial Sequence
  Description of Artificial Sequence: Synthetic peptide
  Seed: AMASASPSVM (MAGC3_HUMAN)
AIASASPSVV

SEQ ID NO: 110704 - protein, 9 aa, Artificial Sequence
  Description of Artificial Sequence: Synthetic peptide
  Seed: CLLILILSM (MAGC3_HUMAN)
CMLILILSV

SEQ ID NO: 110705 - protein, 9 aa, Artificial Sequence
  Description of Artificial Sequence: Synthetic peptide
  Seed: KFSLRRAVS (MAGC3_HUMAN)
KISLRRAVK

SEQ ID NO: 110706 - protein, 10 aa, Artificial Sequence
  Description of Artificial Sequence: Synthetic peptide
  Seed: NAIGPWSALA (MAGC3_HUMAN)
NTIGPWSALM

SEQ ID NO: 110707 - protein, 9 aa, Artificial Sequence
  Description of Artificial Sequence: Synthetic peptide
  Seed: VAELVQFLL (MAGC3_HUMAN)
VTELVQFLW

SEQ ID NO: 110708 - protein, 9 aa, Artificial Sequence
  Description of Artificial Sequence: Synthetic peptide
  Seed: RTLSGSPGL (MAGC3_HUMAN)
RTLSGSPGW

SEQ ID NO: 110709 - protein, 10 aa, Artificial Sequence
  Description of Artificial Sequence: Synthetic peptide
  Seed: SCSSPLLWTR (MAGC3_HUMAN)
SKSSPLLWTK

SEQ ID NO: 110710 - protein, 11 aa, Artificial Sequence
  Description of Artificial Sequence: Synthetic peptide
  Seed: FIKGNCASEEV (MAGC3_HUMAN)
FMKGNCASEEL

SEQ ID NO: 110711 - protein, 9 aa, Artificial Sequence
  Description of Artificial Sequence: Synthetic peptide
  Seed: MPPLPQSPP (MAGC3_HUMAN)
MPPLPQSPI

SEQ ID NO: 110712 - protein, 10 aa, Artificial Sequence
  Description of Artificial Sequence: Synthetic peptide
  Seed: ILFGISLTEV (MAGC3_HUMAN)
IMFGISLTER

SEQ ID NO: 110713 - protein, 10 aa, Artificial Sequence
  Description of Artificial Sequence: Synthetic peptide
  Seed: VTKAEMLTTV (MAGC3_HUMAN)
VQKAEMLTTV

SEQ ID NO: 110714 - protein, 10 aa, Artificial Sequence
  Description of Artificial Sequence: Synthetic peptide
  Seed: KAHEFIELIF (MAGC3_HUMAN)
KSHEFIELIY

SEQ ID NO: 110715 - protein, 11 aa, Artificial Sequence
  Description of Artificial Sequence: Synthetic peptide
  Seed: FIELIFGIALT (MAGC3_HUMAN)
FYELIFGIALV

SEQ ID NO: 110716 - protein, 10 aa, Artificial Sequence
  Description of Artificial Sequence: Synthetic peptide
  Seed: TDMDPDNHSY (MAGC3_HUMAN)
TWMDPDNHSY

SEQ ID NO: 110717 - protein, 10 aa, Artificial Sequence
  Description of Artificial Sequence: Synthetic peptide
  Seed: FSDGSLGQWV (MAGC3_HUMAN)
FLDGSLGQWI

SEQ ID NO: 110718 - protein, 9 aa, Artificial Sequence
  Description of Artificial Sequence: Synthetic peptide
  Seed: MQMNVINTY (MAGC3_HUMAN)
MCMNVINTM

SEQ ID NO: 110719 - protein, 9 aa, Artificial Sequence
  Description of Artificial Sequence: Synthetic peptide
  Seed: IELIFGIAL (MAGC3_HUMAN)
IKLIFGIAL

SEQ ID NO: 110720 - protein, 9 aa, Artificial Sequence
  Description of Artificial Sequence: Synthetic peptide
  Seed: DMDPDNHSY (MAGC3_HUMAN)
DIDPDNHSL

SEQ ID NO: 110721 - protein, 11 aa, Artificial Sequence
  Description of Artificial Sequence: Synthetic peptide
  Seed: KFSLRRAVSVK (MAGC3_HUMAN)
KYSLRRAVSVK

SEQ ID NO: 110722 - protein, 9 aa, Artificial Sequence
  Description of Artificial Sequence: Synthetic peptide
  Seed: HALPESESL (MAGC3_HUMAN)
HPLPESESV

SEQ ID NO: 110723 - protein, 10 aa, Artificial Sequence
  Description of Artificial Sequence: Synthetic peptide
  Seed: AEMLTTVIKK (MAGC3_HUMAN)
ACMLTTVIKK

SEQ ID NO: 110724 - protein, 9 aa, Artificial Sequence
  Description of Artificial Sequence: Synthetic peptide
  Seed: IFGKAHEFI (MAGC3_HUMAN)
IYGKAHEFL

SEQ ID NO: 110725 - protein, 9 aa, Artificial Sequence
  Description of Artificial Sequence: Synthetic peptide
  Seed: KAHEFIELI (MAGC3_HUMAN)
KSHEFIELM

SEQ ID NO: 110726 - protein, 11 aa, Artificial Sequence
  Description of Artificial Sequence: Synthetic peptide
  Seed: KVAELVQFLLL (MAGC3_HUMAN)
KAAELVQFLLW

SEQ ID NO: 110727 - protein, 10 aa, Artificial Sequence
  Description of Artificial Sequence: Synthetic peptide
  Seed: LWKDSDLPTW (MAGC3_HUMAN)
LVKDSDLPTW

SEQ ID NO: 110728 - protein, 11 aa, Artificial Sequence
  Description of Artificial Sequence: Synthetic peptide
  Seed: SSSEEEDTATW (MAGC3_HUMAN)
SLSEEEDTATI

SEQ ID NO: 110729 - protein, 9 aa, Artificial Sequence
  Description of Artificial Sequence: Synthetic peptide
  Seed: WESEGPEAF (MAGC3_HUMAN)
WMSEGPEAM

SEQ ID NO: 110730 - protein, 10 aa, Artificial Sequence
  Description of Artificial Sequence: Synthetic peptide
  Seed: TYFKLWRTLS (MAGC3_HUMAN)
TYFKLWRTLF

SEQ ID NO: 110731 - protein, 10 aa, Artificial Sequence
  Description of Artificial Sequence: Synthetic peptide
  Seed: REVLEFLSKL (MAGC3_HUMAN)
RFVLEFLSKI

SEQ ID NO: 110732 - protein, 9 aa, Artificial Sequence
  Description of Artificial Sequence: Synthetic peptide
  Seed: AMASASPSV (MAGC3_HUMAN)
AVASASPSR

SEQ ID NO: 110733 - protein, 10 aa, Artificial Sequence
  Description of Artificial Sequence: Synthetic peptide
  Seed: KVAELVQFLL (MAGC3_HUMAN)
KIAELVQFLK

SEQ ID NO: 110734 - protein, 10 aa, Artificial Sequence
  Description of Artificial Sequence: Synthetic peptide
  Seed: EVLSAIGPIQ (MAGC3_HUMAN)
EILSAIGPIK

SEQ ID NO: 110735 - protein, 10 aa, Artificial Sequence
  Description of Artificial Sequence: Synthetic peptide
  Seed: EVIWEVLNAI (MAGC3_HUMAN)
EYIWEVLNAI

SEQ ID NO: 110736 - protein, 9 aa, Artificial Sequence
  Description of Artificial Sequence: Synthetic peptide
  Seed: NTYTGYFPM (MAGC3_HUMAN)
NPYTGYFPW

SEQ ID NO: 110737 - protein, 10 aa, Artificial Sequence
  Description of Artificial Sequence: Synthetic peptide
  Seed: YTLDEKVDKL (MAGC3_HUMAN)
YMLDEKVDKL

SEQ ID NO: 110738 - protein, 10 aa, Artificial Sequence
  Description of Artificial Sequence: Synthetic peptide
  Seed: EKVAELVQFL (MAGC3_HUMAN)
EMVAELVQFV

SEQ ID NO: 110739 - protein, 8 aa, Artificial Sequence
  Description of Artificial Sequence: Synthetic peptide
  Seed: FIELIFGI (MAGC3_HUMAN)
FMELIFGI

SEQ ID NO: 110740 - protein, 10 aa, Artificial Sequence
  Description of Artificial Sequence: Synthetic peptide
  Seed: RMDSLVLCPT (MAGC3_HUMAN)
RMDSLVLCPL

SEQ ID NO: 110741 - protein, 9 aa, Artificial Sequence
  Description of Artificial Sequence: Synthetic peptide
  Seed: LKYQTKEPV (MAGC3_HUMAN)
LHYQTKEPM

SEQ ID NO: 110742 - protein, 9 aa, Artificial Sequence
  Description of Artificial Sequence: Synthetic peptide
  Seed: ALSPVVLPP (MAGC3_HUMAN)
AISPVVLPL

SEQ ID NO: 110743 - protein, 11 aa, Artificial Sequence
  Description of Artificial Sequence: Synthetic peptide
  Seed: GEDEDMPAAGM (MAGC3_HUMAN)
GEDEDMPAAGW

SEQ ID NO: 110744 - protein, 9 aa, Artificial Sequence
  Description of Artificial Sequence: Synthetic peptide
  Seed: FVNTLDLTC (MAGC3_HUMAN)
FSNTLDLTI

SEQ ID NO: 110745 - protein, 9 aa, Artificial Sequence
  Description of Artificial Sequence: Synthetic peptide
  Seed: FEDTLDLTY (MAGC3_HUMAN)
FYDTLDLTF

SEQ ID NO: 110746 - protein, 8 aa, Artificial Sequence
  Description of Artificial Sequence: Synthetic peptide
  Seed: LDEKVAEL (MAGC3_HUMAN)
LYEKVAEL

SEQ ID NO: 110747 - protein, 9 aa, Artificial Sequence
  Description of Artificial Sequence: Synthetic peptide
  Seed: MEDRAQAII (MAGC3_HUMAN)
MSDRAQAII

SEQ ID NO: 110748 - protein, 9 aa, Artificial Sequence
  Description of Artificial Sequence: Synthetic peptide
  Seed: AIIDTTDDA (MAGC3_HUMAN)
AMIDTTDDV

SEQ ID NO: 110749 - protein, 10 aa, Artificial Sequence
  Description of Artificial Sequence: Synthetic peptide
  Seed: MQMNVINTYT (MAGC3_HUMAN)
MMMNVINTYM

SEQ ID NO: 110750 - protein, 9 aa, Artificial Sequence
  Description of Artificial Sequence: Synthetic peptide
  Seed: NVINTYTGY (MAGC3_HUMAN)
NTINTYTGK

SEQ ID NO: 110751 - protein, 11 aa, Artificial Sequence
  Description of Artificial Sequence: Synthetic peptide
  Seed: YALDEKVAELV (MAGC3_HUMAN)
YMLDEKVAELC

SEQ ID NO: 110752 - protein, 10 aa, Artificial Sequence
  Description of Artificial Sequence: Synthetic peptide
  Seed: AEMLTTVIKK (MAGC3_HUMAN)
AWMLTTVIKK

SEQ ID NO: 110753 - protein, 10 aa, Artificial Sequence
  Description of Artificial Sequence: Synthetic peptide
  Seed: QFLLLKYQAK (MAGC3_HUMAN)
QMLLLKYQAR

SEQ ID NO: 110754 - protein, 9 aa, Artificial Sequence
  Description of Artificial Sequence: Synthetic peptide
  Seed: FADVLSRLA (MAGC3_HUMAN)
FCDVLSRLL

SEQ ID NO: 110755 - protein, 10 aa, Artificial Sequence
  Description of Artificial Sequence: Synthetic peptide
  Seed: QWVKNTCATY (MAGC3_HUMAN)
QVVKNTCATY

SEQ ID NO: 110756 - protein, 10 aa, Artificial Sequence
  Description of Artificial Sequence: Synthetic peptide
  Seed: EVIWEVLNAI (MAGC3_HUMAN)
EIIWEVLNAA

SEQ ID NO: 110757 - protein, 10 aa, Artificial Sequence
  Description of Artificial Sequence: Synthetic peptide
  Seed: FKLWRTLSGS (MAGC3_HUMAN)
FMLWRTLSGT

SEQ ID NO: 110758 - protein, 10 aa, Artificial Sequence
  Description of Artificial Sequence: Synthetic peptide
  Seed: ALAGFADVLS (MAGC3_HUMAN)
AMAGFADVLM

SEQ ID NO: 110759 - protein, 10 aa, Artificial Sequence
  Description of Artificial Sequence: Synthetic peptide
  Seed: SWYMDALKDM (MAGC3_HUMAN)
SFYMDALKDM

SEQ ID NO: 110760 - protein, 10 aa, Artificial Sequence
  Description of Artificial Sequence: Synthetic peptide
  Seed: MIFRKAREFI (MAGC3_HUMAN)
MGFRKAREFK

SEQ ID NO: 110761 - protein, 9 aa, Artificial Sequence
  Description of Artificial Sequence: Synthetic peptide
  Seed: ADVLSRLAL (MAGC3_HUMAN)
AEVLSRLAV

SEQ ID NO: 110762 - protein, 9 aa, Artificial Sequence
  Description of Artificial Sequence: Synthetic peptide
  Seed: QTKEPVTKA (MAGC3_HUMAN)
QPKEPVTKA

SEQ ID NO: 110763 - protein, 9 aa, Artificial Sequence
  Description of Artificial Sequence: Synthetic peptide
  Seed: FPSWYMDAL (MAGC3_HUMAN)
FPSWYMDAV

SEQ ID NO: 110764 - protein, 9 aa, Artificial Sequence
  Description of Artificial Sequence: Synthetic peptide
  Seed: QGMPKNCLL (MAGC3_HUMAN)
QTMPKNCLW

SEQ ID NO: 110765 - protein, 10 aa, Artificial Sequence
  Description of Artificial Sequence: Synthetic peptide
  Seed: ALDEKVAELV (MAGC3_HUMAN)
ALDEKVAELM

SEQ ID NO: 110766 - protein, 10 aa, Artificial Sequence
  Description of Artificial Sequence: Synthetic peptide
  Seed: VLSAIGPIQR (MAGC3_HUMAN)
VFSAIGPIQR

SEQ ID NO: 110767 - protein, 9 aa, Artificial Sequence
  Description of Artificial Sequence: Synthetic peptide
  Seed: MPPLPQSPP (MAGC3_HUMAN)
MPPLPQSPF

SEQ ID NO: 110768 - protein, 9 aa, Artificial Sequence
  Description of Artificial Sequence: Synthetic peptide
  Seed: HLREVRLFL (MAGC3_HUMAN)
HAREVRLFV

SEQ ID NO: 110769 - protein, 9 aa, Artificial Sequence
  Description of Artificial Sequence: Synthetic peptide
  Seed: EKVDKLVQF (MAGC3_HUMAN)
EYVDKLVQY

SEQ ID NO: 110770 - protein, 10 aa, Artificial Sequence
  Description of Artificial Sequence: Synthetic peptide
  Seed: LPCHWVLDAT (MAGC3_HUMAN)
LPCHWVLDAA

SEQ ID NO: 110771 - protein, 9 aa, Artificial Sequence
  Description of Artificial Sequence: Synthetic peptide
  Seed: HLREVRLFL (MAGC3_HUMAN)
HIREVRLFI

SEQ ID NO: 110772 - protein, 9 aa, Artificial Sequence
  Description of Artificial Sequence: Synthetic peptide
  Seed: ASEEVIWEV (MAGC3_HUMAN)
AIEEVIWEV

SEQ ID NO: 110773 - protein, 9 aa, Artificial Sequence
  Description of Artificial Sequence: Synthetic peptide
  Seed: ASEEVIWEV (MAGC3_HUMAN)
ALEEVIWET

SEQ ID NO: 110774 - protein, 9 aa, Artificial Sequence
  Description of Artificial Sequence: Synthetic peptide
  Seed: FSLRRAVSV (MAGC3_HUMAN)
FCLRRAVSL

SEQ ID NO: 110775 - protein, 9 aa, Artificial Sequence
  Description of Artificial Sequence: Synthetic peptide
  Seed: MLLPCHWVL (MAGC3_HUMAN)
MPLPCHWVF

SEQ ID NO: 110776 - protein, 10 aa, Artificial Sequence
  Description of Artificial Sequence: Synthetic peptide
  Seed: RRGTGYTLSL (MAGC3_HUMAN)
RRGTGYTLSY

SEQ ID NO: 110777 - protein, 9 aa, Artificial Sequence
  Description of Artificial Sequence: Synthetic peptide
  Seed: YTGYFPMIF (MAGC3_HUMAN)
YQGYFPMIY

SEQ ID NO: 110778 - protein, 11 aa, Artificial Sequence
  Description of Artificial Sequence: Synthetic peptide
  Seed: RTLSGSPGLQL (MAGC3_HUMAN)
RQLSGSPGLQY

SEQ ID NO: 110779 - protein, 10 aa, Artificial Sequence
  Description of Artificial Sequence: Synthetic peptide
  Seed: TAMASASPSV (MAGC3_HUMAN)
TDMASASPSL

SEQ ID NO: 110780 - protein, 10 aa, Artificial Sequence
  Description of Artificial Sequence: Synthetic peptide
  Seed: SKLSSIIPSA (MAGC3_HUMAN)
SYLSSIIPSV

SEQ ID NO: 110781 - protein, 9 aa, Artificial Sequence
  Description of Artificial Sequence: Synthetic peptide
  Seed: HFYVFVNTL (MAGC3_HUMAN)
HRYVFVNTM

SEQ ID NO: 110782 - protein, 10 aa, Artificial Sequence
  Description of Artificial Sequence: Synthetic peptide
  Seed: SQPEGKFSLR (MAGC3_HUMAN)
SIPEGKFSLK

SEQ ID NO: 110783 - protein, 9 aa, Artificial Sequence
  Description of Artificial Sequence: Synthetic peptide
  Seed: MDPDNHSYF (MAGC3_HUMAN)
MYPDNHSYM

SEQ ID NO: 110784 - protein, 9 aa, Artificial Sequence
  Description of Artificial Sequence: Synthetic peptide
  Seed: TKAEMLTTV (MAGC3_HUMAN)
THAEMLTTP

SEQ ID NO: 110785 - protein, 10 aa, Artificial Sequence
  Description of Artificial Sequence: Synthetic peptide
  Seed: FPSWYMDALK (MAGC3_HUMAN)
FASWYMDALY

SEQ ID NO: 110786 - protein, 9 aa, Artificial Sequence
  Description of Artificial Sequence: Synthetic peptide
  Seed: YFFEDTLDL (MAGC3_HUMAN)
YFFEDTLDI

SEQ ID NO: 110787 - protein, 9 aa, Artificial Sequence
  Description of Artificial Sequence: Synthetic peptide
  Seed: AEGSVLDLA (MAGC3_HUMAN)
AEGSVLDLL

SEQ ID NO: 110788 - protein, 10 aa, Artificial Sequence
  Description of Artificial Sequence: Synthetic peptide
  Seed: MQMNVINTYT (MAGC3_HUMAN)
MKMNVINTYG

SEQ ID NO: 110789 - protein, 9 aa, Artificial Sequence
  Description of Artificial Sequence: Synthetic peptide
  Seed: SCVPEEVIW (MAGC3_HUMAN)
SIVPEEVIW

SEQ ID NO: 110790 - protein, 9 aa, Artificial Sequence
  Description of Artificial Sequence: Synthetic peptide
  Seed: VPEEVIWEV (MAGC3_HUMAN)
VMEEVIWEL

SEQ ID NO: 110791 - protein, 9 aa, Artificial Sequence
  Description of Artificial Sequence: Synthetic peptide
  Seed: FSLRRAVSV (MAGC3_HUMAN)
FTLRRAVSL

SEQ ID NO: 110792 - protein, 9 aa, Artificial Sequence
  Description of Artificial Sequence: Synthetic peptide
  Seed: SALAGFADV (MAGC3_HUMAN)
SQLAGFADI

SEQ ID NO: 110793 - protein, 10 aa, Artificial Sequence
  Description of Artificial Sequence: Synthetic peptide
  Seed: YTLDEKVDKL (MAGC3_HUMAN)
YILDEKVDKI

SEQ ID NO: 110794 - protein, 10 aa, Artificial Sequence
  Description of Artificial Sequence: Synthetic peptide
  Seed: EKVAELVQFL (MAGC3_HUMAN)
EGVAELVQFY

SEQ ID NO: 110795 - protein, 10 aa, Artificial Sequence
  Description of Artificial Sequence: Synthetic peptide
  Seed: FSDGSLGQWV (MAGC3_HUMAN)
FSDGSLGQWY

SEQ ID NO: 110796 - protein, 9 aa, Artificial Sequence
  Description of Artificial Sequence: Synthetic peptide
  Seed: GYFPMIFRK (MAGC3_HUMAN)
GVFPMIFRR

SEQ ID NO: 110797 - protein, 11 aa, Artificial Sequence
  Description of Artificial Sequence: Synthetic peptide
  Seed: ILFGISLTEVD (MAGC3_HUMAN)
IMFGISLTEVM

SEQ ID NO: 110798 - protein, 9 aa, Artificial Sequence
  Description of Artificial Sequence: Synthetic peptide
  Seed: FVNTLDLTC (MAGC3_HUMAN)
FVNTLDLTL

SEQ ID NO: 110799 - protein, 10 aa, Artificial Sequence
  Description of Artificial Sequence: Synthetic peptide
  Seed: YALSPVVLPP (MAGC3_HUMAN)
YVLSPVVLPT

SEQ ID NO: 110800 - protein, 9 aa, Artificial Sequence
  Description of Artificial Sequence: Synthetic peptide
  Seed: KVAELVQFL (MAGC3_HUMAN)
KSAELVQFI

SEQ ID NO: 110801 - protein, 10 aa, Artificial Sequence
  Description of Artificial Sequence: Synthetic peptide
  Seed: YALSPVVLPP (MAGC3_HUMAN)
YFLSPVVLPM

SEQ ID NO: 110802 - protein, 10 aa, Artificial Sequence
  Description of Artificial Sequence: Synthetic peptide
  Seed: LNAIGPWSAL (MAGC3_HUMAN)
LLAIGPWSAM

SEQ ID NO: 110803 - protein, 9 aa, Artificial Sequence
  Description of Artificial Sequence: Synthetic peptide
  Seed: MQMNVINTY (MAGC3_HUMAN)
MSMNVINTL

SEQ ID NO: 110804 - protein, 9 aa, Artificial Sequence
  Description of Artificial Sequence: Synthetic peptide
  Seed: RTLWKDSDL (MAGC3_HUMAN)
RTLWKDSDF

SEQ ID NO: 110805 - protein, 8 aa, Artificial Sequence
  Description of Artificial Sequence: Synthetic peptide
  Seed: VDKLVQFL (MAGC3_HUMAN)
VQKLVQFV

SEQ ID NO: 110806 - protein, 9 aa, Artificial Sequence
  Description of Artificial Sequence: Synthetic peptide
  Seed: AIIDTTDDA (MAGC3_HUMAN)
AQIDTTDDV

SEQ ID NO: 110807 - protein, 10 aa, Artificial Sequence
  Description of Artificial Sequence: Synthetic peptide
  Seed: EMLTTVIKKY (MAGC3_HUMAN)
EILTTVIKKK

SEQ ID NO: 110808 - protein, 9 aa, Artificial Sequence
  Description of Artificial Sequence: Synthetic peptide
  Seed: SASPSVMST (MAGC3_HUMAN)
SNSPSVMSL

SEQ ID NO: 110809 - protein, 9 aa, Artificial Sequence
  Description of Artificial Sequence: Synthetic peptide
  Seed: HFYVFVNTL (MAGC3_HUMAN)
HTYVFVNTI

SEQ ID NO: 110810 - protein, 9 aa, Artificial Sequence
  Description of Artificial Sequence: Synthetic peptide
  Seed: SPSVMSTNF (MAGC3_HUMAN)
SPSVMSTNV

SEQ ID NO: 110811 - protein, 10 aa, Artificial Sequence
  Description of Artificial Sequence: Synthetic peptide
  Seed: KKYKDYFPMI (MAGC3_HUMAN)
KVYKDYFPMA

SEQ ID NO: 110812 - protein, 9 aa, Artificial Sequence
  Description of Artificial Sequence: Synthetic peptide
  Seed: EVLSAIGPI (MAGC3_HUMAN)
ETLSAIGPV

SEQ ID NO: 110813 - protein, 9 aa, Artificial Sequence
  Description of Artificial Sequence: Synthetic peptide
  Seed: GFADVLSRL (MAGC3_HUMAN)
GIADVLSRL

SEQ ID NO: 110814 - protein, 8 aa, Artificial Sequence
  Description of Artificial Sequence: Synthetic peptide
  Seed: IFGKAHEF (MAGC3_HUMAN)
IWGKAHEL

SEQ ID NO: 110815 - protein, 9 aa, Artificial Sequence
  Description of Artificial Sequence: Synthetic peptide
  Seed: VDPDHFYVF (MAGC3_HUMAN)
VQPDHFYVM

SEQ ID NO: 110816 - protein, 8 aa, Artificial Sequence
  Description of Artificial Sequence: Synthetic peptide
  Seed: FADVLSRL (MAGC3_HUMAN)
FSDVLSRM

SEQ ID NO: 110817 - protein, 10 aa, Artificial Sequence
  Description of Artificial Sequence: Synthetic peptide
  Seed: ILFGISLTEV (MAGC3_HUMAN)
IMFGISLTEI

SEQ ID NO: 110818 - protein, 10 aa, Artificial Sequence
  Description of Artificial Sequence: Synthetic peptide
  Seed: YALDEKVAEL (MAGC3_HUMAN)
YCLDEKVAEI

SEQ ID NO: 110819 - protein, 9 aa, Artificial Sequence
  Description of Artificial Sequence: Synthetic peptide
  Seed: SAFHLGHLR (MAGC3_HUMAN)
SCFHLGHLR

SEQ ID NO: 110820 - protein, 9 aa, Artificial Sequence
  Description of Artificial Sequence: Synthetic peptide
  Seed: VIWEVLSAI (MAGC3_HUMAN)
VMWEVLSAC

SEQ ID NO: 110821 - protein, 9 aa, Artificial Sequence
  Description of Artificial Sequence: Synthetic peptide
  Seed: KYKDYFPMI (MAGC3_HUMAN)
KYKDYFPMW

SEQ ID NO: 110822 - protein, 9 aa, Artificial Sequence
  Description of Artificial Sequence: Synthetic peptide
  Seed: VINTYTGYF (MAGC3_HUMAN)
VQNTYTGYM

SEQ ID NO: 110823 - protein, 10 aa, Artificial Sequence
  Description of Artificial Sequence: Synthetic peptide
  Seed: VTKAEMLTTV (MAGC3_HUMAN)
VVKAEMLTTV

SEQ ID NO: 110824 - protein, 9 aa, Artificial Sequence
  Description of Artificial Sequence: Synthetic peptide
  Seed: GKAHEFIEL (MAGC3_HUMAN)
GKAHEFIEF

SEQ ID NO: 110825 - protein, 9 aa, Artificial Sequence
  Description of Artificial Sequence: Synthetic peptide
  Seed: CATYALSPV (MAGC3_HUMAN)
CMTYALSPA

SEQ ID NO: 110826 - protein, 9 aa, Artificial Sequence
  Description of Artificial Sequence: Synthetic peptide
  Seed: KLVQFLLLK (MAGC3_HUMAN)
KLVQFLLLL

SEQ ID NO: 110827 - protein, 10 aa, Artificial Sequence
  Description of Artificial Sequence: Synthetic peptide
  Seed: PTYFKLWRTL (MAGC3_HUMAN)
PRYFKLWRTF

SEQ ID NO: 110828 - protein, 9 aa, Artificial Sequence
  Description of Artificial Sequence: Synthetic peptide
  Seed: KVAELVQFL (MAGC3_HUMAN)
KMAELVQFS

SEQ ID NO: 110829 - protein, 10 aa, Artificial Sequence
  Description of Artificial Sequence: Synthetic peptide
  Seed: REVRLFLRGG (MAGC3_HUMAN)
RTVRLFLRGK

SEQ ID NO: 110830 - protein, 9 aa, Artificial Sequence
  Description of Artificial Sequence: Synthetic peptide
  Seed: AVSPGKRLW (MAGC3_HUMAN)
ASSPGKRLL

SEQ ID NO: 110831 - protein, 9 aa, Artificial Sequence
  Description of Artificial Sequence: Synthetic peptide
  Seed: VLCPTYFKL (MAGC3_HUMAN)
VICPTYFKI

SEQ ID NO: 110832 - protein, 9 aa, Artificial Sequence
  Description of Artificial Sequence: Synthetic peptide
  Seed: SPQGPPQSP (MAGC3_HUMAN)
SAQGPPQSL

SEQ ID NO: 110833 - protein, 10 aa, Artificial Sequence
  Description of Artificial Sequence: Synthetic peptide
  Seed: ALDEKVAELV (MAGC3_HUMAN)
AVDEKVAELM

SEQ ID NO: 110834 - protein, 9 aa, Artificial Sequence
  Description of Artificial Sequence: Synthetic peptide
  Seed: KKYKDYFPM (MAGC3_HUMAN)
KFYKDYFPF

SEQ ID NO: 110835 - protein, 9 aa, Artificial Sequence
  Description of Artificial Sequence: Synthetic peptide
  Seed: MLLPCHWVL (MAGC3_HUMAN)
MTLPCHWVL

SEQ ID NO: 110836 - protein, 8 aa, Artificial Sequence
  Description of Artificial Sequence: Synthetic peptide
  Seed: KYKDYFPM (MAGC3_HUMAN)
KWKDYFPF

SEQ ID NO: 110837 - protein, 10 aa, Artificial Sequence
  Description of Artificial Sequence: Synthetic peptide
  Seed: TAMASASPSV (MAGC3_HUMAN)
THMASASPSL

SEQ ID NO: 110838 - protein, 9 aa, Artificial Sequence
  Description of Artificial Sequence: Synthetic peptide
  Seed: LIDDQGMPK (MAGC3_HUMAN)
LTDDQGMPV

SEQ ID NO: 110839 - protein, 9 aa, Artificial Sequence
  Description of Artificial Sequence: Synthetic peptide
  Seed: MDPDNHSYF (MAGC3_HUMAN)
MQPDNHSYM

SEQ ID NO: 110840 - protein, 10 aa, Artificial Sequence
  Description of Artificial Sequence: Synthetic peptide
  Seed: EVIWEVLNAI (MAGC3_HUMAN)
EIIWEVLNAF

SEQ ID NO: 110841 - protein, 9 aa, Artificial Sequence
  Description of Artificial Sequence: Synthetic peptide
  Seed: TAMASASPS (MAGC3_HUMAN)
TLMASASPY

SEQ ID NO: 110842 - protein, 9 aa, Artificial Sequence
  Description of Artificial Sequence: Synthetic peptide
  Seed: DMDPDNHSY (MAGC3_HUMAN)
DYDPDNHSV

SEQ ID NO: 110843 - protein, 9 aa, Artificial Sequence
  Description of Artificial Sequence: Synthetic peptide
  Seed: SAFHLGHLR (MAGC3_HUMAN)
SAFHLGHLY

SEQ ID NO: 110844 - protein, 9 aa, Artificial Sequence
  Description of Artificial Sequence: Synthetic peptide
  Seed: VPEEVIWEV (MAGC3_HUMAN)
VIEEVIWEL

SEQ ID NO: 110845 - protein, 10 aa, Artificial Sequence
  Description of Artificial Sequence: Synthetic peptide
  Seed: FFEDTLDLTY (MAGC3_HUMAN)
FLEDTLDLTM

SEQ ID NO: 110846 - protein, 9 aa, Artificial Sequence
  Description of Artificial Sequence: Synthetic peptide
  Seed: MQMNVINTY (MAGC3_HUMAN)
MIMNVINTL

SEQ ID NO: 110847 - protein, 9 aa, Artificial Sequence
  Description of Artificial Sequence: Synthetic peptide
  Seed: IPSAFPSWY (MAGC3_HUMAN)
ILSAFPSWY

SEQ ID NO: 110848 - protein, 9 aa, Artificial Sequence
  Description of Artificial Sequence: Synthetic peptide
  Seed: LILSMIFIK (MAGC3_HUMAN)
LLLSMIFIR

SEQ ID NO: 110849 - protein, 9 aa, Artificial Sequence
  Description of Artificial Sequence: Synthetic peptide
  Seed: HLREVRLFL (MAGC3_HUMAN)
HQREVRLFK

SEQ ID NO: 110850 - protein, 9 aa, Artificial Sequence
  Description of Artificial Sequence: Synthetic peptide
  Seed: KYKDYFPMI (MAGC3_HUMAN)
KYKDYFPMV

SEQ ID NO: 110851 - protein, 9 aa, Artificial Sequence
  Description of Artificial Sequence: Synthetic peptide
  Seed: MIFRKAREF (MAGC3_HUMAN)
MSFRKAREY

SEQ ID NO: 110852 - protein, 10 aa, Artificial Sequence
  Description of Artificial Sequence: Synthetic peptide
  Seed: SAFHLGHLRE (MAGC3_HUMAN)
SAFHLGHLRR

SEQ ID NO: 110853 - protein, 11 aa, Artificial Sequence
  Description of Artificial Sequence: Synthetic peptide
  Seed: IPPQGPPKISP (MAGC3_HUMAN)
IPPQGPPKISL

SEQ ID NO: 110854 - protein, 9 aa, Artificial Sequence
  Description of Artificial Sequence: Synthetic peptide
  Seed: SAFHLGHLR (MAGC3_HUMAN)
SAFHLGHLK

SEQ ID NO: 110855 - protein, 9 aa, Artificial Sequence
  Description of Artificial Sequence: Synthetic peptide
  Seed: WRRGTGYTL (MAGC3_HUMAN)
WQRGTGYTL

SEQ ID NO: 110856 - protein, 9 aa, Artificial Sequence
  Description of Artificial Sequence: Synthetic peptide
  Seed: SAEGSVLDL (MAGC3_HUMAN)
SWEGSVLDM

SEQ ID NO: 110857 - protein, 10 aa, Artificial Sequence
  Description of Artificial Sequence: Synthetic peptide
  Seed: LILILSMIFI (MAGC3_HUMAN)
LYLILSMIFV

SEQ ID NO: 110858 - protein, 11 aa, Artificial Sequence
  Description of Artificial Sequence: Synthetic peptide
  Seed: MPPLPQSPPEI (MAGC3_HUMAN)
MPPLPQSPPEL

SEQ ID NO: 110859 - protein, 9 aa, Artificial Sequence
  Description of Artificial Sequence: Synthetic peptide
  Seed: TLDEKVDKL (MAGC3_HUMAN)
TLDEKVDKM

SEQ ID NO: 110860 - protein, 10 aa, Artificial Sequence
  Description of Artificial Sequence: Synthetic peptide
  Seed: SKLSSIIPSA (MAGC3_HUMAN)
SCLSSIIPSI

SEQ ID NO: 110861 - protein, 9 aa, Artificial Sequence
  Description of Artificial Sequence: Synthetic peptide
  Seed: MPAAGMPPL (MAGC3_HUMAN)
MGAAGMPPV

SEQ ID NO: 110862 - protein, 9 aa, Artificial Sequence
  Description of Artificial Sequence: Synthetic peptide
  Seed: FADVLSRLA (MAGC3_HUMAN)
FWDVLSRLV

SEQ ID NO: 110863 - protein, 9 aa, Artificial Sequence
  Description of Artificial Sequence: Synthetic peptide
  Seed: RPAREVLEF (MAGC3_HUMAN)
RVAREVLEF

SEQ ID NO: 110864 - protein, 9 aa, Artificial Sequence
  Description of Artificial Sequence: Synthetic peptide
  Seed: VLCPTYFKL (MAGC3_HUMAN)
VGCPTYFKW

SEQ ID NO: 110865 - protein, 9 aa, Artificial Sequence
  Description of Artificial Sequence: Synthetic peptide
  Seed: HFYVFVNTL (MAGC3_HUMAN)
HGYVFVNTI

SEQ ID NO: 110866 - protein, 9 aa, Artificial Sequence
  Description of Artificial Sequence: Synthetic peptide
  Seed: YALSPVVLP (MAGC3_HUMAN)
YSLSPVVLL

SEQ ID NO: 110867 - protein, 9 aa, Artificial Sequence
  Description of Artificial Sequence: Synthetic peptide
  Seed: FHLGHLREV (MAGC3_HUMAN)
FALGHLREI

SEQ ID NO: 110868 - protein, 10 aa, Artificial Sequence
  Description of Artificial Sequence: Synthetic peptide
  Seed: YALSPVVLPP (MAGC3_HUMAN)
YALSPVVLPV

SEQ ID NO: 110869 - protein, 9 aa, Artificial Sequence
  Description of Artificial Sequence: Synthetic peptide
  Seed: SAFHLGHLR (MAGC3_HUMAN)
SYFHLGHLR

SEQ ID NO: 110870 - protein, 9 aa, Artificial Sequence
  Description of Artificial Sequence: Synthetic peptide
  Seed: IPPQGPPKI (MAGC3_HUMAN)
IMPQGPPKY

SEQ ID NO: 110871 - protein, 9 aa, Artificial Sequence
  Description of Artificial Sequence: Synthetic peptide
  Seed: IQRPAREVL (MAGC3_HUMAN)
IYRPAREVY

SEQ ID NO: 110872 - protein, 9 aa, Artificial Sequence
  Description of Artificial Sequence: Synthetic peptide
  Seed: FSDGSLGQW (MAGC3_HUMAN)
FYDGSLGQL

SEQ ID NO: 110873 - protein, 10 aa, Artificial Sequence
  Description of Artificial Sequence: Synthetic peptide
  Seed: MDPDNHSYFF (MAGC3_HUMAN)
MGPDNHSYFW

SEQ ID NO: 110874 - protein, 10 aa, Artificial Sequence
  Description of Artificial Sequence: Synthetic peptide
  Seed: MQMNVINTYT (MAGC3_HUMAN)
MQMNVINTYD

SEQ ID NO: 110875 - protein, 9 aa, Artificial Sequence
  Description of Artificial Sequence: Synthetic peptide
  Seed: LSSIIPSAF (MAGC3_HUMAN)
LISIIPSAY

SEQ ID NO: 110876 - protein, 10 aa, Artificial Sequence
  Description of Artificial Sequence: Synthetic peptide
  Seed: ALDEKVAELV (MAGC3_HUMAN)
AGDEKVAELM

SEQ ID NO: 110877 - protein, 11 aa, Artificial Sequence
  Description of Artificial Sequence: Synthetic peptide
  Seed: ALWESEGPEAF (MAGC3_HUMAN)
ALWESEGPEAW

SEQ ID NO: 110878 - protein, 9 aa, Artificial Sequence
  Description of Artificial Sequence: Synthetic peptide
  Seed: KGSCVPEEV (MAGC3_HUMAN)
KTSCVPEEI

SEQ ID NO: 110879 - protein, 9 aa, Artificial Sequence
  Description of Artificial Sequence: Synthetic peptide
  Seed: ATDKDYSAF (MAGC3_HUMAN)
AADKDYSAL

SEQ ID NO: 110880 - protein, 9 aa, Artificial Sequence
  Description of Artificial Sequence: Synthetic peptide
  Seed: MIFRKAREF (MAGC3_HUMAN)
MAFRKAREM

SEQ ID NO: 110881 - protein, 10 aa, Artificial Sequence
  Description of Artificial Sequence: Synthetic peptide
  Seed: LVLCPTYFKL (MAGC3_HUMAN)
LLLCPTYFKM

SEQ ID NO: 110882 - protein, 10 aa, Artificial Sequence
  Description of Artificial Sequence: Synthetic peptide
  Seed: EVIWEVLSAI (MAGC3_HUMAN)
EGIWEVLSAV

SEQ ID NO: 110883 - protein, 9 aa, Artificial Sequence
  Description of Artificial Sequence: Synthetic peptide
  Seed: SPSVMSTNF (MAGC3_HUMAN)
SPSVMSTNW

SEQ ID NO: 110884 - protein, 10 aa, Artificial Sequence
  Description of Artificial Sequence: Synthetic peptide
  Seed: VLDLANPQGL (MAGC3_HUMAN)
VSDLANPQGL

SEQ ID NO: 110885 - protein, 9 aa, Artificial Sequence
  Description of Artificial Sequence: Synthetic peptide
  Seed: FSDGSLGQW (MAGC3_HUMAN)
FWDGSLGQI

SEQ ID NO: 110886 - protein, 10 aa, Artificial Sequence
  Description of Artificial Sequence: Synthetic peptide
  Seed: TLDEKVDKLV (MAGC3_HUMAN)
TMDEKVDKLF

SEQ ID NO: 110887 - protein, 11 aa, Artificial Sequence
  Description of Artificial Sequence: Synthetic peptide
  Seed: AEMQMNVINTY (MAGC3_HUMAN)
AIMQMNVINTY

SEQ ID NO: 110888 - protein, 9 aa, Artificial Sequence
  Description of Artificial Sequence: Synthetic peptide
  Seed: WVKNTCATY (MAGC3_HUMAN)
WVKNTCATR

SEQ ID NO: 110889 - protein, 10 aa, Artificial Sequence
  Description of Artificial Sequence: Synthetic peptide
  Seed: TGYFPMIFRK (MAGC3_HUMAN)
TMYFPMIFRP

SEQ ID NO: 110890 - protein, 10 aa, Artificial Sequence
  Description of Artificial Sequence: Synthetic peptide
  Seed: EVDPDHFYVF (MAGC3_HUMAN)
ESDPDHFYVY

SEQ ID NO: 110891 - protein, 11 aa, Artificial Sequence
  Description of Artificial Sequence: Synthetic peptide
  Seed: KFSLRRAVSVK (MAGC3_HUMAN)
KMSLRRAVSVK

SEQ ID NO: 110892 - protein, 9 aa, Artificial Sequence
  Description of Artificial Sequence: Synthetic peptide
  Seed: MIFIKGSCV (MAGC3_HUMAN)
MSFIKGSCL

SEQ ID NO: 110893 - protein, 10 aa, Artificial Sequence
  Description of Artificial Sequence: Synthetic peptide
  Seed: TGYFPMIFRK (MAGC3_HUMAN)
TMYFPMIFRA

SEQ ID NO: 110894 - protein, 10 aa, Artificial Sequence
  Description of Artificial Sequence: Synthetic peptide
  Seed: KAEMLTTVIK (MAGC3_HUMAN)
KTEMLTTVIR

SEQ ID NO: 110895 - protein, 9 aa, Artificial Sequence
  Description of Artificial Sequence: Synthetic peptide
  Seed: RPAREVLEF (MAGC3_HUMAN)
RMAREVLEL

SEQ ID NO: 110896 - protein, 11 aa, Artificial Sequence
  Description of Artificial Sequence: Synthetic peptide
  Seed: ALAGFADVLSR (MAGC3_HUMAN)
AMAGFADVLSR

SEQ ID NO: 110897 - protein, 9 aa, Artificial Sequence
  Description of Artificial Sequence: Synthetic peptide
  Seed: KVDKLVQFL (MAGC3_HUMAN)
KSDKLVQFW

SEQ ID NO: 110898 - protein, 9 aa, Artificial Sequence
  Description of Artificial Sequence: Synthetic peptide
  Seed: EVIWEVLSA (MAGC3_HUMAN)
ELIWEVLSR

SEQ ID NO: 110899 - protein, 11 aa, Artificial Sequence
  Description of Artificial Sequence: Synthetic peptide
  Seed: TTDDATAMASA (MAGC3_HUMAN)
TIDDATAMASL

SEQ ID NO: 110900 - protein, 9 aa, Artificial Sequence
  Description of Artificial Sequence: Synthetic peptide
  Seed: MASASPSVM (MAGC3_HUMAN)
MTSASPSVV

SEQ ID NO: 110901 - protein, 9 aa, Artificial Sequence
  Description of Artificial Sequence: Synthetic peptide
  Seed: TLDEKVDKL (MAGC3_HUMAN)
TFDEKVDKF

SEQ ID NO: 110902 - protein, 10 aa, Artificial Sequence
  Description of Artificial Sequence: Synthetic peptide
  Seed: TTDDATAMAS (MAGC3_HUMAN)
TGDDATAMAL

SEQ ID NO: 110903 - protein, 9 aa, Artificial Sequence
  Description of Artificial Sequence: Synthetic peptide
  Seed: YFFEDTLDL (MAGC3_HUMAN)
YVFEDTLDL

SEQ ID NO: 110904 - protein, 10 aa, Artificial Sequence
  Description of Artificial Sequence: Synthetic peptide
  Seed: MQMNVINTYT (MAGC3_HUMAN)
MGMNVINTYY

SEQ ID NO: 110905 - protein, 9 aa, Artificial Sequence
  Description of Artificial Sequence: Synthetic peptide
  Seed: WESEGPEAF (MAGC3_HUMAN)
WMSEGPEAY

SEQ ID NO: 110906 - protein, 10 aa, Artificial Sequence
  Description of Artificial Sequence: Synthetic peptide
  Seed: LILILSMIFI (MAGC3_HUMAN)
LMLILSMIFL

SEQ ID NO: 110907 - protein, 9 aa, Artificial Sequence
  Description of Artificial Sequence: Synthetic peptide
  Seed: KAHEFIELI (MAGC3_HUMAN)
KIHEFIELA

SEQ ID NO: 110908 - protein, 10 aa, Artificial Sequence
  Description of Artificial Sequence: Synthetic peptide
  Seed: TYFKLWRTLS (MAGC3_HUMAN)
TYFKLWRTLI

SEQ ID NO: 110909 - protein, 10 aa, Artificial Sequence
  Description of Artificial Sequence: Synthetic peptide
  Seed: MIFRKAREFI (MAGC3_HUMAN)
MWFRKAREFK

SEQ ID NO: 110910 - protein, 9 aa, Artificial Sequence
  Description of Artificial Sequence: Synthetic peptide
  Seed: SQPEGKFSL (MAGC3_HUMAN)
SEPEGKFSL

SEQ ID NO: 110911 - protein, 11 aa, Artificial Sequence
  Description of Artificial Sequence: Synthetic peptide
  Seed: IIDTTDDATAM (MAGC3_HUMAN)
IYDTTDDATAM

SEQ ID NO: 110912 - protein, 9 aa, Artificial Sequence
  Description of Artificial Sequence: Synthetic peptide
  Seed: TTDDATAMA (MAGC3_HUMAN)
TSDDATAMF

SEQ ID NO: 110913 - protein, 9 aa, Artificial Sequence
  Description of Artificial Sequence: Synthetic peptide
  Seed: LKYQTKEPV (MAGC3_HUMAN)
LSYQTKEPF

SEQ ID NO: 110914 - protein, 11 aa, Artificial Sequence
  Description of Artificial Sequence: Synthetic peptide
  Seed: FIELIFGIALT (MAGC3_HUMAN)
FWELIFGIALV

SEQ ID NO: 110915 - protein, 10 aa, Artificial Sequence
  Description of Artificial Sequence: Synthetic peptide
  Seed: SKLSSIIPSA (MAGC3_HUMAN)
SWLSSIIPSL

SEQ ID NO: 110916 - protein, 10 aa, Artificial Sequence
  Description of Artificial Sequence: Synthetic peptide
  Seed: TGYFPMIFRK (MAGC3_HUMAN)
TIYFPMIFRR

SEQ ID NO: 110917 - protein, 10 aa, Artificial Sequence
  Description of Artificial Sequence: Synthetic peptide
  Seed: EEVIWEVLNA (MAGC3_HUMAN)
EFVIWEVLNV

SEQ ID NO: 110918 - protein, 9 aa, Artificial Sequence
  Description of Artificial Sequence: Synthetic peptide
  Seed: KVDKLVQFL (MAGC3_HUMAN)
KFDKLVQFF

SEQ ID NO: 110919 - protein, 10 aa, Artificial Sequence
  Description of Artificial Sequence: Synthetic peptide
  Seed: ALWESEGPEA (MAGC3_HUMAN)
AQWESEGPEV

SEQ ID NO: 110920 - protein, 10 aa, Artificial Sequence
  Description of Artificial Sequence: Synthetic peptide
  Seed: AMASASPSVM (MAGC3_HUMAN)
AHASASPSVY

SEQ ID NO: 110921 - protein, 10 aa, Artificial Sequence
  Description of Artificial Sequence: Synthetic peptide
  Seed: YALDEKVAEL (MAGC3_HUMAN)
YHLDEKVAET

SEQ ID NO: 110922 - protein, 9 aa, Artificial Sequence
  Description of Artificial Sequence: Synthetic peptide
  Seed: EKVDKLVQF (MAGC3_HUMAN)
EEVDKLVQW

SEQ ID NO: 110923 - protein, 11 aa, Artificial Sequence
  Description of Artificial Sequence: Synthetic peptide
  Seed: IIDTTDDATAM (MAGC3_HUMAN)
IFDTTDDATAM

SEQ ID NO: 110924 - protein, 10 aa, Artificial Sequence
  Description of Artificial Sequence: Synthetic peptide
  Seed: EKVAELVQFL (MAGC3_HUMAN)
ENVAELVQFY

SEQ ID NO: 110925 - protein, 9 aa, Artificial Sequence
  Description of Artificial Sequence: Synthetic peptide
  Seed: TYTGYFPMI (MAGC3_HUMAN)
TYTGYFPMM

SEQ ID NO: 110926 - protein, 9 aa, Artificial Sequence
  Description of Artificial Sequence: Synthetic peptide
  Seed: HLREVRLFL (MAGC3_HUMAN)
HLREVRLFA

SEQ ID NO: 110927 - protein, 9 aa, Artificial Sequence
  Description of Artificial Sequence: Synthetic peptide
  Seed: RPAREVLEF (MAGC3_HUMAN)
RQAREVLEL

SEQ ID NO: 110928 - protein, 9 aa, Artificial Sequence
  Description of Artificial Sequence: Synthetic peptide
  Seed: YQAKEPLTR (MAGC3_HUMAN)
YVAKEPLTM

SEQ ID NO: 110929 - protein, 9 aa, Artificial Sequence
  Description of Artificial Sequence: Synthetic peptide
  Seed: YFFEDTLDL (MAGC3_HUMAN)
YRFEDTLDY

SEQ ID NO: 110930 - protein, 9 aa, Artificial Sequence
  Description of Artificial Sequence: Synthetic peptide
  Seed: LIDDQGMPK (MAGC3_HUMAN)
LMDDQGMPY

SEQ ID NO: 110931 - protein, 10 aa, Artificial Sequence
  Description of Artificial Sequence: Synthetic peptide
  Seed: NTYTGYFPMI (MAGC3_HUMAN)
NLYTGYFPMM

SEQ ID NO: 110932 - protein, 11 aa, Artificial Sequence
  Description of Artificial Sequence: Synthetic peptide
  Seed: RYALDEKVAEL (MAGC3_HUMAN)
RWALDEKVAEF

SEQ ID NO: 110933 - protein, 10 aa, Artificial Sequence
  Description of Artificial Sequence: Synthetic peptide
  Seed: IELIFGIALT (MAGC3_HUMAN)
IHLIFGIALV

SEQ ID NO: 110934 - protein, 9 aa, Artificial Sequence
  Description of Artificial Sequence: Synthetic peptide
  Seed: MQMNVINTY (MAGC3_HUMAN)
MPMNVINTN

SEQ ID NO: 110935 - protein, 11 aa, Artificial Sequence
  Description of Artificial Sequence: Synthetic peptide
  Seed: FPMIFGKAHEF (MAGC3_HUMAN)
FPMIFGKAHEV

SEQ ID NO: 110936 - protein, 9 aa, Artificial Sequence
  Description of Artificial Sequence: Synthetic peptide
  Seed: SEEVIWEVL (MAGC3_HUMAN)
SEEVIWEVT

SEQ ID NO: 110937 - protein, 9 aa, Artificial Sequence
  Description of Artificial Sequence: Synthetic peptide
  Seed: EFIELIFGI (MAGC3_HUMAN)
ETIELIFGA

SEQ ID NO: 110938 - protein, 9 aa, Artificial Sequence
  Description of Artificial Sequence: Synthetic peptide
  Seed: IELIFGIAL (MAGC3_HUMAN)
IELIFGIAM

SEQ ID NO: 110939 - protein, 9 aa, Artificial Sequence
  Description of Artificial Sequence: Synthetic peptide
  Seed: MIFGKAHEF (MAGC3_HUMAN)
MIFGKAHEI

SEQ ID NO: 110940 - protein, 11 aa, Artificial Sequence
  Description of Artificial Sequence: Synthetic peptide
  Seed: ATAMASASPSV (MAGC3_HUMAN)
ALAMASASPSV

SEQ ID NO: 110941 - protein, 8 aa, Artificial Sequence
  Description of Artificial Sequence: Synthetic peptide
  Seed: FADVLSRL (MAGC3_HUMAN)
FYDVLSRI

SEQ ID NO: 110942 - protein, 10 aa, Artificial Sequence
  Description of Artificial Sequence: Synthetic peptide
  Seed: EVIWEVLNAI (MAGC3_HUMAN)
ERIWEVLNAV

SEQ ID NO: 110943 - protein, 9 aa, Artificial Sequence
  Description of Artificial Sequence: Synthetic peptide
  Seed: KVAELVQFL (MAGC3_HUMAN)
KQAELVQFT

SEQ ID NO: 110944 - protein, 9 aa, Artificial Sequence
  Description of Artificial Sequence: Synthetic peptide
  Seed: FPSWYMDAL (MAGC3_HUMAN)
FQSWYMDAF

SEQ ID NO: 110945 - protein, 10 aa, Artificial Sequence
  Description of Artificial Sequence: Synthetic peptide
  Seed: NTYTGYFPMI (MAGC3_HUMAN)
NLYTGYFPMI

SEQ ID NO: 110946 - protein, 11 aa, Artificial Sequence
  Description of Artificial Sequence: Synthetic peptide
  Seed: FIELIFGIALT (MAGC3_HUMAN)
FHELIFGIALV

SEQ ID NO: 110947 - protein, 9 aa, Artificial Sequence
  Description of Artificial Sequence: Synthetic peptide
  Seed: KLVQFLLLK (MAGC3_HUMAN)
KIVQFLLLI

SEQ ID NO: 110948 - protein, 10 aa, Artificial Sequence
  Description of Artificial Sequence: Synthetic peptide
  Seed: MQMNVINTYT (MAGC3_HUMAN)
MSMNVINTYF

SEQ ID NO: 110949 - protein, 9 aa, Artificial Sequence
  Description of Artificial Sequence: Synthetic peptide
  Seed: GYTLSLPAV (MAGC3_HUMAN)
GYTLSLPAL

SEQ ID NO: 110950 - protein, 9 aa, Artificial Sequence
  Description of Artificial Sequence: Synthetic peptide
  Seed: MIFRKAREF (MAGC3_HUMAN)
MKFRKAREY

SEQ ID NO: 110951 - protein, 9 aa, Artificial Sequence
  Description of Artificial Sequence: Synthetic peptide
  Seed: TSDQRMDSL (MAGC3_HUMAN)
TSDQRMDSI

SEQ ID NO: 110952 - protein, 9 aa, Artificial Sequence
  Description of Artificial Sequence: Synthetic peptide
  Seed: HSYFFEDTL (MAGC3_HUMAN)
HAYFFEDTL

SEQ ID NO: 110953 - protein, 9 aa, Artificial Sequence
  Description of Artificial Sequence: Synthetic peptide
  Seed: MQMNVINTY (MAGC3_HUMAN)
MMMNVINTW

SEQ ID NO: 110954 - protein, 10 aa, Artificial Sequence
  Description of Artificial Sequence: Synthetic peptide
  Seed: SKLSSIIPSA (MAGC3_HUMAN)
SYLSSIIPSI

SEQ ID NO: 110955 - protein, 9 aa, Artificial Sequence
  Description of Artificial Sequence: Synthetic peptide
  Seed: MIFGKAHEF (MAGC3_HUMAN)
MMFGKAHEL

SEQ ID NO: 110956 - protein, 11 aa, Artificial Sequence
  Description of Artificial Sequence: Synthetic peptide
  Seed: NTYTGYFPMIF (MAGC3_HUMAN)
NSYTGYFPMIW

SEQ ID NO: 110957 - protein, 10 aa, Artificial Sequence
  Description of Artificial Sequence: Synthetic peptide
  Seed: SLIDDQGMPK (MAGC3_HUMAN)
SSIDDQGMPK

SEQ ID NO: 110958 - protein, 11 aa, Artificial Sequence
  Description of Artificial Sequence: Synthetic peptide
  Seed: DEQGMPQNRLL (MAGC3_HUMAN)
DEQGMPQNRLW

SEQ ID NO: 110959 - protein, 9 aa, Artificial Sequence
  Description of Artificial Sequence: Synthetic peptide
  Seed: WEVLNAIGP (MAGC3_HUMAN)
WEVLNAIGA

SEQ ID NO: 110960 - protein, 9 aa, Artificial Sequence
  Description of Artificial Sequence: Synthetic peptide
  Seed: EVDPDHFYV (MAGC3_HUMAN)
ELDPDHFYY

SEQ ID NO: 110961 - protein, 11 aa, Artificial Sequence
  Description of Artificial Sequence: Synthetic peptide
  Seed: SLVLCPTYFKL (MAGC3_HUMAN)
SVVLCPTYFKK

SEQ ID NO: 110962 - protein, 9 aa, Artificial Sequence
  Description of Artificial Sequence: Synthetic peptide
  Seed: LSDEQGMPQ (MAGC3_HUMAN)
LNDEQGMPL

SEQ ID NO: 110963 - protein, 9 aa, Artificial Sequence
  Description of Artificial Sequence: Synthetic peptide
  Seed: MLLPCHWVL (MAGC3_HUMAN)
MSLPCHWVL

SEQ ID NO: 110964 - protein, 9 aa, Artificial Sequence
  Description of Artificial Sequence: Synthetic peptide
  Seed: RPAREVLEF (MAGC3_HUMAN)
RRAREVLEY

SEQ ID NO: 110965 - protein, 9 aa, Artificial Sequence
  Description of Artificial Sequence: Synthetic peptide
  Seed: MLTTVIKKY (MAGC3_HUMAN)
MSTTVIKKM

SEQ ID NO: 110966 - protein, 11 aa, Artificial Sequence
  Description of Artificial Sequence: Synthetic peptide
  Seed: TSDQRMDSLVL (MAGC3_HUMAN)
TEDQRMDSLVF

SEQ ID NO: 110967 - protein, 9 aa, Artificial Sequence
  Description of Artificial Sequence: Synthetic peptide
  Seed: KGSCVPEEV (MAGC3_HUMAN)
KQSCVPEEF

SEQ ID NO: 110968 - protein, 10 aa, Artificial Sequence
  Description of Artificial Sequence: Synthetic peptide
  Seed: EVIWEVLSAI (MAGC3_HUMAN)
ELIWEVLSAV

SEQ ID NO: 110969 - protein, 9 aa, Artificial Sequence
  Description of Artificial Sequence: Synthetic peptide
  Seed: KYKDYFPMI (MAGC3_HUMAN)
KIKDYFPMS

SEQ ID NO: 110970 - protein, 9 aa, Artificial Sequence
  Description of Artificial Sequence: Synthetic peptide
  Seed: AVSPGKRLW (MAGC3_HUMAN)
AISPGKRLW

SEQ ID NO: 110971 - protein, 9 aa, Artificial Sequence
  Description of Artificial Sequence: Synthetic peptide
  Seed: CLLILILSM (MAGC3_HUMAN)
CALILILSY

SEQ ID NO: 110972 - protein, 10 aa, Artificial Sequence
  Description of Artificial Sequence: Synthetic peptide
  Seed: KVAELVQFLL (MAGC3_HUMAN)
KAAELVQFLY

SEQ ID NO: 110973 - protein, 11 aa, Artificial Sequence
  Description of Artificial Sequence: Synthetic peptide
  Seed: TDMDPDNHSYF (MAGC3_HUMAN)
TIMDPDNHSYY

SEQ ID NO: 110974 - protein, 9 aa, Artificial Sequence
  Description of Artificial Sequence: Synthetic peptide
  Seed: NTYTGYFPM (MAGC3_HUMAN)
NHYTGYFPY

SEQ ID NO: 110975 - protein, 9 aa, Artificial Sequence
  Description of Artificial Sequence: Synthetic peptide
  Seed: IIPSAFPSW (MAGC3_HUMAN)
ISPSAFPSI

SEQ ID NO: 110976 - protein, 9 aa, Artificial Sequence
  Description of Artificial Sequence: Synthetic peptide
  Seed: HALPESESL (MAGC3_HUMAN)
HRLPESESY

SEQ ID NO: 110977 - protein, 10 aa, Artificial Sequence
  Description of Artificial Sequence: Synthetic peptide
  Seed: KKYKDYFPMI (MAGC3_HUMAN)
KQYKDYFPMF

SEQ ID NO: 110978 - protein, 9 aa, Artificial Sequence
  Description of Artificial Sequence: Synthetic peptide
  Seed: VLPPQPQPR (MAGC3_HUMAN)
VFPPQPQPM

SEQ ID NO: 110979 - protein, 9 aa, Artificial Sequence
  Description of Artificial Sequence: Synthetic peptide
  Seed: QTKEPVTKA (MAGC3_HUMAN)
QPKEPVTKV

SEQ ID NO: 110980 - protein, 11 aa, Artificial Sequence
  Description of Artificial Sequence: Synthetic peptide
  Seed: INTYTGYFPMI (MAGC3_HUMAN)
IGTYTGYFPMF

SEQ ID NO: 110981 - protein, 9 aa, Artificial Sequence
  Description of Artificial Sequence: Synthetic peptide
  Seed: MASASPSVM (MAGC3_HUMAN)
MLSASPSVW

SEQ ID NO: 110982 - protein, 11 aa, Artificial Sequence
  Description of Artificial Sequence: Synthetic peptide
  Seed: SKLSSIIPSAF (MAGC3_HUMAN)
SSLSSIIPSAW

SEQ ID NO: 110983 - protein, 9 aa, Artificial Sequence
  Description of Artificial Sequence: Synthetic peptide
  Seed: MLTTVIKKY (MAGC3_HUMAN)
MVTTVIKKF

SEQ ID NO: 110984 - protein, 9 aa, Artificial Sequence
  Description of Artificial Sequence: Synthetic peptide
  Seed: YALSPVVLP (MAGC3_HUMAN)
YGLSPVVLL

SEQ ID NO: 110985 - protein, 11 aa, Artificial Sequence
  Description of Artificial Sequence: Synthetic peptide
  Seed: TSDQRMDSLVL (MAGC3_HUMAN)
TNDQRMDSLVY

SEQ ID NO: 110986 - protein, 9 aa, Artificial Sequence
  Description of Artificial Sequence: Synthetic peptide
  Seed: RTLSGSPGL (MAGC3_HUMAN)
RMLSGSPGW

SEQ ID NO: 110987 - protein, 9 aa, Artificial Sequence
  Description of Artificial Sequence: Synthetic peptide
  Seed: MQMNVINTY (MAGC3_HUMAN)
MAMNVINTF

SEQ ID NO: 110988 - protein, 10 aa, Artificial Sequence
  Description of Artificial Sequence: Synthetic peptide
  Seed: TWRRGTGYTL (MAGC3_HUMAN)
TYRRGTGYTI

SEQ ID NO: 110989 - protein, 10 aa, Artificial Sequence
  Description of Artificial Sequence: Synthetic peptide
  Seed: LNAIGPWSAL (MAGC3_HUMAN)
LPAIGPWSAM

SEQ ID NO: 110990 - protein, 9 aa, Artificial Sequence
  Description of Artificial Sequence: Synthetic peptide
  Seed: AVSPGKRLW (MAGC3_HUMAN)
APSPGKRLW

SEQ ID NO: 110991 - protein, 9 aa, Artificial Sequence
  Description of Artificial Sequence: Synthetic peptide
  Seed: EVLEFLSKL (MAGC3_HUMAN)
ETLEFLSKT

SEQ ID NO: 110992 - protein, 9 aa, Artificial Sequence
  Description of Artificial Sequence: Synthetic peptide
  Seed: SEEEDTATW (MAGC3_HUMAN)
SQEEDTATW

SEQ ID NO: 110993 - protein, 9 aa, Artificial Sequence
  Description of Artificial Sequence: Synthetic peptide
  Seed: VDPDHFYVF (MAGC3_HUMAN)
VIPDHFYVL

SEQ ID NO: 110994 - protein, 10 aa, Artificial Sequence
  Description of Artificial Sequence: Synthetic peptide
  Seed: CASEEVIWEV (MAGC3_HUMAN)
CISEEVIWEV

SEQ ID NO: 110995 - protein, 10 aa, Artificial Sequence
  Description of Artificial Sequence: Synthetic peptide
  Seed: NTYTGYFPMI (MAGC3_HUMAN)
NMYTGYFPMA

SEQ ID NO: 110996 - protein, 9 aa, Artificial Sequence
  Description of Artificial Sequence: Synthetic peptide
  Seed: MASASPSVM (MAGC3_HUMAN)
MQSASPSVH

SEQ ID NO: 110997 - protein, 9 aa, Artificial Sequence
  Description of Artificial Sequence: Synthetic peptide
  Seed: AEMLTTVIK (MAGC3_HUMAN)
AEMLTTVIV

SEQ ID NO: 110998 - protein, 11 aa, Artificial Sequence
  Description of Artificial Sequence: Synthetic peptide
  Seed: RTLSGSPGLQL (MAGC3_HUMAN)
RLLSGSPGLQL

SEQ ID NO: 110999 - protein, 10 aa, Artificial Sequence
  Description of Artificial Sequence: Synthetic peptide
  Seed: KLSSIIPSAF (MAGC3_HUMAN)
KQSSIIPSAM

SEQ ID NO: 111000 - protein, 11 aa, Artificial Sequence
  Description of Artificial Sequence: Synthetic peptide
  Seed: TYTGYFPMIFR (MAGC3_HUMAN)
TITGYFPMIFR

SEQ ID NO: 111001 - protein, 11 aa, Artificial Sequence
  Description of Artificial Sequence: Synthetic peptide
  Seed: GSQPEGKFSLR (MAGC3_HUMAN)
GTQPEGKFSLR

SEQ ID NO: 111002 - protein, 10 aa, Artificial Sequence
  Description of Artificial Sequence: Synthetic peptide
  Seed: SPLDSCSSPL (MAGC3_HUMAN)
SPLDSCSSPY

SEQ ID NO: 111003 - protein, 10 aa, Artificial Sequence
  Description of Artificial Sequence: Synthetic peptide
  Seed: SPPEIPPQGP (MAGC3_HUMAN)
SPPEIPPQGM

SEQ ID NO: 111004 - protein, 9 aa, Artificial Sequence
  Description of Artificial Sequence: Synthetic peptide
  Seed: IPPQGPPKI (MAGC3_HUMAN)
IMPQGPPKL

SEQ ID NO: 111005 - protein, 11 aa, Artificial Sequence
  Description of Artificial Sequence: Synthetic peptide
  Seed: TDMDPDNHSYF (MAGC3_HUMAN)
TGMDPDNHSYF

SEQ ID NO: 111006 - protein, 9 aa, Artificial Sequence
  Description of Artificial Sequence: Synthetic peptide
  Seed: MLLPCHWVL (MAGC3_HUMAN)
MFLPCHWVI

SEQ ID NO: 111007 - protein, 10 aa, Artificial Sequence
  Description of Artificial Sequence: Synthetic peptide
  Seed: EKVAELVQFL (MAGC3_HUMAN)
EDVAELVQFI

SEQ ID NO: 111008 - protein, 9 aa, Artificial Sequence
  Description of Artificial Sequence: Synthetic peptide
  Seed: MASASPSVM (MAGC3_HUMAN)
MQSASPSVI

SEQ ID NO: 111009 - protein, 9 aa, Artificial Sequence
  Description of Artificial Sequence: Synthetic peptide
  Seed: VIKKYKDYF (MAGC3_HUMAN)
VVKKYKDYY

SEQ ID NO: 111010 - protein, 9 aa, Artificial Sequence
  Description of Artificial Sequence: Synthetic peptide
  Seed: IIPSAFPSW (MAGC3_HUMAN)
IQPSAFPSW

SEQ ID NO: 111011 - protein, 10 aa, Artificial Sequence
  Description of Artificial Sequence: Synthetic peptide
  Seed: TAMASASPSV (MAGC3_HUMAN)
TLMASASPSA

SEQ ID NO: 111012 - protein, 9 aa, Artificial Sequence
  Description of Artificial Sequence: Synthetic peptide
  Seed: IELIFGIAL (MAGC3_HUMAN)
IELIFGIAP

SEQ ID NO: 111013 - protein, 10 aa, Artificial Sequence
  Description of Artificial Sequence: Synthetic peptide
  Seed: LTEASPQQKK (MAGC3_HUMAN)
LLEASPQQKY

SEQ ID NO: 111014 - protein, 10 aa, Artificial Sequence
  Description of Artificial Sequence: Synthetic peptide
  Seed: DMPAAGMPPL (MAGC3_HUMAN)
DTPAAGMPPV

SEQ ID NO: 111015 - protein, 8 aa, Artificial Sequence
  Description of Artificial Sequence: Synthetic peptide
  Seed: KVDKLVQF (MAGC3_HUMAN)
KVDKLVQL

SEQ ID NO: 111016 - protein, 10 aa, Artificial Sequence
  Description of Artificial Sequence: Synthetic peptide
  Seed: MQMNVINTYT (MAGC3_HUMAN)
MFMNVINTYI

SEQ ID NO: 111017 - protein, 9 aa, Artificial Sequence
  Description of Artificial Sequence: Synthetic peptide
  Seed: SLPAVSPGK (MAGC3_HUMAN)
SAPAVSPGF

SEQ ID NO: 111018 - protein, 9 aa, Artificial Sequence
  Description of Artificial Sequence: Synthetic peptide
  Seed: NAIGPWSAL (MAGC3_HUMAN)
NQIGPWSAM

SEQ ID NO: 111019 - protein, 11 aa, Artificial Sequence
  Description of Artificial Sequence: Synthetic peptide
  Seed: LSKLSSIIPSA (MAGC3_HUMAN)
LPKLSSIIPSI

SEQ ID NO: 111020 - protein, 10 aa, Artificial Sequence
  Description of Artificial Sequence: Synthetic peptide
  Seed: AMASASPSVM (MAGC3_HUMAN)
AVASASPSVY

SEQ ID NO: 111021 - protein, 10 aa, Artificial Sequence
  Description of Artificial Sequence: Synthetic peptide
  Seed: LLKYQAKEPL (MAGC3_HUMAN)
LYKYQAKEPY

SEQ ID NO: 111022 - protein, 10 aa, Artificial Sequence
  Description of Artificial Sequence: Synthetic peptide
  Seed: EVIWEVLSAI (MAGC3_HUMAN)
EVIWEVLSAR

SEQ ID NO: 111023 - protein, 9 aa, Artificial Sequence
  Description of Artificial Sequence: Synthetic peptide
  Seed: FGSQPEGKF (MAGC3_HUMAN)
FPSQPEGKY

SEQ ID NO: 111024 - protein, 9 aa, Artificial Sequence
  Description of Artificial Sequence: Synthetic peptide
  Seed: MPKNCLLIL (MAGC3_HUMAN)
MMKNCLLIL

SEQ ID NO: 111025 - protein, 9 aa, Artificial Sequence
  Description of Artificial Sequence: Synthetic peptide
  Seed: RGTGYTLSL (MAGC3_HUMAN)
RFTGYTLSF

SEQ ID NO: 111026 - protein, 9 aa, Artificial Sequence
  Description of Artificial Sequence: Synthetic peptide
  Seed: NVINTYTGY (MAGC3_HUMAN)
NQINTYTGF

SEQ ID NO: 111027 - protein, 9 aa, Artificial Sequence
  Description of Artificial Sequence: Synthetic peptide
  Seed: ISPQGPPQS (MAGC3_HUMAN)
IGPQGPPQL

SEQ ID NO: 111028 - protein, 9 aa, Artificial Sequence
  Description of Artificial Sequence: Synthetic peptide
  Seed: VLPPQPQPR (MAGC3_HUMAN)
VGPPQPQPY

SEQ ID NO: 111029 - protein, 9 aa, Artificial Sequence
  Description of Artificial Sequence: Synthetic peptide
  Seed: AIGPIQRPA (MAGC3_HUMAN)
AMGPIQRPL

SEQ ID NO: 111030 - protein, 9 aa, Artificial Sequence
  Description of Artificial Sequence: Synthetic peptide
  Seed: FLLLKYQTK (MAGC3_HUMAN)
FTLLKYQTK

SEQ ID NO: 111031 - protein, 9 aa, Artificial Sequence
  Description of Artificial Sequence: Synthetic peptide
  Seed: KLSSIIPSA (MAGC3_HUMAN)
KQSSIIPSL

SEQ ID NO: 111032 - protein, 9 aa, Artificial Sequence
  Description of Artificial Sequence: Synthetic peptide
  Seed: MIFGKAHEF (MAGC3_HUMAN)
MMFGKAHEV

SEQ ID NO: 111033 - protein, 9 aa, Artificial Sequence
  Description of Artificial Sequence: Synthetic peptide
  Seed: MIFRKAREF (MAGC3_HUMAN)
MYFRKAREF

SEQ ID NO: 111034 - protein, 9 aa, Artificial Sequence
  Description of Artificial Sequence: Synthetic peptide
  Seed: FPSWYMDAL (MAGC3_HUMAN)
FPSWYMDAA

SEQ ID NO: 111035 - protein, 9 aa, Artificial Sequence
  Description of Artificial Sequence: Synthetic peptide
  Seed: FSLRRAVSV (MAGC3_HUMAN)
FTLRRAVSW

SEQ ID NO: 111036 - protein, 9 aa, Artificial Sequence
  Description of Artificial Sequence: Synthetic peptide
  Seed: HSYFFEDTL (MAGC3_HUMAN)
HMYFFEDTF

SEQ ID NO: 111037 - protein, 9 aa, Artificial Sequence
  Description of Artificial Sequence: Synthetic peptide
  Seed: KAHEFIELI (MAGC3_HUMAN)
KMHEFIELS

SEQ ID NO: 111038 - protein, 10 aa, Artificial Sequence
  Description of Artificial Sequence: Synthetic peptide
  Seed: MQMNVINTYT (MAGC3_HUMAN)
MDMNVINTYF

SEQ ID NO: 111039 - protein, 10 aa, Artificial Sequence
  Description of Artificial Sequence: Synthetic peptide
  Seed: MDSLVLCPTY (MAGC3_HUMAN)
MISLVLCPTW

SEQ ID NO: 111040 - protein, 10 aa, Artificial Sequence
  Description of Artificial Sequence: Synthetic peptide
  Seed: SLTEVDPDHF (MAGC3_HUMAN)
SQTEVDPDHL

SEQ ID NO: 111041 - protein, 11 aa, Artificial Sequence
  Description of Artificial Sequence: Synthetic peptide
  Seed: ILFGISLTEVD (MAGC3_HUMAN)
IMFGISLTEVR

SEQ ID NO: 111042 - protein, 10 aa, Artificial Sequence
  Description of Artificial Sequence: Synthetic peptide
  Seed: MQMNVINTYT (MAGC3_HUMAN)
MVMNVINTYI

SEQ ID NO: 111043 - protein, 9 aa, Artificial Sequence
  Description of Artificial Sequence: Synthetic peptide
  Seed: FSDGSLGQW (MAGC3_HUMAN)
FYDGSLGQF

SEQ ID NO: 111044 - protein, 9 aa, Artificial Sequence
  Description of Artificial Sequence: Synthetic peptide
  Seed: YTGYFPMIF (MAGC3_HUMAN)
YAGYFPMIY

SEQ ID NO: 111045 - protein, 11 aa, Artificial Sequence
  Description of Artificial Sequence: Synthetic peptide
  Seed: ALWESEGPEAF (MAGC3_HUMAN)
AYWESEGPEAY

SEQ ID NO: 111046 - protein, 9 aa, Artificial Sequence
  Description of Artificial Sequence: Synthetic peptide
  Seed: HSYFFEDTL (MAGC3_HUMAN)
HHYFFEDTV

SEQ ID NO: 111047 - protein, 8 aa, Artificial Sequence
  Description of Artificial Sequence: Synthetic peptide
  Seed: YMDALKDM (MAGC3_HUMAN)
YADALKDI

SEQ ID NO: 111048 - protein, 9 aa, Artificial Sequence
  Description of Artificial Sequence: Synthetic peptide
  Seed: KVAELVQFL (MAGC3_HUMAN)
KTAELVQFA

SEQ ID NO: 111049 - protein, 8 aa, Artificial Sequence
  Description of Artificial Sequence: Synthetic peptide
  Seed: LPQSPPEI (MAGC3_HUMAN)
LPQSPPEL

SEQ ID NO: 111050 - protein, 9 aa, Artificial Sequence
  Description of Artificial Sequence: Synthetic peptide
  Seed: ATYALSPVV (MAGC3_HUMAN)
AMYALSPVL

SEQ ID NO: 111051 - protein, 9 aa, Artificial Sequence
  Description of Artificial Sequence: Synthetic peptide
  Seed: FSLRRAVSV (MAGC3_HUMAN)
FMLRRAVSA

SEQ ID NO: 111052 - protein, 11 aa, Artificial Sequence
  Description of Artificial Sequence: Synthetic peptide
  Seed: YALDEKVAELV (MAGC3_HUMAN)
YMLDEKVAELG

SEQ ID NO: 111053 - protein, 10 aa, Artificial Sequence
  Description of Artificial Sequence: Synthetic peptide
  Seed: SCSSPLLWTR (MAGC3_HUMAN)
SVSSPLLWTK

SEQ ID NO: 111054 - protein, 11 aa, Artificial Sequence
  Description of Artificial Sequence: Synthetic peptide
  Seed: ATAMASASPSV (MAGC3_HUMAN)
AEAMASASPSV

SEQ ID NO: 111055 - protein, 9 aa, Artificial Sequence
  Description of Artificial Sequence: Synthetic peptide
  Seed: HFYVFVNTL (MAGC3_HUMAN)
HFYVFVNTW

SEQ ID NO: 111056 - protein, 9 aa, Artificial Sequence
  Description of Artificial Sequence: Synthetic peptide
  Seed: CEESGLRSA (MAGC3_HUMAN)
CEESGLRSV

SEQ ID NO: 111057 - protein, 10 aa, Artificial Sequence
  Description of Artificial Sequence: Synthetic peptide
  Seed: KLVQFLLLKY (MAGC3_HUMAN)
KLVQFLLLKR

SEQ ID NO: 111058 - protein, 9 aa, Artificial Sequence
  Description of Artificial Sequence: Synthetic peptide
  Seed: KVAELVQFL (MAGC3_HUMAN)
KAAELVQFW

SEQ ID NO: 111059 - protein, 9 aa, Artificial Sequence
  Description of Artificial Sequence: Synthetic peptide
  Seed: HALPESESL (MAGC3_HUMAN)
HSLPESESV

SEQ ID NO: 111060 - protein, 9 aa, Artificial Sequence
  Description of Artificial Sequence: Synthetic peptide
  Seed: VIWEVLSAI (MAGC3_HUMAN)
VMWEVLSAL

SEQ ID NO: 111061 - protein, 9 aa, Artificial Sequence
  Description of Artificial Sequence: Synthetic peptide
  Seed: NTYTGYFPM (MAGC3_HUMAN)
NTYTGYFPY

SEQ ID NO: 111062 - protein, 9 aa, Artificial Sequence
  Description of Artificial Sequence: Synthetic peptide
  Seed: YFFEDTLDL (MAGC3_HUMAN)
YPFEDTLDT

SEQ ID NO: 111063 - protein, 9 aa, Artificial Sequence
  Description of Artificial Sequence: Synthetic peptide
  Seed: KLVQFLLLK (MAGC3_HUMAN)
KTVQFLLLF

SEQ ID NO: 111064 - protein, 10 aa, Artificial Sequence
  Description of Artificial Sequence: Synthetic peptide
  Seed: FFEDTLDLTY (MAGC3_HUMAN)
FIEDTLDLTY

SEQ ID NO: 111065 - protein, 10 aa, Artificial Sequence
  Description of Artificial Sequence: Synthetic peptide
  Seed: YALDEKVAEL (MAGC3_HUMAN)
YRLDEKVAET

SEQ ID NO: 111066 - protein, 9 aa, Artificial Sequence
  Description of Artificial Sequence: Synthetic peptide
  Seed: GKAHEFIEL (MAGC3_HUMAN)
GKAHEFIEY

SEQ ID NO: 111067 - protein, 10 aa, Artificial Sequence
  Description of Artificial Sequence: Synthetic peptide
  Seed: IELIFGIALT (MAGC3_HUMAN)
IPLIFGIALL

SEQ ID NO: 111068 - protein, 9 aa, Artificial Sequence
  Description of Artificial Sequence: Synthetic peptide
  Seed: SASPSVMST (MAGC3_HUMAN)
SFSPSVMSF

SEQ ID NO: 111069 - protein, 9 aa, Artificial Sequence
  Description of Artificial Sequence: Synthetic peptide
  Seed: FKLWRTLSG (MAGC3_HUMAN)
FMLWRTLSM

SEQ ID NO: 111070 - protein, 9 aa, Artificial Sequence
  Description of Artificial Sequence: Synthetic peptide
  Seed: MLTTVIKKY (MAGC3_HUMAN)
MTTTVIKKW

SEQ ID NO: 111071 - protein, 9 aa, Artificial Sequence
  Description of Artificial Sequence: Synthetic peptide
  Seed: TKAEMLTTV (MAGC3_HUMAN)
TRAEMLTTF

SEQ ID NO: 111072 - protein, 9 aa, Artificial Sequence
  Description of Artificial Sequence: Synthetic peptide
  Seed: RTLSGSPGL (MAGC3_HUMAN)
RVLSGSPGW

SEQ ID NO: 111073 - protein, 9 aa, Artificial Sequence
  Description of Artificial Sequence: Synthetic peptide
  Seed: SAFHLGHLR (MAGC3_HUMAN)
STFHLGHLL

SEQ ID NO: 111074 - protein, 9 aa, Artificial Sequence
  Description of Artificial Sequence: Synthetic peptide
  Seed: KYKDYFPMI (MAGC3_HUMAN)
KSKDYFPMI

SEQ ID NO: 111075 - protein, 10 aa, Artificial Sequence
  Description of Artificial Sequence: Synthetic peptide
  Seed: EIPPQGPPKI (MAGC3_HUMAN)
ETPPQGPPKR

SEQ ID NO: 111076 - protein, 9 aa, Artificial Sequence
  Description of Artificial Sequence: Synthetic peptide
  Seed: MDPDNHSYF (MAGC3_HUMAN)
MSPDNHSYL

SEQ ID NO: 111077 - protein, 9 aa, Artificial Sequence
  Description of Artificial Sequence: Synthetic peptide
  Seed: GEKAGSLPE (MAGC3_HUMAN)
GEKAGSLPV

SEQ ID NO: 111078 - protein, 11 aa, Artificial Sequence
  Description of Artificial Sequence: Synthetic peptide
  Seed: INTYTGYFPMI (MAGC3_HUMAN)
IYTYTGYFPMI

SEQ ID NO: 111079 - protein, 9 aa, Artificial Sequence
  Description of Artificial Sequence: Synthetic peptide
  Seed: KVDKLVQFL (MAGC3_HUMAN)
KVDKLVQFI

SEQ ID NO: 111080 - protein, 10 aa, Artificial Sequence
  Description of Artificial Sequence: Synthetic peptide
  Seed: KVDKLVQFLL (MAGC3_HUMAN)
KTDKLVQFLK

SEQ ID NO: 111081 - protein, 10 aa, Artificial Sequence
  Description of Artificial Sequence: Synthetic peptide
  Seed: REVLEFLSKL (MAGC3_HUMAN)
RMVLEFLSKA

SEQ ID NO: 111082 - protein, 9 aa, Artificial Sequence
  Description of Artificial Sequence: Synthetic peptide
  Seed: YSAFHLGHL (MAGC3_HUMAN)
YQAFHLGHY

SEQ ID NO: 111083 - protein, 9 aa, Artificial Sequence
  Description of Artificial Sequence: Synthetic peptide
  Seed: NTYTGYFPM (MAGC3_HUMAN)
NVYTGYFPV

SEQ ID NO: 111084 - protein, 9 aa, Artificial Sequence
  Description of Artificial Sequence: Synthetic peptide
  Seed: YKDYFPMIF (MAGC3_HUMAN)
YTDYFPMIY

SEQ ID NO: 111085 - protein, 9 aa, Artificial Sequence
  Description of Artificial Sequence: Synthetic peptide
  Seed: FPSWYMDAL (MAGC3_HUMAN)
FPSWYMDAN

SEQ ID NO: 111086 - protein, 9 aa, Artificial Sequence
  Description of Artificial Sequence: Synthetic peptide
  Seed: KLVQFLLLK (MAGC3_HUMAN)
KGVQFLLLY

SEQ ID NO: 111087 - protein, 9 aa, Artificial Sequence
  Description of Artificial Sequence: Synthetic peptide
  Seed: LSDLHFGSQ (MAGC3_HUMAN)
LVDLHFGSY

SEQ ID NO: 111088 - protein, 10 aa, Artificial Sequence
  Description of Artificial Sequence: Synthetic peptide
  Seed: IPSAFPSWYM (MAGC3_HUMAN)
IGSAFPSWYF

SEQ ID NO: 111089 - protein, 10 aa, Artificial Sequence
  Description of Artificial Sequence: Synthetic peptide
  Seed: YALDEKVAEL (MAGC3_HUMAN)
YMLDEKVAEV

SEQ ID NO: 111090 - protein, 9 aa, Artificial Sequence
  Description of Artificial Sequence: Synthetic peptide
  Seed: RGTGYTLSL (MAGC3_HUMAN)
RQTGYTLSH

SEQ ID NO: 111091 - protein, 10 aa, Artificial Sequence
  Description of Artificial Sequence: Synthetic peptide
  Seed: FKLWRTLSGS (MAGC3_HUMAN)
FTLWRTLSGA

SEQ ID NO: 111092 - protein, 9 aa, Artificial Sequence
  Description of Artificial Sequence: Synthetic peptide
  Seed: GFADVLSRL (MAGC3_HUMAN)
GYADVLSRL

SEQ ID NO: 111093 - protein, 9 aa, Artificial Sequence
  Description of Artificial Sequence: Synthetic peptide
  Seed: HFYVFVNTL (MAGC3_HUMAN)
HSYVFVNTY

SEQ ID NO: 111094 - protein, 9 aa, Artificial Sequence
  Description of Artificial Sequence: Synthetic peptide
  Seed: YALDEKVAE (MAGC3_HUMAN)
YVLDEKVAM

SEQ ID NO: 111095 - protein, 9 aa, Artificial Sequence
  Description of Artificial Sequence: Synthetic peptide
  Seed: VIWEVLSAI (MAGC3_HUMAN)
VSWEVLSAL

SEQ ID NO: 111096 - protein, 9 aa, Artificial Sequence
  Description of Artificial Sequence: Synthetic peptide
  Seed: ALDEKVAEL (MAGC3_HUMAN)
AVDEKVAEV

SEQ ID NO: 111097 - protein, 8 aa, Artificial Sequence
  Description of Artificial Sequence: Synthetic peptide
  Seed: YALSPVVL (MAGC3_HUMAN)
YALSPVVM

SEQ ID NO: 111098 - protein, 9 aa, Artificial Sequence
  Description of Artificial Sequence: Synthetic peptide
  Seed: MQMNVINTY (MAGC3_HUMAN)
MSMNVINTH

SEQ ID NO: 111099 - protein, 10 aa, Artificial Sequence
  Description of Artificial Sequence: Synthetic peptide
  Seed: YSAFHLGHLR (MAGC3_HUMAN)
YLAFHLGHLK

SEQ ID NO: 111100 - protein, 9 aa, Artificial Sequence
  Description of Artificial Sequence: Synthetic peptide
  Seed: RTLSGSPGL (MAGC3_HUMAN)
RALSGSPGI

SEQ ID NO: 111101 - protein, 11 aa, Artificial Sequence
  Description of Artificial Sequence: Synthetic peptide
  Seed: TAMASASPSVM (MAGC3_HUMAN)
TKMASASPSVF

SEQ ID NO: 111102 - protein, 9 aa, Artificial Sequence
  Description of Artificial Sequence: Synthetic peptide
  Seed: MIFRKAREF (MAGC3_HUMAN)
MWFRKAREM

SEQ ID NO: 111103 - protein, 9 aa, Artificial Sequence
  Description of Artificial Sequence: Synthetic peptide
  Seed: VDPDHFYVF (MAGC3_HUMAN)
VRPDHFYVI

SEQ ID NO: 111104 - protein, 10 aa, Artificial Sequence
  Description of Artificial Sequence: Synthetic peptide
  Seed: EMQMNVINTY (MAGC3_HUMAN)
ELQMNVINTF

SEQ ID NO: 111105 - protein, 9 aa, Artificial Sequence
  Description of Artificial Sequence: Synthetic peptide
  Seed: SLGQWVKNT (MAGC3_HUMAN)
SLGQWVKNA

SEQ ID NO: 111106 - protein, 9 aa, Artificial Sequence
  Description of Artificial Sequence: Synthetic peptide
  Seed: MQMNVINTY (MAGC3_HUMAN)
MGMNVINTL

SEQ ID NO: 111107 - protein, 10 aa, Artificial Sequence
  Description of Artificial Sequence: Synthetic peptide
  Seed: RPAREVLEFL (MAGC3_HUMAN)
RMAREVLEFA

SEQ ID NO: 111108 - protein, 9 aa, Artificial Sequence
  Description of Artificial Sequence: Synthetic peptide
  Seed: YQAKEPLTR (MAGC3_HUMAN)
YLAKEPLTF

SEQ ID NO: 111109 - protein, 9 aa, Artificial Sequence
  Description of Artificial Sequence: Synthetic peptide
  Seed: DYSAFHLGH (MAGC3_HUMAN)
DYSAFHLGR

SEQ ID NO: 111110 - protein, 9 aa, Artificial Sequence
  Description of Artificial Sequence: Synthetic peptide
  Seed: AELVQFLLL (MAGC3_HUMAN)
AELVQFLLV

SEQ ID NO: 111111 - protein, 11 aa, Artificial Sequence
  Description of Artificial Sequence: Synthetic peptide
  Seed: FIELIFGIALT (MAGC3_HUMAN)
FNELIFGIALI

SEQ ID NO: 111112 - protein, 10 aa, Artificial Sequence
  Description of Artificial Sequence: Synthetic peptide
  Seed: KDYFPMIFGK (MAGC3_HUMAN)
KRYFPMIFGK

SEQ ID NO: 111113 - protein, 10 aa, Artificial Sequence
  Description of Artificial Sequence: Synthetic peptide
  Seed: KKYKDYFPMI (MAGC3_HUMAN)
KMYKDYFPMF

SEQ ID NO: 111114 - protein, 11 aa, Artificial Sequence
  Description of Artificial Sequence: Synthetic peptide
  Seed: LDSCSSPLLWT (MAGC3_HUMAN)
LSSCSSPLLWK

SEQ ID NO: 111115 - protein, 11 aa, Artificial Sequence
  Description of Artificial Sequence: Synthetic peptide
  Seed: YFFEDTLDLTY (MAGC3_HUMAN)
YMFEDTLDLTF

SEQ ID NO: 111116 - protein, 9 aa, Artificial Sequence
  Description of Artificial Sequence: Synthetic peptide
  Seed: VIWEVLNAI (MAGC3_HUMAN)
VQWEVLNAT

SEQ ID NO: 111117 - protein, 9 aa, Artificial Sequence
  Description of Artificial Sequence: Synthetic peptide
  Seed: AELVQFLLL (MAGC3_HUMAN)
AQLVQFLLI

SEQ ID NO: 111118 - protein, 9 aa, Artificial Sequence
  Description of Artificial Sequence: Synthetic peptide
  Seed: VIWEVLSAI (MAGC3_HUMAN)
VTWEVLSAA

SEQ ID NO: 111119 - protein, 10 aa, Artificial Sequence
  Description of Artificial Sequence: Synthetic peptide
  Seed: FFEDTLDLTY (MAGC3_HUMAN)
FMEDTLDLTL

SEQ ID NO: 111120 - protein, 10 aa, Artificial Sequence
  Description of Artificial Sequence: Synthetic peptide
  Seed: EFLSKLSSII (MAGC3_HUMAN)
EYLSKLSSIL

SEQ ID NO: 111121 - protein, 9 aa, Artificial Sequence
  Description of Artificial Sequence: Synthetic peptide
  Seed: HLREVRLFL (MAGC3_HUMAN)
HVREVRLFY

SEQ ID NO: 111122 - protein, 9 aa, Artificial Sequence
  Description of Artificial Sequence: Synthetic peptide
  Seed: MASASPSVM (MAGC3_HUMAN)
MYSASPSVI

SEQ ID NO: 111123 - protein, 9 aa, Artificial Sequence
  Description of Artificial Sequence: Synthetic peptide
  Seed: ALDEKVAEL (MAGC3_HUMAN)
AWDEKVAEC

SEQ ID NO: 111124 - protein, 10 aa, Artificial Sequence
  Description of Artificial Sequence: Synthetic peptide
  Seed: LLKYQAKEPL (MAGC3_HUMAN)
LNKYQAKEPY

SEQ ID NO: 111125 - protein, 11 aa, Artificial Sequence
  Description of Artificial Sequence: Synthetic peptide
  Seed: GSQPEGKFSLR (MAGC3_HUMAN)
GVQPEGKFSLR

SEQ ID NO: 111126 - protein, 9 aa, Artificial Sequence
  Description of Artificial Sequence: Synthetic peptide
  Seed: SLVLCPTYF (MAGC3_HUMAN)
STVLCPTYF

SEQ ID NO: 111127 - protein, 9 aa, Artificial Sequence
  Description of Artificial Sequence: Synthetic peptide
  Seed: TKAEMLTTV (MAGC3_HUMAN)
TRAEMLTTI

SEQ ID NO: 111128 - protein, 9 aa, Artificial Sequence
  Description of Artificial Sequence: Synthetic peptide
  Seed: YKDYFPMIF (MAGC3_HUMAN)
YVDYFPMIY

SEQ ID NO: 111129 - protein, 9 aa, Artificial Sequence
  Description of Artificial Sequence: Synthetic peptide
  Seed: SALAGFADV (MAGC3_HUMAN)
SLLAGFADL

SEQ ID NO: 111130 - protein, 9 aa, Artificial Sequence
  Description of Artificial Sequence: Synthetic peptide
  Seed: IPPQGPPKI (MAGC3_HUMAN)
ILPQGPPKF

SEQ ID NO: 111131 - protein, 9 aa, Artificial Sequence
  Description of Artificial Sequence: Synthetic peptide
  Seed: DVLSRLALW (MAGC3_HUMAN)
DILSRLALY

SEQ ID NO: 111132 - protein, 10 aa, Artificial Sequence
  Description of Artificial Sequence: Synthetic peptide
  Seed: MDPDNHSYFF (MAGC3_HUMAN)
MGPDNHSYFY

SEQ ID NO: 111133 - protein, 9 aa, Artificial Sequence
  Description of Artificial Sequence: Synthetic peptide
  Seed: FSDGSLGQW (MAGC3_HUMAN)
FSDGSLGQF

SEQ ID NO: 111134 - protein, 9 aa, Artificial Sequence
  Description of Artificial Sequence: Synthetic peptide
  Seed: FSDGSLGQW (MAGC3_HUMAN)
FQDGSLGQW

SEQ ID NO: 111135 - protein, 9 aa, Artificial Sequence
  Description of Artificial Sequence: Synthetic peptide
  Seed: FPSWYMDAL (MAGC3_HUMAN)
FISWYMDAM

SEQ ID NO: 111136 - protein, 10 aa, Artificial Sequence
  Description of Artificial Sequence: Synthetic peptide
  Seed: FKLWRTLSGS (MAGC3_HUMAN)
FLLWRTLSGT

SEQ ID NO: 111137 - protein, 9 aa, Artificial Sequence
  Description of Artificial Sequence: Synthetic peptide
  Seed: AVSPGKRLW (MAGC3_HUMAN)
AASPGKRLI

SEQ ID NO: 111138 - protein, 9 aa, Artificial Sequence
  Description of Artificial Sequence: Synthetic peptide
  Seed: MLTTVIKKY (MAGC3_HUMAN)
MATTVIKKL

SEQ ID NO: 111139 - protein, 9 aa, Artificial Sequence
  Description of Artificial Sequence: Synthetic peptide
  Seed: LKYQAKEPL (MAGC3_HUMAN)
LLYQAKEPF

SEQ ID NO: 111140 - protein, 9 aa, Artificial Sequence
  Description of Artificial Sequence: Synthetic peptide
  Seed: VIWEVLNAI (MAGC3_HUMAN)
VIWEVLNAW

SEQ ID NO: 111141 - protein, 9 aa, Artificial Sequence
  Description of Artificial Sequence: Synthetic peptide
  Seed: SLRRAVSVK (MAGC3_HUMAN)
SVRRAVSVI

SEQ ID NO: 111142 - protein, 9 aa, Artificial Sequence
  Description of Artificial Sequence: Synthetic peptide
  Seed: LSAIGPIQR (MAGC3_HUMAN)
LSAIGPIQL

SEQ ID NO: 111143 - protein, 9 aa, Artificial Sequence
  Description of Artificial Sequence: Synthetic peptide
  Seed: KAHEFIELI (MAGC3_HUMAN)
KMHEFIELL

SEQ ID NO: 111144 - protein, 10 aa, Artificial Sequence
  Description of Artificial Sequence: Synthetic peptide
  Seed: LPTWRRGTGY (MAGC3_HUMAN)
LGTWRRGTGF

SEQ ID NO: 111145 - protein, 9 aa, Artificial Sequence
  Description of Artificial Sequence: Synthetic peptide
  Seed: SQPEGKFSL (MAGC3_HUMAN)
SLPEGKFSL

SEQ ID NO: 111146 - protein, 11 aa, Artificial Sequence
  Description of Artificial Sequence: Synthetic peptide
  Seed: TSDQRMDSLVL (MAGC3_HUMAN)
TTDQRMDSLVF

SEQ ID NO: 111147 - protein, 11 aa, Artificial Sequence
  Description of Artificial Sequence: Synthetic peptide
  Seed: HALPESESLPR (MAGC3_HUMAN)
HYLPESESLPR

SEQ ID NO: 111148 - protein, 8 aa, Artificial Sequence
  Description of Artificial Sequence: Synthetic peptide
  Seed: QAKEPLTR (MAGC3_HUMAN)
QAKEPLTY

SEQ ID NO: 111149 - protein, 10 aa, Artificial Sequence
  Description of Artificial Sequence: Synthetic peptide
  Seed: KDYFPMIFGK (MAGC3_HUMAN)
KKYFPMIFGK

SEQ ID NO: 111150 - protein, 9 aa, Artificial Sequence
  Description of Artificial Sequence: Synthetic peptide
  Seed: MQMNVINTY (MAGC3_HUMAN)
MEMNVINTM

SEQ ID NO: 111151 - protein, 9 aa, Artificial Sequence
  Description of Artificial Sequence: Synthetic peptide
  Seed: IPPQGPPKI (MAGC3_HUMAN)
IAPQGPPKY

SEQ ID NO: 111152 - protein, 9 aa, Artificial Sequence
  Description of Artificial Sequence: Synthetic peptide
  Seed: MASASPSVM (MAGC3_HUMAN)
MVSASPSVF

SEQ ID NO: 111153 - protein, 9 aa, Artificial Sequence
  Description of Artificial Sequence: Synthetic peptide
  Seed: KGSCVPEEV (MAGC3_HUMAN)
KSSCVPEEV

SEQ ID NO: 111154 - protein, 9 aa, Artificial Sequence
  Description of Artificial Sequence: Synthetic peptide
  Seed: YQAKEPLTR (MAGC3_HUMAN)
YKAKEPLTY

SEQ ID NO: 111155 - protein, 9 aa, Artificial Sequence
  Description of Artificial Sequence: Synthetic peptide
  Seed: MASASPSVM (MAGC3_HUMAN)
MVSASPSVW

SEQ ID NO: 111156 - protein, 9 aa, Artificial Sequence
  Description of Artificial Sequence: Synthetic peptide
  Seed: MQMNVINTY (MAGC3_HUMAN)
MRMNVINTM

SEQ ID NO: 111157 - protein, 11 aa, Artificial Sequence
  Description of Artificial Sequence: Synthetic peptide
  Seed: TEVDPDHFYVF (MAGC3_HUMAN)
TQVDPDHFYVF

SEQ ID NO: 111158 - protein, 10 aa, Artificial Sequence
  Description of Artificial Sequence: Synthetic peptide
  Seed: LIFGIALTDM (MAGC3_HUMAN)
LLFGIALTDL

SEQ ID NO: 111159 - protein, 9 aa, Artificial Sequence
  Description of Artificial Sequence: Synthetic peptide
  Seed: QTKEPVTKA (MAGC3_HUMAN)
QAKEPVTKF

SEQ ID NO: 111160 - protein, 10 aa, Artificial Sequence
  Description of Artificial Sequence: Synthetic peptide
  Seed: ATFSDGSLGQ (MAGC3_HUMAN)
AVFSDGSLGR

SEQ ID NO: 111161 - protein, 11 aa, Artificial Sequence
  Description of Artificial Sequence: Synthetic peptide
  Seed: TTDDATAMASA (MAGC3_HUMAN)
TIDDATAMASY

SEQ ID NO: 111162 - protein, 9 aa, Artificial Sequence
  Description of Artificial Sequence: Synthetic peptide
  Seed: KLSSIIPSA (MAGC3_HUMAN)
KTSSIIPSI

SEQ ID NO: 111163 - protein, 9 aa, Artificial Sequence
  Description of Artificial Sequence: Synthetic peptide
  Seed: KLVQFLLLK (MAGC3_HUMAN)
KWVQFLLLY

SEQ ID NO: 111164 - protein, 11 aa, Artificial Sequence
  Description of Artificial Sequence: Synthetic peptide
  Seed: YFFEDTLDLTY (MAGC3_HUMAN)
YPFEDTLDLTH

SEQ ID NO: 111165 - protein, 10 aa, Artificial Sequence
  Description of Artificial Sequence: Synthetic peptide
  Seed: KLSSIIPSAF (MAGC3_HUMAN)
KFSSIIPSAF

SEQ ID NO: 111166 - protein, 9 aa, Artificial Sequence
  Description of Artificial Sequence: Synthetic peptide
  Seed: WESEGPEAF (MAGC3_HUMAN)
WKSEGPEAF

SEQ ID NO: 111167 - protein, 9 aa, Artificial Sequence
  Description of Artificial Sequence: Synthetic peptide
  Seed: ATYALSPVV (MAGC3_HUMAN)
AVYALSPVF

SEQ ID NO: 111168 - protein, 9 aa, Artificial Sequence
  Description of Artificial Sequence: Synthetic peptide
  Seed: MDPDNHSYF (MAGC3_HUMAN)
MNPDNHSYL

SEQ ID NO: 111169 - protein, 10 aa, Artificial Sequence
  Description of Artificial Sequence: Synthetic peptide
  Seed: YALDEKVAEL (MAGC3_HUMAN)
YCLDEKVAEC

SEQ ID NO: 111170 - protein, 10 aa, Artificial Sequence
  Description of Artificial Sequence: Synthetic peptide
  Seed: MLLPCHWVLD (MAGC3_HUMAN)
MILPCHWVLI

SEQ ID NO: 111171 - protein, 11 aa, Artificial Sequence
  Description of Artificial Sequence: Synthetic peptide
  Seed: IIDTTDDATAM (MAGC3_HUMAN)
IADTTDDATAM

SEQ ID NO: 111172 - protein, 11 aa, Artificial Sequence
  Description of Artificial Sequence: Synthetic peptide
  Seed: SASPSVMSTNF (MAGC3_HUMAN)
STSPSVMSTNW

SEQ ID NO: 111173 - protein, 9 aa, Artificial Sequence
  Description of Artificial Sequence: Synthetic peptide
  Seed: MIFRKAREF (MAGC3_HUMAN)
MNFRKAREY

SEQ ID NO: 111174 - protein, 9 aa, Artificial Sequence
  Description of Artificial Sequence: Synthetic peptide
  Seed: KLVQFLLLK (MAGC3_HUMAN)
KNVQFLLLR

SEQ ID NO: 111175 - protein, 10 aa, Artificial Sequence
  Description of Artificial Sequence: Synthetic peptide
  Seed: MPQNRLLILI (MAGC3_HUMAN)
MPQNRLLILA

SEQ ID NO: 111176 - protein, 9 aa, Artificial Sequence
  Description of Artificial Sequence: Synthetic peptide
  Seed: ATYALSPVV (MAGC3_HUMAN)
AIYALSPVW

SEQ ID NO: 111177 - protein, 11 aa, Artificial Sequence
  Description of Artificial Sequence: Synthetic peptide
  Seed: MLLPCHWVLDA (MAGC3_HUMAN)
MMLPCHWVLDV

SEQ ID NO: 111178 - protein, 10 aa, Artificial Sequence
  Description of Artificial Sequence: Synthetic peptide
  Seed: IKKYKDYFPM (MAGC3_HUMAN)
IYKYKDYFPF

SEQ ID NO: 111179 - protein, 10 aa, Artificial Sequence
  Description of Artificial Sequence: Synthetic peptide
  Seed: YQAKEPLTRA (MAGC3_HUMAN)
YLAKEPLTRT

SEQ ID NO: 111180 - protein, 9 aa, Artificial Sequence
  Description of Artificial Sequence: Synthetic peptide
  Seed: LVQFLLLKY (MAGC3_HUMAN)
LFQFLLLKY

SEQ ID NO: 111181 - protein, 9 aa, Artificial Sequence
  Description of Artificial Sequence: Synthetic peptide
  Seed: IIDTTDDAT (MAGC3_HUMAN)
IVDTTDDAI

SEQ ID NO: 111182 - protein, 10 aa, Artificial Sequence
  Description of Artificial Sequence: Synthetic peptide
  Seed: QWVKNTCATY (MAGC3_HUMAN)
QQVKNTCATF

SEQ ID NO: 111183 - protein, 10 aa, Artificial Sequence
  Description of Artificial Sequence: Synthetic peptide
  Seed: YALDEKVAEL (MAGC3_HUMAN)
YMLDEKVAEW

SEQ ID NO: 111184 - protein, 9 aa, Artificial Sequence
  Description of Artificial Sequence: Synthetic peptide
  Seed: FEDTLDLTY (MAGC3_HUMAN)
FPDTLDLTH

SEQ ID NO: 111185 - protein, 10 aa, Artificial Sequence
  Description of Artificial Sequence: Synthetic peptide
  Seed: SLTEVDPDHF (MAGC3_HUMAN)
SMTEVDPDHF

SEQ ID NO: 111186 - protein, 9 aa, Artificial Sequence
  Description of Artificial Sequence: Synthetic peptide
  Seed: EMLTTVIKK (MAGC3_HUMAN)
EALTTVIKR

SEQ ID NO: 111187 - protein, 10 aa, Artificial Sequence
  Description of Artificial Sequence: Synthetic peptide
  Seed: EVIWEVLNAI (MAGC3_HUMAN)
EIIWEVLNAV

SEQ ID NO: 111188 - protein, 10 aa, Artificial Sequence
  Description of Artificial Sequence: Synthetic peptide
  Seed: LPTWRRGTGY (MAGC3_HUMAN)
LPTWRRGTGW

SEQ ID NO: 111189 - protein, 9 aa, Artificial Sequence
  Description of Artificial Sequence: Synthetic peptide
  Seed: LSDEQGMPQ (MAGC3_HUMAN)
LIDEQGMPI

SEQ ID NO: 111190 - protein, 10 aa, Artificial Sequence
  Description of Artificial Sequence: Synthetic peptide
  Seed: MNVINTYTGY (MAGC3_HUMAN)
MMVINTYTGM

SEQ ID NO: 111191 - protein, 8 aa, Artificial Sequence
  Description of Artificial Sequence: Synthetic peptide
  Seed: KVDKLVQF (MAGC3_HUMAN)
KADKLVQM

SEQ ID NO: 111192 - protein, 9 aa, Artificial Sequence
  Description of Artificial Sequence: Synthetic peptide
  Seed: RGTGYTLSL (MAGC3_HUMAN)
RATGYTLSY

SEQ ID NO: 111193 - protein, 9 aa, Artificial Sequence
  Description of Artificial Sequence: Synthetic peptide
  Seed: MEDRAQAII (MAGC3_HUMAN)
MSDRAQAIL

SEQ ID NO: 111194 - protein, 10 aa, Artificial Sequence
  Description of Artificial Sequence: Synthetic peptide
  Seed: MLLPCHWVLD (MAGC3_HUMAN)
MLLPCHWVLT

SEQ ID NO: 111195 - protein, 9 aa, Artificial Sequence
  Description of Artificial Sequence: Synthetic peptide
  Seed: DEQGMPQNR (MAGC3_HUMAN)
DVQGMPQNR

SEQ ID NO: 111196 - protein, 9 aa, Artificial Sequence
  Description of Artificial Sequence: Synthetic peptide
  Seed: EVLEFLSKL (MAGC3_HUMAN)
EVLEFLSKW

SEQ ID NO: 111197 - protein, 11 aa, Artificial Sequence
  Description of Artificial Sequence: Synthetic peptide
  Seed: ALWESEGPEAF (MAGC3_HUMAN)
AIWESEGPEAL

SEQ ID NO: 111198 - protein, 9 aa, Artificial Sequence
  Description of Artificial Sequence: Synthetic peptide
  Seed: KVDKLVQFL (MAGC3_HUMAN)
KEDKLVQFF

SEQ ID NO: 111199 - protein, 10 aa, Artificial Sequence
  Description of Artificial Sequence: Synthetic peptide
  Seed: SLIDDQGMPK (MAGC3_HUMAN)
SRIDDQGMPY

SEQ ID NO: 111200 - protein, 11 aa, Artificial Sequence
  Description of Artificial Sequence: Synthetic peptide
  Seed: INTYTGYFPMI (MAGC3_HUMAN)
IFTYTGYFPMF

SEQ ID NO: 111201 - protein, 8 aa, Artificial Sequence
  Description of Artificial Sequence: Synthetic peptide
  Seed: LDEKVAEL (MAGC3_HUMAN)
LSEKVAEL

SEQ ID NO: 111202 - protein, 9 aa, Artificial Sequence
  Description of Artificial Sequence: Synthetic peptide
  Seed: GSLPESEPL (MAGC3_HUMAN)
GLLPESEPL

SEQ ID NO: 111203 - protein, 9 aa, Artificial Sequence
  Description of Artificial Sequence: Synthetic peptide
  Seed: HFYVFVNTL (MAGC3_HUMAN)
HTYVFVNTV

SEQ ID NO: 111204 - protein, 8 aa, Artificial Sequence
  Description of Artificial Sequence: Synthetic peptide
  Seed: TTDDATAM (MAGC3_HUMAN)
TMDDATAV

SEQ ID NO: 111205 - protein, 10 aa, Artificial Sequence
  Description of Artificial Sequence: Synthetic peptide
  Seed: ALWESEGPEA (MAGC3_HUMAN)
ALWESEGPEI

SEQ ID NO: 111206 - protein, 11 aa, Artificial Sequence
  Description of Artificial Sequence: Synthetic peptide
  Seed: SASPSVMSTNF (MAGC3_HUMAN)
SLSPSVMSTNY

SEQ ID NO: 111207 - protein, 9 aa, Artificial Sequence
  Description of Artificial Sequence: Synthetic peptide
  Seed: TRAEMQMNV (MAGC3_HUMAN)
THAEMQMNM

SEQ ID NO: 111208 - protein, 9 aa, Artificial Sequence
  Description of Artificial Sequence: Synthetic peptide
  Seed: MLTTVIKKY (MAGC3_HUMAN)
MYTTVIKKY

SEQ ID NO: 111209 - protein, 9 aa, Artificial Sequence
  Description of Artificial Sequence: Synthetic peptide
  Seed: VPEEVIWEV (MAGC3_HUMAN)
VSEEVIWEI

SEQ ID NO: 111210 - protein, 9 aa, Artificial Sequence
  Description of Artificial Sequence: Synthetic peptide
  Seed: QLSDLHFGS (MAGC3_HUMAN)
QLSDLHFGL

SEQ ID NO: 111211 - protein, 11 aa, Artificial Sequence
  Description of Artificial Sequence: Synthetic peptide
  Seed: MPAAGMPPLPQ (MAGC3_HUMAN)
MPAAGMPPLPM

SEQ ID NO: 111212 - protein, 10 aa, Artificial Sequence
  Description of Artificial Sequence: Synthetic peptide
  Seed: SDQRMDSLVL (MAGC3_HUMAN)
STQRMDSLVM

SEQ ID NO: 111213 - protein, 10 aa, Artificial Sequence
  Description of Artificial Sequence: Synthetic peptide
  Seed: ATYALSPVVL (MAGC3_HUMAN)
ALYALSPVVV

SEQ ID NO: 111214 - protein, 9 aa, Artificial Sequence
  Description of Artificial Sequence: Synthetic peptide
  Seed: ALAGFADVL (MAGC3_HUMAN)
AVAGFADVY

SEQ ID NO: 111215 - protein, 9 aa, Artificial Sequence
  Description of Artificial Sequence: Synthetic peptide
  Seed: DEQGMPQNR (MAGC3_HUMAN)
DYQGMPQNR

SEQ ID NO: 111216 - protein, 10 aa, Artificial Sequence
  Description of Artificial Sequence: Synthetic peptide
  Seed: YALDEKVAEL (MAGC3_HUMAN)
YVLDEKVAEW

SEQ ID NO: 111217 - protein, 9 aa, Artificial Sequence
  Description of Artificial Sequence: Synthetic peptide
  Seed: VDPDHFYVF (MAGC3_HUMAN)
VAPDHFYVL

SEQ ID NO: 111218 - protein, 9 aa, Artificial Sequence
  Description of Artificial Sequence: Synthetic peptide
  Seed: EFIELIFGI (MAGC3_HUMAN)
EAIELIFGT

SEQ ID NO: 111219 - protein, 10 aa, Artificial Sequence
  Description of Artificial Sequence: Synthetic peptide
  Seed: LIFGIALTDM (MAGC3_HUMAN)
LMFGIALTDA

SEQ ID NO: 111220 - protein, 9 aa, Artificial Sequence
  Description of Artificial Sequence: Synthetic peptide
  Seed: FSLRRAVSV (MAGC3_HUMAN)
FILRRAVSM

SEQ ID NO: 111221 - protein, 9 aa, Artificial Sequence
  Description of Artificial Sequence: Synthetic peptide
  Seed: NPQGLAGHR (MAGC3_HUMAN)
NYQGLAGHR

SEQ ID NO: 111222 - protein, 10 aa, Artificial Sequence
  Description of Artificial Sequence: Synthetic peptide
  Seed: MQMNVINTYT (MAGC3_HUMAN)
MAMNVINTYF

SEQ ID NO: 111223 - protein, 9 aa, Artificial Sequence
  Description of Artificial Sequence: Synthetic peptide
  Seed: VLCPTYFKL (MAGC3_HUMAN)
VLCPTYFKR

SEQ ID NO: 111224 - protein, 9 aa, Artificial Sequence
  Description of Artificial Sequence: Synthetic peptide
  Seed: GYTLSLPAV (MAGC3_HUMAN)
GYTLSLPAW

SEQ ID NO: 111225 - protein, 10 aa, Artificial Sequence
  Description of Artificial Sequence: Synthetic peptide
  Seed: KLSSIIPSAF (MAGC3_HUMAN)
KESSIIPSAW

SEQ ID NO: 111226 - protein, 10 aa, Artificial Sequence
  Description of Artificial Sequence: Synthetic peptide
  Seed: EVIWEVLSAI (MAGC3_HUMAN)
ESIWEVLSAA

SEQ ID NO: 111227 - protein, 9 aa, Artificial Sequence
  Description of Artificial Sequence: Synthetic peptide
  Seed: SEEVIWEVL (MAGC3_HUMAN)
SEEVIWEVP

SEQ ID NO: 111228 - protein, 10 aa, Artificial Sequence
  Description of Artificial Sequence: Synthetic peptide
  Seed: HLREVRLFLR (MAGC3_HUMAN)
HSREVRLFLR

SEQ ID NO: 111229 - protein, 9 aa, Artificial Sequence
  Description of Artificial Sequence: Synthetic peptide
  Seed: NTYTGYFPM (MAGC3_HUMAN)
NSYTGYFPI

SEQ ID NO: 111230 - protein, 11 aa, Artificial Sequence
  Description of Artificial Sequence: Synthetic peptide
  Seed: SSSEEEDTATW (MAGC3_HUMAN)
SASEEEDTATF

SEQ ID NO: 111231 - protein, 10 aa, Artificial Sequence
  Description of Artificial Sequence: Synthetic peptide
  Seed: YQAKEPLTRA (MAGC3_HUMAN)
YVAKEPLTRI

SEQ ID NO: 111232 - protein, 9 aa, Artificial Sequence
  Description of Artificial Sequence: Synthetic peptide
  Seed: KKYKDYFPM (MAGC3_HUMAN)
KAYKDYFPL

SEQ ID NO: 111233 - protein, 9 aa, Artificial Sequence
  Description of Artificial Sequence: Synthetic peptide
  Seed: LILSMIFIK (MAGC3_HUMAN)
LLLSMIFIK

SEQ ID NO: 111234 - protein, 9 aa, Artificial Sequence
  Description of Artificial Sequence: Synthetic peptide
  Seed: NAIGPWSAL (MAGC3_HUMAN)
NQIGPWSAL

SEQ ID NO: 111235 - protein, 8 aa, Artificial Sequence
  Description of Artificial Sequence: Synthetic peptide
  Seed: SSIIPSAF (MAGC3_HUMAN)
SQIIPSAF

SEQ ID NO: 111236 - protein, 10 aa, Artificial Sequence
  Description of Artificial Sequence: Synthetic peptide
  Seed: TGYFPMIFRK (MAGC3_HUMAN)
TTYFPMIFRK

SEQ ID NO: 111237 - protein, 9 aa, Artificial Sequence
  Description of Artificial Sequence: Synthetic peptide
  Seed: MDPDNHSYF (MAGC3_HUMAN)
MAPDNHSYM

SEQ ID NO: 111238 - protein, 9 aa, Artificial Sequence
  Description of Artificial Sequence: Synthetic peptide
  Seed: RPAREVLEF (MAGC3_HUMAN)
RQAREVLEH

SEQ ID NO: 111239 - protein, 10 aa, Artificial Sequence
  Description of Artificial Sequence: Synthetic peptide
  Seed: MLLPCHWVLD (MAGC3_HUMAN)
MVLPCHWVLV

SEQ ID NO: 111240 - protein, 11 aa, Artificial Sequence
  Description of Artificial Sequence: Synthetic peptide
  Seed: KVAELVQFLLL (MAGC3_HUMAN)
KLAELVQFLLA

SEQ ID NO: 111241 - protein, 9 aa, Artificial Sequence
  Description of Artificial Sequence: Synthetic peptide
  Seed: ATDKDYSAF (MAGC3_HUMAN)
AIDKDYSAL

SEQ ID NO: 111242 - protein, 9 aa, Artificial Sequence
  Description of Artificial Sequence: Synthetic peptide
  Seed: MDPDNHSYF (MAGC3_HUMAN)
MYPDNHSYY

SEQ ID NO: 111243 - protein, 10 aa, Artificial Sequence
  Description of Artificial Sequence: Synthetic peptide
  Seed: REVRLFLRGG (MAGC3_HUMAN)
RMVRLFLRGK

SEQ ID NO: 111244 - protein, 10 aa, Artificial Sequence
  Description of Artificial Sequence: Synthetic peptide
  Seed: TAMASASPSV (MAGC3_HUMAN)
TRMASASPSL

SEQ ID NO: 111245 - protein, 10 aa, Artificial Sequence
  Description of Artificial Sequence: Synthetic peptide
  Seed: FKLWRTLSGS (MAGC3_HUMAN)
FGLWRTLSGL

SEQ ID NO: 111246 - protein, 11 aa, Artificial Sequence
  Description of Artificial Sequence: Synthetic peptide
  Seed: ILFGISLTEVD (MAGC3_HUMAN)
IMFGISLTEVY

SEQ ID NO: 111247 - protein, 10 aa, Artificial Sequence
  Description of Artificial Sequence: Synthetic peptide
  Seed: LPTWRRGTGY (MAGC3_HUMAN)
LRTWRRGTGF

SEQ ID NO: 111248 - protein, 10 aa, Artificial Sequence
  Description of Artificial Sequence: Synthetic peptide
  Seed: TYFKLWRTLS (MAGC3_HUMAN)
TWFKLWRTLW

SEQ ID NO: 111249 - protein, 10 aa, Artificial Sequence
  Description of Artificial Sequence: Synthetic peptide
  Seed: LILILSVIFI (MAGC3_HUMAN)
LGLILSVIFV

SEQ ID NO: 111250 - protein, 9 aa, Artificial Sequence
  Description of Artificial Sequence: Synthetic peptide
  Seed: SEEEDTATW (MAGC3_HUMAN)
SEEEDTATV

SEQ ID NO: 111251 - protein, 8 aa, Artificial Sequence
  Description of Artificial Sequence: Synthetic peptide
  Seed: EEVIWEVL (MAGC3_HUMAN)
EEVIWEVY

SEQ ID NO: 111252 - protein, 10 aa, Artificial Sequence
  Description of Artificial Sequence: Synthetic peptide
  Seed: ATFSDGSLGQ (MAGC3_HUMAN)
ASFSDGSLGY

SEQ ID NO: 111253 - protein, 9 aa, Artificial Sequence
  Description of Artificial Sequence: Synthetic peptide
  Seed: MIFGKAHEF (MAGC3_HUMAN)
MNFGKAHEV

SEQ ID NO: 111254 - protein, 9 aa, Artificial Sequence
  Description of Artificial Sequence: Synthetic peptide
  Seed: NAIGPWSAL (MAGC3_HUMAN)
NQIGPWSAF

SEQ ID NO: 111255 - protein, 10 aa, Artificial Sequence
  Description of Artificial Sequence: Synthetic peptide
  Seed: EVIWEVLNAI (MAGC3_HUMAN)
EYIWEVLNAV

SEQ ID NO: 111256 - protein, 10 aa, Artificial Sequence
  Description of Artificial Sequence: Synthetic peptide
  Seed: IKKYKDYFPM (MAGC3_HUMAN)
IDKYKDYFPY

SEQ ID NO: 111257 - protein, 10 aa, Artificial Sequence
  Description of Artificial Sequence: Synthetic peptide
  Seed: INTYTGYFPM (MAGC3_HUMAN)
IHTYTGYFPF

SEQ ID NO: 111258 - protein, 9 aa, Artificial Sequence
  Description of Artificial Sequence: Synthetic peptide
  Seed: YKDYFPMIF (MAGC3_HUMAN)
YLDYFPMIM

SEQ ID NO: 111259 - protein, 9 aa, Artificial Sequence
  Description of Artificial Sequence: Synthetic peptide
  Seed: YSAFHLGHL (MAGC3_HUMAN)
YLAFHLGHI

SEQ ID NO: 111260 - protein, 11 aa, Artificial Sequence
  Description of Artificial Sequence: Synthetic peptide
  Seed: RYALDEKVAEL (MAGC3_HUMAN)
RQALDEKVAEV

SEQ ID NO: 111261 - protein, 10 aa, Artificial Sequence
  Description of Artificial Sequence: Synthetic peptide
  Seed: IELIFGIALT (MAGC3_HUMAN)
ISLIFGIALL

SEQ ID NO: 111262 - protein, 9 aa, Artificial Sequence
  Description of Artificial Sequence: Synthetic peptide
  Seed: CATYALSPV (MAGC3_HUMAN)
CITYALSPV

SEQ ID NO: 111263 - protein, 9 aa, Artificial Sequence
  Description of Artificial Sequence: Synthetic peptide
  Seed: KLSSIIPSA (MAGC3_HUMAN)
KLSSIIPSM

SEQ ID NO: 111264 - protein, 9 aa, Artificial Sequence
  Description of Artificial Sequence: Synthetic peptide
  Seed: QAKEPLTRA (MAGC3_HUMAN)
QAKEPLTRF

SEQ ID NO: 111265 - protein, 9 aa, Artificial Sequence
  Description of Artificial Sequence: Synthetic peptide
  Seed: HFYVFVNTL (MAGC3_HUMAN)
HWYVFVNTW

SEQ ID NO: 111266 - protein, 10 aa, Artificial Sequence
  Description of Artificial Sequence: Synthetic peptide
  Seed: VTKAEMLTTV (MAGC3_HUMAN)
VTKAEMLTTK

SEQ ID NO: 111267 - protein, 11 aa, Artificial Sequence
  Description of Artificial Sequence: Synthetic peptide
  Seed: FIELIFGIALT (MAGC3_HUMAN)
FEELIFGIALI

SEQ ID NO: 111268 - protein, 9 aa, Artificial Sequence
  Description of Artificial Sequence: Synthetic peptide
  Seed: TRAEMQMNV (MAGC3_HUMAN)
TQAEMQMNL

SEQ ID NO: 111269 - protein, 10 aa, Artificial Sequence
  Description of Artificial Sequence: Synthetic peptide
  Seed: KVAELVQFLL (MAGC3_HUMAN)
KMAELVQFLQ

SEQ ID NO: 111270 - protein, 11 aa, Artificial Sequence
  Description of Artificial Sequence: Synthetic peptide
  Seed: TSDQRMDSLVL (MAGC3_HUMAN)
TQDQRMDSLVY

SEQ ID NO: 111271 - protein, 10 aa, Artificial Sequence
  Description of Artificial Sequence: Synthetic peptide
  Seed: FKLWRTLSGS (MAGC3_HUMAN)
FGLWRTLSGV

SEQ ID NO: 111272 - protein, 10 aa, Artificial Sequence
  Description of Artificial Sequence: Synthetic peptide
  Seed: LIFGIALTDM (MAGC3_HUMAN)
LSFGIALTDF

SEQ ID NO: 111273 - protein, 10 aa, Artificial Sequence
  Description of Artificial Sequence: Synthetic peptide
  Seed: KLSSIIPSAF (MAGC3_HUMAN)
KGSSIIPSAF

SEQ ID NO: 111274 - protein, 10 aa, Artificial Sequence
  Description of Artificial Sequence: Synthetic peptide
  Seed: KAEMLTTVIK (MAGC3_HUMAN)
KLEMLTTVIR

SEQ ID NO: 111275 - protein, 10 aa, Artificial Sequence
  Description of Artificial Sequence: Synthetic peptide
  Seed: MQMNVINTYT (MAGC3_HUMAN)
MIMNVINTYY

SEQ ID NO: 111276 - protein, 9 aa, Artificial Sequence
  Description of Artificial Sequence: Synthetic peptide
  Seed: MIFGKAHEF (MAGC3_HUMAN)
MSFGKAHEL

SEQ ID NO: 111277 - protein, 11 aa, Artificial Sequence
  Description of Artificial Sequence: Synthetic peptide
  Seed: EILFGISLTEV (MAGC3_HUMAN)
EMLFGISLTEI

SEQ ID NO: 111278 - protein, 10 aa, Artificial Sequence
  Description of Artificial Sequence: Synthetic peptide
  Seed: YALSPVVLPP (MAGC3_HUMAN)
YMLSPVVLPV

SEQ ID NO: 111279 - protein, 11 aa, Artificial Sequence
  Description of Artificial Sequence: Synthetic peptide
  Seed: DLANPQGLAGH (MAGC3_HUMAN)
DSANPQGLAGR

SEQ ID NO: 111280 - protein, 9 aa, Artificial Sequence
  Description of Artificial Sequence: Synthetic peptide
  Seed: LSSIIPSAF (MAGC3_HUMAN)
LHSIIPSAY

SEQ ID NO: 111281 - protein, 9 aa, Artificial Sequence
  Description of Artificial Sequence: Synthetic peptide
  Seed: CATYALSPV (MAGC3_HUMAN)
CTTYALSPA

SEQ ID NO: 111282 - protein, 9 aa, Artificial Sequence
  Description of Artificial Sequence: Synthetic peptide
  Seed: NTYTGYFPM (MAGC3_HUMAN)
NVYTGYFPR

SEQ ID NO: 111283 - protein, 10 aa, Artificial Sequence
  Description of Artificial Sequence: Synthetic peptide
  Seed: HLREVRLFLR (MAGC3_HUMAN)
HWREVRLFLR

SEQ ID NO: 111284 - protein, 10 aa, Artificial Sequence
  Description of Artificial Sequence: Synthetic peptide
  Seed: AMASASPSVM (MAGC3_HUMAN)
AMASASPSVA

SEQ ID NO: 111285 - protein, 10 aa, Artificial Sequence
  Description of Artificial Sequence: Synthetic peptide
  Seed: TDMDPDNHSY (MAGC3_HUMAN)
TTMDPDNHSF

SEQ ID NO: 111286 - protein, 11 aa, Artificial Sequence
  Description of Artificial Sequence: Synthetic peptide
  Seed: LIDDQGMPKNC (MAGC3_HUMAN)
LADDQGMPKNM

SEQ ID NO: 111287 - protein, 9 aa, Artificial Sequence
  Description of Artificial Sequence: Synthetic peptide
  Seed: MQMNVINTY (MAGC3_HUMAN)
MPMNVINTQ

SEQ ID NO: 111288 - protein, 10 aa, Artificial Sequence
  Description of Artificial Sequence: Synthetic peptide
  Seed: ATYALSPVVL (MAGC3_HUMAN)
AAYALSPVVW

SEQ ID NO: 111289 - protein, 9 aa, Artificial Sequence
  Description of Artificial Sequence: Synthetic peptide
  Seed: EVLSAIGPI (MAGC3_HUMAN)
EILSAIGPR

SEQ ID NO: 111290 - protein, 9 aa, Artificial Sequence
  Description of Artificial Sequence: Synthetic peptide
  Seed: SEEEDTATW (MAGC3_HUMAN)
SLEEDTATW

SEQ ID NO: 111291 - protein, 9 aa, Artificial Sequence
  Description of Artificial Sequence: Synthetic peptide
  Seed: RTLSGSPGL (MAGC3_HUMAN)
RILSGSPGI

SEQ ID NO: 111292 - protein, 9 aa, Artificial Sequence
  Description of Artificial Sequence: Synthetic peptide
  Seed: VIWEVLSAI (MAGC3_HUMAN)
VQWEVLSAT

SEQ ID NO: 111293 - protein, 9 aa, Artificial Sequence
  Description of Artificial Sequence: Synthetic peptide
  Seed: AELVQFLLL (MAGC3_HUMAN)
AQLVQFLLV

SEQ ID NO: 111294 - protein, 9 aa, Artificial Sequence
  Description of Artificial Sequence: Synthetic peptide
  Seed: EAFCEESGL (MAGC3_HUMAN)
EVFCEESGR

SEQ ID NO: 111295 - protein, 10 aa, Artificial Sequence
  Description of Artificial Sequence: Synthetic peptide
  Seed: MIFGKAHEFI (MAGC3_HUMAN)
MMFGKAHEFL

SEQ ID NO: 111296 - protein, 9 aa, Artificial Sequence
  Description of Artificial Sequence: Synthetic peptide
  Seed: YFFEDTLDL (MAGC3_HUMAN)
YLFEDTLDC

SEQ ID NO: 111297 - protein, 9 aa, Artificial Sequence
  Description of Artificial Sequence: Synthetic peptide
  Seed: KNCLLILIL (MAGC3_HUMAN)
KTCLLILIF

SEQ ID NO: 111298 - protein, 10 aa, Artificial Sequence
  Description of Artificial Sequence: Synthetic peptide
  Seed: YALSPVVLPP (MAGC3_HUMAN)
YFLSPVVLPV

SEQ ID NO: 111299 - protein, 10 aa, Artificial Sequence
  Description of Artificial Sequence: Synthetic peptide
  Seed: REVLEFLSKL (MAGC3_HUMAN)
RLVLEFLSKM

SEQ ID NO: 111300 - protein, 10 aa, Artificial Sequence
  Description of Artificial Sequence: Synthetic peptide
  Seed: EPQDWPLNEK (MAGC3_HUMAN)
EVQDWPLNER

SEQ ID NO: 111301 - protein, 9 aa, Artificial Sequence
  Description of Artificial Sequence: Synthetic peptide
  Seed: SASPSVMST (MAGC3_HUMAN)
SASPSVMSL

SEQ ID NO: 111302 - protein, 9 aa, Artificial Sequence
  Description of Artificial Sequence: Synthetic peptide
  Seed: MIFGKAHEF (MAGC3_HUMAN)
MKFGKAHEM

SEQ ID NO: 111303 - protein, 9 aa, Artificial Sequence
  Description of Artificial Sequence: Synthetic peptide
  Seed: KYKDYFPMI (MAGC3_HUMAN)
KIKDYFPMF

SEQ ID NO: 111304 - protein, 10 aa, Artificial Sequence
  Description of Artificial Sequence: Synthetic peptide
  Seed: TAMASASPSV (MAGC3_HUMAN)
TCMASASPSV

SEQ ID NO: 111305 - protein, 9 aa, Artificial Sequence
  Description of Artificial Sequence: Synthetic peptide
  Seed: TYFKLWRTL (MAGC3_HUMAN)
TFFKLWRTF

SEQ ID NO: 111306 - protein, 11 aa, Artificial Sequence
  Description of Artificial Sequence: Synthetic peptide
  Seed: IIDTTDDATAM (MAGC3_HUMAN)
IFDTTDDATAI

SEQ ID NO: 111307 - protein, 10 aa, Artificial Sequence
  Description of Artificial Sequence: Synthetic peptide
  Seed: GSLPESEPLF (MAGC3_HUMAN)
GTLPESEPLF

SEQ ID NO: 111308 - protein, 10 aa, Artificial Sequence
  Description of Artificial Sequence: Synthetic peptide
  Seed: KVAELVQFLL (MAGC3_HUMAN)
KMAELVQFLH

SEQ ID NO: 111309 - protein, 10 aa, Artificial Sequence
  Description of Artificial Sequence: Synthetic peptide
  Seed: KLSSIIPSAF (MAGC3_HUMAN)
KYSSIIPSAY

SEQ ID NO: 111310 - protein, 9 aa, Artificial Sequence
  Description of Artificial Sequence: Synthetic peptide
  Seed: VINTYTGYF (MAGC3_HUMAN)
VMNTYTGYW

SEQ ID NO: 111311 - protein, 8 aa, Artificial Sequence
  Description of Artificial Sequence: Synthetic peptide
  Seed: SAFHLGHL (MAGC3_HUMAN)
SQFHLGHI

SEQ ID NO: 111312 - protein, 9 aa, Artificial Sequence
  Description of Artificial Sequence: Synthetic peptide
  Seed: TEVDPDHFY (MAGC3_HUMAN)
TEVDPDHFA

SEQ ID NO: 111313 - protein, 10 aa, Artificial Sequence
  Description of Artificial Sequence: Synthetic peptide
  Seed: CASEEVIWEV (MAGC3_HUMAN)
CMSEEVIWEA

SEQ ID NO: 111314 - protein, 10 aa, Artificial Sequence
  Description of Artificial Sequence: Synthetic peptide
  Seed: YQAKEPLTRA (MAGC3_HUMAN)
YVAKEPLTRL

SEQ ID NO: 111315 - protein, 10 aa, Artificial Sequence
  Description of Artificial Sequence: Synthetic peptide
  Seed: KATDKDYSAF (MAGC3_HUMAN)
KRTDKDYSAF

SEQ ID NO: 111316 - protein, 11 aa, Artificial Sequence
  Description of Artificial Sequence: Synthetic peptide
  Seed: AEMQMNVINTY (MAGC3_HUMAN)
AKMQMNVINTM

SEQ ID NO: 111317 - protein, 9 aa, Artificial Sequence
  Description of Artificial Sequence: Synthetic peptide
  Seed: KAHEFIELI (MAGC3_HUMAN)
KVHEFIELF

SEQ ID NO: 111318 - protein, 9 aa, Artificial Sequence
  Description of Artificial Sequence: Synthetic peptide
  Seed: QLSDLHFGS (MAGC3_HUMAN)
QMSDLHFGM

SEQ ID NO: 111319 - protein, 9 aa, Artificial Sequence
  Description of Artificial Sequence: Synthetic peptide
  Seed: VDPDHFYVF (MAGC3_HUMAN)
VIPDHFYVV

SEQ ID NO: 111320 - protein, 9 aa, Artificial Sequence
  Description of Artificial Sequence: Synthetic peptide
  Seed: MQMNVINTY (MAGC3_HUMAN)
MIMNVINTV

SEQ ID NO: 111321 - protein, 10 aa, Artificial Sequence
  Description of Artificial Sequence: Synthetic peptide
  Seed: VTKAEMLTTV (MAGC3_HUMAN)
VLKAEMLTTL

SEQ ID NO: 111322 - protein, 10 aa, Artificial Sequence
  Description of Artificial Sequence: Synthetic peptide
  Seed: RSAEGSVLDL (MAGC3_HUMAN)
RMAEGSVLDL

SEQ ID NO: 111323 - protein, 9 aa, Artificial Sequence
  Description of Artificial Sequence: Synthetic peptide
  Seed: ALDEKVAEL (MAGC3_HUMAN)
ANDEKVAEV

SEQ ID NO: 111324 - protein, 9 aa, Artificial Sequence
  Description of Artificial Sequence: Synthetic peptide
  Seed: MDPDNHSYF (MAGC3_HUMAN)
MFPDNHSYL

SEQ ID NO: 111325 - protein, 9 aa, Artificial Sequence
  Description of Artificial Sequence: Synthetic peptide
  Seed: TYFKLWRTL (MAGC3_HUMAN)
TWFKLWRTM

SEQ ID NO: 111326 - protein, 9 aa, Artificial Sequence
  Description of Artificial Sequence: Synthetic peptide
  Seed: MIFGKAHEF (MAGC3_HUMAN)
MVFGKAHEY

SEQ ID NO: 111327 - protein, 10 aa, Artificial Sequence
  Description of Artificial Sequence: Synthetic peptide
  Seed: SAFHLGHLRE (MAGC3_HUMAN)
STFHLGHLRL

SEQ ID NO: 111328 - protein, 9 aa, Artificial Sequence
  Description of Artificial Sequence: Synthetic peptide
  Seed: DMDPDNHSY (MAGC3_HUMAN)
DVDPDNHSL

SEQ ID NO: 111329 - protein, 10 aa, Artificial Sequence
  Description of Artificial Sequence: Synthetic peptide
  Seed: KAEMLTTVIK (MAGC3_HUMAN)
KIEMLTTVIK

SEQ ID NO: 111330 - protein, 10 aa, Artificial Sequence
  Description of Artificial Sequence: Synthetic peptide
  Seed: KLVQFLLLKY (MAGC3_HUMAN)
KIVQFLLLKR

SEQ ID NO: 111331 - protein, 10 aa, Artificial Sequence
  Description of Artificial Sequence: Synthetic peptide
  Seed: CSSPLLWTRL (MAGC3_HUMAN)
CGSPLLWTRW

SEQ ID NO: 111332 - protein, 9 aa, Artificial Sequence
  Description of Artificial Sequence: Synthetic peptide
  Seed: ISPQGPPQS (MAGC3_HUMAN)
IVPQGPPQV

SEQ ID NO: 111333 - protein, 9 aa, Artificial Sequence
  Description of Artificial Sequence: Synthetic peptide
  Seed: YQAKEPLTR (MAGC3_HUMAN)
YFAKEPLTY

SEQ ID NO: 111334 - protein, 10 aa, Artificial Sequence
  Description of Artificial Sequence: Synthetic peptide
  Seed: HLREVRLFLR (MAGC3_HUMAN)
HTREVRLFLK

SEQ ID NO: 111335 - protein, 9 aa, Artificial Sequence
  Description of Artificial Sequence: Synthetic peptide
  Seed: KEPVTKAEM (MAGC3_HUMAN)
KAPVTKAEY

SEQ ID NO: 111336 - protein, 9 aa, Artificial Sequence
  Description of Artificial Sequence: Synthetic peptide
  Seed: KLSSIIPSA (MAGC3_HUMAN)
KASSIIPSV

SEQ ID NO: 111337 - protein, 9 aa, Artificial Sequence
  Description of Artificial Sequence: Synthetic peptide
  Seed: KLWRTLSGS (MAGC3_HUMAN)
KMWRTLSGA

SEQ ID NO: 111338 - protein, 11 aa, Artificial Sequence
  Description of Artificial Sequence: Synthetic peptide
  Seed: RTLSGSPGLQL (MAGC3_HUMAN)
RMLSGSPGLQY

SEQ ID NO: 111339 - protein, 9 aa, Artificial Sequence
  Description of Artificial Sequence: Synthetic peptide
  Seed: HLREVRLFL (MAGC3_HUMAN)
HMREVRLFA

SEQ ID NO: 111340 - protein, 9 aa, Artificial Sequence
  Description of Artificial Sequence: Synthetic peptide
  Seed: LKYQTKEPV (MAGC3_HUMAN)
LQYQTKEPW

SEQ ID NO: 111341 - protein, 9 aa, Artificial Sequence
  Description of Artificial Sequence: Synthetic peptide
  Seed: KVDKLVQFL (MAGC3_HUMAN)
KLDKLVQFW

SEQ ID NO: 111342 - protein, 9 aa, Artificial Sequence
  Description of Artificial Sequence: Synthetic peptide
  Seed: LSGSPGLQL (MAGC3_HUMAN)
LMGSPGLQW

SEQ ID NO: 111343 - protein, 9 aa, Artificial Sequence
  Description of Artificial Sequence: Synthetic peptide
  Seed: SASPSVMST (MAGC3_HUMAN)
STSPSVMSF

SEQ ID NO: 111344 - protein, 10 aa, Artificial Sequence
  Description of Artificial Sequence: Synthetic peptide
  Seed: YSAFHLGHLR (MAGC3_HUMAN)
YSAFHLGHLK

SEQ ID NO: 111345 - protein, 9 aa, Artificial Sequence
  Description of Artificial Sequence: Synthetic peptide
  Seed: KKYKDYFPM (MAGC3_HUMAN)
KMYKDYFPI

SEQ ID NO: 111346 - protein, 10 aa, Artificial Sequence
  Description of Artificial Sequence: Synthetic peptide
  Seed: MLLPCHWVLD (MAGC3_HUMAN)
MLLPCHWVLI

SEQ ID NO: 111347 - protein, 9 aa, Artificial Sequence
  Description of Artificial Sequence: Synthetic peptide
  Seed: SAEGSVLDL (MAGC3_HUMAN)
SYEGSVLDL

SEQ ID NO: 111348 - protein, 10 aa, Artificial Sequence
  Description of Artificial Sequence: Synthetic peptide
  Seed: KFSLRRAVSV (MAGC3_HUMAN)
KTSLRRAVSK

SEQ ID NO: 111349 - protein, 9 aa, Artificial Sequence
  Description of Artificial Sequence: Synthetic peptide
  Seed: SLRRAVSVK (MAGC3_HUMAN)
STRRAVSVA

SEQ ID NO: 111350 - protein, 9 aa, Artificial Sequence
  Description of Artificial Sequence: Synthetic peptide
  Seed: TKAEMLTTV (MAGC3_HUMAN)
TVAEMLTTI

SEQ ID NO: 111351 - protein, 9 aa, Artificial Sequence
  Description of Artificial Sequence: Synthetic peptide
  Seed: EVLSAIGPI (MAGC3_HUMAN)
ETLSAIGPF

SEQ ID NO: 111352 - protein, 10 aa, Artificial Sequence
  Description of Artificial Sequence: Synthetic peptide
  Seed: LDSCSSPLLW (MAGC3_HUMAN)
LISCSSPLLF

SEQ ID NO: 111353 - protein, 9 aa, Artificial Sequence
  Description of Artificial Sequence: Synthetic peptide
  Seed: FADVLSRLA (MAGC3_HUMAN)
FWDVLSRLM

SEQ ID NO: 111354 - protein, 10 aa, Artificial Sequence
  Description of Artificial Sequence: Synthetic peptide
  Seed: YTLDEKVDKL (MAGC3_HUMAN)
YILDEKVDKL

SEQ ID NO: 111355 - protein, 10 aa, Artificial Sequence
  Description of Artificial Sequence: Synthetic peptide
  Seed: RMDSLVLCPT (MAGC3_HUMAN)
RVDSLVLCPV

SEQ ID NO: 111356 - protein, 9 aa, Artificial Sequence
  Description of Artificial Sequence: Synthetic peptide
  Seed: LRSAEGSVL (MAGC3_HUMAN)
LESAEGSVF

SEQ ID NO: 111357 - protein, 11 aa, Artificial Sequence
  Description of Artificial Sequence: Synthetic peptide
  Seed: EVLSAIGPIQR (MAGC3_HUMAN)
EGLSAIGPIQR

SEQ ID NO: 111358 - protein, 9 aa, Artificial Sequence
  Description of Artificial Sequence: Synthetic peptide
  Seed: FHLGHLREV (MAGC3_HUMAN)
FALGHLREV

SEQ ID NO: 111359 - protein, 9 aa, Artificial Sequence
  Description of Artificial Sequence: Synthetic peptide
  Seed: SLVLCPTYF (MAGC3_HUMAN)
SSVLCPTYF

SEQ ID NO: 111360 - protein, 10 aa, Artificial Sequence
  Description of Artificial Sequence: Synthetic peptide
  Seed: EMQMNVINTY (MAGC3_HUMAN)
EWQMNVINTF

SEQ ID NO: 111361 - protein, 10 aa, Artificial Sequence
  Description of Artificial Sequence: Synthetic peptide
  Seed: AMASASPSVM (MAGC3_HUMAN)
ALASASPSVF

SEQ ID NO: 111362 - protein, 9 aa, Artificial Sequence
  Description of Artificial Sequence: Synthetic peptide
  Seed: SESLPRYAL (MAGC3_HUMAN)
SDSLPRYAL

SEQ ID NO: 111363 - protein, 9 aa, Artificial Sequence
  Description of Artificial Sequence: Synthetic peptide
  Seed: VIWEVLSAI (MAGC3_HUMAN)
VAWEVLSAF

SEQ ID NO: 111364 - protein, 10 aa, Artificial Sequence
  Description of Artificial Sequence: Synthetic peptide
  Seed: MPAAGMPPLP (MAGC3_HUMAN)
MHAAGMPPLY

SEQ ID NO: 111365 - protein, 10 aa, Artificial Sequence
  Description of Artificial Sequence: Synthetic peptide
  Seed: MDPDNHSYFF (MAGC3_HUMAN)
MLPDNHSYFL

SEQ ID NO: 111366 - protein, 10 aa, Artificial Sequence
  Description of Artificial Sequence: Synthetic peptide
  Seed: YALSPVVLPP (MAGC3_HUMAN)
YTLSPVVLPL

SEQ ID NO: 111367 - protein, 8 aa, Artificial Sequence
  Description of Artificial Sequence: Synthetic peptide
  Seed: FLSKLSSI (MAGC3_HUMAN)
FMSKLSSL

SEQ ID NO: 111368 - protein, 9 aa, Artificial Sequence
  Description of Artificial Sequence: Synthetic peptide
  Seed: EVLEFLSKL (MAGC3_HUMAN)
ECLEFLSKR

SEQ ID NO: 111369 - protein, 9 aa, Artificial Sequence
  Description of Artificial Sequence: Synthetic peptide
  Seed: YSAFHLGHL (MAGC3_HUMAN)
YHAFHLGHF

SEQ ID NO: 111370 - protein, 10 aa, Artificial Sequence
  Description of Artificial Sequence: Synthetic peptide
  Seed: FPSWYMDALK (MAGC3_HUMAN)
FTSWYMDALR

SEQ ID NO: 111371 - protein, 10 aa, Artificial Sequence
  Description of Artificial Sequence: Synthetic peptide
  Seed: KATDKDYSAF (MAGC3_HUMAN)
KKTDKDYSAF

SEQ ID NO: 111372 - protein, 9 aa, Artificial Sequence
  Description of Artificial Sequence: Synthetic peptide
  Seed: FPSWYMDAL (MAGC3_HUMAN)
FVSWYMDAL

SEQ ID NO: 111373 - protein, 10 aa, Artificial Sequence
  Description of Artificial Sequence: Synthetic peptide
  Seed: REVRLFLRGG (MAGC3_HUMAN)
RHVRLFLRGV

SEQ ID NO: 111374 - protein, 9 aa, Artificial Sequence
  Description of Artificial Sequence: Synthetic peptide
  Seed: KVAELVQFL (MAGC3_HUMAN)
KLAELVQFY

SEQ ID NO: 111375 - protein, 9 aa, Artificial Sequence
  Description of Artificial Sequence: Synthetic peptide
  Seed: VINTYTGYF (MAGC3_HUMAN)
VQNTYTGYL

SEQ ID NO: 111376 - protein, 9 aa, Artificial Sequence
  Description of Artificial Sequence: Synthetic peptide
  Seed: YSAFHLGHL (MAGC3_HUMAN)
YGAFHLGHY

SEQ ID NO: 111377 - protein, 11 aa, Artificial Sequence
  Description of Artificial Sequence: Synthetic peptide
  Seed: MQMNVINTYTG (MAGC3_HUMAN)
MMMNVINTYTF

SEQ ID NO: 111378 - protein, 11 aa, Artificial Sequence
  Description of Artificial Sequence: Synthetic peptide
  Seed: FPMIFGKAHEF (MAGC3_HUMAN)
FPMIFGKAHEM

SEQ ID NO: 111379 - protein, 10 aa, Artificial Sequence
  Description of Artificial Sequence: Synthetic peptide
  Seed: REVLEFLSKL (MAGC3_HUMAN)
RLVLEFLSKV

SEQ ID NO: 111380 - protein, 9 aa, Artificial Sequence
  Description of Artificial Sequence: Synthetic peptide
  Seed: MIFRKAREF (MAGC3_HUMAN)
MTFRKAREM

SEQ ID NO: 111381 - protein, 10 aa, Artificial Sequence
  Description of Artificial Sequence: Synthetic peptide
  Seed: YALDEKVAEL (MAGC3_HUMAN)
YRLDEKVAEC

SEQ ID NO: 111382 - protein, 11 aa, Artificial Sequence
  Description of Artificial Sequence: Synthetic peptide
  Seed: YALDEKVAELV (MAGC3_HUMAN)
YLLDEKVAELS

SEQ ID NO: 111383 - protein, 9 aa, Artificial Sequence
  Description of Artificial Sequence: Synthetic peptide
  Seed: FSDGSLGQW (MAGC3_HUMAN)
FVDGSLGQF

SEQ ID NO: 111384 - protein, 9 aa, Artificial Sequence
  Description of Artificial Sequence: Synthetic peptide
  Seed: MLLPCHWVL (MAGC3_HUMAN)
MFLPCHWVW

SEQ ID NO: 111385 - protein, 9 aa, Artificial Sequence
  Description of Artificial Sequence: Synthetic peptide
  Seed: HLREVRLFL (MAGC3_HUMAN)
HIREVRLFW

SEQ ID NO: 111386 - protein, 9 aa, Artificial Sequence
  Description of Artificial Sequence: Synthetic peptide
  Seed: NTYTGYFPM (MAGC3_HUMAN)
NFYTGYFPM

SEQ ID NO: 111387 - protein, 9 aa, Artificial Sequence
  Description of Artificial Sequence: Synthetic peptide
  Seed: SQPEGKFSL (MAGC3_HUMAN)
SLPEGKFSF

SEQ ID NO: 111388 - protein, 9 aa, Artificial Sequence
  Description of Artificial Sequence: Synthetic peptide
  Seed: SQPEGKFSL (MAGC3_HUMAN)
SLPEGKFSY

SEQ ID NO: 111389 - protein, 10 aa, Artificial Sequence
  Description of Artificial Sequence: Synthetic peptide
  Seed: YALDEKVAEL (MAGC3_HUMAN)
YMLDEKVAER

SEQ ID NO: 111390 - protein, 10 aa, Artificial Sequence
  Description of Artificial Sequence: Synthetic peptide
  Seed: YALDEKVAEL (MAGC3_HUMAN)
YSLDEKVAEF

SEQ ID NO: 111391 - protein, 9 aa, Artificial Sequence
  Description of Artificial Sequence: Synthetic peptide
  Seed: AIGPWSALA (MAGC3_HUMAN)
AVGPWSALL

SEQ ID NO: 111392 - protein, 9 aa, Artificial Sequence
  Description of Artificial Sequence: Synthetic peptide
  Seed: RGTGYTLSL (MAGC3_HUMAN)
RHTGYTLSF

SEQ ID NO: 111393 - protein, 10 aa, Artificial Sequence
  Description of Artificial Sequence: Synthetic peptide
  Seed: TTDDATAMAS (MAGC3_HUMAN)
TYDDATAMAF

SEQ ID NO: 111394 - protein, 9 aa, Artificial Sequence
  Description of Artificial Sequence: Synthetic peptide
  Seed: EVLEFLSKL (MAGC3_HUMAN)
EVLEFLSKR

SEQ ID NO: 111395 - protein, 9 aa, Artificial Sequence
  Description of Artificial Sequence: Synthetic peptide
  Seed: AMASASPSV (MAGC3_HUMAN)
AHASASPSF

SEQ ID NO: 111396 - protein, 9 aa, Artificial Sequence
  Description of Artificial Sequence: Synthetic peptide
  Seed: AMASASPSV (MAGC3_HUMAN)
ARASASPSY

SEQ ID NO: 111397 - protein, 9 aa, Artificial Sequence
  Description of Artificial Sequence: Synthetic peptide
  Seed: KLSSIIPSA (MAGC3_HUMAN)
KTSSIIPSK

SEQ ID NO: 111398 - protein, 10 aa, Artificial Sequence
  Description of Artificial Sequence: Synthetic peptide
  Seed: SPLDSCSSPL (MAGC3_HUMAN)
SELDSCSSPV

SEQ ID NO: 111399 - protein, 9 aa, Artificial Sequence
  Description of Artificial Sequence: Synthetic peptide
  Seed: TAMASASPS (MAGC3_HUMAN)
TIMASASPM

SEQ ID NO: 111400 - protein, 10 aa, Artificial Sequence
  Description of Artificial Sequence: Synthetic peptide
  Seed: VVLPPQPQPR (MAGC3_HUMAN)
VVLPPQPQPK

SEQ ID NO: 111401 - protein, 9 aa, Artificial Sequence
  Description of Artificial Sequence: Synthetic peptide
  Seed: LSDEQGMPQ (MAGC3_HUMAN)
LMDEQGMPV

SEQ ID NO: 111402 - protein, 9 aa, Artificial Sequence
  Description of Artificial Sequence: Synthetic peptide
  Seed: TAMASASPS (MAGC3_HUMAN)
TAMASASPL

SEQ ID NO: 111403 - protein, 10 aa, Artificial Sequence
  Description of Artificial Sequence: Synthetic peptide
  Seed: SLPAVSPGKR (MAGC3_HUMAN)
SVPAVSPGKK

SEQ ID NO: 111404 - protein, 10 aa, Artificial Sequence
  Description of Artificial Sequence: Synthetic peptide
  Seed: SLVLCPTYFK (MAGC3_HUMAN)
SWVLCPTYFR

SEQ ID NO: 111405 - protein, 9 aa, Artificial Sequence
  Description of Artificial Sequence: Synthetic peptide
  Seed: TYALSPVVL (MAGC3_HUMAN)
TSALSPVVL

SEQ ID NO: 111406 - protein, 9 aa, Artificial Sequence
  Description of Artificial Sequence: Synthetic peptide
  Seed: VIWEVLNAI (MAGC3_HUMAN)
VVWEVLNAL

SEQ ID NO: 111407 - protein, 10 aa, Artificial Sequence
  Description of Artificial Sequence: Synthetic peptide
  Seed: FKLWRTLSGS (MAGC3_HUMAN)
FYLWRTLSGL

SEQ ID NO: 111408 - protein, 9 aa, Artificial Sequence
  Description of Artificial Sequence: Synthetic peptide
  Seed: YSAFHLGHL (MAGC3_HUMAN)
YTAFHLGHL

SEQ ID NO: 111409 - protein, 11 aa, Artificial Sequence
  Description of Artificial Sequence: Synthetic peptide
  Seed: KKYKDYFPMIF (MAGC3_HUMAN)
KFYKDYFPMIF

SEQ ID NO: 111410 - protein, 9 aa, Artificial Sequence
  Description of Artificial Sequence: Synthetic peptide
  Seed: KVDKLVQFL (MAGC3_HUMAN)
KVDKLVQFM

SEQ ID NO: 111411 - protein, 9 aa, Artificial Sequence
  Description of Artificial Sequence: Synthetic peptide
  Seed: MLTTVIKKY (MAGC3_HUMAN)
MATTVIKKF

SEQ ID NO: 111412 - protein, 10 aa, Artificial Sequence
  Description of Artificial Sequence: Synthetic peptide
  Seed: FSDGSLGQWV (MAGC3_HUMAN)
FADGSLGQWF

SEQ ID NO: 111413 - protein, 9 aa, Artificial Sequence
  Description of Artificial Sequence: Synthetic peptide
  Seed: ALAGFADVL (MAGC3_HUMAN)
AMAGFADVM

SEQ ID NO: 111414 - protein, 9 aa, Artificial Sequence
  Description of Artificial Sequence: Synthetic peptide
  Seed: ASEEVIWEV (MAGC3_HUMAN)
AIEEVIWEA

SEQ ID NO: 111415 - protein, 11 aa, Artificial Sequence
  Description of Artificial Sequence: Synthetic peptide
  Seed: FIELIFGIALT (MAGC3_HUMAN)
FMELIFGIALA

SEQ ID NO: 111416 - protein, 9 aa, Artificial Sequence
  Description of Artificial Sequence: Synthetic peptide
  Seed: TKAEMLTTV (MAGC3_HUMAN)
THAEMLTTM

SEQ ID NO: 111417 - protein, 9 aa, Artificial Sequence
  Description of Artificial Sequence: Synthetic peptide
  Seed: TLDEKVDKL (MAGC3_HUMAN)
TQDEKVDKL

SEQ ID NO: 111418 - protein, 9 aa, Artificial Sequence
  Description of Artificial Sequence: Synthetic peptide
  Seed: MIFGKAHEF (MAGC3_HUMAN)
MPFGKAHEM

SEQ ID NO: 111419 - protein, 10 aa, Artificial Sequence
  Description of Artificial Sequence: Synthetic peptide
  Seed: REVRLFLRGG (MAGC3_HUMAN)
RMVRLFLRGI

SEQ ID NO: 111420 - protein, 9 aa, Artificial Sequence
  Description of Artificial Sequence: Synthetic peptide
  Seed: IIPSAFPSW (MAGC3_HUMAN)
IMPSAFPSI

SEQ ID NO: 111421 - protein, 9 aa, Artificial Sequence
  Description of Artificial Sequence: Synthetic peptide
  Seed: RTLSGSPGL (MAGC3_HUMAN)
RVLSGSPGM

SEQ ID NO: 111422 - protein, 10 aa, Artificial Sequence
  Description of Artificial Sequence: Synthetic peptide
  Seed: YTLDEKVDKL (MAGC3_HUMAN)
YILDEKVDKA

SEQ ID NO: 111423 - protein, 9 aa, Artificial Sequence
  Description of Artificial Sequence: Synthetic peptide
  Seed: ALSPVVLPP (MAGC3_HUMAN)
AVSPVVLPL

SEQ ID NO: 111424 - protein, 11 aa, Artificial Sequence
  Description of Artificial Sequence: Synthetic peptide
  Seed: ATDKDYSAFHL (MAGC3_HUMAN)
AADKDYSAFHY

SEQ ID NO: 111425 - protein, 9 aa, Artificial Sequence
  Description of Artificial Sequence: Synthetic peptide
  Seed: IQRPAREVL (MAGC3_HUMAN)
IERPAREVY

SEQ ID NO: 111426 - protein, 10 aa, Artificial Sequence
  Description of Artificial Sequence: Synthetic peptide
  Seed: FKLWRTLSGS (MAGC3_HUMAN)
FFLWRTLSGV

SEQ ID NO: 111427 - protein, 10 aa, Artificial Sequence
  Description of Artificial Sequence: Synthetic peptide
  Seed: IIPSAFPSWY (MAGC3_HUMAN)
IMPSAFPSWY

SEQ ID NO: 111428 - protein, 9 aa, Artificial Sequence
  Description of Artificial Sequence: Synthetic peptide
  Seed: KYKDYFPMI (MAGC3_HUMAN)
KLKDYFPMK

SEQ ID NO: 111429 - protein, 9 aa, Artificial Sequence
  Description of Artificial Sequence: Synthetic peptide
  Seed: TGYTLSLPA (MAGC3_HUMAN)
TPYTLSLPM

SEQ ID NO: 111430 - protein, 9 aa, Artificial Sequence
  Description of Artificial Sequence: Synthetic peptide
  Seed: LILSMIFIK (MAGC3_HUMAN)
LALSMIFIK

SEQ ID NO: 111431 - protein, 9 aa, Artificial Sequence
  Description of Artificial Sequence: Synthetic peptide
  Seed: VIKKYKDYF (MAGC3_HUMAN)
VMKKYKDYY

SEQ ID NO: 111432 - protein, 9 aa, Artificial Sequence
  Description of Artificial Sequence: Synthetic peptide
  Seed: KAHEFIELI (MAGC3_HUMAN)
KIHEFIELY

SEQ ID NO: 111433 - protein, 11 aa, Artificial Sequence
  Description of Artificial Sequence: Synthetic peptide
  Seed: TAMASASPSVM (MAGC3_HUMAN)
TMMASASPSVM

SEQ ID NO: 111434 - protein, 9 aa, Artificial Sequence
  Description of Artificial Sequence: Synthetic peptide
  Seed: ALSPVVLPP (MAGC3_HUMAN)
ALSPVVLPT

SEQ ID NO: 111435 - protein, 9 aa, Artificial Sequence
  Description of Artificial Sequence: Synthetic peptide
  Seed: GSCVPEEVI (MAGC3_HUMAN)
GSCVPEEVW

SEQ ID NO: 111436 - protein, 9 aa, Artificial Sequence
  Description of Artificial Sequence: Synthetic peptide
  Seed: SASPSVMST (MAGC3_HUMAN)
SPSPSVMSA

SEQ ID NO: 111437 - protein, 10 aa, Artificial Sequence
  Description of Artificial Sequence: Synthetic peptide
  Seed: KKYKDYFPMI (MAGC3_HUMAN)
KKYKDYFPMF

SEQ ID NO: 111438 - protein, 8 aa, Artificial Sequence
  Description of Artificial Sequence: Synthetic peptide
  Seed: YTLSLPAV (MAGC3_HUMAN)
YLLSLPAL

SEQ ID NO: 111439 - protein, 9 aa, Artificial Sequence
  Description of Artificial Sequence: Synthetic peptide
  Seed: VIWEVLSAI (MAGC3_HUMAN)
VIWEVLSAR

SEQ ID NO: 111440 - protein, 9 aa, Artificial Sequence
  Description of Artificial Sequence: Synthetic peptide
  Seed: AGFADVLSR (MAGC3_HUMAN)
AAFADVLSR

SEQ ID NO: 111441 - protein, 9 aa, Artificial Sequence
  Description of Artificial Sequence: Synthetic peptide
  Seed: EVLNAIGPW (MAGC3_HUMAN)
EALNAIGPK

SEQ ID NO: 111442 - protein, 9 aa, Artificial Sequence
  Description of Artificial Sequence: Synthetic peptide
  Seed: MIFGKAHEF (MAGC3_HUMAN)
MLFGKAHEI

SEQ ID NO: 111443 - protein, 9 aa, Artificial Sequence
  Description of Artificial Sequence: Synthetic peptide
  Seed: SQPEGKFSL (MAGC3_HUMAN)
SMPEGKFSY

SEQ ID NO: 111444 - protein, 9 aa, Artificial Sequence
  Description of Artificial Sequence: Synthetic peptide
  Seed: RPAREVLEF (MAGC3_HUMAN)
RAAREVLEW

SEQ ID NO: 111445 - protein, 9 aa, Artificial Sequence
  Description of Artificial Sequence: Synthetic peptide
  Seed: LILSMIFIK (MAGC3_HUMAN)
LFLSMIFIK

SEQ ID NO: 111446 - protein, 9 aa, Artificial Sequence
  Description of Artificial Sequence: Synthetic peptide
  Seed: KLSSIIPSA (MAGC3_HUMAN)
KSSSIIPSR

SEQ ID NO: 111447 - protein, 10 aa, Artificial Sequence
  Description of Artificial Sequence: Synthetic peptide
  Seed: EKVAELVQFL (MAGC3_HUMAN)
EWVAELVQFV

SEQ ID NO: 111448 - protein, 10 aa, Artificial Sequence
  Description of Artificial Sequence: Synthetic peptide
  Seed: FKLWRTLSGS (MAGC3_HUMAN)
FKLWRTLSGI

SEQ ID NO: 111449 - protein, 10 aa, Artificial Sequence
  Description of Artificial Sequence: Synthetic peptide
  Seed: SDQRMDSLVL (MAGC3_HUMAN)
SIQRMDSLVL

SEQ ID NO: 111450 - protein, 9 aa, Artificial Sequence
  Description of Artificial Sequence: Synthetic peptide
  Seed: YFFEDTLDL (MAGC3_HUMAN)
YFFEDTLDM

SEQ ID NO: 111451 - protein, 9 aa, Artificial Sequence
  Description of Artificial Sequence: Synthetic peptide
  Seed: YQAKEPLTR (MAGC3_HUMAN)
YIAKEPLTY

SEQ ID NO: 111452 - protein, 9 aa, Artificial Sequence
  Description of Artificial Sequence: Synthetic peptide
  Seed: KVAELVQFL (MAGC3_HUMAN)
KQAELVQFF

SEQ ID NO: 111453 - protein, 8 aa, Artificial Sequence
  Description of Artificial Sequence: Synthetic peptide
  Seed: TTDDATAM (MAGC3_HUMAN)
TADDATAL

SEQ ID NO: 111454 - protein, 11 aa, Artificial Sequence
  Description of Artificial Sequence: Synthetic peptide
  Seed: LSLPAVSPGKR (MAGC3_HUMAN)
LVLPAVSPGKK

SEQ ID NO: 111455 - protein, 9 aa, Artificial Sequence
  Description of Artificial Sequence: Synthetic peptide
  Seed: WESEGPEAF (MAGC3_HUMAN)
WVSEGPEAF

SEQ ID NO: 111456 - protein, 9 aa, Artificial Sequence
  Description of Artificial Sequence: Synthetic peptide
  Seed: DGSLGQWVK (MAGC3_HUMAN)
DVSLGQWVK

SEQ ID NO: 111457 - protein, 9 aa, Artificial Sequence
  Description of Artificial Sequence: Synthetic peptide
  Seed: FHLGHLREV (MAGC3_HUMAN)
FRLGHLREV

SEQ ID NO: 111458 - protein, 9 aa, Artificial Sequence
  Description of Artificial Sequence: Synthetic peptide
  Seed: TSDQRMDSL (MAGC3_HUMAN)
TSDQRMDSY

SEQ ID NO: 111459 - protein, 10 aa, Artificial Sequence
  Description of Artificial Sequence: Synthetic peptide
  Seed: MQMNVINTYT (MAGC3_HUMAN)
MRMNVINTYF

SEQ ID NO: 111460 - protein, 8 aa, Artificial Sequence
  Description of Artificial Sequence: Synthetic peptide
  Seed: MEDRAQAI (MAGC3_HUMAN)
MVDRAQAI

SEQ ID NO: 111461 - protein, 11 aa, Artificial Sequence
  Description of Artificial Sequence: Synthetic peptide
  Seed: ILFGISLTEVD (MAGC3_HUMAN)
IMFGISLTEVF

SEQ ID NO: 111462 - protein, 9 aa, Artificial Sequence
  Description of Artificial Sequence: Synthetic peptide
  Seed: IIPSAFPSW (MAGC3_HUMAN)
IMPSAFPSW

SEQ ID NO: 111463 - protein, 9 aa, Artificial Sequence
  Description of Artificial Sequence: Synthetic peptide
  Seed: SLRRAVSVK (MAGC3_HUMAN)
SSRRAVSVS

SEQ ID NO: 111464 - protein, 9 aa, Artificial Sequence
  Description of Artificial Sequence: Synthetic peptide
  Seed: SASPSVMST (MAGC3_HUMAN)
SPSPSVMSV

SEQ ID NO: 111465 - protein, 11 aa, Artificial Sequence
  Description of Artificial Sequence: Synthetic peptide
  Seed: LSDEQGMPQNR (MAGC3_HUMAN)
LLDEQGMPQNY

SEQ ID NO: 111466 - protein, 9 aa, Artificial Sequence
  Description of Artificial Sequence: Synthetic peptide
  Seed: KVDKLVQFL (MAGC3_HUMAN)
KMDKLVQFI

SEQ ID NO: 111467 - protein, 9 aa, Artificial Sequence
  Description of Artificial Sequence: Synthetic peptide
  Seed: VDPDHFYVF (MAGC3_HUMAN)
VFPDHFYVF

SEQ ID NO: 111468 - protein, 11 aa, Artificial Sequence
  Description of Artificial Sequence: Synthetic peptide
  Seed: LTDMDPDNHSY (MAGC3_HUMAN)
LSDMDPDNHSM

SEQ ID NO: 111469 - protein, 9 aa, Artificial Sequence
  Description of Artificial Sequence: Synthetic peptide
  Seed: RTLWKDSDL (MAGC3_HUMAN)
RSLWKDSDF

SEQ ID NO: 111470 - protein, 9 aa, Artificial Sequence
  Description of Artificial Sequence: Synthetic peptide
  Seed: LVQFLLLKY (MAGC3_HUMAN)
LSQFLLLKY

SEQ ID NO: 111471 - protein, 9 aa, Artificial Sequence
  Description of Artificial Sequence: Synthetic peptide
  Seed: QGMPKNCLL (MAGC3_HUMAN)
QTMPKNCLL

SEQ ID NO: 111472 - protein, 9 aa, Artificial Sequence
  Description of Artificial Sequence: Synthetic peptide
  Seed: QPQPRKKAT (MAGC3_HUMAN)
QQQPRKKAL

SEQ ID NO: 111473 - protein, 9 aa, Artificial Sequence
  Description of Artificial Sequence: Synthetic peptide
  Seed: FPSWYMDAL (MAGC3_HUMAN)
FSSWYMDAM

SEQ ID NO: 111474 - protein, 10 aa, Artificial Sequence
  Description of Artificial Sequence: Synthetic peptide
  Seed: MQMNVINTYT (MAGC3_HUMAN)
MEMNVINTYM

SEQ ID NO: 111475 - protein, 9 aa, Artificial Sequence
  Description of Artificial Sequence: Synthetic peptide
  Seed: MQMNVINTY (MAGC3_HUMAN)
MQMNVINTA

SEQ ID NO: 111476 - protein, 9 aa, Artificial Sequence
  Description of Artificial Sequence: Synthetic peptide
  Seed: QPQPRKKAT (MAGC3_HUMAN)
QPQPRKKAI

SEQ ID NO: 111477 - protein, 10 aa, Artificial Sequence
  Description of Artificial Sequence: Synthetic peptide
  Seed: MNVINTYTGY (MAGC3_HUMAN)
MSVINTYTGW

SEQ ID NO: 111478 - protein, 9 aa, Artificial Sequence
  Description of Artificial Sequence: Synthetic peptide
  Seed: TEASPQQKK (MAGC3_HUMAN)
TEASPQQKM

SEQ ID NO: 111479 - protein, 9 aa, Artificial Sequence
  Description of Artificial Sequence: Synthetic peptide
  Seed: VLPPQPQPR (MAGC3_HUMAN)
VIPPQPQPY

SEQ ID NO: 111480 - protein, 10 aa, Artificial Sequence
  Description of Artificial Sequence: Synthetic peptide
  Seed: KLVQFLLLKY (MAGC3_HUMAN)
KAVQFLLLKR

SEQ ID NO: 111481 - protein, 10 aa, Artificial Sequence
  Description of Artificial Sequence: Synthetic peptide
  Seed: LPTWRRGTGY (MAGC3_HUMAN)
LWTWRRGTGW

SEQ ID NO: 111482 - protein, 10 aa, Artificial Sequence
  Description of Artificial Sequence: Synthetic peptide
  Seed: SLVLCPTYFK (MAGC3_HUMAN)
SPVLCPTYFK

SEQ ID NO: 111483 - protein, 10 aa, Artificial Sequence
  Description of Artificial Sequence: Synthetic peptide
  Seed: LLILILSVIF (MAGC3_HUMAN)
LQILILSVIY

SEQ ID NO: 111484 - protein, 10 aa, Artificial Sequence
  Description of Artificial Sequence: Synthetic peptide
  Seed: TDMDPDNHSY (MAGC3_HUMAN)
TVMDPDNHSL

SEQ ID NO: 111485 - protein, 10 aa, Artificial Sequence
  Description of Artificial Sequence: Synthetic peptide
  Seed: EMQMNVINTY (MAGC3_HUMAN)
ERQMNVINTM

SEQ ID NO: 111486 - protein, 9 aa, Artificial Sequence
  Description of Artificial Sequence: Synthetic peptide
  Seed: EFIELIFGI (MAGC3_HUMAN)
ETIELIFGM

SEQ ID NO: 111487 - protein, 9 aa, Artificial Sequence
  Description of Artificial Sequence: Synthetic peptide
  Seed: KAHEFIELI (MAGC3_HUMAN)
KMHEFIELI

SEQ ID NO: 111488 - protein, 10 aa, Artificial Sequence
  Description of Artificial Sequence: Synthetic peptide
  Seed: FADVLSRLAL (MAGC3_HUMAN)
FPDVLSRLAM

SEQ ID NO: 111489 - protein, 10 aa, Artificial Sequence
  Description of Artificial Sequence: Synthetic peptide
  Seed: VLDLANPQGL (MAGC3_HUMAN)
VADLANPQGF

SEQ ID NO: 111490 - protein, 9 aa, Artificial Sequence
  Description of Artificial Sequence: Synthetic peptide
  Seed: EIPPQGPPK (MAGC3_HUMAN)
EVPPQGPPR

SEQ ID NO: 111491 - protein, 9 aa, Artificial Sequence
  Description of Artificial Sequence: Synthetic peptide
  Seed: SEEVIWEVL (MAGC3_HUMAN)
SEEVIWEVY

SEQ ID NO: 111492 - protein, 9 aa, Artificial Sequence
  Description of Artificial Sequence: Synthetic peptide
  Seed: VLPPQPQPR (MAGC3_HUMAN)
VAPPQPQPF

SEQ ID NO: 111493 - protein, 8 aa, Artificial Sequence
  Description of Artificial Sequence: Synthetic peptide
  Seed: PAAGMPPL (MAGC3_HUMAN)
PRAGMPPL

SEQ ID NO: 111494 - protein, 10 aa, Artificial Sequence
  Description of Artificial Sequence: Synthetic peptide
  Seed: MQMNVINTYT (MAGC3_HUMAN)
MQMNVINTYN

SEQ ID NO: 111495 - protein, 9 aa, Artificial Sequence
  Description of Artificial Sequence: Synthetic peptide
  Seed: YQAKEPLTR (MAGC3_HUMAN)
YRAKEPLTI

SEQ ID NO: 111496 - protein, 9 aa, Artificial Sequence
  Description of Artificial Sequence: Synthetic peptide
  Seed: WVKNTCATY (MAGC3_HUMAN)
WYKNTCATV

SEQ ID NO: 111497 - protein, 9 aa, Artificial Sequence
  Description of Artificial Sequence: Synthetic peptide
  Seed: IIPSAFPSW (MAGC3_HUMAN)
ISPSAFPSL

SEQ ID NO: 111498 - protein, 9 aa, Artificial Sequence
  Description of Artificial Sequence: Synthetic peptide
  Seed: DVLSRLALW (MAGC3_HUMAN)
DVLSRLALL

SEQ ID NO: 111499 - protein, 9 aa, Artificial Sequence
  Description of Artificial Sequence: Synthetic peptide
  Seed: LKYQTKEPV (MAGC3_HUMAN)
LIYQTKEPF

SEQ ID NO: 111500 - protein, 10 aa, Artificial Sequence
  Description of Artificial Sequence: Synthetic peptide
  Seed: MDPDNHSYFF (MAGC3_HUMAN)
MAPDNHSYFL

SEQ ID NO: 111501 - protein, 11 aa, Artificial Sequence
  Description of Artificial Sequence: Synthetic peptide
  Seed: VVLPPQPQPRK (MAGC3_HUMAN)
VVLPPQPQPRR

SEQ ID NO: 111502 - protein, 9 aa, Artificial Sequence
  Description of Artificial Sequence: Synthetic peptide
  Seed: LTEASPQQK (MAGC3_HUMAN)
LMEASPQQY

SEQ ID NO: 111503 - protein, 9 aa, Artificial Sequence
  Description of Artificial Sequence: Synthetic peptide
  Seed: KAHEFIELI (MAGC3_HUMAN)
KEHEFIELV

SEQ ID NO: 111504 - protein, 9 aa, Artificial Sequence
  Description of Artificial Sequence: Synthetic peptide
  Seed: DSDLPTWRR (MAGC3_HUMAN)
DTDLPTWRR

SEQ ID NO: 111505 - protein, 9 aa, Artificial Sequence
  Description of Artificial Sequence: Synthetic peptide
  Seed: IIDTTDDAT (MAGC3_HUMAN)
INDTTDDAL

SEQ ID NO: 111506 - protein, 9 aa, Artificial Sequence
  Description of Artificial Sequence: Synthetic peptide
  Seed: YTGYFPMIF (MAGC3_HUMAN)
YTGYFPMIM

SEQ ID NO: 111507 - protein, 9 aa, Artificial Sequence
  Description of Artificial Sequence: Synthetic peptide
  Seed: SLVLCPTYF (MAGC3_HUMAN)
SIVLCPTYL

SEQ ID NO: 111508 - protein, 11 aa, Artificial Sequence
  Description of Artificial Sequence: Synthetic peptide
  Seed: LTDMDPDNHSY (MAGC3_HUMAN)
LLDMDPDNHSL

SEQ ID NO: 111509 - protein, 11 aa, Artificial Sequence
  Description of Artificial Sequence: Synthetic peptide
  Seed: FSDGSLGQWVK (MAGC3_HUMAN)
FSDGSLGQWVY

SEQ ID NO: 111510 - protein, 10 aa, Artificial Sequence
  Description of Artificial Sequence: Synthetic peptide
  Seed: LDLANPQGLA (MAGC3_HUMAN)
LNLANPQGLV

SEQ ID NO: 111511 - protein, 9 aa, Artificial Sequence
  Description of Artificial Sequence: Synthetic peptide
  Seed: NTYTGYFPM (MAGC3_HUMAN)
NIYTGYFPI

SEQ ID NO: 111512 - protein, 10 aa, Artificial Sequence
  Description of Artificial Sequence: Synthetic peptide
  Seed: AELVQFLLLK (MAGC3_HUMAN)
AELVQFLLLL

SEQ ID NO: 111513 - protein, 9 aa, Artificial Sequence
  Description of Artificial Sequence: Synthetic peptide
  Seed: QDWPLNEKR (MAGC3_HUMAN)
QAWPLNEKK

SEQ ID NO: 111514 - protein, 10 aa, Artificial Sequence
  Description of Artificial Sequence: Synthetic peptide
  Seed: LVLCPTYFKL (MAGC3_HUMAN)
LMLCPTYFKI

SEQ ID NO: 111515 - protein, 10 aa, Artificial Sequence
  Description of Artificial Sequence: Synthetic peptide
  Seed: ASPSVMSTNF (MAGC3_HUMAN)
AQPSVMSTNY

SEQ ID NO: 111516 - protein, 9 aa, Artificial Sequence
  Description of Artificial Sequence: Synthetic peptide
  Seed: GPWSALAGF (MAGC3_HUMAN)
GPWSALAGA

SEQ ID NO: 111517 - protein, 9 aa, Artificial Sequence
  Description of Artificial Sequence: Synthetic peptide
  Seed: QGMPKNCLL (MAGC3_HUMAN)
QTMPKNCLF

SEQ ID NO: 111518 - protein, 10 aa, Artificial Sequence
  Description of Artificial Sequence: Synthetic peptide
  Seed: YQAKEPLTRA (MAGC3_HUMAN)
YLAKEPLTRA

SEQ ID NO: 111519 - protein, 9 aa, Artificial Sequence
  Description of Artificial Sequence: Synthetic peptide
  Seed: VPEEVIWEV (MAGC3_HUMAN)
VSEEVIWEM

SEQ ID NO: 111520 - protein, 9 aa, Artificial Sequence
  Description of Artificial Sequence: Synthetic peptide
  Seed: NTYTGYFPM (MAGC3_HUMAN)
NTYTGYFPA

SEQ ID NO: 111521 - protein, 9 aa, Artificial Sequence
  Description of Artificial Sequence: Synthetic peptide
  Seed: RGTGYTLSL (MAGC3_HUMAN)
RVTGYTLSM

SEQ ID NO: 111522 - protein, 9 aa, Artificial Sequence
  Description of Artificial Sequence: Synthetic peptide
  Seed: TEASPQQKK (MAGC3_HUMAN)
TEASPQQKW

SEQ ID NO: 111523 - protein, 9 aa, Artificial Sequence
  Description of Artificial Sequence: Synthetic peptide
  Seed: LSSIIPSAF (MAGC3_HUMAN)
LISIIPSAW

SEQ ID NO: 111524 - protein, 9 aa, Artificial Sequence
  Description of Artificial Sequence: Synthetic peptide
  Seed: LKYQTKEPV (MAGC3_HUMAN)
LEYQTKEPY

SEQ ID NO: 111525 - protein, 10 aa, Artificial Sequence
  Description of Artificial Sequence: Synthetic peptide
  Seed: MDPDNHSYFF (MAGC3_HUMAN)
MRPDNHSYFF

SEQ ID NO: 111526 - protein, 9 aa, Artificial Sequence
  Description of Artificial Sequence: Synthetic peptide
  Seed: IIPSAFPSW (MAGC3_HUMAN)
IWPSAFPSI

SEQ ID NO: 111527 - protein, 9 aa, Artificial Sequence
  Description of Artificial Sequence: Synthetic peptide
  Seed: MQMNVINTY (MAGC3_HUMAN)
MPMNVINTC

SEQ ID NO: 111528 - protein, 10 aa, Artificial Sequence
  Description of Artificial Sequence: Synthetic peptide
  Seed: IELIFGIALT (MAGC3_HUMAN)
IGLIFGIALI

SEQ ID NO: 111529 - protein, 10 aa, Artificial Sequence
  Description of Artificial Sequence: Synthetic peptide
  Seed: KVAELVQFLL (MAGC3_HUMAN)
KQAELVQFLA

SEQ ID NO: 111530 - protein, 9 aa, Artificial Sequence
  Description of Artificial Sequence: Synthetic peptide
  Seed: MIFGKAHEF (MAGC3_HUMAN)
MLFGKAHEY

SEQ ID NO: 111531 - protein, 8 aa, Artificial Sequence
  Description of Artificial Sequence: Synthetic peptide
  Seed: YTLSLPAV (MAGC3_HUMAN)
YMLSLPAI

SEQ ID NO: 111532 - protein, 9 aa, Artificial Sequence
  Description of Artificial Sequence: Synthetic peptide
  Seed: ILILSMIFI (MAGC3_HUMAN)
IQILSMIFA

SEQ ID NO: 111533 - protein, 9 aa, Artificial Sequence
  Description of Artificial Sequence: Synthetic peptide
  Seed: TEVDPDHFY (MAGC3_HUMAN)
TEVDPDHFT

SEQ ID NO: 111534 - protein, 11 aa, Artificial Sequence
  Description of Artificial Sequence: Synthetic peptide
  Seed: ATFSDGSLGQW (MAGC3_HUMAN)
AMFSDGSLGQY

SEQ ID NO: 111535 - protein, 10 aa, Artificial Sequence
  Description of Artificial Sequence: Synthetic peptide
  Seed: KYKDYFPMIF (MAGC3_HUMAN)
KKKDYFPMIY

SEQ ID NO: 111536 - protein, 10 aa, Artificial Sequence
  Description of Artificial Sequence: Synthetic peptide
  Seed: DMDPDNHSYF (MAGC3_HUMAN)
DVDPDNHSYY

SEQ ID NO: 111537 - protein, 9 aa, Artificial Sequence
  Description of Artificial Sequence: Synthetic peptide
  Seed: HFYVFVNTL (MAGC3_HUMAN)
HFYVFVNTM

SEQ ID NO: 111538 - protein, 9 aa, Artificial Sequence
  Description of Artificial Sequence: Synthetic peptide
  Seed: VIWEVLNAI (MAGC3_HUMAN)
VMWEVLNAR

SEQ ID NO: 111539 - protein, 9 aa, Artificial Sequence
  Description of Artificial Sequence: Synthetic peptide
  Seed: VDPDHFYVF (MAGC3_HUMAN)
VRPDHFYVM

SEQ ID NO: 111540 - protein, 10 aa, Artificial Sequence
  Description of Artificial Sequence: Synthetic peptide
  Seed: YALDEKVAEL (MAGC3_HUMAN)
YRLDEKVAEL

SEQ ID NO: 111541 - protein, 9 aa, Artificial Sequence
  Description of Artificial Sequence: Synthetic peptide
  Seed: TSDQRMDSL (MAGC3_HUMAN)
TADQRMDSF

SEQ ID NO: 111542 - protein, 9 aa, Artificial Sequence
  Description of Artificial Sequence: Synthetic peptide
  Seed: KYKDYFPMI (MAGC3_HUMAN)
KTKDYFPMI

SEQ ID NO: 111543 - protein, 9 aa, Artificial Sequence
  Description of Artificial Sequence: Synthetic peptide
  Seed: RGTGYTLSL (MAGC3_HUMAN)
RITGYTLSY

SEQ ID NO: 111544 - protein, 9 aa, Artificial Sequence
  Description of Artificial Sequence: Synthetic peptide
  Seed: AGFADVLSR (MAGC3_HUMAN)
ATFADVLSV

SEQ ID NO: 111545 - protein, 9 aa, Artificial Sequence
  Description of Artificial Sequence: Synthetic peptide
  Seed: LSSIIPSAF (MAGC3_HUMAN)
LVSIIPSAM

SEQ ID NO: 111546 - protein, 10 aa, Artificial Sequence
  Description of Artificial Sequence: Synthetic peptide
  Seed: LPESEPLFTY (MAGC3_HUMAN)
LPESEPLFTF

SEQ ID NO: 111547 - protein, 10 aa, Artificial Sequence
  Description of Artificial Sequence: Synthetic peptide
  Seed: FADVLSRLAL (MAGC3_HUMAN)
FPDVLSRLAL

SEQ ID NO: 111548 - protein, 10 aa, Artificial Sequence
  Description of Artificial Sequence: Synthetic peptide
  Seed: FSDGSLGQWV (MAGC3_HUMAN)
FLDGSLGQWV

SEQ ID NO: 111549 - protein, 9 aa, Artificial Sequence
  Description of Artificial Sequence: Synthetic peptide
  Seed: EVLSAIGPI (MAGC3_HUMAN)
ETLSAIGPW

SEQ ID NO: 111550 - protein, 10 aa, Artificial Sequence
  Description of Artificial Sequence: Synthetic peptide
  Seed: TTDDATAMAS (MAGC3_HUMAN)
TFDDATAMAV

SEQ ID NO: 111551 - protein, 9 aa, Artificial Sequence
  Description of Artificial Sequence: Synthetic peptide
  Seed: RPAREVLEF (MAGC3_HUMAN)
RMAREVLEM

SEQ ID NO: 111552 - protein, 9 aa, Artificial Sequence
  Description of Artificial Sequence: Synthetic peptide
  Seed: EVLEFLSKL (MAGC3_HUMAN)
EILEFLSKI

SEQ ID NO: 111553 - protein, 10 aa, Artificial Sequence
  Description of Artificial Sequence: Synthetic peptide
  Seed: MQMNVINTYT (MAGC3_HUMAN)
MLMNVINTYL

SEQ ID NO: 111554 - protein, 9 aa, Artificial Sequence
  Description of Artificial Sequence: Synthetic peptide
  Seed: ATYALSPVV (MAGC3_HUMAN)
AAYALSPVK

SEQ ID NO: 111555 - protein, 10 aa, Artificial Sequence
  Description of Artificial Sequence: Synthetic peptide
  Seed: ATYALSPVVL (MAGC3_HUMAN)
AMYALSPVVF

SEQ ID NO: 111556 - protein, 11 aa, Artificial Sequence
  Description of Artificial Sequence: Synthetic peptide
  Seed: IIDTTDDATAM (MAGC3_HUMAN)
ISDTTDDATAW

SEQ ID NO: 111557 - protein, 9 aa, Artificial Sequence
  Description of Artificial Sequence: Synthetic peptide
  Seed: KVAELVQFL (MAGC3_HUMAN)
KMAELVQFL

SEQ ID NO: 111558 - protein, 11 aa, Artificial Sequence
  Description of Artificial Sequence: Synthetic peptide
  Seed: AEMQMNVINTY (MAGC3_HUMAN)
AEMQMNVINTM

SEQ ID NO: 111559 - protein, 9 aa, Artificial Sequence
  Description of Artificial Sequence: Synthetic peptide
  Seed: LKYQTKEPV (MAGC3_HUMAN)
LQYQTKEPV

SEQ ID NO: 111560 - protein, 9 aa, Artificial Sequence
  Description of Artificial Sequence: Synthetic peptide
  Seed: SEEEDTATW (MAGC3_HUMAN)
SAEEDTATW

SEQ ID NO: 111561 - protein, 10 aa, Artificial Sequence
  Description of Artificial Sequence: Synthetic peptide
  Seed: FFEDTLDLTY (MAGC3_HUMAN)
FSEDTLDLTM

SEQ ID NO: 111562 - protein, 9 aa, Artificial Sequence
  Description of Artificial Sequence: Synthetic peptide
  Seed: YSAFHLGHL (MAGC3_HUMAN)
YYAFHLGHF

SEQ ID NO: 111563 - protein, 8 aa, Artificial Sequence
  Description of Artificial Sequence: Synthetic peptide
  Seed: FLSKLSSI (MAGC3_HUMAN)
FMSKLSSA

SEQ ID NO: 111564 - protein, 11 aa, Artificial Sequence
  Description of Artificial Sequence: Synthetic peptide
  Seed: ATFSDGSLGQW (MAGC3_HUMAN)
AIFSDGSLGQW

SEQ ID NO: 111565 - protein, 9 aa, Artificial Sequence
  Description of Artificial Sequence: Synthetic peptide
  Seed: HSYFFEDTL (MAGC3_HUMAN)
HTYFFEDTY

SEQ ID NO: 111566 - protein, 9 aa, Artificial Sequence
  Description of Artificial Sequence: Synthetic peptide
  Seed: VLCPTYFKL (MAGC3_HUMAN)
VACPTYFKL

SEQ ID NO: 111567 - protein, 11 aa, Artificial Sequence
  Description of Artificial Sequence: Synthetic peptide
  Seed: IIDTTDDATAM (MAGC3_HUMAN)
ICDTTDDATAL

SEQ ID NO: 111568 - protein, 9 aa, Artificial Sequence
  Description of Artificial Sequence: Synthetic peptide
  Seed: SPSVMSTNF (MAGC3_HUMAN)
SASVMSTNF

SEQ ID NO: 111569 - protein, 10 aa, Artificial Sequence
  Description of Artificial Sequence: Synthetic peptide
  Seed: EAFCEESGLR (MAGC3_HUMAN)
EYFCEESGLR

SEQ ID NO: 111570 - protein, 9 aa, Artificial Sequence
  Description of Artificial Sequence: Synthetic peptide
  Seed: MIFGKAHEF (MAGC3_HUMAN)
MLFGKAHER

SEQ ID NO: 111571 - protein, 9 aa, Artificial Sequence
  Description of Artificial Sequence: Synthetic peptide
  Seed: AVSPGKRLW (MAGC3_HUMAN)
ASSPGKRLW

SEQ ID NO: 111572 - protein, 9 aa, Artificial Sequence
  Description of Artificial Sequence: Synthetic peptide
  Seed: NVINTYTGY (MAGC3_HUMAN)
NIINTYTGK

SEQ ID NO: 111573 - protein, 9 aa, Artificial Sequence
  Description of Artificial Sequence: Synthetic peptide
  Seed: LSDEQGMPQ (MAGC3_HUMAN)
LSDEQGMPL

SEQ ID NO: 111574 - protein, 10 aa, Artificial Sequence
  Description of Artificial Sequence: Synthetic peptide
  Seed: HLREVRLFLR (MAGC3_HUMAN)
HQREVRLFLR

SEQ ID NO: 111575 - protein, 10 aa, Artificial Sequence
  Description of Artificial Sequence: Synthetic peptide
  Seed: IELIFGIALT (MAGC3_HUMAN)
ITLIFGIALI

SEQ ID NO: 111576 - protein, 9 aa, Artificial Sequence
  Description of Artificial Sequence: Synthetic peptide
  Seed: YTGYFPMIF (MAGC3_HUMAN)
YTGYFPMIW

SEQ ID NO: 111577 - protein, 9 aa, Artificial Sequence
  Description of Artificial Sequence: Synthetic peptide
  Seed: EIPPQGPPK (MAGC3_HUMAN)
ELPPQGPPR

SEQ ID NO: 111578 - protein, 9 aa, Artificial Sequence
  Description of Artificial Sequence: Synthetic peptide
  Seed: KLVQFLLLK (MAGC3_HUMAN)
KSVQFLLLY

SEQ ID NO: 111579 - protein, 9 aa, Artificial Sequence
  Description of Artificial Sequence: Synthetic peptide
  Seed: EVLEFLSKL (MAGC3_HUMAN)
EALEFLSKY

SEQ ID NO: 111580 - protein, 9 aa, Artificial Sequence
  Description of Artificial Sequence: Synthetic peptide
  Seed: RTLSGSPGL (MAGC3_HUMAN)
RQLSGSPGR

SEQ ID NO: 111581 - protein, 9 aa, Artificial Sequence
  Description of Artificial Sequence: Synthetic peptide
  Seed: RKKATDKDY (MAGC3_HUMAN)
RQKATDKDY

SEQ ID NO: 111582 - protein, 9 aa, Artificial Sequence
  Description of Artificial Sequence: Synthetic peptide
  Seed: KLVQFLLLK (MAGC3_HUMAN)
KGVQFLLLR

SEQ ID NO: 111583 - protein, 10 aa, Artificial Sequence
  Description of Artificial Sequence: Synthetic peptide
  Seed: FFEDTLDLTY (MAGC3_HUMAN)
FLEDTLDLTL

SEQ ID NO: 111584 - protein, 10 aa, Artificial Sequence
  Description of Artificial Sequence: Synthetic peptide
  Seed: FKLWRTLSGS (MAGC3_HUMAN)
FILWRTLSGA

SEQ ID NO: 111585 - protein, 10 aa, Artificial Sequence
  Description of Artificial Sequence: Synthetic peptide
  Seed: LVLCPTYFKL (MAGC3_HUMAN)
LRLCPTYFKV

SEQ ID NO: 111586 - protein, 9 aa, Artificial Sequence
  Description of Artificial Sequence: Synthetic peptide
  Seed: NAIGPWSAL (MAGC3_HUMAN)
NVIGPWSAV

SEQ ID NO: 111587 - protein, 10 aa, Artificial Sequence
  Description of Artificial Sequence: Synthetic peptide
  Seed: KVDKLVQFLL (MAGC3_HUMAN)
KMDKLVQFLV

SEQ ID NO: 111588 - protein, 10 aa, Artificial Sequence
  Description of Artificial Sequence: Synthetic peptide
  Seed: SPPQSPLDSC (MAGC3_HUMAN)
SPPQSPLDSL

SEQ ID NO: 111589 - protein, 10 aa, Artificial Sequence
  Description of Artificial Sequence: Synthetic peptide
  Seed: TTDDATAMAS (MAGC3_HUMAN)
TTDDATAMAI

SEQ ID NO: 111590 - protein, 9 aa, Artificial Sequence
  Description of Artificial Sequence: Synthetic peptide
  Seed: DMDPDNHSY (MAGC3_HUMAN)
DSDPDNHSL

SEQ ID NO: 111591 - protein, 9 aa, Artificial Sequence
  Description of Artificial Sequence: Synthetic peptide
  Seed: ELIFGIALT (MAGC3_HUMAN)
ELIFGIALI

SEQ ID NO: 111592 - protein, 9 aa, Artificial Sequence
  Description of Artificial Sequence: Synthetic peptide
  Seed: TSDQRMDSL (MAGC3_HUMAN)
TVDQRMDSF

SEQ ID NO: 111593 - protein, 10 aa, Artificial Sequence
  Description of Artificial Sequence: Synthetic peptide
  Seed: EVIWEVLNAI (MAGC3_HUMAN)
EAIWEVLNAL

SEQ ID NO: 111594 - protein, 9 aa, Artificial Sequence
  Description of Artificial Sequence: Synthetic peptide
  Seed: FSLRRAVSV (MAGC3_HUMAN)
FPLRRAVSM

SEQ ID NO: 111595 - protein, 10 aa, Artificial Sequence
  Description of Artificial Sequence: Synthetic peptide
  Seed: YTLDEKVDKL (MAGC3_HUMAN)
YCLDEKVDKL

SEQ ID NO: 111596 - protein, 10 aa, Artificial Sequence
  Description of Artificial Sequence: Synthetic peptide
  Seed: LDLTYEGSLI (MAGC3_HUMAN)
LLLTYEGSLV

SEQ ID NO: 111597 - protein, 10 aa, Artificial Sequence
  Description of Artificial Sequence: Synthetic peptide
  Seed: NTYTGYFPMI (MAGC3_HUMAN)
NPYTGYFPMF

SEQ ID NO: 111598 - protein, 9 aa, Artificial Sequence
  Description of Artificial Sequence: Synthetic peptide
  Seed: HLREVRLFL (MAGC3_HUMAN)
HSREVRLFA

SEQ ID NO: 111599 - protein, 10 aa, Artificial Sequence
  Description of Artificial Sequence: Synthetic peptide
  Seed: KDYFPMIFGK (MAGC3_HUMAN)
KCYFPMIFGR

SEQ ID NO: 111600 - protein, 9 aa, Artificial Sequence
  Description of Artificial Sequence: Synthetic peptide
  Seed: AIGPWSALA (MAGC3_HUMAN)
ALGPWSALL

SEQ ID NO: 111601 - protein, 9 aa, Artificial Sequence
  Description of Artificial Sequence: Synthetic peptide
  Seed: TYALSPVVL (MAGC3_HUMAN)
TFALSPVVM

SEQ ID NO: 111602 - protein, 9 aa, Artificial Sequence
  Description of Artificial Sequence: Synthetic peptide
  Seed: ALDEKVAEL (MAGC3_HUMAN)
AYDEKVAEF

SEQ ID NO: 111603 - protein, 9 aa, Artificial Sequence
  Description of Artificial Sequence: Synthetic peptide
  Seed: LSGSPGLQL (MAGC3_HUMAN)
LVGSPGLQM

SEQ ID NO: 111604 - protein, 10 aa, Artificial Sequence
  Description of Artificial Sequence: Synthetic peptide
  Seed: MNVINTYTGY (MAGC3_HUMAN)
MDVINTYTGR

SEQ ID NO: 111605 - protein, 10 aa, Artificial Sequence
  Description of Artificial Sequence: Synthetic peptide
  Seed: MQMNVINTYT (MAGC3_HUMAN)
MDMNVINTYM

SEQ ID NO: 111606 - protein, 9 aa, Artificial Sequence
  Description of Artificial Sequence: Synthetic peptide
  Seed: ALDEKVAEL (MAGC3_HUMAN)
ATDEKVAEM

SEQ ID NO: 111607 - protein, 9 aa, Artificial Sequence
  Description of Artificial Sequence: Synthetic peptide
  Seed: MEDRAQAII (MAGC3_HUMAN)
MHDRAQAII

SEQ ID NO: 111608 - protein, 9 aa, Artificial Sequence
  Description of Artificial Sequence: Synthetic peptide
  Seed: IIPSAFPSW (MAGC3_HUMAN)
IIPSAFPSY

SEQ ID NO: 111609 - protein, 9 aa, Artificial Sequence
  Description of Artificial Sequence: Synthetic peptide
  Seed: MEDRAQAII (MAGC3_HUMAN)
MADRAQAIM

SEQ ID NO: 111610 - protein, 9 aa, Artificial Sequence
  Description of Artificial Sequence: Synthetic peptide
  Seed: LSGSPGLQL (MAGC3_HUMAN)
LYGSPGLQL

SEQ ID NO: 111611 - protein, 10 aa, Artificial Sequence
  Description of Artificial Sequence: Synthetic peptide
  Seed: RLLILILSVI (MAGC3_HUMAN)
RILILILSVV

SEQ ID NO: 111612 - protein, 9 aa, Artificial Sequence
  Description of Artificial Sequence: Synthetic peptide
  Seed: MLLPCHWVL (MAGC3_HUMAN)
MTLPCHWVF

SEQ ID NO: 111613 - protein, 9 aa, Artificial Sequence
  Description of Artificial Sequence: Synthetic peptide
  Seed: MIFGKAHEF (MAGC3_HUMAN)
MLFGKAHEV

SEQ ID NO: 111614 - protein, 9 aa, Artificial Sequence
  Description of Artificial Sequence: Synthetic peptide
  Seed: GSLPESEPL (MAGC3_HUMAN)
GVLPESEPF

SEQ ID NO: 111615 - protein, 9 aa, Artificial Sequence
  Description of Artificial Sequence: Synthetic peptide
  Seed: FKLWRTLSG (MAGC3_HUMAN)
FHLWRTLSY

SEQ ID NO: 111616 - protein, 11 aa, Artificial Sequence
  Description of Artificial Sequence: Synthetic peptide
  Seed: IWEVLNAIGPW (MAGC3_HUMAN)
IYEVLNAIGPW

SEQ ID NO: 111617 - protein, 10 aa, Artificial Sequence
  Description of Artificial Sequence: Synthetic peptide
  Seed: MNVINTYTGY (MAGC3_HUMAN)
MSVINTYTGM

SEQ ID NO: 111618 - protein, 10 aa, Artificial Sequence
  Description of Artificial Sequence: Synthetic peptide
  Seed: INTYTGYFPM (MAGC3_HUMAN)
IFTYTGYFPW

SEQ ID NO: 111619 - protein, 11 aa, Artificial Sequence
  Description of Artificial Sequence: Synthetic peptide
  Seed: LSKLSSIIPSA (MAGC3_HUMAN)
LMKLSSIIPSV

SEQ ID NO: 111620 - protein, 9 aa, Artificial Sequence
  Description of Artificial Sequence: Synthetic peptide
  Seed: MIFGKAHEF (MAGC3_HUMAN)
MTFGKAHEL

SEQ ID NO: 111621 - protein, 10 aa, Artificial Sequence
  Description of Artificial Sequence: Synthetic peptide
  Seed: TGYFPMIFRK (MAGC3_HUMAN)
TAYFPMIFRV

SEQ ID NO: 111622 - protein, 10 aa, Artificial Sequence
  Description of Artificial Sequence: Synthetic peptide
  Seed: YALDEKVAEL (MAGC3_HUMAN)
YWLDEKVAEI

SEQ ID NO: 111623 - protein, 10 aa, Artificial Sequence
  Description of Artificial Sequence: Synthetic peptide
  Seed: YALSPVVLPP (MAGC3_HUMAN)
YYLSPVVLPA

SEQ ID NO: 111624 - protein, 10 aa, Artificial Sequence
  Description of Artificial Sequence: Synthetic peptide
  Seed: MNVINTYTGY (MAGC3_HUMAN)
MAVINTYTGM

SEQ ID NO: 111625 - protein, 8 aa, Artificial Sequence
  Description of Artificial Sequence: Synthetic peptide
  Seed: FLSKLSSI (MAGC3_HUMAN)
FMSKLSSV

SEQ ID NO: 111626 - protein, 9 aa, Artificial Sequence
  Description of Artificial Sequence: Synthetic peptide
  Seed: KVAELVQFL (MAGC3_HUMAN)
KIAELVQFM

SEQ ID NO: 111627 - protein, 8 aa, Artificial Sequence
  Description of Artificial Sequence: Synthetic peptide
  Seed: KAHEFIEL (MAGC3_HUMAN)
KFHEFIEL

SEQ ID NO: 111628 - protein, 10 aa, Artificial Sequence
  Description of Artificial Sequence: Synthetic peptide
  Seed: SLPESEPLFT (MAGC3_HUMAN)
SLPESEPLFL

SEQ ID NO: 111629 - protein, 9 aa, Artificial Sequence
  Description of Artificial Sequence: Synthetic peptide
  Seed: TTDDATAMA (MAGC3_HUMAN)
TSDDATAMV

SEQ ID NO: 111630 - protein, 9 aa, Artificial Sequence
  Description of Artificial Sequence: Synthetic peptide
  Seed: DVLSRLALW (MAGC3_HUMAN)
DVLSRLALM

SEQ ID NO: 111631 - protein, 10 aa, Artificial Sequence
  Description of Artificial Sequence: Synthetic peptide
  Seed: KVAELVQFLL (MAGC3_HUMAN)
KMAELVQFLC

SEQ ID NO: 111632 - protein, 9 aa, Artificial Sequence
  Description of Artificial Sequence: Synthetic peptide
  Seed: FPSWYMDAL (MAGC3_HUMAN)
FASWYMDAY

SEQ ID NO: 111633 - protein, 11 aa, Artificial Sequence
  Description of Artificial Sequence: Synthetic peptide
  Seed: EILFGISLTEV (MAGC3_HUMAN)
EMLFGISLTEL

SEQ ID NO: 111634 - protein, 9 aa, Artificial Sequence
  Description of Artificial Sequence: Synthetic peptide
  Seed: SAIGPIQRP (MAGC3_HUMAN)
STIGPIQRF

SEQ ID NO: 111635 - protein, 8 aa, Artificial Sequence
  Description of Artificial Sequence: Synthetic peptide
  Seed: YMDALKDM (MAGC3_HUMAN)
YWDALKDL

SEQ ID NO: 111636 - protein, 9 aa, Artificial Sequence
  Description of Artificial Sequence: Synthetic peptide
  Seed: ASEEVIWEV (MAGC3_HUMAN)
AREEVIWEL

SEQ ID NO: 111637 - protein, 9 aa, Artificial Sequence
  Description of Artificial Sequence: Synthetic peptide
  Seed: MPKNCLLIL (MAGC3_HUMAN)
MQKNCLLIF

SEQ ID NO: 111638 - protein, 9 aa, Artificial Sequence
  Description of Artificial Sequence: Synthetic peptide
  Seed: FEDTLDLTY (MAGC3_HUMAN)
FSDTLDLTM

SEQ ID NO: 111639 - protein, 10 aa, Artificial Sequence
  Description of Artificial Sequence: Synthetic peptide
  Seed: REVLEFLSKL (MAGC3_HUMAN)
RIVLEFLSKI

SEQ ID NO: 111640 - protein, 9 aa, Artificial Sequence
  Description of Artificial Sequence: Synthetic peptide
  Seed: SASPSVMST (MAGC3_HUMAN)
SRSPSVMSF

SEQ ID NO: 111641 - protein, 11 aa, Artificial Sequence
  Description of Artificial Sequence: Synthetic peptide
  Seed: LDSCSSPLLWT (MAGC3_HUMAN)
LSSCSSPLLWD

SEQ ID NO: 111642 - protein, 10 aa, Artificial Sequence
  Description of Artificial Sequence: Synthetic peptide
  Seed: ALAGFADVLS (MAGC3_HUMAN)
ALAGFADVLL

SEQ ID NO: 111643 - protein, 9 aa, Artificial Sequence
  Description of Artificial Sequence: Synthetic peptide
  Seed: IPPQGPPKI (MAGC3_HUMAN)
IWPQGPPKY

SEQ ID NO: 111644 - protein, 9 aa, Artificial Sequence
  Description of Artificial Sequence: Synthetic peptide
  Seed: SPSVMSTNF (MAGC3_HUMAN)
SISVMSTNY

SEQ ID NO: 111645 - protein, 9 aa, Artificial Sequence
  Description of Artificial Sequence: Synthetic peptide
  Seed: IQRPAREVL (MAGC3_HUMAN)
IQRPAREVI

SEQ ID NO: 111646 - protein, 8 aa, Artificial Sequence
  Description of Artificial Sequence: Synthetic peptide
  Seed: SCSSPLLW (MAGC3_HUMAN)
SWSSPLLW

SEQ ID NO: 111647 - protein, 9 aa, Artificial Sequence
  Description of Artificial Sequence: Synthetic peptide
  Seed: AEMLTTVIK (MAGC3_HUMAN)
AEMLTTVIS

SEQ ID NO: 111648 - protein, 11 aa, Artificial Sequence
  Description of Artificial Sequence: Synthetic peptide
  Seed: KDMEDRAQAII (MAGC3_HUMAN)
KEMEDRAQAII

SEQ ID NO: 111649 - protein, 9 aa, Artificial Sequence
  Description of Artificial Sequence: Synthetic peptide
  Seed: SQPEGKFSL (MAGC3_HUMAN)
SQPEGKFSI

SEQ ID NO: 111650 - protein, 9 aa, Artificial Sequence
  Description of Artificial Sequence: Synthetic peptide
  Seed: TSDQRMDSL (MAGC3_HUMAN)
TYDQRMDSF

SEQ ID NO: 111651 - protein, 9 aa, Artificial Sequence
  Description of Artificial Sequence: Synthetic peptide
  Seed: VIKKYKDYF (MAGC3_HUMAN)
VSKKYKDYY

SEQ ID NO: 111652 - protein, 10 aa, Artificial Sequence
  Description of Artificial Sequence: Synthetic peptide
  Seed: EVLSAIGPIQ (MAGC3_HUMAN)
ETLSAIGPIK

SEQ ID NO: 111653 - protein, 9 aa, Artificial Sequence
  Description of Artificial Sequence: Synthetic peptide
  Seed: SLVLCPTYF (MAGC3_HUMAN)
SQVLCPTYY

SEQ ID NO: 111654 - protein, 10 aa, Artificial Sequence
  Description of Artificial Sequence: Synthetic peptide
  Seed: SKLSSIIPSA (MAGC3_HUMAN)
SNLSSIIPSV

SEQ ID NO: 111655 - protein, 9 aa, Artificial Sequence
  Description of Artificial Sequence: Synthetic peptide
  Seed: LKYQAKEPL (MAGC3_HUMAN)
LRYQAKEPL

SEQ ID NO: 111656 - protein, 9 aa, Artificial Sequence
  Description of Artificial Sequence: Synthetic peptide
  Seed: MQMNVINTY (MAGC3_HUMAN)
MTMNVINTA

SEQ ID NO: 111657 - protein, 11 aa, Artificial Sequence
  Description of Artificial Sequence: Synthetic peptide
  Seed: KKYKDYFPMIF (MAGC3_HUMAN)
KWYKDYFPMIF

SEQ ID NO: 111658 - protein, 9 aa, Artificial Sequence
  Description of Artificial Sequence: Synthetic peptide
  Seed: EVLNAIGPW (MAGC3_HUMAN)
EILNAIGPR

SEQ ID NO: 111659 - protein, 10 aa, Artificial Sequence
  Description of Artificial Sequence: Synthetic peptide
  Seed: EKVAELVQFL (MAGC3_HUMAN)
ESVAELVQFL

SEQ ID NO: 111660 - protein, 9 aa, Artificial Sequence
  Description of Artificial Sequence: Synthetic peptide
  Seed: FEDTLDLTY (MAGC3_HUMAN)
FEDTLDLTL

SEQ ID NO: 111661 - protein, 11 aa, Artificial Sequence
  Description of Artificial Sequence: Synthetic peptide
  Seed: RGLTEASPQQK (MAGC3_HUMAN)
RLLTEASPQQR

SEQ ID NO: 111662 - protein, 8 aa, Artificial Sequence
  Description of Artificial Sequence: Synthetic peptide
  Seed: FIELIFGI (MAGC3_HUMAN)
FIELIFGL

SEQ ID NO: 111663 - protein, 11 aa, Artificial Sequence
  Description of Artificial Sequence: Synthetic peptide
  Seed: SSIIPSAFPSW (MAGC3_HUMAN)
STIIPSAFPSY

SEQ ID NO: 111664 - protein, 11 aa, Artificial Sequence
  Description of Artificial Sequence: Synthetic peptide
  Seed: GHLREVRLFLR (MAGC3_HUMAN)
GTLREVRLFLR

SEQ ID NO: 111665 - protein, 10 aa, Artificial Sequence
  Description of Artificial Sequence: Synthetic peptide
  Seed: MQMNVINTYT (MAGC3_HUMAN)
MDMNVINTYV

SEQ ID NO: 111666 - protein, 10 aa, Artificial Sequence
  Description of Artificial Sequence: Synthetic peptide
  Seed: YALDEKVAEL (MAGC3_HUMAN)
YYLDEKVAEY

SEQ ID NO: 111667 - protein, 9 aa, Artificial Sequence
  Description of Artificial Sequence: Synthetic peptide
  Seed: MASASPSVM (MAGC3_HUMAN)
MHSASPSVY

SEQ ID NO: 111668 - protein, 9 aa, Artificial Sequence
  Description of Artificial Sequence: Synthetic peptide
  Seed: EVLSAIGPI (MAGC3_HUMAN)
EVLSAIGPF

SEQ ID NO: 111669 - protein, 10 aa, Artificial Sequence
  Description of Artificial Sequence: Synthetic peptide
  Seed: EKVAELVQFL (MAGC3_HUMAN)
EVVAELVQFF

SEQ ID NO: 111670 - protein, 11 aa, Artificial Sequence
  Description of Artificial Sequence: Synthetic peptide
  Seed: INTYTGYFPMI (MAGC3_HUMAN)
IRTYTGYFPMF

SEQ ID NO: 111671 - protein, 9 aa, Artificial Sequence
  Description of Artificial Sequence: Synthetic peptide
  Seed: MIFRKAREF (MAGC3_HUMAN)
MYFRKAREV

SEQ ID NO: 111672 - protein, 10 aa, Artificial Sequence
  Description of Artificial Sequence: Synthetic peptide
  Seed: FADVLSRLAL (MAGC3_HUMAN)
FADVLSRLAM

SEQ ID NO: 111673 - protein, 9 aa, Artificial Sequence
  Description of Artificial Sequence: Synthetic peptide
  Seed: TSDQRMDSL (MAGC3_HUMAN)
TVDQRMDSI

SEQ ID NO: 111674 - protein, 10 aa, Artificial Sequence
  Description of Artificial Sequence: Synthetic peptide
  Seed: INTYTGYFPM (MAGC3_HUMAN)
ISTYTGYFPM

SEQ ID NO: 111675 - protein, 10 aa, Artificial Sequence
  Description of Artificial Sequence: Synthetic peptide
  Seed: IELIFGIALT (MAGC3_HUMAN)
ITLIFGIALA

SEQ ID NO: 111676 - protein, 11 aa, Artificial Sequence
  Description of Artificial Sequence: Synthetic peptide
  Seed: YALDEKVAELV (MAGC3_HUMAN)
YQLDEKVAELV

SEQ ID NO: 111677 - protein, 9 aa, Artificial Sequence
  Description of Artificial Sequence: Synthetic peptide
  Seed: IQRPAREVL (MAGC3_HUMAN)
ITRPAREVY

SEQ ID NO: 111678 - protein, 11 aa, Artificial Sequence
  Description of Artificial Sequence: Synthetic peptide
  Seed: TDMDPDNHSYF (MAGC3_HUMAN)
TEMDPDNHSYY

SEQ ID NO: 111679 - protein, 9 aa, Artificial Sequence
  Description of Artificial Sequence: Synthetic peptide
  Seed: YFFEDTLDL (MAGC3_HUMAN)
YLFEDTLDY

SEQ ID NO: 111680 - protein, 10 aa, Artificial Sequence
  Description of Artificial Sequence: Synthetic peptide
  Seed: SIIPSAFPSW (MAGC3_HUMAN)
SMIPSAFPSY

SEQ ID NO: 111681 - protein, 10 aa, Artificial Sequence
  Description of Artificial Sequence: Synthetic peptide
  Seed: TDMDPDNHSY (MAGC3_HUMAN)
TQMDPDNHSF

SEQ ID NO: 111682 - protein, 9 aa, Artificial Sequence
  Description of Artificial Sequence: Synthetic peptide
  Seed: RTLSGSPGL (MAGC3_HUMAN)
RYLSGSPGY

SEQ ID NO: 111683 - protein, 9 aa, Artificial Sequence
  Description of Artificial Sequence: Synthetic peptide
  Seed: YTGYFPMIF (MAGC3_HUMAN)
YWGYFPMII

SEQ ID NO: 111684 - protein, 9 aa, Artificial Sequence
  Description of Artificial Sequence: Synthetic peptide
  Seed: LKYQAKEPL (MAGC3_HUMAN)
LMYQAKEPI

SEQ ID NO: 111685 - protein, 9 aa, Artificial Sequence
  Description of Artificial Sequence: Synthetic peptide
  Seed: ELIFGIALT (MAGC3_HUMAN)
EGIFGIALV

SEQ ID NO: 111686 - protein, 9 aa, Artificial Sequence
  Description of Artificial Sequence: Synthetic peptide
  Seed: KLVQFLLLK (MAGC3_HUMAN)
KAVQFLLLF

SEQ ID NO: 111687 - protein, 8 aa, Artificial Sequence
  Description of Artificial Sequence: Synthetic peptide
  Seed: ILILSMIF (MAGC3_HUMAN)
IQILSMIM

SEQ ID NO: 111688 - protein, 10 aa, Artificial Sequence
  Description of Artificial Sequence: Synthetic peptide
  Seed: YALDEKVAEL (MAGC3_HUMAN)
YFLDEKVAET

SEQ ID NO: 111689 - protein, 9 aa, Artificial Sequence
  Description of Artificial Sequence: Synthetic peptide
  Seed: LIDDQGMPK (MAGC3_HUMAN)
LTDDQGMPF

SEQ ID NO: 111690 - protein, 11 aa, Artificial Sequence
  Description of Artificial Sequence: Synthetic peptide
  Seed: LIDDQGMPKNC (MAGC3_HUMAN)
LVDDQGMPKNL

SEQ ID NO: 111691 - protein, 9 aa, Artificial Sequence
  Description of Artificial Sequence: Synthetic peptide
  Seed: ALDEKVAEL (MAGC3_HUMAN)
AADEKVAEM

SEQ ID NO: 111692 - protein, 10 aa, Artificial Sequence
  Description of Artificial Sequence: Synthetic peptide
  Seed: MNVINTYTGY (MAGC3_HUMAN)
MWVINTYTGR

SEQ ID NO: 111693 - protein, 9 aa, Artificial Sequence
  Description of Artificial Sequence: Synthetic peptide
  Seed: NPQGLAGHR (MAGC3_HUMAN)
NTQGLAGHK

SEQ ID NO: 111694 - protein, 10 aa, Artificial Sequence
  Description of Artificial Sequence: Synthetic peptide
  Seed: AEMLTTVIKK (MAGC3_HUMAN)
AMMLTTVIKK

SEQ ID NO: 111695 - protein, 11 aa, Artificial Sequence
  Description of Artificial Sequence: Synthetic peptide
  Seed: TDMDPDNHSYF (MAGC3_HUMAN)
TIMDPDNHSYF

SEQ ID NO: 111696 - protein, 9 aa, Artificial Sequence
  Description of Artificial Sequence: Synthetic peptide
  Seed: LTEASPQQK (MAGC3_HUMAN)
LVEASPQQY

SEQ ID NO: 111697 - protein, 10 aa, Artificial Sequence
  Description of Artificial Sequence: Synthetic peptide
  Seed: LNAIGPWSAL (MAGC3_HUMAN)
LYAIGPWSAF

SEQ ID NO: 111698 - protein, 9 aa, Artificial Sequence
  Description of Artificial Sequence: Synthetic peptide
  Seed: RPAREVLEF (MAGC3_HUMAN)
RLAREVLEF

SEQ ID NO: 111699 - protein, 9 aa, Artificial Sequence
  Description of Artificial Sequence: Synthetic peptide
  Seed: SLVLCPTYF (MAGC3_HUMAN)
SLVLCPTYR

SEQ ID NO: 111700 - protein, 8 aa, Artificial Sequence
  Description of Artificial Sequence: Synthetic peptide
  Seed: SAFHLGHL (MAGC3_HUMAN)
SQFHLGHV

SEQ ID NO: 111701 - protein, 9 aa, Artificial Sequence
  Description of Artificial Sequence: Synthetic peptide
  Seed: KLSSIIPSA (MAGC3_HUMAN)
KVSSIIPSY

SEQ ID NO: 111702 - protein, 10 aa, Artificial Sequence
  Description of Artificial Sequence: Synthetic peptide
  Seed: INTYTGYFPM (MAGC3_HUMAN)
IRTYTGYFPW

SEQ ID NO: 111703 - protein, 11 aa, Artificial Sequence
  Description of Artificial Sequence: Synthetic peptide
  Seed: FLSKLSSIIPS (MAGC3_HUMAN)
FVSKLSSIIPV

SEQ ID NO: 111704 - protein, 9 aa, Artificial Sequence
  Description of Artificial Sequence: Synthetic peptide
  Seed: MPAAGMPPL (MAGC3_HUMAN)
MPAAGMPPG

SEQ ID NO: 111705 - protein, 11 aa, Artificial Sequence
  Description of Artificial Sequence: Synthetic peptide
  Seed: RTLSGSPGLQL (MAGC3_HUMAN)
RSLSGSPGLQR

SEQ ID NO: 111706 - protein, 10 aa, Artificial Sequence
  Description of Artificial Sequence: Synthetic peptide
  Seed: TGYFPMIFRK (MAGC3_HUMAN)
TGYFPMIFRR

SEQ ID NO: 111707 - protein, 9 aa, Artificial Sequence
  Description of Artificial Sequence: Synthetic peptide
  Seed: SLVLCPTYF (MAGC3_HUMAN)
SAVLCPTYY

SEQ ID NO: 111708 - protein, 9 aa, Artificial Sequence
  Description of Artificial Sequence: Synthetic peptide
  Seed: SLRRAVSVK (MAGC3_HUMAN)
SVRRAVSVY

SEQ ID NO: 111709 - protein, 10 aa, Artificial Sequence
  Description of Artificial Sequence: Synthetic peptide
  Seed: ASPSVMSTNF (MAGC3_HUMAN)
ASPSVMSTNW

SEQ ID NO: 111710 - protein, 9 aa, Artificial Sequence
  Description of Artificial Sequence: Synthetic peptide
  Seed: SQPEGKFSL (MAGC3_HUMAN)
SAPEGKFSF

SEQ ID NO: 111711 - protein, 9 aa, Artificial Sequence
  Description of Artificial Sequence: Synthetic peptide
  Seed: ALDEKVAEL (MAGC3_HUMAN)
AIDEKVAEI

SEQ ID NO: 111712 - protein, 9 aa, Artificial Sequence
  Description of Artificial Sequence: Synthetic peptide
  Seed: QPEGKFSLR (MAGC3_HUMAN)
QTEGKFSLK

SEQ ID NO: 111713 - protein, 10 aa, Artificial Sequence
  Description of Artificial Sequence: Synthetic peptide
  Seed: EMQMNVINTY (MAGC3_HUMAN)
ECQMNVINTF

SEQ ID NO: 111714 - protein, 11 aa, Artificial Sequence
  Description of Artificial Sequence: Synthetic peptide
  Seed: ALWESEGPEAF (MAGC3_HUMAN)
AIWESEGPEAW

SEQ ID NO: 111715 - protein, 11 aa, Artificial Sequence
  Description of Artificial Sequence: Synthetic peptide
  Seed: FLSKLSSIIPS (MAGC3_HUMAN)
FVSKLSSIIPI

SEQ ID NO: 111716 - protein, 10 aa, Artificial Sequence
  Description of Artificial Sequence: Synthetic peptide
  Seed: YALDEKVAEL (MAGC3_HUMAN)
YKLDEKVAEM

SEQ ID NO: 111717 - protein, 10 aa, Artificial Sequence
  Description of Artificial Sequence: Synthetic peptide
  Seed: TEVDPDHFYV (MAGC3_HUMAN)
TLVDPDHFYL

SEQ ID NO: 111718 - protein, 10 aa, Artificial Sequence
  Description of Artificial Sequence: Synthetic peptide
  Seed: YALDEKVAEL (MAGC3_HUMAN)
YRLDEKVAEM

SEQ ID NO: 111719 - protein, 9 aa, Artificial Sequence
  Description of Artificial Sequence: Synthetic peptide
  Seed: KAHEFIELI (MAGC3_HUMAN)
KLHEFIELW

SEQ ID NO: 111720 - protein, 10 aa, Artificial Sequence
  Description of Artificial Sequence: Synthetic peptide
  Seed: MQMNVINTYT (MAGC3_HUMAN)
MIMNVINTYT

SEQ ID NO: 111721 - protein, 9 aa, Artificial Sequence
  Description of Artificial Sequence: Synthetic peptide
  Seed: ISPQGPPQS (MAGC3_HUMAN)
ISPQGPPQV

SEQ ID NO: 111722 - protein, 10 aa, Artificial Sequence
  Description of Artificial Sequence: Synthetic peptide
  Seed: SALAGFADVL (MAGC3_HUMAN)
SMLAGFADVV

SEQ ID NO: 111723 - protein, 9 aa, Artificial Sequence
  Description of Artificial Sequence: Synthetic peptide
  Seed: KLSSIIPSA (MAGC3_HUMAN)
KVSSIIPSI

SEQ ID NO: 111724 - protein, 9 aa, Artificial Sequence
  Description of Artificial Sequence: Synthetic peptide
  Seed: MPPLPQSPP (MAGC3_HUMAN)
MPPLPQSPV

SEQ ID NO: 111725 - protein, 10 aa, Artificial Sequence
  Description of Artificial Sequence: Synthetic peptide
  Seed: WEVLSAIGPI (MAGC3_HUMAN)
WLVLSAIGPV

SEQ ID NO: 111726 - protein, 9 aa, Artificial Sequence
  Description of Artificial Sequence: Synthetic peptide
  Seed: LSSIIPSAF (MAGC3_HUMAN)
LVSIIPSAF

SEQ ID NO: 111727 - protein, 9 aa, Artificial Sequence
  Description of Artificial Sequence: Synthetic peptide
  Seed: YFFEDTLDL (MAGC3_HUMAN)
YHFEDTLDF

SEQ ID NO: 111728 - protein, 10 aa, Artificial Sequence
  Description of Artificial Sequence: Synthetic peptide
  Seed: YALSPVVLPP (MAGC3_HUMAN)
YRLSPVVLPT

SEQ ID NO: 111729 - protein, 9 aa, Artificial Sequence
  Description of Artificial Sequence: Synthetic peptide
  Seed: ADVLSRLAL (MAGC3_HUMAN)
AEVLSRLAS

SEQ ID NO: 111730 - protein, 9 aa, Artificial Sequence
  Description of Artificial Sequence: Synthetic peptide
  Seed: FLSKLSSII (MAGC3_HUMAN)
FISKLSSIM

SEQ ID NO: 111731 - protein, 10 aa, Artificial Sequence
  Description of Artificial Sequence: Synthetic peptide
  Seed: YTLDEKVDKL (MAGC3_HUMAN)
YLLDEKVDKW

SEQ ID NO: 111732 - protein, 9 aa, Artificial Sequence
  Description of Artificial Sequence: Synthetic peptide
  Seed: FPSWYMDAL (MAGC3_HUMAN)
FASWYMDAL

SEQ ID NO: 111733 - protein, 10 aa, Artificial Sequence
  Description of Artificial Sequence: Synthetic peptide
  Seed: ILILSMIFIK (MAGC3_HUMAN)
IGILSMIFIR

SEQ ID NO: 111734 - protein, 9 aa, Artificial Sequence
  Description of Artificial Sequence: Synthetic peptide
  Seed: KNCLLILIL (MAGC3_HUMAN)
KTCLLILIL

SEQ ID NO: 111735 - protein, 10 aa, Artificial Sequence
  Description of Artificial Sequence: Synthetic peptide
  Seed: KDYFPMIFGK (MAGC3_HUMAN)
KLYFPMIFGK

SEQ ID NO: 111736 - protein, 11 aa, Artificial Sequence
  Description of Artificial Sequence: Synthetic peptide
  Seed: LSKLSSIIPSA (MAGC3_HUMAN)
LWKLSSIIPSI

SEQ ID NO: 111737 - protein, 11 aa, Artificial Sequence
  Description of Artificial Sequence: Synthetic peptide
  Seed: HALPESESLPR (MAGC3_HUMAN)
HTLPESESLPY

SEQ ID NO: 111738 - protein, 9 aa, Artificial Sequence
  Description of Artificial Sequence: Synthetic peptide
  Seed: NVINTYTGY (MAGC3_HUMAN)
NAINTYTGK

SEQ ID NO: 111739 - protein, 10 aa, Artificial Sequence
  Description of Artificial Sequence: Synthetic peptide
  Seed: EVIWEVLSAI (MAGC3_HUMAN)
ESIWEVLSAL

SEQ ID NO: 111740 - protein, 9 aa, Artificial Sequence
  Description of Artificial Sequence: Synthetic peptide
  Seed: HFYVFVNTL (MAGC3_HUMAN)
HYYVFVNTI

SEQ ID NO: 111741 - protein, 9 aa, Artificial Sequence
  Description of Artificial Sequence: Synthetic peptide
  Seed: HSYFFEDTL (MAGC3_HUMAN)
HLYFFEDTY

SEQ ID NO: 111742 - protein, 9 aa, Artificial Sequence
  Description of Artificial Sequence: Synthetic peptide
  Seed: MASASPSVM (MAGC3_HUMAN)
MQSASPSVW

SEQ ID NO: 111743 - protein, 10 aa, Artificial Sequence
  Description of Artificial Sequence: Synthetic peptide
  Seed: WEVLSAIGPI (MAGC3_HUMAN)
WEVLSAIGPF

SEQ ID NO: 111744 - protein, 10 aa, Artificial Sequence
  Description of Artificial Sequence: Synthetic peptide
  Seed: ILFGISLTEV (MAGC3_HUMAN)
ILFGISLTER

SEQ ID NO: 111745 - protein, 10 aa, Artificial Sequence
  Description of Artificial Sequence: Synthetic peptide
  Seed: SPLDSCSSPL (MAGC3_HUMAN)
SMLDSCSSPI

SEQ ID NO: 111746 - protein, 10 aa, Artificial Sequence
  Description of Artificial Sequence: Synthetic peptide
  Seed: TAMASASPSV (MAGC3_HUMAN)
TAMASASPSY

SEQ ID NO: 111747 - protein, 11 aa, Artificial Sequence
  Description of Artificial Sequence: Synthetic peptide
  Seed: HALPESESLPR (MAGC3_HUMAN)
HMLPESESLPK

SEQ ID NO: 111748 - protein, 10 aa, Artificial Sequence
  Description of Artificial Sequence: Synthetic peptide
  Seed: NTYTGYFPMI (MAGC3_HUMAN)
NAYTGYFPMF

SEQ ID NO: 111749 - protein, 11 aa, Artificial Sequence
  Description of Artificial Sequence: Synthetic peptide
  Seed: LDSCSSPLLWT (MAGC3_HUMAN)
LSSCSSPLLWR

SEQ ID NO: 111750 - protein, 11 aa, Artificial Sequence
  Description of Artificial Sequence: Synthetic peptide
  Seed: TTDDATAMASA (MAGC3_HUMAN)
TSDDATAMASM

SEQ ID NO: 111751 - protein, 10 aa, Artificial Sequence
  Description of Artificial Sequence: Synthetic peptide
  Seed: MDPDNHSYFF (MAGC3_HUMAN)
MAPDNHSYFM

SEQ ID NO: 111752 - protein, 10 aa, Artificial Sequence
  Description of Artificial Sequence: Synthetic peptide
  Seed: KVAELVQFLL (MAGC3_HUMAN)
KMAELVQFLM

SEQ ID NO: 111753 - protein, 9 aa, Artificial Sequence
  Description of Artificial Sequence: Synthetic peptide
  Seed: FEDTLDLTY (MAGC3_HUMAN)
FFDTLDLTM

SEQ ID NO: 111754 - protein, 10 aa, Artificial Sequence
  Description of Artificial Sequence: Synthetic peptide
  Seed: YTLDEKVDKL (MAGC3_HUMAN)
YHLDEKVDKV

SEQ ID NO: 111755 - protein, 9 aa, Artificial Sequence
  Description of Artificial Sequence: Synthetic peptide
  Seed: MPAAGMPPL (MAGC3_HUMAN)
MYAAGMPPM

SEQ ID NO: 111756 - protein, 10 aa, Artificial Sequence
  Description of Artificial Sequence: Synthetic peptide
  Seed: SSEEEDTATW (MAGC3_HUMAN)
STEEEDTATY

SEQ ID NO: 111757 - protein, 9 aa, Artificial Sequence
  Description of Artificial Sequence: Synthetic peptide
  Seed: YFFEDTLDL (MAGC3_HUMAN)
YPFEDTLDM

SEQ ID NO: 111758 - protein, 9 aa, Artificial Sequence
  Description of Artificial Sequence: Synthetic peptide
  Seed: AGFADVLSR (MAGC3_HUMAN)
ATFADVLSL

SEQ ID NO: 111759 - protein, 10 aa, Artificial Sequence
  Description of Artificial Sequence: Synthetic peptide
  Seed: IIDTTDDATA (MAGC3_HUMAN)
IVDTTDDATF

SEQ ID NO: 111760 - protein, 9 aa, Artificial Sequence
  Description of Artificial Sequence: Synthetic peptide
  Seed: TSDQRMDSL (MAGC3_HUMAN)
TTDQRMDSL

SEQ ID NO: 111761 - protein, 11 aa, Artificial Sequence
  Description of Artificial Sequence: Synthetic peptide
  Seed: SSEEEDTATWH (MAGC3_HUMAN)
SIEEEDTATWY

SEQ ID NO: 111762 - protein, 9 aa, Artificial Sequence
  Description of Artificial Sequence: Synthetic peptide
  Seed: TKAEMLTTV (MAGC3_HUMAN)
TIAEMLTTV

SEQ ID NO: 111763 - protein, 9 aa, Artificial Sequence
  Description of Artificial Sequence: Synthetic peptide
  Seed: TAMASASPS (MAGC3_HUMAN)
TFMASASPY

SEQ ID NO: 111764 - protein, 9 aa, Artificial Sequence
  Description of Artificial Sequence: Synthetic peptide
  Seed: VINTYTGYF (MAGC3_HUMAN)
VINTYTGYY

SEQ ID NO: 111765 - protein, 11 aa, Artificial Sequence
  Description of Artificial Sequence: Synthetic peptide
  Seed: AIGPWSALAGF (MAGC3_HUMAN)
AAGPWSALAGY

SEQ ID NO: 111766 - protein, 9 aa, Artificial Sequence
  Description of Artificial Sequence: Synthetic peptide
  Seed: TKAEMLTTV (MAGC3_HUMAN)
TLAEMLTTV

SEQ ID NO: 111767 - protein, 10 aa, Artificial Sequence
  Description of Artificial Sequence: Synthetic peptide
  Seed: LDSCSSPLLW (MAGC3_HUMAN)
LPSCSSPLLF

SEQ ID NO: 111768 - protein, 10 aa, Artificial Sequence
  Description of Artificial Sequence: Synthetic peptide
  Seed: KVAELVQFLL (MAGC3_HUMAN)
KLAELVQFLN

SEQ ID NO: 111769 - protein, 9 aa, Artificial Sequence
  Description of Artificial Sequence: Synthetic peptide
  Seed: TEVDPDHFY (MAGC3_HUMAN)
TEVDPDHFF

SEQ ID NO: 111770 - protein, 9 aa, Artificial Sequence
  Description of Artificial Sequence: Synthetic peptide
  Seed: TSDQRMDSL (MAGC3_HUMAN)
TWDQRMDSV

SEQ ID NO: 111771 - protein, 9 aa, Artificial Sequence
  Description of Artificial Sequence: Synthetic peptide
  Seed: MPAAGMPPL (MAGC3_HUMAN)
MAAAGMPPY

SEQ ID NO: 111772 - protein, 9 aa, Artificial Sequence
  Description of Artificial Sequence: Synthetic peptide
  Seed: KEPVTKAEM (MAGC3_HUMAN)
KQPVTKAEF

SEQ ID NO: 111773 - protein, 9 aa, Artificial Sequence
  Description of Artificial Sequence: Synthetic peptide
  Seed: LSDEQGMPQ (MAGC3_HUMAN)
LADEQGMPF

SEQ ID NO: 111774 - protein, 9 aa, Artificial Sequence
  Description of Artificial Sequence: Synthetic peptide
  Seed: LSDEQGMPQ (MAGC3_HUMAN)
LQDEQGMPM

SEQ ID NO: 111775 - protein, 9 aa, Artificial Sequence
  Description of Artificial Sequence: Synthetic peptide
  Seed: GFADVLSRL (MAGC3_HUMAN)
GMADVLSRL

SEQ ID NO: 111776 - protein, 9 aa, Artificial Sequence
  Description of Artificial Sequence: Synthetic peptide
  Seed: MIFGKAHEF (MAGC3_HUMAN)
MIFGKAHEY

SEQ ID NO: 111777 - protein, 11 aa, Artificial Sequence
  Description of Artificial Sequence: Synthetic peptide
  Seed: RTLSGSPGLQL (MAGC3_HUMAN)
RRLSGSPGLQY

SEQ ID NO: 111778 - protein, 11 aa, Artificial Sequence
  Description of Artificial Sequence: Synthetic peptide
  Seed: MQMNVINTYTG (MAGC3_HUMAN)
MQMNVINTYTL

SEQ ID NO: 111779 - protein, 9 aa, Artificial Sequence
  Description of Artificial Sequence: Synthetic peptide
  Seed: LSDEQGMPQ (MAGC3_HUMAN)
LFDEQGMPI

SEQ ID NO: 111780 - protein, 10 aa, Artificial Sequence
  Description of Artificial Sequence: Synthetic peptide
  Seed: WPLNEKRTLW (MAGC3_HUMAN)
WALNEKRTLW

SEQ ID NO: 111781 - protein, 9 aa, Artificial Sequence
  Description of Artificial Sequence: Synthetic peptide
  Seed: DYSAFHLGH (MAGC3_HUMAN)
DLSAFHLGR

SEQ ID NO: 111782 - protein, 9 aa, Artificial Sequence
  Description of Artificial Sequence: Synthetic peptide
  Seed: FKLWRTLSG (MAGC3_HUMAN)
FALWRTLSF

SEQ ID NO: 111783 - protein, 9 aa, Artificial Sequence
  Description of Artificial Sequence: Synthetic peptide
  Seed: SLPAVSPGK (MAGC3_HUMAN)
STPAVSPGR

SEQ ID NO: 111784 - protein, 9 aa, Artificial Sequence
  Description of Artificial Sequence: Synthetic peptide
  Seed: LSSIIPSAF (MAGC3_HUMAN)
LVSIIPSAY

SEQ ID NO: 111785 - protein, 9 aa, Artificial Sequence
  Description of Artificial Sequence: Synthetic peptide
  Seed: TSDQRMDSL (MAGC3_HUMAN)
TYDQRMDSM

SEQ ID NO: 111786 - protein, 10 aa, Artificial Sequence
  Description of Artificial Sequence: Synthetic peptide
  Seed: ILFGISLTEV (MAGC3_HUMAN)
IQFGISLTEL

SEQ ID NO: 111787 - protein, 10 aa, Artificial Sequence
  Description of Artificial Sequence: Synthetic peptide
  Seed: MQMNVINTYT (MAGC3_HUMAN)
MKMNVINTYK

SEQ ID NO: 111788 - protein, 11 aa, Artificial Sequence
  Description of Artificial Sequence: Synthetic peptide
  Seed: RTLSGSPGLQL (MAGC3_HUMAN)
RTLSGSPGLQF

SEQ ID NO: 111789 - protein, 10 aa, Artificial Sequence
  Description of Artificial Sequence: Synthetic peptide
  Seed: SDQRMDSLVL (MAGC3_HUMAN)
SAQRMDSLVM

SEQ ID NO: 111790 - protein, 10 aa, Artificial Sequence
  Description of Artificial Sequence: Synthetic peptide
  Seed: AMASASPSVM (MAGC3_HUMAN)
ATASASPSVF

SEQ ID NO: 111791 - protein, 11 aa, Artificial Sequence
  Description of Artificial Sequence: Synthetic peptide
  Seed: EDMPAAGMPPL (MAGC3_HUMAN)
EEMPAAGMPPA

SEQ ID NO: 111792 - protein, 11 aa, Artificial Sequence
  Description of Artificial Sequence: Synthetic peptide
  Seed: YALDEKVAELV (MAGC3_HUMAN)
YMLDEKVAELK

SEQ ID NO: 111793 - protein, 9 aa, Artificial Sequence
  Description of Artificial Sequence: Synthetic peptide
  Seed: IIDTTDDAT (MAGC3_HUMAN)
IIDTTDDAF

SEQ ID NO: 111794 - protein, 10 aa, Artificial Sequence
  Description of Artificial Sequence: Synthetic peptide
  Seed: YALDEKVAEL (MAGC3_HUMAN)
YILDEKVAEY

SEQ ID NO: 111795 - protein, 9 aa, Artificial Sequence
  Description of Artificial Sequence: Synthetic peptide
  Seed: IPPQGPPKI (MAGC3_HUMAN)
IAPQGPPKF

SEQ ID NO: 111796 - protein, 9 aa, Artificial Sequence
  Description of Artificial Sequence: Synthetic peptide
  Seed: MPAAGMPPL (MAGC3_HUMAN)
MFAAGMPPF

SEQ ID NO: 111797 - protein, 10 aa, Artificial Sequence
  Description of Artificial Sequence: Synthetic peptide
  Seed: YALDEKVAEL (MAGC3_HUMAN)
YALDEKVAEW

SEQ ID NO: 111798 - protein, 9 aa, Artificial Sequence
  Description of Artificial Sequence: Synthetic peptide
  Seed: ALSPVVLPP (MAGC3_HUMAN)
AQSPVVLPL

SEQ ID NO: 111799 - protein, 9 aa, Artificial Sequence
  Description of Artificial Sequence: Synthetic peptide
  Seed: ISPQGPPQS (MAGC3_HUMAN)
IVPQGPPQM

SEQ ID NO: 111800 - protein, 9 aa, Artificial Sequence
  Description of Artificial Sequence: Synthetic peptide
  Seed: HALPESESL (MAGC3_HUMAN)
HHLPESESA

SEQ ID NO: 111801 - protein, 9 aa, Artificial Sequence
  Description of Artificial Sequence: Synthetic peptide
  Seed: LPQSPPEIP (MAGC3_HUMAN)
LPQSPPEIV

SEQ ID NO: 111802 - protein, 10 aa, Artificial Sequence
  Description of Artificial Sequence: Synthetic peptide
  Seed: KAHEFIELIF (MAGC3_HUMAN)
KSHEFIELIM

SEQ ID NO: 111803 - protein, 9 aa, Artificial Sequence
  Description of Artificial Sequence: Synthetic peptide
  Seed: YFPMIFRKA (MAGC3_HUMAN)
YWPMIFRKM

SEQ ID NO: 111804 - protein, 9 aa, Artificial Sequence
  Description of Artificial Sequence: Synthetic peptide
  Seed: WESEGPEAF (MAGC3_HUMAN)
WMSEGPEAL

SEQ ID NO: 111805 - protein, 10 aa, Artificial Sequence
  Description of Artificial Sequence: Synthetic peptide
  Seed: MNVINTYTGY (MAGC3_HUMAN)
MMVINTYTGW

SEQ ID NO: 111806 - protein, 11 aa, Artificial Sequence
  Description of Artificial Sequence: Synthetic peptide
  Seed: ILFGISLTEVD (MAGC3_HUMAN)
IMFGISLTEVK

SEQ ID NO: 111807 - protein, 9 aa, Artificial Sequence
  Description of Artificial Sequence: Synthetic peptide
  Seed: DTTDDATAM (MAGC3_HUMAN)
DLTDDATAR

SEQ ID NO: 111808 - protein, 11 aa, Artificial Sequence
  Description of Artificial Sequence: Synthetic peptide
  Seed: TDMDPDNHSYF (MAGC3_HUMAN)
TQMDPDNHSYW

SEQ ID NO: 111809 - protein, 9 aa, Artificial Sequence
  Description of Artificial Sequence: Synthetic peptide
  Seed: MIFRKAREF (MAGC3_HUMAN)
MPFRKAREL

SEQ ID NO: 111810 - protein, 10 aa, Artificial Sequence
  Description of Artificial Sequence: Synthetic peptide
  Seed: FKLWRTLSGS (MAGC3_HUMAN)
FILWRTLSGL

SEQ ID NO: 111811 - protein, 9 aa, Artificial Sequence
  Description of Artificial Sequence: Synthetic peptide
  Seed: HSYFFEDTL (MAGC3_HUMAN)
HMYFFEDTY

SEQ ID NO: 111812 - protein, 9 aa, Artificial Sequence
  Description of Artificial Sequence: Synthetic peptide
  Seed: ALAGFADVL (MAGC3_HUMAN)
ATAGFADVV

SEQ ID NO: 111813 - protein, 9 aa, Artificial Sequence
  Description of Artificial Sequence: Synthetic peptide
  Seed: MLLPCHWVL (MAGC3_HUMAN)
MILPCHWVL

SEQ ID NO: 111814 - protein, 9 aa, Artificial Sequence
  Description of Artificial Sequence: Synthetic peptide
  Seed: LANPQGLAG (MAGC3_HUMAN)
LGNPQGLAL

SEQ ID NO: 111815 - protein, 9 aa, Artificial Sequence
  Description of Artificial Sequence: Synthetic peptide
  Seed: EVLEFLSKL (MAGC3_HUMAN)
ETLEFLSKM

SEQ ID NO: 111816 - protein, 9 aa, Artificial Sequence
  Description of Artificial Sequence: Synthetic peptide
  Seed: SLVLCPTYF (MAGC3_HUMAN)
STVLCPTYR

SEQ ID NO: 111817 - protein, 10 aa, Artificial Sequence
  Description of Artificial Sequence: Synthetic peptide
  Seed: KATDKDYSAF (MAGC3_HUMAN)
KMTDKDYSAF

SEQ ID NO: 111818 - protein, 10 aa, Artificial Sequence
  Description of Artificial Sequence: Synthetic peptide
  Seed: FFEDTLDLTY (MAGC3_HUMAN)
FAEDTLDLTV

SEQ ID NO: 111819 - protein, 9 aa, Artificial Sequence
  Description of Artificial Sequence: Synthetic peptide
  Seed: ELIFGIALT (MAGC3_HUMAN)
ETIFGIALV

SEQ ID NO: 111820 - protein, 9 aa, Artificial Sequence
  Description of Artificial Sequence: Synthetic peptide
  Seed: FGSQPEGKF (MAGC3_HUMAN)
FQSQPEGKY

SEQ ID NO: 111821 - protein, 10 aa, Artificial Sequence
  Description of Artificial Sequence: Synthetic peptide
  Seed: ADVLSRLALW (MAGC3_HUMAN)
AAVLSRLALW

SEQ ID NO: 111822 - protein, 9 aa, Artificial Sequence
  Description of Artificial Sequence: Synthetic peptide
  Seed: VIWEVLNAI (MAGC3_HUMAN)
VQWEVLNAY

SEQ ID NO: 111823 - protein, 11 aa, Artificial Sequence
  Description of Artificial Sequence: Synthetic peptide
  Seed: SLVLCPTYFKL (MAGC3_HUMAN)
SIVLCPTYFKK

SEQ ID NO: 111824 - protein, 10 aa, Artificial Sequence
  Description of Artificial Sequence: Synthetic peptide
  Seed: TAMASASPSV (MAGC3_HUMAN)
TGMASASPSL

SEQ ID NO: 111825 - protein, 10 aa, Artificial Sequence
  Description of Artificial Sequence: Synthetic peptide
  Seed: YALSPVVLPP (MAGC3_HUMAN)
YMLSPVVLPA

SEQ ID NO: 111826 - protein, 9 aa, Artificial Sequence
  Description of Artificial Sequence: Synthetic peptide
  Seed: KDSDLPTWR (MAGC3_HUMAN)
KMSDLPTWK

SEQ ID NO: 111827 - protein, 10 aa, Artificial Sequence
  Description of Artificial Sequence: Synthetic peptide
  Seed: RLLILILSVI (MAGC3_HUMAN)
RALILILSVV

SEQ ID NO: 111828 - protein, 10 aa, Artificial Sequence
  Description of Artificial Sequence: Synthetic peptide
  Seed: YALSPVVLPP (MAGC3_HUMAN)
YCLSPVVLPV

SEQ ID NO: 111829 - protein, 10 aa, Artificial Sequence
  Description of Artificial Sequence: Synthetic peptide
  Seed: YALSPVVLPP (MAGC3_HUMAN)
YGLSPVVLPI

SEQ ID NO: 111830 - protein, 10 aa, Artificial Sequence
  Description of Artificial Sequence: Synthetic peptide
  Seed: LIFGIALTDM (MAGC3_HUMAN)
LLFGIALTDY

SEQ ID NO: 111831 - protein, 10 aa, Artificial Sequence
  Description of Artificial Sequence: Synthetic peptide
  Seed: EVIWEVLSAI (MAGC3_HUMAN)
EVIWEVLSAM

SEQ ID NO: 111832 - protein, 10 aa, Artificial Sequence
  Description of Artificial Sequence: Synthetic peptide
  Seed: SLIDDQGMPK (MAGC3_HUMAN)
SMIDDQGMPK

SEQ ID NO: 111833 - protein, 9 aa, Artificial Sequence
  Description of Artificial Sequence: Synthetic peptide
  Seed: EVIWEVLSA (MAGC3_HUMAN)
ELIWEVLSV

SEQ ID NO: 111834 - protein, 10 aa, Artificial Sequence
  Description of Artificial Sequence: Synthetic peptide
  Seed: EIPPQGPPKI (MAGC3_HUMAN)
EAPPQGPPKR

SEQ ID NO: 111835 - protein, 10 aa, Artificial Sequence
  Description of Artificial Sequence: Synthetic peptide
  Seed: ATFSDGSLGQ (MAGC3_HUMAN)
AIFSDGSLGK

SEQ ID NO: 111836 - protein, 8 aa, Artificial Sequence
  Description of Artificial Sequence: Synthetic peptide
  Seed: FGISLTEV (MAGC3_HUMAN)
FQISLTEL

SEQ ID NO: 111837 - protein, 11 aa, Artificial Sequence
  Description of Artificial Sequence: Synthetic peptide
  Seed: TTDDATAMASA (MAGC3_HUMAN)
TFDDATAMASM

SEQ ID NO: 111838 - protein, 11 aa, Artificial Sequence
  Description of Artificial Sequence: Synthetic peptide
  Seed: FIELIFGIALT (MAGC3_HUMAN)
FSELIFGIALL

SEQ ID NO: 111839 - protein, 9 aa, Artificial Sequence
  Description of Artificial Sequence: Synthetic peptide
  Seed: KGSCVPEEV (MAGC3_HUMAN)
KVSCVPEEL

SEQ ID NO: 111840 - protein, 8 aa, Artificial Sequence
  Description of Artificial Sequence: Synthetic peptide
  Seed: TTDDATAM (MAGC3_HUMAN)
TSDDATAL

SEQ ID NO: 111841 - protein, 9 aa, Artificial Sequence
  Description of Artificial Sequence: Synthetic peptide
  Seed: MPAAGMPPL (MAGC3_HUMAN)
MYAAGMPPY

SEQ ID NO: 111842 - protein, 9 aa, Artificial Sequence
  Description of Artificial Sequence: Synthetic peptide
  Seed: IIDTTDDAT (MAGC3_HUMAN)
ITDTTDDAF

SEQ ID NO: 111843 - protein, 10 aa, Artificial Sequence
  Description of Artificial Sequence: Synthetic peptide
  Seed: SVIFIKGNCA (MAGC3_HUMAN)
STIFIKGNCV

SEQ ID NO: 111844 - protein, 9 aa, Artificial Sequence
  Description of Artificial Sequence: Synthetic peptide
  Seed: SLPESEPLF (MAGC3_HUMAN)
SMPESEPLI

SEQ ID NO: 111845 - protein, 10 aa, Artificial Sequence
  Description of Artificial Sequence: Synthetic peptide
  Seed: SPLDSCSSPL (MAGC3_HUMAN)
SALDSCSSPY

SEQ ID NO: 111846 - protein, 11 aa, Artificial Sequence
  Description of Artificial Sequence: Synthetic peptide
  Seed: LTDMDPDNHSY (MAGC3_HUMAN)
LVDMDPDNHSW

SEQ ID NO: 111847 - protein, 9 aa, Artificial Sequence
  Description of Artificial Sequence: Synthetic peptide
  Seed: ATDKDYSAF (MAGC3_HUMAN)
ASDKDYSAY

SEQ ID NO: 111848 - protein, 11 aa, Artificial Sequence
  Description of Artificial Sequence: Synthetic peptide
  Seed: EVLSAIGPIQR (MAGC3_HUMAN)
ELLSAIGPIQR

SEQ ID NO: 111849 - protein, 10 aa, Artificial Sequence
  Description of Artificial Sequence: Synthetic peptide
  Seed: RPAREVLEFL (MAGC3_HUMAN)
RTAREVLEFK

SEQ ID NO: 111850 - protein, 9 aa, Artificial Sequence
  Description of Artificial Sequence: Synthetic peptide
  Seed: SLRRAVSVK (MAGC3_HUMAN)
SNRRAVSVK

SEQ ID NO: 111851 - protein, 10 aa, Artificial Sequence
  Description of Artificial Sequence: Synthetic peptide
  Seed: REVLEFLSKL (MAGC3_HUMAN)
RTVLEFLSKV

SEQ ID NO: 111852 - protein, 11 aa, Artificial Sequence
  Description of Artificial Sequence: Synthetic peptide
  Seed: YFFEDTLDLTY (MAGC3_HUMAN)
YMFEDTLDLTY

SEQ ID NO: 111853 - protein, 10 aa, Artificial Sequence
  Description of Artificial Sequence: Synthetic peptide
  Seed: ILFGISLTEV (MAGC3_HUMAN)
ITFGISLTEK

SEQ ID NO: 111854 - protein, 10 aa, Artificial Sequence
  Description of Artificial Sequence: Synthetic peptide
  Seed: REVRLFLRGG (MAGC3_HUMAN)
RLVRLFLRGA

SEQ ID NO: 111855 - protein, 9 aa, Artificial Sequence
  Description of Artificial Sequence: Synthetic peptide
  Seed: HALPESESL (MAGC3_HUMAN)
HPLPESEST

SEQ ID NO: 111856 - protein, 10 aa, Artificial Sequence
  Description of Artificial Sequence: Synthetic peptide
  Seed: SAFPSWYMDA (MAGC3_HUMAN)
SVFPSWYMDV

SEQ ID NO: 111857 - protein, 9 aa, Artificial Sequence
  Description of Artificial Sequence: Synthetic peptide
  Seed: RPAREVLEF (MAGC3_HUMAN)
RTAREVLEY

SEQ ID NO: 111858 - protein, 9 aa, Artificial Sequence
  Description of Artificial Sequence: Synthetic peptide
  Seed: EVDPDHFYV (MAGC3_HUMAN)
EADPDHFYI

SEQ ID NO: 111859 - protein, 10 aa, Artificial Sequence
  Description of Artificial Sequence: Synthetic peptide
  Seed: MQMNVINTYT (MAGC3_HUMAN)
MVMNVINTYY

SEQ ID NO: 111860 - protein, 10 aa, Artificial Sequence
  Description of Artificial Sequence: Synthetic peptide
  Seed: LLKYQAKEPL (MAGC3_HUMAN)
LDKYQAKEPY

SEQ ID NO: 111861 - protein, 10 aa, Artificial Sequence
  Description of Artificial Sequence: Synthetic peptide
  Seed: KVAELVQFLL (MAGC3_HUMAN)
KVAELVQFLF

SEQ ID NO: 111862 - protein, 9 aa, Artificial Sequence
  Description of Artificial Sequence: Synthetic peptide
  Seed: ASEEVIWEV (MAGC3_HUMAN)
AMEEVIWEC

SEQ ID NO: 111863 - protein, 9 aa, Artificial Sequence
  Description of Artificial Sequence: Synthetic peptide
  Seed: SESLPRYAL (MAGC3_HUMAN)
SHSLPRYAM

SEQ ID NO: 111864 - protein, 9 aa, Artificial Sequence
  Description of Artificial Sequence: Synthetic peptide
  Seed: ATDKDYSAF (MAGC3_HUMAN)
AWDKDYSAV

SEQ ID NO: 111865 - protein, 9 aa, Artificial Sequence
  Description of Artificial Sequence: Synthetic peptide
  Seed: FLSKLSSII (MAGC3_HUMAN)
FQSKLSSIY

SEQ ID NO: 111866 - protein, 10 aa, Artificial Sequence
  Description of Artificial Sequence: Synthetic peptide
  Seed: EVIWEVLNAI (MAGC3_HUMAN)
ELIWEVLNAR

SEQ ID NO: 111867 - protein, 10 aa, Artificial Sequence
  Description of Artificial Sequence: Synthetic peptide
  Seed: MDPDNHSYFF (MAGC3_HUMAN)
MFPDNHSYFW

SEQ ID NO: 111868 - protein, 10 aa, Artificial Sequence
  Description of Artificial Sequence: Synthetic peptide
  Seed: SLPAVSPGKR (MAGC3_HUMAN)
STPAVSPGKY

SEQ ID NO: 111869 - protein, 9 aa, Artificial Sequence
  Description of Artificial Sequence: Synthetic peptide
  Seed: HALPESESL (MAGC3_HUMAN)
HALPESESF

SEQ ID NO: 111870 - protein, 10 aa, Artificial Sequence
  Description of Artificial Sequence: Synthetic peptide
  Seed: TTDDATAMAS (MAGC3_HUMAN)
TTDDATAMAY

SEQ ID NO: 111871 - protein, 10 aa, Artificial Sequence
  Description of Artificial Sequence: Synthetic peptide
  Seed: YALDEKVAEL (MAGC3_HUMAN)
YVLDEKVAEY

SEQ ID NO: 111872 - protein, 11 aa, Artificial Sequence
  Description of Artificial Sequence: Synthetic peptide
  Seed: LSKLSSIIPSA (MAGC3_HUMAN)
LEKLSSIIPSV

SEQ ID NO: 111873 - protein, 10 aa, Artificial Sequence
  Description of Artificial Sequence: Synthetic peptide
  Seed: YALDEKVAEL (MAGC3_HUMAN)
YRLDEKVAEA

SEQ ID NO: 111874 - protein, 10 aa, Artificial Sequence
  Description of Artificial Sequence: Synthetic peptide
  Seed: LSKLSSIIPS (MAGC3_HUMAN)
LSKLSSIIPK

SEQ ID NO: 111875 - protein, 10 aa, Artificial Sequence
  Description of Artificial Sequence: Synthetic peptide
  Seed: YALDEKVAEL (MAGC3_HUMAN)
YRLDEKVAEF

SEQ ID NO: 111876 - protein, 9 aa, Artificial Sequence
  Description of Artificial Sequence: Synthetic peptide
  Seed: YFFEDTLDL (MAGC3_HUMAN)
YLFEDTLDL

SEQ ID NO: 111877 - protein, 9 aa, Artificial Sequence
  Description of Artificial Sequence: Synthetic peptide
  Seed: SDLHFGSQP (MAGC3_HUMAN)
SELHFGSQI

SEQ ID NO: 111878 - protein, 10 aa, Artificial Sequence
  Description of Artificial Sequence: Synthetic peptide
  Seed: EVIWEVLNAI (MAGC3_HUMAN)
EIIWEVLNAW

SEQ ID NO: 111879 - protein, 10 aa, Artificial Sequence
  Description of Artificial Sequence: Synthetic peptide
  Seed: LDLANPQGLA (MAGC3_HUMAN)
LYLANPQGLV

SEQ ID NO: 111880 - protein, 9 aa, Artificial Sequence
  Description of Artificial Sequence: Synthetic peptide
  Seed: LKYQTKEPV (MAGC3_HUMAN)
LQYQTKEPL

SEQ ID NO: 111881 - protein, 10 aa, Artificial Sequence
  Description of Artificial Sequence: Synthetic peptide
  Seed: KAEMLTTVIK (MAGC3_HUMAN)
KVEMLTTVIK

SEQ ID NO: 111882 - protein, 10 aa, Artificial Sequence
  Description of Artificial Sequence: Synthetic peptide
  Seed: YALDEKVAEL (MAGC3_HUMAN)
YGLDEKVAEA

SEQ ID NO: 111883 - protein, 10 aa, Artificial Sequence
  Description of Artificial Sequence: Synthetic peptide
  Seed: ALWESEGPEA (MAGC3_HUMAN)
AQWESEGPEI

SEQ ID NO: 111884 - protein, 9 aa, Artificial Sequence
  Description of Artificial Sequence: Synthetic peptide
  Seed: SAIGPIQRP (MAGC3_HUMAN)
SSIGPIQRF

SEQ ID NO: 111885 - protein, 9 aa, Artificial Sequence
  Description of Artificial Sequence: Synthetic peptide
  Seed: VPEEVIWEV (MAGC3_HUMAN)
VFEEVIWEL

SEQ ID NO: 111886 - protein, 9 aa, Artificial Sequence
  Description of Artificial Sequence: Synthetic peptide
  Seed: ASEEVIWEV (MAGC3_HUMAN)
AAEEVIWEI

SEQ ID NO: 111887 - protein, 9 aa, Artificial Sequence
  Description of Artificial Sequence: Synthetic peptide
  Seed: GYFPMIFRK (MAGC3_HUMAN)
GLFPMIFRY

SEQ ID NO: 111888 - protein, 9 aa, Artificial Sequence
  Description of Artificial Sequence: Synthetic peptide
  Seed: WRRGTGYTL (MAGC3_HUMAN)
WHRGTGYTF

SEQ ID NO: 111889 - protein, 9 aa, Artificial Sequence
  Description of Artificial Sequence: Synthetic peptide
  Seed: MPAAGMPPL (MAGC3_HUMAN)
MIAAGMPPM

SEQ ID NO: 111890 - protein, 10 aa, Artificial Sequence
  Description of Artificial Sequence: Synthetic peptide
  Seed: IIDTTDDATA (MAGC3_HUMAN)
ISDTTDDATI

SEQ ID NO: 111891 - protein, 9 aa, Artificial Sequence
  Description of Artificial Sequence: Synthetic peptide
  Seed: TSDQRMDSL (MAGC3_HUMAN)
TGDQRMDSM

SEQ ID NO: 111892 - protein, 10 aa, Artificial Sequence
  Description of Artificial Sequence: Synthetic peptide
  Seed: LVLCPTYFKL (MAGC3_HUMAN)
LALCPTYFKK

SEQ ID NO: 111893 - protein, 9 aa, Artificial Sequence
  Description of Artificial Sequence: Synthetic peptide
  Seed: AMASASPSV (MAGC3_HUMAN)
AVASASPSY

SEQ ID NO: 111894 - protein, 10 aa, Artificial Sequence
  Description of Artificial Sequence: Synthetic peptide
  Seed: NTYTGYFPMI (MAGC3_HUMAN)
NTYTGYFPMA

SEQ ID NO: 111895 - protein, 9 aa, Artificial Sequence
  Description of Artificial Sequence: Synthetic peptide
  Seed: SVLDLANPQ (MAGC3_HUMAN)
STLDLANPK

SEQ ID NO: 111896 - protein, 9 aa, Artificial Sequence
  Description of Artificial Sequence: Synthetic peptide
  Seed: TYFKLWRTL (MAGC3_HUMAN)
TYFKLWRTW

SEQ ID NO: 111897 - protein, 9 aa, Artificial Sequence
  Description of Artificial Sequence: Synthetic peptide
  Seed: TTDDATAMA (MAGC3_HUMAN)
TADDATAMC

SEQ ID NO: 111898 - protein, 9 aa, Artificial Sequence
  Description of Artificial Sequence: Synthetic peptide
  Seed: ALSPVVLPP (MAGC3_HUMAN)
AISPVVLPA

SEQ ID NO: 111899 - protein, 11 aa, Artificial Sequence
  Description of Artificial Sequence: Synthetic peptide
  Seed: KYKDYFPMIFG (MAGC3_HUMAN)
KYKDYFPMIFF

SEQ ID NO: 111900 - protein, 10 aa, Artificial Sequence
  Description of Artificial Sequence: Synthetic peptide
  Seed: VLCPTYFKLW (MAGC3_HUMAN)
VFCPTYFKLF

SEQ ID NO: 111901 - protein, 9 aa, Artificial Sequence
  Description of Artificial Sequence: Synthetic peptide
  Seed: KVAELVQFL (MAGC3_HUMAN)
KSAELVQFR

SEQ ID NO: 111902 - protein, 9 aa, Artificial Sequence
  Description of Artificial Sequence: Synthetic peptide
  Seed: YQAKEPLTR (MAGC3_HUMAN)
YIAKEPLTR

SEQ ID NO: 111903 - protein, 10 aa, Artificial Sequence
  Description of Artificial Sequence: Synthetic peptide
  Seed: NAIGPWSALA (MAGC3_HUMAN)
NSIGPWSALI

SEQ ID NO: 111904 - protein, 8 aa, Artificial Sequence
  Description of Artificial Sequence: Synthetic peptide
  Seed: VKNTCATY (MAGC3_HUMAN)
VQNTCATM

SEQ ID NO: 111905 - protein, 9 aa, Artificial Sequence
  Description of Artificial Sequence: Synthetic peptide
  Seed: EVLEFLSKL (MAGC3_HUMAN)
ETLEFLSKR

SEQ ID NO: 111906 - protein, 9 aa, Artificial Sequence
  Description of Artificial Sequence: Synthetic peptide
  Seed: SLPESEPLF (MAGC3_HUMAN)
SLPESEPLM

SEQ ID NO: 111907 - protein, 9 aa, Artificial Sequence
  Description of Artificial Sequence: Synthetic peptide
  Seed: SPQGPPQSP (MAGC3_HUMAN)
SAQGPPQSM

SEQ ID NO: 111908 - protein, 10 aa, Artificial Sequence
  Description of Artificial Sequence: Synthetic peptide
  Seed: MIFGKAHEFI (MAGC3_HUMAN)
MTFGKAHEFT

SEQ ID NO: 111909 - protein, 9 aa, Artificial Sequence
  Description of Artificial Sequence: Synthetic peptide
  Seed: LKYQTKEPV (MAGC3_HUMAN)
LRYQTKEPF

SEQ ID NO: 111910 - protein, 10 aa, Artificial Sequence
  Description of Artificial Sequence: Synthetic peptide
  Seed: TGYFPMIFRK (MAGC3_HUMAN)
TKYFPMIFRR

SEQ ID NO: 111911 - protein, 9 aa, Artificial Sequence
  Description of Artificial Sequence: Synthetic peptide
  Seed: VLCPTYFKL (MAGC3_HUMAN)
VICPTYFKK

SEQ ID NO: 111912 - protein, 9 aa, Artificial Sequence
  Description of Artificial Sequence: Synthetic peptide
  Seed: YQAKEPLTR (MAGC3_HUMAN)
YGAKEPLTL

SEQ ID NO: 111913 - protein, 10 aa, Artificial Sequence
  Description of Artificial Sequence: Synthetic peptide
  Seed: TYTGYFPMIF (MAGC3_HUMAN)
TMTGYFPMIY

SEQ ID NO: 111914 - protein, 9 aa, Artificial Sequence
  Description of Artificial Sequence: Synthetic peptide
  Seed: TSDQRMDSL (MAGC3_HUMAN)
TTDQRMDSI

SEQ ID NO: 111915 - protein, 9 aa, Artificial Sequence
  Description of Artificial Sequence: Synthetic peptide
  Seed: YQAKEPLTR (MAGC3_HUMAN)
YTAKEPLTV

SEQ ID NO: 111916 - protein, 11 aa, Artificial Sequence
  Description of Artificial Sequence: Synthetic peptide
  Seed: MLLPCHWVLDA (MAGC3_HUMAN)
MLLPCHWVLDI

SEQ ID NO: 111917 - protein, 9 aa, Artificial Sequence
  Description of Artificial Sequence: Synthetic peptide
  Seed: KVAELVQFL (MAGC3_HUMAN)
KIAELVQFC

SEQ ID NO: 111918 - protein, 10 aa, Artificial Sequence
  Description of Artificial Sequence: Synthetic peptide
  Seed: YALDEKVAEL (MAGC3_HUMAN)
YSLDEKVAEM

SEQ ID NO: 111919 - protein, 9 aa, Artificial Sequence
  Description of Artificial Sequence: Synthetic peptide
  Seed: KKYKDYFPM (MAGC3_HUMAN)
KMYKDYFPY

SEQ ID NO: 111920 - protein, 9 aa, Artificial Sequence
  Description of Artificial Sequence: Synthetic peptide
  Seed: MQMNVINTY (MAGC3_HUMAN)
MKMNVINTL

SEQ ID NO: 111921 - protein, 9 aa, Artificial Sequence
  Description of Artificial Sequence: Synthetic peptide
  Seed: YSAFHLGHL (MAGC3_HUMAN)
YFAFHLGHY

SEQ ID NO: 111922 - protein, 9 aa, Artificial Sequence
  Description of Artificial Sequence: Synthetic peptide
  Seed: DMDPDNHSY (MAGC3_HUMAN)
DSDPDNHSF

SEQ ID NO: 111923 - protein, 10 aa, Artificial Sequence
  Description of Artificial Sequence: Synthetic peptide
  Seed: SWYMDALKDM (MAGC3_HUMAN)
SMYMDALKDF

SEQ ID NO: 111924 - protein, 9 aa, Homo sapiens
  Native (MAGC3_HUMAN)
QMNVINTYT

SEQ ID NO: 111925 - protein, 9 aa, Homo sapiens
  Native (MAGC3_HUMAN)
AHEFIELIF

SEQ ID NO: 111926 - protein, 10 aa, Homo sapiens
  Native (MAGC3_HUMAN)
LILILSMIFI

SEQ ID NO: 111927 - protein, 10 aa, Homo sapiens
  Native (MAGC3_HUMAN)
ALWESEGPEA

SEQ ID NO: 111928 - protein, 11 aa, Homo sapiens
  Native (MAGC3_HUMAN)
PESESLPRYAL

SEQ ID NO: 111929 - protein, 10 aa, Homo sapiens
  Native (MAGC3_HUMAN)
SWYMDALKDM

SEQ ID NO: 111930 - protein, 11 aa, Homo sapiens
  Native (MAGC3_HUMAN)
EDMPAAGMPPL

SEQ ID NO: 111931 - protein, 11 aa, Homo sapiens
  Native (MAGC3_HUMAN)
WRRGTGYTLSL

SEQ ID NO: 111932 - protein, 8 aa, Homo sapiens
  Native (MAGC3_HUMAN)
AREVLEFL

SEQ ID NO: 111933 - protein, 9 aa, Homo sapiens
  Native (MAGC3_HUMAN)
LDLTCEGSL

SEQ ID NO: 111934 - protein, 8 aa, Homo sapiens
  Native (MAGC3_HUMAN)
KDYFPMIF

SEQ ID NO: 111935 - protein, 10 aa, Homo sapiens
  Native (MAGC3_HUMAN)
AFPSWYMDAL

SEQ ID NO: 111936 - protein, 10 aa, Homo sapiens
  Native (MAGC3_HUMAN)
SVIFIKGNCA

SEQ ID NO: 111937 - protein, 8 aa, Homo sapiens
  Native (MAGC3_HUMAN)
IWEVLSAI

SEQ ID NO: 111938 - protein, 10 aa, Homo sapiens
  Native (MAGC3_HUMAN)
MPAAGMPPLP

SEQ ID NO: 111939 - protein, 8 aa, Homo sapiens
  Native (MAGC3_HUMAN)
EPLTRAEM

SEQ ID NO: 111940 - protein, 9 aa, Homo sapiens
  Native (MAGC3_HUMAN)
KQREEPQDW

SEQ ID NO: 111941 - protein, 10 aa, Homo sapiens
  Native (MAGC3_HUMAN)
LRRAVSVKQR

SEQ ID NO: 111942 - protein, 8 aa, Homo sapiens
  Native (MAGC3_HUMAN)
TEVDPDHF

SEQ ID NO: 111943 - protein, 9 aa, Homo sapiens
  Native (MAGC3_HUMAN)
DRAQAIIDT

SEQ ID NO: 111944 - protein, 11 aa, Homo sapiens
  Native (MAGC3_HUMAN)
INTYTGYFPMI

SEQ ID NO: 111945 - protein, 8 aa, Homo sapiens
  Native (MAGC3_HUMAN)
GMPQNRLL

SEQ ID NO: 111946 - protein, 8 aa, Homo sapiens
  Native (MAGC3_HUMAN)
LLPCHWVL

SEQ ID NO: 111947 - protein, 11 aa, Homo sapiens
  Native (MAGC3_HUMAN)
TTDDATAMASA

SEQ ID NO: 111948 - protein, 9 aa, Homo sapiens
  Native (MAGC3_HUMAN)
QDWPLNEKR

SEQ ID NO: 111949 - protein, 10 aa, Homo sapiens
  Native (MAGC3_HUMAN)
ILILSVIFIK

SEQ ID NO: 111950 - protein, 8 aa, Homo sapiens
  Native (MAGC3_HUMAN)
QDWPLNEK

SEQ ID NO: 111951 - protein, 9 aa, Homo sapiens
  Native (MAGC3_HUMAN)
PLDSCSSPL

SEQ ID NO: 111952 - protein, 11 aa, Homo sapiens
  Native (MAGC3_HUMAN)
DSLVLCPTYFK

SEQ ID NO: 111953 - protein, 9 aa, Homo sapiens
  Native (MAGC3_HUMAN)
LPTWRRGTG

SEQ ID NO: 111954 - protein, 9 aa, Homo sapiens
  Native (MAGC3_HUMAN)
MDPDNHSYF

SEQ ID NO: 111955 - protein, 11 aa, Homo sapiens
  Native (MAGC3_HUMAN)
LEFLSKLSSII

SEQ ID NO: 111956 - protein, 9 aa, Homo sapiens
  Native (MAGC3_HUMAN)
KGSCVPEEV

SEQ ID NO: 111957 - protein, 9 aa, Homo sapiens
  Native (MAGC3_HUMAN)
QTKEPVTKA

SEQ ID NO: 111958 - protein, 10 aa, Homo sapiens
  Native (MAGC3_HUMAN)
KDSDLPTWRR

SEQ ID NO: 111959 - protein, 8 aa, Homo sapiens
  Native (MAGC3_HUMAN)
SEEVIWEV

SEQ ID NO: 111960 - protein, 9 aa, Homo sapiens
  Native (MAGC3_HUMAN)
PAVSPGKRL

SEQ ID NO: 111961 - protein, 9 aa, Homo sapiens
  Native (MAGC3_HUMAN)
PLPQSPPEI

SEQ ID NO: 111962 - protein, 10 aa, Homo sapiens
  Native (MAGC3_HUMAN)
LHFGSQPEGK

SEQ ID NO: 111963 - protein, 10 aa, Homo sapiens
  Native (MAGC3_HUMAN)
KYQAKEPLTR

SEQ ID NO: 111964 - protein, 11 aa, Homo sapiens
  Native (MAGC3_HUMAN)
AELVQFLLLKY

SEQ ID NO: 111965 - protein, 9 aa, Homo sapiens
  Native (MAGC3_HUMAN)
TRAEMQMNV

SEQ ID NO: 111966 - protein, 11 aa, Homo sapiens
  Native (MAGC3_HUMAN)
ALWESEGPEAF

SEQ ID NO: 111967 - protein, 10 aa, Homo sapiens
  Native (MAGC3_HUMAN)
SAIGPIQRPA

SEQ ID NO: 111968 - protein, 11 aa, Homo sapiens
  Native (MAGC3_HUMAN)
YTGYFPMIFRK

SEQ ID NO: 111969 - protein, 11 aa, Homo sapiens
  Native (MAGC3_HUMAN)
TRLDEESSSEE

SEQ ID NO: 111970 - protein, 10 aa, Homo sapiens
  Native (MAGC3_HUMAN)
SSEEEDTATW

SEQ ID NO: 111971 - protein, 9 aa, Homo sapiens
  Native (MAGC3_HUMAN)
AGFADVLSR

SEQ ID NO: 111972 - protein, 10 aa, Homo sapiens
  Native (MAGC3_HUMAN)
IEILFGISLT

SEQ ID NO: 111973 - protein, 8 aa, Homo sapiens
  Native (MAGC3_HUMAN)
AHEFIELI

SEQ ID NO: 111974 - protein, 9 aa, Homo sapiens
  Native (MAGC3_HUMAN)
WKDSDLPTW

SEQ ID NO: 111975 - protein, 8 aa, Homo sapiens
  Native (MAGC3_HUMAN)
FPMIFGKA

SEQ ID NO: 111976 - protein, 9 aa, Homo sapiens
  Native (MAGC3_HUMAN)
TEVDPDHFY

SEQ ID NO: 111977 - protein, 11 aa, Homo sapiens
  Native (MAGC3_HUMAN)
QEDGRRGLTEA

SEQ ID NO: 111978 - protein, 10 aa, Homo sapiens
  Native (MAGC3_HUMAN)
MDPDNHSYFF

SEQ ID NO: 111979 - protein, 10 aa, Homo sapiens
  Native (MAGC3_HUMAN)
ILILSMIFIK

SEQ ID NO: 111980 - protein, 11 aa, Homo sapiens
  Native (MAGC3_HUMAN)
HEFIELIFGIA

SEQ ID NO: 111981 - protein, 11 aa, Homo sapiens
  Native (MAGC3_HUMAN)
KEPLTRAEMQM

SEQ ID NO: 111982 - protein, 11 aa, Homo sapiens
  Native (MAGC3_HUMAN)
QRPAREVLEFL

SEQ ID NO: 111983 - protein, 10 aa, Homo sapiens
  Native (MAGC3_HUMAN)
KVAELVQFLL

SEQ ID NO: 111984 - protein, 10 aa, Homo sapiens
  Native (MAGC3_HUMAN)
LPQSPPEIPP

SEQ ID NO: 111985 - protein, 8 aa, Homo sapiens
  Native (MAGC3_HUMAN)
GEDEDMPA

SEQ ID NO: 111986 - protein, 10 aa, Homo sapiens
  Native (MAGC3_HUMAN)
MPKNCLLILI

SEQ ID NO: 111987 - protein, 8 aa, Homo sapiens
  Native (MAGC3_HUMAN)
FYVFVNTL

SEQ ID NO: 111988 - protein, 9 aa, Homo sapiens
  Native (MAGC3_HUMAN)
MIFRKAREF

SEQ ID NO: 111989 - protein, 11 aa, Homo sapiens
  Native (MAGC3_HUMAN)
DEKVDKLVQFL

SEQ ID NO: 111990 - protein, 10 aa, Homo sapiens
  Native (MAGC3_HUMAN)
EVLSAIGPIQ

SEQ ID NO: 111991 - protein, 10 aa, Homo sapiens
  Native (MAGC3_HUMAN)
KYQTKEPVTK

SEQ ID NO: 111992 - protein, 11 aa, Homo sapiens
  Native (MAGC3_HUMAN)
HSYFFEDTLDL

SEQ ID NO: 111993 - protein, 10 aa, Homo sapiens
  Native (MAGC3_HUMAN)
VKNTCATYAL

SEQ ID NO: 111994 - protein, 9 aa, Homo sapiens
  Native (MAGC3_HUMAN)
DDATAMASA

SEQ ID NO: 111995 - protein, 9 aa, Homo sapiens
  Native (MAGC3_HUMAN)
ILILSVIFI

SEQ ID NO: 111996 - protein, 10 aa, Homo sapiens
  Native (MAGC3_HUMAN)
TFSDGSLGQW

SEQ ID NO: 111997 - protein, 10 aa, Homo sapiens
  Native (MAGC3_HUMAN)
PPQSPPQSPL

SEQ ID NO: 111998 - protein, 10 aa, Homo sapiens
  Native (MAGC3_HUMAN)
INTYTGYFPM

SEQ ID NO: 111999 - protein, 9 aa, Homo sapiens
  Native (MAGC3_HUMAN)
DPDNHSYFF

SEQ ID NO: 112000 - protein, 9 aa, Homo sapiens
  Native (MAGC3_HUMAN)
LHFGSQPEG

SEQ ID NO: 112001 - protein, 9 aa, Homo sapiens
  Native (MAGC3_HUMAN)
DHFYVFVNT

SEQ ID NO: 112002 - protein, 9 aa, Homo sapiens
  Native (MAGC3_HUMAN)
DGRRGLTEA

SEQ ID NO: 112003 - protein, 9 aa, Homo sapiens
  Native (MAGC3_HUMAN)
KATDKDYSA

SEQ ID NO: 112004 - protein, 9 aa, Homo sapiens
  Native (MAGC3_HUMAN)
ASEEVIWEV

SEQ ID NO: 112005 - protein, 8 aa, Homo sapiens
  Native (MAGC3_HUMAN)
QTKEPVTK

SEQ ID NO: 112006 - protein, 9 aa, Homo sapiens
  Native (MAGC3_HUMAN)
YFPMIFRKA

SEQ ID NO: 112007 - protein, 11 aa, Homo sapiens
  Native (MAGC3_HUMAN)
EEVIWEVLSAI

SEQ ID NO: 112008 - protein, 9 aa, Homo sapiens
  Native (MAGC3_HUMAN)
CATYALSPV

SEQ ID NO: 112009 - protein, 11 aa, Homo sapiens
  Native (MAGC3_HUMAN)
AFCEESGLRSA

SEQ ID NO: 112010 - protein, 8 aa, Homo sapiens
  Native (MAGC3_HUMAN)
QRMDSLVL

SEQ ID NO: 112011 - protein, 8 aa, Homo sapiens
  Native (MAGC3_HUMAN)
GEKAGSLP

SEQ ID NO: 112012 - protein, 11 aa, Homo sapiens
  Native (MAGC3_HUMAN)
EILFGISLTEV

SEQ ID NO: 112013 - protein, 9 aa, Homo sapiens
  Native (MAGC3_HUMAN)
TSDQRMDSL

SEQ ID NO: 112014 - protein, 9 aa, Homo sapiens
  Native (MAGC3_HUMAN)
VIWEVLNAI

SEQ ID NO: 112015 - protein, 9 aa, Homo sapiens
  Native (MAGC3_HUMAN)
SVLDLANPQ

SEQ ID NO: 112016 - protein, 10 aa, Homo sapiens
  Native (MAGC3_HUMAN)
GLTEASPQQK

SEQ ID NO: 112017 - protein, 10 aa, Homo sapiens
  Native (MAGC3_HUMAN)
TYFKLWRTLS

SEQ ID NO: 112018 - protein, 10 aa, Homo sapiens
  Native (MAGC3_HUMAN)
VLNAIGPWSA

SEQ ID NO: 112019 - protein, 8 aa, Homo sapiens
  Native (MAGC3_HUMAN)
GFADVLSR

SEQ ID NO: 112020 - protein, 10 aa, Homo sapiens
  Native (MAGC3_HUMAN)
GMPQNRLLIL

SEQ ID NO: 112021 - protein, 10 aa, Homo sapiens
  Native (MAGC3_HUMAN)
REVLEFLSKL

SEQ ID NO: 112022 - protein, 9 aa, Homo sapiens
  Native (MAGC3_HUMAN)
FPMIFRKAR

SEQ ID NO: 112023 - protein, 8 aa, Homo sapiens
  Native (MAGC3_HUMAN)
KDSDLPTW

SEQ ID NO: 112024 - protein, 11 aa, Homo sapiens
  Native (MAGC3_HUMAN)
DMDPDNHSYFF

SEQ ID NO: 112025 - protein, 8 aa, Homo sapiens
  Native (MAGC3_HUMAN)
TYALSPVV

SEQ ID NO: 112026 - protein, 10 aa, Homo sapiens
  Native (MAGC3_HUMAN)
IELIFGIALT

SEQ ID NO: 112027 - protein, 11 aa, Homo sapiens
  Native (MAGC3_HUMAN)
IWEVLNAIGPW

SEQ ID NO: 112028 - protein, 11 aa, Homo sapiens
  Native (MAGC3_HUMAN)
LPRYALDEKVA

SEQ ID NO: 112029 - protein, 9 aa, Homo sapiens
  Native (MAGC3_HUMAN)
LPAVSPGKR

SEQ ID NO: 112030 - protein, 11 aa, Homo sapiens
  Native (MAGC3_HUMAN)
CEESGLRSAEG

SEQ ID NO: 112031 - protein, 9 aa, Homo sapiens
  Native (MAGC3_HUMAN)
GLRSAEGSV

SEQ ID NO: 112032 - protein, 11 aa, Homo sapiens
  Native (MAGC3_HUMAN)
GQWVKNTCATY

SEQ ID NO: 112033 - protein, 11 aa, Homo sapiens
  Native (MAGC3_HUMAN)
LANPQGLAGHR

SEQ ID NO: 112034 - protein, 10 aa, Homo sapiens
  Native (MAGC3_HUMAN)
TAMASASPSV

SEQ ID NO: 112035 - protein, 11 aa, Homo sapiens
  Native (MAGC3_HUMAN)
SPPEIPPQGPP

SEQ ID NO: 112036 - protein, 10 aa, Homo sapiens
  Native (MAGC3_HUMAN)
DEKVDKLVQF

SEQ ID NO: 112037 - protein, 11 aa, Homo sapiens
  Native (MAGC3_HUMAN)
ESLPRYALDEK

SEQ ID NO: 112038 - protein, 8 aa, Homo sapiens
  Native (MAGC3_HUMAN)
SAIGPIQR

SEQ ID NO: 112039 - protein, 11 aa, Homo sapiens
  Native (MAGC3_HUMAN)
GYFPMIFRKAR

SEQ ID NO: 112040 - protein, 9 aa, Homo sapiens
  Native (MAGC3_HUMAN)
LREVRLFLR

SEQ ID NO: 112041 - protein, 11 aa, Homo sapiens
  Native (MAGC3_HUMAN)
DYSAFHLGHLR

SEQ ID NO: 112042 - protein, 10 aa, Homo sapiens
  Native (MAGC3_HUMAN)
SAFHLGHLRE

SEQ ID NO: 112043 - protein, 10 aa, Homo sapiens
  Native (MAGC3_HUMAN)
IIPSAFPSWY

SEQ ID NO: 112044 - protein, 8 aa, Homo sapiens
  Native (MAGC3_HUMAN)
HLGHLREV

SEQ ID NO: 112045 - protein, 9 aa, Homo sapiens
  Native (MAGC3_HUMAN)
SLVLCPTYF

SEQ ID NO: 112046 - protein, 9 aa, Homo sapiens
  Native (MAGC3_HUMAN)
AIGPWSALA

SEQ ID NO: 112047 - protein, 9 aa, Homo sapiens
  Native (MAGC3_HUMAN)
ELIFGIALT

SEQ ID NO: 112048 - protein, 9 aa, Homo sapiens
  Native (MAGC3_HUMAN)
YKDYFPMIF

SEQ ID NO: 112049 - protein, 10 aa, Homo sapiens
  Native (MAGC3_HUMAN)
DMPAAGMPPL

SEQ ID NO: 112050 - protein, 10 aa, Homo sapiens
  Native (MAGC3_HUMAN)
KFSLRRAVSV

SEQ ID NO: 112051 - protein, 9 aa, Homo sapiens
  Native (MAGC3_HUMAN)
TTDDATAMA

SEQ ID NO: 112052 - protein, 9 aa, Homo sapiens
  Native (MAGC3_HUMAN)
EKVAELVQF

SEQ ID NO: 112053 - protein, 11 aa, Homo sapiens
  Native (MAGC3_HUMAN)
SVKQREEPQDW

SEQ ID NO: 112054 - protein, 10 aa, Homo sapiens
  Native (MAGC3_HUMAN)
TLWKDSDLPT

SEQ ID NO: 112055 - protein, 9 aa, Homo sapiens
  Native (MAGC3_HUMAN)
LILILSVIF

SEQ ID NO: 112056 - protein, 8 aa, Homo sapiens
  Native (MAGC3_HUMAN)
FLSKLSSI

SEQ ID NO: 112057 - protein, 10 aa, Homo sapiens
  Native (MAGC3_HUMAN)
HEFIELIFGI

SEQ ID NO: 112058 - protein, 11 aa, Homo sapiens
  Native (MAGC3_HUMAN)
TLWKDSDLPTW

SEQ ID NO: 112059 - protein, 8 aa, Homo sapiens
  Native (MAGC3_HUMAN)
PAAGMPPL

SEQ ID NO: 112060 - protein, 10 aa, Homo sapiens
  Native (MAGC3_HUMAN)
SMIFIKGSCV

SEQ ID NO: 112061 - protein, 11 aa, Homo sapiens
  Native (MAGC3_HUMAN)
SDEQGMPQNRL

SEQ ID NO: 112062 - protein, 11 aa, Homo sapiens
  Native (MAGC3_HUMAN)
AREVLEFLSKL

SEQ ID NO: 112063 - protein, 9 aa, Homo sapiens
  Native (MAGC3_HUMAN)
VLCPTYFKL

SEQ ID NO: 112064 - protein, 9 aa, Homo sapiens
  Native (MAGC3_HUMAN)
DEKVAELVQ

SEQ ID NO: 112065 - protein, 8 aa, Homo sapiens
  Native (MAGC3_HUMAN)
TLDEKVDK

SEQ ID NO: 112066 - protein, 8 aa, Homo sapiens
  Native (MAGC3_HUMAN)
SLPESEPL

SEQ ID NO: 112067 - protein, 9 aa, Homo sapiens
  Native (MAGC3_HUMAN)
LSRLALWES

SEQ ID NO: 112068 - protein, 8 aa, Homo sapiens
  Native (MAGC3_HUMAN)
YMDALKDM

SEQ ID NO: 112069 - protein, 11 aa, Homo sapiens
  Native (MAGC3_HUMAN)
SAFPSWYMDAL

SEQ ID NO: 112070 - protein, 11 aa, Homo sapiens
  Native (MAGC3_HUMAN)
SPSVMSTNFCP

SEQ ID NO: 112071 - protein, 9 aa, Homo sapiens
  Native (MAGC3_HUMAN)
LSGSPGLQL

SEQ ID NO: 112072 - protein, 9 aa, Homo sapiens
  Native (MAGC3_HUMAN)
AIIDTTDDA

SEQ ID NO: 112073 - protein, 10 aa, Homo sapiens
  Native (MAGC3_HUMAN)
LTEASPQQKK

SEQ ID NO: 112074 - protein, 9 aa, Homo sapiens
  Native (MAGC3_HUMAN)
YTLDEKVDK

SEQ ID NO: 112075 - protein, 9 aa, Homo sapiens
  Native (MAGC3_HUMAN)
VLPPQPQPR

SEQ ID NO: 112076 - protein, 9 aa, Homo sapiens
  Native (MAGC3_HUMAN)
GEKAGSLPE

SEQ ID NO: 112077 - protein, 10 aa, Homo sapiens
  Native (MAGC3_HUMAN)
SGLRSAEGSV

SEQ ID NO: 112078 - protein, 9 aa, Homo sapiens
  Native (MAGC3_HUMAN)
LSDLHFGSQ

SEQ ID NO: 112079 - protein, 9 aa, Homo sapiens
  Native (MAGC3_HUMAN)
LTEVDPDHF

SEQ ID NO: 112080 - protein, 11 aa, Homo sapiens
  Native (MAGC3_HUMAN)
KATDKDYSAFH

SEQ ID NO: 112081 - protein, 10 aa, Homo sapiens
  Native (MAGC3_HUMAN)
WSALAGFADV

SEQ ID NO: 112082 - protein, 10 aa, Homo sapiens
  Native (MAGC3_HUMAN)
SLPRYALDEK

SEQ ID NO: 112083 - protein, 10 aa, Homo sapiens
  Native (MAGC3_HUMAN)
RRAVSVKQRE

SEQ ID NO: 112084 - protein, 9 aa, Homo sapiens
  Native (MAGC3_HUMAN)
YALDEKVAE

SEQ ID NO: 112085 - protein, 11 aa, Homo sapiens
  Native (MAGC3_HUMAN)
EPQDWPLNEKR

SEQ ID NO: 112086 - protein, 10 aa, Homo sapiens
  Native (MAGC3_HUMAN)
ALAGFADVLS

SEQ ID NO: 112087 - protein, 9 aa, Homo sapiens
  Native (MAGC3_HUMAN)
GKAHEFIEL

SEQ ID NO: 112088 - protein, 11 aa, Homo sapiens
  Native (MAGC3_HUMAN)
FLRGGTSDQRM

SEQ ID NO: 112089 - protein, 9 aa, Homo sapiens
  Native (MAGC3_HUMAN)
PQDWPLNEK

SEQ ID NO: 112090 - protein, 9 aa, Homo sapiens
  Native (MAGC3_HUMAN)
TGYTLSLPA

SEQ ID NO: 112091 - protein, 9 aa, Homo sapiens
  Native (MAGC3_HUMAN)
HSYFFEDTL

SEQ ID NO: 112092 - protein, 11 aa, Homo sapiens
  Native (MAGC3_HUMAN)
YFFEDTLDLTY

SEQ ID NO: 112093 - protein, 11 aa, Homo sapiens
  Native (MAGC3_HUMAN)
AGSLPESEPLF

SEQ ID NO: 112094 - protein, 11 aa, Homo sapiens
  Native (MAGC3_HUMAN)
FIELIFGIALT

SEQ ID NO: 112095 - protein, 8 aa, Homo sapiens
  Native (MAGC3_HUMAN)
VLCPTYFK

SEQ ID NO: 112096 - protein, 8 aa, Homo sapiens
  Native (MAGC3_HUMAN)
KYQAKEPL

SEQ ID NO: 112097 - protein, 10 aa, Homo sapiens
  Native (MAGC3_HUMAN)
EAFCEESGLR

SEQ ID NO: 112098 - protein, 10 aa, Homo sapiens
  Native (MAGC3_HUMAN)
IPPQGPPKIS

SEQ ID NO: 112099 - protein, 10 aa, Homo sapiens
  Native (MAGC3_HUMAN)
EEVIWEVLNA

SEQ ID NO: 112100 - protein, 9 aa, Homo sapiens
  Native (MAGC3_HUMAN)
SEEVIWEVL

SEQ ID NO: 112101 - protein, 8 aa, Homo sapiens
  Native (MAGC3_HUMAN)
DEKVDKLV

SEQ ID NO: 112102 - protein, 11 aa, Homo sapiens
  Native (MAGC3_HUMAN)
YKDYFPMIFGK

SEQ ID NO: 112103 - protein, 9 aa, Homo sapiens
  Native (MAGC3_HUMAN)
LTEASPQQK

SEQ ID NO: 112104 - protein, 9 aa, Homo sapiens
  Native (MAGC3_HUMAN)
ALAGFADVL

SEQ ID NO: 112105 - protein, 8 aa, Homo sapiens
  Native (MAGC3_HUMAN)
MPQNRLLI

SEQ ID NO: 112106 - protein, 11 aa, Homo sapiens
  Native (MAGC3_HUMAN)
GRRGLTEASPQ

SEQ ID NO: 112107 - protein, 8 aa, Homo sapiens
  Native (MAGC3_HUMAN)
EVLEFLSK

SEQ ID NO: 112108 - protein, 10 aa, Homo sapiens
  Native (MAGC3_HUMAN)
SPQGPPQSPP

SEQ ID NO: 112109 - protein, 11 aa, Homo sapiens
  Native (MAGC3_HUMAN)
DLHFGSQPEGK

SEQ ID NO: 112110 - protein, 9 aa, Homo sapiens
  Native (MAGC3_HUMAN)
LKYQTKEPV

SEQ ID NO: 112111 - protein, 9 aa, Homo sapiens
  Native (MAGC3_HUMAN)
GKFSLRRAV

SEQ ID NO: 112112 - protein, 11 aa, Homo sapiens
  Native (MAGC3_HUMAN)
IDDQGMPKNCL

SEQ ID NO: 112113 - protein, 9 aa, Homo sapiens
  Native (MAGC3_HUMAN)
AEGSVLDLA

SEQ ID NO: 112114 - protein, 11 aa, Homo sapiens
  Native (MAGC3_HUMAN)
ATDKDYSAFHL

SEQ ID NO: 112115 - protein, 10 aa, Homo sapiens
  Native (MAGC3_HUMAN)
DHFYVFVNTL

SEQ ID NO: 112116 - protein, 11 aa, Homo sapiens
  Native (MAGC3_HUMAN)
QSPLDSCSSPL

SEQ ID NO: 112117 - protein, 10 aa, Homo sapiens
  Native (MAGC3_HUMAN)
ASPSVMSTNF

SEQ ID NO: 112118 - protein, 9 aa, Homo sapiens
  Native (MAGC3_HUMAN)
AVSPGKRLW

SEQ ID NO: 112119 - protein, 10 aa, Homo sapiens
  Native (MAGC3_HUMAN)
WRTLSGSPGL

SEQ ID NO: 112120 - protein, 9 aa, Homo sapiens
  Native (MAGC3_HUMAN)
VIKKYKDYF

SEQ ID NO: 112121 - protein, 11 aa, Homo sapiens
  Native (MAGC3_HUMAN)
EVDPDHFYVFV

SEQ ID NO: 112122 - protein, 10 aa, Homo sapiens
  Native (MAGC3_HUMAN)
QEDGRRGLTE

SEQ ID NO: 112123 - protein, 11 aa, Homo sapiens
  Native (MAGC3_HUMAN)
SEGPEAFCEES

SEQ ID NO: 112124 - protein, 11 aa, Homo sapiens
  Native (MAGC3_HUMAN)
GPIQRPAREVL

SEQ ID NO: 112125 - protein, 10 aa, Homo sapiens
  Native (MAGC3_HUMAN)
ESESLPRYAL

SEQ ID NO: 112126 - protein, 8 aa, Homo sapiens
  Native (MAGC3_HUMAN)
DSCSSPLL

SEQ ID NO: 112127 - protein, 10 aa, Homo sapiens
  Native (MAGC3_HUMAN)
LTRAEMQMNV

SEQ ID NO: 112128 - protein, 10 aa, Homo sapiens
  Native (MAGC3_HUMAN)
TDDATAMASA

SEQ ID NO: 112129 - protein, 10 aa, Homo sapiens
  Native (MAGC3_HUMAN)
ALPESESLPR

SEQ ID NO: 112130 - protein, 9 aa, Homo sapiens
  Native (MAGC3_HUMAN)
SDQRMDSLV

SEQ ID NO: 112131 - protein, 9 aa, Homo sapiens
  Native (MAGC3_HUMAN)
REEPQDWPL

SEQ ID NO: 112132 - protein, 9 aa, Homo sapiens
  Native (MAGC3_HUMAN)
FADVLSRLA

SEQ ID NO: 112133 - protein, 11 aa, Homo sapiens
  Native (MAGC3_HUMAN)
FGSQPEGKFSL

SEQ ID NO: 112134 - protein, 10 aa, Homo sapiens
  Native (MAGC3_HUMAN)
VTKAEMLTTV

SEQ ID NO: 112135 - protein, 9 aa, Homo sapiens
  Native (MAGC3_HUMAN)
LTDMDPDNH

SEQ ID NO: 112136 - protein, 11 aa, Homo sapiens
  Native (MAGC3_HUMAN)
RTLSGSPGLQL

SEQ ID NO: 112137 - protein, 11 aa, Homo sapiens
  Native (MAGC3_HUMAN)
GSQPEGKFSLR

SEQ ID NO: 112138 - protein, 8 aa, Homo sapiens
  Native (MAGC3_HUMAN)
DVLSRLAL

SEQ ID NO: 112139 - protein, 8 aa, Homo sapiens
  Native (MAGC3_HUMAN)
DPDHFYVF

SEQ ID NO: 112140 - protein, 10 aa, Homo sapiens
  Native (MAGC3_HUMAN)
SLIDDQGMPK

SEQ ID NO: 112141 - protein, 10 aa, Homo sapiens
  Native (MAGC3_HUMAN)
CLLILILSMI

SEQ ID NO: 112142 - protein, 10 aa, Homo sapiens
  Native (MAGC3_HUMAN)
GPIQRPAREV

SEQ ID NO: 112143 - protein, 9 aa, Homo sapiens
  Native (MAGC3_HUMAN)
LRGGTSDQR

SEQ ID NO: 112144 - protein, 10 aa, Homo sapiens
  Native (MAGC3_HUMAN)
WESEGPEAFC

SEQ ID NO: 112145 - protein, 9 aa, Homo sapiens
  Native (MAGC3_HUMAN)
PEIPPQGPP

SEQ ID NO: 112146 - protein, 11 aa, Homo sapiens
  Native (MAGC3_HUMAN)
SLTEVDPDHFY

SEQ ID NO: 112147 - protein, 8 aa, Homo sapiens
  Native (MAGC3_HUMAN)
SGSPGLQL

SEQ ID NO: 112148 - protein, 11 aa, Homo sapiens
  Native (MAGC3_HUMAN)
SEEVIWEVLNA

SEQ ID NO: 112149 - protein, 9 aa, Homo sapiens
  Native (MAGC3_HUMAN)
AEMQMNVIN

SEQ ID NO: 112150 - protein, 9 aa, Homo sapiens
  Native (MAGC3_HUMAN)
ILILSMIFI

SEQ ID NO: 112151 - protein, 11 aa, Homo sapiens
  Native (MAGC3_HUMAN)
EEVIWEVLNAI

SEQ ID NO: 112152 - protein, 9 aa, Homo sapiens
  Native (MAGC3_HUMAN)
SAIGPIQRP

SEQ ID NO: 112153 - protein, 10 aa, Homo sapiens
  Native (MAGC3_HUMAN)
LVLCPTYFKL

SEQ ID NO: 112154 - protein, 9 aa, Homo sapiens
  Native (MAGC3_HUMAN)
RGTGYTLSL

SEQ ID NO: 112155 - protein, 10 aa, Homo sapiens
  Native (MAGC3_HUMAN)
LPESEPLFTY

SEQ ID NO: 112156 - protein, 9 aa, Homo sapiens
  Native (MAGC3_HUMAN)
REVLEFLSK

SEQ ID NO: 112157 - protein, 9 aa, Homo sapiens
  Native (MAGC3_HUMAN)
LKYQAKEPL

SEQ ID NO: 112158 - protein, 10 aa, Homo sapiens
  Native (MAGC3_HUMAN)
IGPWSALAGF

SEQ ID NO: 112159 - protein, 11 aa, Homo sapiens
  Native (MAGC3_HUMAN)
PEAFCEESGLR

SEQ ID NO: 112160 - protein, 9 aa, Homo sapiens
  Native (MAGC3_HUMAN)
SPGLQLSDL

SEQ ID NO: 112161 - protein, 10 aa, Homo sapiens
  Native (MAGC3_HUMAN)
TSDQRMDSLV

SEQ ID NO: 112162 - protein, 11 aa, Homo sapiens
  Native (MAGC3_HUMAN)
KKYKDYFPMIF

SEQ ID NO: 112163 - protein, 9 aa, Homo sapiens
  Native (MAGC3_HUMAN)
QRMDSLVLC

SEQ ID NO: 112164 - protein, 10 aa, Homo sapiens
  Native (MAGC3_HUMAN)
VAELVQFLLL

SEQ ID NO: 112165 - protein, 11 aa, Homo sapiens
  Native (MAGC3_HUMAN)
QAKEPLTRAEM

SEQ ID NO: 112166 - protein, 9 aa, Homo sapiens
  Native (MAGC3_HUMAN)
KDSDLPTWR

SEQ ID NO: 112167 - protein, 9 aa, Homo sapiens
  Native (MAGC3_HUMAN)
GPPKISPQG

SEQ ID NO: 112168 - protein, 10 aa, Homo sapiens
  Native (MAGC3_HUMAN)
TLDEKVDKLV

SEQ ID NO: 112169 - protein, 11 aa, Homo sapiens
  Native (MAGC3_HUMAN)
KRLWGEKAGSL

SEQ ID NO: 112170 - protein, 10 aa, Homo sapiens
  Native (MAGC3_HUMAN)
DTTDDATAMA

SEQ ID NO: 112171 - protein, 10 aa, Homo sapiens
  Native (MAGC3_HUMAN)
GHLREVRLFL

SEQ ID NO: 112172 - protein, 10 aa, Homo sapiens
  Native (MAGC3_HUMAN)
KDYFPMIFGK

SEQ ID NO: 112173 - protein, 11 aa, Homo sapiens
  Native (MAGC3_HUMAN)
AIIDTTDDATA

SEQ ID NO: 112174 - protein, 8 aa, Homo sapiens
  Native (MAGC3_HUMAN)
PEEVIWEV

SEQ ID NO: 112175 - protein, 11 aa, Homo sapiens
  Native (MAGC3_HUMAN)
PLDSCSSPLLW

SEQ ID NO: 112176 - protein, 11 aa, Homo sapiens
  Native (MAGC3_HUMAN)
SLPESEPLFTY

SEQ ID NO: 112177 - protein, 9 aa, Homo sapiens
  Native (MAGC3_HUMAN)
HFYVFVNTL

SEQ ID NO: 112178 - protein, 9 aa, Homo sapiens
  Native (MAGC3_HUMAN)
YALSPVVLP

SEQ ID NO: 112179 - protein, 8 aa, Homo sapiens
  Native (MAGC3_HUMAN)
GTGYTLSL

SEQ ID NO: 112180 - protein, 8 aa, Homo sapiens
  Native (MAGC3_HUMAN)
AIGPWSAL

SEQ ID NO: 112181 - protein, 9 aa, Homo sapiens
  Native (MAGC3_HUMAN)
YQAKEPLTR

SEQ ID NO: 112182 - protein, 10 aa, Homo sapiens
  Native (MAGC3_HUMAN)
CSSPLLWTRL

SEQ ID NO: 112183 - protein, 10 aa, Homo sapiens
  Native (MAGC3_HUMAN)
PAVSPGKRLW

SEQ ID NO: 112184 - protein, 9 aa, Homo sapiens
  Native (MAGC3_HUMAN)
LDEKVDKLV

SEQ ID NO: 112185 - protein, 9 aa, Homo sapiens
  Native (MAGC3_HUMAN)
SPLDSCSSP

SEQ ID NO: 112186 - protein, 9 aa, Homo sapiens
  Native (MAGC3_HUMAN)
AFCEESGLR

SEQ ID NO: 112187 - protein, 9 aa, Homo sapiens
  Native (MAGC3_HUMAN)
NAIGPWSAL

SEQ ID NO: 112188 - protein, 10 aa, Homo sapiens
  Native (MAGC3_HUMAN)
LSLPAVSPGK

SEQ ID NO: 112189 - protein, 9 aa, Homo sapiens
  Native (MAGC3_HUMAN)
YTGYFPMIF

SEQ ID NO: 112190 - protein, 9 aa, Homo sapiens
  Native (MAGC3_HUMAN)
EDTATWHAL

SEQ ID NO: 112191 - protein, 11 aa, Homo sapiens
  Native (MAGC3_HUMAN)
KGSCVPEEVIW

SEQ ID NO: 112192 - protein, 9 aa, Homo sapiens
  Native (MAGC3_HUMAN)
LTTVIKKYK

SEQ ID NO: 112193 - protein, 10 aa, Homo sapiens
  Native (MAGC3_HUMAN)
NAIGPWSALA

SEQ ID NO: 112194 - protein, 10 aa, Homo sapiens
  Native (MAGC3_HUMAN)
ASEEVIWEVL

SEQ ID NO: 112195 - protein, 9 aa, Homo sapiens
  Native (MAGC3_HUMAN)
RTLWKDSDL

SEQ ID NO: 112196 - protein, 8 aa, Homo sapiens
  Native (MAGC3_HUMAN)
IFIKGSCV

SEQ ID NO: 112197 - protein, 10 aa, Homo sapiens
  Native (MAGC3_HUMAN)
DMDPDNHSYF

SEQ ID NO: 112198 - protein, 10 aa, Homo sapiens
  Native (MAGC3_HUMAN)
AMASASPSVM

SEQ ID NO: 112199 - protein, 9 aa, Homo sapiens
  Native (MAGC3_HUMAN)
EVIWEVLNA

SEQ ID NO: 112200 - protein, 10 aa, Homo sapiens
  Native (MAGC3_HUMAN)
VLSAIGPIQR

SEQ ID NO: 112201 - protein, 10 aa, Homo sapiens
  Native (MAGC3_HUMAN)
IIDTTDDATA

SEQ ID NO: 112202 - protein, 9 aa, Homo sapiens
  Native (MAGC3_HUMAN)
CPTYFKLWR

SEQ ID NO: 112203 - protein, 9 aa, Homo sapiens
  Native (MAGC3_HUMAN)
SLGQWVKNT

SEQ ID NO: 112204 - protein, 11 aa, Homo sapiens
  Native (MAGC3_HUMAN)
DLANPQGLAGH

SEQ ID NO: 112205 - protein, 9 aa, Homo sapiens
  Native (MAGC3_HUMAN)
AEMLTTVIK

SEQ ID NO: 112206 - protein, 10 aa, Homo sapiens
  Native (MAGC3_HUMAN)
KLVQFLLLKY

SEQ ID NO: 112207 - protein, 9 aa, Homo sapiens
  Native (MAGC3_HUMAN)
MLLPCHWVL

SEQ ID NO: 112208 - protein, 11 aa, Homo sapiens
  Native (MAGC3_HUMAN)
RGLTEASPQQK

SEQ ID NO: 112209 - protein, 9 aa, Homo sapiens
  Native (MAGC3_HUMAN)
FHLGHLREV

SEQ ID NO: 112210 - protein, 10 aa, Homo sapiens
  Native (MAGC3_HUMAN)
SAEGSVLDLA

SEQ ID NO: 112211 - protein, 9 aa, Homo sapiens
  Native (MAGC3_HUMAN)
DMEDRAQAI

SEQ ID NO: 112212 - protein, 11 aa, Homo sapiens
  Native (MAGC3_HUMAN)
EESSSEEEDTA

SEQ ID NO: 112213 - protein, 11 aa, Homo sapiens
  Native (MAGC3_HUMAN)
FTYTLDEKVDK

SEQ ID NO: 112214 - protein, 9 aa, Homo sapiens
  Native (MAGC3_HUMAN)
KNCLLILIL

SEQ ID NO: 112215 - protein, 10 aa, Homo sapiens
  Native (MAGC3_HUMAN)
TTDDATAMAS

SEQ ID NO: 112216 - protein, 9 aa, Homo sapiens
  Native (MAGC3_HUMAN)
RPAREVLEF

SEQ ID NO: 112217 - protein, 10 aa, Homo sapiens
  Native (MAGC3_HUMAN)
LDLTYEGSLI

SEQ ID NO: 112218 - protein, 8 aa, Homo sapiens
  Native (MAGC3_HUMAN)
IQRPAREV

SEQ ID NO: 112219 - protein, 8 aa, Homo sapiens
  Native (MAGC3_HUMAN)
SLVLCPTY

SEQ ID NO: 112220 - protein, 8 aa, Homo sapiens
  Native (MAGC3_HUMAN)
QMNVINTY

SEQ ID NO: 112221 - protein, 8 aa, Homo sapiens
  Native (MAGC3_HUMAN)
QGMPKNCL

SEQ ID NO: 112222 - protein, 8 aa, Homo sapiens
  Native (MAGC3_HUMAN)
AEMQMNVI

SEQ ID NO: 112223 - protein, 9 aa, Homo sapiens
  Native (MAGC3_HUMAN)
GFADVLSRL

SEQ ID NO: 112224 - protein, 9 aa, Homo sapiens
  Native (MAGC3_HUMAN)
VIWEVLSAI

SEQ ID NO: 112225 - protein, 10 aa, Homo sapiens
  Native (MAGC3_HUMAN)
KKYKDYFPMI

SEQ ID NO: 112226 - protein, 11 aa, Homo sapiens
  Native (MAGC3_HUMAN)
RMDSLVLCPTY

SEQ ID NO: 112227 - protein, 10 aa, Homo sapiens
  Native (MAGC3_HUMAN)
NVINTYTGYF

SEQ ID NO: 112228 - protein, 10 aa, Homo sapiens
  Native (MAGC3_HUMAN)
SEEEDTATWH

SEQ ID NO: 112229 - protein, 8 aa, Homo sapiens
  Native (MAGC3_HUMAN)
KYKDYFPM

SEQ ID NO: 112230 - protein, 9 aa, Homo sapiens
  Native (MAGC3_HUMAN)
KVDKLVQFL

SEQ ID NO: 112231 - protein, 10 aa, Homo sapiens
  Native (MAGC3_HUMAN)
SLPESEPLFT

SEQ ID NO: 112232 - protein, 10 aa, Homo sapiens
  Native (MAGC3_HUMAN)
EKVAELVQFL

SEQ ID NO: 112233 - protein, 10 aa, Homo sapiens
  Native (MAGC3_HUMAN)
MLTTVIKKYK

SEQ ID NO: 112234 - protein, 11 aa, Homo sapiens
  Native (MAGC3_HUMAN)
EVLSAIGPIQR

SEQ ID NO: 112235 - protein, 10 aa, Homo sapiens
  Native (MAGC3_HUMAN)
AIGPIQRPAR

SEQ ID NO: 112236 - protein, 10 aa, Homo sapiens
  Native (MAGC3_HUMAN)
KEPVTKAEML

SEQ ID NO: 112237 - protein, 9 aa, Homo sapiens
  Native (MAGC3_HUMAN)
LFGISLTEV

SEQ ID NO: 112238 - protein, 11 aa, Homo sapiens
  Native (MAGC3_HUMAN)
DEQGMPQNRLL

SEQ ID NO: 112239 - protein, 10 aa, Homo sapiens
  Native (MAGC3_HUMAN)
DEDMPAAGMP

SEQ ID NO: 112240 - protein, 9 aa, Homo sapiens
  Native (MAGC3_HUMAN)
GLQLSDLHF

SEQ ID NO: 112241 - protein, 9 aa, Homo sapiens
  Native (MAGC3_HUMAN)
TKAEMLTTV

SEQ ID NO: 112242 - protein, 9 aa, Homo sapiens
  Native (MAGC3_HUMAN)
SSPLLWTRL

SEQ ID NO: 112243 - protein, 10 aa, Homo sapiens
  Native (MAGC3_HUMAN)
SPPQSPLDSC

SEQ ID NO: 112244 - protein, 9 aa, Homo sapiens
  Native (MAGC3_HUMAN)
REVRLFLRG

SEQ ID NO: 112245 - protein, 10 aa, Homo sapiens
  Native (MAGC3_HUMAN)
LLPCHWVLDA

SEQ ID NO: 112246 - protein, 11 aa, Homo sapiens
  Native (MAGC3_HUMAN)
IKKYKDYFPMI

SEQ ID NO: 112247 - protein, 10 aa, Homo sapiens
  Native (MAGC3_HUMAN)
KDMEDRAQAI

SEQ ID NO: 112248 - protein, 8 aa, Homo sapiens
  Native (MAGC3_HUMAN)
SAFPSWYM

SEQ ID NO: 112249 - protein, 11 aa, Homo sapiens
  Native (MAGC3_HUMAN)
ISLTEVDPDHF

SEQ ID NO: 112250 - protein, 9 aa, Homo sapiens
  Native (MAGC3_HUMAN)
IIPSAFPSW

SEQ ID NO: 112251 - protein, 11 aa, Homo sapiens
  Native (MAGC3_HUMAN)
GHLREVRLFLR

SEQ ID NO: 112252 - protein, 9 aa, Homo sapiens
  Native (MAGC3_HUMAN)
AMASASPSV

SEQ ID NO: 112253 - protein, 11 aa, Homo sapiens
  Native (MAGC3_HUMAN)
GSLIDDQGMPK

SEQ ID NO: 112254 - protein, 10 aa, Homo sapiens
  Native (MAGC3_HUMAN)
TGYFPMIFRK

SEQ ID NO: 112255 - protein, 9 aa, Homo sapiens
  Native (MAGC3_HUMAN)
EQGMPQNRL

SEQ ID NO: 112256 - protein, 9 aa, Homo sapiens
  Native (MAGC3_HUMAN)
FEDTLDLTY

SEQ ID NO: 112257 - protein, 9 aa, Homo sapiens
  Native (MAGC3_HUMAN)
MPKNCLLIL

SEQ ID NO: 112258 - protein, 10 aa, Homo sapiens
  Native (MAGC3_HUMAN)
SIIPSAFPSW

SEQ ID NO: 112259 - protein, 10 aa, Homo sapiens
  Native (MAGC3_HUMAN)
EFLSKLSSII

SEQ ID NO: 112260 - protein, 10 aa, Homo sapiens
  Native (MAGC3_HUMAN)
QWVKNTCATY

SEQ ID NO: 112261 - protein, 10 aa, Homo sapiens
  Native (MAGC3_HUMAN)
TLDLTYEGSL

SEQ ID NO: 112262 - protein, 10 aa, Homo sapiens
  Native (MAGC3_HUMAN)
LPESESLPRY

SEQ ID NO: 112263 - protein, 9 aa, Homo sapiens
  Native (MAGC3_HUMAN)
VDPDHFYVF

SEQ ID NO: 112264 - protein, 9 aa, Homo sapiens
  Native (MAGC3_HUMAN)
LGHLREVRL

SEQ ID NO: 112265 - protein, 10 aa, Homo sapiens
  Native (MAGC3_HUMAN)
DEQGMPQNRL

SEQ ID NO: 112266 - protein, 10 aa, Homo sapiens
  Native (MAGC3_HUMAN)
MQMNVINTYT

SEQ ID NO: 112267 - protein, 10 aa, Homo sapiens
  Native (MAGC3_HUMAN)
GEDEDMPAAG

SEQ ID NO: 112268 - protein, 9 aa, Homo sapiens
  Native (MAGC3_HUMAN)
EEVIWEVLS

SEQ ID NO: 112269 - protein, 11 aa, Homo sapiens
  Native (MAGC3_HUMAN)
SLVLCPTYFKL

SEQ ID NO: 112270 - protein, 8 aa, Homo sapiens
  Native (MAGC3_HUMAN)
YALSPVVL

SEQ ID NO: 112271 - protein, 10 aa, Homo sapiens
  Native (MAGC3_HUMAN)
RLWGEKAGSL

SEQ ID NO: 112272 - protein, 10 aa, Homo sapiens
  Native (MAGC3_HUMAN)
SDGSLGQWVK

SEQ ID NO: 112273 - protein, 11 aa, Homo sapiens
  Native (MAGC3_HUMAN)
VLEFLSKLSSI

SEQ ID NO: 112274 - protein, 9 aa, Homo sapiens
  Native (MAGC3_HUMAN)
LILSVIFIK

SEQ ID NO: 112275 - protein, 11 aa, Homo sapiens
  Native (MAGC3_HUMAN)
SLPAVSPGKRL

SEQ ID NO: 112276 - protein, 9 aa, Homo sapiens
  Native (MAGC3_HUMAN)
LANPQGLAG

SEQ ID NO: 112277 - protein, 10 aa, Homo sapiens
  Native (MAGC3_HUMAN)
MPPLPQSPPE

SEQ ID NO: 112278 - protein, 11 aa, Homo sapiens
  Native (MAGC3_HUMAN)
KAGSLPESEPL

SEQ ID NO: 112279 - protein, 11 aa, Homo sapiens
  Native (MAGC3_HUMAN)
PESEPLFTYTL

SEQ ID NO: 112280 - protein, 9 aa, Homo sapiens
  Native (MAGC3_HUMAN)
KLWRTLSGS

SEQ ID NO: 112281 - protein, 9 aa, Homo sapiens
  Native (MAGC3_HUMAN)
SPVVLPPQP

SEQ ID NO: 112282 - protein, 9 aa, Homo sapiens
  Native (MAGC3_HUMAN)
SDGSLGQWV

SEQ ID NO: 112283 - protein, 10 aa, Homo sapiens
  Native (MAGC3_HUMAN)
KAEMLTTVIK

SEQ ID NO: 112284 - protein, 10 aa, Homo sapiens
  Native (MAGC3_HUMAN)
PPLPQSPPEI

SEQ ID NO: 112285 - protein, 11 aa, Homo sapiens
  Native (MAGC3_HUMAN)
LHFGSQPEGKF

SEQ ID NO: 112286 - protein, 10 aa, Homo sapiens
  Native (MAGC3_HUMAN)
CASEEVIWEV

SEQ ID NO: 112287 - protein, 9 aa, Homo sapiens
  Native (MAGC3_HUMAN)
HFGSQPEGK

SEQ ID NO: 112288 - protein, 10 aa, Homo sapiens
  Native (MAGC3_HUMAN)
DEKVAELVQF

SEQ ID NO: 112289 - protein, 8 aa, Homo sapiens
  Native (MAGC3_HUMAN)
IWEVLNAI

SEQ ID NO: 112290 - protein, 8 aa, Homo sapiens
  Native (MAGC3_HUMAN)
QPEGKFSL

SEQ ID NO: 112291 - protein, 9 aa, Homo sapiens
  Native (MAGC3_HUMAN)
RRGTGYTLS

SEQ ID NO: 112292 - protein, 9 aa, Homo sapiens
  Native (MAGC3_HUMAN)
EVDPDHFYV

SEQ ID NO: 112293 - protein, 9 aa, Homo sapiens
  Native (MAGC3_HUMAN)
LPESEPLFT

SEQ ID NO: 112294 - protein, 11 aa, Homo sapiens
  Native (MAGC3_HUMAN)
WSALAGFADVL

SEQ ID NO: 112295 - protein, 9 aa, Homo sapiens
  Native (MAGC3_HUMAN)
VINTYTGYF

SEQ ID NO: 112296 - protein, 9 aa, Homo sapiens
  Native (MAGC3_HUMAN)
KNTCATYAL

SEQ ID NO: 112297 - protein, 10 aa, Homo sapiens
  Native (MAGC3_HUMAN)
SLTEVDPDHF

SEQ ID NO: 112298 - protein, 10 aa, Homo sapiens
  Native (MAGC3_HUMAN)
EPQDWPLNEK

SEQ ID NO: 112299 - protein, 10 aa, Homo sapiens
  Native (MAGC3_HUMAN)
EEVIWEVLSA

SEQ ID NO: 112300 - protein, 11 aa, Homo sapiens
  Native (MAGC3_HUMAN)
AEMQMNVINTY

SEQ ID NO: 112301 - protein, 10 aa, Homo sapiens
  Native (MAGC3_HUMAN)
DKLVQFLLLK

SEQ ID NO: 112302 - protein, 11 aa, Homo sapiens
  Native (MAGC3_HUMAN)
VIKKYKDYFPM

SEQ ID NO: 112303 - protein, 11 aa, Homo sapiens
  Native (MAGC3_HUMAN)
TAMASASPSVM

SEQ ID NO: 112304 - protein, 9 aa, Homo sapiens
  Native (MAGC3_HUMAN)
LWGEKAGSL

SEQ ID NO: 112305 - protein, 10 aa, Homo sapiens
  Native (MAGC3_HUMAN)
AGFADVLSRL

SEQ ID NO: 112306 - protein, 9 aa, Homo sapiens
  Native (MAGC3_HUMAN)
MIFIKGSCV

SEQ ID NO: 112307 - protein, 8 aa, Homo sapiens
  Native (MAGC3_HUMAN)
RSAEGSVL

SEQ ID NO: 112308 - protein, 11 aa, Homo sapiens
  Native (MAGC3_HUMAN)
MPQNRLLILIL

SEQ ID NO: 112309 - protein, 8 aa, Homo sapiens
  Native (MAGC3_HUMAN)
ESLPRYAL

SEQ ID NO: 112310 - protein, 10 aa, Homo sapiens
  Native (MAGC3_HUMAN)
TWRRGTGYTL

SEQ ID NO: 112311 - protein, 10 aa, Homo sapiens
  Native (MAGC3_HUMAN)
RMDSLVLCPT

SEQ ID NO: 112312 - protein, 10 aa, Homo sapiens
  Native (MAGC3_HUMAN)
GPWSALAGFA

SEQ ID NO: 112313 - protein, 10 aa, Homo sapiens
  Native (MAGC3_HUMAN)
YALSPVVLPP

SEQ ID NO: 112314 - protein, 11 aa, Homo sapiens
  Native (MAGC3_HUMAN)
AEGSVLDLANP

SEQ ID NO: 112315 - protein, 11 aa, Homo sapiens
  Native (MAGC3_HUMAN)
GLTEASPQQKK

SEQ ID NO: 112316 - protein, 9 aa, Homo sapiens
  Native (MAGC3_HUMAN)
CLLILILSM

SEQ ID NO: 112317 - protein, 9 aa, Homo sapiens
  Native (MAGC3_HUMAN)
FLLLKYQAK

SEQ ID NO: 112318 - protein, 9 aa, Homo sapiens
  Native (MAGC3_HUMAN)
CHWVLDATF

SEQ ID NO: 112319 - protein, 8 aa, Homo sapiens
  Native (MAGC3_HUMAN)
LTYEGSLI

SEQ ID NO: 112320 - protein, 8 aa, Homo sapiens
  Native (MAGC3_HUMAN)
HLREVRLF

SEQ ID NO: 112321 - protein, 9 aa, Homo sapiens
  Native (MAGC3_HUMAN)
HLGHLREVR

SEQ ID NO: 112322 - protein, 9 aa, Homo sapiens
  Native (MAGC3_HUMAN)
GSCVPEEVI

SEQ ID NO: 112323 - protein, 10 aa, Homo sapiens
  Native (MAGC3_HUMAN)
GSQPEGKFSL

SEQ ID NO: 112324 - protein, 9 aa, Homo sapiens
  Native (MAGC3_HUMAN)
QGMPQNRLL

SEQ ID NO: 112325 - protein, 10 aa, Homo sapiens
  Native (MAGC3_HUMAN)
SLPAVSPGKR

SEQ ID NO: 112326 - protein, 8 aa, Homo sapiens
  Native (MAGC3_HUMAN)
YFKLWRTL

SEQ ID NO: 112327 - protein, 10 aa, Homo sapiens
  Native (MAGC3_HUMAN)
AEMQMNVINT

SEQ ID NO: 112328 - protein, 10 aa, Homo sapiens
  Native (MAGC3_HUMAN)
HFGSQPEGKF

SEQ ID NO: 112329 - protein, 9 aa, Homo sapiens
  Native (MAGC3_HUMAN)
LCPTYFKLW

SEQ ID NO: 112330 - protein, 9 aa, Homo sapiens
  Native (MAGC3_HUMAN)
IFGKAHEFI

SEQ ID NO: 112331 - protein, 10 aa, Homo sapiens
  Native (MAGC3_HUMAN)
TLDLTCEGSL

SEQ ID NO: 112332 - protein, 9 aa, Homo sapiens
  Native (MAGC3_HUMAN)
PAREVLEFL

SEQ ID NO: 112333 - protein, 10 aa, Homo sapiens
  Native (MAGC3_HUMAN)
MNVINTYTGY

SEQ ID NO: 112334 - protein, 9 aa, Homo sapiens
  Native (MAGC3_HUMAN)
TVIKKYKDY

SEQ ID NO: 112335 - protein, 9 aa, Homo sapiens
  Native (MAGC3_HUMAN)
EMLTTVIKK

SEQ ID NO: 112336 - protein, 10 aa, Homo sapiens
  Native (MAGC3_HUMAN)
LNAIGPWSAL

SEQ ID NO: 112337 - protein, 9 aa, Homo sapiens
  Native (MAGC3_HUMAN)
EVLSAIGPI

SEQ ID NO: 112338 - protein, 11 aa, Homo sapiens
  Native (MAGC3_HUMAN)
VVLPPQPQPRK

SEQ ID NO: 112339 - protein, 11 aa, Homo sapiens
  Native (MAGC3_HUMAN)
GPPQSPPQSPL

SEQ ID NO: 112340 - protein, 10 aa, Homo sapiens
  Native (MAGC3_HUMAN)
GMPKNCLLIL

SEQ ID NO: 112341 - protein, 11 aa, Homo sapiens
  Native (MAGC3_HUMAN)
LWKDSDLPTWR

SEQ ID NO: 112342 - protein, 11 aa, Homo sapiens
  Native (MAGC3_HUMAN)
TLSLPAVSPGK

SEQ ID NO: 112343 - protein, 10 aa, Homo sapiens
  Native (MAGC3_HUMAN)
FPSWYMDALK

SEQ ID NO: 112344 - protein, 8 aa, Homo sapiens
  Native (MAGC3_HUMAN)
CHWVLDAT

SEQ ID NO: 112345 - protein, 8 aa, Homo sapiens
  Native (MAGC3_HUMAN)
EEVIWEVL

SEQ ID NO: 112346 - protein, 9 aa, Homo sapiens
  Native (MAGC3_HUMAN)
ATYALSPVV

SEQ ID NO: 112347 - protein, 10 aa, Homo sapiens
  Native (MAGC3_HUMAN)
DRAQAIIDTT

SEQ ID NO: 112348 - protein, 9 aa, Homo sapiens
  Native (MAGC3_HUMAN)
GPWSALAGF

SEQ ID NO: 112349 - protein, 10 aa, Homo sapiens
  Native (MAGC3_HUMAN)
WEVLSAIGPI

SEQ ID NO: 112350 - protein, 10 aa, Homo sapiens
  Native (MAGC3_HUMAN)
TYTGYFPMIF

SEQ ID NO: 112351 - protein, 9 aa, Homo sapiens
  Native (MAGC3_HUMAN)
GHLREVRLF

SEQ ID NO: 112352 - protein, 10 aa, Homo sapiens
  Native (MAGC3_HUMAN)
VQFLLLKYQA

SEQ ID NO: 112353 - protein, 8 aa, Homo sapiens
  Native (MAGC3_HUMAN)
CASEEVIW

SEQ ID NO: 112354 - protein, 10 aa, Homo sapiens
  Native (MAGC3_HUMAN)
SCSSPLLWTR

SEQ ID NO: 112355 - protein, 11 aa, Homo sapiens
  Native (MAGC3_HUMAN)
ATAMASASPSV

SEQ ID NO: 112356 - protein, 9 aa, Homo sapiens
  Native (MAGC3_HUMAN)
LSAIGPIQR

SEQ ID NO: 112357 - protein, 10 aa, Homo sapiens
  Native (MAGC3_HUMAN)
KYKDYFPMIF

SEQ ID NO: 112358 - protein, 9 aa, Homo sapiens
  Native (MAGC3_HUMAN)
DVLSRLALW

SEQ ID NO: 112359 - protein, 10 aa, Homo sapiens
  Native (MAGC3_HUMAN)
LLKYQAKEPL

SEQ ID NO: 112360 - protein, 10 aa, Homo sapiens
  Native (MAGC3_HUMAN)
SALAGFADVL

SEQ ID NO: 112361 - protein, 10 aa, Homo sapiens
  Native (MAGC3_HUMAN)
GPPKISPQGP

SEQ ID NO: 112362 - protein, 8 aa, Homo sapiens
  Native (MAGC3_HUMAN)
LTTVIKKY

SEQ ID NO: 112363 - protein, 9 aa, Homo sapiens
  Native (MAGC3_HUMAN)
EVIWEVLSA

SEQ ID NO: 112364 - protein, 9 aa, Homo sapiens
  Native (MAGC3_HUMAN)
WYMDALKDM

SEQ ID NO: 112365 - protein, 10 aa, Homo sapiens
  Native (MAGC3_HUMAN)
EESSSEEEDT

SEQ ID NO: 112366 - protein, 8 aa, Homo sapiens
  Native (MAGC3_HUMAN)
SPLLWTRL

SEQ ID NO: 112367 - protein, 8 aa, Homo sapiens
  Native (MAGC3_HUMAN)
TDKDYSAF

SEQ ID NO: 112368 - protein, 9 aa, Homo sapiens
  Native (MAGC3_HUMAN)
DSDLPTWRR

SEQ ID NO: 112369 - protein, 9 aa, Homo sapiens
  Native (MAGC3_HUMAN)
GMPQNRLLI

SEQ ID NO: 112370 - protein, 9 aa, Homo sapiens
  Native (MAGC3_HUMAN)
TEASPQQKK

SEQ ID NO: 112371 - protein, 10 aa, Homo sapiens
  Native (MAGC3_HUMAN)
KVDKLVQFLL

SEQ ID NO: 112372 - protein, 10 aa, Homo sapiens
  Native (MAGC3_HUMAN)
YTLDEKVDKL

SEQ ID NO: 112373 - protein, 9 aa, Homo sapiens
  Native (MAGC3_HUMAN)
FPMIFGKAH

SEQ ID NO: 112374 - protein, 10 aa, Homo sapiens
  Native (MAGC3_HUMAN)
AREVLEFLSK

SEQ ID NO: 112375 - protein, 8 aa, Homo sapiens
  Native (MAGC3_HUMAN)
EEEDTATW

SEQ ID NO: 112376 - protein, 9 aa, Homo sapiens
  Native (MAGC3_HUMAN)
KFSLRRAVS

SEQ ID NO: 112377 - protein, 10 aa, Homo sapiens
  Native (MAGC3_HUMAN)
TEASPQQKKG

SEQ ID NO: 112378 - protein, 8 aa, Homo sapiens
  Native (MAGC3_HUMAN)
MPPLPQSP

SEQ ID NO: 112379 - protein, 8 aa, Homo sapiens
  Native (MAGC3_HUMAN)
QSPPQSPL

SEQ ID NO: 112380 - protein, 10 aa, Homo sapiens
  Native (MAGC3_HUMAN)
EEEDTATWHA

SEQ ID NO: 112381 - protein, 10 aa, Homo sapiens
  Native (MAGC3_HUMAN)
SYFFEDTLDL

SEQ ID NO: 112382 - protein, 8 aa, Homo sapiens
  Native (MAGC3_HUMAN)
SEGPEAFC

SEQ ID NO: 112383 - protein, 9 aa, Homo sapiens
  Native (MAGC3_HUMAN)
CSSPLLWTR

SEQ ID NO: 112384 - protein, 10 aa, Homo sapiens
  Native (MAGC3_HUMAN)
GNCASEEVIW

SEQ ID NO: 112385 - protein, 8 aa, Homo sapiens
  Native (MAGC3_HUMAN)
KVDKLVQF

SEQ ID NO: 112386 - protein, 11 aa, Homo sapiens
  Native (MAGC3_HUMAN)
SVLDLANPQGL

SEQ ID NO: 112387 - protein, 10 aa, Homo sapiens
  Native (MAGC3_HUMAN)
FGKAHEFIEL

SEQ ID NO: 112388 - protein, 9 aa, Homo sapiens
  Native (MAGC3_HUMAN)
EVLNAIGPW

SEQ ID NO: 112389 - protein, 11 aa, Homo sapiens
  Native (MAGC3_HUMAN)
SLRRAVSVKQR

SEQ ID NO: 112390 - protein, 10 aa, Homo sapiens
  Native (MAGC3_HUMAN)
PTYFKLWRTL

SEQ ID NO: 112391 - protein, 11 aa, Homo sapiens
  Native (MAGC3_HUMAN)
EEEDTATWHAL

SEQ ID NO: 112392 - protein, 11 aa, Homo sapiens
  Native (MAGC3_HUMAN)
SAFHLGHLREV

SEQ ID NO: 112393 - protein, 11 aa, Homo sapiens
  Native (MAGC3_HUMAN)
KKATDKDYSAF

SEQ ID NO: 112394 - protein, 11 aa, Homo sapiens
  Native (MAGC3_HUMAN)
MPKNCLLILIL

SEQ ID NO: 112395 - protein, 9 aa, Homo sapiens
  Native (MAGC3_HUMAN)
LDLANPQGL

SEQ ID NO: 112396 - protein, 11 aa, Homo sapiens
  Native (MAGC3_HUMAN)
LPQSPPEIPPQ

SEQ ID NO: 112397 - protein, 8 aa, Homo sapiens
  Native (MAGC3_HUMAN)
VLSRLALW

SEQ ID NO: 112398 - protein, 10 aa, Homo sapiens
  Native (MAGC3_HUMAN)
VLCPTYFKLW

SEQ ID NO: 112399 - protein, 10 aa, Homo sapiens
  Native (MAGC3_HUMAN)
SDQRMDSLVL

SEQ ID NO: 112400 - protein, 10 aa, Homo sapiens
  Native (MAGC3_HUMAN)
YSAFHLGHLR

SEQ ID NO: 112401 - protein, 9 aa, Homo sapiens
  Native (MAGC3_HUMAN)
FVNTLDLTC

SEQ ID NO: 112402 - protein, 9 aa, Homo sapiens
  Native (MAGC3_HUMAN)
KDMEDRAQA

SEQ ID NO: 112403 - protein, 10 aa, Homo sapiens
  Native (MAGC3_HUMAN)
ATDKDYSAFH

SEQ ID NO: 112404 - protein, 10 aa, Homo sapiens
  Native (MAGC3_HUMAN)
EPLTRAEMQM

SEQ ID NO: 112405 - protein, 10 aa, Homo sapiens
  Native (MAGC3_HUMAN)
MDSLVLCPTY

SEQ ID NO: 112406 - protein, 9 aa, Homo sapiens
  Native (MAGC3_HUMAN)
MEDRAQAII

SEQ ID NO: 112407 - protein, 10 aa, Homo sapiens
  Native (MAGC3_HUMAN)
KATDKDYSAF

SEQ ID NO: 112408 - protein, 10 aa, Homo sapiens
  Native (MAGC3_HUMAN)
MLLPCHWVLD

SEQ ID NO: 112409 - protein, 9 aa, Homo sapiens
  Native (MAGC3_HUMAN)
FGSQPEGKF

SEQ ID NO: 112410 - protein, 8 aa, Homo sapiens
  Native (MAGC3_HUMAN)
SESLPRYA

SEQ ID NO: 112411 - protein, 9 aa, Homo sapiens
  Native (MAGC3_HUMAN)
DEKVDKLVQ

SEQ ID NO: 112412 - protein, 10 aa, Homo sapiens
  Native (MAGC3_HUMAN)
FKLWRTLSGS

SEQ ID NO: 112413 - protein, 9 aa, Homo sapiens
  Native (MAGC3_HUMAN)
DALKDMEDR

SEQ ID NO: 112414 - protein, 8 aa, Homo sapiens
  Native (MAGC3_HUMAN)
ADVLSRLA

SEQ ID NO: 112415 - protein, 8 aa, Homo sapiens
  Native (MAGC3_HUMAN)
GYFPMIFR

SEQ ID NO: 112416 - protein, 9 aa, Homo sapiens
  Native (MAGC3_HUMAN)
QPQPRKKAT

SEQ ID NO: 112417 - protein, 11 aa, Homo sapiens
  Native (MAGC3_HUMAN)
SPGKRLWGEKA

SEQ ID NO: 112418 - protein, 8 aa, Homo sapiens
  Native (MAGC3_HUMAN)
HEFIELIF

SEQ ID NO: 112419 - protein, 11 aa, Homo sapiens
  Native (MAGC3_HUMAN)
KAEMLTTVIKK

SEQ ID NO: 112420 - protein, 8 aa, Homo sapiens
  Native (MAGC3_HUMAN)
LREVRLFL

SEQ ID NO: 112421 - protein, 9 aa, Homo sapiens
  Native (MAGC3_HUMAN)
NHSYFFEDT

SEQ ID NO: 112422 - protein, 10 aa, Homo sapiens
  Native (MAGC3_HUMAN)
FIELIFGIAL

SEQ ID NO: 112423 - protein, 10 aa, Homo sapiens
  Native (MAGC3_HUMAN)
EVDPDHFYVF

SEQ ID NO: 112424 - protein, 9 aa, Homo sapiens
  Native (MAGC3_HUMAN)
DKLVQFLLL

SEQ ID NO: 112425 - protein, 11 aa, Homo sapiens
  Native (MAGC3_HUMAN)
SGSPGLQLSDL

SEQ ID NO: 112426 - protein, 8 aa, Homo sapiens
  Native (MAGC3_HUMAN)
AVSPGKRL

SEQ ID NO: 112427 - protein, 9 aa, Homo sapiens
  Native (MAGC3_HUMAN)
EKVDKLVQF

SEQ ID NO: 112428 - protein, 8 aa, Homo sapiens
  Native (MAGC3_HUMAN)
QPQPRKKA

SEQ ID NO: 112429 - protein, 10 aa, Homo sapiens
  Native (MAGC3_HUMAN)
GSCVPEEVIW

SEQ ID NO: 112430 - protein, 9 aa, Homo sapiens
  Native (MAGC3_HUMAN)
KAEMLTTVI

SEQ ID NO: 112431 - protein, 9 aa, Homo sapiens
  Native (MAGC3_HUMAN)
LLILILSMI

SEQ ID NO: 112432 - protein, 11 aa, Homo sapiens
  Native (MAGC3_HUMAN)
VINTYTGYFPM

SEQ ID NO: 112433 - protein, 8 aa, Homo sapiens
  Native (MAGC3_HUMAN)
FGISLTEV

SEQ ID NO: 112434 - protein, 11 aa, Homo sapiens
  Native (MAGC3_HUMAN)
LSLPAVSPGKR

SEQ ID NO: 112435 - protein, 11 aa, Homo sapiens
  Native (MAGC3_HUMAN)
GHRQEDGRRGL

SEQ ID NO: 112436 - protein, 10 aa, Homo sapiens
  Native (MAGC3_HUMAN)
GPPQSPPQSP

SEQ ID NO: 112437 - protein, 9 aa, Homo sapiens
  Native (MAGC3_HUMAN)
GYFPMIFRK

SEQ ID NO: 112438 - protein, 9 aa, Homo sapiens
  Native (MAGC3_HUMAN)
KKYKDYFPM

SEQ ID NO: 112439 - protein, 9 aa, Homo sapiens
  Native (MAGC3_HUMAN)
LIDDQGMPK

SEQ ID NO: 112440 - protein, 11 aa, Homo sapiens
  Native (MAGC3_HUMAN)
IPPQGPPKISP

SEQ ID NO: 112441 - protein, 10 aa, Homo sapiens
  Native (MAGC3_HUMAN)
SPPEIPPQGP

SEQ ID NO: 112442 - protein, 9 aa, Homo sapiens
  Native (MAGC3_HUMAN)
NCASEEVIW

SEQ ID NO: 112443 - protein, 9 aa, Homo sapiens
  Native (MAGC3_HUMAN)
SPPEIPPQG

SEQ ID NO: 112444 - protein, 11 aa, Homo sapiens
  Native (MAGC3_HUMAN)
LLLKYQAKEPL

SEQ ID NO: 112445 - protein, 9 aa, Homo sapiens
  Native (MAGC3_HUMAN)
QAKEPLTRA

SEQ ID NO: 112446 - protein, 9 aa, Homo sapiens
  Native (MAGC3_HUMAN)
DSCSSPLLW

SEQ ID NO: 112447 - protein, 11 aa, Homo sapiens
  Native (MAGC3_HUMAN)
LSDEQGMPQNR

SEQ ID NO: 112448 - protein, 8 aa, Homo sapiens
  Native (MAGC3_HUMAN)
IDDQGMPK

SEQ ID NO: 112449 - protein, 9 aa, Homo sapiens
  Native (MAGC3_HUMAN)
IDTTDDATA

SEQ ID NO: 112450 - protein, 8 aa, Homo sapiens
  Native (MAGC3_HUMAN)
EASPQQKK

SEQ ID NO: 112451 - protein, 9 aa, Homo sapiens
  Native (MAGC3_HUMAN)
LVQFLLLKY

SEQ ID NO: 112452 - protein, 10 aa, Homo sapiens
  Native (MAGC3_HUMAN)
WHALPESESL

SEQ ID NO: 112453 - protein, 8 aa, Homo sapiens
  Native (MAGC3_HUMAN)
MLTTVIKK

SEQ ID NO: 112454 - protein, 10 aa, Homo sapiens
  Native (MAGC3_HUMAN)
KAHEFIELIF

SEQ ID NO: 112455 - protein, 8 aa, Homo sapiens
  Native (MAGC3_HUMAN)
MEDRAQAI

SEQ ID NO: 112456 - protein, 11 aa, Homo sapiens
  Native (MAGC3_HUMAN)
MPAAGMPPLPQ

SEQ ID NO: 112457 - protein, 9 aa, Homo sapiens
  Native (MAGC3_HUMAN)
SPPQSPLDS

SEQ ID NO: 112458 - protein, 8 aa, Homo sapiens
  Native (MAGC3_HUMAN)
ALAGFADV

SEQ ID NO: 112459 - protein, 10 aa, Homo sapiens
  Native (MAGC3_HUMAN)
IKKYKDYFPM

SEQ ID NO: 112460 - protein, 10 aa, Homo sapiens
  Native (MAGC3_HUMAN)
LDSCSSPLLW

SEQ ID NO: 112461 - protein, 8 aa, Homo sapiens
  Native (MAGC3_HUMAN)
DEKVAELV

SEQ ID NO: 112462 - protein, 10 aa, Homo sapiens
  Native (MAGC3_HUMAN)
ATYALSPVVL

SEQ ID NO: 112463 - protein, 10 aa, Homo sapiens
  Native (MAGC3_HUMAN)
LPCHWVLDAT

SEQ ID NO: 112464 - protein, 10 aa, Homo sapiens
  Native (MAGC3_HUMAN)
FLSKLSSIIP

SEQ ID NO: 112465 - protein, 11 aa, Homo sapiens
  Native (MAGC3_HUMAN)
NTYTGYFPMIF

SEQ ID NO: 112466 - protein, 9 aa, Homo sapiens
  Native (MAGC3_HUMAN)
YFFEDTLDL

SEQ ID NO: 112467 - protein, 9 aa, Homo sapiens
  Native (MAGC3_HUMAN)
IIDTTDDAT

SEQ ID NO: 112468 - protein, 11 aa, Homo sapiens
  Native (MAGC3_HUMAN)
AFHLGHLREVR

SEQ ID NO: 112469 - protein, 9 aa, Homo sapiens
  Native (MAGC3_HUMAN)
KLSSIIPSA

SEQ ID NO: 112470 - protein, 9 aa, Homo sapiens
  Native (MAGC3_HUMAN)
DTTDDATAM

SEQ ID NO: 112471 - protein, 9 aa, Homo sapiens
  Native (MAGC3_HUMAN)
LPPQPQPRK

SEQ ID NO: 112472 - protein, 11 aa, Homo sapiens
  Native (MAGC3_HUMAN)
YEGSLIDDQGM

SEQ ID NO: 112473 - protein, 9 aa, Homo sapiens
  Native (MAGC3_HUMAN)
KEPLTRAEM

SEQ ID NO: 112474 - protein, 10 aa, Homo sapiens
  Native (MAGC3_HUMAN)
LANPQGLAGH

SEQ ID NO: 112475 - protein, 11 aa, Homo sapiens
  Native (MAGC3_HUMAN)
LPESESLPRYA

SEQ ID NO: 112476 - protein, 8 aa, Homo sapiens
  Native (MAGC3_HUMAN)
EDTLDLTY

SEQ ID NO: 112477 - protein, 11 aa, Homo sapiens
  Native (MAGC3_HUMAN)
ILFGISLTEVD

SEQ ID NO: 112478 - protein, 10 aa, Homo sapiens
  Native (MAGC3_HUMAN)
REVRLFLRGG

SEQ ID NO: 112479 - protein, 9 aa, Homo sapiens
  Native (MAGC3_HUMAN)
PQNRLLILI

SEQ ID NO: 112480 - protein, 10 aa, Homo sapiens
  Native (MAGC3_HUMAN)
KRTLWKDSDL

SEQ ID NO: 112481 - protein, 11 aa, Homo sapiens
  Native (MAGC3_HUMAN)
LDSCSSPLLWT

SEQ ID NO: 112482 - protein, 8 aa, Homo sapiens
  Native (MAGC3_HUMAN)
MPAAGMPP

SEQ ID NO: 112483 - protein, 9 aa, Homo sapiens
  Native (MAGC3_HUMAN)
DGSLGQWVK

SEQ ID NO: 112484 - protein, 9 aa, Homo sapiens
  Native (MAGC3_HUMAN)
DPDHFYVFV

SEQ ID NO: 112485 - protein, 9 aa, Homo sapiens
  Native (MAGC3_HUMAN)
ELVQFLLLK

SEQ ID NO: 112486 - protein, 9 aa, Homo sapiens
  Native (MAGC3_HUMAN)
KGNCASEEV

SEQ ID NO: 112487 - protein, 8 aa, Homo sapiens
  Native (MAGC3_HUMAN)
WESEGPEA

SEQ ID NO: 112488 - protein, 11 aa, Homo sapiens
  Native (MAGC3_HUMAN)
EMLTTVIKKYK

SEQ ID NO: 112489 - protein, 8 aa, Homo sapiens
  Native (MAGC3_HUMAN)
LPESEPLF

SEQ ID NO: 112490 - protein, 11 aa, Homo sapiens
  Native (MAGC3_HUMAN)
LLLKYQTKEPV

SEQ ID NO: 112491 - protein, 10 aa, Homo sapiens
  Native (MAGC3_HUMAN)
ADVLSRLALW

SEQ ID NO: 112492 - protein, 11 aa, Homo sapiens
  Native (MAGC3_HUMAN)
ALPESESLPRY

SEQ ID NO: 112493 - protein, 9 aa, Homo sapiens
  Native (MAGC3_HUMAN)
EIPPQGPPK

SEQ ID NO: 112494 - protein, 11 aa, Homo sapiens
  Native (MAGC3_HUMAN)
YMDALKDMEDR

SEQ ID NO: 112495 - protein, 9 aa, Homo sapiens
  Native (MAGC3_HUMAN)
ALSPVVLPP

SEQ ID NO: 112496 - protein, 8 aa, Homo sapiens
  Native (MAGC3_HUMAN)
FLLLKYQA

SEQ ID NO: 112497 - protein, 9 aa, Homo sapiens
  Native (MAGC3_HUMAN)
LILSMIFIK

SEQ ID NO: 112498 - protein, 9 aa, Homo sapiens
  Native (MAGC3_HUMAN)
PEEVIWEVL

SEQ ID NO: 112499 - protein, 8 aa, Homo sapiens
  Native (MAGC3_HUMAN)
IPSAFPSW

SEQ ID NO: 112500 - protein, 8 aa, Homo sapiens
  Native (MAGC3_HUMAN)
SAFHLGHL

SEQ ID NO: 112501 - protein, 11 aa, Homo sapiens
  Native (MAGC3_HUMAN)
SLPRYALDEKV

SEQ ID NO: 112502 - protein, 8 aa, Homo sapiens
  Native (MAGC3_HUMAN)
HWVLDATF

SEQ ID NO: 112503 - protein, 8 aa, Homo sapiens
  Native (MAGC3_HUMAN)
VKNTCATY

SEQ ID NO: 112504 - protein, 10 aa, Homo sapiens
  Native (MAGC3_HUMAN)
QREEPQDWPL

SEQ ID NO: 112505 - protein, 8 aa, Homo sapiens
  Native (MAGC3_HUMAN)
QAKEPLTR

SEQ ID NO: 112506 - protein, 11 aa, Homo sapiens
  Native (MAGC3_HUMAN)
SPVVLPPQPQP

SEQ ID NO: 112507 - protein, 9 aa, Homo sapiens
  Native (MAGC3_HUMAN)
LILILSMIF

SEQ ID NO: 112508 - protein, 10 aa, Homo sapiens
  Native (MAGC3_HUMAN)
FSDGSLGQWV

SEQ ID NO: 112509 - protein, 9 aa, Homo sapiens
  Native (MAGC3_HUMAN)
MPPLPQSPP

SEQ ID NO: 112510 - protein, 11 aa, Homo sapiens
  Native (MAGC3_HUMAN)
HALPESESLPR

SEQ ID NO: 112511 - protein, 8 aa, Homo sapiens
  Native (MAGC3_HUMAN)
KAEMLTTV

SEQ ID NO: 112512 - protein, 10 aa, Homo sapiens
  Native (MAGC3_HUMAN)
CVPEEVIWEV

SEQ ID NO: 112513 - protein, 8 aa, Homo sapiens
  Native (MAGC3_HUMAN)
IELIFGIA

SEQ ID NO: 112514 - protein, 9 aa, Homo sapiens
  Native (MAGC3_HUMAN)
IQRPAREVL

SEQ ID NO: 112515 - protein, 11 aa, Homo sapiens
  Native (MAGC3_HUMAN)
AEMLTTVIKKY

SEQ ID NO: 112516 - protein, 10 aa, Homo sapiens
  Native (MAGC3_HUMAN)
ELVQFLLLKY

SEQ ID NO: 112517 - protein, 8 aa, Homo sapiens
  Native (MAGC3_HUMAN)
AEMLTTVI

SEQ ID NO: 112518 - protein, 10 aa, Homo sapiens
  Native (MAGC3_HUMAN)
LLILILSMIF

SEQ ID NO: 112519 - protein, 10 aa, Homo sapiens
  Native (MAGC3_HUMAN)
WPLNEKRTLW

SEQ ID NO: 112520 - protein, 8 aa, Homo sapiens
  Native (MAGC3_HUMAN)
FPSWYMDA

SEQ ID NO: 112521 - protein, 10 aa, Homo sapiens
  Native (MAGC3_HUMAN)
QFLLLKYQAK

SEQ ID NO: 112522 - protein, 11 aa, Homo sapiens
  Native (MAGC3_HUMAN)
VLNAIGPWSAL

SEQ ID NO: 112523 - protein, 8 aa, Homo sapiens
  Native (MAGC3_HUMAN)
LQLSDLHF

SEQ ID NO: 112524 - protein, 9 aa, Homo sapiens
  Native (MAGC3_HUMAN)
WHALPESES

SEQ ID NO: 112525 - protein, 9 aa, Homo sapiens
  Native (MAGC3_HUMAN)
ISPQGPPQS

SEQ ID NO: 112526 - protein, 10 aa, Homo sapiens
  Native (MAGC3_HUMAN)
WVKNTCATYA

SEQ ID NO: 112527 - protein, 11 aa, Homo sapiens
  Native (MAGC3_HUMAN)
KDMEDRAQAII

SEQ ID NO: 112528 - protein, 8 aa, Homo sapiens
  Native (MAGC3_HUMAN)
DPDNHSYF

SEQ ID NO: 112529 - protein, 8 aa, Homo sapiens
  Native (MAGC3_HUMAN)
ESESLPRY

SEQ ID NO: 112530 - protein, 8 aa, Homo sapiens
  Native (MAGC3_HUMAN)
VSPGKRLW

SEQ ID NO: 112531 - protein, 11 aa, Homo sapiens
  Native (MAGC3_HUMAN)
KVAELVQFLLL

SEQ ID NO: 112532 - protein, 9 aa, Homo sapiens
  Native (MAGC3_HUMAN)
LRSAEGSVL

SEQ ID NO: 112533 - protein, 10 aa, Homo sapiens
  Native (MAGC3_HUMAN)
PMIFGKAHEF

SEQ ID NO: 112534 - protein, 10 aa, Homo sapiens
  Native (MAGC3_HUMAN)
EVIWEVLSAI

SEQ ID NO: 112535 - protein, 11 aa, Homo sapiens
  Native (MAGC3_HUMAN)
QMNVINTYTGY

SEQ ID NO: 112536 - protein, 9 aa, Homo sapiens
  Native (MAGC3_HUMAN)
RTLSGSPGL

SEQ ID NO: 112537 - protein, 10 aa, Homo sapiens
  Native (MAGC3_HUMAN)
SKLSSIIPSA

SEQ ID NO: 112538 - protein, 9 aa, Homo sapiens
  Native (MAGC3_HUMAN)
DSLVLCPTY

SEQ ID NO: 112539 - protein, 8 aa, Homo sapiens
  Native (MAGC3_HUMAN)
SSIIPSAF

SEQ ID NO: 112540 - protein, 9 aa, Homo sapiens
  Native (MAGC3_HUMAN)
DEQGMPQNR

SEQ ID NO: 112541 - protein, 11 aa, Homo sapiens
  Native (MAGC3_HUMAN)
MQMNVINTYTG

SEQ ID NO: 112542 - protein, 11 aa, Homo sapiens
  Native (MAGC3_HUMAN)
SASPSVMSTNF

SEQ ID NO: 112543 - protein, 9 aa, Homo sapiens
  Native (MAGC3_HUMAN)
NPQGLAGHR

SEQ ID NO: 112544 - protein, 11 aa, Homo sapiens
  Native (MAGC3_HUMAN)
LRSAEGSVLDL

SEQ ID NO: 112545 - protein, 11 aa, Homo sapiens
  Native (MAGC3_HUMAN)
QDWPLNEKRTL

SEQ ID NO: 112546 - protein, 8 aa, Homo sapiens
  Native (MAGC3_HUMAN)
SPQGPPQS

SEQ ID NO: 112547 - protein, 10 aa, Homo sapiens
  Native (MAGC3_HUMAN)
LWESEGPEAF

SEQ ID NO: 112548 - protein, 8 aa, Homo sapiens
  Native (MAGC3_HUMAN)
IFGKAHEF

SEQ ID NO: 112549 - protein, 9 aa, Homo sapiens
  Native (MAGC3_HUMAN)
YSAFHLGHL

SEQ ID NO: 112550 - protein, 8 aa, Homo sapiens
  Native (MAGC3_HUMAN)
VAELVQFL

SEQ ID NO: 112551 - protein, 8 aa, Homo sapiens
  Native (MAGC3_HUMAN)
AELVQFLL

SEQ ID NO: 112552 - protein, 9 aa, Homo sapiens
  Native (MAGC3_HUMAN)
GEDEDMPAA

SEQ ID NO: 112553 - protein, 9 aa, Homo sapiens
  Native (MAGC3_HUMAN)
PTWRRGTGY

SEQ ID NO: 112554 - protein, 11 aa, Homo sapiens
  Native (MAGC3_HUMAN)
LPCHWVLDATF

SEQ ID NO: 112555 - protein, 8 aa, Homo sapiens
  Native (MAGC3_HUMAN)
ILILSMIF

SEQ ID NO: 112556 - protein, 8 aa, Homo sapiens
  Native (MAGC3_HUMAN)
EESGLRSA

SEQ ID NO: 112557 - protein, 11 aa, Homo sapiens
  Native (MAGC3_HUMAN)
FHLGHLREVRL

SEQ ID NO: 112558 - protein, 10 aa, Homo sapiens
  Native (MAGC3_HUMAN)
GSLPESEPLF

SEQ ID NO: 112559 - protein, 8 aa, Homo sapiens
  Native (MAGC3_HUMAN)
KAHEFIEL

SEQ ID NO: 112560 - protein, 9 aa, Homo sapiens
  Native (MAGC3_HUMAN)
LEFLSKLSS

SEQ ID NO: 112561 - protein, 8 aa, Homo sapiens
  Native (MAGC3_HUMAN)
TTDDATAM

SEQ ID NO: 112562 - protein, 9 aa, Homo sapiens
  Native (MAGC3_HUMAN)
WEVLNAIGP

SEQ ID NO: 112563 - protein, 8 aa, Homo sapiens
  Native (MAGC3_HUMAN)
SSPLLWTR

SEQ ID NO: 112564 - protein, 11 aa, Homo sapiens
  Native (MAGC3_HUMAN)
RYALDEKVAEL

SEQ ID NO: 112565 - protein, 11 aa, Homo sapiens
  Native (MAGC3_HUMAN)
GEDEDMPAAGM

SEQ ID NO: 112566 - protein, 9 aa, Homo sapiens
  Native (MAGC3_HUMAN)
SPSVMSTNF

SEQ ID NO: 112567 - protein, 11 aa, Homo sapiens
  Native (MAGC3_HUMAN)
MEDRAQAIIDT

SEQ ID NO: 112568 - protein, 9 aa, Homo sapiens
  Native (MAGC3_HUMAN)
DQRMDSLVL

SEQ ID NO: 112569 - protein, 11 aa, Homo sapiens
  Native (MAGC3_HUMAN)
KGNCASEEVIW

SEQ ID NO: 112570 - protein, 10 aa, Homo sapiens
  Native (MAGC3_HUMAN)
EMQMNVINTY

SEQ ID NO: 112571 - protein, 11 aa, Homo sapiens
  Native (MAGC3_HUMAN)
TSDQRMDSLVL

SEQ ID NO: 112572 - protein, 11 aa, Homo sapiens
  Native (MAGC3_HUMAN)
DSCSSPLLWTR

SEQ ID NO: 112573 - protein, 11 aa, Homo sapiens
  Native (MAGC3_HUMAN)
CEGSLSDEQGM

SEQ ID NO: 112574 - protein, 8 aa, Homo sapiens
  Native (MAGC3_HUMAN)
MPKNCLLI

SEQ ID NO: 112575 - protein, 9 aa, Homo sapiens
  Native (MAGC3_HUMAN)
QEDGRRGLT

SEQ ID NO: 112576 - protein, 9 aa, Homo sapiens
  Native (MAGC3_HUMAN)
AELVQFLLL

SEQ ID NO: 112577 - protein, 11 aa, Homo sapiens
  Native (MAGC3_HUMAN)
FSDGSLGQWVK

SEQ ID NO: 112578 - protein, 9 aa, Homo sapiens
  Native (MAGC3_HUMAN)
PQSPPQSPL

SEQ ID NO: 112579 - protein, 11 aa, Homo sapiens
  Native (MAGC3_HUMAN)
YALDEKVAELV

SEQ ID NO: 112580 - protein, 9 aa, Homo sapiens
  Native (MAGC3_HUMAN)
HEFIELIFG

SEQ ID NO: 112581 - protein, 10 aa, Homo sapiens
  Native (MAGC3_HUMAN)
VPEEVIWEVL

SEQ ID NO: 112582 - protein, 10 aa, Homo sapiens
  Native (MAGC3_HUMAN)
YFPMIFRKAR

SEQ ID NO: 112583 - protein, 9 aa, Homo sapiens
  Native (MAGC3_HUMAN)
SCVPEEVIW

SEQ ID NO: 112584 - protein, 10 aa, Homo sapiens
  Native (MAGC3_HUMAN)
LLILILSVIF

SEQ ID NO: 112585 - protein, 11 aa, Homo sapiens
  Native (MAGC3_HUMAN)
LVLCPTYFKLW

SEQ ID NO: 112586 - protein, 9 aa, Homo sapiens
  Native (MAGC3_HUMAN)
CEESGLRSA

SEQ ID NO: 112587 - protein, 9 aa, Homo sapiens
  Native (MAGC3_HUMAN)
HLREVRLFL

SEQ ID NO: 112588 - protein, 11 aa, Homo sapiens
  Native (MAGC3_HUMAN)
FADVLSRLALW

SEQ ID NO: 112589 - protein, 9 aa, Homo sapiens
  Native (MAGC3_HUMAN)
GMPKNCLLI

SEQ ID NO: 112590 - protein, 10 aa, Homo sapiens
  Native (MAGC3_HUMAN)
TRAEMQMNVI

SEQ ID NO: 112591 - protein, 11 aa, Homo sapiens
  Native (MAGC3_HUMAN)
LPAVSPGKRLW

SEQ ID NO: 112592 - protein, 10 aa, Homo sapiens
  Native (MAGC3_HUMAN)
GTSDQRMDSL

SEQ ID NO: 112593 - protein, 8 aa, Homo sapiens
  Native (MAGC3_HUMAN)
QRPAREVL

SEQ ID NO: 112594 - protein, 11 aa, Homo sapiens
  Native (MAGC3_HUMAN)
TDMDPDNHSYF

SEQ ID NO: 112595 - protein, 9 aa, Homo sapiens
  Native (MAGC3_HUMAN)
DYFPMIFGK

SEQ ID NO: 112596 - protein, 11 aa, Homo sapiens
  Native (MAGC3_HUMAN)
KYKDYFPMIFG

SEQ ID NO: 112597 - protein, 9 aa, Homo sapiens
  Native (MAGC3_HUMAN)
LSSIIPSAF

SEQ ID NO: 112598 - protein, 9 aa, Homo sapiens
  Native (MAGC3_HUMAN)
GYTLSLPAV

SEQ ID NO: 112599 - protein, 8 aa, Homo sapiens
  Native (MAGC3_HUMAN)
ALPESESL

SEQ ID NO: 112600 - protein, 9 aa, Homo sapiens
  Native (MAGC3_HUMAN)
PRYALDEKV

SEQ ID NO: 112601 - protein, 8 aa, Homo sapiens
  Native (MAGC3_HUMAN)
PLNEKRTL

SEQ ID NO: 112602 - protein, 10 aa, Homo sapiens
  Native (MAGC3_HUMAN)
MIFGKAHEFI

SEQ ID NO: 112603 - protein, 11 aa, Homo sapiens
  Native (MAGC3_HUMAN)
RRGTGYTLSLP

SEQ ID NO: 112604 - protein, 10 aa, Homo sapiens
  Native (MAGC3_HUMAN)
KRLWGEKAGS

SEQ ID NO: 112605 - protein, 11 aa, Homo sapiens
  Native (MAGC3_HUMAN)
SKLSSIIPSAF

SEQ ID NO: 112606 - protein, 10 aa, Homo sapiens
  Native (MAGC3_HUMAN)
SPVVLPPQPQ

SEQ ID NO: 112607 - protein, 9 aa, Homo sapiens
  Native (MAGC3_HUMAN)
SALAGFADV

SEQ ID NO: 112608 - protein, 10 aa, Homo sapiens
  Native (MAGC3_HUMAN)
SLRRAVSVKQ

SEQ ID NO: 112609 - protein, 9 aa, Homo sapiens
  Native (MAGC3_HUMAN)
GPPQSPPQS

SEQ ID NO: 112610 - protein, 11 aa, Homo sapiens
  Native (MAGC3_HUMAN)
LTEVDPDHFYV

SEQ ID NO: 112611 - protein, 11 aa, Homo sapiens
  Native (MAGC3_HUMAN)
SEEEDTATWHA

SEQ ID NO: 112612 - protein, 10 aa, Homo sapiens
  Native (MAGC3_HUMAN)
EVIWEVLNAI

SEQ ID NO: 112613 - protein, 8 aa, Homo sapiens
  Native (MAGC3_HUMAN)
SDQRMDSL

SEQ ID NO: 112614 - protein, 8 aa, Homo sapiens
  Native (MAGC3_HUMAN)
SEEEDTAT

SEQ ID NO: 112615 - protein, 11 aa, Homo sapiens
  Native (MAGC3_HUMAN)
FIKGNCASEEV

SEQ ID NO: 112616 - protein, 10 aa, Homo sapiens
  Native (MAGC3_HUMAN)
QRMDSLVLCP

SEQ ID NO: 112617 - protein, 10 aa, Homo sapiens
  Native (MAGC3_HUMAN)
FSLRRAVSVK

SEQ ID NO: 112618 - protein, 9 aa, Homo sapiens
  Native (MAGC3_HUMAN)
IPSAFPSWY

SEQ ID NO: 112619 - protein, 8 aa, Homo sapiens
  Native (MAGC3_HUMAN)
MLLPCHWV

SEQ ID NO: 112620 - protein, 10 aa, Homo sapiens
  Native (MAGC3_HUMAN)
EMLTTVIKKY

SEQ ID NO: 112621 - protein, 9 aa, Homo sapiens
  Native (MAGC3_HUMAN)
DATFSDGSL

SEQ ID NO: 112622 - protein, 8 aa, Homo sapiens
  Native (MAGC3_HUMAN)
MDPDNHSY

SEQ ID NO: 112623 - protein, 9 aa, Homo sapiens
  Native (MAGC3_HUMAN)
DMDPDNHSY

SEQ ID NO: 112624 - protein, 10 aa, Homo sapiens
  Native (MAGC3_HUMAN)
TDKDYSAFHL

SEQ ID NO: 112625 - protein, 10 aa, Homo sapiens
  Native (MAGC3_HUMAN)
CATYALSPVV

SEQ ID NO: 112626 - protein, 10 aa, Homo sapiens
  Native (MAGC3_HUMAN)
NHSYFFEDTL

SEQ ID NO: 112627 - protein, 10 aa, Homo sapiens
  Native (MAGC3_HUMAN)
VLPPQPQPRK

SEQ ID NO: 112628 - protein, 8 aa, Homo sapiens
  Native (MAGC3_HUMAN)
AEGSVLDL

SEQ ID NO: 112629 - protein, 9 aa, Homo sapiens
  Native (MAGC3_HUMAN)
LLILILSVI

SEQ ID NO: 112630 - protein, 11 aa, Homo sapiens
  Native (MAGC3_HUMAN)
NTCATYALSPV

SEQ ID NO: 112631 - protein, 9 aa, Homo sapiens
  Native (MAGC3_HUMAN)
IFGIALTDM

SEQ ID NO: 112632 - protein, 11 aa, Homo sapiens
  Native (MAGC3_HUMAN)
IQRPAREVLEF

SEQ ID NO: 112633 - protein, 9 aa, Homo sapiens
  Native (MAGC3_HUMAN)
FKLWRTLSG

SEQ ID NO: 112634 - protein, 10 aa, Homo sapiens
  Native (MAGC3_HUMAN)
FLRGGTSDQR

SEQ ID NO: 112635 - protein, 9 aa, Homo sapiens
  Native (MAGC3_HUMAN)
PLNEKRTLW

SEQ ID NO: 112636 - protein, 8 aa, Homo sapiens
  Native (MAGC3_HUMAN)
SYFFEDTL

SEQ ID NO: 112637 - protein, 9 aa, Homo sapiens
  Native (MAGC3_HUMAN)
LDEKVAELV

SEQ ID NO: 112638 - protein, 9 aa, Homo sapiens
  Native (MAGC3_HUMAN)
PESESLPRY

SEQ ID NO: 112639 - protein, 9 aa, Homo sapiens
  Native (MAGC3_HUMAN)
LPESESLPR

SEQ ID NO: 112640 - protein, 10 aa, Homo sapiens
  Native (MAGC3_HUMAN)
TCATYALSPV

SEQ ID NO: 112641 - protein, 8 aa, Homo sapiens
  Native (MAGC3_HUMAN)
EVDPDHFY

SEQ ID NO: 112642 - protein, 11 aa, Homo sapiens
  Native (MAGC3_HUMAN)
TEVDPDHFYVF

SEQ ID NO: 112643 - protein, 11 aa, Homo sapiens
  Native (MAGC3_HUMAN)
ALAGFADVLSR

SEQ ID NO: 112644 - protein, 11 aa, Homo sapiens
  Native (MAGC3_HUMAN)
NTLDLTCEGSL

SEQ ID NO: 112645 - protein, 10 aa, Homo sapiens
  Native (MAGC3_HUMAN)
GEKAGSLPES

SEQ ID NO: 112646 - protein, 9 aa, Homo sapiens
  Native (MAGC3_HUMAN)
HALPESESL

SEQ ID NO: 112647 - protein, 9 aa, Homo sapiens
  Native (MAGC3_HUMAN)
VDKLVQFLL

SEQ ID NO: 112648 - protein, 10 aa, Homo sapiens
  Native (MAGC3_HUMAN)
MIFRKAREFI

SEQ ID NO: 112649 - protein, 10 aa, Homo sapiens
  Native (MAGC3_HUMAN)
PESESLPRYA

SEQ ID NO: 112650 - protein, 9 aa, Homo sapiens
  Native (MAGC3_HUMAN)
ATDKDYSAF

SEQ ID NO: 112651 - protein, 10 aa, Homo sapiens
  Native (MAGC3_HUMAN)
LIFGIALTDM

SEQ ID NO: 112652 - protein, 9 aa, Homo sapiens
  Native (MAGC3_HUMAN)
DKDYSAFHL

SEQ ID NO: 112653 - protein, 8 aa, Homo sapiens
  Native (MAGC3_HUMAN)
LLILILSV

SEQ ID NO: 112654 - protein, 9 aa, Homo sapiens
  Native (MAGC3_HUMAN)
DEDMPAAGM

SEQ ID NO: 112655 - protein, 10 aa, Homo sapiens
  Native (MAGC3_HUMAN)
HRQEDGRRGL

SEQ ID NO: 112656 - protein, 11 aa, Homo sapiens
  Native (MAGC3_HUMAN)
LIDDQGMPKNC

SEQ ID NO: 112657 - protein, 10 aa, Homo sapiens
  Native (MAGC3_HUMAN)
VLDLANPQGL

SEQ ID NO: 112658 - protein, 10 aa, Homo sapiens
  Native (MAGC3_HUMAN)
MPQNRLLILI

SEQ ID NO: 112659 - protein, 10 aa, Homo sapiens
  Native (MAGC3_HUMAN)
VVLPPQPQPR

SEQ ID NO: 112660 - protein, 11 aa, Homo sapiens
  Native (MAGC3_HUMAN)
QGMPKNCLLIL

SEQ ID NO: 112661 - protein, 9 aa, Homo sapiens
  Native (MAGC3_HUMAN)
EDMPAAGMP

SEQ ID NO: 112662 - protein, 11 aa, Homo sapiens
  Native (MAGC3_HUMAN)
SAIGPIQRPAR

SEQ ID NO: 112663 - protein, 9 aa, Homo sapiens
  Native (MAGC3_HUMAN)
SPQGPPQSP

SEQ ID NO: 112664 - protein, 10 aa, Homo sapiens
  Native (MAGC3_HUMAN)
CEGSLSDEQG

SEQ ID NO: 112665 - protein, 9 aa, Homo sapiens
  Native (MAGC3_HUMAN)
LPCHWVLDA

SEQ ID NO: 112666 - protein, 9 aa, Homo sapiens
  Native (MAGC3_HUMAN)
SLPAVSPGK

SEQ ID NO: 112667 - protein, 9 aa, Homo sapiens
  Native (MAGC3_HUMAN)
IGPIQRPAR

SEQ ID NO: 112668 - protein, 8 aa, Homo sapiens
  Native (MAGC3_HUMAN)
VQFLLLKY

SEQ ID NO: 112669 - protein, 11 aa, Homo sapiens
  Native (MAGC3_HUMAN)
TYTGYFPMIFR

SEQ ID NO: 112670 - protein, 11 aa, Homo sapiens
  Native (MAGC3_HUMAN)
VLCPTYFKLWR

SEQ ID NO: 112671 - protein, 11 aa, Homo sapiens
  Native (MAGC3_HUMAN)
ALKDMEDRAQA

SEQ ID NO: 112672 - protein, 9 aa, Homo sapiens
  Native (MAGC3_HUMAN)
AIGPIQRPA

SEQ ID NO: 112673 - protein, 9 aa, Homo sapiens
  Native (MAGC3_HUMAN)
IELIFGIAL

SEQ ID NO: 112674 - protein, 11 aa, Homo sapiens
  Native (MAGC3_HUMAN)
SSEEEDTATWH

SEQ ID NO: 112675 - protein, 10 aa, Homo sapiens
  Native (MAGC3_HUMAN)
TLSGSPGLQL

SEQ ID NO: 112676 - protein, 9 aa, Homo sapiens
  Native (MAGC3_HUMAN)
RRAVSVKQR

SEQ ID NO: 112677 - protein, 8 aa, Homo sapiens
  Native (MAGC3_HUMAN)
LNEKRTLW

SEQ ID NO: 112678 - protein, 11 aa, Homo sapiens
  Native (MAGC3_HUMAN)
QGMPQNRLLIL

SEQ ID NO: 112679 - protein, 8 aa, Homo sapiens
  Native (MAGC3_HUMAN)
TYTGYFPM

SEQ ID NO: 112680 - protein, 9 aa, Homo sapiens
  Native (MAGC3_HUMAN)
ADVLSRLAL

SEQ ID NO: 112681 - protein, 11 aa, Homo sapiens
  Native (MAGC3_HUMAN)
VLDATFSDGSL

SEQ ID NO: 112682 - protein, 9 aa, Homo sapiens
  Native (MAGC3_HUMAN)
QLSDLHFGS

SEQ ID NO: 112683 - protein, 10 aa, Homo sapiens
  Native (MAGC3_HUMAN)
EIPPQGPPKI

SEQ ID NO: 112684 - protein, 10 aa, Homo sapiens
  Native (MAGC3_HUMAN)
LLKYQTKEPV

SEQ ID NO: 112685 - protein, 8 aa, Homo sapiens
  Native (MAGC3_HUMAN)
KVAELVQF

SEQ ID NO: 112686 - protein, 9 aa, Homo sapiens
  Native (MAGC3_HUMAN)
GQWVKNTCA

SEQ ID NO: 112687 - protein, 10 aa, Homo sapiens
  Native (MAGC3_HUMAN)
KLSSIIPSAF

SEQ ID NO: 112688 - protein, 9 aa, Homo sapiens
  Native (MAGC3_HUMAN)
WPLNEKRTL

SEQ ID NO: 112689 - protein, 9 aa, Homo sapiens
  Native (MAGC3_HUMAN)
WRRGTGYTL

SEQ ID NO: 112690 - protein, 9 aa, Homo sapiens
  Native (MAGC3_HUMAN)
EFLSKLSSI

SEQ ID NO: 112691 - protein, 11 aa, Homo sapiens
  Native (MAGC3_HUMAN)
PEIPPQGPPKI

SEQ ID NO: 112692 - protein, 10 aa, Homo sapiens
  Native (MAGC3_HUMAN)
LILILSVIFI

SEQ ID NO: 112693 - protein, 10 aa, Homo sapiens
  Native (MAGC3_HUMAN)
SAFPSWYMDA

SEQ ID NO: 112694 - protein, 11 aa, Homo sapiens
  Native (MAGC3_HUMAN)
YTLDEKVDKLV

SEQ ID NO: 112695 - protein, 10 aa, Homo sapiens
  Native (MAGC3_HUMAN)
RSAEGSVLDL

SEQ ID NO: 112696 - protein, 11 aa, Homo sapiens
  Native (MAGC3_HUMAN)
SPQGPPQSPPQ

SEQ ID NO: 112697 - protein, 9 aa, Homo sapiens
  Native (MAGC3_HUMAN)
FFEDTLDLT

SEQ ID NO: 112698 - protein, 10 aa, Homo sapiens
  Native (MAGC3_HUMAN)
NTYTGYFPMI

SEQ ID NO: 112699 - protein, 9 aa, Homo sapiens
  Native (MAGC3_HUMAN)
RKKATDKDY

SEQ ID NO: 112700 - protein, 9 aa, Homo sapiens
  Native (MAGC3_HUMAN)
IPPQGPPKI

SEQ ID NO: 112701 - protein, 11 aa, Homo sapiens
  Native (MAGC3_HUMAN)
SPLDSCSSPLL

SEQ ID NO: 112702 - protein, 9 aa, Homo sapiens
  Native (MAGC3_HUMAN)
VAELVQFLL

SEQ ID NO: 112703 - protein, 8 aa, Homo sapiens
  Native (MAGC3_HUMAN)
SLRRAVSV

SEQ ID NO: 112704 - protein, 10 aa, Homo sapiens
  Native (MAGC3_HUMAN)
SESLPRYALD

SEQ ID NO: 112705 - protein, 9 aa, Homo sapiens
  Native (MAGC3_HUMAN)
EEDTATWHA

SEQ ID NO: 112706 - protein, 11 aa, Homo sapiens
  Native (MAGC3_HUMAN)
SIIPSAFPSWY

SEQ ID NO: 112707 - protein, 9 aa, Homo sapiens
  Native (MAGC3_HUMAN)
PESEPLFTY

SEQ ID NO: 112708 - protein, 11 aa, Homo sapiens
  Native (MAGC3_HUMAN)
CPTYFKLWRTL

SEQ ID NO: 112709 - protein, 10 aa, Homo sapiens
  Native (MAGC3_HUMAN)
RLLILILSVI

SEQ ID NO: 112710 - protein, 9 aa, Homo sapiens
  Native (MAGC3_HUMAN)
LPQSPPEIP

SEQ ID NO: 112711 - protein, 10 aa, Homo sapiens
  Native (MAGC3_HUMAN)
LRGGTSDQRM

SEQ ID NO: 112712 - protein, 10 aa, Homo sapiens
  Native (MAGC3_HUMAN)
ATFSDGSLGQ

SEQ ID NO: 112713 - protein, 8 aa, Homo sapiens
  Native (MAGC3_HUMAN)
FGSQPEGK

SEQ ID NO: 112714 - protein, 11 aa, Homo sapiens
  Native (MAGC3_HUMAN)
LSKLSSIIPSA

SEQ ID NO: 112715 - protein, 8 aa, Homo sapiens
  Native (MAGC3_HUMAN)
FEDTLDLT

SEQ ID NO: 112716 - protein, 9 aa, Homo sapiens
  Native (MAGC3_HUMAN)
QPEGKFSLR

SEQ ID NO: 112717 - protein, 9 aa, Homo sapiens
  Native (MAGC3_HUMAN)
EAFCEESGL

SEQ ID NO: 112718 - protein, 9 aa, Homo sapiens
  Native (MAGC3_HUMAN)
SASPSVMST

SEQ ID NO: 112719 - protein, 9 aa, Homo sapiens
  Native (MAGC3_HUMAN)
VTKAEMLTT

SEQ ID NO: 112720 - protein, 8 aa, Homo sapiens
  Native (MAGC3_HUMAN)
LDEKVDKL

SEQ ID NO: 112721 - protein, 9 aa, Homo sapiens
  Native (MAGC3_HUMAN)
EFIELIFGI

SEQ ID NO: 112722 - protein, 8 aa, Homo sapiens
  Native (MAGC3_HUMAN)
EDMPAAGM

SEQ ID NO: 112723 - protein, 11 aa, Homo sapiens
  Native (MAGC3_HUMAN)
VLPPQPQPRKK

SEQ ID NO: 112724 - protein, 10 aa, Homo sapiens
  Native (MAGC3_HUMAN)
LWKDSDLPTW

SEQ ID NO: 112725 - protein, 11 aa, Homo sapiens
  Native (MAGC3_HUMAN)
MPPLPQSPPEI

SEQ ID NO: 112726 - protein, 10 aa, Homo sapiens
  Native (MAGC3_HUMAN)
FCEESGLRSA

SEQ ID NO: 112727 - protein, 11 aa, Homo sapiens
  Native (MAGC3_HUMAN)
DEDMPAAGMPP

SEQ ID NO: 112728 - protein, 11 aa, Homo sapiens
  Native (MAGC3_HUMAN)
FIKGSCVPEEV

SEQ ID NO: 112729 - protein, 8 aa, Homo sapiens
  Native (MAGC3_HUMAN)
PPQGPPKI

SEQ ID NO: 112730 - protein, 10 aa, Homo sapiens
  Native (MAGC3_HUMAN)
LPTWRRGTGY

SEQ ID NO: 112731 - protein, 10 aa, Homo sapiens
  Native (MAGC3_HUMAN)
EESGLRSAEG

SEQ ID NO: 112732 - protein, 10 aa, Homo sapiens
  Native (MAGC3_HUMAN)
LSKLSSIIPS

SEQ ID NO: 112733 - protein, 10 aa, Homo sapiens
  Native (MAGC3_HUMAN)
YALDEKVAEL

SEQ ID NO: 112734 - protein, 10 aa, Homo sapiens
  Native (MAGC3_HUMAN)
FYVFVNTLDL

SEQ ID NO: 112735 - protein, 11 aa, Homo sapiens
  Native (MAGC3_HUMAN)
QTKEPVTKAEM

SEQ ID NO: 112736 - protein, 11 aa, Homo sapiens
  Native (MAGC3_HUMAN)
FLSKLSSIIPS

SEQ ID NO: 112737 - protein, 11 aa, Homo sapiens
  Native (MAGC3_HUMAN)
FPMIFRKAREF

SEQ ID NO: 112738 - protein, 10 aa, Homo sapiens
  Native (MAGC3_HUMAN)
AEMLTTVIKK

SEQ ID NO: 112739 - protein, 11 aa, Homo sapiens
  Native (MAGC3_HUMAN)
MLLPCHWVLDA

SEQ ID NO: 112740 - protein, 9 aa, Homo sapiens
  Native (MAGC3_HUMAN)
RAEMQMNVI

SEQ ID NO: 112741 - protein, 10 aa, Homo sapiens
  Native (MAGC3_HUMAN)
EEDTATWHAL

SEQ ID NO: 112742 - protein, 10 aa, Homo sapiens
  Native (MAGC3_HUMAN)
TDMDPDNHSY

SEQ ID NO: 112743 - protein, 9 aa, Homo sapiens
  Native (MAGC3_HUMAN)
LDSCSSPLL

SEQ ID NO: 112744 - protein, 8 aa, Homo sapiens
  Native (MAGC3_HUMAN)
LPQSPPEI

SEQ ID NO: 112745 - protein, 9 aa, Homo sapiens
  Native (MAGC3_HUMAN)
QGMPKNCLL

SEQ ID NO: 112746 - protein, 10 aa, Homo sapiens
  Native (MAGC3_HUMAN)
SPLDSCSSPL

SEQ ID NO: 112747 - protein, 9 aa, Homo sapiens
  Native (MAGC3_HUMAN)
GSLPESEPL

SEQ ID NO: 112748 - protein, 10 aa, Homo sapiens
  Native (MAGC3_HUMAN)
AELVQFLLLK

SEQ ID NO: 112749 - protein, 8 aa, Homo sapiens
  Native (MAGC3_HUMAN)
YTLSLPAV

SEQ ID NO: 112750 - protein, 9 aa, Homo sapiens
  Native (MAGC3_HUMAN)
DYSAFHLGH

SEQ ID NO: 112751 - protein, 9 aa, Homo sapiens
  Native (MAGC3_HUMAN)
SEEEDTATW

SEQ ID NO: 112752 - protein, 9 aa, Homo sapiens
  Native (MAGC3_HUMAN)
YQTKEPVTK

SEQ ID NO: 112753 - protein, 9 aa, Homo sapiens
  Native (MAGC3_HUMAN)
SIIPSAFPS

SEQ ID NO: 112754 - protein, 10 aa, Homo sapiens
  Native (MAGC3_HUMAN)
YQAKEPLTRA

SEQ ID NO: 112755 - protein, 10 aa, Homo sapiens
  Native (MAGC3_HUMAN)
GSPGLQLSDL

SEQ ID NO: 112756 - protein, 8 aa, Homo sapiens
  Native (MAGC3_HUMAN)
ILSMIFIK

SEQ ID NO: 112757 - protein, 9 aa, Homo sapiens
  Native (MAGC3_HUMAN)
LDLTYEGSL

SEQ ID NO: 112758 - protein, 9 aa, Homo sapiens
  Native (MAGC3_HUMAN)
AAGMPPLPQ

SEQ ID NO: 112759 - protein, 10 aa, Homo sapiens
  Native (MAGC3_HUMAN)
HLGHLREVRL

SEQ ID NO: 112760 - protein, 10 aa, Homo sapiens
  Native (MAGC3_HUMAN)
LDLANPQGLA

SEQ ID NO: 112761 - protein, 9 aa, Homo sapiens
  Native (MAGC3_HUMAN)
KEPVTKAEM

SEQ ID NO: 112762 - protein, 8 aa, Homo sapiens
  Native (MAGC3_HUMAN)
AFHLGHLR

SEQ ID NO: 112763 - protein, 10 aa, Homo sapiens
  Native (MAGC3_HUMAN)
TEVDPDHFYV

SEQ ID NO: 112764 - protein, 9 aa, Homo sapiens
  Native (MAGC3_HUMAN)
VPEEVIWEV

SEQ ID NO: 112765 - protein, 11 aa, Homo sapiens
  Native (MAGC3_HUMAN)
REVLEFLSKLS

SEQ ID NO: 112766 - protein, 8 aa, Homo sapiens
  Native (MAGC3_HUMAN)
MASASPSV

SEQ ID NO: 112767 - protein, 8 aa, Homo sapiens
  Native (MAGC3_HUMAN)
VDKLVQFL

SEQ ID NO: 112768 - protein, 9 aa, Homo sapiens
  Native (MAGC3_HUMAN)
RQEDGRRGL

SEQ ID NO: 112769 - protein, 8 aa, Homo sapiens
  Native (MAGC3_HUMAN)
QEDGRRGL

SEQ ID NO: 112770 - protein, 10 aa, Homo sapiens
  Native (MAGC3_HUMAN)
RRGTGYTLSL

SEQ ID NO: 112771 - protein, 10 aa, Homo sapiens
  Native (MAGC3_HUMAN)
RPAREVLEFL

SEQ ID NO: 112772 - protein, 8 aa, Homo sapiens
  Native (MAGC3_HUMAN)
ASASPSVM

SEQ ID NO: 112773 - protein, 11 aa, Homo sapiens
  Native (MAGC3_HUMAN)
IIPSAFPSWYM

SEQ ID NO: 112774 - protein, 8 aa, Homo sapiens
  Native (MAGC3_HUMAN)
KDYSAFHL

SEQ ID NO: 112775 - protein, 11 aa, Homo sapiens
  Native (MAGC3_HUMAN)
KFSLRRAVSVK

SEQ ID NO: 112776 - protein, 11 aa, Homo sapiens
  Native (MAGC3_HUMAN)
YSAFHLGHLRE

SEQ ID NO: 112777 - protein, 10 aa, Homo sapiens
  Native (MAGC3_HUMAN)
QFLLLKYQTK

SEQ ID NO: 112778 - protein, 11 aa, Homo sapiens
  Native (MAGC3_HUMAN)
CASEEVIWEVL

SEQ ID NO: 112779 - protein, 10 aa, Homo sapiens
  Native (MAGC3_HUMAN)
PPQGPPKISP

SEQ ID NO: 112780 - protein, 9 aa, Homo sapiens
  Native (MAGC3_HUMAN)
MLTTVIKKY

SEQ ID NO: 112781 - protein, 11 aa, Homo sapiens
  Native (MAGC3_HUMAN)
IIDTTDDATAM

SEQ ID NO: 112782 - protein, 11 aa, Homo sapiens
  Native (MAGC3_HUMAN)
LPPQPQPRKKA

SEQ ID NO: 112783 - protein, 8 aa, Homo sapiens
  Native (MAGC3_HUMAN)
FIELIFGI

SEQ ID NO: 112784 - protein, 10 aa, Homo sapiens
  Native (MAGC3_HUMAN)
TTVIKKYKDY

SEQ ID NO: 112785 - protein, 8 aa, Homo sapiens
  Native (MAGC3_HUMAN)
FFEDTLDL

SEQ ID NO: 112786 - protein, 9 aa, Homo sapiens
  Native (MAGC3_HUMAN)
FSDGSLGQW

SEQ ID NO: 112787 - protein, 10 aa, Homo sapiens
  Native (MAGC3_HUMAN)
ALDEKVAELV

SEQ ID NO: 112788 - protein, 9 aa, Homo sapiens
  Native (MAGC3_HUMAN)
DQGMPKNCL

SEQ ID NO: 112789 - protein, 8 aa, Homo sapiens
  Native (MAGC3_HUMAN)
EEPQDWPL

SEQ ID NO: 112790 - protein, 9 aa, Homo sapiens
  Native (MAGC3_HUMAN)
LSDEQGMPQ

SEQ ID NO: 112791 - protein, 11 aa, Homo sapiens
  Native (MAGC3_HUMAN)
KYQTKEPVTKA

SEQ ID NO: 112792 - protein, 9 aa, Homo sapiens
  Native (MAGC3_HUMAN)
ALKDMEDRA

SEQ ID NO: 112793 - protein, 9 aa, Homo sapiens
  Native (MAGC3_HUMAN)
SDLHFGSQP

SEQ ID NO: 112794 - protein, 10 aa, Homo sapiens
  Native (MAGC3_HUMAN)
LPAVSPGKRL

SEQ ID NO: 112795 - protein, 11 aa, Homo sapiens
  Native (MAGC3_HUMAN)
LFLRGGTSDQR

SEQ ID NO: 112796 - protein, 10 aa, Homo sapiens
  Native (MAGC3_HUMAN)
QRPAREVLEF

SEQ ID NO: 112797 - protein, 9 aa, Homo sapiens
  Native (MAGC3_HUMAN)
WEVLSAIGP

SEQ ID NO: 112798 - protein, 11 aa, Homo sapiens
  Native (MAGC3_HUMAN)
GMPKNCLLILI

SEQ ID NO: 112799 - protein, 9 aa, Homo sapiens
  Native (MAGC3_HUMAN)
WVKNTCATY

SEQ ID NO: 112800 - protein, 10 aa, Homo sapiens
  Native (MAGC3_HUMAN)
YFPMIFGKAH

SEQ ID NO: 112801 - protein, 11 aa, Homo sapiens
  Native (MAGC3_HUMAN)
FPMIFGKAHEF

SEQ ID NO: 112802 - protein, 8 aa, Homo sapiens
  Native (MAGC3_HUMAN)
REVLEFLS

SEQ ID NO: 112803 - protein, 10 aa, Homo sapiens
  Native (MAGC3_HUMAN)
PPQPQPRKKA

SEQ ID NO: 112804 - protein, 10 aa, Homo sapiens
  Native (MAGC3_HUMAN)
GLRSAEGSVL

SEQ ID NO: 112805 - protein, 8 aa, Homo sapiens
  Native (MAGC3_HUMAN)
RRGTGYTL

SEQ ID NO: 112806 - protein, 10 aa, Homo sapiens
  Native (MAGC3_HUMAN)
IPSAFPSWYM

SEQ ID NO: 112807 - protein, 9 aa, Homo sapiens
  Native (MAGC3_HUMAN)
FLLLKYQTK

SEQ ID NO: 112808 - protein, 10 aa, Homo sapiens
  Native (MAGC3_HUMAN)
LEFLSKLSSI

SEQ ID NO: 112809 - protein, 8 aa, Homo sapiens
  Native (MAGC3_HUMAN)
SCSSPLLW

SEQ ID NO: 112810 - protein, 11 aa, Homo sapiens
  Native (MAGC3_HUMAN)
GPPKISPQGPP

SEQ ID NO: 112811 - protein, 11 aa, Homo sapiens
  Native (MAGC3_HUMAN)
RLDEESSSEEE

SEQ ID NO: 112812 - protein, 10 aa, Homo sapiens
  Native (MAGC3_HUMAN)
LPRYALDEKV

SEQ ID NO: 112813 - protein, 11 aa, Homo sapiens
  Native (MAGC3_HUMAN)
KQREEPQDWPL

SEQ ID NO: 112814 - protein, 9 aa, Homo sapiens
  Native (MAGC3_HUMAN)
SLPESEPLF

SEQ ID NO: 112815 - protein, 10 aa, Homo sapiens
  Native (MAGC3_HUMAN)
ANPQGLAGHR

SEQ ID NO: 112816 - protein, 11 aa, Homo sapiens
  Native (MAGC3_HUMAN)
SQPEGKFSLRR

SEQ ID NO: 112817 - protein, 9 aa, Homo sapiens
  Native (MAGC3_HUMAN)
TRLDEESSS

SEQ ID NO: 112818 - protein, 9 aa, Homo sapiens
  Native (MAGC3_HUMAN)
SAEGSVLDL

SEQ ID NO: 112819 - protein, 8 aa, Homo sapiens
  Native (MAGC3_HUMAN)
YTGYFPMI

SEQ ID NO: 112820 - protein, 11 aa, Homo sapiens
  Native (MAGC3_HUMAN)
AIGPWSALAGF

SEQ ID NO: 112821 - protein, 8 aa, Homo sapiens
  Native (MAGC3_HUMAN)
LAGFADVL

SEQ ID NO: 112822 - protein, 11 aa, Homo sapiens
  Native (MAGC3_HUMAN)
AFPSWYMDALK

SEQ ID NO: 112823 - protein, 9 aa, Homo sapiens
  Native (MAGC3_HUMAN)
PPQSPPQSP

SEQ ID NO: 112824 - protein, 8 aa, Homo sapiens
  Native (MAGC3_HUMAN)
LDEKVAEL

SEQ ID NO: 112825 - protein, 10 aa, Homo sapiens
  Native (MAGC3_HUMAN)
SQPEGKFSLR

SEQ ID NO: 112826 - protein, 9 aa, Homo sapiens
  Native (MAGC3_HUMAN)
TAMASASPS

SEQ ID NO: 112827 - protein, 9 aa, Homo sapiens
  Native (MAGC3_HUMAN)
PSWYMDALK

SEQ ID NO: 112828 - protein, 10 aa, Homo sapiens
  Native (MAGC3_HUMAN)
LAGFADVLSR

SEQ ID NO: 112829 - protein, 8 aa, Homo sapiens
  Native (MAGC3_HUMAN)
GHLREVRL

SEQ ID NO: 112830 - protein, 9 aa, Artificial Sequence
  Description of Artificial Sequence: Synthetic peptide
  Seed: AAGMPPLPQ (MAGC3_HUMAN)
  misc_feature (2)..(2): Xaa can be Ala, Val, Ser, Ile, Thr, Gly, Met, Leu, Gln, Cys, Pro, Asn, Glu, Asp, or Phe
  misc_feature (9)..(9): Xaa can be Tyr, Phe, Met, Leu, His, Val, Arg, Lys, Ile, Ala, Cys, Trp, Thr, Ser, Pro, Gln, or Gly
AXGMPPLPX

SEQ ID NO: 112831 - protein, 8 aa, Artificial Sequence
  Description of Artificial Sequence: Synthetic peptide
  Seed: ADVLSRLA (MAGC3_HUMAN)
  misc_feature (2)..(2): Xaa can be Glu, Asp, or Gln
  misc_feature (8)..(8): Xaa can be Leu, Ala, Phe, Met, Val, Ile, Cys, Pro, Gly, Ser, or Thr
AXVLSRLX

SEQ ID NO: 112832 - protein, 9 aa, Artificial Sequence
  Description of Artificial Sequence: Synthetic peptide
  Seed: ADVLSRLAL (MAGC3_HUMAN)
  misc_feature (2)..(2): Xaa can be Glu, Asp, Gln, Arg, Ser, His, Ala, Asn, Gly, Phe, Tyr, Thr, Ile, Val, Pro, Lys, Met, or Le u
  misc_feature (9)..(9): Xaa can be Leu, Met, Ile, Val, Phe, Cys, Tyr, Ala, Pro, Trp, Arg, Thr, Lys, Ser, Glu, Asn, Gly, Gln, Asp, or His
AXVLSRLAX

SEQ ID NO: 112833 - protein, 10 aa, Artificial Sequence
  Description of Artificial Sequence: Synthetic peptide
  Seed: ADVLSRLALW (MAGC3_HUMAN)
  misc_feature (2)..(2): Xaa can be Glu, Ser, Thr, Ala, Val, Gln, Cys, Asp, Met, Arg, Tyr, Phe, His, Ile, Pro, Leu, Gly, Lys, Asn, or Trp
  misc_feature (10)..(10): Xaa can be Trp, Tyr, Phe, Met, Ile, Leu, Val, Cys, or His
AXVLSRLALX

SEQ ID NO: 112834 - protein, 8 aa, Artificial Sequence
  Description of Artificial Sequence: Synthetic peptide
  Seed: AEGSVLDL (MAGC3_HUMAN)
  misc_feature (2)..(2): Xaa can be Glu, or Asp
  misc_feature (8)..(8): Xaa can be Met, Leu, Phe, Ile, Val, Ala, Pro, Cys, or Thr
AXGSVLDX

SEQ ID NO: 112835 - protein, 9 aa, Artificial Sequence
  Description of Artificial Sequence: Synthetic peptide
  Seed: AEGSVLDLA (MAGC3_HUMAN)
  misc_feature (2)..(2): Xaa can be Glu, Asp, or Gln
  misc_feature (9)..(9): Xaa can be Ala, Met, Phe, Ile, Leu, Val, Cys, Ser, Gly, Pro, Thr, Tyr, Lys, Trp, or Arg
AXGSVLDLX

SEQ ID NO: 112836 - protein, 11 aa, Artificial Sequence
  Description of Artificial Sequence: Synthetic peptide
  Seed: AEGSVLDLANP (MAGC3_HUMAN)
  misc_feature (2)..(2): Xaa can be , or Glu
  misc_feature (11)..(11): Xaa can be Val, Ala, Phe, Leu, Ile, Met, Cys, Thr, or Pro
AXGSVLDLANX

SEQ ID NO: 112837 - protein, 8 aa, Artificial Sequence
  Description of Artificial Sequence: Synthetic peptide
  Seed: AELVQFLL (MAGC3_HUMAN)
  misc_feature (2)..(2): Xaa can be Glu, Asp, Gln, or Ala
  misc_feature (8)..(8): Xaa can be Ile, Val, Leu, Met, Phe, Ala, Trp, Gly, Ser, Tyr, Pro, Cys, or Thr
AXLVQFLX

SEQ ID NO: 112838 - protein, 9 aa, Artificial Sequence
  Description of Artificial Sequence: Synthetic peptide
  Seed: AELVQFLLL (MAGC3_HUMAN)
  misc_feature (2)..(2): Xaa can be Glu, Gln, Asp, Arg, Met, Leu, Ile, Ala, Asn, Val, Ser, Thr, Gly, or His
  misc_feature (9)..(9): Xaa can be Leu, Val, Ile, Phe, Met, Trp, Tyr, Cys, Ala, Thr, Pro, Lys, Arg, Glu, Ser, Gln, His, Gly, or Asp
AXLVQFLLX

SEQ ID NO: 112839 - protein, 10 aa, Artificial Sequence
  Description of Artificial Sequence: Synthetic peptide
  Seed: AELVQFLLLK (MAGC3_HUMAN)
  misc_feature (2)..(2): Xaa can be Glu, Thr, Leu, Val, Met, Ser, Gln, Ala, Ile, Phe, Asp, Pro, His, Arg, Lys, Gly, Tyr, Asn, Cys, or Trp
  misc_feature (10)..(10): Xaa can be Lys, Arg, Tyr, Thr, Phe, Cys, Gly, Glu, Ser, Val, Asp, His, Gln, Leu, Trp, Ala, Ile, Pro, Asn, or Met
AXLVQFLLLX

SEQ ID NO: 112840 - protein, 11 aa, Artificial Sequence
  Description of Artificial Sequence: Synthetic peptide
  Seed: AELVQFLLLKY (MAGC3_HUMAN)
  misc_feature (2)..(2): Xaa can be , or Glu
  misc_feature (11)..(11): Xaa can be Trp, Tyr, or Phe
AXLVQFLLLKX

SEQ ID NO: 112841 - protein, 8 aa, Artificial Sequence
  Description of Artificial Sequence: Synthetic peptide
  Seed: AEMLTTVI (MAGC3_HUMAN)
  misc_feature (2)..(2): Xaa can be Glu, Asp, Gln, Gly, Asn, Ala, Met, Ser, Leu, Val, Thr, Ile, His, or Pro
  misc_feature (8)..(8): Xaa can be Ile, Val, Leu, Phe, Cys, Met, Ala, Trp, Tyr, Pro, Thr, Gly, Ser, or His
AXMLTTVX

SEQ ID NO: 112842 - protein, 9 aa, Artificial Sequence
  Description of Artificial Sequence: Synthetic peptide
  Seed: AEMLTTVIK (MAGC3_HUMAN)
  misc_feature (2)..(2): Xaa can be Glu, Asp, Gln, Arg, or Ala
  misc_feature (9)..(9): Xaa can be Phe, Tyr, Ala, Pro, Val, Met, Trp, Cys, Leu, Ile, Lys, Thr, Gly, Arg, Ser, Gln, Asn, Asp, Glu, or His
AXMLTTVIX

SEQ ID NO: 112843 - protein, 10 aa, Artificial Sequence
  Description of Artificial Sequence: Synthetic peptide
  Seed: AEMLTTVIKK (MAGC3_HUMAN)
  misc_feature (2)..(2): Xaa can be Ser, Met, Val, Thr, Leu, Glu, Gln, Arg, Ala, Ile, Gly, Tyr, Trp, Lys, Phe, Pro, His, Cys, Asp, or Asn
  misc_feature (10)..(10): Xaa can be Lys, Arg, Tyr, Phe, Leu, Trp, Met, Ile, Glu, Gln, Pro, Asp, His, Thr, Cys, Gly, Ser, Val, Asn, or Ala
AXMLTTVIKX

SEQ ID NO: 112844 - protein, 11 aa, Artificial Sequence
  Description of Artificial Sequence: Synthetic peptide
  Seed: AEMLTTVIKKY (MAGC3_HUMAN)
  misc_feature (2)..(2): Xaa can be Glu, Asp, Gln, Met, or Leu
  misc_feature (11)..(11): Xaa can be Tyr, Phe, Trp, Val, His, Leu, Ile, Met, or Cys
AXMLTTVIKKX

SEQ ID NO: 112845 - protein, 8 aa, Artificial Sequence
  Description of Artificial Sequence: Synthetic peptide
  Seed: AEMQMNVI (MAGC3_HUMAN)
  misc_feature (2)..(2): Xaa can be Glu, Asp, Gln, Ser, Met, Ala, Gly, Val, Leu, Asn, Ile, or Thr
  misc_feature (8)..(8): Xaa can be Ile, Val, Leu, Met, Phe, Trp, Ala, Tyr, Gly, Ser, Pro, Thr, His, or Cys
AXMQMNVX

SEQ ID NO: 112846 - protein, 9 aa, Artificial Sequence
  Description of Artificial Sequence: Synthetic peptide
  Seed: AEMQMNVIN (MAGC3_HUMAN)
  misc_feature (2)..(2): Xaa can be Glu, Asp, or Gln
  misc_feature (9)..(9): Xaa can be Phe, Cys, Ile, Pro, Trp, Ala, Met, Val, Leu, Gly, Ser, Thr, Arg, Asp, Lys, Tyr, Asn, Glu, His, or Gln
AXMQMNVIX

SEQ ID NO: 112847 - protein, 10 aa, Artificial Sequence
  Description of Artificial Sequence: Synthetic peptide
  Seed: AEMQMNVINT (MAGC3_HUMAN)
  misc_feature (2)..(2): Xaa can be Glu, Asp, or Gln
  misc_feature (10)..(10): Xaa can be Ala, Cys, Tyr, Trp, Phe, Ile, Leu, Val, Met, Thr, Glu, Lys, Gly, His, Pro, Ser, Gln, Asp, or Arg
AXMQMNVINX

SEQ ID NO: 112848 - protein, 11 aa, Artificial Sequence
  Description of Artificial Sequence: Synthetic peptide
  Seed: AEMQMNVINTY (MAGC3_HUMAN)
  misc_feature (2)..(2): Xaa can be Glu, Gln, Asp, Ala, Val, Thr, Met, Ser, Lys, His, Arg, Leu, Tyr, Trp, Ile, Phe, Cys, Asn, Pro, or Gly
  misc_feature (11)..(11): Xaa can be Phe, Tyr, Met, Leu, Trp, His, Ile, Val, Cys, Ala, Lys, Arg, Glu, Gly, Pro, Ser, Gln, or Th r
AXMQMNVINTX

SEQ ID NO: 112849 - protein, 9 aa, Artificial Sequence
  Description of Artificial Sequence: Synthetic peptide
  Seed: AFCEESGLR (MAGC3_HUMAN)
  misc_feature (2)..(2): Xaa can be Ala, Ile, Thr, Ser, Val, Gly, Phe, Met, Leu, Trp, Gln, Pro, Asn, Tyr, Cys, Glu, Asp, or Hi s
  misc_feature (9)..(9): Xaa can be Lys, Arg, Tyr, Phe, Met, Leu, Trp, Ile, or Val
AXCEESGLX

SEQ ID NO: 112850 - protein, 11 aa, Artificial Sequence
  Description of Artificial Sequence: Synthetic peptide
  Seed: AFCEESGLRSA (MAGC3_HUMAN)
  misc_feature (2)..(2): Xaa can be His, Lys, Asn, Ser, Leu, Trp, Gln, Pro, Asp, Ile, Thr, Gly, Met, Ala, Phe, Tyr, Val, Cys, Glu, or Arg
  misc_feature (11)..(11): Xaa can be , or Ala
AXCEESGLRSX

SEQ ID NO: 112851 - protein, 8 aa, Artificial Sequence
  Description of Artificial Sequence: Synthetic peptide
  Seed: AFHLGHLR (MAGC3_HUMAN)
  misc_feature (2)..(2): Xaa can be Val, Trp, Thr, Leu, Tyr, Ser, Met, Ile, or Phe
  misc_feature (8)..(8): Xaa can be , or Arg
AXHLGHLX

SEQ ID NO: 112852 - protein, 11 aa, Artificial Sequence
  Description of Artificial Sequence: Synthetic peptide
  Seed: AFHLGHLREVR (MAGC3_HUMAN)
  misc_feature (2)..(2): Xaa can be Tyr, Ile, Val, Phe, Thr, Ser, Met, or Leu
  misc_feature (11)..(11): Xaa can be , or Arg
AXHLGHLREVX

SEQ ID NO: 112853 - protein, 10 aa, Artificial Sequence
  Description of Artificial Sequence: Synthetic peptide
  Seed: AFPSWYMDAL (MAGC3_HUMAN)
  misc_feature (2)..(2): Xaa can be Phe, Tyr, Met, Pro, Trp, Gln, His, Val, Lys, Asn, Glu, Arg, Asp, Ile, Leu, Gly, Ser, Thr, Cys, or Ala
  misc_feature (10)..(10): Xaa can be Val, Phe, Leu, Met, Ile, Tyr, Trp, or Ala
AXPSWYMDAX

SEQ ID NO: 112854 - protein, 11 aa, Artificial Sequence
  Description of Artificial Sequence: Synthetic peptide
  Seed: AFPSWYMDALK (MAGC3_HUMAN)
  misc_feature (2)..(2): Xaa can be Arg, Thr, Trp, Leu, Ala, Cys, Gly, Asn, Met, Glu, Lys, Asp, Ser, Pro, Gln, His, Ile, Val, Tyr, or Phe
  misc_feature (11)..(11): Xaa can be Lys, or Arg
AXPSWYMDALX

SEQ ID NO: 112855 - protein, 9 aa, Artificial Sequence
  Description of Artificial Sequence: Synthetic peptide
  Seed: AGFADVLSR (MAGC3_HUMAN)
  misc_feature (2)..(2): Xaa can be Arg, Ala, Thr, Ser, Ile, Val, Gly, Leu, Gln, Met, Cys, Asn, Tyr, Phe, His, Lys, Pro, Glu, Asp, or Trp
  misc_feature (9)..(9): Xaa can be Arg, Lys, Tyr, Phe, Met, Leu, Ile, Val, His, Ala, Trp, Gln, Cys, Gly, Ser, Asn, Pro, Thr, or Glu
AXFADVLSX

SEQ ID NO: 112856 - protein, 10 aa, Artificial Sequence
  Description of Artificial Sequence: Synthetic peptide
  Seed: AGFADVLSRL (MAGC3_HUMAN)
  misc_feature (2)..(2): Xaa can be Thr, Ala, Ser, Val, Ile, Gly, Leu, Gln, Asn, or Met
  misc_feature (10)..(10): Xaa can be Leu, Met, Val, Ile, or Phe
AXFADVLSRX

SEQ ID NO: 112857 - protein, 11 aa, Artificial Sequence
  Description of Artificial Sequence: Synthetic peptide
  Seed: AGSLPESEPLF (MAGC3_HUMAN)
  misc_feature (2)..(2): Xaa can be Thr, Ser, Val, Ala, Gly, Cys, Pro, Asn, Gln, Ile, Met, or Leu
  misc_feature (11)..(11): Xaa can be Trp, Phe, Leu, or Tyr
AXSLPESEPLX

SEQ ID NO: 112858 - protein, 8 aa, Artificial Sequence
  Description of Artificial Sequence: Synthetic peptide
  Seed: AHEFIELI (MAGC3_HUMAN)
  misc_feature (2)..(2): Xaa can be , or His
  misc_feature (8)..(8): Xaa can be Ile, Ala, Met, Leu, Phe, or Val
AXEFIELX

SEQ ID NO: 112859 - protein, 9 aa, Artificial Sequence
  Description of Artificial Sequence: Synthetic peptide
  Seed: AHEFIELIF (MAGC3_HUMAN)
  misc_feature (2)..(2): Xaa can be His, Arg, Gln, Tyr, Met, Lys, or Phe
  misc_feature (9)..(9): Xaa can be Phe, Met, Tyr, Leu, Ile, Val, Cys, or Trp
AXEFIELIX

SEQ ID NO: 112860 - protein, 9 aa, Artificial Sequence
  Description of Artificial Sequence: Synthetic peptide
  Seed: AIGPIQRPA (MAGC3_HUMAN)
  misc_feature (2)..(2): Xaa can be Ala, Pro, Val, Met, Ser, Leu, Ile, Gln, Thr, Gly, Glu, Cys, Asn, Asp, Phe, or Tyr
  misc_feature (9)..(9): Xaa can be Tyr, Phe, Met, Leu, Val, Ala, His, Ile, Thr, Trp, Arg, Ser, Gln, Gly, Lys, Cys, or Pro
AXGPIQRPX

SEQ ID NO: 112861 - protein, 10 aa, Artificial Sequence
  Description of Artificial Sequence: Synthetic peptide
  Seed: AIGPIQRPAR (MAGC3_HUMAN)
  misc_feature (2)..(2): Xaa can be Thr, Met, Ile, Leu, Ser, Tyr, Gly, Trp, Val, Phe, Ala, Gln, or Asn
  misc_feature (10)..(10): Xaa can be Arg, or Lys
AXGPIQRPAX

SEQ ID NO: 112862 - protein, 8 aa, Artificial Sequence
  Description of Artificial Sequence: Synthetic peptide
  Seed: AIGPWSAL (MAGC3_HUMAN)
  misc_feature (2)..(2): Xaa can be Ala, Val, Thr, Ile, Ser, Gly, Gln, Leu, Arg, Met, Asn, Cys, Pro, Glu, Tyr, His, Asp, or Ph e
  misc_feature (8)..(8): Xaa can be Leu, Tyr, Phe, Met, His, Ile, Arg, Lys, Val, Trp, or Ala
AXGPWSAX

SEQ ID NO: 112863 - protein, 9 aa, Artificial Sequence
  Description of Artificial Sequence: Synthetic peptide
  Seed: AIGPWSALA (MAGC3_HUMAN)
  misc_feature (2)..(2): Xaa can be Met, Leu, Val, Gln, Ile, Ala, Ser, Thr, or Phe
  misc_feature (9)..(9): Xaa can be Val, Leu, Ala, Ile, Met, Thr, Phe, Ser, or Cys
AXGPWSALX

SEQ ID NO: 112864 - protein, 11 aa, Artificial Sequence
  Description of Artificial Sequence: Synthetic peptide
  Seed: AIGPWSALAGF (MAGC3_HUMAN)
  misc_feature (2)..(2): Xaa can be Ala, Ile, Leu, Ser, Gln, Met, Thr, Gly, Val, Glu, Asn, Phe, Trp, Cys, Tyr, Asp, Pro, His, Lys, or Arg
  misc_feature (11)..(11): Xaa can be Tyr, Lys, Arg, Phe, Trp, His, Leu, Met, Ile, Ala, or Val
AXGPWSALAGX

SEQ ID NO: 112865 - protein, 9 aa, Artificial Sequence
  Description of Artificial Sequence: Synthetic peptide
  Seed: AIIDTTDDA (MAGC3_HUMAN)
  misc_feature (2)..(2): Xaa can be Met, Leu, Ile, Gln, Thr, Val, Ala, or Ser
  misc_feature (9)..(9): Xaa can be Val, Ile, Leu, Met, Ala, or Thr
AXIDTTDDX

SEQ ID NO: 112866 - protein, 11 aa, Artificial Sequence
  Description of Artificial Sequence: Synthetic peptide
  Seed: AIIDTTDDATA (MAGC3_HUMAN)
  misc_feature (2)..(2): Xaa can be Leu, Met, Ile, Val, Gln, Thr, Ala, Ser, or Cys
  misc_feature (11)..(11): Xaa can be Leu, Val, Met, Ile, Ala, Phe, Thr, Cys, Tyr, or Ser
AXIDTTDDATX

SEQ ID NO: 112867 - protein, 8 aa, Artificial Sequence
  Description of Artificial Sequence: Synthetic peptide
  Seed: ALAGFADV (MAGC3_HUMAN)
  misc_feature (2)..(2): Xaa can be Leu, or Met
  misc_feature (8)..(8): Xaa can be Val, or Leu
AXAGFADX

SEQ ID NO: 112868 - protein, 9 aa, Artificial Sequence
  Description of Artificial Sequence: Synthetic peptide
  Seed: ALAGFADVL (MAGC3_HUMAN)
  misc_feature (2)..(2): Xaa can be Met, Ala, Gln, Leu, Val, Ile, Ser, Thr, Gly, Glu, Asn, Arg, Phe, Tyr, Pro, Cys, His, Lys, Asp, or Trp
  misc_feature (9)..(9): Xaa can be Tyr, Phe, Leu, Met, Lys, Arg, Ile, Trp, Val, His, Ala, Thr, Cys, Ser, or Gln
AXAGFADVX

SEQ ID NO: 112869 - protein, 10 aa, Artificial Sequence
  Description of Artificial Sequence: Synthetic peptide
  Seed: ALAGFADVLS (MAGC3_HUMAN)
  misc_feature (2)..(2): Xaa can be Leu, Met, Ile, Gln, Val, Thr, Ala, or Ser
  misc_feature (10)..(10): Xaa can be Val, Leu, Met, Ala, Ile, Tyr, Cys, Gln, Trp, Thr, Arg, Pro, Phe, Ser, Gly, His, Lys, Asp, Glu, or Asn
AXAGFADVLX

SEQ ID NO: 112870 - protein, 11 aa, Artificial Sequence
  Description of Artificial Sequence: Synthetic peptide
  Seed: ALAGFADVLSR (MAGC3_HUMAN)
  misc_feature (2)..(2): Xaa can be Ala, Ser, Thr, Met, Gln, Ile, Gly, Val, Cys, Glu, Leu, Pro, Asn, Phe, Asp, Trp, Tyr, or Hi s
  misc_feature (11)..(11): Xaa can be Lys, Arg, Tyr, Phe, Leu, His, Met, Trp, Val, Ile, Cys, Ala, or Gln
AXAGFADVLSX

SEQ ID NO: 112871 - protein, 9 aa, Artificial Sequence
  Description of Artificial Sequence: Synthetic peptide
  Seed: ALDEKVAEL (MAGC3_HUMAN)
  misc_feature (2)..(2): Xaa can be Ala, Thr, Val, Ser, Phe, Glu, Tyr, Ile, Trp, Leu, Met, Arg, Gly, Gln, Pro, His, Cys, Asn, Asp, or Lys
  misc_feature (9)..(9): Xaa can be Tyr, Cys, Trp, Val, Met, Phe, Arg, Ile, Leu, Ala, Lys, Thr, His, Ser, Pro, Gln, Gly, Glu, Asn, or Asp
AXDEKVAEX

SEQ ID NO: 112872 - protein, 10 aa, Artificial Sequence
  Description of Artificial Sequence: Synthetic peptide
  Seed: ALDEKVAELV (MAGC3_HUMAN)
  misc_feature (2)..(2): Xaa can be Met, Leu, Ala, Tyr, Val, Ser, Thr, Ile, Phe, Gln, Trp, Gly, Asn, Glu, Cys, Pro, His, Arg, Lys, or Asp
  misc_feature (10)..(10): Xaa can be Leu, Met, Phe, Trp, Ile, Tyr, Val, Cys, Ala, Thr, Lys, Arg, Gln, His, Ser, Gly, Asn, Pro, Glu, or Asp
AXDEKVAELX

SEQ ID NO: 112873 - protein, 9 aa, Artificial Sequence
  Description of Artificial Sequence: Synthetic peptide
  Seed: ALKDMEDRA (MAGC3_HUMAN)
  misc_feature (2)..(2): Xaa can be Leu, Met, Val, Ile, Gln, Thr, or Ala
  misc_feature (9)..(9): Xaa can be Val, Ile, Leu, Met, or Ala
AXKDMEDRX

SEQ ID NO: 112874 - protein, 11 aa, Artificial Sequence
  Description of Artificial Sequence: Synthetic peptide
  Seed: ALKDMEDRAQA (MAGC3_HUMAN)
  misc_feature (2)..(2): Xaa can be Met, Leu, Val, or Ile
  misc_feature (11)..(11): Xaa can be Leu, Val, Ile, Ala, or Met
AXKDMEDRAQX

SEQ ID NO: 112875 - protein, 8 aa, Artificial Sequence
  Description of Artificial Sequence: Synthetic peptide
  Seed: ALPESESL (MAGC3_HUMAN)
  misc_feature (2)..(2): Xaa can be Val, Arg, Ala, Ser, Thr, Leu, Gln, Met, Ile, Gly, His, Cys, Glu, Tyr, Phe, Asn, Trp, Asp, or Pro
  misc_feature (8)..(8): Xaa can be Leu, Met, Ile, Val, or Phe
AXPESESX

SEQ ID NO: 112876 - protein, 10 aa, Artificial Sequence
  Description of Artificial Sequence: Synthetic peptide
  Seed: ALPESESLPR (MAGC3_HUMAN)
  misc_feature (2)..(2): Xaa can be Ala, Thr, Ser, Ile, Leu, Gln, Val, Met, Gly, Glu, Tyr, Phe, Pro, Asn, Cys, Asp, Trp, or Hi s
  misc_feature (10)..(10): Xaa can be Lys, Arg, Tyr, Phe, Met, Leu, His, Trp, Ile, Val, or Ala
AXPESESLPX

SEQ ID NO: 112877 - protein, 11 aa, Artificial Sequence
  Description of Artificial Sequence: Synthetic peptide
  Seed: ALPESESLPRY (MAGC3_HUMAN)
  misc_feature (2)..(2): Xaa can be Met, Leu, Ile, Thr, Val, Ala, Gln, Ser, Tyr, Trp, Glu, Asn, Gly, Lys, Asp, Phe, His, Cys, Arg, or Pro
  misc_feature (11)..(11): Xaa can be Trp, Tyr, Phe, Arg, Lys, Leu, or Met
AXPESESLPRX

SEQ ID NO: 112878 - protein, 9 aa, Artificial Sequence
  Description of Artificial Sequence: Synthetic peptide
  Seed: ALSPVVLPP (MAGC3_HUMAN)
  misc_feature (2)..(2): Xaa can be Met, Leu, Ile, Val, Gln, Thr, Ser, Ala, Asn, Cys, Gly, Phe, Glu, Trp, or Tyr
  misc_feature (9)..(9): Xaa can be Leu, Val, Ile, Ala, Met, Thr, Phe, Cys, Gly, Lys, Ser, Pro, or Arg
AXSPVVLPX

SEQ ID NO: 112879 - protein, 10 aa, Artificial Sequence
  Description of Artificial Sequence: Synthetic peptide
  Seed: ALWESEGPEA (MAGC3_HUMAN)
  misc_feature (2)..(2): Xaa can be Gln, Leu, Met, Val, Glu, Ile, Thr, Ala, Ser, Lys, or Phe
  misc_feature (10)..(10): Xaa can be Val, Ile, Leu, Phe, Ala, Met, Thr, Trp, Cys, Gly, or Tyr
AXWESEGPEX

SEQ ID NO: 112880 - protein, 11 aa, Artificial Sequence
  Description of Artificial Sequence: Synthetic peptide
  Seed: ALWESEGPEAF (MAGC3_HUMAN)
  misc_feature (2)..(2): Xaa can be Arg, Gln, Leu, Met, Gly, Val, Ala, Ile, Glu, Thr, Tyr, Ser, Lys, His, Asn, Pro, Asp, Cys, Phe, or Trp
  misc_feature (11)..(11): Xaa can be Phe, Lys, Met, Trp, Leu, Tyr, Arg, Ile, Val, His, Ala, Cys, Thr, Gln, Glu, Ser, Pro, Asn, or Gly
AXWESEGPEAX

SEQ ID NO: 112881 - protein, 9 aa, Artificial Sequence
  Description of Artificial Sequence: Synthetic peptide
  Seed: AMASASPSV (MAGC3_HUMAN)
  misc_feature (2)..(2): Xaa can be Ala, Met, Gln, Leu, Val, Ile, Ser, Thr, Gly, Asn, Lys, His, Phe, Glu, Pro, Cys, Tyr, Arg, Asp, or Trp
  misc_feature (9)..(9): Xaa can be Leu, Phe, Tyr, Met, Ile, Val, Trp, Arg, His, Ala, Lys, Thr, Cys, Ser, Gly, Pro, or Gln
AXASASPSX

SEQ ID NO: 112882 - protein, 10 aa, Artificial Sequence
  Description of Artificial Sequence: Synthetic peptide
  Seed: AMASASPSVM (MAGC3_HUMAN)
  misc_feature (2)..(2): Xaa can be Met, Leu, Ala, Val, Ser, Ile, Thr, Pro, Gln, Tyr, Phe, Arg, Gly, Glu, Asn, Cys, Lys, His, Trp, or Asp
  misc_feature (10)..(10): Xaa can be Tyr, Phe, Met, Leu, Lys, Trp, Arg, Ile, Val, His, Ala, Cys, Thr, Ser, Gly, Gln, Glu, Asp, Asn, or Pro
AXASASPSVX

SEQ ID NO: 112883 - protein, 10 aa, Artificial Sequence
  Description of Artificial Sequence: Synthetic peptide
  Seed: ANPQGLAGHR (MAGC3_HUMAN)
  misc_feature (2)..(2): Xaa can be Ala, Val, Thr, Ser, Ile, Met, Asp, Asn, Glu, Gln, Gly, Leu, Phe, Trp, Pro, or Tyr
  misc_feature (10)..(10): Xaa can be Arg, Lys, Leu, Met, Phe, Tyr, Ile, or Val
AXPQGLAGHX

SEQ ID NO: 112884 - protein, 9 aa, Artificial Sequence
  Description of Artificial Sequence: Synthetic peptide
  Seed: AREFIEILF (MAGC3_HUMAN)
  misc_feature (2)..(2): Xaa can be Arg, His, Gln, Glu, Tyr, Phe, Lys, Ala, Met, Ser, Trp, Thr, Gly, or Asn
  misc_feature (9)..(9): Xaa can be Leu, Met, Phe, Tyr, Ile, Trp, Arg, Lys, Val, Cys, Gln, Ala, or His
AXEFIEILX

SEQ ID NO: 112885 - protein, 11 aa, Artificial Sequence
  Description of Artificial Sequence: Synthetic peptide
  Seed: AREFIEILFGI (MAGC3_HUMAN)
  misc_feature (2)..(2): Xaa can be , or Arg
  misc_feature (11)..(11): Xaa can be Ile, Tyr, Lys, Met, Val, Leu, Arg, Ala, or Phe
AXEFIEILFGX

SEQ ID NO: 112886 - protein, 8 aa, Artificial Sequence
  Description of Artificial Sequence: Synthetic peptide
  Seed: AREVLEFL (MAGC3_HUMAN)
  misc_feature (2)..(2): Xaa can be , or Arg
  misc_feature (8)..(8): Xaa can be , or Leu
AXEVLEFX

SEQ ID NO: 112887 - protein, 10 aa, Artificial Sequence
  Description of Artificial Sequence: Synthetic peptide
  Seed: AREVLEFLSK (MAGC3_HUMAN)
  misc_feature (2)..(2): Xaa can be , or Arg
  misc_feature (10)..(10): Xaa can be Arg, Leu, Val, Trp, His, Phe, Tyr, Lys, Met, or Ile
AXEVLEFLSX

SEQ ID NO: 112888 - protein, 11 aa, Artificial Sequence
  Description of Artificial Sequence: Synthetic peptide
  Seed: AREVLEFLSKL (MAGC3_HUMAN)
  misc_feature (2)..(2): Xaa can be , or Arg
  misc_feature (11)..(11): Xaa can be Trp, Leu, Met, Val, Phe, Arg, Ile, Tyr, or Lys
AXEVLEFLSKX

SEQ ID NO: 112889 - protein, 8 aa, Artificial Sequence
  Description of Artificial Sequence: Synthetic peptide
  Seed: ASASPSVM (MAGC3_HUMAN)
  misc_feature (2)..(2): Xaa can be Ala, Ser, Ile, Thr, Val, Gly, Leu, Gln, Met, Cys, or Asn
  misc_feature (8)..(8): Xaa can be Tyr, Phe, Met, Leu, Lys, Arg, His, Ile, Val, or Ala
AXASPSVX

SEQ ID NO: 112890 - protein, 9 aa, Artificial Sequence
  Description of Artificial Sequence: Synthetic peptide
  Seed: ASEEVIWEV (MAGC3_HUMAN)
  misc_feature (2)..(2): Xaa can be Met, Leu, Gln, Ile, Val, Ala, Ser, Thr, Phe, Tyr, Cys, Asn, Arg, Trp, Gly, His, Glu, Pro, Asp, or Lys
  misc_feature (9)..(9): Xaa can be Leu, Phe, Trp, Met, Val, Ile, Lys, Arg, Tyr, Ala, Cys, Thr, Ser, Gly, His, or Pro
AXEEVIWEX

SEQ ID NO: 112891 - protein, 10 aa, Artificial Sequence
  Description of Artificial Sequence: Synthetic peptide
  Seed: ASEEVIWEVL (MAGC3_HUMAN)
  misc_feature (2)..(2): Xaa can be Glu, Tyr, Val, Thr, Ala, Met, Arg, His, Ser, Gln, Phe, Trp, Asp, Ile, Gly, Lys, Asn, Cys, Leu, or Pro
  misc_feature (10)..(10): Xaa can be Leu, Met, Phe, Ile, Ala, or Val
AXEEVIWEVX

SEQ ID NO: 112892 - protein, 10 aa, Artificial Sequence
  Description of Artificial Sequence: Synthetic peptide
  Seed: ASPSVMSTNF (MAGC3_HUMAN)
  misc_feature (2)..(2): Xaa can be Ala, Ser, Val, Gly, Thr, Pro, Met, Trp, Phe, Tyr, Leu, Ile, Arg, Asn, Gln, Cys, Glu, Lys, His, or Asp
  misc_feature (10)..(10): Xaa can be Phe, Ile, Leu, Met, Tyr, Trp, Lys, Arg, Val, or His
AXPSVMSTNX

SEQ ID NO: 112893 - protein, 11 aa, Artificial Sequence
  Description of Artificial Sequence: Synthetic peptide
  Seed: ATAMASASPSV (MAGC3_HUMAN)
  misc_feature (2)..(2): Xaa can be Phe, Met, Leu, Asp, Lys, Trp, Asn, Tyr, Cys, Pro, Gln, Thr, Ile, Val, His, Glu, Ser, Gly, Arg, or Ala
  misc_feature (11)..(11): Xaa can be Ile, Leu, Val, Ala, or Met
AXAMASASPSX

SEQ ID NO: 112894 - protein, 9 aa, Artificial Sequence
  Description of Artificial Sequence: Synthetic peptide
  Seed: ATDKDYSAF (MAGC3_HUMAN)
  misc_feature (2)..(2): Xaa can be Ser, Ala, Thr, Ile, Val, Leu, Tyr, Phe, Met, Trp, Gly, Asn, Gln, Arg, Asp, Cys, Pro, Glu, Lys, or His
  misc_feature (9)..(9): Xaa can be Leu, Met, Tyr, Ile, Phe, Trp, Val, Lys, Arg, Cys, Ala, His, Thr, or Gln
AXDKDYSAX

SEQ ID NO: 112895 - protein, 10 aa, Artificial Sequence
  Description of Artificial Sequence: Synthetic peptide
  Seed: ATDKDYSAFH (MAGC3_HUMAN)
  misc_feature (2)..(2): Xaa can be Thr, Val, Ser, Ala, Ile, Leu, Met, Gly, Phe, Gln, Asn, Asp, Tyr, Trp, Glu, Cys, Lys, or Pr o
  misc_feature (10)..(10): Xaa can be Tyr, Lys, Arg, Phe, His, Trp, Met, Gln, or Leu
AXDKDYSAFX

SEQ ID NO: 112896 - protein, 11 aa, Artificial Sequence
  Description of Artificial Sequence: Synthetic peptide
  Seed: ATDKDYSAFHL (MAGC3_HUMAN)
  misc_feature (2)..(2): Xaa can be Ala, Thr, Val, Ile, Ser, Leu, Met, Gly, Cys, Asn, Gln, Trp, Pro, Phe, Asp, Glu, or Tyr
  misc_feature (11)..(11): Xaa can be Tyr, Trp, Lys, Phe, Leu, His, Arg, Met, Ile, or Val
AXDKDYSAFHX

SEQ ID NO: 112897 - protein, 10 aa, Artificial Sequence
  Description of Artificial Sequence: Synthetic peptide
  Seed: ATFSDGSLGQ (MAGC3_HUMAN)
  misc_feature (2)..(2): Xaa can be Thr, Val, Ser, Ile, Asp, Met, Glu, Tyr, Trp, Asn, Phe, Leu, Gln, Gly, Cys, Ala, or Pro
  misc_feature (10)..(10): Xaa can be Arg, Lys, Tyr, His, Phe, Gln, or Trp
AXFSDGSLGX

SEQ ID NO: 112898 - protein, 11 aa, Artificial Sequence
  Description of Artificial Sequence: Synthetic peptide
  Seed: ATFSDGSLGQW (MAGC3_HUMAN)
  misc_feature (2)..(2): Xaa can be Glu, Ala, Leu, Gln, Thr, Met, Val, Ser, Ile, Gly, Asn, Cys, His, Pro, Tyr, Lys, Phe, Asp, Arg, or Trp
  misc_feature (11)..(11): Xaa can be Phe, Trp, Tyr, Arg, Lys, Leu, Met, His, Ile, Val, Cys, Ala, Gln, Thr, Ser, Pro, or Gly
AXFSDGSLGQX

SEQ ID NO: 112899 - protein, 9 aa, Artificial Sequence
  Description of Artificial Sequence: Synthetic peptide
  Seed: ATYALSPVV (MAGC3_HUMAN)
  misc_feature (2)..(2): Xaa can be Gln, Thr, Ala, Met, Ser, Val, Leu, Ile, Tyr, Gly, Asn, Phe, Glu, Cys, Pro, Asp, Trp, His, Lys, or Arg
  misc_feature (9)..(9): Xaa can be Val, Ile, Leu, Tyr, Met, Phe, Trp, Arg, Lys, Ala, Cys, His, Ser, Thr, Gly, Pro, or Gln
AXYALSPVX

SEQ ID NO: 112900 - protein, 10 aa, Artificial Sequence
  Description of Artificial Sequence: Synthetic peptide
  Seed: ATYALSPVVL (MAGC3_HUMAN)
  misc_feature (2)..(2): Xaa can be Ala, Thr, Val, Ile, Ser, Met, Leu, Gly, Gln, Asp, Asn, Glu, Pro, Tyr, Cys, Phe, Trp, Arg, His, or Lys
  misc_feature (10)..(10): Xaa can be Ile, Met, Tyr, Trp, Leu, Phe, Lys, Val, His, Arg, Ala, Thr, Cys, or Gln
AXYALSPVVX

SEQ ID NO: 112901 - protein, 8 aa, Artificial Sequence
  Description of Artificial Sequence: Synthetic peptide
  Seed: AVSPGKRL (MAGC3_HUMAN)
  misc_feature (2)..(2): Xaa can be Ala, Val, Ser, Thr, Ile, Gln, Gly, Met, Leu, Glu, Phe, Arg, His, Asn, Asp, or Tyr
  misc_feature (8)..(8): Xaa can be Leu, Tyr, Phe, Met, Ile, Val, Trp, or His
AXSPGKRX

SEQ ID NO: 112902 - protein, 9 aa, Artificial Sequence
  Description of Artificial Sequence: Synthetic peptide
  Seed: AVSPGKRLW (MAGC3_HUMAN)
  misc_feature (2)..(2): Xaa can be Ala, Ser, Thr, Ile, Val, Gln, Gly, Leu, Met, Asn, Cys, Glu, Phe, Pro, Trp, Tyr, Asp, His, Arg, or Lys
  misc_feature (9)..(9): Xaa can be Tyr, Trp, Phe, Met, Leu, Ile, Val, His, Lys, Ala, Cys, Arg, Pro, Gln, Ser, or Thr
AXSPGKRLX

SEQ ID NO: 112903 - protein, 8 aa, Artificial Sequence
  Description of Artificial Sequence: Synthetic peptide
  Seed: CASEEVIW (MAGC3_HUMAN)
  misc_feature (2)..(2): Xaa can be Thr, Val, Ala, Ile, or Ser
  misc_feature (8)..(8): Xaa can be , or Trp
CXSEEVIX

SEQ ID NO: 112904 - protein, 10 aa, Artificial Sequence
  Description of Artificial Sequence: Synthetic peptide
  Seed: CASEEVIWEV (MAGC3_HUMAN)
  misc_feature (2)..(2): Xaa can be Leu, Met, Gln, Val, Ala, Ile, Thr, Ser, Phe, or Tyr
  misc_feature (10)..(10): Xaa can be Val, Leu, Met, Ile, Ala, Thr, Phe, Cys, or Ser
CXSEEVIWEX

SEQ ID NO: 112905 - protein, 11 aa, Artificial Sequence
  Description of Artificial Sequence: Synthetic peptide
  Seed: CASEEVIWEVL (MAGC3_HUMAN)
  misc_feature (2)..(2): Xaa can be , or Ala
  misc_feature (11)..(11): Xaa can be , or Leu
CXSEEVIWEVX

SEQ ID NO: 112906 - protein, 9 aa, Artificial Sequence
  Description of Artificial Sequence: Synthetic peptide
  Seed: CATYALSPV (MAGC3_HUMAN)
  misc_feature (2)..(2): Xaa can be Leu, Met, Ala, Gln, Ser, Thr, Ile, Val, Gly, Asn, or Pro
  misc_feature (9)..(9): Xaa can be Val, Phe, Tyr, Met, Ala, Ile, Leu, Thr, Pro, Ser, Cys, His, or Trp
CXTYALSPX

SEQ ID NO: 112907 - protein, 10 aa, Artificial Sequence
  Description of Artificial Sequence: Synthetic peptide
  Seed: CATYALSPVV (MAGC3_HUMAN)
  misc_feature (2)..(2): Xaa can be Met, Leu, Gln, Ile, Thr, Val, Lys, Pro, Trp, Asn, Ser, Ala, Phe, Gly, Cys, Glu, His, Asp, Arg, or Tyr
  misc_feature (10)..(10): Xaa can be Val, Ile, Ala, Leu, Thr, Met, Cys, Trp, Pro, Ser, Tyr, Asn, Phe, Gly, Lys, Asp, His, Arg, Glu, or Gln
CXTYALSPVX

SEQ ID NO: 112908 - protein, 9 aa, Artificial Sequence
  Description of Artificial Sequence: Synthetic peptide
  Seed: CEESGLRSA (MAGC3_HUMAN)
  misc_feature (2)..(2): Xaa can be Glu, Asp, or Gln
  misc_feature (9)..(9): Xaa can be Phe, Ile, Val, Leu, Met, Ala, Gly, Pro, Trp, Thr, Ser, Cys, or Tyr
CXESGLRSX

SEQ ID NO: 112909 - protein, 11 aa, Artificial Sequence
  Description of Artificial Sequence: Synthetic peptide
  Seed: CEESGLRSAEG (MAGC3_HUMAN)
  misc_feature (2)..(2): Xaa can be , or Glu
  misc_feature (11)..(11): Xaa can be Pro, Ile, Leu, Met, Ala, Val, Phe, Cys, Thr, Ser, or Gly
CXESGLRSAEX

SEQ ID NO: 112910 - protein, 10 aa, Artificial Sequence
  Description of Artificial Sequence: Synthetic peptide
  Seed: CEGSLSDEQG (MAGC3_HUMAN)
  misc_feature (2)..(2): Xaa can be , or Glu
  misc_feature (10)..(10): Xaa can be Met, Phe, Cys, Leu, Val, Pro, Ser, Ala, Thr, Gly, or Ile
CXGSLSDEQX

SEQ ID NO: 112911 - protein, 11 aa, Artificial Sequence
  Description of Artificial Sequence: Synthetic peptide
  Seed: CEGSLSDEQGM (MAGC3_HUMAN)
  misc_feature (2)..(2): Xaa can be Glu, Gln, or Asp
  misc_feature (11)..(11): Xaa can be Trp, Val, Phe, Ala, Met, Thr, Pro, Tyr, Leu, Cys, or Ile
CXGSLSDEQGX

SEQ ID NO: 112912 - protein, 8 aa, Artificial Sequence
  Description of Artificial Sequence: Synthetic peptide
  Seed: CHWVLDAT (MAGC3_HUMAN)
  misc_feature (2)..(2): Xaa can be His, or Arg
  misc_feature (8)..(8): Xaa can be Ala, Val, Thr, Ile, Met, Leu, or Cys
CXWVLDAX

SEQ ID NO: 112913 - protein, 9 aa, Artificial Sequence
  Description of Artificial Sequence: Synthetic peptide
  Seed: CHWVLDATF (MAGC3_HUMAN)
  misc_feature (2)..(2): Xaa can be His, Gln, Arg, Met, Lys, Tyr, Ser, Ala, Glu, Leu, Ile, Phe, Thr, Val, Asn, Pro, or Gly
  misc_feature (9)..(9): Xaa can be Tyr, Phe, Met, Leu, Val, Ala, Ile, Cys, Trp, Thr, His, Ser, or Pro
CXWVLDATX

SEQ ID NO: 112914 - protein, 9 aa, Artificial Sequence
  Description of Artificial Sequence: Synthetic peptide
  Seed: CLLILILSM (MAGC3_HUMAN)
  misc_feature (2)..(2): Xaa can be Gln, Leu, Met, Val, Ile, Ser, Ala, Thr, Pro, Lys, Tyr, Asn, Phe, Arg, Gly, Asp, Glu, Trp, His, or Cys
  misc_feature (9)..(9): Xaa can be Tyr, Phe, Met, Ile, Leu, Val, Ala, Thr, His, or Trp
CXLILILSX

SEQ ID NO: 112915 - protein, 10 aa, Artificial Sequence
  Description of Artificial Sequence: Synthetic peptide
  Seed: CLLILILSMI (MAGC3_HUMAN)
  misc_feature (2)..(2): Xaa can be Met, Ile, Tyr, His, Lys, Arg, Ser, Leu, Val, Phe, Ala, Asn, Gln, Thr, Gly, Cys, Asp, Trp, Glu, or Pro
  misc_feature (10)..(10): Xaa can be Ala, Val, Ile, or Leu
CXLILILSMX

SEQ ID NO: 112916 - protein, 9 aa, Artificial Sequence
  Description of Artificial Sequence: Synthetic peptide
  Seed: CPTYFKLWR (MAGC3_HUMAN)
  misc_feature (2)..(2): Xaa can be Ser, Val, Ala, Ile, Thr, Tyr, His, Pro, Gly, Gln, Phe, Trp, Met, Asp, Asn, or Leu
  misc_feature (9)..(9): Xaa can be Arg, or Lys
CXTYFKLWX

SEQ ID NO: 112917 - protein, 11 aa, Artificial Sequence
  Description of Artificial Sequence: Synthetic peptide
  Seed: CPTYFKLWRTL (MAGC3_HUMAN)
  misc_feature (2)..(2): Xaa can be Thr, His, Asn, Val, Met, Ile, Gln, Ala, Phe, Lys, Trp, Ser, Leu, Cys, Glu, Pro, Asp, Gly, Arg, or Tyr
  misc_feature (11)..(11): Xaa can be Leu, Met, Trp, Phe, or Ile
CXTYFKLWRTX

SEQ ID NO: 112918 - protein, 9 aa, Artificial Sequence
  Description of Artificial Sequence: Synthetic peptide
  Seed: CSSPLLWTR (MAGC3_HUMAN)
  misc_feature (2)..(2): Xaa can be Met, Leu, Ile, Val, Thr, Gln, Ser, Ala, Cys, Trp, Phe, Glu, Asn, Tyr, Gly, Asp, Pro, Arg, His, or Lys
  misc_feature (9)..(9): Xaa can be Arg, Lys, Tyr, His, Leu, Val, Met, Ile, Phe, or Ala
CXSPLLWTX

SEQ ID NO: 112919 - protein, 10 aa, Artificial Sequence
  Description of Artificial Sequence: Synthetic peptide
  Seed: CSSPLLWTRL (MAGC3_HUMAN)
  misc_feature (2)..(2): Xaa can be Ser, Thr, Ala, Ile, Val, Met, Gly, Cys, Gln, His, Asp, Pro, Leu, Lys, Asn, Glu, or Phe
  misc_feature (10)..(10): Xaa can be Trp, Phe, Tyr, Ile, Leu, Met, or Val
CXSPLLWTRX

SEQ ID NO: 112920 - protein, 10 aa, Artificial Sequence
  Description of Artificial Sequence: Synthetic peptide
  Seed: CVPEEVIWEV (MAGC3_HUMAN)
  misc_feature (2)..(2): Xaa can be Leu, Met, Ile, Gln, Val, Thr, Ala, or Ser
  misc_feature (10)..(10): Xaa can be Ile, Val, Leu, Ala, Met, Thr, Phe, Cys, Ser, or Tyr
CXPEEVIWEX

SEQ ID NO: 112921 - protein, 9 aa, Artificial Sequence
  Description of Artificial Sequence: Synthetic peptide
  Seed: DALKDMEDR (MAGC3_HUMAN)
  misc_feature (2)..(2): Xaa can be Val, Leu, Tyr, Ser, Met, Asn, Ala, Phe, Gln, Thr, Ile, Gly, or Trp
  misc_feature (9)..(9): Xaa can be Arg, Lys, or Tyr
DXLKDMEDX

SEQ ID NO: 112922 - protein, 9 aa, Artificial Sequence
  Description of Artificial Sequence: Synthetic peptide
  Seed: DATFSDGSL (MAGC3_HUMAN)
  misc_feature (2)..(2): Xaa can be Ala, or Pro
  misc_feature (9)..(9): Xaa can be Leu, Val, Phe, Met, or Ile
DXTFSDGSX

SEQ ID NO: 112923 - protein, 9 aa, Artificial Sequence
  Description of Artificial Sequence: Synthetic peptide
  Seed: DDATAMASA (MAGC3_HUMAN)
  misc_feature (2)..(2): Xaa can be Glu, Gln, or Asp
  misc_feature (9)..(9): Xaa can be Ala, Val, Ile, Leu, Cys, Ser, Thr, Gly, Met, Pro, or Phe
DXATAMASX

SEQ ID NO: 112924 - protein, 9 aa, Artificial Sequence
  Description of Artificial Sequence: Synthetic peptide
  Seed: DEDMPAAGM (MAGC3_HUMAN)
  misc_feature (2)..(2): Xaa can be Glu, Gln, Asp, or Ala
  misc_feature (9)..(9): Xaa can be Leu, Met, Val, Trp, Phe, Ile, Ala, Tyr, Thr, His, Gly, Cys, Ser, or Pro
DXDMPAAGX

SEQ ID NO: 112925 - protein, 10 aa, Artificial Sequence
  Description of Artificial Sequence: Synthetic peptide
  Seed: DEDMPAAGMP (MAGC3_HUMAN)
  misc_feature (2)..(2): Xaa can be , or Glu
  misc_feature (10)..(10): Xaa can be Val, Pro, Met, Phe, Thr, Leu, Cys, Ala, or Ile
DXDMPAAGMX

SEQ ID NO: 112926 - protein, 11 aa, Artificial Sequence
  Description of Artificial Sequence: Synthetic peptide
  Seed: DEDMPAAGMPP (MAGC3_HUMAN)
  misc_feature (2)..(2): Xaa can be , or Glu
  misc_feature (11)..(11): Xaa can be Pro, Met, Leu, Ile, Thr, Cys, Gly, Ala, Phe, Val, or Ser
DXDMPAAGMPX

SEQ ID NO: 112927 - protein, 8 aa, Artificial Sequence
  Description of Artificial Sequence: Synthetic peptide
  Seed: DEKVAELV (MAGC3_HUMAN)
  misc_feature (2)..(2): Xaa can be Glu, Gln, or Asp
  misc_feature (8)..(8): Xaa can be Met, Tyr, Leu, Phe, Ile, Thr, Cys, Ala, His, Val, or Trp
DXKVAELX

SEQ ID NO: 112928 - protein, 9 aa, Artificial Sequence
  Description of Artificial Sequence: Synthetic peptide
  Seed: DEKVAELVQ (MAGC3_HUMAN)
  misc_feature (2)..(2): Xaa can be Glu, Gln, or Asp
  misc_feature (9)..(9): Xaa can be Met, Phe, Tyr, Arg, Thr, Lys, Ala, Leu, Ile, Gln, Cys, Val, His, or Trp
DXKVAELVX

SEQ ID NO: 112929 - protein, 10 aa, Artificial Sequence
  Description of Artificial Sequence: Synthetic peptide
  Seed: DEKVAELVQF (MAGC3_HUMAN)
  misc_feature (2)..(2): Xaa can be Glu, or Gln
  misc_feature (10)..(10): Xaa can be Trp, Met, Leu, Phe, or Tyr
DXKVAELVQX

SEQ ID NO: 112930 - protein, 8 aa, Artificial Sequence
  Description of Artificial Sequence: Synthetic peptide
  Seed: DEKVDKLV (MAGC3_HUMAN)
  misc_feature (2)..(2): Xaa can be , or Glu
  misc_feature (8)..(8): Xaa can be Met, Phe, Val, Leu, Ala, or Ile
DXKVDKLX

SEQ ID NO: 112931 - protein, 9 aa, Artificial Sequence
  Description of Artificial Sequence: Synthetic peptide
  Seed: DEKVDKLVQ (MAGC3_HUMAN)
  misc_feature (2)..(2): Xaa can be Glu, Gln, or Asp
  misc_feature (9)..(9): Xaa can be Tyr, Phe, Thr, Ile, Cys, Met, Arg, His, Lys, Val, Leu, Ala, Gln, or Trp
DXKVDKLVX

SEQ ID NO: 112932 - protein, 10 aa, Artificial Sequence
  Description of Artificial Sequence: Synthetic peptide
  Seed: DEKVDKLVQF (MAGC3_HUMAN)
  misc_feature (2)..(2): Xaa can be Glu, or Gln
  misc_feature (10)..(10): Xaa can be Tyr, Trp, Phe, Ile, Cys, Val, Pro, Met, Thr, Ala, or Leu
DXKVDKLVQX

SEQ ID NO: 112933 - protein, 11 aa, Artificial Sequence
  Description of Artificial Sequence: Synthetic peptide
  Seed: DEKVDKLVQFL (MAGC3_HUMAN)
  misc_feature (2)..(2): Xaa can be , or Glu
  misc_feature (11)..(11): Xaa can be , or Leu
DXKVDKLVQFX

SEQ ID NO: 112934 - protein, 9 aa, Artificial Sequence
  Description of Artificial Sequence: Synthetic peptide
  Seed: DEQGMPQNR (MAGC3_HUMAN)
  misc_feature (2)..(2): Xaa can be Thr, Val, Ile, Ala, Ser, Gly, Leu, Asp, Tyr, Gln, Asn, Trp, Phe, Pro, Met, His, Glu, Cys, Lys, or Arg
  misc_feature (9)..(9): Xaa can be Arg, Lys, Tyr, Met, His, Phe, or Leu
DXQGMPQNX

SEQ ID NO: 112935 - protein, 10 aa, Artificial Sequence
  Description of Artificial Sequence: Synthetic peptide
  Seed: DEQGMPQNRL (MAGC3_HUMAN)
  misc_feature (2)..(2): Xaa can be Glu, or Gln
  misc_feature (10)..(10): Xaa can be Trp, Tyr, Phe, Leu, Cys, Ile, Ala, Met, Thr, or Val
DXQGMPQNRX

SEQ ID NO: 112936 - protein, 11 aa, Artificial Sequence
  Description of Artificial Sequence: Synthetic peptide
  Seed: DEQGMPQNRLL (MAGC3_HUMAN)
  misc_feature (2)..(2): Xaa can be Glu, or Gln
  misc_feature (11)..(11): Xaa can be Tyr, Trp, Phe, Ile, Ala, Val, Met, Cys, or Leu
DXQGMPQNRLX

SEQ ID NO: 112937 - protein, 9 aa, Artificial Sequence
  Description of Artificial Sequence: Synthetic peptide
  Seed: DGRRGLTEA (MAGC3_HUMAN)
  misc_feature (2)..(2): Xaa can be Pro, Ala, Val, Leu, Met, Gly, or Ile
  misc_feature (9)..(9): Xaa can be Ala, Val, Met, Leu, Ile, Phe, Thr, or Pro
DXRRGLTEX

SEQ ID NO: 112938 - protein, 9 aa, Artificial Sequence
  Description of Artificial Sequence: Synthetic peptide
  Seed: DGSLGQWVK (MAGC3_HUMAN)
  misc_feature (2)..(2): Xaa can be Thr, Val, Ser, Ile, Met, Leu, Ala, Asn, Gln, Phe, Tyr, Gly, Cys, Trp, Pro, Glu, Arg, His, Lys, or Asp
  misc_feature (9)..(9): Xaa can be Arg, Lys, Tyr, or His
DXSLGQWVX

SEQ ID NO: 112939 - protein, 9 aa, Artificial Sequence
  Description of Artificial Sequence: Synthetic peptide
  Seed: DHFYVFVNT (MAGC3_HUMAN)
  misc_feature (2)..(2): Xaa can be His, Arg, Gln, or Lys
  misc_feature (9)..(9): Xaa can be Ala, Leu, Ile, Cys, Val, Met, Ser, Pro, Thr, or Phe
DXFYVFVNX

SEQ ID NO: 112940 - protein, 10 aa, Artificial Sequence
  Description of Artificial Sequence: Synthetic peptide
  Seed: DHFYVFVNTL (MAGC3_HUMAN)
  misc_feature (2)..(2): Xaa can be Arg, or His
  misc_feature (10)..(10): Xaa can be Ile, Phe, Leu, Ala, Met, Val, or Cys
DXFYVFVNTX

SEQ ID NO: 112941 - protein, 9 aa, Artificial Sequence
  Description of Artificial Sequence: Synthetic peptide
  Seed: DKDYSAFHL (MAGC3_HUMAN)
  misc_feature (2)..(2): Xaa can be His, Arg, Gln, Glu, or Lys
  misc_feature (9)..(9): Xaa can be Leu, Phe, Val, Met, Ile, Trp, or Tyr
DXDYSAFHX

SEQ ID NO: 112942 - protein, 9 aa, Artificial Sequence
  Description of Artificial Sequence: Synthetic peptide
  Seed: DKLVQFLLL (MAGC3_HUMAN)
  misc_feature (2)..(2): Xaa can be Arg, His, Gln, Ala, Lys, or Glu
  misc_feature (9)..(9): Xaa can be Leu, Val, Met, Ile, Phe, Cys, Ala, or Thr
DXLVQFLLX

SEQ ID NO: 112943 - protein, 10 aa, Artificial Sequence
  Description of Artificial Sequence: Synthetic peptide
  Seed: DKLVQFLLLK (MAGC3_HUMAN)
  misc_feature (2)..(2): Xaa can be Ser, Val, Met, Ile, Thr, Ala, Gln, Pro, Glu, Lys, Asp, Arg, Cys, Phe, His, Tyr, Leu, Trp, Gly, or Asn
  misc_feature (10)..(10): Xaa can be Lys, or Arg
DXLVQFLLLX

SEQ ID NO: 112944 - protein, 11 aa, Artificial Sequence
  Description of Artificial Sequence: Synthetic peptide
  Seed: DLANPQGLAGH (MAGC3_HUMAN)
  misc_feature (2)..(2): Xaa can be Val, Thr, Ile, Ala, Ser, Leu, Met, Asn, Asp, Lys, Pro, Cys, Gln, Glu, Phe, Tyr, Trp, Gly, or His
  misc_feature (11)..(11): Xaa can be Arg, Lys, His, Tyr, Gln, Leu, Met, Phe, Asn, Glu, Val, Ala, Ile, or Trp
DXANPQGLAGX

SEQ ID NO: 112945 - protein, 11 aa, Artificial Sequence
  Description of Artificial Sequence: Synthetic peptide
  Seed: DLHFGSQPEGK (MAGC3_HUMAN)
  misc_feature (2)..(2): Xaa can be Met, Val, Ile, Cys, Gln, Ser, Asn, Thr, Leu, Gly, or Ala
  misc_feature (11)..(11): Xaa can be Arg, or Lys
DXHFGSQPEGX

SEQ ID NO: 112946 - protein, 9 aa, Artificial Sequence
  Description of Artificial Sequence: Synthetic peptide
  Seed: DMDPDNHSY (MAGC3_HUMAN)
  misc_feature (2)..(2): Xaa can be Thr, Ala, Leu, Ile, Tyr, Val, Ser, Phe, Met, Trp, Glu, Arg, Pro, Asp, Gly, Asn, His, Gln, Cys, or Lys
  misc_feature (9)..(9): Xaa can be Ile, Tyr, Met, Leu, Lys, Phe, Val, Trp, Arg, His, Ala, Cys, or Thr
DXDPDNHSX

SEQ ID NO: 112947 - protein, 10 aa, Artificial Sequence
  Description of Artificial Sequence: Synthetic peptide
  Seed: DMDPDNHSYF (MAGC3_HUMAN)
  misc_feature (2)..(2): Xaa can be Leu, Val, Thr, Ser, Met, Tyr, Ile, Ala, Gly, Phe, Trp, Gln, Asn, Cys, Pro, His, Glu, Arg, Asp, or Lys
  misc_feature (10)..(10): Xaa can be Tyr, Leu, Phe, Trp, Met, Lys, Ile, Arg, Val, His, or Cys
DXDPDNHSYX

SEQ ID NO: 112948 - protein, 11 aa, Artificial Sequence
  Description of Artificial Sequence: Synthetic peptide
  Seed: DMDPDNHSYFF (MAGC3_HUMAN)
  misc_feature (2)..(2): Xaa can be Ala, Ile, Thr, Met, Leu, Ser, Val, Cys, Gly, Pro, Phe, Trp, Gln, Tyr, Glu, Asn, Asp, His, or Lys
  misc_feature (11)..(11): Xaa can be Tyr, Trp, Lys, Phe, Leu, Met, Arg, His, Ile, or Val
DXDPDNHSYFX

SEQ ID NO: 112949 - protein, 9 aa, Artificial Sequence
  Description of Artificial Sequence: Synthetic peptide
  Seed: DMEDRAQAI (MAGC3_HUMAN)
  misc_feature (2)..(2): Xaa can be Arg, Tyr, His, Leu, Ile, Phe, Trp, Ala, Gln, Pro, Val, Thr, Met, Ser, Lys, Glu, Asn, Gly, Cys, or Asp
  misc_feature (9)..(9): Xaa can be Leu, Met, Ile, Val, Phe, Ala, Tyr, or Cys
DXEDRAQAX

SEQ ID NO: 112950 - protein, 10 aa, Artificial Sequence
  Description of Artificial Sequence: Synthetic peptide
  Seed: DMPAAGMPPL (MAGC3_HUMAN)
  misc_feature (2)..(2): Xaa can be Met, Tyr, Arg, Ile, Phe, Val, Thr, Leu, Lys, Ala, His, Ser, Trp, Asp, Glu, Cys, Pro, Gln, Asn, or Gly
  misc_feature (10)..(10): Xaa can be Leu, Phe, Tyr, Met, Ile, Val, Ala, or Trp
DXPAAGMPPX

SEQ ID NO: 112951 - protein, 8 aa, Artificial Sequence
  Description of Artificial Sequence: Synthetic peptide
  Seed: DPDHFYVF (MAGC3_HUMAN)
  misc_feature (2)..(2): Xaa can be Pro, or Ala
  misc_feature (8)..(8): Xaa can be Phe, Tyr, Met, or Leu
DXDHFYVX

SEQ ID NO: 112952 - protein, 9 aa, Artificial Sequence
  Description of Artificial Sequence: Synthetic peptide
  Seed: DPDHFYVFV (MAGC3_HUMAN)
  misc_feature (2)..(2): Xaa can be Pro, or Ala
  misc_feature (9)..(9): Xaa can be Val, Ile, Leu, or Met
DXDHFYVFX

SEQ ID NO: 112953 - protein, 8 aa, Artificial Sequence
  Description of Artificial Sequence: Synthetic peptide
  Seed: DPDNHSYF (MAGC3_HUMAN)
  misc_feature (2)..(2): Xaa can be Ala, or Pro
  misc_feature (8)..(8): Xaa can be Phe, or Tyr
DXDNHSYX

SEQ ID NO: 112954 - protein, 9 aa, Artificial Sequence
  Description of Artificial Sequence: Synthetic peptide
  Seed: DPDNHSYFF (MAGC3_HUMAN)
  misc_feature (2)..(2): Xaa can be Pro, Tyr, Phe, Ala, Val, Leu, Ser, Ile, Thr, Met, Gly, or Gln
  misc_feature (9)..(9): Xaa can be Tyr, Trp, Phe, Met, Leu, Ile, or Val
DXDNHSYFX

SEQ ID NO: 112955 - protein, 9 aa, Artificial Sequence
  Description of Artificial Sequence: Synthetic peptide
  Seed: DQGMPKNCL (MAGC3_HUMAN)
  misc_feature (2)..(2): Xaa can be His, Arg, or Gln
  misc_feature (9)..(9): Xaa can be Met, Leu, Val, Phe, Ile, or Trp
DXGMPKNCX

SEQ ID NO: 112956 - protein, 9 aa, Artificial Sequence
  Description of Artificial Sequence: Synthetic peptide
  Seed: DQRMDSLVL (MAGC3_HUMAN)
  misc_feature (2)..(2): Xaa can be His, Glu, Arg, Gln, Met, Ala, Leu, Lys, Asp, Ser, Val, Ile, Pro, Asn, Gly, Phe, Thr, Cys, Tyr, or Trp
  misc_feature (9)..(9): Xaa can be Tyr, Phe, Met, Leu, Val, Ile, Ala, Thr, Pro, Cys, or Trp
DXRMDSLVX

SEQ ID NO: 112957 - protein, 9 aa, Artificial Sequence
  Description of Artificial Sequence: Synthetic peptide
  Seed: DRAQAIIDT (MAGC3_HUMAN)
  misc_feature (2)..(2): Xaa can be Arg, His, or Gln
  misc_feature (9)..(9): Xaa can be Val, Ile, Ala, Met, Leu, Pro, Phe, Thr, or Cys
DXAQAIIDX

SEQ ID NO: 112958 - protein, 10 aa, Artificial Sequence
  Description of Artificial Sequence: Synthetic peptide
  Seed: DRAQAIIDTT (MAGC3_HUMAN)
  misc_feature (2)..(2): Xaa can be , or Arg
  misc_feature (10)..(10): Xaa can be Val, Pro, Ala, Met, Ile, Phe, Leu, Cys, or Thr
DXAQAIIDTX

SEQ ID NO: 112959 - protein, 8 aa, Artificial Sequence
  Description of Artificial Sequence: Synthetic peptide
  Seed: DSCSSPLL (MAGC3_HUMAN)
  misc_feature (2)..(2): Xaa can be Ala, Pro, Ser, or Gly
  misc_feature (8)..(8): Xaa can be Ile, Leu, Val, or Met
DXCSSPLX

SEQ ID NO: 112960 - protein, 9 aa, Artificial Sequence
  Description of Artificial Sequence: Synthetic peptide
  Seed: DSCSSPLLW (MAGC3_HUMAN)
  misc_feature (2)..(2): Xaa can be Glu, Ala, Pro, Val, Thr, Ile, Ser, Leu, Gln, Met, Phe, Cys, Gly, Tyr, Lys, Asn, Asp, or Tr p
  misc_feature (9)..(9): Xaa can be Trp, Phe, Tyr, Met, Leu, or Ile
DXCSSPLLX

SEQ ID NO: 112961 - protein, 11 aa, Artificial Sequence
  Description of Artificial Sequence: Synthetic peptide
  Seed: DSCSSPLLWTR (MAGC3_HUMAN)
  misc_feature (2)..(2): Xaa can be Arg, Thr, Phe, Pro, Leu, Cys, Met, Lys, Trp, Gln, Ser, Asp, Glu, Gly, Ala, Val, Tyr, His, Asn, or Ile
  misc_feature (11)..(11): Xaa can be Arg, or Lys
DXCSSPLLWTX

SEQ ID NO: 112962 - protein, 9 aa, Artificial Sequence
  Description of Artificial Sequence: Synthetic peptide
  Seed: DSDLPTWRR (MAGC3_HUMAN)
  misc_feature (2)..(2): Xaa can be Thr, Ser, Met, Ala, Leu, Val, Ile, Gly, Gln, Phe, Trp, Asn, Tyr, Asp, Pro, Cys, Glu, Lys, His, or Arg
  misc_feature (9)..(9): Xaa can be Arg, Tyr, Lys, Phe, His, Met, or Trp
DXDLPTWRX

SEQ ID NO: 112963 - protein, 9 aa, Artificial Sequence
  Description of Artificial Sequence: Synthetic peptide
  Seed: DSLVLCPTY (MAGC3_HUMAN)
  misc_feature (2)..(2): Xaa can be Thr, Val, Ala, Met, Pro, Gln, Ser, Ile, Leu, Glu, Phe, Gly, His, Arg, Cys, Trp, Tyr, Lys, Asp, or Asn
  misc_feature (9)..(9): Xaa can be Tyr, Phe, Met, Trp, Leu, or Ile
DXLVLCPTX

SEQ ID NO: 112964 - protein, 11 aa, Artificial Sequence
  Description of Artificial Sequence: Synthetic peptide
  Seed: DSLVLCPTYFK (MAGC3_HUMAN)
  misc_feature (2)..(2): Xaa can be Met, Arg, Phe, Tyr, Ile, Glu, Pro, Lys, Thr, Asn, His, Ser, Ala, Trp, Cys, Leu, Val, Gly, Asp, or Gln
  misc_feature (11)..(11): Xaa can be Arg, or Lys
DXLVLCPTYFX

SEQ ID NO: 112965 - protein, 9 aa, Artificial Sequence
  Description of Artificial Sequence: Synthetic peptide
  Seed: DTTDDATAM (MAGC3_HUMAN)
  misc_feature (2)..(2): Xaa can be Val, Thr, Ala, Ile, Pro, Gln, Ser, Met, Leu, Gly, Phe, Asn, Tyr, Trp, Cys, Glu, Asp, His, Lys, or Arg
  misc_feature (9)..(9): Xaa can be Tyr, Arg, Lys, Phe, Met, Trp, Leu, Val, His, Ile, or Ala
DXTDDATAX

SEQ ID NO: 112966 - protein, 10 aa, Artificial Sequence
  Description of Artificial Sequence: Synthetic peptide
  Seed: DTTDDATAMA (MAGC3_HUMAN)
  misc_feature (2)..(2): Xaa can be Thr, Val, Ile, Ala, Ser, Leu, Phe, Met, or Tyr
  misc_feature (10)..(10): Xaa can be Val, Leu, Ile, Met, or Ala
DXTDDATAMX

SEQ ID NO: 112967 - protein, 8 aa, Artificial Sequence
  Description of Artificial Sequence: Synthetic peptide
  Seed: DVLSRLAL (MAGC3_HUMAN)
  misc_feature (2)..(2): Xaa can be Ala, Met, Leu, Ile, Pro, Gln, Gly, Val, Asn, Ser, Phe, Arg, Glu, Tyr, Lys, Thr, Asp, Cys, or His
  misc_feature (8)..(8): Xaa can be Leu, Met, Ile, Val, or Phe
DXLSRLAX

SEQ ID NO: 112968 - protein, 9 aa, Artificial Sequence
  Description of Artificial Sequence: Synthetic peptide
  Seed: DVLSRLALW (MAGC3_HUMAN)
  misc_feature (2)..(2): Xaa can be Val, Thr, Ser, Ala, Ile, Met, Leu, Gly, Pro, Gln, Asn, or Cys
  misc_feature (9)..(9): Xaa can be Trp, Tyr, Phe, Leu, Val, Ile, Met, His, or Arg
DXLSRLALX

SEQ ID NO: 112969 - protein, 9 aa, Artificial Sequence
  Description of Artificial Sequence: Synthetic peptide
  Seed: DYFPMIFGK (MAGC3_HUMAN)
  misc_feature (2)..(2): Xaa can be Thr, Val, Ile, Ala, Ser, Leu, Met, Tyr, Asn, Gly, Gln, Phe, Trp, Asp, Arg, Pro, His, Cys, Lys, or Glu
  misc_feature (9)..(9): Xaa can be Lys, Arg, His, Tyr, Leu, Phe, Met, Val, Gln, Ile, Ala, Asn, or Glu
DXFPMIFGX

SEQ ID NO: 112970 - protein, 9 aa, Artificial Sequence
  Description of Artificial Sequence: Synthetic peptide
  Seed: DYSAFHLGH (MAGC3_HUMAN)
  misc_feature (2)..(2): Xaa can be Tyr, Ile, Ala, Phe, His, Asn, Thr, Val, Leu, Gln, Met, Gly, Pro, Trp, Ser, Glu, Lys, Asp, Cys, or Arg
  misc_feature (9)..(9): Xaa can be Arg, Lys, or His
DXSAFHLGX

SEQ ID NO: 112971 - protein, 11 aa, Artificial Sequence
  Description of Artificial Sequence: Synthetic peptide
  Seed: DYSAFHLGHLR (MAGC3_HUMAN)
  misc_feature (2)..(2): Xaa can be Cys, Ile, Gln, Pro, His, Ser, Val, Ala, Met, Glu, Arg, Trp, Asn, Tyr, Leu, Thr, Asp, Lys, Phe, or Gly
  misc_feature (11)..(11): Xaa can be Lys, or Arg
DXSAFHLGHLX

SEQ ID NO: 112972 - protein, 9 aa, Artificial Sequence
  Description of Artificial Sequence: Synthetic peptide
  Seed: EAFCEESGL (MAGC3_HUMAN)
  misc_feature (2)..(2): Xaa can be Thr, Val, Ala, Ile, Ser, Met, Leu, Pro, Gly, Glu, Cys, Gln, Phe, Asp, Tyr, or Asn
  misc_feature (9)..(9): Xaa can be Arg, Lys, Val, Ile, Tyr, Trp, Phe, Ala, His, Leu, Met, Gln, or Thr
EXFCEESGX

SEQ ID NO: 112973 - protein, 10 aa, Artificial Sequence
  Description of Artificial Sequence: Synthetic peptide
  Seed: EAFCEESGLR (MAGC3_HUMAN)
  misc_feature (2)..(2): Xaa can be Thr, Val, Ala, Ser, Ile, Leu, Met, Asn, Cys, Phe, Glu, Gly, Trp, Gln, Tyr, Asp, or Pro
  misc_feature (10)..(10): Xaa can be Arg, Lys, Tyr, Phe, His, Leu, or Met
EXFCEESGLX

SEQ ID NO: 112974 - protein, 8 aa, Artificial Sequence
  Description of Artificial Sequence: Synthetic peptide
  Seed: EASPQQKK (MAGC3_HUMAN)
  misc_feature (2)..(2): Xaa can be Ala, Thr, Ser, Met, Val, Leu, Ile, or Gly
  misc_feature (8)..(8): Xaa can be Lys, Arg, Leu, Phe, Tyr, or Met
EXSPQQKX

SEQ ID NO: 112975 - protein, 8 aa, Artificial Sequence
  Description of Artificial Sequence: Synthetic peptide
  Seed: EDMPAAGM (MAGC3_HUMAN)
  misc_feature (2)..(2): Xaa can be Glu, Asp, or Gln
  misc_feature (8)..(8): Xaa can be Leu, Ile, Met, Val, Phe, or Ala
EXMPAAGX

SEQ ID NO: 112976 - protein, 9 aa, Artificial Sequence
  Description of Artificial Sequence: Synthetic peptide
  Seed: EDMPAAGMP (MAGC3_HUMAN)
  misc_feature (2)..(2): Xaa can be Glu, Asp, or Gln
  misc_feature (9)..(9): Xaa can be Ala, Val, Pro, Ile, Cys, Leu, Thr, Phe, Ser, Gly, Met, or Asp
EXMPAAGMX

SEQ ID NO: 112977 - protein, 11 aa, Artificial Sequence
  Description of Artificial Sequence: Synthetic peptide
  Seed: EDMPAAGMPPL (MAGC3_HUMAN)
  misc_feature (2)..(2): Xaa can be Glu, Pro, Asp, Gln, Arg, Ile, Met, Asn, Ser, Ala, Leu, Phe, Val, Gly, Tyr, Thr, Lys, His, Trp, or Cys
  misc_feature (11)..(11): Xaa can be Met, Leu, Val, Cys, Ala, Phe, Ile, Thr, Trp, Tyr, Gly, Ser, or Pro
EXMPAAGMPPX

SEQ ID NO: 112978 - protein, 9 aa, Artificial Sequence
  Description of Artificial Sequence: Synthetic peptide
  Seed: EDTATWHAL (MAGC3_HUMAN)
  misc_feature (2)..(2): Xaa can be Glu, Asp, or Gln
  misc_feature (9)..(9): Xaa can be Met, Pro, Val, Ala, Cys, Phe, Ile, Leu, Trp, Ser, Gly, Thr, or Tyr
EXTATWHAX

SEQ ID NO: 112979 - protein, 8 aa, Artificial Sequence
  Description of Artificial Sequence: Synthetic peptide
  Seed: EDTLDLTY (MAGC3_HUMAN)
  misc_feature (2)..(2): Xaa can be Glu, or Asp
  misc_feature (8)..(8): Xaa can be Tyr, Phe, His, Leu, Trp, or Met
EXTLDLTX

SEQ ID NO: 112980 - protein, 9 aa, Artificial Sequence
  Description of Artificial Sequence: Synthetic peptide
  Seed: EEDTATWHA (MAGC3_HUMAN)
  misc_feature (2)..(2): Xaa can be Glu, Gln, or Asp
  misc_feature (9)..(9): Xaa can be Ile, Ala, Val, Leu, Met, Phe, Cys, Ser, Thr, Gly, or Pro
EXDTATWHX

SEQ ID NO: 112981 - protein, 10 aa, Artificial Sequence
  Description of Artificial Sequence: Synthetic peptide
  Seed: EEDTATWHAL (MAGC3_HUMAN)
  misc_feature (2)..(2): Xaa can be Glu, Gln, Asp, Lys, Arg, Ser, or His
  misc_feature (10)..(10): Xaa can be Trp, Phe, Tyr, Met, Leu, Val, Ala, Ser, Ile, Gly, Pro, Cys, or Thr
EXDTATWHAX

SEQ ID NO: 112982 - protein, 8 aa, Artificial Sequence
  Description of Artificial Sequence: Synthetic peptide
  Seed: EEEDTATW (MAGC3_HUMAN)
  misc_feature (2)..(2): Xaa can be Glu, or Gln
  misc_feature (8)..(8): Xaa can be Trp, Phe, or Tyr
EXEDTATX

SEQ ID NO: 112983 - protein, 10 aa, Artificial Sequence
  Description of Artificial Sequence: Synthetic peptide
  Seed: EEEDTATWHA (MAGC3_HUMAN)
  misc_feature (2)..(2): Xaa can be Glu, or Gln
  misc_feature (10)..(10): Xaa can be Leu, Ala, Val, Pro, Thr, Ile, Phe, Gly, Met, Ser, or Cys
EXEDTATWHX

SEQ ID NO: 112984 - protein, 11 aa, Artificial Sequence
  Description of Artificial Sequence: Synthetic peptide
  Seed: EEEDTATWHAL (MAGC3_HUMAN)
  misc_feature (2)..(2): Xaa can be Glu, Gln, Asp, Arg, or Lys
  misc_feature (11)..(11): Xaa can be Trp, Ala, Phe, Tyr, Leu, Cys, Thr, Ile, Pro, Ser, Val, or Met
EXEDTATWHAX

SEQ ID NO: 112985 - protein, 8 aa, Artificial Sequence
  Description of Artificial Sequence: Synthetic peptide
  Seed: EEPQDWPL (MAGC3_HUMAN)
  misc_feature (2)..(2): Xaa can be , or Glu
  misc_feature (8)..(8): Xaa can be Ala, Leu, or Val
EXPQDWPX

SEQ ID NO: 112986 - protein, 8 aa, Artificial Sequence
  Description of Artificial Sequence: Synthetic peptide
  Seed: EESGLRSA (MAGC3_HUMAN)
  misc_feature (2)..(2): Xaa can be Glu, Asp, or Gln
  misc_feature (8)..(8): Xaa can be Leu, Val, Ala, Met, Ile, Cys, Phe, Thr, or Pro
EXSGLRSX

SEQ ID NO: 112987 - protein, 10 aa, Artificial Sequence
  Description of Artificial Sequence: Synthetic peptide
  Seed: EESGLRSAEG (MAGC3_HUMAN)
  misc_feature (2)..(2): Xaa can be Glu, or Gln
  misc_feature (10)..(10): Xaa can be Ala, Val, Cys, Thr, Met, Leu, Gly, Ser, Ile, Phe, or Pro
EXSGLRSAEX

SEQ ID NO: 112988 - protein, 10 aa, Artificial Sequence
  Description of Artificial Sequence: Synthetic peptide
  Seed: EESSSEEEDT (MAGC3_HUMAN)
  misc_feature (2)..(2): Xaa can be , or Glu
  misc_feature (10)..(10): Xaa can be Thr, Cys, Met, Ala, Phe, Val, Ile, or Leu
EXSSSEEEDX

SEQ ID NO: 112989 - protein, 11 aa, Artificial Sequence
  Description of Artificial Sequence: Synthetic peptide
  Seed: EESSSEEEDTA (MAGC3_HUMAN)
  misc_feature (2)..(2): Xaa can be Glu, or Gln
  misc_feature (11)..(11): Xaa can be Met, Ile, Leu, Ala, Phe, Pro, Val, Ser, Trp, Cys, Tyr, Gly, or Thr
EXSSSEEEDTX

SEQ ID NO: 112990 - protein, 8 aa, Artificial Sequence
  Description of Artificial Sequence: Synthetic peptide
  Seed: EEVIWEVL (MAGC3_HUMAN)
  misc_feature (2)..(2): Xaa can be Glu, Asp, Gln, Tyr, Ile, Phe, Trp, or Met
  misc_feature (8)..(8): Xaa can be Tyr, Leu, Phe, Val, Ile, Trp, Thr, Ala, Met, His, Cys, or Pro
EXVIWEVX

SEQ ID NO: 112991 - protein, 10 aa, Artificial Sequence
  Description of Artificial Sequence: Synthetic peptide
  Seed: EEVIWEVLNA (MAGC3_HUMAN)
  misc_feature (2)..(2): Xaa can be Thr, Glu, Ala, Cys, Lys, His, Gln, Trp, Pro, Leu, Phe, Arg, Asp, Val, Asn, Met, Ser, Tyr, Gly, or Ile
  misc_feature (10)..(10): Xaa can be Ala, Val, Leu, Ile, Met, Thr, or Cys
EXVIWEVLNX

SEQ ID NO: 112992 - protein, 11 aa, Artificial Sequence
  Description of Artificial Sequence: Synthetic peptide
  Seed: EEVIWEVLNAI (MAGC3_HUMAN)
  misc_feature (2)..(2): Xaa can be , or Glu
  misc_feature (11)..(11): Xaa can be Cys, Ile, Met, Val, Ala, Phe, or Leu
EXVIWEVLNAX

SEQ ID NO: 112993 - protein, 9 aa, Artificial Sequence
  Description of Artificial Sequence: Synthetic peptide
  Seed: EEVIWEVLS (MAGC3_HUMAN)
  misc_feature (2)..(2): Xaa can be Glu, Gln, or Asp
  misc_feature (9)..(9): Xaa can be Ile, Val, Leu, Ala, Cys, Met, Pro, Thr, Ser, Gly, or Phe
EXVIWEVLX

SEQ ID NO: 112994 - protein, 10 aa, Artificial Sequence
  Description of Artificial Sequence: Synthetic peptide
  Seed: EEVIWEVLSA (MAGC3_HUMAN)
  misc_feature (2)..(2): Xaa can be Glu, Thr, Leu, Ile, Lys, Asp, Pro, Trp, His, Phe, Ala, Gln, Gly, Asn, Cys, Arg, Met, Tyr, Ser, or Val
  misc_feature (10)..(10): Xaa can be Leu, Ala, Val, Ile, Met, Thr, Pro, or Cys
EXVIWEVLSX

SEQ ID NO: 112995 - protein, 11 aa, Artificial Sequence
  Description of Artificial Sequence: Synthetic peptide
  Seed: EEVIWEVLSAI (MAGC3_HUMAN)
  misc_feature (2)..(2): Xaa can be , or Glu
  misc_feature (11)..(11): Xaa can be Leu, Ala, Ile, Val, Met, or Cys
EXVIWEVLSAX

SEQ ID NO: 112996 - protein, 9 aa, Artificial Sequence
  Description of Artificial Sequence: Synthetic peptide
  Seed: EFIEILFGI (MAGC3_HUMAN)
  misc_feature (2)..(2): Xaa can be Thr, Ala, Val, Ile, Met, Ser, Leu, Gln, Phe, Tyr, Trp, Asn, Cys, Gly, Pro, Asp, Glu, Lys, His, or Arg
  misc_feature (9)..(9): Xaa can be Val, Leu, Ile, Met, Ala, Thr, Phe, Cys, Ser, Gly, Pro, Trp, Arg, Tyr, Asn, Glu, Asp, or Ly s
EXIEILFGX

SEQ ID NO: 112997 - protein, 9 aa, Artificial Sequence
  Description of Artificial Sequence: Synthetic peptide
  Seed: EFIELIFGI (MAGC3_HUMAN)
  misc_feature (2)..(2): Xaa can be Thr, Val, Ser, Ile, Met, Leu, Ala, Tyr, Phe, Trp, Cys, Gly, Asn, Gln, Pro, Glu, or Asp
  misc_feature (9)..(9): Xaa can be Val, Ile, Leu, Met, Ala, Phe, Thr, Cys, Ser, Gly, Trp, Pro, or Tyr
EXIELIFGX

SEQ ID NO: 112998 - protein, 9 aa, Artificial Sequence
  Description of Artificial Sequence: Synthetic peptide
  Seed: EFLSKLSSI (MAGC3_HUMAN)
  misc_feature (2)..(2): Xaa can be Pro, Leu, Ala, Phe, Ile, Tyr, Met, Trp, Gln, Gly, Val, Ser, Arg, Thr, Asn, Cys, His, Lys, Asp, or Glu
  misc_feature (9)..(9): Xaa can be Leu, Met, Ile, Val, Phe, Cys, Ala, Trp, or Tyr
EXLSKLSSX

SEQ ID NO: 112999 - protein, 10 aa, Artificial Sequence
  Description of Artificial Sequence: Synthetic peptide
  Seed: EFLSKLSSII (MAGC3_HUMAN)
  misc_feature (2)..(2): Xaa can be Phe, Tyr, Met, Leu, Trp, Ser, Val, Ile, Ala, Lys, Gly, Arg, Thr, Cys, His, or Gln
  misc_feature (10)..(10): Xaa can be Val, Leu, Ile, Ala, or Met
EXLSKLSSIX

SEQ ID NO: 113000 - protein, 11 aa, Artificial Sequence
  Description of Artificial Sequence: Synthetic peptide
  Seed: EILFGISLTEV (MAGC3_HUMAN)
  misc_feature (2)..(2): Xaa can be Phe, Tyr, Trp, Ser, Lys, Arg, Met, Asn, Gly, Ile, Leu, Gln, His, Ala, Thr, Cys, Val, or Gl u
  misc_feature (11)..(11): Xaa can be Val, Ile, Ala, Leu, Met, or Thr
EXLFGISLTEX

SEQ ID NO: 113001 - protein, 9 aa, Artificial Sequence
  Description of Artificial Sequence: Synthetic peptide
  Seed: EIPPQGPPK (MAGC3_HUMAN)
  misc_feature (2)..(2): Xaa can be Ala, Ile, Val, Thr, Ser, Leu, Met, Gly, Phe, Gln, Cys, Pro, Asn, Tyr, Trp, Glu, Asp, or Hi s
  misc_feature (9)..(9): Xaa can be Arg, Lys, Tyr, Met, Phe, Leu, Ile, Val, His, Ala, Gln, Cys, Thr, or Trp
EXPPQGPPX

SEQ ID NO: 113002 - protein, 10 aa, Artificial Sequence
  Description of Artificial Sequence: Synthetic peptide
  Seed: EIPPQGPPKI (MAGC3_HUMAN)
  misc_feature (2)..(2): Xaa can be Val, Thr, Ile, Ser, Met, Leu, Ala, Gly, Phe, Cys, Tyr, Gln, Pro, Asn, Glu, Trp, or Asp
  misc_feature (10)..(10): Xaa can be Arg, Leu, Met, Lys, Phe, Ile, Val, Tyr, His, Ala, Trp, or Gln
EXPPQGPPKX

SEQ ID NO: 113003 - protein, 9 aa, Artificial Sequence
  Description of Artificial Sequence: Synthetic peptide
  Seed: EKVAELVQF (MAGC3_HUMAN)
  misc_feature (2)..(2): Xaa can be His, Gln, Met, Arg, Val, Leu, Ile, Ala, Thr, Glu, Gly, Ser, Tyr, Cys, Phe, Asn, Pro, Asp, Lys, or Trp
  misc_feature (9)..(9): Xaa can be Tyr, Phe, Met, Leu, Trp, His, or Ile
EXVAELVQX

SEQ ID NO: 113004 - protein, 10 aa, Artificial Sequence
  Description of Artificial Sequence: Synthetic peptide
  Seed: EKVAELVQFL (MAGC3_HUMAN)
  misc_feature (2)..(2): Xaa can be Thr, Phe, Asp, His, Glu, Leu, Asn, Lys, Trp, Gln, Gly, Tyr, Ile, Cys, Ser, Pro, Arg, Met, Val, or Ala
  misc_feature (10)..(10): Xaa can be Ile, Tyr, Val, Phe, Leu, Thr, Ala, Met, Ser, or Cys
EXVAELVQFX

SEQ ID NO: 113005 - protein, 9 aa, Artificial Sequence
  Description of Artificial Sequence: Synthetic peptide
  Seed: EKVDKLVQF (MAGC3_HUMAN)
  misc_feature (2)..(2): Xaa can be Glu, Arg, Ala, His, Gln, Asp, Ser, Ile, Val, Thr, Gly, Met, Leu, Asn, Phe, Lys, Tyr, Pro, Cys, or Trp
  misc_feature (9)..(9): Xaa can be Ile, Phe, Leu, Met, Val, Tyr, Trp, Lys, Arg, His, Cys, Ala, Thr, Pro, Ser, or Gln
EXVDKLVQX

SEQ ID NO: 113006 - protein, 9 aa, Artificial Sequence
  Description of Artificial Sequence: Synthetic peptide
  Seed: ELIFGIALT (MAGC3_HUMAN)
  misc_feature (2)..(2): Xaa can be Thr, Val, Ser, Ile, Ala, Leu, Met, Gln, Gly, Asn, Cys, Phe, Pro, Tyr, or Asp
  misc_feature (9)..(9): Xaa can be Val, Ile, Leu, Ala, Met, Thr, Ser, Cys, Phe, Pro, or Gly
EXIFGIALX

SEQ ID NO: 113007 - protein, 9 aa, Artificial Sequence
  Description of Artificial Sequence: Synthetic peptide
  Seed: ELVQFLLLK (MAGC3_HUMAN)
  misc_feature (2)..(2): Xaa can be Thr, Val, Ile, Ala, Leu, Ser, Met, Gln, Asn, Gly, Tyr, Cys, Asp, Lys, Pro, Glu, Phe, Trp, His, or Arg
  misc_feature (9)..(9): Xaa can be Arg, Lys, Tyr, His, Leu, Met, Val, Phe, Gln, Ile, or Ala
EXVQFLLLX

SEQ ID NO: 113008 - protein, 10 aa, Artificial Sequence
  Description of Artificial Sequence: Synthetic peptide
  Seed: ELVQFLLLKY (MAGC3_HUMAN)
  misc_feature (2)..(2): Xaa can be Thr, Val, Ile, Ser, Gln, Ala, Met, Asn, Leu, Gly, Trp, Glu, Phe, Tyr, Arg, His, Pro, Asp, Lys, or Cys
  misc_feature (10)..(10): Xaa can be Lys, Tyr, Arg, His, Phe, Leu, Met, or Gln
EXVQFLLLKX

SEQ ID NO: 113009 - protein, 9 aa, Artificial Sequence
  Description of Artificial Sequence: Synthetic peptide
  Seed: EMLTTVIKK (MAGC3_HUMAN)
  misc_feature (2)..(2): Xaa can be Thr, Val, Ile, Ala, Ser, Met, Leu, Asn, Gln, Tyr, Asp, Gly, His, Lys, Glu, Trp, Phe, Pro, Cys, or Arg
  misc_feature (9)..(9): Xaa can be Arg, Lys, His, Tyr, Leu, Met, Val, Phe, Ile, Gln, or Ala
EXLTTVIKX

SEQ ID NO: 113010 - protein, 10 aa, Artificial Sequence
  Description of Artificial Sequence: Synthetic peptide
  Seed: EMLTTVIKKY (MAGC3_HUMAN)
  misc_feature (2)..(2): Xaa can be Val, Thr, Gln, Met, Ala, Ile, Ser, Leu, Phe, Glu, Tyr, Trp, Cys, Gly, Asn, or Asp
  misc_feature (10)..(10): Xaa can be Lys, Tyr, Arg, Phe, Leu, His, or Met
EXLTTVIKKX

SEQ ID NO: 113011 - protein, 11 aa, Artificial Sequence
  Description of Artificial Sequence: Synthetic peptide
  Seed: EMLTTVIKKYK (MAGC3_HUMAN)
  misc_feature (2)..(2): Xaa can be Val, Thr, Ile, Ala, Leu, Met, or Ser
  misc_feature (11)..(11): Xaa can be Lys, or Arg
EXLTTVIKKYX

SEQ ID NO: 113012 - protein, 10 aa, Artificial Sequence
  Description of Artificial Sequence: Synthetic peptide
  Seed: EMQMNVINTY (MAGC3_HUMAN)
  misc_feature (2)..(2): Xaa can be Met, Leu, Ser, Arg, Val, Thr, Ile, Ala, Phe, Lys, His, Tyr, Trp, Pro, Gly, Cys, Asn, Asp, Gln, or Glu
  misc_feature (10)..(10): Xaa can be Phe, Trp, Met, Tyr, Leu, Lys, Arg, Ile, or His
EXQMNVINTX

SEQ ID NO: 113013 - protein, 8 aa, Artificial Sequence
  Description of Artificial Sequence: Synthetic peptide
  Seed: EPLTRAEM (MAGC3_HUMAN)
  misc_feature (2)..(2): Xaa can be Pro, Met, Leu, Ala, Ile, Gly, Thr, Asn, Phe, Gln, Val, Cys, or Ser
  misc_feature (8)..(8): Xaa can be Leu, Met, Ile, Phe, or Val
EXLTRAEX

SEQ ID NO: 113014 - protein, 10 aa, Artificial Sequence
  Description of Artificial Sequence: Synthetic peptide
  Seed: EPLTRAEMQM (MAGC3_HUMAN)
  misc_feature (2)..(2): Xaa can be , or Pro
  misc_feature (10)..(10): Xaa can be Leu, or Met
EXLTRAEMQX

SEQ ID NO: 113015 - protein, 10 aa, Artificial Sequence
  Description of Artificial Sequence: Synthetic peptide
  Seed: EPQDWPLNEK (MAGC3_HUMAN)
  misc_feature (2)..(2): Xaa can be Val, Thr, Ile, Ala, Met, Ser, Leu, Tyr, Lys, Pro, Asp, Phe, Trp, Glu, Gly, Asn, Gln, Cys, or His
  misc_feature (10)..(10): Xaa can be Arg, Lys, Tyr, Met, Leu, Phe, His, Gln, Val, Ile, or Trp
EXQDWPLNEX

SEQ ID NO: 113016 - protein, 11 aa, Artificial Sequence
  Description of Artificial Sequence: Synthetic peptide
  Seed: EPQDWPLNEKR (MAGC3_HUMAN)
  misc_feature (2)..(2): Xaa can be Val, Thr, Tyr, Phe, Ala, Leu, Met, Ile, Ser, Gly, Trp, Cys, Asn, Gln, His, or Pro
  misc_feature (11)..(11): Xaa can be Arg, Lys, Met, Tyr, Leu, or His
EXQDWPLNEKX

SEQ ID NO: 113017 - protein, 9 aa, Artificial Sequence
  Description of Artificial Sequence: Synthetic peptide
  Seed: EQGMPQNRL (MAGC3_HUMAN)
  misc_feature (2)..(2): Xaa can be Glu, Gln, His, Asp, or Arg
  misc_feature (9)..(9): Xaa can be Ile, Leu, Phe, Met, Val, Trp, Ala, or Cys
EXGMPQNRX

SEQ ID NO: 113018 - protein, 10 aa, Artificial Sequence
  Description of Artificial Sequence: Synthetic peptide
  Seed: ESEPLFTYTL (MAGC3_HUMAN)
  misc_feature (2)..(2): Xaa can be Thr, Val, Ile, Ala, Ser, Leu, or Met
  misc_feature (10)..(10): Xaa can be Ala, Val, Ile, Leu, Met, or Thr
EXEPLFTYTX

SEQ ID NO: 113019 - protein, 8 aa, Artificial Sequence
  Description of Artificial Sequence: Synthetic peptide
  Seed: ESESLPRY (MAGC3_HUMAN)
  misc_feature (2)..(2): Xaa can be Ser, or Thr
  misc_feature (8)..(8): Xaa can be , or Tyr
EXESLPRX

SEQ ID NO: 113020 - protein, 10 aa, Artificial Sequence
  Description of Artificial Sequence: Synthetic peptide
  Seed: ESESLPRYAL (MAGC3_HUMAN)
  misc_feature (2)..(2): Xaa can be Ser, Lys, Ala, Tyr, Trp, Met, Arg, Val, Phe, His, Gly, Leu, Ile, Gln, Thr, Asn, Glu, or Cy s
  misc_feature (10)..(10): Xaa can be Leu, Ile, Met, Val, or Phe
EXESLPRYAX

SEQ ID NO: 113021 - protein, 8 aa, Artificial Sequence
  Description of Artificial Sequence: Synthetic peptide
  Seed: ESLPRYAL (MAGC3_HUMAN)
  misc_feature (2)..(2): Xaa can be Met, Arg, Ala, Pro, His, Leu, Gln, Phe, Gly, Asn, Ile, Tyr, Ser, Val, Trp, Asp, Glu, Lys, Thr, or Cys
  misc_feature (8)..(8): Xaa can be Leu, Ile, Met, Val, Phe, Ala, or Tyr
EXLPRYAX

SEQ ID NO: 113022 - protein, 11 aa, Artificial Sequence
  Description of Artificial Sequence: Synthetic peptide
  Seed: ESLPRYALDEK (MAGC3_HUMAN)
  misc_feature (2)..(2): Xaa can be Ala, Thr, Leu, Ser, Met, Ile, Val, or Gln
  misc_feature (11)..(11): Xaa can be Lys, or Arg
EXLPRYALDEX

SEQ ID NO: 113023 - protein, 8 aa, Artificial Sequence
  Description of Artificial Sequence: Synthetic peptide
  Seed: EVDPDHFY (MAGC3_HUMAN)
  misc_feature (2)..(2): Xaa can be Thr, Ser, Val, Ile, Leu, Met, Ala, Phe, Gln, Gly, Asn, Asp, Tyr, Cys, or Trp
  misc_feature (8)..(8): Xaa can be Tyr, Lys, Arg, Phe, or His
EXDPDHFX

SEQ ID NO: 113024 - protein, 9 aa, Artificial Sequence
  Description of Artificial Sequence: Synthetic peptide
  Seed: EVDPDHFYV (MAGC3_HUMAN)
  misc_feature (2)..(2): Xaa can be Thr, Ser, Leu, Ala, Met, Tyr, Val, Ile, Phe, Trp, Cys, Asn, Gln, Gly, Pro, Asp, Glu, His, Arg, or Lys
  misc_feature (9)..(9): Xaa can be Lys, Tyr, Leu, Met, Phe, Arg, Ile, Val, His, Trp, Ala, Cys, Thr, Gln, or Ser
EXDPDHFYX

SEQ ID NO: 113025 - protein, 10 aa, Artificial Sequence
  Description of Artificial Sequence: Synthetic peptide
  Seed: EVDPDHFYVF (MAGC3_HUMAN)
  misc_feature (2)..(2): Xaa can be Thr, Ser, Ala, Ile, Leu, Val, Met, Gly, Gln, Cys, Phe, Tyr, Trp, Asn, Pro, Glu, Asp, Lys, or His
  misc_feature (10)..(10): Xaa can be Tyr, Trp, Lys, Leu, Phe, Met, Arg, Val, His, Ile, or Gln
EXDPDHFYVX

SEQ ID NO: 113026 - protein, 11 aa, Artificial Sequence
  Description of Artificial Sequence: Synthetic peptide
  Seed: EVDPDHFYVFV (MAGC3_HUMAN)
  misc_feature (2)..(2): Xaa can be Thr, Ile, or Val
  misc_feature (11)..(11): Xaa can be , or Val
EXDPDHFYVFX

SEQ ID NO: 113027 - protein, 9 aa, Artificial Sequence
  Description of Artificial Sequence: Synthetic peptide
  Seed: EVIWEVLNA (MAGC3_HUMAN)
  misc_feature (2)..(2): Xaa can be Thr, Val, Ala, Ser, Ile, Met, Leu, Gly, Asn, Cys, Gln, Phe, Pro, Tyr, Glu, Asp, Trp, or Hi s
  misc_feature (9)..(9): Xaa can be Arg, Lys, Val, Tyr, Ile, Leu, Ala, Phe, Met, Thr, His, Gln, Ser, or Cys
EXIWEVLNX

SEQ ID NO: 113028 - protein, 10 aa, Artificial Sequence
  Description of Artificial Sequence: Synthetic peptide
  Seed: EVIWEVLNAI (MAGC3_HUMAN)
  misc_feature (2)..(2): Xaa can be Thr, Val, Ile, Ala, Ser, Leu, Asn, Met, Gln, Phe, Gly, Tyr, Cys, Asp, Glu, Pro, Trp, Arg, Lys, or His
  misc_feature (10)..(10): Xaa can be Val, Phe, Ile, Tyr, Leu, Arg, Lys, Ala, Met, Trp, Ser, Thr, His, Gln, Gly, Pro, or Cys
EXIWEVLNAX

SEQ ID NO: 113029 - protein, 9 aa, Artificial Sequence
  Description of Artificial Sequence: Synthetic peptide
  Seed: EVIWEVLSA (MAGC3_HUMAN)
  misc_feature (2)..(2): Xaa can be Thr, Val, Ile, Ala, Ser, Leu, Met, Gln, Asn, Pro, Cys, Gly, Phe, Glu, Asp, Tyr, Lys, His, or Trp
  misc_feature (9)..(9): Xaa can be Arg, Lys, Val, Tyr, Met, Ala, Ile, Leu, Phe, His, Thr, Gln, Ser, Trp, or Cys
EXIWEVLSX

SEQ ID NO: 113030 - protein, 10 aa, Artificial Sequence
  Description of Artificial Sequence: Synthetic peptide
  Seed: EVIWEVLSAI (MAGC3_HUMAN)
  misc_feature (2)..(2): Xaa can be Thr, Val, Ser, Ile, Ala, Met, Leu, Gln, Gly, Asn, Cys, Glu, Tyr, Pro, Asp, Phe, Trp, Lys, His, or Arg
  misc_feature (10)..(10): Xaa can be Val, Tyr, Ala, Ile, Phe, Met, Leu, Arg, Lys, Trp, Thr, His, Ser, Gln, Cys, Glu, Pro, or Gl y
EXIWEVLSAX

SEQ ID NO: 113031 - protein, 8 aa, Artificial Sequence
  Description of Artificial Sequence: Synthetic peptide
  Seed: EVLEFLSK (MAGC3_HUMAN)
  misc_feature (2)..(2): Xaa can be Met, Ile, Ala, Val, Gly, Asn, Ser, Gln, Leu, or Thr
  misc_feature (8)..(8): Xaa can be Arg, or Lys
EXLEFLSX

SEQ ID NO: 113032 - protein, 9 aa, Artificial Sequence
  Description of Artificial Sequence: Synthetic peptide
  Seed: EVLEFLSKL (MAGC3_HUMAN)
  misc_feature (2)..(2): Xaa can be Thr, Val, Ile, Ala, Leu, Ser, Met, Gln, Gly, Pro, Asn, Cys, Glu, His, Tyr, Arg, Phe, Asp, Lys, or Trp
  misc_feature (9)..(9): Xaa can be Phe, Tyr, Lys, Arg, Val, Leu, Ile, Trp, Met, Ala, His, Cys, Thr, Gln, Glu, Gly, Ser, Asn, or Pro
EXLEFLSKX

SEQ ID NO: 113033 - protein, 9 aa, Artificial Sequence
  Description of Artificial Sequence: Synthetic peptide
  Seed: EVLNAIGPW (MAGC3_HUMAN)
  misc_feature (2)..(2): Xaa can be Val, Thr, Ile, Ala, Ser, Leu, Met, Pro, Gln, Gly, Asn, Cys, Phe, Asp, Glu, Tyr, or Trp
  misc_feature (9)..(9): Xaa can be Arg, Lys, Trp, Tyr, Phe, Met, Leu, His, Val, Ile, Ala, Gln, or Thr
EXLNAIGPX

SEQ ID NO: 113034 - protein, 9 aa, Artificial Sequence
  Description of Artificial Sequence: Synthetic peptide
  Seed: EVLSAIGPI (MAGC3_HUMAN)
  misc_feature (2)..(2): Xaa can be Thr, Val, Ser, Ala, Ile, Met, Leu, Gln, Gly, Asn, Cys, Phe, Asp, Trp, Pro, Glu, Tyr, Lys, or His
  misc_feature (9)..(9): Xaa can be Arg, Lys, Val, Tyr, Trp, Leu, Phe, His, Ile, Ala, Met, Gln, Thr, Ser, Glu, Asn, or Cys
EXLSAIGPX

SEQ ID NO: 113035 - protein, 10 aa, Artificial Sequence
  Description of Artificial Sequence: Synthetic peptide
  Seed: EVLSAIGPIQ (MAGC3_HUMAN)
  misc_feature (2)..(2): Xaa can be Thr, Val, Ile, Ala, Ser, Met, Gly, Asn, Phe, Cys, Leu, Asp, Pro, Gln, Tyr, Trp, or Glu
  misc_feature (10)..(10): Xaa can be Arg, Lys, Tyr, His, Met, Leu, Gln, or Phe
EXLSAIGPIX

SEQ ID NO: 113036 - protein, 11 aa, Artificial Sequence
  Description of Artificial Sequence: Synthetic peptide
  Seed: EVLSAIGPIQR (MAGC3_HUMAN)
  misc_feature (2)..(2): Xaa can be Thr, Val, Ala, Ile, Ser, Trp, Tyr, Cys, Gln, Asn, Pro, Leu, Phe, Asp, Gly, Met, Glu, His, Lys, or Arg
  misc_feature (11)..(11): Xaa can be Arg, Lys, Tyr, His, Gln, Met, Asn, Leu, or Phe
EXLSAIGPIQX

SEQ ID NO: 113037 - protein, 8 aa, Artificial Sequence
  Description of Artificial Sequence: Synthetic peptide
  Seed: FADVLSRL (MAGC3_HUMAN)
  misc_feature (2)..(2): Xaa can be Ala, Ser, Thr, Ile, Gly, Val, Tyr, Leu, Phe, Gln, Trp, Met, Asn, Glu, Cys, Pro, Asp, Arg, His, or Lys
  misc_feature (8)..(8): Xaa can be Ile, Phe, Leu, Met, Val, Tyr, Trp, Lys, Cys, Arg, Ala, His, or Thr
FXDVLSRX

SEQ ID NO: 113038 - protein, 9 aa, Artificial Sequence
  Description of Artificial Sequence: Synthetic peptide
  Seed: FADVLSRLA (MAGC3_HUMAN)
  misc_feature (2)..(2): Xaa can be Ala, Ser, Thr, Tyr, Phe, Leu, Val, Gln, Ile, Gly, Trp, Asn, Met, Cys, Arg, Glu, Asp, Pro, His, or Lys
  misc_feature (9)..(9): Xaa can be Ile, Tyr, Phe, Val, Met, Leu, Ala, Lys, Cys, Trp, Thr, Arg, Ser, His, Pro, Gln, Glu, or Gl y
FXDVLSRLX

SEQ ID NO: 113039 - protein, 10 aa, Artificial Sequence
  Description of Artificial Sequence: Synthetic peptide
  Seed: FADVLSRLAL (MAGC3_HUMAN)
  misc_feature (2)..(2): Xaa can be Pro, Ala, Met, Ser, Leu, Thr, Val, Ile, Phe, Gly, Tyr, Trp, Gln, Asn, Cys, Arg, Glu, His, Asp, or Lys
  misc_feature (10)..(10): Xaa can be Leu, Met, Phe, Ile, Val, Tyr, Lys, Cys, Trp, Arg, Ala, Thr, His, Ser, Gly, or Gln
FXDVLSRLAX

SEQ ID NO: 113040 - protein, 11 aa, Artificial Sequence
  Description of Artificial Sequence: Synthetic peptide
  Seed: FADVLSRLALW (MAGC3_HUMAN)
  misc_feature (2)..(2): Xaa can be Pro, Ser, Thr, Ala, Gly, Tyr, His, Asn, Ile, Asp, Arg, Met, Phe, Val, Cys, Lys, Trp, Leu, Glu, or Gln
  misc_feature (11)..(11): Xaa can be Trp, Tyr, Phe, Met, Ile, or Leu
FXDVLSRLALX

SEQ ID NO: 113041 - protein, 10 aa, Artificial Sequence
  Description of Artificial Sequence: Synthetic peptide
  Seed: FCEESGLRSA (MAGC3_HUMAN)
  misc_feature (2)..(2): Xaa can be Glu, Leu, Arg, Pro, Cys, Asp, His, Val, Phe, Tyr, Trp, Lys, Ile, Thr, Ser, Gly, Ala, Asn, Gln, or Met
  misc_feature (10)..(10): Xaa can be Ala, Pro, Ile, or Val
FXEESGLRSX

SEQ ID NO: 113042 - protein, 8 aa, Artificial Sequence
  Description of Artificial Sequence: Synthetic peptide
  Seed: FEDTLDLT (MAGC3_HUMAN)
  misc_feature (2)..(2): Xaa can be Glu, or Asp
  misc_feature (8)..(8): Xaa can be Leu, Phe, Pro, Thr, Ala, Met, Cys, Val, or Ile
FXDTLDLX

SEQ ID NO: 113043 - protein, 9 aa, Artificial Sequence
  Description of Artificial Sequence: Synthetic peptide
  Seed: FEDTLDLTY (MAGC3_HUMAN)
  misc_feature (2)..(2): Xaa can be Glu, Pro, Thr, Ser, Tyr, Asp, Phe, Ala, Gln, Val, Arg, Trp, Ile, Leu, Met, Asn, Cys, Gly, His, or Lys
  misc_feature (9)..(9): Xaa can be Lys, Met, Leu, Tyr, Phe, Trp, Arg, Val, Ile, His, Ala, Cys, Gln, Thr, Ser, Glu, Pro, Gly, Asn, or Asp
FXDTLDLTX

SEQ ID NO: 113044 - protein, 8 aa, Artificial Sequence
  Description of Artificial Sequence: Synthetic peptide
  Seed: FFEDTLDL (MAGC3_HUMAN)
  misc_feature (2)..(2): Xaa can be Ala, Val, Tyr, Thr, Ser, Phe, Ile, Gly, Trp, Leu, Arg, His, Met, Cys, Asn, Gln, or Asp
  misc_feature (8)..(8): Xaa can be Leu, Phe, Ile, Met, Tyr, Val, or Lys
FXEDTLDX

SEQ ID NO: 113045 - protein, 9 aa, Artificial Sequence
  Description of Artificial Sequence: Synthetic peptide
  Seed: FFEDTLDLT (MAGC3_HUMAN)
  misc_feature (2)..(2): Xaa can be Tyr, Phe, Trp, Ser, Leu, Thr, Met, Val, Pro, Ala, Ile, His, Cys, Gly, Gln, Asp, Arg, Asn, or Glu
  misc_feature (9)..(9): Xaa can be Leu, Met, Ile, Phe, Val, Trp, Ala, Cys, Tyr, or Thr
FXEDTLDLX

SEQ ID NO: 113046 - protein, 10 aa, Artificial Sequence
  Description of Artificial Sequence: Synthetic peptide
  Seed: FFEDTLDLTY (MAGC3_HUMAN)
  misc_feature (2)..(2): Xaa can be Thr, Tyr, Met, Ser, Ala, Phe, Ile, Leu, Val, Pro, Trp, Gly, Cys, Asn, Gln, Arg, His, Glu, Asp, or Lys
  misc_feature (10)..(10): Xaa can be Met, Tyr, Leu, Phe, Trp, Lys, Ile, Arg, Val, Cys, Ala, His, Gln, or Thr
FXEDTLDLTX

SEQ ID NO: 113047 - protein, 8 aa, Artificial Sequence
  Description of Artificial Sequence: Synthetic peptide
  Seed: FGISLTEV (MAGC3_HUMAN)
  misc_feature (2)..(2): Xaa can be Gln, Pro, Ala, Glu, Leu, His, Asn, Ser, Val, Gly, Met, Asp, Ile, Thr, or Lys
  misc_feature (8)..(8): Xaa can be Val, Ile, Leu, Met, Cys, Phe, or Ala
FXISLTEX

SEQ ID NO: 113048 - protein, 10 aa, Artificial Sequence
  Description of Artificial Sequence: Synthetic peptide
  Seed: FGKAHEFIEL (MAGC3_HUMAN)
  misc_feature (2)..(2): Xaa can be Ala, Ser, Thr, Met, Leu, Pro, Ile, Val, Gly, Gln, Phe, Glu, Cys, Asn, or Arg
  misc_feature (10)..(10): Xaa can be Tyr, Leu, Phe, Met, Ile, His, Val, Ala, Trp, or Lys
FXKAHEFIEX

SEQ ID NO: 113049 - protein, 8 aa, Artificial Sequence
  Description of Artificial Sequence: Synthetic peptide
  Seed: FGSQPEGK (MAGC3_HUMAN)
  misc_feature (2)..(2): Xaa can be Ala, Thr, Ser, Val, Gly, Ile, Gln, Leu, Asp, Phe, Met, or Asn
  misc_feature (8)..(8): Xaa can be Lys, Tyr, Arg, Leu, Phe, Met, Ile, Val, or His
FXSQPEGX

SEQ ID NO: 113050 - protein, 9 aa, Artificial Sequence
  Description of Artificial Sequence: Synthetic peptide
  Seed: FGSQPEGKF (MAGC3_HUMAN)
  misc_feature (2)..(2): Xaa can be Ala, Ser, Val, Leu, Gly, Ile, Gln, Pro, Thr, Met, Asn, Cys, Glu, Tyr, Phe, Trp, Asp, Arg, Lys, or His
  misc_feature (9)..(9): Xaa can be Tyr, Phe, Met, Trp, Leu, Lys, Val, Ile, Arg, His, Ala, Cys, Thr, or Gln
FXSQPEGKX

SEQ ID NO: 113051 - protein, 11 aa, Artificial Sequence
  Description of Artificial Sequence: Synthetic peptide
  Seed: FGSQPEGKFSL (MAGC3_HUMAN)
  misc_feature (2)..(2): Xaa can be Ala, Ser, Gly, Val, Thr, Ile, Gln, Met, Leu, Pro, Arg, Glu, Asn, Phe, Tyr, Cys, His, Trp, Lys, or Asp
  misc_feature (11)..(11): Xaa can be Leu, Phe, Met, Tyr, Lys, Ile, His, Trp, Val, Arg, Cys, or Ala
FXSQPEGKFSX

SEQ ID NO: 113052 - protein, 9 aa, Artificial Sequence
  Description of Artificial Sequence: Synthetic peptide
  Seed: FHLGHLREV (MAGC3_HUMAN)
  misc_feature (2)..(2): Xaa can be Arg, Tyr, His, Gln, Phe, Ala, Gly, Trp, Thr, Ser, Met, Asn, Glu, Lys, Pro, Asp, Ile, Leu, Val, or Cys
  misc_feature (9)..(9): Xaa can be Leu, Phe, Tyr, Ile, Val, Met, Cys, Ala, Trp, His, Thr, Lys, Arg, Ser, Gln, Pro, or Gly
FXLGHLREX

SEQ ID NO: 113053 - protein, 11 aa, Artificial Sequence
  Description of Artificial Sequence: Synthetic peptide
  Seed: FHLGHLREVRL (MAGC3_HUMAN)
  misc_feature (2)..(2): Xaa can be , or His
  misc_feature (11)..(11): Xaa can be Phe, Met, Leu, Trp, or Ile
FXLGHLREVRX

SEQ ID NO: 113054 - protein, 10 aa, Artificial Sequence
  Description of Artificial Sequence: Synthetic peptide
  Seed: FIEILFGISL (MAGC3_HUMAN)
  misc_feature (2)..(2): Xaa can be Arg, Lys, Met, Ala, Glu, Tyr, Gln, His, Thr, Ser, Gly, Leu, Cys, Asn, Asp, Pro, Trp, Ile, Phe, or Val
  misc_feature (10)..(10): Xaa can be Phe, Leu, Val, Met, Ile, Ala, or Thr
FXEILFGISX

SEQ ID NO: 113055 - protein, 8 aa, Artificial Sequence
  Description of Artificial Sequence: Synthetic peptide
  Seed: FIELIFGI (MAGC3_HUMAN)
  misc_feature (2)..(2): Xaa can be Met, Leu, Val, Gln, Ile, Thr, Phe, Ser, or Ala
  misc_feature (8)..(8): Xaa can be Val, Ala, Leu, Ile, Met, Phe, Thr, or Ser
FXELIFGX

SEQ ID NO: 113056 - protein, 10 aa, Artificial Sequence
  Description of Artificial Sequence: Synthetic peptide
  Seed: FIELIFGIAL (MAGC3_HUMAN)
  misc_feature (2)..(2): Xaa can be Glu, Arg, Ser, Met, Lys, His, Gly, Gln, Ala, Thr, Trp, Cys, Leu, Asp, Pro, Asn, Tyr, Phe, Ile, or Val
  misc_feature (10)..(10): Xaa can be Met, Ile, Val, Leu, Phe, or Ala
FXELIFGIAX

SEQ ID NO: 113057 - protein, 11 aa, Artificial Sequence
  Description of Artificial Sequence: Synthetic peptide
  Seed: FIELIFGIALT (MAGC3_HUMAN)
  misc_feature (2)..(2): Xaa can be Glu, Phe, Gly, Arg, Ala, Pro, Asn, Thr, Leu, Cys, Trp, Lys, His, Tyr, Met, Gln, Ser, Val, Asp, or Ile
  misc_feature (11)..(11): Xaa can be Met, Val, Leu, Thr, Ile, or Ala
FXELIFGIALX

SEQ ID NO: 113058 - protein, 11 aa, Artificial Sequence
  Description of Artificial Sequence: Synthetic peptide
  Seed: FIKGNCASEEV (MAGC3_HUMAN)
  misc_feature (2)..(2): Xaa can be Met, Leu, Gln, Val, or Ile
  misc_feature (11)..(11): Xaa can be Val, Leu, Ile, Met, or Ala
FXKGNCASEEX

SEQ ID NO: 113059 - protein, 11 aa, Artificial Sequence
  Description of Artificial Sequence: Synthetic peptide
  Seed: FIKGSCVPEEV (MAGC3_HUMAN)
  misc_feature (2)..(2): Xaa can be Met, Leu, Ile, Gln, Val, or Thr
  misc_feature (11)..(11): Xaa can be Val, Leu, Ile, Thr, Ala, or Met
FXKGSCVPEEX

SEQ ID NO: 113060 - protein, 9 aa, Artificial Sequence
  Description of Artificial Sequence: Synthetic peptide
  Seed: FKLWRTLSG (MAGC3_HUMAN)
  misc_feature (2)..(2): Xaa can be Gln, Met, Lys, Glu, Ala, His, Arg, Ser, Leu, Val, Thr, Asn, Tyr, Ile, Phe, Pro, Gly, Trp, Asp, or Cys
  misc_feature (9)..(9): Xaa can be Phe, Tyr, Met, Leu, Trp, His, Ile, Val, Ala, Gly, Ser, Asn, Pro, Thr, Gln, or Cys
FXLWRTLSX

SEQ ID NO: 113061 - protein, 10 aa, Artificial Sequence
  Description of Artificial Sequence: Synthetic peptide
  Seed: FKLWRTLSGS (MAGC3_HUMAN)
  misc_feature (2)..(2): Xaa can be Met, Leu, Ser, Gly, Ala, Ile, Gln, Thr, Val, Asn, Arg, His, Cys, Trp, Phe, Tyr, Asp, Lys, Glu, or Pro
  misc_feature (10)..(10): Xaa can be Met, Leu, Ser, Cys, Thr, Val, Ala, Ile, Phe, Gly, or Pro
FXLWRTLSGX

SEQ ID NO: 113062 - protein, 8 aa, Artificial Sequence
  Description of Artificial Sequence: Synthetic peptide
  Seed: FLLLKYQA (MAGC3_HUMAN)
  misc_feature (2)..(2): Xaa can be Leu, Met, or Ile
  misc_feature (8)..(8): Xaa can be Val, Ile, Ala, Leu, or Met
FXLLKYQX

SEQ ID NO: 113063 - protein, 9 aa, Artificial Sequence
  Description of Artificial Sequence: Synthetic peptide
  Seed: FLLLKYQAK (MAGC3_HUMAN)
  misc_feature (2)..(2): Xaa can be Leu, Met, Thr, Ile, Val, Ala, Ser, Gly, Gln, or Asn
  misc_feature (9)..(9): Xaa can be Lys, Arg, Tyr, Val, Leu, Met, or His
FXLLKYQAX

SEQ ID NO: 113064 - protein, 9 aa, Artificial Sequence
  Description of Artificial Sequence: Synthetic peptide
  Seed: FLLLKYQTK (MAGC3_HUMAN)
  misc_feature (2)..(2): Xaa can be Met, Leu, Thr, Ile, Ser, Ala, Val, Gln, Tyr, Asn, Gly, Phe, or Trp
  misc_feature (9)..(9): Xaa can be Arg, Lys, Tyr, Leu, Val, Met, Ile, Phe, or His
FXLLKYQTX

SEQ ID NO: 113065 - protein, 10 aa, Artificial Sequence
  Description of Artificial Sequence: Synthetic peptide
  Seed: FLRGGTSDQR (MAGC3_HUMAN)
  misc_feature (2)..(2): Xaa can be Thr, Val, Met, Ile, Ser, Leu, Tyr, Ala, Gln, Phe, Trp, Gly, or Asn
  misc_feature (10)..(10): Xaa can be Arg, Lys, or Tyr
FXRGGTSDQX

SEQ ID NO: 113066 - protein, 11 aa, Artificial Sequence
  Description of Artificial Sequence: Synthetic peptide
  Seed: FLRGGTSDQRM (MAGC3_HUMAN)
  misc_feature (2)..(2): Xaa can be Met, Gln, Leu, Val, Gly, Glu, Ile, Ser, Thr, Ala, Lys, Asn, or Pro
  misc_feature (11)..(11): Xaa can be Tyr, Phe, Met, Trp, or Leu
FXRGGTSDQRX

SEQ ID NO: 113067 - protein, 8 aa, Artificial Sequence
  Description of Artificial Sequence: Synthetic peptide
  Seed: FLSKLSSI (MAGC3_HUMAN)
  misc_feature (2)..(2): Xaa can be Leu, Met, Ile, Gln, Pro, Ser, Gly, Val, Glu, Asp, Ala, Lys, Thr, Asn, Arg, Phe, or His
  misc_feature (8)..(8): Xaa can be Leu, Ile, Val, Met, Phe, Ala, Thr, or Ser
FXSKLSSX

SEQ ID NO: 113068 - protein, 9 aa, Artificial Sequence
  Description of Artificial Sequence: Synthetic peptide
  Seed: FLSKLSSII (MAGC3_HUMAN)
  misc_feature (2)..(2): Xaa can be Gln, Met, Leu, Ala, Thr, Ile, Val, Ser, Lys, Gly, Glu, His, Asn, Cys, Pro, Phe, Arg, Tyr, Trp, or Asp
  misc_feature (9)..(9): Xaa can be Tyr, Phe, Met, Leu, Val, Ile, Trp, Ala, His, Thr, Lys, Cys, Ser, Gly, Arg, Pro, Asn, or Gl n
FXSKLSSIX

SEQ ID NO: 113069 - protein, 10 aa, Artificial Sequence
  Description of Artificial Sequence: Synthetic peptide
  Seed: FLSKLSSIIP (MAGC3_HUMAN)
  misc_feature (2)..(2): Xaa can be Met, Leu, Ile, Val, Gln, Thr, or Ala
  misc_feature (10)..(10): Xaa can be Val, Leu, Ile, Ala, Met, Trp, Glu, Gly, Pro, Asn, Gln, His, Tyr, Arg, Thr, Phe, Ser, Asp, Lys, or Cys
FXSKLSSIIX

SEQ ID NO: 113070 - protein, 11 aa, Artificial Sequence
  Description of Artificial Sequence: Synthetic peptide
  Seed: FLSKLSSIIPS (MAGC3_HUMAN)
  misc_feature (2)..(2): Xaa can be Leu, Met, Gln, Ile, Val, Thr, Ala, Ser, Gly, or Phe
  misc_feature (11)..(11): Xaa can be Val, Ile, Leu, Ala, Met, Thr, Phe, Ser, Cys, or Gly
FXSKLSSIIPX

SEQ ID NO: 113071 - protein, 8 aa, Artificial Sequence
  Description of Artificial Sequence: Synthetic peptide
  Seed: FPMIFGKA (MAGC3_HUMAN)
  misc_feature (2)..(2): Xaa can be , or Pro
  misc_feature (8)..(8): Xaa can be Val, Leu, Thr, Cys, Ile, Ser, Phe, Pro, Ala, or Met
FXMIFGKX

SEQ ID NO: 113072 - protein, 9 aa, Artificial Sequence
  Description of Artificial Sequence: Synthetic peptide
  Seed: FPMIFGKAH (MAGC3_HUMAN)
  misc_feature (2)..(2): Xaa can be Pro, Ala, Gly, Thr, Val, Ser, Ile, Met, Leu, Gln, Cys, Glu, Asn, Asp, or Phe
  misc_feature (9)..(9): Xaa can be Tyr, Phe, Met, Leu, Ala, Pro, Thr, Ile, His, Cys, Trp, Val, Asn, Asp, Glu, Gly, Ser, Lys, Gln, or Arg
FXMIFGKAX

SEQ ID NO: 113073 - protein, 11 aa, Artificial Sequence
  Description of Artificial Sequence: Synthetic peptide
  Seed: FPMIFGKAHEF (MAGC3_HUMAN)
  misc_feature (2)..(2): Xaa can be Pro, Ala, Met, Ser, Gln, Gly, Leu, Glu, Val, Ile, Thr, Asp, Cys, Phe, Tyr, Asn, His, Trp, or Lys
  misc_feature (11)..(11): Xaa can be Tyr, Phe, Met, Leu, Trp, Val, Ala, Ile, Ser, Arg, Thr, His, Cys, Lys, Gln, Pro, or Gly
FXMIFGKAHEX

SEQ ID NO: 113074 - protein, 8 aa, Artificial Sequence
  Description of Artificial Sequence: Synthetic peptide
  Seed: FPMIFRKA (MAGC3_HUMAN)
  misc_feature (2)..(2): Xaa can be , or Pro
  misc_feature (8)..(8): Xaa can be Phe, Leu, Met, Pro, Ser, Cys, Ile, Ala, Val, or Thr
FXMIFRKX

SEQ ID NO: 113075 - protein, 9 aa, Artificial Sequence
  Description of Artificial Sequence: Synthetic peptide
  Seed: FPMIFRKAR (MAGC3_HUMAN)
  misc_feature (2)..(2): Xaa can be Pro, Ala, Val, Ser, Tyr, Phe, Met, Gly, Leu, Ile, Trp, Thr, Glu, Asp, Asn, Gln, Cys, or Hi s
  misc_feature (9)..(9): Xaa can be Arg, Lys, Ala, Val, Leu, Cys, Ile, Ser, Met, His, Gly, Trp, Thr, Gln, Tyr, Phe, Pro, Asp, Asn, or Glu
FXMIFRKAX

SEQ ID NO: 113076 - protein, 11 aa, Artificial Sequence
  Description of Artificial Sequence: Synthetic peptide
  Seed: FPMIFRKAREF (MAGC3_HUMAN)
  misc_feature (2)..(2): Xaa can be Pro, Met, Ala, Leu, Ile, Val, Gln, Trp, or Phe
  misc_feature (11)..(11): Xaa can be Leu, Met, Ile, Tyr, Phe, Val, Cys, Ala, or Trp
FXMIFRKAREX

SEQ ID NO: 113077 - protein, 8 aa, Artificial Sequence
  Description of Artificial Sequence: Synthetic peptide
  Seed: FPSWYMDA (MAGC3_HUMAN)
  misc_feature (2)..(2): Xaa can be , or Pro
  misc_feature (8)..(8): Xaa can be Ala, or Val
FXSWYMDX

SEQ ID NO: 113078 - protein, 9 aa, Artificial Sequence
  Description of Artificial Sequence: Synthetic peptide
  Seed: FPSWYMDAL (MAGC3_HUMAN)
  misc_feature (2)..(2): Xaa can be Pro, Thr, Ala, Val, His, Ser, Met, Ile, Leu, Gln, Arg, Gly, Asn, Lys, Glu, Cys, Phe, Tyr, Asp, or Trp
  misc_feature (9)..(9): Xaa can be Phe, Tyr, Met, Val, Leu, Ile, Ala, Trp, Thr, His, Ser, Cys, Gln, Arg, Lys, Gly, Asp, Glu, Pro, or Asn
FXSWYMDAX

SEQ ID NO: 113079 - protein, 10 aa, Artificial Sequence
  Description of Artificial Sequence: Synthetic peptide
  Seed: FPSWYMDALK (MAGC3_HUMAN)
  misc_feature (2)..(2): Xaa can be Pro, Val, Ile, Met, Thr, Ala, Phe, Leu, Ser, Tyr, His, Cys, Gln, Asp, Asn, Glu, Lys, Trp, Arg, or Gly
  misc_feature (10)..(10): Xaa can be Tyr, Arg, Lys, Phe, Met, His, Pro, Leu, Ile, Gly, Gln, Ser, Val, Thr, Glu, Ala, Asp, Cys, Trp, or Asn
FXSWYMDALX

SEQ ID NO: 113080 - protein, 10 aa, Artificial Sequence
  Description of Artificial Sequence: Synthetic peptide
  Seed: FRKAREFIEI (MAGC3_HUMAN)
  misc_feature (2)..(2): Xaa can be , or Arg
  misc_feature (10)..(10): Xaa can be Met, Val, Phe, Leu, or Ile
FXKAREFIEX

SEQ ID NO: 113081 - protein, 9 aa, Artificial Sequence
  Description of Artificial Sequence: Synthetic peptide
  Seed: FSDGSLGQW (MAGC3_HUMAN)
  misc_feature (2)..(2): Xaa can be Ala, Thr, Val, Leu, Ser, Ile, Met, Phe, Cys, Gly, Tyr, Gln, Asn, Trp, Pro, Glu, Asp, His, Lys, or Arg
  misc_feature (9)..(9): Xaa can be Phe, Val, Tyr, Leu, Met, Lys, Ile, Trp, Arg, Cys, Ala, His, Thr, Ser, Gln, Pro, Glu, Gly, or Asn
FXDGSLGQX

SEQ ID NO: 113082 - protein, 10 aa, Artificial Sequence
  Description of Artificial Sequence: Synthetic peptide
  Seed: FSDGSLGQWV (MAGC3_HUMAN)
  misc_feature (2)..(2): Xaa can be Thr, Ser, Met, Ala, Leu, Val, Ile, Gly, Gln, Phe, Tyr, Asn, Trp, Cys, Glu, Pro, Asp, Lys, His, or Arg
  misc_feature (10)..(10): Xaa can be Leu, Tyr, Met, Phe, Lys, Ile, Val, Arg, Trp, His, Ala, Cys, Gln, Thr, Asn, Ser, or Glu
FXDGSLGQWX

SEQ ID NO: 113083 - protein, 11 aa, Artificial Sequence
  Description of Artificial Sequence: Synthetic peptide
  Seed: FSDGSLGQWVK (MAGC3_HUMAN)
  misc_feature (2)..(2): Xaa can be Thr, Ala, Ser, Val, Ile, Leu, Met, Gly, Tyr, Phe, Asn, Gln, Asp, Trp, Cys, Glu, Pro, His, or Lys
  misc_feature (11)..(11): Xaa can be Tyr, Lys, Arg, Phe, His, Leu, Trp, Met, Gln, Ile, Val, or Ala
FXDGSLGQWVX

SEQ ID NO: 113084 - protein, 9 aa, Artificial Sequence
  Description of Artificial Sequence: Synthetic peptide
  Seed: FSLRRAVSV (MAGC3_HUMAN)
  misc_feature (2)..(2): Xaa can be Pro, Met, Leu, Gln, Ala, Arg, Ile, Val, Gly, Ser, Asn, Glu, Phe, Thr, Cys, His, Asp, Lys, Trp, or Tyr
  misc_feature (9)..(9): Xaa can be Phe, Ile, Tyr, Val, Leu, Met, Ala, Cys, Trp, Thr, His, Gly, Lys, Ser, Arg, Glu, Pro, or Gl n
FXLRRAVSX

SEQ ID NO: 113085 - protein, 10 aa, Artificial Sequence
  Description of Artificial Sequence: Synthetic peptide
  Seed: FSLRRAVSVK (MAGC3_HUMAN)
  misc_feature (2)..(2): Xaa can be Thr, Ser, Ala, Val, Ile, Asn, Met, Pro, Glu, Asp, Phe, Tyr, Gly, Trp, Gln, Lys, Leu, Arg, Cys, or His
  misc_feature (10)..(10): Xaa can be Lys, Arg, or Ala
FXLRRAVSVX

SEQ ID NO: 113086 - protein, 8 aa, Artificial Sequence
  Description of Artificial Sequence: Synthetic peptide
  Seed: FTYTLDEK (MAGC3_HUMAN)
  misc_feature (2)..(2): Xaa can be Val, or Thr
  misc_feature (8)..(8): Xaa can be , or Lys
FXYTLDEX

SEQ ID NO: 113087 - protein, 9 aa, Artificial Sequence
  Description of Artificial Sequence: Synthetic peptide
  Seed: FTYTLDEKV (MAGC3_HUMAN)
  misc_feature (2)..(2): Xaa can be Leu, Met, Gln, Ala, Ile, Val, Thr, Arg, Ser, Gly, Asn, Glu, Asp, Phe, Cys, Pro, Lys, Tyr, His, or Trp
  misc_feature (9)..(9): Xaa can be Phe, Tyr, Ile, Val, Leu, Trp, Met, Lys, Arg, His, Ala, Thr, Cys, Ser, or Gly
FXYTLDEKX

SEQ ID NO: 113088 - protein, 11 aa, Artificial Sequence
  Description of Artificial Sequence: Synthetic peptide
  Seed: FTYTLDEKVDK (MAGC3_HUMAN)
  misc_feature (2)..(2): Xaa can be Ala, Thr, Ser, Gly, Val, Ile, Met, Gln, Asn, Asp, Leu, Cys, or Glu
  misc_feature (11)..(11): Xaa can be Lys, Arg, Tyr, Phe, Leu, Met, or Trp
FXYTLDEKVDX

SEQ ID NO: 113089 - protein, 9 aa, Artificial Sequence
  Description of Artificial Sequence: Synthetic peptide
  Seed: FVNTLDLTC (MAGC3_HUMAN)
  misc_feature (2)..(2): Xaa can be Ala, Thr, Val, Ser, Ile, Gly, Pro, Gln, Leu, Cys, Met, Asn, Phe, Trp, Tyr, Asp, or Glu
  misc_feature (9)..(9): Xaa can be Leu, Met, Val, Phe, Ile, Ala, Cys, Tyr, Trp, or Thr
FXNTLDLTX

SEQ ID NO: 113090 - protein, 8 aa, Artificial Sequence
  Description of Artificial Sequence: Synthetic peptide
  Seed: FYVFVNTL (MAGC3_HUMAN)
  misc_feature (2)..(2): Xaa can be Tyr, Phe, Arg, Trp, His, Glu, Ala, Ser, Asp, Asn, Gln, or Gly
  misc_feature (8)..(8): Xaa can be Leu, Phe, Tyr, Met, Val, Ile, or Trp
FXVFVNTX

SEQ ID NO: 113091 - protein, 10 aa, Artificial Sequence
  Description of Artificial Sequence: Synthetic peptide
  Seed: FYVFVNTLDL (MAGC3_HUMAN)
  misc_feature (2)..(2): Xaa can be Tyr, Trp, or Phe
  misc_feature (10)..(10): Xaa can be Leu, Met, Tyr, Trp, Phe, Ile, or Val
FXVFVNTLDX

SEQ ID NO: 113092 - protein, 8 aa, Artificial Sequence
  Description of Artificial Sequence: Synthetic peptide
  Seed: GEDEDMPA (MAGC3_HUMAN)
  misc_feature (2)..(2): Xaa can be , or Glu
  misc_feature (8)..(8): Xaa can be Val, Ile, Met, Leu, or Ala
GXDEDMPX

SEQ ID NO: 113093 - protein, 9 aa, Artificial Sequence
  Description of Artificial Sequence: Synthetic peptide
  Seed: GEDEDMPAA (MAGC3_HUMAN)
  misc_feature (2)..(2): Xaa can be Glu, Gln, Asp, Ala, Ile, Ser, or Val
  misc_feature (9)..(9): Xaa can be Leu, Met, Phe, Ala, Val, Ile, Pro, Cys, Trp, Thr, Asn, Tyr, Asp, Ser, Gly, Glu, Arg, Lys, or Gln
GXDEDMPAX

SEQ ID NO: 113094 - protein, 10 aa, Artificial Sequence
  Description of Artificial Sequence: Synthetic peptide
  Seed: GEDEDMPAAG (MAGC3_HUMAN)
  misc_feature (2)..(2): Xaa can be Glu, Asp, or Gln
  misc_feature (10)..(10): Xaa can be Met, Leu, Val, Phe, Ile, Ala, Cys, Arg, Asn, Lys, Gln, Ser, Tyr, Trp, Gly, Glu, Thr, Asp, or Pro
GXDEDMPAAX

SEQ ID NO: 113095 - protein, 11 aa, Artificial Sequence
  Description of Artificial Sequence: Synthetic peptide
  Seed: GEDEDMPAAGM (MAGC3_HUMAN)
  misc_feature (2)..(2): Xaa can be Glu, Asp, Gln, Lys, or Arg
  misc_feature (11)..(11): Xaa can be Trp, Ile, Met, Phe, Val, Ala, Leu, Cys, Lys, Tyr, Gln, Pro, Ser, His, Thr, Gly, Glu, or Ar g
GXDEDMPAAGX

SEQ ID NO: 113096 - protein, 8 aa, Artificial Sequence
  Description of Artificial Sequence: Synthetic peptide
  Seed: GEKAGSLP (MAGC3_HUMAN)
  misc_feature (2)..(2): Xaa can be , or Glu
  misc_feature (8)..(8): Xaa can be Val, Ala, Leu, Cys, Met, Ile, Thr, or Pro
GXKAGSLX

SEQ ID NO: 113097 - protein, 9 aa, Artificial Sequence
  Description of Artificial Sequence: Synthetic peptide
  Seed: GEKAGSLPE (MAGC3_HUMAN)
  misc_feature (2)..(2): Xaa can be Glu, Asp, or Gln
  misc_feature (9)..(9): Xaa can be Ala, Cys, Pro, Thr, Met, Leu, Ile, Val, Asp, Gly, Glu, Phe, or Ser
GXKAGSLPX

SEQ ID NO: 113098 - protein, 10 aa, Artificial Sequence
  Description of Artificial Sequence: Synthetic peptide
  Seed: GEKAGSLPES (MAGC3_HUMAN)
  misc_feature (2)..(2): Xaa can be Glu, Asp, or Gln
  misc_feature (10)..(10): Xaa can be Leu, Met, Ile, Val, Ala, Phe, Cys, Tyr, Thr, Ser, Gly, Pro, or Trp
GXKAGSLPEX

SEQ ID NO: 113099 - protein, 8 aa, Artificial Sequence
  Description of Artificial Sequence: Synthetic peptide
  Seed: GFADVLSR (MAGC3_HUMAN)
  misc_feature (2)..(2): Xaa can be Ala, Ser, Cys, Met, Leu, Asn, Phe, Thr, Gln, Val, Ile, Asp, Gly, Glu, or Pro
  misc_feature (8)..(8): Xaa can be Lys, Arg, Leu, or Met
GXADVLSX

SEQ ID NO: 113100 - protein, 9 aa, Artificial Sequence
  Description of Artificial Sequence: Synthetic peptide
  Seed: GFADVLSRL (MAGC3_HUMAN)
  misc_feature (2)..(2): Xaa can be Leu, Val, Ile, Arg, Met, Thr, Ala, Gln, Ser, Phe, Asn, Gly, Tyr, Glu, Trp, Cys, His, Lys, Asp, or Pro
  misc_feature (9)..(9): Xaa can be Val, Leu, Tyr, Phe, Met, Ile, Lys, Arg, Ala, Thr, Cys, Trp, Ser, Gly, Pro, or His
GXADVLSRX

SEQ ID NO: 113101 - protein, 8 aa, Artificial Sequence
  Description of Artificial Sequence: Synthetic peptide
  Seed: GHLREVRL (MAGC3_HUMAN)
  misc_feature (2)..(2): Xaa can be , or His
  misc_feature (8)..(8): Xaa can be , or Leu
GXLREVRX

SEQ ID NO: 113102 - protein, 9 aa, Artificial Sequence
  Description of Artificial Sequence: Synthetic peptide
  Seed: GHLREVRLF (MAGC3_HUMAN)
  misc_feature (2)..(2): Xaa can be Arg, His, Gln, or Tyr
  misc_feature (9)..(9): Xaa can be Met, Tyr, Leu, Phe, Trp, Ile, or Val
GXLREVRLX

SEQ ID NO: 113103 - protein, 10 aa, Artificial Sequence
  Description of Artificial Sequence: Synthetic peptide
  Seed: GHLREVRLFL (MAGC3_HUMAN)
  misc_feature (2)..(2): Xaa can be Leu, Met, Ile, Glu, Pro, Gly, Ser, Cys, Trp, Tyr, Arg, Val, Asn, Thr, Lys, Gln, Phe, Ala, Asp, or His
  misc_feature (10)..(10): Xaa can be Ala, Ile, Val, Leu, or Met
GXLREVRLFX

SEQ ID NO: 113104 - protein, 11 aa, Artificial Sequence
  Description of Artificial Sequence: Synthetic peptide
  Seed: GHLREVRLFLR (MAGC3_HUMAN)
  misc_feature (2)..(2): Xaa can be Phe, Ile, Val, Gln, Trp, Lys, Met, Leu, Thr, Ser, Tyr, Ala, Arg, His, Asn, Gly, or Cys
  misc_feature (11)..(11): Xaa can be Arg, or Lys
GXLREVRLFLX

SEQ ID NO: 113105 - protein, 11 aa, Artificial Sequence
  Description of Artificial Sequence: Synthetic peptide
  Seed: GHRQEDGRRGL (MAGC3_HUMAN)
  misc_feature (2)..(2): Xaa can be Arg, Gln, His, or Lys
  misc_feature (11)..(11): Xaa can be Leu, Phe, Met, Ile, Trp, Tyr, Ala, Cys, or Val
GXRQEDGRRGX

SEQ ID NO: 113106 - protein, 9 aa, Artificial Sequence
  Description of Artificial Sequence: Synthetic peptide
  Seed: GKAHEFIEL (MAGC3_HUMAN)
  misc_feature (2)..(2): Xaa can be Arg, Gln, Ala, Lys, Ser, His, Tyr, Glu, Ile, Asn, Thr, Phe, Leu, Val, Met, Gly, Asp, Pro, or Trp
  misc_feature (9)..(9): Xaa can be Tyr, Leu, Phe, Met, Ile, Trp, Val, His, Arg, Ala, Thr, Cys, or Lys
GXAHEFIEX

SEQ ID NO: 113107 - protein, 9 aa, Artificial Sequence
  Description of Artificial Sequence: Synthetic peptide
  Seed: GKFSLRRAV (MAGC3_HUMAN)
  misc_feature (2)..(2): Xaa can be Gln, Glu, Lys, Arg, Met, Ser, His, Leu, Ala, Asn, Thr, Gly, Pro, Ile, Val, Phe, Asp, or Ty r
  misc_feature (9)..(9): Xaa can be Tyr, Phe, Met, Leu, Trp, Val, Ile, His, Cys, Thr, or Ala
GXFSLRRAX

SEQ ID NO: 113108 - protein, 9 aa, Artificial Sequence
  Description of Artificial Sequence: Synthetic peptide
  Seed: GLQLSDLHF (MAGC3_HUMAN)
  misc_feature (2)..(2): Xaa can be Gln, Met, Leu, Ile, Val, Glu, Lys, Ser, Thr, Ala, His, Pro, Arg, Phe, Tyr, Gly, or Asn
  misc_feature (9)..(9): Xaa can be Tyr, Phe, Trp, Leu, Ile, Met, or Val
GXQLSDLHX

SEQ ID NO: 113109 - protein, 9 aa, Artificial Sequence
  Description of Artificial Sequence: Synthetic peptide
  Seed: GLRSAEGSV (MAGC3_HUMAN)
  misc_feature (2)..(2): Xaa can be Met, or Leu
  misc_feature (9)..(9): Xaa can be Ile, Val, or Leu
GXRSAEGSX

SEQ ID NO: 113110 - protein, 10 aa, Artificial Sequence
  Description of Artificial Sequence: Synthetic peptide
  Seed: GLRSAEGSVL (MAGC3_HUMAN)
  misc_feature (2)..(2): Xaa can be Leu, Met, Gln, Ile, Val, Ala, Ser, Thr, Gly, Asn, Phe, Glu, Pro, Asp, Cys, Trp, Tyr, Arg, Lys, or His
  misc_feature (10)..(10): Xaa can be Tyr, Phe, Met, Leu, Trp, Val, Ile, or His
GXRSAEGSVX

SEQ ID NO: 113111 - protein, 10 aa, Artificial Sequence
  Description of Artificial Sequence: Synthetic peptide
  Seed: GLTEASPQQK (MAGC3_HUMAN)
  misc_feature (2)..(2): Xaa can be Ala, Ser, Thr, Val, Met, Ile, Asp, Gln, Asn, Leu, Phe, Glu, Gly, Tyr, or Cys
  misc_feature (10)..(10): Xaa can be Tyr, Lys, Arg, Phe, Met, Leu, Ile, or Trp
GXTEASPQQX

SEQ ID NO: 113112 - protein, 11 aa, Artificial Sequence
  Description of Artificial Sequence: Synthetic peptide
  Seed: GLTEASPQQKK (MAGC3_HUMAN)
  misc_feature (2)..(2): Xaa can be Ile, Val, Ala, Thr, Leu, Met, or Ser
  misc_feature (11)..(11): Xaa can be Lys, or Arg
GXTEASPQQKX

SEQ ID NO: 113113 - protein, 9 aa, Artificial Sequence
  Description of Artificial Sequence: Synthetic peptide
  Seed: GMPKNCLLI (MAGC3_HUMAN)
  misc_feature (2)..(2): Xaa can be Tyr, Leu, Met, Ala, Trp, Gln, Phe, Arg, Gly, Val, Ser, Thr, Ile, Cys, Glu, His, Asn, Pro, or Lys
  misc_feature (9)..(9): Xaa can be Leu, Met, Ile, Phe, Val, Trp, Ala, Cys, or Tyr
GXPKNCLLX

SEQ ID NO: 113114 - protein, 10 aa, Artificial Sequence
  Description of Artificial Sequence: Synthetic peptide
  Seed: GMPKNCLLIL (MAGC3_HUMAN)
  misc_feature (2)..(2): Xaa can be Leu, Met, Ile, Val, Ala, Tyr, Gly, Ser, Glu, Gln, Phe, Asp, His, Pro, Lys, Trp, Asn, Thr, Cys, or Arg
  misc_feature (10)..(10): Xaa can be Met, Leu, Val, Ile, Ala, or Phe
GXPKNCLLIX

SEQ ID NO: 113115 - protein, 11 aa, Artificial Sequence
  Description of Artificial Sequence: Synthetic peptide
  Seed: GMPKNCLLILI (MAGC3_HUMAN)
  misc_feature (2)..(2): Xaa can be Leu, or Met
  misc_feature (11)..(11): Xaa can be Val, Ile, or Leu
GXPKNCLLILX

SEQ ID NO: 113116 - protein, 8 aa, Artificial Sequence
  Description of Artificial Sequence: Synthetic peptide
  Seed: GMPQNRLL (MAGC3_HUMAN)
  misc_feature (2)..(2): Xaa can be Ala, Ser, Thr, Gly, Met, Leu, Val, or Ile
  misc_feature (8)..(8): Xaa can be Leu, Met, Ile, Val, or Phe
GXPQNRLX

SEQ ID NO: 113117 - protein, 9 aa, Artificial Sequence
  Description of Artificial Sequence: Synthetic peptide
  Seed: GMPQNRLLI (MAGC3_HUMAN)
  misc_feature (2)..(2): Xaa can be Ala, Arg, Gln, Met, Leu, Gly, Val, His, Tyr, Thr, Phe, Cys, Ile, Glu, Ser, Pro, Asp, Lys, Asn, or Trp
  misc_feature (9)..(9): Xaa can be Leu, Met, Val, Phe, Ile, Ala, Trp, Cys, or Tyr
GXPQNRLLX

SEQ ID NO: 113118 - protein, 10 aa, Artificial Sequence
  Description of Artificial Sequence: Synthetic peptide
  Seed: GMPQNRLLIL (MAGC3_HUMAN)
  misc_feature (2)..(2): Xaa can be Met, Leu, Ala, Gln, Arg, Val, Tyr, Ile, Trp, Ser, Pro, Phe, Glu, Asp, Asn, Thr, Lys, Cys, His, or Gly
  misc_feature (10)..(10): Xaa can be Met, Leu, Phe, Ile, Val, Trp, or Ala
GXPQNRLLIX

SEQ ID NO: 113119 - protein, 10 aa, Artificial Sequence
  Description of Artificial Sequence: Synthetic peptide
  Seed: GNCASEEVIW (MAGC3_HUMAN)
  misc_feature (2)..(2): Xaa can be Thr, Ser, Val, Cys, Ala, Leu, Gln, Phe, Met, Gly, Asp, Trp, Asn, Pro, or Ile
  misc_feature (10)..(10): Xaa can be Trp, Phe, Tyr, Leu, or Met
GXCASEEVIX

SEQ ID NO: 113120 - protein, 10 aa, Artificial Sequence
  Description of Artificial Sequence: Synthetic peptide
  Seed: GPIQRPAREV (MAGC3_HUMAN)
  misc_feature (2)..(2): Xaa can be , or Pro
  misc_feature (10)..(10): Xaa can be Leu, Tyr, Cys, Met, Ser, Pro, Ile, Thr, Ala, Val, Phe, or Gly
GXIQRPAREX

SEQ ID NO: 113121 - protein, 11 aa, Artificial Sequence
  Description of Artificial Sequence: Synthetic peptide
  Seed: GPIQRPAREVL (MAGC3_HUMAN)
  misc_feature (2)..(2): Xaa can be , or Pro
  misc_feature (11)..(11): Xaa can be Val, Leu, Met, Ser, Gly, Phe, Thr, Ala, Pro, Ile, or Cys
GXIQRPAREVX

SEQ ID NO: 113122 - protein, 9 aa, Artificial Sequence
  Description of Artificial Sequence: Synthetic peptide
  Seed: GPPKISPQG (MAGC3_HUMAN)
  misc_feature (2)..(2): Xaa can be Pro, or Ala
  misc_feature (9)..(9): Xaa can be Ala, Ser, Pro, Thr, Cys, Val, Phe, Gly, Ile, Tyr, Leu, or Met
GXPKISPQX

SEQ ID NO: 113123 - protein, 10 aa, Artificial Sequence
  Description of Artificial Sequence: Synthetic peptide
  Seed: GPPKISPQGP (MAGC3_HUMAN)
  misc_feature (2)..(2): Xaa can be , or Pro
  misc_feature (10)..(10): Xaa can be Phe, Ser, Gly, Ile, Met, Thr, Pro, Cys, Val, Ala, or Leu
GXPKISPQGX

SEQ ID NO: 113124 - protein, 11 aa, Artificial Sequence
  Description of Artificial Sequence: Synthetic peptide
  Seed: GPPKISPQGPP (MAGC3_HUMAN)
  misc_feature (2)..(2): Xaa can be , or Pro
  misc_feature (11)..(11): Xaa can be Pro, Ser, Cys, Phe, Leu, Ile, Thr, Ala, Gly, Val, or Met
GXPKISPQGPX

SEQ ID NO: 113125 - protein, 9 aa, Artificial Sequence
  Description of Artificial Sequence: Synthetic peptide
  Seed: GPPQSPPQS (MAGC3_HUMAN)
  misc_feature (2)..(2): Xaa can be Pro, Ala, or Val
  misc_feature (9)..(9): Xaa can be Ala, Leu, Met, Ile, Tyr, Phe, Thr, Pro, Gly, Val, Cys, or Ser
GXPQSPPQX

SEQ ID NO: 113126 - protein, 10 aa, Artificial Sequence
  Description of Artificial Sequence: Synthetic peptide
  Seed: GPPQSPPQSP (MAGC3_HUMAN)
  misc_feature (2)..(2): Xaa can be Pro, Ala, Val, Ile, or Met
  misc_feature (10)..(10): Xaa can be Leu, Ala, Met, Ile, Pro, Val, Cys, Trp, Thr, Ser, Arg, Lys, Phe, Tyr, or Gly
GXPQSPPQSX

SEQ ID NO: 113127 - protein, 11 aa, Artificial Sequence
  Description of Artificial Sequence: Synthetic peptide
  Seed: GPPQSPPQSPL (MAGC3_HUMAN)
  misc_feature (2)..(2): Xaa can be Pro, Ala, Met, Arg, Ser, Ile, Val, Gly, Thr, Leu, Cys, Tyr, Phe, Gln, Trp, Lys, or His
  misc_feature (11)..(11): Xaa can be Leu, Met, Phe, Ile, Val, Ala, Arg, Gly, Ser, Thr, Tyr, Trp, Lys, Pro, or Cys
GXPQSPPQSPX

SEQ ID NO: 113128 - protein, 9 aa, Artificial Sequence
  Description of Artificial Sequence: Synthetic peptide
  Seed: GPWSALAGF (MAGC3_HUMAN)
  misc_feature (2)..(2): Xaa can be Pro, Gln, Ala, Leu, Met, Val, Ser, Ile, Thr, Asn, Phe, Glu, Lys, Gly, His, Asp, Tyr, Arg, Cys, or Trp
  misc_feature (9)..(9): Xaa can be Tyr, Phe, Met, Trp, Leu, Ile, Val, Ala, Thr, Pro, His, Ser, Cys, or Gly
GXWSALAGX

SEQ ID NO: 113129 - protein, 10 aa, Artificial Sequence
  Description of Artificial Sequence: Synthetic peptide
  Seed: GPWSALAGFA (MAGC3_HUMAN)
  misc_feature (2)..(2): Xaa can be , or Pro
  misc_feature (10)..(10): Xaa can be Leu, Cys, Ile, Met, Ala, Phe, Thr, Pro, or Val
GXWSALAGFX

SEQ ID NO: 113130 - protein, 9 aa, Artificial Sequence
  Description of Artificial Sequence: Synthetic peptide
  Seed: GQWVKNTCA (MAGC3_HUMAN)
  misc_feature (2)..(2): Xaa can be Glu, His, Gln, Asp, Ile, Met, Arg, Leu, or Ala
  misc_feature (9)..(9): Xaa can be Val, Ile, Ala, Leu, Met, Pro, Phe, Cys, Thr, Tyr, Ser, or Gly
GXWVKNTCX

SEQ ID NO: 113131 - protein, 11 aa, Artificial Sequence
  Description of Artificial Sequence: Synthetic peptide
  Seed: GQWVKNTCATY (MAGC3_HUMAN)
  misc_feature (2)..(2): Xaa can be Gln, Met, Ser, Ala, Ile, Leu, His, Lys, Val, Glu, Trp, Gly, Phe, Tyr, Thr, Pro, or Arg
  misc_feature (11)..(11): Xaa can be Tyr, Phe, Trp, Met, or Leu
GXWVKNTCATX

SEQ ID NO: 113132 - protein, 11 aa, Artificial Sequence
  Description of Artificial Sequence: Synthetic peptide
  Seed: GRRGLTEASPQ (MAGC3_HUMAN)
  misc_feature (2)..(2): Xaa can be Arg, Gly, or Gln
  misc_feature (11)..(11): Xaa can be Lys, Met, Tyr, Trp, Leu, Phe, Arg, Ile, His, Val, or Gln
GXRGLTEASPX

SEQ ID NO: 113133 - protein, 9 aa, Artificial Sequence
  Description of Artificial Sequence: Synthetic peptide
  Seed: GSCVPEEVI (MAGC3_HUMAN)
  misc_feature (2)..(2): Xaa can be Thr, Ala, Ser, Gln, Val, Met, Ile, Leu, Glu, Gly, Cys, Phe, Pro, Asp, or Asn
  misc_feature (9)..(9): Xaa can be Trp, Leu, Phe, Ile, Met, Val, or Tyr
GXCVPEEVX

SEQ ID NO: 113134 - protein, 10 aa, Artificial Sequence
  Description of Artificial Sequence: Synthetic peptide
  Seed: GSCVPEEVIW (MAGC3_HUMAN)
  misc_feature (2)..(2): Xaa can be Thr, Ser, Val, Cys, Ala, Phe, Tyr, Leu, Gln, Asn, Asp, Pro, Trp, Gly, Ile, or Met
  misc_feature (10)..(10): Xaa can be Trp, Phe, Tyr, Leu, or Met
GXCVPEEVIX

SEQ ID NO: 113135 - protein, 11 aa, Artificial Sequence
  Description of Artificial Sequence: Synthetic peptide
  Seed: GSLIDDQGMPK (MAGC3_HUMAN)
  misc_feature (2)..(2): Xaa can be Ala, Ser, Val, Thr, Met, Cys, Asp, Leu, Pro, Gln, Glu, Asn, Ile, Phe, Gly, Trp, or Tyr
  misc_feature (11)..(11): Xaa can be Lys, Arg, Tyr, Phe, Met, His, or Leu
GXLIDDQGMPX

SEQ ID NO: 113136 - protein, 9 aa, Artificial Sequence
  Description of Artificial Sequence: Synthetic peptide
  Seed: GSLPESEPL (MAGC3_HUMAN)
  misc_feature (2)..(2): Xaa can be Leu, Met, Gln, Thr, Ala, Ile, Val, Ser, Gly, Arg, Glu, Asn, Phe, Tyr, Cys, Pro, His, Lys, Asp, or Trp
  misc_feature (9)..(9): Xaa can be Tyr, Lys, Phe, Leu, Arg, Met, Trp, Ile, His, Val, Ala, Thr, or Cys
GXLPESEPX

SEQ ID NO: 113137 - protein, 10 aa, Artificial Sequence
  Description of Artificial Sequence: Synthetic peptide
  Seed: GSLPESEPLF (MAGC3_HUMAN)
  misc_feature (2)..(2): Xaa can be Gln, Leu, Met, Thr, Ser, Ile, Val, Ala, Gly, Glu, Pro, Lys, Tyr, Cys, Asn, Phe, Arg, Trp, or Asp
  misc_feature (10)..(10): Xaa can be Trp, Tyr, Phe, Leu, Met, Ile, Lys, Val, or Cys
GXLPESEPLX

SEQ ID NO: 113138 - protein, 10 aa, Artificial Sequence
  Description of Artificial Sequence: Synthetic peptide
  Seed: GSPGLQLSDL (MAGC3_HUMAN)
  misc_feature (2)..(2): Xaa can be Ala, Ser, Met, Val, Leu, Ile, or Thr
  misc_feature (10)..(10): Xaa can be Leu, Met, or Phe
GXPGLQLSDX

SEQ ID NO: 113139 - protein, 10 aa, Artificial Sequence
  Description of Artificial Sequence: Synthetic peptide
  Seed: GSQPEGKFSL (MAGC3_HUMAN)
  misc_feature (2)..(2): Xaa can be Ala, Thr, Ser, Val, Cys, Gly, Met, Asn, Asp, Gln, Pro, Phe, Ile, or Leu
  misc_feature (10)..(10): Xaa can be Trp, Phe, Lys, Leu, Tyr, Ile, Met, Val, or Arg
GXQPEGKFSX

SEQ ID NO: 113140 - protein, 11 aa, Artificial Sequence
  Description of Artificial Sequence: Synthetic peptide
  Seed: GSQPEGKFSLR (MAGC3_HUMAN)
  misc_feature (2)..(2): Xaa can be Ala, Ser, Thr, Val, Phe, Asn, Leu, Gln, Gly, Ile, Met, Cys, Glu, Asp, Tyr, or Trp
  misc_feature (11)..(11): Xaa can be Lys, Tyr, Arg, Phe, Leu, His, Trp, Met, or Ile
GXQPEGKFSLX

SEQ ID NO: 113141 - protein, 8 aa, Artificial Sequence
  Description of Artificial Sequence: Synthetic peptide
  Seed: GTGYTLSL (MAGC3_HUMAN)
  misc_feature (2)..(2): Xaa can be Ser, Ala, or Thr
  misc_feature (8)..(8): Xaa can be Leu, Phe, Met, Ile, or Tyr
GXGYTLSX

SEQ ID NO: 113142 - protein, 10 aa, Artificial Sequence
  Description of Artificial Sequence: Synthetic peptide
  Seed: GTSDQRMDSL (MAGC3_HUMAN)
  misc_feature (2)..(2): Xaa can be Leu, Val, Met, Ala, Thr, Gln, Ile, or Ser
  misc_feature (10)..(10): Xaa can be Leu, Val, Ile, Met, Ala, or Phe
GXSDQRMDSX

SEQ ID NO: 113143 - protein, 8 aa, Artificial Sequence
  Description of Artificial Sequence: Synthetic peptide
  Seed: GYFPMIFR (MAGC3_HUMAN)
  misc_feature (2)..(2): Xaa can be Trp, Thr, Met, Tyr, Phe, Ser, Ala, Arg, Leu, Gln, Gly, Val, Ile, Asn, or His
  misc_feature (8)..(8): Xaa can be Arg, or Lys
GXFPMIFX

SEQ ID NO: 113144 - protein, 9 aa, Artificial Sequence
  Description of Artificial Sequence: Synthetic peptide
  Seed: GYFPMIFRK (MAGC3_HUMAN)
  misc_feature (2)..(2): Xaa can be Met, Leu, Thr, Ile, Val, Gln, Tyr, Ser, Ala, Trp, Phe, Asn, Gly, His, Lys, Asp, Arg, Glu, Pro, or Cys
  misc_feature (9)..(9): Xaa can be Arg, Lys, Tyr, Phe, His, Trp, Leu, Val, Ile, Met, Ala, Thr, or Gln
GXFPMIFRX

SEQ ID NO: 113145 - protein, 11 aa, Artificial Sequence
  Description of Artificial Sequence: Synthetic peptide
  Seed: GYFPMIFRKAR (MAGC3_HUMAN)
  misc_feature (2)..(2): Xaa can be Gln, Met, Trp, Ser, Thr, Val, Ile, Tyr, Phe, Leu, Glu, Arg, Asp, Gly, Lys, His, Asn, or Al a
  misc_feature (11)..(11): Xaa can be Arg, or Lys
GXFPMIFRKAX

SEQ ID NO: 113146 - protein, 9 aa, Artificial Sequence
  Description of Artificial Sequence: Synthetic peptide
  Seed: GYTLSLPAV (MAGC3_HUMAN)
  misc_feature (2)..(2): Xaa can be Tyr, Phe, or Trp
  misc_feature (9)..(9): Xaa can be Phe, Tyr, Leu, Trp, Ile, Met, or Val
GXTLSLPAX

SEQ ID NO: 113147 - protein, 9 aa, Artificial Sequence
  Description of Artificial Sequence: Synthetic peptide
  Seed: HALPESESL (MAGC3_HUMAN)
  misc_feature (2)..(2): Xaa can be Pro, Arg, Glu, His, Gln, Ala, Asp, Leu, Met, Lys, Gly, Thr, Tyr, Ser, Asn, Ile, Phe, Val, Trp, or Cys
  misc_feature (9)..(9): Xaa can be Tyr, Val, Leu, Met, Phe, Arg, Ile, Lys, Trp, Ala, His, Cys, Thr, Pro, Glu, Ser, Gly, Gln, or Asn
HXLPESESX

SEQ ID NO: 113148 - protein, 11 aa, Artificial Sequence
  Description of Artificial Sequence: Synthetic peptide
  Seed: HALPESESLPR (MAGC3_HUMAN)
  misc_feature (2)..(2): Xaa can be Ala, Val, Thr, Ser, Arg, Ile, Gly, Met, Leu, Gln, Cys, Tyr, Asn, Glu, Asp, His, Pro, Phe, or Trp
  misc_feature (11)..(11): Xaa can be Lys, Arg, Tyr, Phe, His, Met, Leu, Trp, Gln, Ile, Ala, or Val
HXLPESESLPX

SEQ ID NO: 113149 - protein, 8 aa, Artificial Sequence
  Description of Artificial Sequence: Synthetic peptide
  Seed: HEFIELIF (MAGC3_HUMAN)
  misc_feature (2)..(2): Xaa can be Glu, Asp, Gln, Pro, Met, Val, Ser, or Ala
  misc_feature (8)..(8): Xaa can be Tyr, Leu, Phe, Trp, Ile, Val, Met, Ala, Cys, Thr, His, Pro, Ser, or Gly
HXFIELIX

SEQ ID NO: 113150 - protein, 9 aa, Artificial Sequence
  Description of Artificial Sequence: Synthetic peptide
  Seed: HEFIELIFG (MAGC3_HUMAN)
  misc_feature (2)..(2): Xaa can be Glu, Asp, or Gln
  misc_feature (9)..(9): Xaa can be Ile, Val, Cys, Ala, Leu, Thr, Met, Pro, Gly, Phe, Ser, Asp, Lys, Glu, or Tyr
HXFIELIFX

SEQ ID NO: 113151 - protein, 10 aa, Artificial Sequence
  Description of Artificial Sequence: Synthetic peptide
  Seed: HEFIELIFGI (MAGC3_HUMAN)
  misc_feature (2)..(2): Xaa can be Glu, Gln, Asp, or Met
  misc_feature (10)..(10): Xaa can be Leu, Phe, Met, Trp, Tyr, Val, Ile, Pro, Ala, Thr, Ser, Cys, or Gly
HXFIELIFGX

SEQ ID NO: 113152 - protein, 11 aa, Artificial Sequence
  Description of Artificial Sequence: Synthetic peptide
  Seed: HEFIELIFGIA (MAGC3_HUMAN)
  misc_feature (2)..(2): Xaa can be , or Glu
  misc_feature (11)..(11): Xaa can be Cys, Val, Ile, Met, Ala, or Leu
HXFIELIFGIX

SEQ ID NO: 113153 - protein, 9 aa, Artificial Sequence
  Description of Artificial Sequence: Synthetic peptide
  Seed: HFGSQPEGK (MAGC3_HUMAN)
  misc_feature (2)..(2): Xaa can be Gly, Arg, Ala, Val, Ser, Thr, Met, Phe, Gln, Ile, Leu, Asn, Asp, Trp, Tyr, Cys, Lys, Pro, or Glu
  misc_feature (9)..(9): Xaa can be Lys, Tyr, Arg, Leu, Phe, Met, Ile, Val, Glu, His, Gln, Trp, or Asn
HXGSQPEGX

SEQ ID NO: 113154 - protein, 10 aa, Artificial Sequence
  Description of Artificial Sequence: Synthetic peptide
  Seed: HFGSQPEGKF (MAGC3_HUMAN)
  misc_feature (2)..(2): Xaa can be Tyr, Arg, Phe, Trp, or His
  misc_feature (10)..(10): Xaa can be Tyr, Phe, Trp, Leu, or Met
HXGSQPEGKX

SEQ ID NO: 113155 - protein, 9 aa, Artificial Sequence
  Description of Artificial Sequence: Synthetic peptide
  Seed: HFYVFVNTL (MAGC3_HUMAN)
  misc_feature (2)..(2): Xaa can be Arg, Gln, Ala, His, Tyr, Met, Ser, Thr, Gly, Val, Ile, Glu, Asn, Phe, Leu, Lys, Trp, Pro, Asp, or Cys
  misc_feature (9)..(9): Xaa can be Phe, Ile, Leu, Tyr, Val, Met, Trp, Ala, Cys, His, Lys, Arg, Thr, Pro, Ser, Gln, Gly, Asn, or Glu
HXYVFVNTX

SEQ ID NO: 113156 - protein, 8 aa, Artificial Sequence
  Description of Artificial Sequence: Synthetic peptide
  Seed: HLGHLREV (MAGC3_HUMAN)
  misc_feature (2)..(2): Xaa can be Gln, Ala, Ile, Gly, Met, Ser, Val, Glu, Leu, Thr, or Asn
  misc_feature (8)..(8): Xaa can be Ile, Val, Leu, Met, or Phe
HXGHLREX

SEQ ID NO: 113157 - protein, 9 aa, Artificial Sequence
  Description of Artificial Sequence: Synthetic peptide
  Seed: HLGHLREVR (MAGC3_HUMAN)
  misc_feature (2)..(2): Xaa can be Val, Thr, Met, Phe, Ile, Trp, Ala, Ser, Tyr, Leu, Pro, Gln, Asp, Asn, Gly, or Glu
  misc_feature (9)..(9): Xaa can be Arg, Lys, or Tyr
HXGHLREVX

SEQ ID NO: 113158 - protein, 10 aa, Artificial Sequence
  Description of Artificial Sequence: Synthetic peptide
  Seed: HLGHLREVRL (MAGC3_HUMAN)
  misc_feature (2)..(2): Xaa can be Leu, or Met
  misc_feature (10)..(10): Xaa can be Leu, or Val
HXGHLREVRX

SEQ ID NO: 113159 - protein, 8 aa, Artificial Sequence
  Description of Artificial Sequence: Synthetic peptide
  Seed: HLREVRLF (MAGC3_HUMAN)
  misc_feature (2)..(2): Xaa can be Gln, Met, Asp, Ser, Val, Ala, Pro, Leu, Glu, Ile, Gly, Phe, Thr, His, Lys, Asn, or Tyr
  misc_feature (8)..(8): Xaa can be Tyr, Phe, Met, Leu, Ile, Val, or Trp
HXREVRLX

SEQ ID NO: 113160 - protein, 9 aa, Artificial Sequence
  Description of Artificial Sequence: Synthetic peptide
  Seed: HLREVRLFL (MAGC3_HUMAN)
  misc_feature (2)..(2): Xaa can be Met, Val, Ser, Thr, Gln, Ala, Leu, Phe, Ile, Tyr, Trp, Gly, Pro, Asn, Arg, Cys, Glu, Asp, His, or Lys
  misc_feature (9)..(9): Xaa can be Phe, Met, Leu, Tyr, Lys, Val, Ile, Arg, Trp, Ala, Thr, Pro, Gln, His, Ser, Gly, Cys, Asn, Glu, or Asp
HXREVRLFX

SEQ ID NO: 113161 - protein, 10 aa, Artificial Sequence
  Description of Artificial Sequence: Synthetic peptide
  Seed: HLREVRLFLR (MAGC3_HUMAN)
  misc_feature (2)..(2): Xaa can be Thr, Ile, Met, Val, Gly, Asn, Trp, Ser, Tyr, Leu, Ala, Gln, Phe, Cys, Pro, His, Asp, or Gl u
  misc_feature (10)..(10): Xaa can be Arg, Lys, or Tyr
HXREVRLFLX

SEQ ID NO: 113162 - protein, 10 aa, Artificial Sequence
  Description of Artificial Sequence: Synthetic peptide
  Seed: HRQEDGRRGL (MAGC3_HUMAN)
  misc_feature (2)..(2): Xaa can be Arg, His, Gln, Tyr, Phe, Gly, Met, Lys, Trp, Glu, Leu, Asn, Ala, Asp, or Ile
  misc_feature (10)..(10): Xaa can be Phe, Tyr, Leu, Lys, Met, Trp, Ile, Arg, Cys, Val, Pro, Ala, His, or Thr
HXQEDGRRGX

SEQ ID NO: 113163 - protein, 9 aa, Artificial Sequence
  Description of Artificial Sequence: Synthetic peptide
  Seed: HSYFFEDTL (MAGC3_HUMAN)
  misc_feature (2)..(2): Xaa can be Glu, Gln, Arg, Ala, Thr, Ile, Val, Ser, His, Asp, Met, Leu, Pro, Gly, Lys, Asn, Tyr, Phe, Trp, or Cys
  misc_feature (9)..(9): Xaa can be Tyr, Met, Trp, Leu, Phe, Val, Ile, Ala, Lys, His, Arg, Thr, Cys, Gly, Ser, or Pro
HXYFFEDTX

SEQ ID NO: 113164 - protein, 11 aa, Artificial Sequence
  Description of Artificial Sequence: Synthetic peptide
  Seed: HSYFFEDTLDL (MAGC3_HUMAN)
  misc_feature (2)..(2): Xaa can be Ser, Thr, Ala, Val, or Met
  misc_feature (11)..(11): Xaa can be Trp, Phe, Tyr, Met, or Leu
HXYFFEDTLDX

SEQ ID NO: 113165 - protein, 8 aa, Artificial Sequence
  Description of Artificial Sequence: Synthetic peptide
  Seed: HWVLDATF (MAGC3_HUMAN)
  misc_feature (2)..(2): Xaa can be Tyr, or Trp
  misc_feature (8)..(8): Xaa can be Phe, or Trp
HXVLDATX

SEQ ID NO: 113166 - protein, 8 aa, Artificial Sequence
  Description of Artificial Sequence: Synthetic peptide
  Seed: IDDQGMPK (MAGC3_HUMAN)
  misc_feature (2)..(2): Xaa can be Ser, Thr, Ala, Val, Ile, Phe, Gly, Gln, Asn, Met, Leu, Cys, Asp, Tyr, Glu, or Pro
  misc_feature (8)..(8): Xaa can be Lys, Leu, Arg, Tyr, Met, Phe, Ile, His, Val, or Trp
IXDQGMPX

SEQ ID NO: 113167 - protein, 11 aa, Artificial Sequence
  Description of Artificial Sequence: Synthetic peptide
  Seed: IDDQGMPKNCL (MAGC3_HUMAN)
  misc_feature (2)..(2): Xaa can be Ala, Thr, Ser, Glu, Ile, Leu, Val, Gly, Met, Pro, Phe, Gln, Cys, Asn, Tyr, Trp, or Asp
  misc_feature (11)..(11): Xaa can be Leu, Phe, Met, Ile, Val, Tyr, Trp, Cys, Ala, or Lys
IXDQGMPKNCX

SEQ ID NO: 113168 - protein, 9 aa, Artificial Sequence
  Description of Artificial Sequence: Synthetic peptide
  Seed: IDTTDDATA (MAGC3_HUMAN)
  misc_feature (2)..(2): Xaa can be Glu, or Asp
  misc_feature (9)..(9): Xaa can be Ala, Val, Ile, Thr, Gly, Met, Leu, Pro, Cys, Ser, or Phe
IXTTDDATX

SEQ ID NO: 113169 - protein, 9 aa, Artificial Sequence
  Description of Artificial Sequence: Synthetic peptide
  Seed: IEILFGISL (MAGC3_HUMAN)
  misc_feature (2)..(2): Xaa can be Glu, Gln, His, Arg, Asp, Ala, Pro, Lys, Met, Leu, Asn, Ile, Ser, Gly, Phe, Tyr, Thr, Val, Trp, or Cys
  misc_feature (9)..(9): Xaa can be Tyr, Met, Phe, Leu, Ile, Val, Trp, Ala, His, Cys, Pro, Thr, Ser, Gly, Lys, Arg, Glu, Asp, Asn, or Gln
IXILFGISX

SEQ ID NO: 113170 - protein, 10 aa, Artificial Sequence
  Description of Artificial Sequence: Synthetic peptide
  Seed: IEILFGISLT (MAGC3_HUMAN)
  misc_feature (2)..(2): Xaa can be , or Glu
  misc_feature (10)..(10): Xaa can be Phe, Met, Gln, Glu, Cys, Thr, Trp, His, Arg, Asp, Ser, Pro, Ile, Tyr, Leu, Asn, Lys, Gly, Val, or Ala
IXILFGISLX

SEQ ID NO: 113171 - protein, 8 aa, Artificial Sequence
  Description of Artificial Sequence: Synthetic peptide
  Seed: IELIFGIA (MAGC3_HUMAN)
  misc_feature (2)..(2): Xaa can be , or Glu
  misc_feature (8)..(8): Xaa can be Leu, Ile, Ala, or Val
IXLIFGIX

SEQ ID NO: 113172 - protein, 9 aa, Artificial Sequence
  Description of Artificial Sequence: Synthetic peptide
  Seed: IELIFGIAL (MAGC3_HUMAN)
  misc_feature (2)..(2): Xaa can be Glu, Arg, His, Gln, Asp, Lys, Pro, Ala, Asn, Met, Gly, Ser, Leu, Val, Ile, Thr, Tyr, Phe, or Cys
  misc_feature (9)..(9): Xaa can be Phe, Tyr, Met, Leu, Val, Ile, Ala, Trp, Cys, Thr, Pro, Gly, His, Ser, Glu, Lys, Gln, or As p
IXLIFGIAX

SEQ ID NO: 113173 - protein, 10 aa, Artificial Sequence
  Description of Artificial Sequence: Synthetic peptide
  Seed: IELIFGIALT (MAGC3_HUMAN)
  misc_feature (2)..(2): Xaa can be Glu, Met, Phe, Ser, Tyr, Leu, Cys, Lys, Arg, Gly, Ala, Ile, Trp, Gln, Asp, Val, Asn, His, Thr, or Pro
  misc_feature (10)..(10): Xaa can be Met, Leu, Ala, Thr, Ile, Val, Ser, or Cys
IXLIFGIALX

SEQ ID NO: 113174 - protein, 9 aa, Artificial Sequence
  Description of Artificial Sequence: Synthetic peptide
  Seed: IFGIALTDM (MAGC3_HUMAN)
  misc_feature (2)..(2): Xaa can be Tyr, Phe, Arg, Trp, Ala, Ser, His, Gln, Ile, Thr, Val, or Gly
  misc_feature (9)..(9): Xaa can be Leu, Met, Tyr, Phe, Ile, His, or Val
IXGIALTDX

SEQ ID NO: 113175 - protein, 8 aa, Artificial Sequence
  Description of Artificial Sequence: Synthetic peptide
  Seed: IFGKAHEF (MAGC3_HUMAN)
  misc_feature (2)..(2): Xaa can be Ala, Ser, Thr, Tyr, Ile, Val, Gly, Phe, Leu, Gln, Trp, Glu, His, Asn, Met, Arg, Asp, Cys, Pro, or Lys
  misc_feature (8)..(8): Xaa can be Trp, Phe, Tyr, Leu, Met, Ile, Val, His, Lys, Arg, Ala, Cys, Thr, or Gln
IXGKAHEX

SEQ ID NO: 113176 - protein, 9 aa, Artificial Sequence
  Description of Artificial Sequence: Synthetic peptide
  Seed: IFGKAHEFI (MAGC3_HUMAN)
  misc_feature (2)..(2): Xaa can be Tyr, Trp, Phe, Arg, Ala, Met, Gln, His, Val, Leu, Ser, Gly, Ile, Thr, Glu, or Asn
  misc_feature (9)..(9): Xaa can be Leu, Phe, Met, Ile, Val, Trp, Tyr, or Cys
IXGKAHEFX

SEQ ID NO: 113177 - protein, 8 aa, Artificial Sequence
  Description of Artificial Sequence: Synthetic peptide
  Seed: IFIKGSCV (MAGC3_HUMAN)
  misc_feature (2)..(2): Xaa can be Tyr, Phe, or Trp
  misc_feature (8)..(8): Xaa can be Phe, Tyr, Met, Leu, Val, or Ile
IXIKGSCX

SEQ ID NO: 113178 - protein, 8 aa, Artificial Sequence
  Description of Artificial Sequence: Synthetic peptide
  Seed: IFRKAREF (MAGC3_HUMAN)
  misc_feature (2)..(2): Xaa can be Ala, Thr, Phe, Tyr, Ser, Val, Trp, Arg, Met, Gly, Leu, Ile, His, or Gln
  misc_feature (8)..(8): Xaa can be Leu, Phe, Tyr, Met, Ile, Val, or Trp
IXRKAREX

SEQ ID NO: 113179 - protein, 9 aa, Artificial Sequence
  Description of Artificial Sequence: Synthetic peptide
  Seed: IFRKAREFI (MAGC3_HUMAN)
  misc_feature (2)..(2): Xaa can be Val, Thr, Ser, Met, Phe, Ile, Tyr, Trp, Leu, Gln, Ala, Gly, Asn, His, Cys, Arg, or Lys
  misc_feature (9)..(9): Xaa can be Lys, Ala, Val, Ile, Ser, Met, Tyr, Leu, Arg, Phe, Gly, Thr, Pro, Glu, Gln, Asn, His, Cys, or Trp
IXRKAREFX

SEQ ID NO: 113180 - protein, 9 aa, Artificial Sequence
  Description of Artificial Sequence: Synthetic peptide
  Seed: IGPIQRPAR (MAGC3_HUMAN)
  misc_feature (2)..(2): Xaa can be Met, Ser, Trp, Ala, Gln, Thr, Asn, Gly, Tyr, Phe, Leu, Val, or Ile
  misc_feature (9)..(9): Xaa can be , or Arg
IXPIQRPAX

SEQ ID NO: 113181 - protein, 10 aa, Artificial Sequence
  Description of Artificial Sequence: Synthetic peptide
  Seed: IGPWSALAGF (MAGC3_HUMAN)
  misc_feature (2)..(2): Xaa can be Ile, Leu, Phe, Thr, Trp, Lys, Gly, Pro, Glu, Ser, Asn, Asp, Ala, Val, Gln, Tyr, His, Met, Cys, or Arg
  misc_feature (10)..(10): Xaa can be Met, Phe, Tyr, or Trp
IXPWSALAGX

SEQ ID NO: 113182 - protein, 9 aa, Artificial Sequence
  Description of Artificial Sequence: Synthetic peptide
  Seed: IIDTTDDAT (MAGC3_HUMAN)
  misc_feature (2)..(2): Xaa can be Ile, Ala, Ser, Thr, Met, Phe, Val, Leu, Gly, Asn, Cys, Gln, Tyr, Trp, Pro, Asp, Glu, His, Lys, or Arg
  misc_feature (9)..(9): Xaa can be Met, Leu, Phe, Ile, Val, Tyr, Trp, Ala, Cys, Thr, or Lys
IXDTTDDAX

SEQ ID NO: 113183 - protein, 10 aa, Artificial Sequence
  Description of Artificial Sequence: Synthetic peptide
  Seed: IIDTTDDATA (MAGC3_HUMAN)
  misc_feature (2)..(2): Xaa can be Ala, Val, Ile, Met, Thr, Leu, Ser, Gln, Gly, Phe, Cys, Asn, Trp, Tyr, Pro, Glu, Asp, or Ly s
  misc_feature (10)..(10): Xaa can be Leu, Phe, Met, Val, Ile, Tyr, Trp, Lys, Cys, Arg, Ala, or Thr
IXDTTDDATX

SEQ ID NO: 113184 - protein, 11 aa, Artificial Sequence
  Description of Artificial Sequence: Synthetic peptide
  Seed: IIDTTDDATAM (MAGC3_HUMAN)
  misc_feature (2)..(2): Xaa can be Ala, Thr, Ile, Tyr, Phe, Ser, Val, Leu, Met, Trp, Gly, Cys, Gln, Asn, Arg, His, Pro, Asp, Glu, or Lys
  misc_feature (11)..(11): Xaa can be Leu, Lys, Phe, Met, Arg, Ile, Trp, Tyr, Val, His, Cys, Ala, Thr, Gln, Ser, Glu, Asn, Pro, or Gly
IXDTTDDATAX

SEQ ID NO: 113185 - protein, 9 aa, Artificial Sequence
  Description of Artificial Sequence: Synthetic peptide
  Seed: IIPSAFPSW (MAGC3_HUMAN)
  misc_feature (2)..(2): Xaa can be Ala, Val, Tyr, Ser, Ile, Thr, Gly, Gln, Leu, Met, Trp, Asn, Pro, Cys, Phe, Glu, His, Arg, Asp, or Lys
  misc_feature (9)..(9): Xaa can be Met, Leu, Trp, Phe, Tyr, Ile, Val, Cys, Ala, His, Lys, Arg, Thr, Ser, Gly, Gln, or Pro
IXPSAFPSX

SEQ ID NO: 113186 - protein, 10 aa, Artificial Sequence
  Description of Artificial Sequence: Synthetic peptide
  Seed: IIPSAFPSWY (MAGC3_HUMAN)
  misc_feature (2)..(2): Xaa can be Met, Gln, Ala, Phe, Thr, Ser, Val, Ile, Leu, Gly, Asn, Glu, Arg, Cys, Tyr, Pro, Lys, His, Trp, or Asp
  misc_feature (10)..(10): Xaa can be Tyr, Lys, Phe, Met, or Arg
IXPSAFPSWX

SEQ ID NO: 113187 - protein, 11 aa, Artificial Sequence
  Description of Artificial Sequence: Synthetic peptide
  Seed: IIPSAFPSWYM (MAGC3_HUMAN)
  misc_feature (2)..(2): Xaa can be Asn, Arg, Gly, Phe, Pro, His, Thr, Lys, Leu, Ile, Met, Trp, Ser, Gln, Asp, Val, Glu, Tyr, Ala, or Cys
  misc_feature (11)..(11): Xaa can be Trp, Phe, Tyr, or Met
IXPSAFPSWYX

SEQ ID NO: 113188 - protein, 10 aa, Artificial Sequence
  Description of Artificial Sequence: Synthetic peptide
  Seed: IKKYKDYFPM (MAGC3_HUMAN)
  misc_feature (2)..(2): Xaa can be Gln, Met, Phe, Glu, Gly, Arg, Ile, Thr, Cys, Tyr, Ser, His, Ala, Trp, Asn, Asp, Lys, Leu, Val, or Pro
  misc_feature (10)..(10): Xaa can be Tyr, Phe, Met, Leu, Trp, Ile, His, or Val
IXKYKDYFPX

SEQ ID NO: 113189 - protein, 11 aa, Artificial Sequence
  Description of Artificial Sequence: Synthetic peptide
  Seed: IKKYKDYFPMI (MAGC3_HUMAN)
  misc_feature (2)..(2): Xaa can be Tyr, Arg, Phe, Thr, Ser, Lys, Leu, Glu, Gln, Val, Pro, His, Ile, Asn, Asp, Cys, Gly, Trp, Ala, or Met
  misc_feature (11)..(11): Xaa can be Phe, Trp, Leu, Ile, or Met
IXKYKDYFPMX

SEQ ID NO: 113190 - protein, 10 aa, Artificial Sequence
  Description of Artificial Sequence: Synthetic peptide
  Seed: ILFGISLTEV (MAGC3_HUMAN)
  misc_feature (2)..(2): Xaa can be Leu, Met, Gln, Val, Thr, Ile, Ala, Ser, Glu, Gly, Cys, Asp, Pro, Asn, Phe, Tyr, or Trp
  misc_feature (10)..(10): Xaa can be Lys, Arg, Val, Leu, Ile, Ala, Met, Tyr, Thr, Phe, Cys, Ser, Pro, Gly, or Trp
IXFGISLTEX

SEQ ID NO: 113191 - protein, 11 aa, Artificial Sequence
  Description of Artificial Sequence: Synthetic peptide
  Seed: ILFGISLTEVD (MAGC3_HUMAN)
  misc_feature (2)..(2): Xaa can be Met, Ile, Leu, Gln, Val, or Thr
  misc_feature (11)..(11): Xaa can be Val, Leu, Ile, Met, Ala, Ser, Tyr, Gln, Asp, His, Thr, Arg, Lys, Pro, Asn, Phe, Trp, Glu, Gly, or Cys
IXFGISLTEVX

SEQ ID NO: 113192 - protein, 8 aa, Artificial Sequence
  Description of Artificial Sequence: Synthetic peptide
  Seed: ILILSMIF (MAGC3_HUMAN)
  misc_feature (2)..(2): Xaa can be Gln, Met, Lys, Ser, Arg, Ala, Glu, His, Leu, Ile, Val, or Thr
  misc_feature (8)..(8): Xaa can be Tyr, Phe, Leu, Met, Trp, or Ile
IXILSMIX

SEQ ID NO: 113193 - protein, 9 aa, Artificial Sequence
  Description of Artificial Sequence: Synthetic peptide
  Seed: ILILSMIFI (MAGC3_HUMAN)
  misc_feature (2)..(2): Xaa can be Gln, Met, Leu, Ile, Val, Thr, Ala, Ser, Gly, or Asn
  misc_feature (9)..(9): Xaa can be Val, Leu, Ile, Ala, Met, Thr, or Ser
IXILSMIFX

SEQ ID NO: 113194 - protein, 10 aa, Artificial Sequence
  Description of Artificial Sequence: Synthetic peptide
  Seed: ILILSMIFIK (MAGC3_HUMAN)
  misc_feature (2)..(2): Xaa can be Thr, Val, Asp, Asn, Lys, Ile, Gln, Ala, Phe, Glu, Tyr, Cys, Arg, Ser, Pro, Gly, Leu, Met, Trp, or His
  misc_feature (10)..(10): Xaa can be Arg, Lys, or Tyr
IXILSMIFIX

SEQ ID NO: 113195 - protein, 9 aa, Artificial Sequence
  Description of Artificial Sequence: Synthetic peptide
  Seed: ILILSVIFI (MAGC3_HUMAN)
  misc_feature (2)..(2): Xaa can be Leu, Met, Gln, Val, Ile, Thr, Ser, Ala, Glu, Asn, or Gly
  misc_feature (9)..(9): Xaa can be Val, Leu, Ala, Ile, Met, Thr, Ser, Cys, or Phe
IXILSVIFX

SEQ ID NO: 113196 - protein, 10 aa, Artificial Sequence
  Description of Artificial Sequence: Synthetic peptide
  Seed: ILILSVIFIK (MAGC3_HUMAN)
  misc_feature (2)..(2): Xaa can be Thr, Ser, Lys, Asp, Gly, Gln, Pro, Arg, Trp, Val, His, Cys, Ile, Met, Phe, Tyr, Glu, Ala, Asn, or Leu
  misc_feature (10)..(10): Xaa can be Lys, Arg, or Tyr
IXILSVIFIX

SEQ ID NO: 113197 - protein, 8 aa, Artificial Sequence
  Description of Artificial Sequence: Synthetic peptide
  Seed: ILSMIFIK (MAGC3_HUMAN)
  misc_feature (2)..(2): Xaa can be Leu, or Met
  misc_feature (8)..(8): Xaa can be , or Lys
IXSMIFIX

SEQ ID NO: 113198 - protein, 10 aa, Artificial Sequence
  Description of Artificial Sequence: Synthetic peptide
  Seed: INTYTGYFPM (MAGC3_HUMAN)
  misc_feature (2)..(2): Xaa can be Gln, Met, Tyr, Ser, Ile, Thr, Cys, Asp, Phe, Gly, Pro, Lys, Arg, His, Val, Asn, Glu, Leu, Ala, or Trp
  misc_feature (10)..(10): Xaa can be Leu, Phe, Tyr, Met, Trp, Ile, His, Ala, or Val
IXTYTGYFPX

SEQ ID NO: 113199 - protein, 11 aa, Artificial Sequence
  Description of Artificial Sequence: Synthetic peptide
  Seed: INTYTGYFPMI (MAGC3_HUMAN)
  misc_feature (2)..(2): Xaa can be Tyr, Asn, Asp, Glu, Met, Ser, Ile, His, Pro, Ala, Thr, Arg, Phe, Gln, Leu, Val, Lys, Trp, Gly, or Cys
  misc_feature (11)..(11): Xaa can be Ile, Met, Leu, Trp, Phe, or Val
IXTYTGYFPMX

SEQ ID NO: 113200 - protein, 9 aa, Artificial Sequence
  Description of Artificial Sequence: Synthetic peptide
  Seed: IPPQGPPKI (MAGC3_HUMAN)
  misc_feature (2)..(2): Xaa can be Ala, Pro, Tyr, Gln, Gly, Arg, Phe, Leu, Met, Ile, Ser, Val, Thr, His, Trp, Cys, Asn, Glu, Asp, or Lys
  misc_feature (9)..(9): Xaa can be Ile, Phe, Tyr, Val, Leu, Met, Ala, Cys, Lys, Trp, His, Thr, Arg, Pro, Ser, Gln, or Gly
IXPQGPPKX

SEQ ID NO: 113201 - protein, 10 aa, Artificial Sequence
  Description of Artificial Sequence: Synthetic peptide
  Seed: IPPQGPPKIS (MAGC3_HUMAN)
  misc_feature (2)..(2): Xaa can be Pro, Ala, or Val
  misc_feature (10)..(10): Xaa can be Leu, Met, Ala, Gly, Ile, Trp, Phe, Tyr, Pro, Cys, Thr, Val, Arg, Ser, or Lys
IXPQGPPKIX

SEQ ID NO: 113202 - protein, 11 aa, Artificial Sequence
  Description of Artificial Sequence: Synthetic peptide
  Seed: IPPQGPPKISP (MAGC3_HUMAN)
  misc_feature (2)..(2): Xaa can be Pro, Ala, or Val
  misc_feature (11)..(11): Xaa can be Leu, Ala, Met, Cys, Val, Gln, Ile, Lys, Pro, Phe, Arg, Tyr, His, Gly, Trp, Ser, or Thr
IXPQGPPKISX

SEQ ID NO: 113203 - protein, 8 aa, Artificial Sequence
  Description of Artificial Sequence: Synthetic peptide
  Seed: IPSAFPSW (MAGC3_HUMAN)
  misc_feature (2)..(2): Xaa can be Pro, Asn, Gln, Gly, Ile, Leu, Ala, Cys, Met, Asp, Phe, Ser, Val, or Thr
  misc_feature (8)..(8): Xaa can be Trp, Met, Tyr, Phe, or Leu
IXSAFPSX

SEQ ID NO: 113204 - protein, 9 aa, Artificial Sequence
  Description of Artificial Sequence: Synthetic peptide
  Seed: IPSAFPSWY (MAGC3_HUMAN)
  misc_feature (2)..(2): Xaa can be Pro, Ala, Met, Gln, Ser, Ile, Phe, Thr, Val, Trp, Leu, Tyr, Asn, Cys, Glu, Gly, Asp, His, or Lys
  misc_feature (9)..(9): Xaa can be Tyr, Phe, Trp, Met, Leu, Ala, Ile, His, or Val
IXSAFPSWX

SEQ ID NO: 113205 - protein, 10 aa, Artificial Sequence
  Description of Artificial Sequence: Synthetic peptide
  Seed: IPSAFPSWYM (MAGC3_HUMAN)
  misc_feature (2)..(2): Xaa can be Pro, Ser, Ala, Thr, His, Arg, Met, Leu, Glu, Gln, Gly, Asn, Ile, Trp, Val, Tyr, Cys, Lys, Phe, or Asp
  misc_feature (10)..(10): Xaa can be Ile, Leu, Phe, Trp, Met, Tyr, Gly, Val, Cys, Ala, Asn, Pro, Thr, Asp, or Ser
IXSAFPSWYX

SEQ ID NO: 113206 - protein, 8 aa, Artificial Sequence
  Description of Artificial Sequence: Synthetic peptide
  Seed: IQRPAREV (MAGC3_HUMAN)
  misc_feature (2)..(2): Xaa can be Ala, Gln, Ser, Val, Gly, Ile, Thr, Asn, Asp, Leu, Glu, Met, Tyr, Arg, Cys, His, Phe, Pro, Lys, or Trp
  misc_feature (8)..(8): Xaa can be Tyr, Leu, Phe, Met, Ile, Val, His, Ala, Trp, Thr, Gln, Cys, Lys, or Arg
IXRPAREX

SEQ ID NO: 113207 - protein, 9 aa, Artificial Sequence
  Description of Artificial Sequence: Synthetic peptide
  Seed: IQRPAREVL (MAGC3_HUMAN)
  misc_feature (2)..(2): Xaa can be Pro, Glu, Ala, His, Arg, Ser, Gln, Met, Ile, Phe, Tyr, Val, Asp, Gly, Thr, Leu, Trp, Asn, Lys, or Cys
  misc_feature (9)..(9): Xaa can be Phe, Met, Tyr, Ile, Leu, Val, Trp, Ala, His, Cys, Thr, Lys, Gln, Pro, Arg, Ser, Gly, Glu, or Asn
IXRPAREVX

SEQ ID NO: 113208 - protein, 11 aa, Artificial Sequence
  Description of Artificial Sequence: Synthetic peptide
  Seed: IQRPAREVLEF (MAGC3_HUMAN)
  misc_feature (2)..(2): Xaa can be Ala, Arg, Gln, Met, Val, Ser, Tyr, His, Thr, Ile, Leu, Gly, Phe, Lys, Glu, Pro, Trp, or As n
  misc_feature (11)..(11): Xaa can be Phe, Tyr, Met, Leu, His, Trp, Ile, or Val
IXRPAREVLEX

SEQ ID NO: 113209 - protein, 11 aa, Artificial Sequence
  Description of Artificial Sequence: Synthetic peptide
  Seed: ISLTEVDPDHF (MAGC3_HUMAN)
  misc_feature (2)..(2): Xaa can be Ser, Thr, Ala, Ile, Gly, Cys, Val, Met, Leu, Pro, Glu, Asn, Trp, Phe, Asp, Tyr, or Gln
  misc_feature (11)..(11): Xaa can be Trp, Phe, Tyr, Leu, Met, or Ile
IXLTEVDPDHX

SEQ ID NO: 113210 - protein, 9 aa, Artificial Sequence
  Description of Artificial Sequence: Synthetic peptide
  Seed: ISPQGPPQS (MAGC3_HUMAN)
  misc_feature (2)..(2): Xaa can be Ala, Ser, Val, Ile, Met, Thr, Leu, Gly, Gln, Cys, Tyr, Phe, Pro, His, Trp, Asp, Glu, Arg, Asn, or Lys
  misc_feature (9)..(9): Xaa can be Ile, Met, Leu, Val, Phe, Cys, Ala, Tyr, Thr, Trp, Ser, Lys, Arg, Pro, His, Gln, or Gly
IXPQGPPQX

SEQ ID NO: 113211 - protein, 8 aa, Artificial Sequence
  Description of Artificial Sequence: Synthetic peptide
  Seed: IWEVLNAI (MAGC3_HUMAN)
  misc_feature (2)..(2): Xaa can be Tyr, Phe, Trp, Asp, Thr, Ser, or Ala
  misc_feature (8)..(8): Xaa can be Leu, Phe, Met, Ile, or Val
IXEVLNAX

SEQ ID NO: 113212 - protein, 11 aa, Artificial Sequence
  Description of Artificial Sequence: Synthetic peptide
  Seed: IWEVLNAIGPW (MAGC3_HUMAN)
  misc_feature (2)..(2): Xaa can be Tyr, Ser, Thr, Trp, Phe, Leu, Cys, Glu, Lys, Asp, Ile, Met, Val, Asn, Gly, Arg, Pro, His, Ala, or Gln
  misc_feature (11)..(11): Xaa can be Trp, Phe, Tyr, Ile, or Leu
IXEVLNAIGPX

SEQ ID NO: 113213 - protein, 8 aa, Artificial Sequence
  Description of Artificial Sequence: Synthetic peptide
  Seed: IWEVLSAI (MAGC3_HUMAN)
  misc_feature (2)..(2): Xaa can be Phe, Trp, Tyr, or Ala
  misc_feature (8)..(8): Xaa can be Leu, Met, Ile, Phe, or Val
IXEVLSAX

SEQ ID NO: 113214 - protein, 8 aa, Artificial Sequence
  Description of Artificial Sequence: Synthetic peptide
  Seed: KAEMLTTV (MAGC3_HUMAN)
  misc_feature (2)..(2): Xaa can be Gln, Ala, Ser, or Thr
  misc_feature (8)..(8): Xaa can be Ile, Leu, or Val
KXEMLTTX

SEQ ID NO: 113215 - protein, 9 aa, Artificial Sequence
  Description of Artificial Sequence: Synthetic peptide
  Seed: KAEMLTTVI (MAGC3_HUMAN)
  misc_feature (2)..(2): Xaa can be Gln, Ser, Ala, Glu, Leu, Thr, Gly, Tyr, Met, Ile, Phe, Val, Asn, Arg, His, Cys, Pro, Asp, Trp, or Lys
  misc_feature (9)..(9): Xaa can be Leu, Met, Trp, Phe, Val, Ile, Tyr, His, or Ala
KXEMLTTVX

SEQ ID NO: 113216 - protein, 10 aa, Artificial Sequence
  Description of Artificial Sequence: Synthetic peptide
  Seed: KAEMLTTVIK (MAGC3_HUMAN)
  misc_feature (2)..(2): Xaa can be Thr, Val, Ser, Tyr, Met, Leu, Ile, Ala, Gly, Trp, Gln, Phe, His, Asn, or Cys
  misc_feature (10)..(10): Xaa can be Arg, Lys, Tyr, Ala, Val, Ile, Met, Ser, or Leu
KXEMLTTVIX

SEQ ID NO: 113217 - protein, 11 aa, Artificial Sequence
  Description of Artificial Sequence: Synthetic peptide
  Seed: KAEMLTTVIKK (MAGC3_HUMAN)
  misc_feature (2)..(2): Xaa can be Met, Thr, Val, Gly, Pro, Leu, Tyr, Lys, Asn, Ile, Phe, Trp, Asp, Ser, Cys, Glu, Arg, Gln, His, or Ala
  misc_feature (11)..(11): Xaa can be Lys, or Arg
KXEMLTTVIKX

SEQ ID NO: 113218 - protein, 11 aa, Artificial Sequence
  Description of Artificial Sequence: Synthetic peptide
  Seed: KAGSLPESEPL (MAGC3_HUMAN)
  misc_feature (2)..(2): Xaa can be Ala, Val, Ser, or Thr
  misc_feature (11)..(11): Xaa can be Tyr, Phe, His, Met, Lys, or Leu
KXGSLPESEPX

SEQ ID NO: 113219 - protein, 8 aa, Artificial Sequence
  Description of Artificial Sequence: Synthetic peptide
  Seed: KAHEFIEL (MAGC3_HUMAN)
  misc_feature (2)..(2): Xaa can be Arg, Ala, Ile, Gly, Val, Gln, Thr, Ser, Asp, Tyr, Phe, Met, Leu, Asn, Trp, Pro, His, Glu, Cys, or Lys
  misc_feature (8)..(8): Xaa can be Met, Tyr, Leu, Phe, Val, Ile, Trp, His, Lys, Arg, Ala, Gln, or Cys
KXHEFIEX

SEQ ID NO: 113220 - protein, 9 aa, Artificial Sequence
  Description of Artificial Sequence: Synthetic peptide
  Seed: KAHEFIELI (MAGC3_HUMAN)
  misc_feature (2)..(2): Xaa can be Arg, Glu, Leu, Met, Gln, Ala, Ile, Val, Ser, Tyr, Thr, Pro, His, Phe, Asp, Trp, Asn, Gly, Lys, or Cys
  misc_feature (9)..(9): Xaa can be Val, Lys, Ile, Leu, Trp, Tyr, Met, Phe, Arg, His, Cys, Ala, Thr, Ser, Gln, Gly, Pro, Glu, or Asn
KXHEFIELX

SEQ ID NO: 113221 - protein, 10 aa, Artificial Sequence
  Description of Artificial Sequence: Synthetic peptide
  Seed: KAHEFIELIF (MAGC3_HUMAN)
  misc_feature (2)..(2): Xaa can be Arg, Val, Ala, Thr, Gln, Ser, Ile, Met, Leu, Tyr, Phe, Glu, Lys, Gly, Cys, His, Asn, Pro, Trp, or Asp
  misc_feature (10)..(10): Xaa can be Phe, Tyr, Trp, Leu, Met, Ile, Val, Lys, His, Arg, Cys, or Ala
KXHEFIELIX

SEQ ID NO: 113222 - protein, 8 aa, Artificial Sequence
  Description of Artificial Sequence: Synthetic peptide
  Seed: KAREFIEI (MAGC3_HUMAN)
  misc_feature (2)..(2): Xaa can be Ala, Thr, Val, Ser, Gln, Ile, Glu, Gly, Asp, Met, Leu, Arg, His, Asn, Cys, Tyr, or Phe
  misc_feature (8)..(8): Xaa can be Leu, Ile, Tyr, Met, Val, Phe, His, Ala, or Lys
KXREFIEX

SEQ ID NO: 113223 - protein, 9 aa, Artificial Sequence
  Description of Artificial Sequence: Synthetic peptide
  Seed: KAREFIEIL (MAGC3_HUMAN)
  misc_feature (2)..(2): Xaa can be Ser, Thr, Val, Ile, Met, Pro, Tyr, Ala, Arg, Gln, Leu, Phe, Trp, Gly, Asn, Glu, Cys, Asp, Lys, or His
  misc_feature (9)..(9): Xaa can be Leu, Val, Phe, Lys, Met, Trp, Tyr, Ile, Arg, His, Ala, Ser, Thr, Gly, Cys, Gln, Pro, Asn, or Glu
KXREFIEIX

SEQ ID NO: 113224 - protein, 10 aa, Artificial Sequence
  Description of Artificial Sequence: Synthetic peptide
  Seed: KAREFIEILF (MAGC3_HUMAN)
  misc_feature (2)..(2): Xaa can be Ser, Thr, Val, Tyr, Met, Ile, Ala, Phe, Gln, Trp, Gly, Arg, Leu, Asn, Lys, Cys, His, Glu, Asp, or Pro
  misc_feature (10)..(10): Xaa can be Leu, Phe, Ile, Met, Tyr, Trp, Lys, Val, Ala, Ser, Arg, Gly, Thr, His, Pro, Gln, Cys, Asn, or Glu
KXREFIEILX

SEQ ID NO: 113225 - protein, 9 aa, Artificial Sequence
  Description of Artificial Sequence: Synthetic peptide
  Seed: KATDKDYSA (MAGC3_HUMAN)
  misc_feature (2)..(2): Xaa can be Ala, Val, Ile, Ser, Thr, Met, Gly, Leu, Cys, Gln, Phe, Asn, Glu, Tyr, or Pro
  misc_feature (9)..(9): Xaa can be Phe, Tyr, Leu, Met, Ile, Val, Trp, Lys, His, Arg, or Ala
KXTDKDYSX

SEQ ID NO: 113226 - protein, 10 aa, Artificial Sequence
  Description of Artificial Sequence: Synthetic peptide
  Seed: KATDKDYSAF (MAGC3_HUMAN)
  misc_feature (2)..(2): Xaa can be Arg, Val, Ser, Ala, Thr, Gln, Met, Leu, Ile, Phe, Tyr, Glu, Lys, His, Asn, Cys, Pro, Trp, Gly, or Asp
  misc_feature (10)..(10): Xaa can be Phe, Trp, Tyr, Met, Leu, Ile, Val, His, or Lys
KXTDKDYSAX

SEQ ID NO: 113227 - protein, 11 aa, Artificial Sequence
  Description of Artificial Sequence: Synthetic peptide
  Seed: KATDKDYSAFH (MAGC3_HUMAN)
  misc_feature (2)..(2): Xaa can be Ala, Val, Ile, Thr, Ser, Gln, or Met
  misc_feature (11)..(11): Xaa can be Tyr, Phe, Met, Leu, or His
KXTDKDYSAFX

SEQ ID NO: 113228 - protein, 9 aa, Artificial Sequence
  Description of Artificial Sequence: Synthetic peptide
  Seed: KDMEDRAQA (MAGC3_HUMAN)
  misc_feature (2)..(2): Xaa can be Glu, Asp, or Gln
  misc_feature (9)..(9): Xaa can be Leu, Ala, Met, Ile, Phe, Val, Cys, Pro, Thr, Tyr, Trp, Lys, Arg, Gly, Ser, His, Asn, Glu, Asp, or Gln
KXMEDRAQX

SEQ ID NO: 113229 - protein, 10 aa, Artificial Sequence
  Description of Artificial Sequence: Synthetic peptide
  Seed: KDMEDRAQAI (MAGC3_HUMAN)
  misc_feature (2)..(2): Xaa can be Glu, Asp, or Gln
  misc_feature (10)..(10): Xaa can be Trp, Cys, Leu, Met, Phe, Ile, Ala, Tyr, Val, Ser, Pro, Thr, Arg, Gly, Glu, Asn, Gln, Asp, His, or Lys
KXMEDRAQAX

SEQ ID NO: 113230 - protein, 11 aa, Artificial Sequence
  Description of Artificial Sequence: Synthetic peptide
  Seed: KDMEDRAQAII (MAGC3_HUMAN)
  misc_feature (2)..(2): Xaa can be Glu, Asp, or Gln
  misc_feature (11)..(11): Xaa can be Phe, Leu, Met, Cys, Ile, Val, Ala, Trp, Thr, Tyr, Gln, Glu, Ser, Lys, Pro, Gly, or Asp
KXMEDRAQAIX

SEQ ID NO: 113231 - protein, 8 aa, Artificial Sequence
  Description of Artificial Sequence: Synthetic peptide
  Seed: KDSDLPTW (MAGC3_HUMAN)
  misc_feature (2)..(2): Xaa can be Glu, Thr, Asp, Ser, Val, Gly, Asn, Met, Ala, Pro, Gln, Phe, Trp, Leu, Cys, or Ile
  misc_feature (8)..(8): Xaa can be Trp, Phe, Tyr, Met, Leu, or Ile
KXSDLPTX

SEQ ID NO: 113232 - protein, 9 aa, Artificial Sequence
  Description of Artificial Sequence: Synthetic peptide
  Seed: KDSDLPTWR (MAGC3_HUMAN)
  misc_feature (2)..(2): Xaa can be Leu, Met, Ile, Val, Thr, Gln, Ser, Ala, Glu, Phe, Asn, Pro, Gly, Tyr, Trp, Cys, Lys, His, Asp, or Arg
  misc_feature (9)..(9): Xaa can be Arg, Lys, Tyr, Met, His, Val, Leu, Ile, Phe, or Ala
KXSDLPTWX

SEQ ID NO: 113233 - protein, 10 aa, Artificial Sequence
  Description of Artificial Sequence: Synthetic peptide
  Seed: KDSDLPTWRR (MAGC3_HUMAN)
  misc_feature (2)..(2): Xaa can be Phe, Met, Val, Leu, Thr, Tyr, Ile, Gly, Ser, Ala, Trp, Gln, Lys, His, Pro, Arg, Cys, Glu, Asp, or Asn
  misc_feature (10)..(10): Xaa can be Arg, Lys, His, Tyr, Ile, Thr, Gln, Trp, Met, Gly, Glu, Leu, Ala, Pro, Ser, Phe, Asn, Cys, Asp, or Val
KXSDLPTWRX

SEQ ID NO: 113234 - protein, 8 aa, Artificial Sequence
  Description of Artificial Sequence: Synthetic peptide
  Seed: KDYFPMIF (MAGC3_HUMAN)
  misc_feature (2)..(2): Xaa can be Glu, or Asp
  misc_feature (8)..(8): Xaa can be Phe, Val, Met, Leu, or Ile
KXYFPMIX

SEQ ID NO: 113235 - protein, 10 aa, Artificial Sequence
  Description of Artificial Sequence: Synthetic peptide
  Seed: KDYFPMIFGK (MAGC3_HUMAN)
  misc_feature (2)..(2): Xaa can be Thr, Ser, Val, Met, Trp, Ala, Tyr, Ile, Gln, Gly, Phe, Asn, Lys, Arg, Leu, Asp, Pro, Cys, Glu, or His
  misc_feature (10)..(10): Xaa can be His, Lys, Arg, Tyr, Ala, Val, Ile, Leu, Met, Ser, Gly, Phe, Thr, or Gln
KXYFPMIFGX

SEQ ID NO: 113236 - protein, 8 aa, Artificial Sequence
  Description of Artificial Sequence: Synthetic peptide
  Seed: KDYSAFHL (MAGC3_HUMAN)
  misc_feature (2)..(2): Xaa can be Glu, Asp, Gln, Ser, Met, Ala, Gly, Val, or Leu
  misc_feature (8)..(8): Xaa can be Ile, Val, Leu, Met, Phe, Ala, Pro, Cys, Thr, or Ser
KXYSAFHX

SEQ ID NO: 113237 - protein, 9 aa, Artificial Sequence
  Description of Artificial Sequence: Synthetic peptide
  Seed: KEPLTRAEM (MAGC3_HUMAN)
  misc_feature (2)..(2): Xaa can be Glu, Arg, Ala, Asp, Gln, Met, Thr, Val, Ser, Ile, Gly, Phe, Leu, His, Tyr, Asn, Lys, Cys, Trp, or Pro
  misc_feature (9)..(9): Xaa can be Phe, Met, Tyr, Leu, Ile, Val, His, Trp, Ala, Cys, Ser, Pro, Gly, or Thr
KXPLTRAEX

SEQ ID NO: 113238 - protein, 11 aa, Artificial Sequence
  Description of Artificial Sequence: Synthetic peptide
  Seed: KEPLTRAEMQM (MAGC3_HUMAN)
  misc_feature (2)..(2): Xaa can be , or Glu
  misc_feature (11)..(11): Xaa can be Cys, Phe, Leu, Ile, Met, or Val
KXPLTRAEMQX

SEQ ID NO: 113239 - protein, 9 aa, Artificial Sequence
  Description of Artificial Sequence: Synthetic peptide
  Seed: KEPVTKAEM (MAGC3_HUMAN)
  misc_feature (2)..(2): Xaa can be Glu, Arg, Ala, Asp, Gln, Ile, Gly, Thr, Tyr, Val, Ser, Met, Lys, Asn, His, Pro, Leu, Phe, Cys, or Trp
  misc_feature (9)..(9): Xaa can be Leu, Met, Tyr, Ile, Phe, Val, His, Trp, Ala, Cys, Thr, Ser, Lys, Arg, Gly, or Pro
KXPVTKAEX

SEQ ID NO: 113240 - protein, 10 aa, Artificial Sequence
  Description of Artificial Sequence: Synthetic peptide
  Seed: KEPVTKAEML (MAGC3_HUMAN)
  misc_feature (2)..(2): Xaa can be Glu, Gln, or Asp
  misc_feature (10)..(10): Xaa can be Trp, Ala, Thr, Val, Cys, Leu, Met, Tyr, Ile, Pro, or Phe
KXPVTKAEMX

SEQ ID NO: 113241 - protein, 9 aa, Artificial Sequence
  Description of Artificial Sequence: Synthetic peptide
  Seed: KFSLRRAVS (MAGC3_HUMAN)
  misc_feature (2)..(2): Xaa can be Thr, Ser, Val, Met, Ala, Ile, Tyr, Gln, Phe, Trp, Leu, Gly, Asn, Cys, His, or Lys
  misc_feature (9)..(9): Xaa can be Lys, Ala, Val, Ile, Met, Ser, Tyr, Leu, Arg, Gly, Thr, Pro, Phe, Asn, Gln, Cys, His, or Gl u
KXSLRRAVX

SEQ ID NO: 113242 - protein, 10 aa, Artificial Sequence
  Description of Artificial Sequence: Synthetic peptide
  Seed: KFSLRRAVSV (MAGC3_HUMAN)
  misc_feature (2)..(2): Xaa can be Thr, Ser, Val, Tyr, Met, Trp, Phe, Lys, Ala, Gln, Asn, Leu, Arg, Ile, Gly, Cys, Pro, Asp, His, or Glu
  misc_feature (10)..(10): Xaa can be Lys, Ala, Val, Ile, Met, Leu, Ser, Tyr, Arg, Gly, or Thr
KXSLRRAVSX

SEQ ID NO: 113243 - protein, 11 aa, Artificial Sequence
  Description of Artificial Sequence: Synthetic peptide
  Seed: KFSLRRAVSVK (MAGC3_HUMAN)
  misc_feature (2)..(2): Xaa can be Thr, Ser, Val, Phe, Tyr, Trp, Met, Ile, Arg, Asn, Gln, Ala, Asp, Glu, Pro, His, Leu, Gly, Cys, or Lys
  misc_feature (11)..(11): Xaa can be Lys, Ala, Arg, Val, Met, Ile, Ser, Tyr, Leu, Thr, Phe, or Gly
KXSLRRAVSVX

SEQ ID NO: 113244 - protein, 9 aa, Artificial Sequence
  Description of Artificial Sequence: Synthetic peptide
  Seed: KGNCASEEV (MAGC3_HUMAN)
  misc_feature (2)..(2): Xaa can be Val, Ala, Ser, Thr, Ile, Gly, Met, Asn, Leu, Gln, or Cys
  misc_feature (9)..(9): Xaa can be Leu, Met, Ile, Val, or Phe
KXNCASEEX

SEQ ID NO: 113245 - protein, 11 aa, Artificial Sequence
  Description of Artificial Sequence: Synthetic peptide
  Seed: KGNCASEEVIW (MAGC3_HUMAN)
  misc_feature (2)..(2): Xaa can be Ser, Thr, Ala, Ile, Val, Gly, Cys, Leu, Met, Gln, Glu, Lys, Asp, Tyr, Asn, Phe, Pro, His, or Trp
  misc_feature (11)..(11): Xaa can be Trp, Phe, Tyr, Leu, Ile, or Met
KXNCASEEVIX

SEQ ID NO: 113246 - protein, 9 aa, Artificial Sequence
  Description of Artificial Sequence: Synthetic peptide
  Seed: KGSCVPEEV (MAGC3_HUMAN)
  misc_feature (2)..(2): Xaa can be Leu, Ala, Gln, Gly, Met, Thr, Ser, Val, Ile, Asn, Phe, Glu, Cys, Asp, Lys, His, Tyr, or Ar g
  misc_feature (9)..(9): Xaa can be Leu, Phe, Ile, Trp, Met, Tyr, Val, Lys, Arg, Cys, Ala, or Thr
KXSCVPEEX

SEQ ID NO: 113247 - protein, 11 aa, Artificial Sequence
  Description of Artificial Sequence: Synthetic peptide
  Seed: KGSCVPEEVIW (MAGC3_HUMAN)
  misc_feature (2)..(2): Xaa can be Thr, Ser, Ala, Val, Cys, Ile, Gly, Leu, Asn, Met, Gln, Asp, Glu, Tyr, Lys, Pro, Arg, His, Trp, or Phe
  misc_feature (11)..(11): Xaa can be Trp, Phe, Tyr, Leu, Met, Ile, or Val
KXSCVPEEVIX

SEQ ID NO: 113248 - protein, 11 aa, Artificial Sequence
  Description of Artificial Sequence: Synthetic peptide
  Seed: KKATDKDYSAF (MAGC3_HUMAN)
  misc_feature (2)..(2): Xaa can be Gln, Lys, Met, Arg, Glu, His, Leu, or Ala
  misc_feature (11)..(11): Xaa can be Tyr, Phe, Met, Trp, or Leu
KXATDKDYSAX

SEQ ID NO: 113249 - protein, 9 aa, Artificial Sequence
  Description of Artificial Sequence: Synthetic peptide
  Seed: KKYKDYFPM (MAGC3_HUMAN)
  misc_feature (2)..(2): Xaa can be Arg, Gln, Met, Leu, Ser, Glu, Ala, Lys, His, Val, Ile, Thr, Phe, Tyr, Gly, Asn, Cys, Trp, Pro, or Asp
  misc_feature (9)..(9): Xaa can be Tyr, Phe, Met, Leu, Trp, His, Ile, Ala, Val, Pro, Cys, Ser, Gly, Thr, Gln, Lys, Arg, or As n
KXYKDYFPX

SEQ ID NO: 113250 - protein, 10 aa, Artificial Sequence
  Description of Artificial Sequence: Synthetic peptide
  Seed: KKYKDYFPMI (MAGC3_HUMAN)
  misc_feature (2)..(2): Xaa can be Arg, Tyr, Thr, Ser, Ala, Val, Met, Trp, Ile, Phe, Leu, Gln, Gly, Asn, Pro, Cys, His, Lys, Asp, or Glu
  misc_feature (10)..(10): Xaa can be Ala, Trp, Phe, Ile, Met, Val, Lys, Leu, Arg, Ser, Tyr, Gly, Thr, Pro, His, Gln, Cys, Asn, Asp, or Glu
KXYKDYFPMX

SEQ ID NO: 113251 - protein, 11 aa, Artificial Sequence
  Description of Artificial Sequence: Synthetic peptide
  Seed: KKYKDYFPMIF (MAGC3_HUMAN)
  misc_feature (2)..(2): Xaa can be Gln, Tyr, Trp, Met, Phe, Lys, His, Leu, Ser, Glu, Ala, Arg, Val, Gly, Thr, Asn, Ile, or Pr o
  misc_feature (11)..(11): Xaa can be Phe, Tyr, Met, Trp, Leu, Ile, Val, His, Cys, or Ala
KXYKDYFPMIX

SEQ ID NO: 113252 - protein, 9 aa, Artificial Sequence
  Description of Artificial Sequence: Synthetic peptide
  Seed: KLSSIIPSA (MAGC3_HUMAN)
  misc_feature (2)..(2): Xaa can be Thr, Met, Leu, Val, Ser, Gln, Ile, Ala, Tyr, Phe, Trp, Glu, Gly, Asn, Asp, Cys, His, Pro, Lys, or Arg
  misc_feature (9)..(9): Xaa can be Ile, Val, Lys, Leu, Arg, Met, Ala, Ser, Gly, Tyr, Phe, Thr, Cys, His, Pro, Trp, Gln, Asn, or Glu
KXSSIIPSX

SEQ ID NO: 113253 - protein, 10 aa, Artificial Sequence
  Description of Artificial Sequence: Synthetic peptide
  Seed: KLSSIIPSAF (MAGC3_HUMAN)
  misc_feature (2)..(2): Xaa can be Met, Leu, Ala, Gln, Ser, Val, Ile, Thr, Glu, Gly, Arg, Trp, Phe, Cys, Asn, Tyr, Asp, Lys, Pro, or His
  misc_feature (10)..(10): Xaa can be Met, Tyr, Phe, Leu, Trp, Ile, Arg, Lys, Val, His, Cys, Ala, Thr, Gln, Glu, Asp, Pro, Gly, Ser, or Asn
KXSSIIPSAX

SEQ ID NO: 113254 - protein, 9 aa, Artificial Sequence
  Description of Artificial Sequence: Synthetic peptide
  Seed: KLVQFLLLK (MAGC3_HUMAN)
  misc_feature (2)..(2): Xaa can be Met, Leu, Ile, Val, Thr, Gln, Ser, Ala, Phe, Tyr, Asn, Trp, Gly, Glu, Cys, His, Asp, Arg, Pro, or Lys
  misc_feature (9)..(9): Xaa can be Tyr, Arg, Lys, Phe, Val, Leu, Ile, Met, His, Trp, Ala, Thr, Cys, Gly, Ser, Pro, or Gln
KXVQFLLLX

SEQ ID NO: 113255 - protein, 10 aa, Artificial Sequence
  Description of Artificial Sequence: Synthetic peptide
  Seed: KLVQFLLLKY (MAGC3_HUMAN)
  misc_feature (2)..(2): Xaa can be Val, Ile, Thr, Leu, Met, Gln, Ser, Tyr, Ala, Glu, Asn, Phe, Lys, Trp, Cys, Gly, Arg, Asp, His, or Pro
  misc_feature (10)..(10): Xaa can be Lys, Tyr, Arg, Trp, Phe, Leu, Met, Ile, Gly, Asn, His, Val, Thr, Ala, Cys, Ser, Pro, Asp, Gln, or Glu
KXVQFLLLKX

SEQ ID NO: 113256 - protein, 9 aa, Artificial Sequence
  Description of Artificial Sequence: Synthetic peptide
  Seed: KLWRTLSGS (MAGC3_HUMAN)
  misc_feature (2)..(2): Xaa can be Leu, Met, Ile, Val, Thr, Gln, Ala, Ser, or Phe
  misc_feature (9)..(9): Xaa can be Val, Ile, Leu, Met, Ala, Cys, Thr, Ser, or Phe
KXWRTLSGX

SEQ ID NO: 113257 - protein, 9 aa, Artificial Sequence
  Description of Artificial Sequence: Synthetic peptide
  Seed: KNCLLILIL (MAGC3_HUMAN)
  misc_feature (2)..(2): Xaa can be Arg, Gln, Ala, Gly, Ser, Asn, Thr, Leu, Val, Met, Ile, Glu, Cys, Lys, Asp, Phe, His, Pro, Tyr, or Trp
  misc_feature (9)..(9): Xaa can be Trp, Leu, Phe, Met, Ile, Tyr, Val, Lys, Cys, Ala, Arg, His, or Gln
KXCLLILIX

SEQ ID NO: 113258 - protein, 9 aa, Artificial Sequence
  Description of Artificial Sequence: Synthetic peptide
  Seed: KNTCATYAL (MAGC3_HUMAN)
  misc_feature (2)..(2): Xaa can be Arg, Ser, Ala, Thr, Val, Gln, Ile, Met, His, Asn, Gly, or Glu
  misc_feature (9)..(9): Xaa can be Leu, Ile, Val, Met, or Phe
KXTCATYAX

SEQ ID NO: 113259 - protein, 9 aa, Artificial Sequence
  Description of Artificial Sequence: Synthetic peptide
  Seed: KQREEPQDW (MAGC3_HUMAN)
  misc_feature (2)..(2): Xaa can be Glu, Gln, Met, Ser, Thr, Ala, Leu, Val, Ile, Lys, Asp, Asn, Cys, Gly, Tyr, Arg, Phe, Trp, Pro, or His
  misc_feature (9)..(9): Xaa can be Phe, Tyr, Trp, Met, Leu, Ile, Val, His, or Arg
KXREEPQDX

SEQ ID NO: 113260 - protein, 11 aa, Artificial Sequence
  Description of Artificial Sequence: Synthetic peptide
  Seed: KQREEPQDWPL (MAGC3_HUMAN)
  misc_feature (2)..(2): Xaa can be Gln, Met, Leu, Ile, Val, Lys, or Glu
  misc_feature (11)..(11): Xaa can be Phe, Trp, Leu, Tyr, Met, Ile, or Val
KXREEPQDWPX

SEQ ID NO: 113261 - protein, 10 aa, Artificial Sequence
  Description of Artificial Sequence: Synthetic peptide
  Seed: KRLWGEKAGS (MAGC3_HUMAN)
  misc_feature (2)..(2): Xaa can be Arg, or Gln
  misc_feature (10)..(10): Xaa can be Tyr, Phe, Arg, Lys, Leu, Val, Ala, His, Thr, Gln, Asn, Ser, Gly, Ile, Trp, Met, or Cys
KXLWGEKAGX

SEQ ID NO: 113262 - protein, 11 aa, Artificial Sequence
  Description of Artificial Sequence: Synthetic peptide
  Seed: KRLWGEKAGSL (MAGC3_HUMAN)
  misc_feature (2)..(2): Xaa can be Arg, Gln, His, Tyr, Gly, Lys, or Glu
  misc_feature (11)..(11): Xaa can be Phe, Leu, Tyr, Lys, Thr, Pro, Met, Val, Arg, Ala, Trp, Ile, Cys, His, Glu, Asn, or Gln
KXLWGEKAGSX

SEQ ID NO: 113263 - protein, 10 aa, Artificial Sequence
  Description of Artificial Sequence: Synthetic peptide
  Seed: KRTLWKDSDL (MAGC3_HUMAN)
  misc_feature (2)..(2): Xaa can be , or Arg
  misc_feature (10)..(10): Xaa can be Trp, Lys, Leu, Met, Phe, Tyr, Arg, or Ile
KXTLWKDSDX

SEQ ID NO: 113264 - protein, 8 aa, Artificial Sequence
  Description of Artificial Sequence: Synthetic peptide
  Seed: KVAELVQF (MAGC3_HUMAN)
  misc_feature (2)..(2): Xaa can be Ser, Ala, Thr, Val, Ile, Met, Gln, Leu, Gly, Asn, Phe, Glu, Cys, Pro, Lys, or Asp
  misc_feature (8)..(8): Xaa can be Trp, Tyr, Phe, Leu, Met, Lys, Arg, Ile, Val, or His
KXAELVQX

SEQ ID NO: 113265 - protein, 9 aa, Artificial Sequence
  Description of Artificial Sequence: Synthetic peptide
  Seed: KVAELVQFL (MAGC3_HUMAN)
  misc_feature (2)..(2): Xaa can be Met, Leu, Gln, Val, Ile, Arg, Ala, Thr, Ser, Gly, Phe, Tyr, Glu, Asn, Pro, Asp, Trp, His, Lys, or Cys
  misc_feature (9)..(9): Xaa can be Phe, Leu, Lys, Val, Tyr, Met, Arg, Trp, Ile, Ala, His, Thr, Cys, Ser, Gly, Gln, Pro, or Gl u
KXAELVQFX

SEQ ID NO: 113266 - protein, 10 aa, Artificial Sequence
  Description of Artificial Sequence: Synthetic peptide
  Seed: KVAELVQFLL (MAGC3_HUMAN)
  misc_feature (2)..(2): Xaa can be Leu, Val, Met, Ile, Gln, Ser, Ala, Thr, Glu, Cys, Gly, Phe, Asn, Tyr, Trp, Arg, Lys, Asp, His, or Pro
  misc_feature (10)..(10): Xaa can be Tyr, Trp, Phe, Lys, Arg, Met, Leu, Ile, Val, Asn, Gly, Ala, Cys, Asp, His, Thr, Pro, Ser, Gln, or Glu
KXAELVQFLX

SEQ ID NO: 113267 - protein, 11 aa, Artificial Sequence
  Description of Artificial Sequence: Synthetic peptide
  Seed: KVAELVQFLLL (MAGC3_HUMAN)
  misc_feature (2)..(2): Xaa can be Gln, Met, Leu, Val, Glu, Thr, Ala, Ser, Ile, Cys, Asp, Asn, Gly, Pro, Trp, His, Phe, Tyr, Arg, or Lys
  misc_feature (11)..(11): Xaa can be Leu, Trp, Phe, Met, Ile, Val, Tyr, Ala, Thr, Cys, His, Gln, Asp, Arg, Ser, Glu, Pro, Lys, Asn, or Gly
KXAELVQFLLX

SEQ ID NO: 113268 - protein, 8 aa, Artificial Sequence
  Description of Artificial Sequence: Synthetic peptide
  Seed: KVDKLVQF (MAGC3_HUMAN)
  misc_feature (2)..(2): Xaa can be Ser, Ala, Thr, Val, Ile, Leu, Met, Tyr, Gly, Phe, Glu, Trp, Asp, Cys, Gln, Asn, Pro, His, Arg, or Lys
  misc_feature (8)..(8): Xaa can be Met, Ile, Phe, Leu, Val, Trp, Tyr, Lys, Arg, Cys, His, Ala, or Thr
KXDKLVQX

SEQ ID NO: 113269 - protein, 9 aa, Artificial Sequence
  Description of Artificial Sequence: Synthetic peptide
  Seed: KVDKLVQFL (MAGC3_HUMAN)
  misc_feature (2)..(2): Xaa can be Thr, Leu, Ala, Met, Ile, Val, Ser, Phe, Tyr, Gln, Glu, Arg, Cys, Gly, Trp, Asp, Asn, His, Pro, or Lys
  misc_feature (9)..(9): Xaa can be Leu, Trp, Ile, Tyr, Val, Phe, Met, Arg, Lys, Cys, Ala, His, Thr, Gln, Ser, Asn, or Glu
KXDKLVQFX

SEQ ID NO: 113270 - protein, 10 aa, Artificial Sequence
  Description of Artificial Sequence: Synthetic peptide
  Seed: KVDKLVQFLL (MAGC3_HUMAN)
  misc_feature (2)..(2): Xaa can be Leu, Met, Thr, Ser, Ala, Val, Ile, Gln, Tyr, Trp, Phe, Glu, Gly, Asn, Cys, Asp, or Pro
  misc_feature (10)..(10): Xaa can be Trp, Phe, Lys, Ala, Val, Leu, Ile, Met, Tyr, Ser, Thr, Gly, Pro, Arg, Gln, Cys, Asn, Asp, Glu, or His
KXDKLVQFLX

SEQ ID NO: 113271 - protein, 8 aa, Artificial Sequence
  Description of Artificial Sequence: Synthetic peptide
  Seed: KYKDYFPM (MAGC3_HUMAN)
  misc_feature (2)..(2): Xaa can be Tyr, Phe, or Trp
  misc_feature (8)..(8): Xaa can be Leu, Phe, Trp, Met, Tyr, or Ile
KXKDYFPX

SEQ ID NO: 113272 - protein, 9 aa, Artificial Sequence
  Description of Artificial Sequence: Synthetic peptide
  Seed: KYKDYFPMI (MAGC3_HUMAN)
  misc_feature (2)..(2): Xaa can be Thr, Met, Phe, Ser, Ile, Tyr, Val, Ala, Leu, Gln, Trp, Gly, Arg, Asn, His, Glu, Cys, Asp, Lys, or Pro
  misc_feature (9)..(9): Xaa can be Tyr, Phe, Leu, Lys, Met, Val, Ile, Arg, Ala, Ser, His, Trp, Gln, Thr, Gly, Asn, Cys, Pro, Glu, or Asp
KXKDYFPMX

SEQ ID NO: 113273 - protein, 10 aa, Artificial Sequence
  Description of Artificial Sequence: Synthetic peptide
  Seed: KYKDYFPMIF (MAGC3_HUMAN)
  misc_feature (2)..(2): Xaa can be Arg, Tyr, Trp, Gln, Phe, Met, Leu, Val, Thr, His, Ile, Ser, Ala, Glu, Lys, Gly, Asn, Pro, Cys, or Asp
  misc_feature (10)..(10): Xaa can be Tyr, Phe, Met, Trp, Leu, Ile, Val, Cys, His, Ala, Lys, or Arg
KXKDYFPMIX

SEQ ID NO: 113274 - protein, 11 aa, Artificial Sequence
  Description of Artificial Sequence: Synthetic peptide
  Seed: KYKDYFPMIFG (MAGC3_HUMAN)
  misc_feature (2)..(2): Xaa can be Tyr, Trp, or Phe
  misc_feature (11)..(11): Xaa can be Phe, Trp, Ile, Met, Leu, Ala, His, Glu, Thr, Val, Arg, Gln, Asn, Cys, Pro, Asp, Tyr, Ser, Lys, or Gly
KXKDYFPMIFX

SEQ ID NO: 113275 - protein, 8 aa, Artificial Sequence
  Description of Artificial Sequence: Synthetic peptide
  Seed: KYQAKEPL (MAGC3_HUMAN)
  misc_feature (2)..(2): Xaa can be , or Tyr
  misc_feature (8)..(8): Xaa can be Tyr, Leu, or Phe
KXQAKEPX

SEQ ID NO: 113276 - protein, 10 aa, Artificial Sequence
  Description of Artificial Sequence: Synthetic peptide
  Seed: KYQAKEPLTR (MAGC3_HUMAN)
  misc_feature (2)..(2): Xaa can be Val, Thr, Met, Ala, Trp, Ile, Ser, Tyr, Gln, Phe, Leu, Asn, or Gly
  misc_feature (10)..(10): Xaa can be Arg, Lys, or Tyr
KXQAKEPLTX

SEQ ID NO: 113277 - protein, 10 aa, Artificial Sequence
  Description of Artificial Sequence: Synthetic peptide
  Seed: KYQTKEPVTK (MAGC3_HUMAN)
  misc_feature (2)..(2): Xaa can be Thr, Leu, Trp, Phe, Ser, Tyr, Ala, Gly, Ile, Val, Met, Gln, or Asn
  misc_feature (10)..(10): Xaa can be Arg, Lys, or Ala
KXQTKEPVTX

SEQ ID NO: 113278 - protein, 11 aa, Artificial Sequence
  Description of Artificial Sequence: Synthetic peptide
  Seed: KYQTKEPVTKA (MAGC3_HUMAN)
  misc_feature (2)..(2): Xaa can be Glu, Thr, Leu, Gly, Asp, Met, Arg, His, Phe, Gln, Pro, Cys, Trp, Val, Ile, Asn, Lys, Ala, Tyr, or Ser
  misc_feature (11)..(11): Xaa can be Ala, or Lys
KXQTKEPVTKX

SEQ ID NO: 113279 - protein, 8 aa, Artificial Sequence
  Description of Artificial Sequence: Synthetic peptide
  Seed: LAGFADVL (MAGC3_HUMAN)
  misc_feature (2)..(2): Xaa can be Ala, Ser, or Thr
  misc_feature (8)..(8): Xaa can be Leu, Phe, Met, or Tyr
LXGFADVX

SEQ ID NO: 113280 - protein, 10 aa, Artificial Sequence
  Description of Artificial Sequence: Synthetic peptide
  Seed: LAGFADVLSR (MAGC3_HUMAN)
  misc_feature (2)..(2): Xaa can be Ala, Gly, Tyr, Ser, Leu, Phe, Met, Trp, Val, Ile, Thr, Gln, Asp, Glu, His, Arg, or Asn
  misc_feature (10)..(10): Xaa can be Arg, Lys, Leu, or Met
LXGFADVLSX

SEQ ID NO: 113281 - protein, 9 aa, Artificial Sequence
  Description of Artificial Sequence: Synthetic peptide
  Seed: LANPQGLAG (MAGC3_HUMAN)
  misc_feature (2)..(2): Xaa can be Ala, Ser, Val, Thr, Ile, Met, Gly, Gln, Leu, Phe, Asn, Cys, Pro, Glu, Asp, Trp, Tyr, Lys, Arg, or His
  misc_feature (9)..(9): Xaa can be Tyr, Phe, Lys, Met, Leu, His, Arg, Val, Ile, Trp, Ala, Cys, Gln, Thr, Ser, Pro, Gly, Glu, or Asn
LXNPQGLAX

SEQ ID NO: 113282 - protein, 10 aa, Artificial Sequence
  Description of Artificial Sequence: Synthetic peptide
  Seed: LANPQGLAGH (MAGC3_HUMAN)
  misc_feature (2)..(2): Xaa can be Ala, Val, Ile, Thr, Ser, Gly, Met, Gln, Leu, Glu, Pro, Cys, Phe, or Asn
  misc_feature (10)..(10): Xaa can be Tyr, Phe, Met, Leu, Lys, His, Ala, Arg, Ile, Val, or Trp
LXNPQGLAGX

SEQ ID NO: 113283 - protein, 11 aa, Artificial Sequence
  Description of Artificial Sequence: Synthetic peptide
  Seed: LANPQGLAGHR (MAGC3_HUMAN)
  misc_feature (2)..(2): Xaa can be Thr, Ala, Leu, Val, Ile, Tyr, Met, Ser, Gln, Gly, Phe, Asn, or Trp
  misc_feature (11)..(11): Xaa can be Arg, Lys, or Tyr
LXNPQGLAGHX

SEQ ID NO: 113284 - protein, 9 aa, Artificial Sequence
  Description of Artificial Sequence: Synthetic peptide
  Seed: LCPTYFKLW (MAGC3_HUMAN)
  misc_feature (2)..(2): Xaa can be Thr, Ser, Ala, Met, Val, Gly, Ile, Leu, Cys, Asn, Gln, Glu, Trp, Phe, Pro, or Asp
  misc_feature (9)..(9): Xaa can be Trp, Phe, Ile, Leu, Met, or Tyr
LXPTYFKLX

SEQ ID NO: 113285 - protein, 8 aa, Artificial Sequence
  Description of Artificial Sequence: Synthetic peptide
  Seed: LDEKVAEL (MAGC3_HUMAN)
  misc_feature (2)..(2): Xaa can be Glu, Asp, Phe, Trp, Tyr, Ser, Ile, Ala, Thr, Gly, Arg, Gln, Val, His, Leu, Pro, Cys, Met, Lys, or Asn
  misc_feature (8)..(8): Xaa can be Leu, Met, Phe, Ile, Val, Ala, Tyr, Trp, Ser, Thr, Pro, Cys, or Gly
LXEKVAEX

SEQ ID NO: 113286 - protein, 9 aa, Artificial Sequence
  Description of Artificial Sequence: Synthetic peptide
  Seed: LDEKVAELV (MAGC3_HUMAN)
  misc_feature (2)..(2): Xaa can be Glu, Asp, Gln, Ala, or Ser
  misc_feature (9)..(9): Xaa can be Leu, Met, Phe, Cys, Val, Ala, Ile, Tyr, Pro, Trp, Glu, Thr, Lys, Ser, Asp, Gly, Arg, or Gl n
LXEKVAELX

SEQ ID NO: 113287 - protein, 8 aa, Artificial Sequence
  Description of Artificial Sequence: Synthetic peptide
  Seed: LDEKVDKL (MAGC3_HUMAN)
  misc_feature (2)..(2): Xaa can be Glu, Asp, or Gln
  misc_feature (8)..(8): Xaa can be Leu, Phe, Val, Ile, Met, Thr, Cys, Tyr, Ala, or Pro
LXEKVDKX

SEQ ID NO: 113288 - protein, 9 aa, Artificial Sequence
  Description of Artificial Sequence: Synthetic peptide
  Seed: LDEKVDKLV (MAGC3_HUMAN)
  misc_feature (2)..(2): Xaa can be Glu, Asp, or Gln
  misc_feature (9)..(9): Xaa can be Phe, Met, Ala, Ile, Leu, Val, Cys, Pro, Arg, Trp, Ser, Tyr, Lys, Thr, or Gly
LXEKVDKLX

SEQ ID NO: 113289 - protein, 9 aa, Artificial Sequence
  Description of Artificial Sequence: Synthetic peptide
  Seed: LDLANPQGL (MAGC3_HUMAN)
  misc_feature (2)..(2): Xaa can be Glu, Arg, Gln, Asp, Ala, Gly, Tyr, Ser, Thr, His, Phe, Asn, Lys, Met, Trp, Ile, Cys, Val, Pro, or Leu
  misc_feature (9)..(9): Xaa can be Leu, Met, Ile, Phe, Val, Tyr, Lys, Arg, Ala, Trp, Cys, Thr, Gly, His, Pro, or Ser
LXLANPQGX

SEQ ID NO: 113290 - protein, 10 aa, Artificial Sequence
  Description of Artificial Sequence: Synthetic peptide
  Seed: LDLANPQGLA (MAGC3_HUMAN)
  misc_feature (2)..(2): Xaa can be Phe, Tyr, Met, His, Trp, Val, Arg, Ile, Ala, Asp, Cys, Glu, Thr, Ser, Pro, Asn, Gly, Lys, Leu, or Gln
  misc_feature (10)..(10): Xaa can be Leu, Ala, Val, Ile, or Met
LXLANPQGLX

SEQ ID NO: 113291 - protein, 9 aa, Artificial Sequence
  Description of Artificial Sequence: Synthetic peptide
  Seed: LDLTCEGSL (MAGC3_HUMAN)
  misc_feature (2)..(2): Xaa can be Glu, or Asp
  misc_feature (9)..(9): Xaa can be Met, Ile, Phe, Leu, Ala, or Val
LXLTCEGSX

SEQ ID NO: 113292 - protein, 9 aa, Artificial Sequence
  Description of Artificial Sequence: Synthetic peptide
  Seed: LDLTYEGSL (MAGC3_HUMAN)
  misc_feature (2)..(2): Xaa can be Glu, or Asp
  misc_feature (9)..(9): Xaa can be Val, Phe, Met, Leu, Ile, Thr, Cys, or Ala
LXLTYEGSX

SEQ ID NO: 113293 - protein, 10 aa, Artificial Sequence
  Description of Artificial Sequence: Synthetic peptide
  Seed: LDLTYEGSLI (MAGC3_HUMAN)
  misc_feature (2)..(2): Xaa can be Leu, Met, Phe, Trp, Thr, Asp, Glu, Lys, Cys, Ser, Val, Tyr, Ile, Gly, Asn, His, Ala, Pro, Gln, or Arg
  misc_feature (10)..(10): Xaa can be Ile, Val, Leu, or Ala
LXLTYEGSLX

SEQ ID NO: 113294 - protein, 9 aa, Artificial Sequence
  Description of Artificial Sequence: Synthetic peptide
  Seed: LDSCSSPLL (MAGC3_HUMAN)
  misc_feature (2)..(2): Xaa can be Glu, Asp, or Gln
  misc_feature (9)..(9): Xaa can be Leu, Ala, Met, Phe, Val, Ile, Gly, Pro, Ser, Thr, or Cys
LXSCSSPLX

SEQ ID NO: 113295 - protein, 10 aa, Artificial Sequence
  Description of Artificial Sequence: Synthetic peptide
  Seed: LDSCSSPLLW (MAGC3_HUMAN)
  misc_feature (2)..(2): Xaa can be Ser, Thr, Ala, Arg, Gly, Met, Lys, Leu, Ile, Cys, Asp, Glu, Tyr, Pro, His, Phe, Val, Trp, Asn, or Gln
  misc_feature (10)..(10): Xaa can be Met, Phe, Leu, Ile, Trp, Tyr, Val, Cys, or Gly
LXSCSSPLLX

SEQ ID NO: 113296 - protein, 11 aa, Artificial Sequence
  Description of Artificial Sequence: Synthetic peptide
  Seed: LDSCSSPLLWT (MAGC3_HUMAN)
  misc_feature (2)..(2): Xaa can be Arg, Gln, Glu, Ala, Leu, Cys, Met, Ser, Thr, Lys, Ile, Pro, Asn, Tyr, Val, Trp, His, Gly, Asp, or Phe
  misc_feature (11)..(11): Xaa can be His, Tyr, Arg, Leu, Gln, Asp, Pro, Glu, Met, Ile, Thr, Gly, Asn, Phe, Cys, Val, Ala, Lys, Trp, or Ser
LXSCSSPLLWX

SEQ ID NO: 113297 - protein, 9 aa, Artificial Sequence
  Description of Artificial Sequence: Synthetic peptide
  Seed: LEFLSKLSS (MAGC3_HUMAN)
  misc_feature (2)..(2): Xaa can be Glu, Asp, or Gln
  misc_feature (9)..(9): Xaa can be Met, Val, Ala, Ile, Leu, Cys, Phe, Thr, Pro, Glu, Gln, Gly, Trp, Ser, Tyr, or Asp
LXFLSKLSX

SEQ ID NO: 113298 - protein, 10 aa, Artificial Sequence
  Description of Artificial Sequence: Synthetic peptide
  Seed: LEFLSKLSSI (MAGC3_HUMAN)
  misc_feature (2)..(2): Xaa can be Glu, Gln, Asp, or Ala
  misc_feature (10)..(10): Xaa can be Leu, Ile, Phe, Trp, Met, Val, Gly, Thr, Ala, Cys, Pro, Tyr, or Ser
LXFLSKLSSX

SEQ ID NO: 113299 - protein, 11 aa, Artificial Sequence
  Description of Artificial Sequence: Synthetic peptide
  Seed: LEFLSKLSSII (MAGC3_HUMAN)
  misc_feature (2)..(2): Xaa can be , or Glu
  misc_feature (11)..(11): Xaa can be Phe, Val, Met, Leu, Cys, Ala, or Ile
LXFLSKLSSIX

SEQ ID NO: 113300 - protein, 9 aa, Artificial Sequence
  Description of Artificial Sequence: Synthetic peptide
  Seed: LFGISLTEV (MAGC3_HUMAN)
  misc_feature (2)..(2): Xaa can be Tyr, Phe, Trp, Met, or Ala
  misc_feature (9)..(9): Xaa can be Phe, Leu, Met, Tyr, Ile, Val, His, or Trp
LXGISLTEX

SEQ ID NO: 113301 - protein, 11 aa, Artificial Sequence
  Description of Artificial Sequence: Synthetic peptide
  Seed: LFLRGGTSDQR (MAGC3_HUMAN)
  misc_feature (2)..(2): Xaa can be Tyr, Thr, Phe, or Met
  misc_feature (11)..(11): Xaa can be , or Arg
LXLRGGTSDQX

SEQ ID NO: 113302 - protein, 9 aa, Artificial Sequence
  Description of Artificial Sequence: Synthetic peptide
  Seed: LGHLREVRL (MAGC3_HUMAN)
  misc_feature (2)..(2): Xaa can be Arg, Ser, Pro, Ala, Gln, Met, Ile, Leu, Thr, Gly, Val, Glu, Phe, Asn, Tyr, His, Asp, Trp, Cys, or Lys
  misc_feature (9)..(9): Xaa can be Leu, Met, Ile, Phe, Tyr, Val, Trp, Ala, Lys, Cys, His, or Arg
LXHLREVRX

SEQ ID NO: 113303 - protein, 9 aa, Artificial Sequence
  Description of Artificial Sequence: Synthetic peptide
  Seed: LHFGSQPEG (MAGC3_HUMAN)
  misc_feature (2)..(2): Xaa can be His, Arg, Gln, Pro, Glu, or Lys
  misc_feature (9)..(9): Xaa can be Ala, Leu, Val, Met, Ile, Cys, Pro, Thr, Ser, Gly, or Phe
LXFGSQPEX

SEQ ID NO: 113304 - protein, 10 aa, Artificial Sequence
  Description of Artificial Sequence: Synthetic peptide
  Seed: LHFGSQPEGK (MAGC3_HUMAN)
  misc_feature (2)..(2): Xaa can be Ala, Val, Thr, Ser, Gly, Ile, Gln, Leu, Asn, Phe, Glu, Asp, Cys, Met, Tyr, Pro, Trp, or Hi s
  misc_feature (10)..(10): Xaa can be Lys, Arg, Leu, Phe, Met, Ile, Val, or Tyr
LXFGSQPEGX

SEQ ID NO: 113305 - protein, 11 aa, Artificial Sequence
  Description of Artificial Sequence: Synthetic peptide
  Seed: LHFGSQPEGKF (MAGC3_HUMAN)
  misc_feature (2)..(2): Xaa can be Arg, His, Gln, Tyr, Met, Leu, Pro, Lys, Ala, or Phe
  misc_feature (11)..(11): Xaa can be Phe, Tyr, Met, Leu, Val, Trp, Ile, Lys, His, Arg, or Cys
LXFGSQPEGKX

SEQ ID NO: 113306 - protein, 9 aa, Artificial Sequence
  Description of Artificial Sequence: Synthetic peptide
  Seed: LIDDQGMPK (MAGC3_HUMAN)
  misc_feature (2)..(2): Xaa can be Ala, Ser, Ile, Thr, Val, Leu, Met, Gly, Phe, Gln, Cys, Asn, Tyr, Trp, Pro, Asp, His, Glu, Lys, or Arg
  misc_feature (9)..(9): Xaa can be Phe, Leu, Ile, Tyr, Val, Met, Lys, Arg, Cys, Trp, Ala, Thr, His, Gln, Ser, Pro, Gly, Glu, or Asn
LXDDQGMPX

SEQ ID NO: 113307 - protein, 11 aa, Artificial Sequence
  Description of Artificial Sequence: Synthetic peptide
  Seed: LIDDQGMPKNC (MAGC3_HUMAN)
  misc_feature (2)..(2): Xaa can be Ala, Ser, Val, Thr, Ile, Leu, Gly, Met, Asn, Phe, Cys, Pro, Gln, Tyr, Glu, Trp, or Asp
  misc_feature (11)..(11): Xaa can be Met, Leu, Phe, Ile, Val, Trp, Cys, Tyr, Ala, or Thr
LXDDQGMPKNX

SEQ ID NO: 113308 - protein, 10 aa, Artificial Sequence
  Description of Artificial Sequence: Synthetic peptide
  Seed: LIFGIALTDM (MAGC3_HUMAN)
  misc_feature (2)..(2): Xaa can be Met, Gln, Leu, Val, Ile, Ala, Thr, Ser, Gly, Phe, Glu, or Asn
  misc_feature (10)..(10): Xaa can be Tyr, Phe, Val, Met, Ile, Leu, Ala, Thr, His, or Trp
LXFGIALTDX

SEQ ID NO: 113309 - protein, 9 aa, Artificial Sequence
  Description of Artificial Sequence: Synthetic peptide
  Seed: LILILSMIF (MAGC3_HUMAN)
  misc_feature (2)..(2): Xaa can be Gln, Lys, Ser, Met, Thr, Ala, His, Val, Asn, Glu, Pro, Ile, Arg, Leu, Cys, Gly, Asp, Phe, or Tyr
  misc_feature (9)..(9): Xaa can be Tyr, Phe, Trp, Met, Leu, Ile, Val, His, Ala, or Gly
LXLILSMIX

SEQ ID NO: 113310 - protein, 10 aa, Artificial Sequence
  Description of Artificial Sequence: Synthetic peptide
  Seed: LILILSMIFI (MAGC3_HUMAN)
  misc_feature (2)..(2): Xaa can be Met, Leu, Cys, His, Gly, Val, Ala, Pro, Tyr, Trp, Phe, Arg, Glu, Asp, Asn, Gln, Ile, Ser, Thr, or Lys
  misc_feature (10)..(10): Xaa can be Val, Leu, Ala, Ile, Met, or Thr
LXLILSMIFX

SEQ ID NO: 113311 - protein, 9 aa, Artificial Sequence
  Description of Artificial Sequence: Synthetic peptide
  Seed: LILILSVIF (MAGC3_HUMAN)
  misc_feature (2)..(2): Xaa can be Ser, Ala, Gln, Thr, Met, Leu, Pro, Val, Gly, Ile, Cys, Asn, Asp, Glu, Lys, Phe, Arg, or Hi s
  misc_feature (9)..(9): Xaa can be Tyr, Phe, Trp, Met, Leu, Ile, His, or Val
LXLILSVIX

SEQ ID NO: 113312 - protein, 10 aa, Artificial Sequence
  Description of Artificial Sequence: Synthetic peptide
  Seed: LILILSVIFI (MAGC3_HUMAN)
  misc_feature (2)..(2): Xaa can be Met, Tyr, Phe, Leu, Gly, Val, Thr, Cys, Trp, Gln, Asp, Arg, Asn, Ala, Glu, Pro, Ser, Ile, His, or Lys
  misc_feature (10)..(10): Xaa can be Ile, Ala, Leu, Val, Met, or Thr
LXLILSVIFX

SEQ ID NO: 113313 - protein, 9 aa, Artificial Sequence
  Description of Artificial Sequence: Synthetic peptide
  Seed: LILSMIFIK (MAGC3_HUMAN)
  misc_feature (2)..(2): Xaa can be Met, Leu, Thr, Ile, Val, Tyr, Trp, Gln, Gly, Cys, Asn, Phe, Asp, Pro, Ser, Ala, Lys, Arg, or His
  misc_feature (9)..(9): Xaa can be Arg, Lys, His, Tyr, Leu, Val, Met, Ile, or Phe
LXLSMIFIX

SEQ ID NO: 113314 - protein, 9 aa, Artificial Sequence
  Description of Artificial Sequence: Synthetic peptide
  Seed: LILSVIFIK (MAGC3_HUMAN)
  misc_feature (2)..(2): Xaa can be Met, Leu, Thr, Val, Ile, Tyr, Ser, Trp, Glu, Gln, His, Phe, Pro, Gly, Asp, Ala, Asn, Cys, Arg, or Lys
  misc_feature (9)..(9): Xaa can be Arg, Lys, His, Tyr, Leu, Val, Met, Ile, Phe, or Ala
LXLSVIFIX

SEQ ID NO: 113315 - protein, 9 aa, Artificial Sequence
  Description of Artificial Sequence: Synthetic peptide
  Seed: LKYQAKEPL (MAGC3_HUMAN)
  misc_feature (2)..(2): Xaa can be Gln, Arg, Met, His, Lys, Leu, Ser, Ala, Pro, Glu, Tyr, Gly, Trp, Ile, Asn, Phe, Val, Thr, Cys, or Asp
  misc_feature (9)..(9): Xaa can be Phe, Tyr, Met, Leu, Ile, Trp, His, Val, Ala, Thr, Cys, Ser, Gly, Lys, Asn, or Arg
LXYQAKEPX

SEQ ID NO: 113316 - protein, 9 aa, Artificial Sequence
  Description of Artificial Sequence: Synthetic peptide
  Seed: LKYQTKEPV (MAGC3_HUMAN)
  misc_feature (2)..(2): Xaa can be His, Gln, Arg, Met, Lys, Glu, Ala, Leu, Ser, Pro, Thr, Asn, Val, Ile, Gly, Phe, Tyr, Cys, Asp, or Trp
  misc_feature (9)..(9): Xaa can be Tyr, Phe, Met, Leu, Ile, Trp, His, Ala, Val, Thr, Cys, Gly, Ser, or Pro
LXYQTKEPX

SEQ ID NO: 113317 - protein, 9 aa, Artificial Sequence
  Description of Artificial Sequence: Synthetic peptide
  Seed: LLILILSMI (MAGC3_HUMAN)
  misc_feature (2)..(2): Xaa can be Gln, Leu, Met, Ile, Val, Ser, Thr, Ala, Gly, Glu, or Asn
  misc_feature (9)..(9): Xaa can be Val, Ile, Leu, Ala, Met, Thr, Ser, or Phe
LXILILSMX

SEQ ID NO: 113318 - protein, 10 aa, Artificial Sequence
  Description of Artificial Sequence: Synthetic peptide
  Seed: LLILILSMIF (MAGC3_HUMAN)
  misc_feature (2)..(2): Xaa can be Gln, Met, Val, Ala, Ile, Ser, Leu, Thr, Glu, Arg, Lys, Tyr, Pro, Gly, His, or Asn
  misc_feature (10)..(10): Xaa can be Tyr, Phe, Met, or Leu
LXILILSMIX

SEQ ID NO: 113319 - protein, 8 aa, Artificial Sequence
  Description of Artificial Sequence: Synthetic peptide
  Seed: LLILILSV (MAGC3_HUMAN)
  misc_feature (2)..(2): Xaa can be Met, or Leu
  misc_feature (8)..(8): Xaa can be , or Val
LXILILSX

SEQ ID NO: 113320 - protein, 9 aa, Artificial Sequence
  Description of Artificial Sequence: Synthetic peptide
  Seed: LLILILSVI (MAGC3_HUMAN)
  misc_feature (2)..(2): Xaa can be Leu, Gln, Met, Ile, Glu, Ala, Val, Thr, Asn, Asp, Gly, Ser, Pro, His, or Lys
  misc_feature (9)..(9): Xaa can be Val, Ile, Leu, Met, Ala, Phe, Trp, Ser, Thr, Cys, or Tyr
LXILILSVX

SEQ ID NO: 113321 - protein, 10 aa, Artificial Sequence
  Description of Artificial Sequence: Synthetic peptide
  Seed: LLILILSVIF (MAGC3_HUMAN)
  misc_feature (2)..(2): Xaa can be Gln, Met, Thr, Ser, Leu, Ala, Val, Gly, or Ile
  misc_feature (10)..(10): Xaa can be Tyr, Phe, Met, or Leu
LXILILSVIX

SEQ ID NO: 113322 - protein, 10 aa, Artificial Sequence
  Description of Artificial Sequence: Synthetic peptide
  Seed: LLKYQAKEPL (MAGC3_HUMAN)
  misc_feature (2)..(2): Xaa can be Met, Gln, Leu, Ile, Cys, Glu, Trp, Phe, Tyr, Thr, Arg, Asn, Lys, Gly, Ser, Pro, Asp, His, Ala, or Val
  misc_feature (10)..(10): Xaa can be Tyr, Met, Phe, Leu, Val, Ile, Ala, Trp, or His
LXKYQAKEPX

SEQ ID NO: 113323 - protein, 10 aa, Artificial Sequence
  Description of Artificial Sequence: Synthetic peptide
  Seed: LLKYQTKEPV (MAGC3_HUMAN)
  misc_feature (2)..(2): Xaa can be Leu, Met, or Ile
  misc_feature (10)..(10): Xaa can be Val, Leu, Ala, or Ile
LXKYQTKEPX

SEQ ID NO: 113324 - protein, 11 aa, Artificial Sequence
  Description of Artificial Sequence: Synthetic peptide
  Seed: LLLKYQAKEPL (MAGC3_HUMAN)
  misc_feature (2)..(2): Xaa can be Leu, Met, Phe, Ile, or Tyr
  misc_feature (11)..(11): Xaa can be Val, Ala, Leu, or Ile
LXLKYQAKEPX

SEQ ID NO: 113325 - protein, 11 aa, Artificial Sequence
  Description of Artificial Sequence: Synthetic peptide
  Seed: LLLKYQTKEPV (MAGC3_HUMAN)
  misc_feature (2)..(2): Xaa can be Leu, Met, Phe, or Tyr
  misc_feature (11)..(11): Xaa can be Val, Ile, or Leu
LXLKYQTKEPX

SEQ ID NO: 113326 - protein, 8 aa, Artificial Sequence
  Description of Artificial Sequence: Synthetic peptide
  Seed: LLPCHWVL (MAGC3_HUMAN)
  misc_feature (2)..(2): Xaa can be Met, Leu, Trp, Tyr, Phe, or Ile
  misc_feature (8)..(8): Xaa can be Val, Leu, or Ile
LXPCHWVX

SEQ ID NO: 113327 - protein, 10 aa, Artificial Sequence
  Description of Artificial Sequence: Synthetic peptide
  Seed: LLPCHWVLDA (MAGC3_HUMAN)
  misc_feature (2)..(2): Xaa can be Leu, Met, Ile, Gln, or Val
  misc_feature (10)..(10): Xaa can be Val, Ile, Ala, Leu, or Met
LXPCHWVLDX

SEQ ID NO: 113328 - protein, 10 aa, Artificial Sequence
  Description of Artificial Sequence: Synthetic peptide
  Seed: LNAIGPWSAL (MAGC3_HUMAN)
  misc_feature (2)..(2): Xaa can be Tyr, Phe, Pro, Asp, Lys, His, Gln, Arg, Thr, Val, Cys, Glu, Ile, Asn, Trp, Leu, Met, Ala, Gly, or Ser
  misc_feature (10)..(10): Xaa can be Leu, Tyr, Phe, Ile, Met, Val, or Trp
LXAIGPWSAX

SEQ ID NO: 113329 - protein, 8 aa, Artificial Sequence
  Description of Artificial Sequence: Synthetic peptide
  Seed: LNEKRTLW (MAGC3_HUMAN)
  misc_feature (2)..(2): Xaa can be Thr, Pro, Cys, Leu, Ser, Gln, Asn, Met, Trp, Gly, Asp, Tyr, Val, Ala, Ile, or Phe
  misc_feature (8)..(8): Xaa can be , or Trp
LXEKRTLX

SEQ ID NO: 113330 - protein, 9 aa, Artificial Sequence
  Description of Artificial Sequence: Synthetic peptide
  Seed: LPAVSPGKR (MAGC3_HUMAN)
  misc_feature (2)..(2): Xaa can be Val, Ala, Ser, Thr, Ile, Asn, Pro, Met, Tyr, Trp, Gln, Gly, Leu, Phe, or Asp
  misc_feature (9)..(9): Xaa can be Arg, or Lys
LXAVSPGKX

SEQ ID NO: 113331 - protein, 10 aa, Artificial Sequence
  Description of Artificial Sequence: Synthetic peptide
  Seed: LPAVSPGKRL (MAGC3_HUMAN)
  misc_feature (2)..(2): Xaa can be Pro, or Ala
  misc_feature (10)..(10): Xaa can be Trp, Ile, Leu, Ser, Cys, Ala, Val, Pro, Tyr, Thr, Gly, Met, or Phe
LXAVSPGKRX

SEQ ID NO: 113332 - protein, 11 aa, Artificial Sequence
  Description of Artificial Sequence: Synthetic peptide
  Seed: LPAVSPGKRLW (MAGC3_HUMAN)
  misc_feature (2)..(2): Xaa can be Ser, Thr, Ala, Pro, Cys, Ile, Asn, Val, Gly, Met, Phe, Trp, Tyr, Glu, Arg, Lys, Leu, Gln, Asp, or His
  misc_feature (11)..(11): Xaa can be Trp, Phe, Tyr, Met, Leu, Ile, or Val
LXAVSPGKRLX

SEQ ID NO: 113333 - protein, 9 aa, Artificial Sequence
  Description of Artificial Sequence: Synthetic peptide
  Seed: LPCHWVLDA (MAGC3_HUMAN)
  misc_feature (2)..(2): Xaa can be , or Pro
  misc_feature (9)..(9): Xaa can be Ser, Tyr, Ala, Pro, Phe, Met, Val, Leu, Cys, Ile, or Thr
LXCHWVLDX

SEQ ID NO: 113334 - protein, 10 aa, Artificial Sequence
  Description of Artificial Sequence: Synthetic peptide
  Seed: LPCHWVLDAT (MAGC3_HUMAN)
  misc_feature (2)..(2): Xaa can be , or Pro
  misc_feature (10)..(10): Xaa can be Phe, Ile, Pro, Leu, Cys, Ala, Met, Ser, Thr, or Val
LXCHWVLDAX

SEQ ID NO: 113335 - protein, 11 aa, Artificial Sequence
  Description of Artificial Sequence: Synthetic peptide
  Seed: LPCHWVLDATF (MAGC3_HUMAN)
  misc_feature (2)..(2): Xaa can be , or Pro
  misc_feature (11)..(11): Xaa can be Trp, Phe, Leu, Met, or Tyr
LXCHWVLDATX

SEQ ID NO: 113336 - protein, 8 aa, Artificial Sequence
  Description of Artificial Sequence: Synthetic peptide
  Seed: LPESEPLF (MAGC3_HUMAN)
  misc_feature (2)..(2): Xaa can be , or Pro
  misc_feature (8)..(8): Xaa can be Tyr, or Phe
LXESEPLX

SEQ ID NO: 113337 - protein, 9 aa, Artificial Sequence
  Description of Artificial Sequence: Synthetic peptide
  Seed: LPESEPLFT (MAGC3_HUMAN)
  misc_feature (2)..(2): Xaa can be , or Pro
  misc_feature (9)..(9): Xaa can be Ala, Thr, Leu, Met, Ile, or Val
LXESEPLFX

SEQ ID NO: 113338 - protein, 10 aa, Artificial Sequence
  Description of Artificial Sequence: Synthetic peptide
  Seed: LPESEPLFTY (MAGC3_HUMAN)
  misc_feature (2)..(2): Xaa can be Pro, Ile, Asn, Leu, Val, Ser, Cys, Phe, Asp, Glu, Thr, Met, His, Gly, Tyr, Trp, Ala, Gln, Lys, or Arg
  misc_feature (10)..(10): Xaa can be Trp, Phe, Tyr, Leu, Met, Ala, Ile, or Val
LXESEPLFTX

SEQ ID NO: 113339 - protein, 9 aa, Artificial Sequence
  Description of Artificial Sequence: Synthetic peptide
  Seed: LPESESLPR (MAGC3_HUMAN)
  misc_feature (2)..(2): Xaa can be Val, Pro, Ser, Thr, Ala, or Ile
  misc_feature (9)..(9): Xaa can be Arg, or Lys
LXESESLPX

SEQ ID NO: 113340 - protein, 10 aa, Artificial Sequence
  Description of Artificial Sequence: Synthetic peptide
  Seed: LPESESLPRY (MAGC3_HUMAN)
  misc_feature (2)..(2): Xaa can be Pro, Ala, Gln, or Met
  misc_feature (10)..(10): Xaa can be Tyr, Trp, Met, Phe, or Leu
LXESESLPRX

SEQ ID NO: 113341 - protein, 11 aa, Artificial Sequence
  Description of Artificial Sequence: Synthetic peptide
  Seed: LPESESLPRYA (MAGC3_HUMAN)
  misc_feature (2)..(2): Xaa can be , or Pro
  misc_feature (11)..(11): Xaa can be Ala, or Leu
LXESESLPRYX

SEQ ID NO: 113342 - protein, 9 aa, Artificial Sequence
  Description of Artificial Sequence: Synthetic peptide
  Seed: LPPQPQPRK (MAGC3_HUMAN)
  misc_feature (2)..(2): Xaa can be Ala, Ser, Leu, Ile, Val, Thr, Met, Pro, Gly, Asp, Gln, or Asn
  misc_feature (9)..(9): Xaa can be Lys, or Arg
LXPQPQPRX

SEQ ID NO: 113343 - protein, 11 aa, Artificial Sequence
  Description of Artificial Sequence: Synthetic peptide
  Seed: LPPQPQPRKKA (MAGC3_HUMAN)
  misc_feature (2)..(2): Xaa can be , or Pro
  misc_feature (11)..(11): Xaa can be Ile, Ala, Val, Cys, Leu, Phe, or Met
LXPQPQPRKKX

SEQ ID NO: 113344 - protein, 8 aa, Artificial Sequence
  Description of Artificial Sequence: Synthetic peptide
  Seed: LPQSPPEI (MAGC3_HUMAN)
  misc_feature (2)..(2): Xaa can be Pro, Ala, or Gln
  misc_feature (8)..(8): Xaa can be Val, Ile, Leu, Pro, Cys, Met, Phe, Ala, Thr, or Ser
LXQSPPEX

SEQ ID NO: 113345 - protein, 9 aa, Artificial Sequence
  Description of Artificial Sequence: Synthetic peptide
  Seed: LPQSPPEIP (MAGC3_HUMAN)
  misc_feature (2)..(2): Xaa can be Pro, Ala, Val, Ser, Ile, Gly, Met, Thr, Cys, Phe, or Leu
  misc_feature (9)..(9): Xaa can be Tyr, Phe, Leu, Ile, Met, Val, Ala, Cys, Trp, His, Lys, Glu, Thr, Gln, Gly, Ser, Asn, Pro, or Arg
LXQSPPEIX

SEQ ID NO: 113346 - protein, 10 aa, Artificial Sequence
  Description of Artificial Sequence: Synthetic peptide
  Seed: LPQSPPEIPP (MAGC3_HUMAN)
  misc_feature (2)..(2): Xaa can be Pro, Ala, or Val
  misc_feature (10)..(10): Xaa can be Ala, Leu, Asn, Gly, Ile, Val, Tyr, Cys, Glu, Phe, Pro, His, Thr, Met, Arg, Ser, Trp, Lys, or Gln
LXQSPPEIPX

SEQ ID NO: 113347 - protein, 11 aa, Artificial Sequence
  Description of Artificial Sequence: Synthetic peptide
  Seed: LPQSPPEIPPQ (MAGC3_HUMAN)
  misc_feature (2)..(2): Xaa can be Pro, or Ala
  misc_feature (11)..(11): Xaa can be Ala, Cys, Arg, Met, Pro, Lys, Ile, Val, Phe, Thr, Glu, Gly, Gln, Leu, Tyr, Ser, His, Asn, or Trp
LXQSPPEIPPX

SEQ ID NO: 113348 - protein, 10 aa, Artificial Sequence
  Description of Artificial Sequence: Synthetic peptide
  Seed: LPRYALDEKV (MAGC3_HUMAN)
  misc_feature (2)..(2): Xaa can be , or Pro
  misc_feature (10)..(10): Xaa can be Phe, Ile, Cys, Leu, Ala, Met, or Val
LXRYALDEKX

SEQ ID NO: 113349 - protein, 11 aa, Artificial Sequence
  Description of Artificial Sequence: Synthetic peptide
  Seed: LPRYALDEKVA (MAGC3_HUMAN)
  misc_feature (2)..(2): Xaa can be , or Pro
  misc_feature (11)..(11): Xaa can be Leu, Met, Val, or Ala
LXRYALDEKVX

SEQ ID NO: 113350 - protein, 9 aa, Artificial Sequence
  Description of Artificial Sequence: Synthetic peptide
  Seed: LPTWRRGTG (MAGC3_HUMAN)
  misc_feature (2)..(2): Xaa can be Pro, Ala, Val, Met, Thr, Ile, Leu, or Ser
  misc_feature (9)..(9): Xaa can be Leu, Met, Ala, Tyr, Phe, Gly, Pro, Val, Trp, Ser, His, Cys, Ile, or Thr
LXTWRRGTX

SEQ ID NO: 113351 - protein, 10 aa, Artificial Sequence
  Description of Artificial Sequence: Synthetic peptide
  Seed: LPTWRRGTGY (MAGC3_HUMAN)
  misc_feature (2)..(2): Xaa can be Ser, Phe, Arg, Trp, Tyr, Val, Glu, Ile, Leu, Asn, Gln, Lys, Cys, Asp, Thr, His, Ala, Met, Pro, or Gly
  misc_feature (10)..(10): Xaa can be Met, Tyr, Phe, Trp, or Leu
LXTWRRGTGX

SEQ ID NO: 113352 - protein, 8 aa, Artificial Sequence
  Description of Artificial Sequence: Synthetic peptide
  Seed: LQLSDLHF (MAGC3_HUMAN)
  misc_feature (2)..(2): Xaa can be Gln, Met, Leu, or Lys
  misc_feature (8)..(8): Xaa can be Tyr, Phe, Met, or Leu
LXLSDLHX

SEQ ID NO: 113353 - protein, 8 aa, Artificial Sequence
  Description of Artificial Sequence: Synthetic peptide
  Seed: LREVRLFL (MAGC3_HUMAN)
  misc_feature (2)..(2): Xaa can be Arg, Tyr, Gln, or His
  misc_feature (8)..(8): Xaa can be , or Leu
LXEVRLFX

SEQ ID NO: 113354 - protein, 9 aa, Artificial Sequence
  Description of Artificial Sequence: Synthetic peptide
  Seed: LREVRLFLR (MAGC3_HUMAN)
  misc_feature (2)..(2): Xaa can be Arg, Gln, Thr, Leu, Ile, Val, Ala, Trp, Phe, Asn, Met, Ser, or Gly
  misc_feature (9)..(9): Xaa can be Leu, Lys, Phe, Tyr, Met, His, Ile, Trp, Val, or Arg
LXEVRLFLX

SEQ ID NO: 113355 - protein, 9 aa, Artificial Sequence
  Description of Artificial Sequence: Synthetic peptide
  Seed: LRGGTSDQR (MAGC3_HUMAN)
  misc_feature (2)..(2): Xaa can be , or Arg
  misc_feature (9)..(9): Xaa can be Ile, Leu, Arg, Met, Tyr, Phe, or Lys
LXGGTSDQX

SEQ ID NO: 113356 - protein, 10 aa, Artificial Sequence
  Description of Artificial Sequence: Synthetic peptide
  Seed: LRGGTSDQRM (MAGC3_HUMAN)
  misc_feature (2)..(2): Xaa can be Arg, or Tyr
  misc_feature (10)..(10): Xaa can be Tyr, Phe, Lys, Trp, Val, Ile, Arg, Met, or Leu
LXGGTSDQRX

SEQ ID NO: 113357 - protein, 10 aa, Artificial Sequence
  Description of Artificial Sequence: Synthetic peptide
  Seed: LRRAVSVKQR (MAGC3_HUMAN)
  misc_feature (2)..(2): Xaa can be , or Arg
  misc_feature (10)..(10): Xaa can be Val, Tyr, Ile, Leu, Trp, Arg, Lys, Met, or Phe
LXRAVSVKQX

SEQ ID NO: 113358 - protein, 9 aa, Artificial Sequence
  Description of Artificial Sequence: Synthetic peptide
  Seed: LRSAEGSVL (MAGC3_HUMAN)
  misc_feature (2)..(2): Xaa can be Arg, His, Gln, Met, Lys, Ala, Tyr, Pro, Phe, Leu, Trp, Val, Gly, Ile, Glu, Thr, Asn, Ser, or Cys
  misc_feature (9)..(9): Xaa can be Phe, Tyr, Met, Leu, Ile, Val, Trp, Ala, His, Thr, Pro, Cys, Lys, Arg, or Gly
LXSAEGSVX

SEQ ID NO: 113359 - protein, 11 aa, Artificial Sequence
  Description of Artificial Sequence: Synthetic peptide
  Seed: LRSAEGSVLDL (MAGC3_HUMAN)
  misc_feature (2)..(2): Xaa can be Arg, Tyr, or Ala
  misc_feature (11)..(11): Xaa can be Leu, Met, Phe, Tyr, Val, Ile, Trp, Lys, or Arg
LXSAEGSVLDX

SEQ ID NO: 113360 - protein, 9 aa, Artificial Sequence
  Description of Artificial Sequence: Synthetic peptide
  Seed: LSAIGPIQR (MAGC3_HUMAN)
  misc_feature (2)..(2): Xaa can be Ala, Ser, Val, Gly, Met, Ile, Thr, Leu, Gln, Cys, Phe, Asn, Tyr, Trp, Pro, Glu, Asp, or Hi s
  misc_feature (9)..(9): Xaa can be Arg, Lys, Tyr, Met, Phe, Leu, Ile, Val, His, Trp, Ala, Thr, Ser, Gln, or Cys
LXAIGPIQX

SEQ ID NO: 113361 - protein, 9 aa, Artificial Sequence
  Description of Artificial Sequence: Synthetic peptide
  Seed: LSDEQGMPQ (MAGC3_HUMAN)
  misc_feature (2)..(2): Xaa can be Ala, Ser, Thr, Ile, Val, Leu, Phe, Met, Gly, Cys, Tyr, Asn, Gln, Trp, Glu, Asp, Pro, His, Lys, or Arg
  misc_feature (9)..(9): Xaa can be Met, Phe, Ile, Leu, Val, Tyr, Lys, Arg, Cys, Ala, Trp, His, Thr, Ser, Gln, Pro, Gly, Asn, or Glu
LXDEQGMPX

SEQ ID NO: 113362 - protein, 11 aa, Artificial Sequence
  Description of Artificial Sequence: Synthetic peptide
  Seed: LSDEQGMPQNR (MAGC3_HUMAN)
  misc_feature (2)..(2): Xaa can be Thr, Ala, Ser, Ile, Met, Val, Leu, Gln, Gly, Tyr, Cys, Asn, Phe, Asp, Glu, Trp, Lys, or Pr o
  misc_feature (11)..(11): Xaa can be Tyr, Lys, Phe, Arg, His, Trp, Met, Leu, Ile, Val, or Gln
LXDEQGMPQNX

SEQ ID NO: 113363 - protein, 9 aa, Artificial Sequence
  Description of Artificial Sequence: Synthetic peptide
  Seed: LSDLHFGSQ (MAGC3_HUMAN)
  misc_feature (2)..(2): Xaa can be Thr, Ser, Met, Leu, Ile, Val, Ala, Asn, Gly, Phe, Gln, Asp, Trp, Glu, Tyr, Cys, His, Pro, or Lys
  misc_feature (9)..(9): Xaa can be Tyr, Lys, Arg, Phe, His, Trp, Leu, Met, Ile, Gln, Val, or Ala
LXDLHFGSX

SEQ ID NO: 113364 - protein, 9 aa, Artificial Sequence
  Description of Artificial Sequence: Synthetic peptide
  Seed: LSGSPGLQL (MAGC3_HUMAN)
  misc_feature (2)..(2): Xaa can be Ala, Arg, Thr, Ser, Ile, Pro, Val, Gln, Met, Gly, Leu, Asn, Phe, Glu, Cys, Tyr, His, Asp, Trp, or Lys
  misc_feature (9)..(9): Xaa can be Leu, Trp, Met, Phe, Tyr, Ile, Lys, Val, Arg, His, Ala, Cys, Gln, Thr, Pro, or Ser
LXGSPGLQX

SEQ ID NO: 113365 - protein, 10 aa, Artificial Sequence
  Description of Artificial Sequence: Synthetic peptide
  Seed: LSKLSSIIPS (MAGC3_HUMAN)
  misc_feature (2)..(2): Xaa can be Thr, Ser, Val, Met, Ala, Ile, Tyr, Phe, Leu, Trp, Asn, Gln, Gly, or His
  misc_feature (10)..(10): Xaa can be Lys, Ala, Val, Ile, Ser, Met, Leu, Gly, or Thr
LXKLSSIIPX

SEQ ID NO: 113366 - protein, 11 aa, Artificial Sequence
  Description of Artificial Sequence: Synthetic peptide
  Seed: LSKLSSIIPSA (MAGC3_HUMAN)
  misc_feature (2)..(2): Xaa can be Phe, Met, Thr, Gln, Val, Tyr, Ala, Ser, Arg, Trp, Leu, Cys, Ile, Glu, His, Asp, Pro, Gly, Asn, or Lys
  misc_feature (11)..(11): Xaa can be Val, Leu, Ile, Ala, Met, or Lys
LXKLSSIIPSX

SEQ ID NO: 113367 - protein, 10 aa, Artificial Sequence
  Description of Artificial Sequence: Synthetic peptide
  Seed: LSLPAVSPGK (MAGC3_HUMAN)
  misc_feature (2)..(2): Xaa can be Leu, Ala, Met, Thr, Ser, Val, Ile, Tyr, Trp, Arg, Gly, Phe, Lys, Gln, Asp, Pro, Asn, Cys, His, or Glu
  misc_feature (10)..(10): Xaa can be Arg, Lys, Leu, Tyr, Met, Phe, Val, Ile, or His
LXLPAVSPGX

SEQ ID NO: 113368 - protein, 11 aa, Artificial Sequence
  Description of Artificial Sequence: Synthetic peptide
  Seed: LSLPAVSPGKR (MAGC3_HUMAN)
  misc_feature (2)..(2): Xaa can be Met, Leu, Thr, Phe, Gln, Trp, Ser, Ala, Gly, Tyr, Pro, Val, Ile, Asn, Asp, Cys, Glu, or Hi s
  misc_feature (11)..(11): Xaa can be Lys, Arg, Tyr, Met, or Leu
LXLPAVSPGKX

SEQ ID NO: 113369 - protein, 9 aa, Artificial Sequence
  Description of Artificial Sequence: Synthetic peptide
  Seed: LSRLALWES (MAGC3_HUMAN)
  misc_feature (2)..(2): Xaa can be Thr, Ser, Val, Ile, Ala, Met, Tyr, Trp, Gly, Phe, Gln, Asn, Leu, His, or Arg
  misc_feature (9)..(9): Xaa can be Lys, Ala, Val, Ile, Ser, Met, Gly, Leu, Thr, Arg, Pro, or Tyr
LXRLALWEX

SEQ ID NO: 113370 - protein, 9 aa, Artificial Sequence
  Description of Artificial Sequence: Synthetic peptide
  Seed: LSSIIPSAF (MAGC3_HUMAN)
  misc_feature (2)..(2): Xaa can be Pro, Ala, Gln, Arg, Val, Met, Thr, Ser, Ile, Gly, Leu, Asn, Glu, Cys, Phe, Lys, Tyr, His, Asp, or Trp
  misc_feature (9)..(9): Xaa can be Leu, Trp, Phe, Tyr, Met, Val, Ile, Lys, Arg, His, Ala, Thr, Pro, Ser, Cys, Gly, Gln, Asn, or Glu
LXSIIPSAX

SEQ ID NO: 113371 - protein, 9 aa, Artificial Sequence
  Description of Artificial Sequence: Synthetic peptide
  Seed: LTDMDPDNH (MAGC3_HUMAN)
  misc_feature (2)..(2): Xaa can be Thr, Ser, Val, Met, Ile, Ala, Leu, Phe, Gly, Gln, Asn, Tyr, Trp, Asp, Cys, Glu, or Pro
  misc_feature (9)..(9): Xaa can be Tyr, Lys, Arg, Phe, His, Met, Trp, or Leu
LXDMDPDNX

SEQ ID NO: 113372 - protein, 11 aa, Artificial Sequence
  Description of Artificial Sequence: Synthetic peptide
  Seed: LTDMDPDNHSY (MAGC3_HUMAN)
  misc_feature (2)..(2): Xaa can be Thr, Ala, Ile, Val, Ser, Met, Leu, Gly, Pro, Gln, Asn, Phe, Trp, Cys, Tyr, Asp, Glu, His, Lys, or Arg
  misc_feature (11)..(11): Xaa can be Trp, Tyr, Met, Leu, Phe, Lys, Val, Ile, Arg, Cys, His, Ala, Gln, or Thr
LXDMDPDNHSX

SEQ ID NO: 113373 - protein, 9 aa, Artificial Sequence
  Description of Artificial Sequence: Synthetic peptide
  Seed: LTEASPQQK (MAGC3_HUMAN)
  misc_feature (2)..(2): Xaa can be Ser, Thr, Ala, Val, Phe, Ile, Met, Leu, Tyr, Gly, Trp, Gln, Asp, Asn, Cys, Glu, or Pro
  misc_feature (9)..(9): Xaa can be Tyr, Lys, Arg, Phe, Leu, Met, His, Val, Ile, or Trp
LXEASPQQX

SEQ ID NO: 113374 - protein, 10 aa, Artificial Sequence
  Description of Artificial Sequence: Synthetic peptide
  Seed: LTEASPQQKK (MAGC3_HUMAN)
  misc_feature (2)..(2): Xaa can be Thr, Ser, Val, Ile, Ala, Met, Leu, Gly, Gln, Asp, Asn, Glu, Phe, Cys, Trp, or Tyr
  misc_feature (10)..(10): Xaa can be Tyr, Lys, Arg, Phe, Trp, or His
LXEASPQQKX

SEQ ID NO: 113375 - protein, 9 aa, Artificial Sequence
  Description of Artificial Sequence: Synthetic peptide
  Seed: LTEVDPDHF (MAGC3_HUMAN)
  misc_feature (2)..(2): Xaa can be Ser, Thr, Met, Ile, Val, Gly, Leu, Ala, Gln, Phe, Cys, Tyr, Asn, Trp, Pro, Asp, or Glu
  misc_feature (9)..(9): Xaa can be Tyr, Leu, Trp, Met, Phe, Lys, Ile, Val, Arg, or His
LXEVDPDHX

SEQ ID NO: 113376 - protein, 10 aa, Artificial Sequence
  Description of Artificial Sequence: Synthetic peptide
  Seed: LTEVDPDHFY (MAGC3_HUMAN)
  misc_feature (2)..(2): Xaa can be Thr, Ser, Met, Ala, Val, Gln, Leu, Gly, Ile, Asn, Tyr, Cys, Trp, Phe, Pro, Glu, or Asp
  misc_feature (10)..(10): Xaa can be Tyr, Lys, Trp, Arg, Phe, His, or Met
LXEVDPDHFX

SEQ ID NO: 113377 - protein, 11 aa, Artificial Sequence
  Description of Artificial Sequence: Synthetic peptide
  Seed: LTEVDPDHFYV (MAGC3_HUMAN)
  misc_feature (2)..(2): Xaa can be Leu, Met, Ile, Gln, Phe, Ser, Lys, Asn, Pro, Trp, His, Arg, Tyr, Thr, Val, Glu, Asp, Cys, Ala, or Gly
  misc_feature (11)..(11): Xaa can be Val, Leu, Ile, Met, or Ala
LXEVDPDHFYX

SEQ ID NO: 113378 - protein, 10 aa, Artificial Sequence
  Description of Artificial Sequence: Synthetic peptide
  Seed: LTRAEMQMNV (MAGC3_HUMAN)
  misc_feature (2)..(2): Xaa can be Leu, Met, Thr, Ser, Val, Ile, Gln, Tyr, Ala, Phe, Gly, Asn, or Trp
  misc_feature (10)..(10): Xaa can be Lys, Ala, Val, Leu, Ile, Met, or Thr
LXRAEMQMNX

SEQ ID NO: 113379 - protein, 8 aa, Artificial Sequence
  Description of Artificial Sequence: Synthetic peptide
  Seed: LTTVIKKY (MAGC3_HUMAN)
  misc_feature (2)..(2): Xaa can be Ser, Ala, Thr, Val, or Gly
  misc_feature (8)..(8): Xaa can be Leu, Phe, Tyr, Ile, Met, or Val
LXTVIKKX

SEQ ID NO: 113380 - protein, 9 aa, Artificial Sequence
  Description of Artificial Sequence: Synthetic peptide
  Seed: LTTVIKKYK (MAGC3_HUMAN)
  misc_feature (2)..(2): Xaa can be Ala, Leu, Tyr, Ser, Val, Thr, Ile, Phe, Met, Gln, Trp, Asn, or Gly
  misc_feature (9)..(9): Xaa can be Arg, or Lys
LXTVIKKYX

SEQ ID NO: 113381 - protein, 8 aa, Artificial Sequence
  Description of Artificial Sequence: Synthetic peptide
  Seed: LTYEGSLI (MAGC3_HUMAN)
  misc_feature (2)..(2): Xaa can be Ala, Gly, Gln, Ile, Thr, Val, Met, Ser, Leu, Glu, His, Asn, Pro, Asp, Phe, Lys, or Cys
  misc_feature (8)..(8): Xaa can be Leu, Ile, Val, Tyr, Phe, Met, Trp, Lys, Cys, Arg, His, or Ala
LXYEGSLX

SEQ ID NO: 113382 - protein, 9 aa, Artificial Sequence
  Description of Artificial Sequence: Synthetic peptide
  Seed: LVLCPTYFK (MAGC3_HUMAN)
  misc_feature (2)..(2): Xaa can be Met, Thr, Leu, Ile, Val, Ser, Gln, Ala, Trp, Phe, Tyr, Asp, Asn, Pro, Cys, Glu, His, Lys, Arg, or Gly
  misc_feature (9)..(9): Xaa can be Arg, Lys, His, Tyr, Met, Val, Leu, Phe, Ile, Ala, or Gln
LXLCPTYFX

SEQ ID NO: 113383 - protein, 10 aa, Artificial Sequence
  Description of Artificial Sequence: Synthetic peptide
  Seed: LVLCPTYFKL (MAGC3_HUMAN)
  misc_feature (2)..(2): Xaa can be Thr, Ser, Met, Ile, Leu, Val, Gln, Phe, Tyr, Ala, Cys, Asn, Asp, Lys, Pro, His, Glu, Arg, Trp, or Gly
  misc_feature (10)..(10): Xaa can be Lys, Ala, Leu, Val, Ile, Met, Arg, Asn, Cys, Thr, His, Phe, Asp, Ser, Glu, Gly, Trp, Tyr, Gln, or Pro
LXLCPTYFKX

SEQ ID NO: 113384 - protein, 11 aa, Artificial Sequence
  Description of Artificial Sequence: Synthetic peptide
  Seed: LVLCPTYFKLW (MAGC3_HUMAN)
  misc_feature (2)..(2): Xaa can be Ser, Thr, Ala, Gln, Gly, Val, Asn, Leu, Ile, Cys, or Met
  misc_feature (11)..(11): Xaa can be Trp, Phe, Tyr, Met, or Leu
LXLCPTYFKLX

SEQ ID NO: 113385 - protein, 9 aa, Artificial Sequence
  Description of Artificial Sequence: Synthetic peptide
  Seed: LVQFLLLKY (MAGC3_HUMAN)
  misc_feature (2)..(2): Xaa can be Ala, Thr, Leu, Met, Ser, Gln, Val, Gly, Ile, Asn, Phe, Tyr, Pro, Lys, Glu, Asp, Trp, Cys, His, or Arg
  misc_feature (9)..(9): Xaa can be Tyr, Phe, Lys, Arg, Trp, Leu, Met, Ile, Val, or His
LXQFLLLKX

SEQ ID NO: 113386 - protein, 10 aa, Artificial Sequence
  Description of Artificial Sequence: Synthetic peptide
  Seed: LWESEGPEAF (MAGC3_HUMAN)
  misc_feature (2)..(2): Xaa can be Trp, Phe, Tyr, Gln, Met, Leu, Pro, Ala, Val, Arg, Ser, Ile, Glu, Thr, Cys, Gly, or His
  misc_feature (10)..(10): Xaa can be Tyr, Phe, Leu, Met, Trp, Ile, or Val
LXESEGPEAX

SEQ ID NO: 113387 - protein, 9 aa, Artificial Sequence
  Description of Artificial Sequence: Synthetic peptide
  Seed: LWGEKAGSL (MAGC3_HUMAN)
  misc_feature (2)..(2): Xaa can be Tyr, Arg, Gln, Trp, Phe, Met, Ala, Ile, Leu, Ser, Val, Gly, Thr, His, Glu, Asn, Pro, Cys, Asp, or Lys
  misc_feature (9)..(9): Xaa can be Leu, Met, Phe, Ile, Val, Tyr, Trp, Lys, His, Arg, Cys, or Ala
LXGEKAGSX

SEQ ID NO: 113388 - protein, 10 aa, Artificial Sequence
  Description of Artificial Sequence: Synthetic peptide
  Seed: LWKDSDLPTW (MAGC3_HUMAN)
  misc_feature (2)..(2): Xaa can be Thr, Ser, Tyr, Ala, Trp, Val, Phe, Cys, Ile, Gln, Gly, Leu, Asn, Pro, Asp, Met, Glu, His, Arg, or Lys
  misc_feature (10)..(10): Xaa can be Trp, Phe, Leu, Met, Ile, Tyr, Val, or Cys
LXKDSDLPTX

SEQ ID NO: 113389 - protein, 11 aa, Artificial Sequence
  Description of Artificial Sequence: Synthetic peptide
  Seed: LWKDSDLPTWR (MAGC3_HUMAN)
  misc_feature (2)..(2): Xaa can be Tyr, Met, Trp, Leu, Val, Gln, Thr, Ala, Phe, Ile, Ser, Gly, or Asn
  misc_feature (11)..(11): Xaa can be Arg, or Lys
LXKDSDLPTWX

SEQ ID NO: 113390 - protein, 8 aa, Artificial Sequence
  Description of Artificial Sequence: Synthetic peptide
  Seed: MASASPSV (MAGC3_HUMAN)
  misc_feature (2)..(2): Xaa can be Ala, Ser, Thr, Val, Pro, Gln, Met, Ile, Glu, Gly, or Leu
  misc_feature (8)..(8): Xaa can be Ile, Leu, Val, Tyr, Met, Phe, or His
MXSASPSX

SEQ ID NO: 113391 - protein, 9 aa, Artificial Sequence
  Description of Artificial Sequence: Synthetic peptide
  Seed: MASASPSVM (MAGC3_HUMAN)
  misc_feature (2)..(2): Xaa can be Pro, Gln, Ala, Met, Ser, Tyr, Val, Phe, Thr, Arg, Ile, Gly, Leu, His, Glu, Asn, Asp, Lys, Cys, or Trp
  misc_feature (9)..(9): Xaa can be Val, Leu, Tyr, Met, Ile, Phe, Trp, His, Lys, Arg, Ala, Cys, Thr, Gly, Ser, Gln, Pro, Glu, Asn, or Asp
MXSASPSVX

SEQ ID NO: 113392 - protein, 8 aa, Artificial Sequence
  Description of Artificial Sequence: Synthetic peptide
  Seed: MDPDNHSY (MAGC3_HUMAN)
  misc_feature (2)..(2): Xaa can be Ala, Pro, Val, Glu, Ser, Met, Leu, Ile, Gln, Asp, Tyr, Thr, Gly, or Phe
  misc_feature (8)..(8): Xaa can be Tyr, Phe, or Leu
MXPDNHSX

SEQ ID NO: 113393 - protein, 9 aa, Artificial Sequence
  Description of Artificial Sequence: Synthetic peptide
  Seed: MDPDNHSYF (MAGC3_HUMAN)
  misc_feature (2)..(2): Xaa can be Ala, Ile, Val, Ser, Arg, Thr, Gly, Gln, Phe, Leu, Tyr, Met, Pro, Asn, Glu, Asp, Trp, His, Cys, or Lys
  misc_feature (9)..(9): Xaa can be Met, Phe, Val, Leu, Ile, Tyr, Trp, Cys, His, Ala, Lys, Arg, Thr, Ser, Gln, or Pro
MXPDNHSYX

SEQ ID NO: 113394 - protein, 10 aa, Artificial Sequence
  Description of Artificial Sequence: Synthetic peptide
  Seed: MDPDNHSYFF (MAGC3_HUMAN)
  misc_feature (2)..(2): Xaa can be Phe, Ala, Ser, Met, Pro, Gly, Asn, Thr, His, Tyr, Leu, Val, Ile, Cys, Lys, Trp, Asp, Glu, Arg, or Gln
  misc_feature (10)..(10): Xaa can be Phe, Val, Ala, Leu, Met, Tyr, Trp, Ile, or His
MXPDNHSYFX

SEQ ID NO: 113395 - protein, 10 aa, Artificial Sequence
  Description of Artificial Sequence: Synthetic peptide
  Seed: MDSLVLCPTY (MAGC3_HUMAN)
  misc_feature (2)..(2): Xaa can be Ser, Thr, Gln, Met, Ala, Cys, His, Asn, Ile, Val, Glu, Phe, Arg, Pro, Trp, Lys, Leu, Gly, Tyr, or Asp
  misc_feature (10)..(10): Xaa can be Met, Ile, Leu, Phe, Trp, Tyr, Val, His, Gly, Ala, Cys, Asp, or Asn
MXSLVLCPTX

SEQ ID NO: 113396 - protein, 8 aa, Artificial Sequence
  Description of Artificial Sequence: Synthetic peptide
  Seed: MEDRAQAI (MAGC3_HUMAN)
  misc_feature (2)..(2): Xaa can be Glu, Ala, Ser, Asp, Thr, Phe, Leu, Ile, Val, Tyr, Gly, Pro, His, Arg, Trp, Asn, Met, Gln, Cys, or Lys
  misc_feature (8)..(8): Xaa can be Leu, Ile, Met, Phe, Val, Tyr, Cys, Ala, Trp, Ser, Pro, Thr, or Gly
MXDRAQAX

SEQ ID NO: 113397 - protein, 9 aa, Artificial Sequence
  Description of Artificial Sequence: Synthetic peptide
  Seed: MEDRAQAII (MAGC3_HUMAN)
  misc_feature (2)..(2): Xaa can be Glu, Ala, Asp, Ile, Ser, Tyr, Phe, His, Gln, Thr, Val, Leu, Gly, Met, Trp, Arg, Cys, Asn, Lys, or Pro
  misc_feature (9)..(9): Xaa can be Met, Ile, Phe, Leu, Val, Cys, Tyr, Trp, Ala, Thr, Pro, Ser, Glu, Lys, Asp, Arg, Gly, or Hi s
MXDRAQAIX

SEQ ID NO: 113398 - protein, 11 aa, Artificial Sequence
  Description of Artificial Sequence: Synthetic peptide
  Seed: MEDRAQAIIDT (MAGC3_HUMAN)
  misc_feature (2)..(2): Xaa can be , or Glu
  misc_feature (11)..(11): Xaa can be Thr, Pro, Ile, Cys, Val, Met, Ser, Ala, Leu, or Phe
MXDRAQAIIDX

SEQ ID NO: 113399 - protein, 9 aa, Artificial Sequence
  Description of Artificial Sequence: Synthetic peptide
  Seed: MIFGKAHEF (MAGC3_HUMAN)
  misc_feature (2)..(2): Xaa can be Pro, Arg, Ala, Gln, Met, Leu, Tyr, Val, Phe, Ser, Ile, His, Glu, Thr, Asn, Gly, Trp, Lys, Cys, or Asp
  misc_feature (9)..(9): Xaa can be Ile, Tyr, Val, Phe, His, Trp, Leu, Arg, Met, Lys, Ala, Cys, Thr, Ser, Gln, Gly, Pro, Asn, Glu, or Asp
MXFGKAHEX

SEQ ID NO: 113400 - protein, 10 aa, Artificial Sequence
  Description of Artificial Sequence: Synthetic peptide
  Seed: MIFGKAHEFI (MAGC3_HUMAN)
  misc_feature (2)..(2): Xaa can be Met, Leu, Thr, Gln, Val, Ile, Ala, Ser, Glu, Phe, Gly, Pro, Asn, Tyr, or Cys
  misc_feature (10)..(10): Xaa can be Val, Ile, Leu, Ala, Thr, Met, Phe, Cys, Ser, Pro, Gly, or Trp
MXFGKAHEFX

SEQ ID NO: 113401 - protein, 9 aa, Artificial Sequence
  Description of Artificial Sequence: Synthetic peptide
  Seed: MIFIKGSCV (MAGC3_HUMAN)
  misc_feature (2)..(2): Xaa can be Ala, Met, Leu, Gln, Ser, Pro, Thr, Ile, Phe, Val, Trp, Asn, Gly, Cys, Glu, Tyr, Arg, Asp, Lys, or His
  misc_feature (9)..(9): Xaa can be Leu, Met, Ile, Val, Tyr, Phe, Ala, Cys, Thr, Trp, His, Gly, or Lys
MXFIKGSCX

SEQ ID NO: 113402 - protein, 9 aa, Artificial Sequence
  Description of Artificial Sequence: Synthetic peptide
  Seed: MIFRKAREF (MAGC3_HUMAN)
  misc_feature (2)..(2): Xaa can be Gln, Met, Arg, Leu, Pro, Ala, Tyr, Val, Thr, Ile, Phe, Ser, Lys, Gly, Glu, His, Trp, Asp, Cys, or Asn
  misc_feature (9)..(9): Xaa can be Tyr, Met, Ile, Val, Phe, Leu, Trp, His, Ala, Cys, Thr, Gly, Ser, Lys, Gln, or Arg
MXFRKAREX

SEQ ID NO: 113403 - protein, 10 aa, Artificial Sequence
  Description of Artificial Sequence: Synthetic peptide
  Seed: MIFRKAREFI (MAGC3_HUMAN)
  misc_feature (2)..(2): Xaa can be Thr, Ser, Met, Val, Gln, Ala, Ile, Arg, Tyr, Leu, Trp, Phe, Gly, Lys, Asn, Cys, His, Glu, Asp, or Pro
  misc_feature (10)..(10): Xaa can be Lys, Val, Ala, Ile, Leu, Met, Ser, Tyr, Arg, Gly, Thr, Pro, Phe, or Cys
MXFRKAREFX

SEQ ID NO: 113404 - protein, 8 aa, Artificial Sequence
  Description of Artificial Sequence: Synthetic peptide
  Seed: MLLPCHWV (MAGC3_HUMAN)
  misc_feature (2)..(2): Xaa can be Met, Leu, Gln, Val, or Ile
  misc_feature (8)..(8): Xaa can be Val, Ile, Leu, or Ala
MXLPCHWX

SEQ ID NO: 113405 - protein, 9 aa, Artificial Sequence
  Description of Artificial Sequence: Synthetic peptide
  Seed: MLLPCHWVL (MAGC3_HUMAN)
  misc_feature (2)..(2): Xaa can be Pro, Tyr, Met, Leu, Gln, Thr, Ser, Arg, Ala, Ile, Val, Trp, His, Glu, Phe, Cys, Gly, Asn, Lys, or Asp
  misc_feature (9)..(9): Xaa can be Ile, Tyr, Phe, Val, Met, Trp, Leu, Arg, Lys, His, Ala, Thr, Cys, Gly, Pro, Ser, Asn, Glu, or Gln
MXLPCHWVX

SEQ ID NO: 113406 - protein, 10 aa, Artificial Sequence
  Description of Artificial Sequence: Synthetic peptide
  Seed: MLLPCHWVLD (MAGC3_HUMAN)
  misc_feature (2)..(2): Xaa can be Met, Leu, Ile, Asn, Trp, Glu, Arg, Ser, Thr, Lys, Gln, Tyr, His, Val, Gly, Cys, Phe, Pro, Ala, or Asp
  misc_feature (10)..(10): Xaa can be Leu, Val, Ile, Met, Ala, Thr, Phe, Glu, Tyr, Ser, Arg, Asn, Trp, Cys, Asp, Lys, His, Pro, Gln, or Gly
MXLPCHWVLX

SEQ ID NO: 113407 - protein, 11 aa, Artificial Sequence
  Description of Artificial Sequence: Synthetic peptide
  Seed: MLLPCHWVLDA (MAGC3_HUMAN)
  misc_feature (2)..(2): Xaa can be Met, Leu, Gln, Ile, Phe, Thr, Val, or Tyr
  misc_feature (11)..(11): Xaa can be Val, Leu, Ile, Met, Ala, or Thr
MXLPCHWVLDX

SEQ ID NO: 113408 - protein, 8 aa, Artificial Sequence
  Description of Artificial Sequence: Synthetic peptide
  Seed: MLTTVIKK (MAGC3_HUMAN)
  misc_feature (2)..(2): Xaa can be Thr, Ala, Val, Ser, Leu, Gly, or Ile
  misc_feature (8)..(8): Xaa can be Lys, or Arg
MXTTVIKX

SEQ ID NO: 113409 - protein, 9 aa, Artificial Sequence
  Description of Artificial Sequence: Synthetic peptide
  Seed: MLTTVIKKY (MAGC3_HUMAN)
  misc_feature (2)..(2): Xaa can be Ala, Ile, Val, Gly, Ser, Gln, Thr, Met, Asn, Leu, Phe, Cys, Glu, Tyr, Asp, Lys, Pro, Arg, His, or Trp
  misc_feature (9)..(9): Xaa can be Tyr, Phe, Met, Leu, Trp, Lys, Arg, Val, Ile, His, Ala, or Cys
MXTTVIKKX

SEQ ID NO: 113410 - protein, 10 aa, Artificial Sequence
  Description of Artificial Sequence: Synthetic peptide
  Seed: MLTTVIKKYK (MAGC3_HUMAN)
  misc_feature (2)..(2): Xaa can be Thr, Val, Leu, Cys, His, Met, Ala, Ser, Pro, Asn, Glu, Tyr, Gly, Gln, Lys, Arg, Asp, Phe, Trp, or Ile
  misc_feature (10)..(10): Xaa can be Lys, Arg, or Tyr
MXTTVIKKYX

SEQ ID NO: 113411 - protein, 10 aa, Artificial Sequence
  Description of Artificial Sequence: Synthetic peptide
  Seed: MNVINTYTGY (MAGC3_HUMAN)
  misc_feature (2)..(2): Xaa can be Pro, Thr, Gln, Met, Leu, Ile, Arg, Glu, Lys, Ala, Asn, Ser, His, Gly, Tyr, Val, Trp, Asp, Phe, or Cys
  misc_feature (10)..(10): Xaa can be Trp, Ala, Arg, Leu, Lys, Phe, Tyr, Ile, Val, Met, His, Ser, Thr, Gln, or Gly
MXVINTYTGX

SEQ ID NO: 113412 - protein, 8 aa, Artificial Sequence
  Description of Artificial Sequence: Synthetic peptide
  Seed: MPAAGMPP (MAGC3_HUMAN)
  misc_feature (2)..(2): Xaa can be , or Pro
  misc_feature (8)..(8): Xaa can be Tyr, Ile, Met, Thr, Ser, Val, Gly, Cys, Leu, Phe, Pro, or Ala
MXAAGMPX

SEQ ID NO: 113413 - protein, 9 aa, Artificial Sequence
  Description of Artificial Sequence: Synthetic peptide
  Seed: MPAAGMPPL (MAGC3_HUMAN)
  misc_feature (2)..(2): Xaa can be Pro, Ala, Thr, His, Ser, Val, Arg, Tyr, Ile, Gln, Gly, Met, Phe, Asn, Leu, Asp, Glu, Cys, Trp, or Lys
  misc_feature (9)..(9): Xaa can be Ile, Met, Leu, Val, Tyr, Phe, Ala, Trp, His, Thr, Lys, Arg, Cys, Ser, Pro, Gly, Glu, Asn, Gln, or Asp
MXAAGMPPX

SEQ ID NO: 113414 - protein, 10 aa, Artificial Sequence
  Description of Artificial Sequence: Synthetic peptide
  Seed: MPAAGMPPLP (MAGC3_HUMAN)
  misc_feature (2)..(2): Xaa can be Pro, Ala, Val, Arg, Asp, Ile, Gln, Lys, Trp, Asn, His, Thr, Cys, Gly, Glu, Met, Phe, Tyr, Ser, or Leu
  misc_feature (10)..(10): Xaa can be Tyr, Phe, Met, Leu, Ala, Trp, His, Asn, Gln, Lys, Arg, Cys, Ile, Pro, Gly, Ser, Asp, Val, Thr, or Glu
MXAAGMPPLX

SEQ ID NO: 113415 - protein, 11 aa, Artificial Sequence
  Description of Artificial Sequence: Synthetic peptide
  Seed: MPAAGMPPLPQ (MAGC3_HUMAN)
  misc_feature (2)..(2): Xaa can be Pro, Ala, or Val
  misc_feature (11)..(11): Xaa can be Ala, Leu, Cys, Glu, Ile, Asp, Asn, Ser, Met, Thr, Trp, Phe, Tyr, Arg, His, Val, Gly, Lys, Pro, or Gln
MXAAGMPPLPX

SEQ ID NO: 113416 - protein, 8 aa, Artificial Sequence
  Description of Artificial Sequence: Synthetic peptide
  Seed: MPKNCLLI (MAGC3_HUMAN)
  misc_feature (2)..(2): Xaa can be , or Pro
  misc_feature (8)..(8): Xaa can be Pro, Ala, Leu, Thr, Met, Phe, Val, or Ile
MXKNCLLX

SEQ ID NO: 113417 - protein, 9 aa, Artificial Sequence
  Description of Artificial Sequence: Synthetic peptide
  Seed: MPKNCLLIL (MAGC3_HUMAN)
  misc_feature (2)..(2): Xaa can be Pro, Arg, Ala, Gln, Met, Ser, Gly, Ile, Asn, Thr, Val, His, Leu, Glu, Asp, Lys, Cys, Phe, Trp, or Tyr
  misc_feature (9)..(9): Xaa can be Phe, Leu, Ile, Tyr, Met, Val, Lys, Trp, Ala, Arg, His, Cys, Gln, Pro, Asn, Thr, Glu, Ser, or Gly
MXKNCLLIX

SEQ ID NO: 113418 - protein, 10 aa, Artificial Sequence
  Description of Artificial Sequence: Synthetic peptide
  Seed: MPKNCLLILI (MAGC3_HUMAN)
  misc_feature (2)..(2): Xaa can be Pro, Ala, or Ser
  misc_feature (10)..(10): Xaa can be Trp, Ala, Phe, Met, Tyr, Leu, Asn, Lys, His, Ile, Gly, Cys, Val, Pro, Ser, Arg, Gln, Glu, Thr, or Asp
MXKNCLLILX

SEQ ID NO: 113419 - protein, 11 aa, Artificial Sequence
  Description of Artificial Sequence: Synthetic peptide
  Seed: MPKNCLLILIL (MAGC3_HUMAN)
  misc_feature (2)..(2): Xaa can be , or Pro
  misc_feature (11)..(11): Xaa can be Phe, Ile, Cys, Ala, Leu, Val, or Met
MXKNCLLILIX

SEQ ID NO: 113420 - protein, 8 aa, Artificial Sequence
  Description of Artificial Sequence: Synthetic peptide
  Seed: MPPLPQSP (MAGC3_HUMAN)
  misc_feature (2)..(2): Xaa can be Pro, or Ala
  misc_feature (8)..(8): Xaa can be Ala, Leu, Gly, Val, Pro, Tyr, Phe, Cys, Ser, Thr, Met, or Ile
MXPLPQSX

SEQ ID NO: 113421 - protein, 9 aa, Artificial Sequence
  Description of Artificial Sequence: Synthetic peptide
  Seed: MPPLPQSPP (MAGC3_HUMAN)
  misc_feature (2)..(2): Xaa can be Pro, Ala, Val, Thr, Gly, Ile, Ser, Met, Leu, Gln, Cys, or Phe
  misc_feature (9)..(9): Xaa can be Leu, Ala, Met, Val, Ile, Phe, Cys, Pro, Ser, Thr, Gly, Arg, Glu, Gln, Asp, His, Tyr, Lys, Trp, or Asn
MXPLPQSPX

SEQ ID NO: 113422 - protein, 10 aa, Artificial Sequence
  Description of Artificial Sequence: Synthetic peptide
  Seed: MPPLPQSPPE (MAGC3_HUMAN)
  misc_feature (2)..(2): Xaa can be Pro, Ala, Gly, Val, Ile, or Met
  misc_feature (10)..(10): Xaa can be Ala, Val, Cys, Leu, Gly, Pro, Ile, Tyr, Thr, Asn, His, Phe, Ser, Glu, Arg, Lys, Met, Trp, or Gln
MXPLPQSPPX

SEQ ID NO: 113423 - protein, 11 aa, Artificial Sequence
  Description of Artificial Sequence: Synthetic peptide
  Seed: MPPLPQSPPEI (MAGC3_HUMAN)
  misc_feature (2)..(2): Xaa can be Pro, Ala, Ser, Val, Ile, Gly, Thr, Leu, Met, or Arg
  misc_feature (11)..(11): Xaa can be Leu, Met, Ile, Phe, Tyr, Val, Cys, Ala, Gly, Ser, Thr, Lys, Pro, Arg, or Trp
MXPLPQSPPEX

SEQ ID NO: 113424 - protein, 8 aa, Artificial Sequence
  Description of Artificial Sequence: Synthetic peptide
  Seed: MPQNRLLI (MAGC3_HUMAN)
  misc_feature (2)..(2): Xaa can be Pro, Met, Leu, Ala, Gln, Ile, Val, Phe, Ser, Arg, Gly, or Asn
  misc_feature (8)..(8): Xaa can be Leu, Met, Ile, Phe, Val, Ala, Pro, Cys, or Thr
MXQNRLLX

SEQ ID NO: 113425 - protein, 9 aa, Artificial Sequence
  Description of Artificial Sequence: Synthetic peptide
  Seed: MPQNRLLIL (MAGC3_HUMAN)
  misc_feature (2)..(2): Xaa can be Pro, Arg, Met, Ala, Ser, His, Gln, Gly, Leu, Phe, Thr, Val, Ile, Tyr, Glu, Lys, Asn, Asp, Trp, or Cys
  misc_feature (9)..(9): Xaa can be Tyr, Phe, Met, Ile, Val, Leu, Ala, Lys, Cys, Trp, Arg, His, Thr, Gly, Ser, Gln, Pro, Asn, or Glu
MXQNRLLIX

SEQ ID NO: 113426 - protein, 10 aa, Artificial Sequence
  Description of Artificial Sequence: Synthetic peptide
  Seed: MPQNRLLILI (MAGC3_HUMAN)
  misc_feature (2)..(2): Xaa can be Met, Pro, Gln, Leu, Val, Ala, Tyr, Ile, His, Asn, Phe, Trp, Gly, Asp, Ser, Thr, Arg, Lys, Cys, or Glu
  misc_feature (10)..(10): Xaa can be Phe, Met, Leu, Ile, Val, Ala, Trp, Thr, Ser, Asn, Arg, Gln, Glu, His, Tyr, Lys, Pro, Gly, Cys, or Asp
MXQNRLLILX

SEQ ID NO: 113427 - protein, 11 aa, Artificial Sequence
  Description of Artificial Sequence: Synthetic peptide
  Seed: MPQNRLLILIL (MAGC3_HUMAN)
  misc_feature (2)..(2): Xaa can be Pro, Met, Ala, or Leu
  misc_feature (11)..(11): Xaa can be Leu, Trp, Met, Ile, Val, Ala, Phe, or Tyr
MXQNRLLILIX

SEQ ID NO: 113428 - protein, 9 aa, Artificial Sequence
  Description of Artificial Sequence: Synthetic peptide
  Seed: MQMNVINTY (MAGC3_HUMAN)
  misc_feature (2)..(2): Xaa can be Pro, Glu, Ala, Arg, Gln, Met, Leu, Tyr, Lys, Thr, Ser, Ile, Phe, Val, His, Asp, Asn, Trp, Cys, or Gly
  misc_feature (9)..(9): Xaa can be Arg, Leu, Met, Phe, Trp, Ala, Ile, Tyr, Val, His, Lys, Thr, Cys, Ser, Gln, Gly, Pro, Glu, Asn, or Asp
MXMNVINTX

SEQ ID NO: 113429 - protein, 10 aa, Artificial Sequence
  Description of Artificial Sequence: Synthetic peptide
  Seed: MQMNVINTYT (MAGC3_HUMAN)
  misc_feature (2)..(2): Xaa can be Arg, Leu, Lys, His, Gln, Pro, Met, Ala, Tyr, Ser, Thr, Glu, Val, Ile, Phe, Trp, Gly, Asn, Cys, or Asp
  misc_feature (10)..(10): Xaa can be Val, Ala, Thr, Phe, Ile, Tyr, Met, Leu, Ser, Trp, His, Lys, Cys, Arg, Gln, Asn, Gly, Pro, Glu, or Asp
MXMNVINTYX

SEQ ID NO: 113430 - protein, 11 aa, Artificial Sequence
  Description of Artificial Sequence: Synthetic peptide
  Seed: MQMNVINTYTG (MAGC3_HUMAN)
  misc_feature (2)..(2): Xaa can be Met, Gln, Lys, His, Arg, Leu, Thr, Val, Glu, Ile, Ser, Ala, Tyr, Gly, Asn, Phe, or Trp
  misc_feature (11)..(11): Xaa can be Tyr, Phe, Met, Leu, Trp, His, Val, Ile, Asp, Ser, Gly, Gln, Cys, Lys, Arg, Ala, Asn, Pro, Glu, or Thr
MXMNVINTYTX

SEQ ID NO: 113431 - protein, 9 aa, Artificial Sequence
  Description of Artificial Sequence: Synthetic peptide
  Seed: NAIGPWSAL (MAGC3_HUMAN)
  misc_feature (2)..(2): Xaa can be Pro, Thr, Ala, Val, His, Tyr, Arg, Ser, Ile, Met, Gln, Phe, Gly, Leu, Glu, Trp, Asn, Cys, Lys, or Asp
  misc_feature (9)..(9): Xaa can be Tyr, Leu, Arg, Phe, Met, Val, Lys, Trp, Ile, His, Ala, Thr, Cys, Gln, Pro, Ser, Gly, Glu, or Asn
NXIGPWSAX

SEQ ID NO: 113432 - protein, 10 aa, Artificial Sequence
  Description of Artificial Sequence: Synthetic peptide
  Seed: NAIGPWSALA (MAGC3_HUMAN)
  misc_feature (2)..(2): Xaa can be Thr, Val, Ala, Ser, Ile, Leu, Met, Asn, Gly, Phe, Pro, Cys, Gln, or Tyr
  misc_feature (10)..(10): Xaa can be Val, Ile, Ala, Leu, Met, Thr, Ser, Phe, Trp, Glu, Gly, Pro, Cys, Tyr, Asn, Asp, His, Arg, Gln, or Lys
NXIGPWSALX

SEQ ID NO: 113433 - protein, 9 aa, Artificial Sequence
  Description of Artificial Sequence: Synthetic peptide
  Seed: NCASEEVIW (MAGC3_HUMAN)
  misc_feature (2)..(2): Xaa can be Ser, Thr, Ala, Cys, Gly, Ile, Phe, Met, Gln, Asn, Pro, Leu, or Val
  misc_feature (9)..(9): Xaa can be Trp, Phe, or Leu
NXASEEVIX

SEQ ID NO: 113434 - protein, 9 aa, Artificial Sequence
  Description of Artificial Sequence: Synthetic peptide
  Seed: NHSYFFEDT (MAGC3_HUMAN)
  misc_feature (2)..(2): Xaa can be His, Arg, or Gln
  misc_feature (9)..(9): Xaa can be Val, Ile, Ala, Leu, Cys, Thr, Phe, or Met
NXSYFFEDX

SEQ ID NO: 113435 - protein, 10 aa, Artificial Sequence
  Description of Artificial Sequence: Synthetic peptide
  Seed: NHSYFFEDTL (MAGC3_HUMAN)
  misc_feature (2)..(2): Xaa can be His, or Arg
  misc_feature (10)..(10): Xaa can be Leu, Met, Val, Phe, Ile, Ala, Tyr, or Trp
NXSYFFEDTX

SEQ ID NO: 113436 - protein, 9 aa, Artificial Sequence
  Description of Artificial Sequence: Synthetic peptide
  Seed: NPQGLAGHR (MAGC3_HUMAN)
  misc_feature (2)..(2): Xaa can be Val, Thr, Ile, Ala, Met, Leu, Gly, Ser, Phe, Pro, Trp, Tyr, Asn, Glu, His, Gln, Cys, or As p
  misc_feature (9)..(9): Xaa can be Arg, Lys, Tyr, Met, His, Leu, or Phe
NXQGLAGHX

SEQ ID NO: 113437 - protein, 8 aa, Artificial Sequence
  Description of Artificial Sequence: Synthetic peptide
  Seed: NRLLILIL (MAGC3_HUMAN)
  misc_feature (2)..(2): Xaa can be His, Arg, or Gln
  misc_feature (8)..(8): Xaa can be Val, Leu, Ala, Ile, Met, Phe, Cys, Pro, Ser, Gly, Thr, or Tyr
NXLLILIX

SEQ ID NO: 113438 - protein, 9 aa, Artificial Sequence
  Description of Artificial Sequence: Synthetic peptide
  Seed: NRLLILILS (MAGC3_HUMAN)
  misc_feature (2)..(2): Xaa can be Arg, His, or Gln
  misc_feature (9)..(9): Xaa can be Leu, Ala, Gly, Thr, Ile, Pro, Met, Phe, Cys, Val, or Ser
NXLLILILX

SEQ ID NO: 113439 - protein, 10 aa, Artificial Sequence
  Description of Artificial Sequence: Synthetic peptide
  Seed: NRLLILILSV (MAGC3_HUMAN)
  misc_feature (2)..(2): Xaa can be Arg, Met, Leu, Gln, Phe, Tyr, Cys, Asp, Ser, Gly, Asn, Pro, Trp, Glu, His, Ile, Thr, Val, Ala, or Lys
  misc_feature (10)..(10): Xaa can be Ile, Leu, Val, Ala, Arg, Met, Phe, Lys, Trp, His, or Tyr
NXLLILILSX

SEQ ID NO: 113440 - protein, 11 aa, Artificial Sequence
  Description of Artificial Sequence: Synthetic peptide
  Seed: NTCATYALSPV (MAGC3_HUMAN)
  misc_feature (2)..(2): Xaa can be Thr, Ala, Ile, Val, or Ser
  misc_feature (11)..(11): Xaa can be Val, Leu, or Ile
NXCATYALSPX

SEQ ID NO: 113441 - protein, 11 aa, Artificial Sequence
  Description of Artificial Sequence: Synthetic peptide
  Seed: NTLDLTCEGSL (MAGC3_HUMAN)
  misc_feature (2)..(2): Xaa can be Thr, Ser, Ala, Val, Cys, Gly, Phe, Asn, Asp, Ile, Gln, Pro, Met, Glu, Leu, or Trp
  misc_feature (11)..(11): Xaa can be Trp, Phe, Leu, Met, Tyr, or Ile
NXLDLTCEGSX

SEQ ID NO: 113442 - protein, 9 aa, Artificial Sequence
  Description of Artificial Sequence: Synthetic peptide
  Seed: NTYTGYFPM (MAGC3_HUMAN)
  misc_feature (2)..(2): Xaa can be Thr, Pro, Met, Leu, Val, Gln, Ile, Ser, Tyr, Ala, Gly, Phe, Asn, Lys, Trp, Cys, Glu, His, Asp, or Arg
  misc_feature (9)..(9): Xaa can be Tyr, Phe, Met, Lys, Leu, Val, Trp, Arg, Ile, Ala, His, Thr, Cys, Ser, Gly, Gln, Pro, Asn, or Glu
NXYTGYFPX

SEQ ID NO: 113443 - protein, 10 aa, Artificial Sequence
  Description of Artificial Sequence: Synthetic peptide
  Seed: NTYTGYFPMI (MAGC3_HUMAN)
  misc_feature (2)..(2): Xaa can be Leu, Met, Thr, Val, Tyr, Gln, Ser, Ile, Ala, Lys, Trp, Asn, Arg, Phe, Pro, Asp, His, Cys, Glu, or Gly
  misc_feature (10)..(10): Xaa can be Leu, Trp, Phe, Ile, Val, Met, Ala, Thr, Cys, Ser, or Tyr
NXYTGYFPMX

SEQ ID NO: 113444 - protein, 11 aa, Artificial Sequence
  Description of Artificial Sequence: Synthetic peptide
  Seed: NTYTGYFPMIF (MAGC3_HUMAN)
  misc_feature (2)..(2): Xaa can be Tyr, Arg, Trp, Ser, Thr, Ile, Phe, Ala, Leu, Gln, Met, Val, Pro, Gly, Asn, Lys, His, or Cy s
  misc_feature (11)..(11): Xaa can be Trp, Phe, Ile, Leu, Tyr, Val, or Met
NXYTGYFPMIX

SEQ ID NO: 113445 - protein, 9 aa, Artificial Sequence
  Description of Artificial Sequence: Synthetic peptide
  Seed: NVINTYTGY (MAGC3_HUMAN)
  misc_feature (2)..(2): Xaa can be Thr, Val, Gln, Ala, Met, Ile, Pro, Ser, Leu, Glu, Gly, Tyr, Cys, Lys, Asp, Phe, Trp, Asn, Arg, or His
  misc_feature (9)..(9): Xaa can be Phe, Tyr, Lys, Arg, Met, Leu, His, Trp, Val, Ile, or Ala
NXINTYTGX

SEQ ID NO: 113446 - protein, 10 aa, Artificial Sequence
  Description of Artificial Sequence: Synthetic peptide
  Seed: NVINTYTGYF (MAGC3_HUMAN)
  misc_feature (2)..(2): Xaa can be Thr, Val, Ala, Ile, Ser, Met, Leu, Gln, Pro, Glu, or Gly
  misc_feature (10)..(10): Xaa can be Tyr, Phe, Lys, Met, Arg, Trp, Leu, Val, or Ala
NXINTYTGYX

SEQ ID NO: 113447 - protein, 8 aa, Artificial Sequence
  Description of Artificial Sequence: Synthetic peptide
  Seed: PAAGMPPL (MAGC3_HUMAN)
  misc_feature (2)..(2): Xaa can be Met, Arg, Ala, His, Tyr, Asn, Ile, Lys, Gln, Phe, Ser, or Trp
  misc_feature (8)..(8): Xaa can be Leu, Met, Ile, Val, or Phe
PXAGMPPX

SEQ ID NO: 113448 - protein, 9 aa, Artificial Sequence
  Description of Artificial Sequence: Synthetic peptide
  Seed: PAREVLEFL (MAGC3_HUMAN)
  misc_feature (2)..(2): Xaa can be Ala, Pro, Met, Ser, Thr, Ile, or Val
  misc_feature (9)..(9): Xaa can be Tyr, Met, Phe, Leu, Val, or Ile
PXREVLEFX

SEQ ID NO: 113449 - protein, 9 aa, Artificial Sequence
  Description of Artificial Sequence: Synthetic peptide
  Seed: PAVSPGKRL (MAGC3_HUMAN)
  misc_feature (2)..(2): Xaa can be Pro, or Ala
  misc_feature (9)..(9): Xaa can be Met, Leu, Val, Phe, or Ile
PXVSPGKRX

SEQ ID NO: 113450 - protein, 10 aa, Artificial Sequence
  Description of Artificial Sequence: Synthetic peptide
  Seed: PAVSPGKRLW (MAGC3_HUMAN)
  misc_feature (2)..(2): Xaa can be Ser, Ala, Thr, Gly, Val, Leu, Cys, Gln, Asp, Met, Phe, Ile, Glu, Pro, or Asn
  misc_feature (10)..(10): Xaa can be Trp, or Phe
PXVSPGKRLX

SEQ ID NO: 113451 - protein, 11 aa, Artificial Sequence
  Description of Artificial Sequence: Synthetic peptide
  Seed: PEAFCEESGLR (MAGC3_HUMAN)
  misc_feature (2)..(2): Xaa can be Glu, or Met
  misc_feature (11)..(11): Xaa can be , or Arg
PXAFCEESGLX

SEQ ID NO: 113452 - protein, 8 aa, Artificial Sequence
  Description of Artificial Sequence: Synthetic peptide
  Seed: PEEVIWEV (MAGC3_HUMAN)
  misc_feature (2)..(2): Xaa can be , or Glu
  misc_feature (8)..(8): Xaa can be Leu, or Val
PXEVIWEX

SEQ ID NO: 113453 - protein, 9 aa, Artificial Sequence
  Description of Artificial Sequence: Synthetic peptide
  Seed: PEEVIWEVL (MAGC3_HUMAN)
  misc_feature (2)..(2): Xaa can be , or Glu
  misc_feature (9)..(9): Xaa can be Met, Phe, Val, Ile, Ala, or Leu
PXEVIWEVX

SEQ ID NO: 113454 - protein, 9 aa, Artificial Sequence
  Description of Artificial Sequence: Synthetic peptide
  Seed: PEIPPQGPP (MAGC3_HUMAN)
  misc_feature (2)..(2): Xaa can be , or Glu
  misc_feature (9)..(9): Xaa can be Thr, Met, Val, Ile, Pro, Leu, Ala, or Cys
PXIPPQGPX

SEQ ID NO: 113455 - protein, 11 aa, Artificial Sequence
  Description of Artificial Sequence: Synthetic peptide
  Seed: PEIPPQGPPKI (MAGC3_HUMAN)
  misc_feature (2)..(2): Xaa can be , or Glu
  misc_feature (11)..(11): Xaa can be Phe, Met, Trp, Ala, Leu, Val, Ile, Thr, Cys, or Pro
PXIPPQGPPKX

SEQ ID NO: 113456 - protein, 9 aa, Artificial Sequence
  Description of Artificial Sequence: Synthetic peptide
  Seed: PESEPLFTY (MAGC3_HUMAN)
  misc_feature (2)..(2): Xaa can be Glu, Gln, Ala, Met, Asp, Arg, Gly, Leu, Ser, Pro, Ile, Val, Thr, Phe, Trp, His, Tyr, Asn, or Lys
  misc_feature (9)..(9): Xaa can be Tyr, Phe, Met, Trp, Leu, or Ile
PXSEPLFTX

SEQ ID NO: 113457 - protein, 11 aa, Artificial Sequence
  Description of Artificial Sequence: Synthetic peptide
  Seed: PESEPLFTYTL (MAGC3_HUMAN)
  misc_feature (2)..(2): Xaa can be , or Glu
  misc_feature (11)..(11): Xaa can be Leu, or Ala
PXSEPLFTYTX

SEQ ID NO: 113458 - protein, 9 aa, Artificial Sequence
  Description of Artificial Sequence: Synthetic peptide
  Seed: PESESLPRY (MAGC3_HUMAN)
  misc_feature (2)..(2): Xaa can be Glu, or Gln
  misc_feature (9)..(9): Xaa can be Trp, Phe, or Tyr
PXSESLPRX

SEQ ID NO: 113459 - protein, 10 aa, Artificial Sequence
  Description of Artificial Sequence: Synthetic peptide
  Seed: PESESLPRYA (MAGC3_HUMAN)
  misc_feature (2)..(2): Xaa can be , or Glu
  misc_feature (10)..(10): Xaa can be Ala, Leu, or Val
PXSESLPRYX

SEQ ID NO: 113460 - protein, 11 aa, Artificial Sequence
  Description of Artificial Sequence: Synthetic peptide
  Seed: PESESLPRYAL (MAGC3_HUMAN)
  misc_feature (2)..(2): Xaa can be , or Glu
  misc_feature (11)..(11): Xaa can be Val, Cys, Met, Leu, or Ala
PXSESLPRYAX

SEQ ID NO: 113461 - protein, 9 aa, Artificial Sequence
  Description of Artificial Sequence: Synthetic peptide
  Seed: PLDSCSSPL (MAGC3_HUMAN)
  misc_feature (2)..(2): Xaa can be Tyr, Val, Phe, Ile, Leu, Ala, Thr, Ser, Trp, Met, Gly, or Gln
  misc_feature (9)..(9): Xaa can be Leu, Met, Val, Phe, Ile, or Tyr
PXDSCSSPX

SEQ ID NO: 113462 - protein, 11 aa, Artificial Sequence
  Description of Artificial Sequence: Synthetic peptide
  Seed: PLDSCSSPLLW (MAGC3_HUMAN)
  misc_feature (2)..(2): Xaa can be Val, Thr, Ala, Ser, Met, Lys, Gly, Ile, Gln, Asn, Arg, Tyr, His, Cys, Phe, Trp, Pro, or Le u
  misc_feature (11)..(11): Xaa can be Trp, or Phe
PXDSCSSPLLX

SEQ ID NO: 113463 - protein, 10 aa, Artificial Sequence
  Description of Artificial Sequence: Synthetic peptide
  Seed: PLFTYTLDEK (MAGC3_HUMAN)
  misc_feature (2)..(2): Xaa can be Leu, Ile, or Met
  misc_feature (10)..(10): Xaa can be , or Lys
PXFTYTLDEX

SEQ ID NO: 113464 - protein, 8 aa, Artificial Sequence
  Description of Artificial Sequence: Synthetic peptide
  Seed: PLNEKRTL (MAGC3_HUMAN)
  misc_feature (2)..(2): Xaa can be Pro, Met, Leu, Ile, Ser, His, Gln, Asn, Gly, Phe, Val, Arg, Ala, Glu, or Tyr
  misc_feature (8)..(8): Xaa can be Leu, Met, or Ile
PXNEKRTX

SEQ ID NO: 113465 - protein, 9 aa, Artificial Sequence
  Description of Artificial Sequence: Synthetic peptide
  Seed: PLNEKRTLW (MAGC3_HUMAN)
  misc_feature (2)..(2): Xaa can be Thr, Ser, Ala, Cys, Pro, Ile, Glu, Met, Gln, Asp, Gly, Val, Asn, Leu, Phe, or Trp
  misc_feature (9)..(9): Xaa can be Trp, Phe, or Tyr
PXNEKRTLX

SEQ ID NO: 113466 - protein, 9 aa, Artificial Sequence
  Description of Artificial Sequence: Synthetic peptide
  Seed: PLPQSPPEI (MAGC3_HUMAN)
  misc_feature (2)..(2): Xaa can be Thr, Ala, Leu, Met, Ser, Phe, Ile, Gly, Val, Gln, Tyr, Pro, Cys, Trp, Asn, or Glu
  misc_feature (9)..(9): Xaa can be Leu, Met, Val, Ile, or Phe
PXPQSPPEX

SEQ ID NO: 113467 - protein, 10 aa, Artificial Sequence
  Description of Artificial Sequence: Synthetic peptide
  Seed: PMIFGKAHEF (MAGC3_HUMAN)
  misc_feature (2)..(2): Xaa can be Met, Gln, Ile, Val, Thr, Leu, Ala, Ser, or Glu
  misc_feature (10)..(10): Xaa can be Tyr, or Phe
PXIFGKAHEX

SEQ ID NO: 113468 - protein, 10 aa, Artificial Sequence
  Description of Artificial Sequence: Synthetic peptide
  Seed: PPLPQSPPEI (MAGC3_HUMAN)
  misc_feature (2)..(2): Xaa can be Pro, or Ala
  misc_feature (10)..(10): Xaa can be Ala, Ile, Thr, Phe, Met, Leu, Cys, Pro, or Val
PXLPQSPPEX

SEQ ID NO: 113469 - protein, 8 aa, Artificial Sequence
  Description of Artificial Sequence: Synthetic peptide
  Seed: PPQGPPKI (MAGC3_HUMAN)
  misc_feature (2)..(2): Xaa can be Pro, or Ala
  misc_feature (8)..(8): Xaa can be Leu, Ile, or Met
PXQGPPKX

SEQ ID NO: 113470 - protein, 10 aa, Artificial Sequence
  Description of Artificial Sequence: Synthetic peptide
  Seed: PPQGPPKISP (MAGC3_HUMAN)
  misc_feature (2)..(2): Xaa can be Pro, Ala, or Val
  misc_feature (10)..(10): Xaa can be Ala, Leu, Gly, Cys, Ser, Thr, Tyr, Val, Met, Phe, Pro, or Ile
PXQGPPKISX

SEQ ID NO: 113471 - protein, 10 aa, Artificial Sequence
  Description of Artificial Sequence: Synthetic peptide
  Seed: PPQPQPRKKA (MAGC3_HUMAN)
  misc_feature (2)..(2): Xaa can be , or Pro
  misc_feature (10)..(10): Xaa can be , or Ala
PXQPQPRKKX

SEQ ID NO: 113472 - protein, 9 aa, Artificial Sequence
  Description of Artificial Sequence: Synthetic peptide
  Seed: PPQSPPQSP (MAGC3_HUMAN)
  misc_feature (2)..(2): Xaa can be Pro, Ala, Val, Ile, Leu, Gly, Met, Ser, or Gln
  misc_feature (9)..(9): Xaa can be Ala, Leu, Met, Val, Phe, Ile, Cys, Pro, Ser, Tyr, or Thr
PXQSPPQSX

SEQ ID NO: 113473 - protein, 10 aa, Artificial Sequence
  Description of Artificial Sequence: Synthetic peptide
  Seed: PPQSPPQSPL (MAGC3_HUMAN)
  misc_feature (2)..(2): Xaa can be Pro, or Ala
  misc_feature (10)..(10): Xaa can be Leu, Ala, Met, Phe, Val, Cys, Ile, Thr, or Pro
PXQSPPQSPX

SEQ ID NO: 113474 - protein, 9 aa, Artificial Sequence
  Description of Artificial Sequence: Synthetic peptide
  Seed: PQDWPLNEK (MAGC3_HUMAN)
  misc_feature (2)..(2): Xaa can be Thr, Ser, Ile, Val, Gln, Leu, Met, Ala, Glu, Cys, Asp, Trp, Phe, Tyr, Gly, or Asn
  misc_feature (9)..(9): Xaa can be Tyr, Lys, Arg, Phe, or His
PXDWPLNEX

SEQ ID NO: 113475 - protein, 9 aa, Artificial Sequence
  Description of Artificial Sequence: Synthetic peptide
  Seed: PQNRLLILI (MAGC3_HUMAN)
  misc_feature (2)..(2): Xaa can be Arg, Gln, Met, Ser, Gly, Val, Ala, Thr, Ile, Leu, Cys, Trp, Phe, Lys, or Asn
  misc_feature (9)..(9): Xaa can be Leu, Ile, Lys, Val, Tyr, Phe, Arg, or Met
PXNRLLILX

SEQ ID NO: 113476 - protein, 9 aa, Artificial Sequence
  Description of Artificial Sequence: Synthetic peptide
  Seed: PQSPPQSPL (MAGC3_HUMAN)
  misc_feature (2)..(2): Xaa can be His, Gln, Met, Phe, Ala, Tyr, Val, Leu, Ile, Arg, Thr, Ser, Lys, Pro, Trp, Glu, Asn, or Gl y
  misc_feature (9)..(9): Xaa can be Tyr, Phe, Met, Leu, Val, or Ile
PXSPPQSPX

SEQ ID NO: 113477 - protein, 9 aa, Artificial Sequence
  Description of Artificial Sequence: Synthetic peptide
  Seed: PRYALDEKV (MAGC3_HUMAN)
  misc_feature (2)..(2): Xaa can be , or Arg
  misc_feature (9)..(9): Xaa can be Val, Ile, Met, Phe, or Leu
PXYALDEKX

SEQ ID NO: 113478 - protein, 9 aa, Artificial Sequence
  Description of Artificial Sequence: Synthetic peptide
  Seed: PSWYMDALK (MAGC3_HUMAN)
  misc_feature (2)..(2): Xaa can be Thr, Ile, Val, Ser, or Ala
  misc_feature (9)..(9): Xaa can be Lys, or Arg
PXWYMDALX

SEQ ID NO: 113479 - protein, 9 aa, Artificial Sequence
  Description of Artificial Sequence: Synthetic peptide
  Seed: PTWRRGTGY (MAGC3_HUMAN)
  misc_feature (2)..(2): Xaa can be Thr, Phe, Tyr, or Met
  misc_feature (9)..(9): Xaa can be , or Tyr
PXWRRGTGX

SEQ ID NO: 113480 - protein, 10 aa, Artificial Sequence
  Description of Artificial Sequence: Synthetic peptide
  Seed: PTYFKLWRTL (MAGC3_HUMAN)
  misc_feature (2)..(2): Xaa can be Trp, Tyr, Phe, Thr, Met, Ile, Ser, Ala, Lys, Arg, Val, Pro, Leu, Asn, His, Gly, Cys, Asp, Glu, or Gln
  misc_feature (10)..(10): Xaa can be Ile, Phe, Leu, Trp, Met, or Val
PXYFKLWRTX

SEQ ID NO: 113481 - protein, 8 aa, Artificial Sequence
  Description of Artificial Sequence: Synthetic peptide
  Seed: QAKEPLTR (MAGC3_HUMAN)
  misc_feature (2)..(2): Xaa can be Ala, Ser, Thr, Val, Ile, Leu, Gly, Met, Gln, Asn, Cys, Phe, Tyr, Asp, Glu, or Trp
  misc_feature (8)..(8): Xaa can be Arg, Tyr, Phe, Met, Lys, Leu, His, Ile, Val, or Ala
QXKEPLTX

SEQ ID NO: 113482 - protein, 9 aa, Artificial Sequence
  Description of Artificial Sequence: Synthetic peptide
  Seed: QAKEPLTRA (MAGC3_HUMAN)
  misc_feature (2)..(2): Xaa can be Ala, Pro, Val, Ser, Ile, Thr, Gln, Gly, Leu, Glu, Met, Asn, Phe, Cys, Tyr, Asp, Arg, or Ly s
  misc_feature (9)..(9): Xaa can be Tyr, Phe, Met, Leu, Val, His, Trp, Ile, Ala, Gln, Thr, Cys, Arg, Lys, Ser, Pro, or Gly
QXKEPLTRX

SEQ ID NO: 113483 - protein, 11 aa, Artificial Sequence
  Description of Artificial Sequence: Synthetic peptide
  Seed: QAKEPLTRAEM (MAGC3_HUMAN)
  misc_feature (2)..(2): Xaa can be Ala, Val, Gln, Leu, Ser, Met, Thr, Ile, or Gly
  misc_feature (11)..(11): Xaa can be Tyr, Phe, Met, His, or Leu
QXKEPLTRAEX

SEQ ID NO: 113484 - protein, 8 aa, Artificial Sequence
  Description of Artificial Sequence: Synthetic peptide
  Seed: QDWPLNEK (MAGC3_HUMAN)
  misc_feature (2)..(2): Xaa can be Ala, Ser, Ile, Val, Gly, Asp, or Thr
  misc_feature (8)..(8): Xaa can be Lys, Leu, Met, Ile, Phe, or Val
QXWPLNEX

SEQ ID NO: 113485 - protein, 9 aa, Artificial Sequence
  Description of Artificial Sequence: Synthetic peptide
  Seed: QDWPLNEKR (MAGC3_HUMAN)
  misc_feature (2)..(2): Xaa can be Met, Leu, Ile, Val, Thr, Ser, Ala, Gln, Glu, Pro, Trp, Asn, Cys, Tyr, Asp, Gly, Phe, Arg, His, or Lys
  misc_feature (9)..(9): Xaa can be Arg, Lys, Tyr, His, Met, Phe, Leu, Val, or Ile
QXWPLNEKX

SEQ ID NO: 113486 - protein, 11 aa, Artificial Sequence
  Description of Artificial Sequence: Synthetic peptide
  Seed: QDWPLNEKRTL (MAGC3_HUMAN)
  misc_feature (2)..(2): Xaa can be Glu, Asp, or Gln
  misc_feature (11)..(11): Xaa can be Phe, Leu, Met, Pro, Gly, Val, Cys, Thr, Ala, Tyr, Ile, Ser, or Trp
QXWPLNEKRTX

SEQ ID NO: 113487 - protein, 8 aa, Artificial Sequence
  Description of Artificial Sequence: Synthetic peptide
  Seed: QEDGRRGL (MAGC3_HUMAN)
  misc_feature (2)..(2): Xaa can be Glu, or Asp
  misc_feature (8)..(8): Xaa can be Leu, Phe, Val, Ile, Met, or Ala
QXDGRRGX

SEQ ID NO: 113488 - protein, 9 aa, Artificial Sequence
  Description of Artificial Sequence: Synthetic peptide
  Seed: QEDGRRGLT (MAGC3_HUMAN)
  misc_feature (2)..(2): Xaa can be Glu, Asp, or Gln
  misc_feature (9)..(9): Xaa can be Ala, Val, Ile, Leu, Met, Phe, Ser, Gly, Cys, Thr, Tyr, Trp, or Pro
QXDGRRGLX

SEQ ID NO: 113489 - protein, 10 aa, Artificial Sequence
  Description of Artificial Sequence: Synthetic peptide
  Seed: QEDGRRGLTE (MAGC3_HUMAN)
  misc_feature (2)..(2): Xaa can be Glu, Asp, or Gln
  misc_feature (10)..(10): Xaa can be Ile, Val, Leu, Ala, Met, Cys, Trp, Pro, Tyr, Lys, Glu, Gly, Phe, Thr, Gln, Asp, Arg, or Se r
QXDGRRGLTX

SEQ ID NO: 113490 - protein, 11 aa, Artificial Sequence
  Description of Artificial Sequence: Synthetic peptide
  Seed: QEDGRRGLTEA (MAGC3_HUMAN)
  misc_feature (2)..(2): Xaa can be Glu, Asp, or Gln
  misc_feature (11)..(11): Xaa can be Leu, Trp, Thr, Gly, Ala, Cys, Tyr, Val, Met, Ile, Phe, Ser, or Pro
QXDGRRGLTEX

SEQ ID NO: 113491 - protein, 10 aa, Artificial Sequence
  Description of Artificial Sequence: Synthetic peptide
  Seed: QFLLLKYQAK (MAGC3_HUMAN)
  misc_feature (2)..(2): Xaa can be Thr, Ser, Tyr, Phe, Trp, Met, Val, Gln, Gly, Ala, His, Arg, Ile, Lys, Asn, or Leu
  misc_feature (10)..(10): Xaa can be Arg, or Lys
QXLLLKYQAX

SEQ ID NO: 113492 - protein, 10 aa, Artificial Sequence
  Description of Artificial Sequence: Synthetic peptide
  Seed: QFLLLKYQTK (MAGC3_HUMAN)
  misc_feature (2)..(2): Xaa can be Tyr, Met, Phe, Trp, Thr, Lys, Asn, His, Ala, Ile, Gly, Arg, Ser, Leu, Val, or Gln
  misc_feature (10)..(10): Xaa can be Arg, or Lys
QXLLLKYQTX

SEQ ID NO: 113493 - protein, 8 aa, Artificial Sequence
  Description of Artificial Sequence: Synthetic peptide
  Seed: QGMPKNCL (MAGC3_HUMAN)
  misc_feature (2)..(2): Xaa can be Pro, Ala, Leu, Met, Gln, Ser, Phe, Gly, Val, or Ile
  misc_feature (8)..(8): Xaa can be Leu, Met, Ile, or Phe
QXMPKNCX

SEQ ID NO: 113494 - protein, 9 aa, Artificial Sequence
  Description of Artificial Sequence: Synthetic peptide
  Seed: QGMPKNCLL (MAGC3_HUMAN)
  misc_feature (2)..(2): Xaa can be Arg, Gln, Ala, Pro, Ser, Thr, Val, Met, Asn, Ile, Leu, Gly, Glu, His, Tyr, Lys, Cys, Phe, Asp, or Trp
  misc_feature (9)..(9): Xaa can be Leu, Trp, Met, Phe, Ile, Val, Tyr, Cys, Ala, Lys, His, Arg, Thr, or Gln
QXMPKNCLX

SEQ ID NO: 113495 - protein, 11 aa, Artificial Sequence
  Description of Artificial Sequence: Synthetic peptide
  Seed: QGMPKNCLLIL (MAGC3_HUMAN)
  misc_feature (2)..(2): Xaa can be Pro, Ala, Gln, Asp, Tyr, Ser, Leu, Val, Lys, Trp, Met, Gly, Glu, Asn, Thr, Phe, Ile, Arg, Cys, or His
  misc_feature (11)..(11): Xaa can be Leu, Ile, Phe, Val, or Met
QXMPKNCLLIX

SEQ ID NO: 113496 - protein, 9 aa, Artificial Sequence
  Description of Artificial Sequence: Synthetic peptide
  Seed: QGMPQNRLL (MAGC3_HUMAN)
  misc_feature (2)..(2): Xaa can be Arg, Gln, Ala, Thr, Ser, Asn, Ile, Leu, Met, Tyr, Gly, Val, Glu, Phe, His, Cys, Asp, Lys, Pro, or Trp
  misc_feature (9)..(9): Xaa can be Trp, Leu, Phe, Met, Val, Tyr, Ile, Cys, Lys, Ala, His, Thr, Arg, or Gln
QXMPQNRLX

SEQ ID NO: 113497 - protein, 11 aa, Artificial Sequence
  Description of Artificial Sequence: Synthetic peptide
  Seed: QGMPQNRLLIL (MAGC3_HUMAN)
  misc_feature (2)..(2): Xaa can be Pro, Gly, Gln, Cys, Lys, Ile, Thr, Met, Glu, Ala, Trp, Arg, His, Asp, Phe, Leu, Tyr, Val, Ser, or Asn
  misc_feature (11)..(11): Xaa can be Leu, Ile, Val, Phe, Met, or Ala
QXMPQNRLLIX

SEQ ID NO: 113498 - protein, 9 aa, Artificial Sequence
  Description of Artificial Sequence: Synthetic peptide
  Seed: QLSDLHFGS (MAGC3_HUMAN)
  misc_feature (2)..(2): Xaa can be Met, Leu, Val, Ile, Thr, Gln, Ala, Ser, or Phe
  misc_feature (9)..(9): Xaa can be Val, Ile, Leu, Met, Ala, Ser, Thr, Phe, or Cys
QXSDLHFGX

SEQ ID NO: 113499 - protein, 8 aa, Artificial Sequence
  Description of Artificial Sequence: Synthetic peptide
  Seed: QMNVINTY (MAGC3_HUMAN)
  misc_feature (2)..(2): Xaa can be Ala, Val, Thr, Met, Ile, Gln, Ser, Tyr, Phe, His, Gly, Glu, Leu, Arg, Lys, Pro, Asp, Asn, or Trp
  misc_feature (8)..(8): Xaa can be Tyr, Phe, Met, Leu, Ile, His, or Val
QXNVINTX

SEQ ID NO: 113500 - protein, 9 aa, Artificial Sequence
  Description of Artificial Sequence: Synthetic peptide
  Seed: QMNVINTYT (MAGC3_HUMAN)
  misc_feature (2)..(2): Xaa can be Leu, Met, Ile, Gln, Val, Thr, Ala, or Ser
  misc_feature (9)..(9): Xaa can be Leu, Val, Ile, Ala, Met, Thr, or Phe
QXNVINTYX

SEQ ID NO: 113501 - protein, 11 aa, Artificial Sequence
  Description of Artificial Sequence: Synthetic peptide
  Seed: QMNVINTYTGY (MAGC3_HUMAN)
  misc_feature (2)..(2): Xaa can be Met, Gln, Tyr, Ser, Leu, Phe, Ala, Val, Arg, Thr, Trp, or Lys
  misc_feature (11)..(11): Xaa can be Tyr, or Phe
QXNVINTYTGX

SEQ ID NO: 113502 - protein, 9 aa, Artificial Sequence
  Description of Artificial Sequence: Synthetic peptide
  Seed: QNRLLILIL (MAGC3_HUMAN)
  misc_feature (2)..(2): Xaa can be Arg, Met, Gln, Pro, Ala, Leu, Ile, Gly, Val, Thr, Asn, Lys, Cys, Phe, or Ser
  misc_feature (9)..(9): Xaa can be Leu, Ile, Met, Phe, Val, Lys, Tyr, His, Trp, or Arg
QXRLLILIX

SEQ ID NO: 113503 - protein, 8 aa, Artificial Sequence
  Description of Artificial Sequence: Synthetic peptide
  Seed: QPEGKFSL (MAGC3_HUMAN)
  misc_feature (2)..(2): Xaa can be , or Pro
  misc_feature (8)..(8): Xaa can be Leu, or Met
QXEGKFSX

SEQ ID NO: 113504 - protein, 9 aa, Artificial Sequence
  Description of Artificial Sequence: Synthetic peptide
  Seed: QPEGKFSLR (MAGC3_HUMAN)
  misc_feature (2)..(2): Xaa can be Val, Thr, Phe, Ile, Asn, Ala, Leu, Met, Tyr, Trp, Asp, Gly, Pro, Gln, Ser, Cys, Lys, Glu, or His
  misc_feature (9)..(9): Xaa can be Arg, Lys, His, Tyr, Leu, or Met
QXEGKFSLX

SEQ ID NO: 113505 - protein, 8 aa, Artificial Sequence
  Description of Artificial Sequence: Synthetic peptide
  Seed: QPQPRKKA (MAGC3_HUMAN)
  misc_feature (2)..(2): Xaa can be Pro, or Ala
  misc_feature (8)..(8): Xaa can be Leu, Ala, Phe, Val, Ile, or Met
QXQPRKKX

SEQ ID NO: 113506 - protein, 9 aa, Artificial Sequence
  Description of Artificial Sequence: Synthetic peptide
  Seed: QPQPRKKAT (MAGC3_HUMAN)
  misc_feature (2)..(2): Xaa can be Pro, Leu, Met, Ala, Gln, Val, Ile, Ser, Gly, Asn, Thr, Phe, Tyr, Cys, Glu, Asp, Lys, Trp, His, or Arg
  misc_feature (9)..(9): Xaa can be Val, Ile, Met, Leu, Phe, Ala, Cys, Thr, Gly, Pro, Trp, Tyr, or Ser
QXQPRKKAX

SEQ ID NO: 113507 - protein, 10 aa, Artificial Sequence
  Description of Artificial Sequence: Synthetic peptide
  Seed: QREEPQDWPL (MAGC3_HUMAN)
  misc_feature (2)..(2): Xaa can be Arg, His, Glu, Phe, Trp, Thr, Met, Pro, Lys, Gln, Asp, Tyr, Cys, Asn, Gly, Ser, Ala, Leu, Val, or Ile
  misc_feature (10)..(10): Xaa can be Leu, Met, Ile, Val, Phe, Trp, Arg, Tyr, Ala, or Lys
QXEEPQDWPX

SEQ ID NO: 113508 - protein, 8 aa, Artificial Sequence
  Description of Artificial Sequence: Synthetic peptide
  Seed: QRMDSLVL (MAGC3_HUMAN)
  misc_feature (2)..(2): Xaa can be Arg, His, or Tyr
  misc_feature (8)..(8): Xaa can be Leu, Met, Tyr, Ile, Phe, or Val
QXMDSLVX

SEQ ID NO: 113509 - protein, 9 aa, Artificial Sequence
  Description of Artificial Sequence: Synthetic peptide
  Seed: QRMDSLVLC (MAGC3_HUMAN)
  misc_feature (2)..(2): Xaa can be Arg, His, Gln, Lys, Ala, Ser, Met, Thr, Glu, Tyr, Asn, Phe, Gly, Trp, Pro, Leu, Ile, Asp, Val, or Cys
  misc_feature (9)..(9): Xaa can be Leu, Met, Tyr, Phe, Ile, Val, Ala, Lys, Arg, Cys, Thr, Trp, Ser, Pro, Gly, Asn, Glu, His, or Gln
QXMDSLVLX

SEQ ID NO: 113510 - protein, 10 aa, Artificial Sequence
  Description of Artificial Sequence: Synthetic peptide
  Seed: QRMDSLVLCP (MAGC3_HUMAN)
  misc_feature (2)..(2): Xaa can be , or Arg
  misc_feature (10)..(10): Xaa can be Leu, Ile, Met, Ala, Cys, Ser, Val, Pro, Gly, or Thr
QXMDSLVLCX

SEQ ID NO: 113511 - protein, 8 aa, Artificial Sequence
  Description of Artificial Sequence: Synthetic peptide
  Seed: QRPAREVL (MAGC3_HUMAN)
  misc_feature (2)..(2): Xaa can be Arg, Tyr, His, Gln, Asn, Gly, Asp, Thr, Ser, Glu, Pro, Ala, or Phe
  misc_feature (8)..(8): Xaa can be Leu, Met, Tyr, Phe, or Ile
QXPAREVX

SEQ ID NO: 113512 - protein, 10 aa, Artificial Sequence
  Description of Artificial Sequence: Synthetic peptide
  Seed: QRPAREVLEF (MAGC3_HUMAN)
  misc_feature (2)..(2): Xaa can be Arg, Tyr, or Phe
  misc_feature (10)..(10): Xaa can be Phe, Tyr, Leu, Met, Lys, Trp, Val, Arg, or Ile
QXPAREVLEX

SEQ ID NO: 113513 - protein, 11 aa, Artificial Sequence
  Description of Artificial Sequence: Synthetic peptide
  Seed: QRPAREVLEFL (MAGC3_HUMAN)
  misc_feature (2)..(2): Xaa can be , or Arg
  misc_feature (11)..(11): Xaa can be , or Leu
QXPAREVLEFX

SEQ ID NO: 113514 - protein, 11 aa, Artificial Sequence
  Description of Artificial Sequence: Synthetic peptide
  Seed: QSPLDSCSSPL (MAGC3_HUMAN)
  misc_feature (2)..(2): Xaa can be Arg, Met, Trp, Tyr, Ser, Pro, Lys, Ala, His, Phe, Ile, Leu, Thr, or Val
  misc_feature (11)..(11): Xaa can be Leu, Met, Phe, Val, or Ile
QXPLDSCSSPX

SEQ ID NO: 113515 - protein, 8 aa, Artificial Sequence
  Description of Artificial Sequence: Synthetic peptide
  Seed: QSPPQSPL (MAGC3_HUMAN)
  misc_feature (2)..(2): Xaa can be Ala, Ser, Val, Thr, Ile, Gly, Gln, Leu, Cys, Tyr, Arg, Met, or Phe
  misc_feature (8)..(8): Xaa can be Leu, Met, Tyr, Arg, Lys, Phe, Ile, or Val
QXPPQSPX

SEQ ID NO: 113516 - protein, 8 aa, Artificial Sequence
  Description of Artificial Sequence: Synthetic peptide
  Seed: QTKEPVTK (MAGC3_HUMAN)
  misc_feature (2)..(2): Xaa can be Ala, Thr, Ser, Ile, Val, Leu, Met, Gly, or Asp
  misc_feature (8)..(8): Xaa can be Lys, Leu, Arg, Phe, Tyr, Met, Val, or Ile
QXKEPVTX

SEQ ID NO: 113517 - protein, 9 aa, Artificial Sequence
  Description of Artificial Sequence: Synthetic peptide
  Seed: QTKEPVTKA (MAGC3_HUMAN)
  misc_feature (2)..(2): Xaa can be Pro, Ala, Val, Thr, Ser, Ile, Leu, Gly, Met, Gln, Glu, Asn, Cys, Tyr, Phe, Asp, Lys, Arg, Trp, or His
  misc_feature (9)..(9): Xaa can be Tyr, Lys, Arg, Phe, Met, Leu, His, Val, Ile, Trp, Ala, Cys, Gln, Thr, Asn, Glu, Gly, Pro, Ser, or Asp
QXKEPVTKX

SEQ ID NO: 113518 - protein, 11 aa, Artificial Sequence
  Description of Artificial Sequence: Synthetic peptide
  Seed: QTKEPVTKAEM (MAGC3_HUMAN)
  misc_feature (2)..(2): Xaa can be Ala, Val, Thr, Ile, Ser, Gln, Gly, Leu, Met, Glu, or Cys
  misc_feature (11)..(11): Xaa can be Tyr, Phe, Leu, Met, His, or Trp
QXKEPVTKAEX

SEQ ID NO: 113519 - protein, 10 aa, Artificial Sequence
  Description of Artificial Sequence: Synthetic peptide
  Seed: QWVKNTCATY (MAGC3_HUMAN)
  misc_feature (2)..(2): Xaa can be Gln, Met, Phe, Tyr, Ile, Leu, Ser, Ala, Val, His, Thr, Gly, Asp, Lys, Glu, Asn, Pro, Trp, Arg, or Cys
  misc_feature (10)..(10): Xaa can be Phe, Tyr, Met, Leu, Trp, or Ile
QXVKNTCATX

SEQ ID NO: 113520 - protein, 9 aa, Artificial Sequence
  Description of Artificial Sequence: Synthetic peptide
  Seed: RAEMQMNVI (MAGC3_HUMAN)
  misc_feature (2)..(2): Xaa can be Ala, Ser, Thr, Val, Tyr, His, Gln, Arg, Glu, Phe, Asn, Gly, Trp, Met, Ile, Asp, Lys, or Le u
  misc_feature (9)..(9): Xaa can be Leu, Met, Phe, Ile, Val, Tyr, or Trp
RXEMQMNVX

SEQ ID NO: 113521 - protein, 9 aa, Artificial Sequence
  Description of Artificial Sequence: Synthetic peptide
  Seed: REEPQDWPL (MAGC3_HUMAN)
  misc_feature (2)..(2): Xaa can be Glu, Asp, Gln, Ile, Arg, Leu, Met, Val, Ala, Tyr, His, Phe, Thr, Ser, Lys, Asn, or Gly
  misc_feature (9)..(9): Xaa can be Leu, Phe, Met, Ile, Trp, Val, Tyr, Cys, Ala, Gly, Ser, Pro, or Thr
RXEPQDWPX

SEQ ID NO: 113522 - protein, 8 aa, Artificial Sequence
  Description of Artificial Sequence: Synthetic peptide
  Seed: REFIEILF (MAGC3_HUMAN)
  misc_feature (2)..(2): Xaa can be Glu, Asp, Gln, Lys, Arg, Met, or His
  misc_feature (8)..(8): Xaa can be Tyr, Phe, Trp, Met, Leu, Val, Ala, Ile, Pro, Gly, Ser, Thr, His, or Cys
RXFIEILX

SEQ ID NO: 113523 - protein, 9 aa, Artificial Sequence
  Description of Artificial Sequence: Synthetic peptide
  Seed: REFIEILFG (MAGC3_HUMAN)
  misc_feature (2)..(2): Xaa can be Glu, Asp, or Gln
  misc_feature (9)..(9): Xaa can be Leu, Met, Val, Cys, Ala, Ile, Phe, Thr, Pro, Tyr, Glu, Ser, Trp, Gln, Gly, or Asp
RXFIEILFX

SEQ ID NO: 113524 - protein, 10 aa, Artificial Sequence
  Description of Artificial Sequence: Synthetic peptide
  Seed: REFIEILFGI (MAGC3_HUMAN)
  misc_feature (2)..(2): Xaa can be Arg, Glu, Gln, Met, Leu, Ile, Val, Thr, Ser, Ala, Phe, Lys, Asp, Tyr, His, Gly, Trp, Pro, Cys, or Asn
  misc_feature (10)..(10): Xaa can be Leu, Phe, Ile, Val, Trp, Met, Ala, Thr, Ser, Cys, Tyr, Pro, Gly, His, Lys, Arg, Asn, Glu, or Gln
RXFIEILFGX

SEQ ID NO: 113525 - protein, 8 aa, Artificial Sequence
  Description of Artificial Sequence: Synthetic peptide
  Seed: REVLEFLS (MAGC3_HUMAN)
  misc_feature (2)..(2): Xaa can be Glu, or Asp
  misc_feature (8)..(8): Xaa can be Ala, Val, Leu, Ile, Met, Phe, Thr, Cys, Ser, Gly, or Pro
RXVLEFLX

SEQ ID NO: 113526 - protein, 9 aa, Artificial Sequence
  Description of Artificial Sequence: Synthetic peptide
  Seed: REVLEFLSK (MAGC3_HUMAN)
  misc_feature (2)..(2): Xaa can be Glu, Arg, Asp, Gln, Met, Thr, Leu, Ala, Gly, Ile, Lys, Ser, Val, Asn, His, Cys, Tyr, Phe, Trp, or Pro
  misc_feature (9)..(9): Xaa can be Leu, Arg, Lys, Phe, Ile, Tyr, Met, Val, His, Trp, Cys, Ala, Pro, Thr, Ser, Gly, Asn, Gln, Glu, or Asp
RXVLEFLSX

SEQ ID NO: 113527 - protein, 10 aa, Artificial Sequence
  Description of Artificial Sequence: Synthetic peptide
  Seed: REVLEFLSKL (MAGC3_HUMAN)
  misc_feature (2)..(2): Xaa can be Glu, Met, Gln, Leu, Arg, Asp, Pro, Thr, Trp, Tyr, Asn, Lys, Val, Ser, Gly, Cys, Ala, His, Ile, or Phe
  misc_feature (10)..(10): Xaa can be Val, Ala, Leu, Ile, Trp, Phe, Met, Tyr, Thr, Cys, Ser, Pro, Arg, Gly, Lys, or His
RXVLEFLSKX

SEQ ID NO: 113528 - protein, 11 aa, Artificial Sequence
  Description of Artificial Sequence: Synthetic peptide
  Seed: REVLEFLSKLS (MAGC3_HUMAN)
  misc_feature (2)..(2): Xaa can be , or Glu
  misc_feature (11)..(11): Xaa can be Pro, Ser, Val, Ala, Phe, Leu, Met, Ile, Thr, or Cys
RXVLEFLSKLX

SEQ ID NO: 113529 - protein, 9 aa, Artificial Sequence
  Description of Artificial Sequence: Synthetic peptide
  Seed: REVRLFLRG (MAGC3_HUMAN)
  misc_feature (2)..(2): Xaa can be Glu, Asp, or Gln
  misc_feature (9)..(9): Xaa can be Leu, Ile, Met, Val, Thr, Phe, Cys, Ala, Pro, Asp, Glu, Gly, Gln, Trp, Tyr, or Ser
RXVRLFLRX

SEQ ID NO: 113530 - protein, 10 aa, Artificial Sequence
  Description of Artificial Sequence: Synthetic peptide
  Seed: REVRLFLRGG (MAGC3_HUMAN)
  misc_feature (2)..(2): Xaa can be Tyr, Ser, Thr, Phe, Ala, Leu, Arg, Lys, Cys, Trp, Pro, Gly, Met, His, Glu, Asn, Ile, Val, Asp, or Gln
  misc_feature (10)..(10): Xaa can be Ile, Asn, Ala, Cys, Lys, Gln, Phe, Gly, Leu, Ser, Arg, Thr, Met, Val, Tyr, Pro, Glu, or Hi s
RXVRLFLRGX

SEQ ID NO: 113531 - protein, 11 aa, Artificial Sequence
  Description of Artificial Sequence: Synthetic peptide
  Seed: RGLTEASPQQK (MAGC3_HUMAN)
  misc_feature (2)..(2): Xaa can be Arg, Gln, Lys, Thr, Gly, Ala, Glu, Phe, Ile, Met, Val, Leu, Ser, Tyr, Asn, His, Cys, or Tr p
  misc_feature (11)..(11): Xaa can be Arg, Lys, Phe, Tyr, Leu, Met, Gln, Val, Ile, Ala, Thr, Asn, Ser, Pro, Glu, Cys, His, Gly, or Trp
RXLTEASPQQX

SEQ ID NO: 113532 - protein, 9 aa, Artificial Sequence
  Description of Artificial Sequence: Synthetic peptide
  Seed: RGTGYTLSL (MAGC3_HUMAN)
  misc_feature (2)..(2): Xaa can be Arg, Gln, Met, Ala, Ser, Thr, Val, Lys, Leu, Ile, His, Gly, Glu, Tyr, Asn, Asp, Phe, Trp, Pro, or Cys
  misc_feature (9)..(9): Xaa can be Phe, Val, Leu, Ile, Tyr, Met, Trp, His, Lys, Arg, Cys, Ala, Thr, Ser, Gly, Gln, Asn, Pro, or Glu
RXTGYTLSX

SEQ ID NO: 113533 - protein, 9 aa, Artificial Sequence
  Description of Artificial Sequence: Synthetic peptide
  Seed: RKAREFIEI (MAGC3_HUMAN)
  misc_feature (2)..(2): Xaa can be Arg, Gln, Met, Lys, Glu, Gly, Ala, Leu, Val, Ile, Ser, His, Asp, Asn, Thr, Tyr, Phe, Pro, Cys, or Trp
  misc_feature (9)..(9): Xaa can be Tyr, Phe, Leu, Met, Ile, Val, Arg, Lys, His, Trp, Ala, Gly, Thr, Cys, Asn, Ser, Gln, Glu, or Pro
RXAREFIEX

SEQ ID NO: 113534 - protein, 10 aa, Artificial Sequence
  Description of Artificial Sequence: Synthetic peptide
  Seed: RKAREFIEIL (MAGC3_HUMAN)
  misc_feature (2)..(2): Xaa can be Arg, Gln, Met, Lys, His, Glu, Ala, Leu, Ser, Gly, Val, Ile, Asn, Cys, Pro, Phe, Asp, Thr, Tyr, or Trp
  misc_feature (10)..(10): Xaa can be Tyr, Phe, Met, Leu, Ile, Val, His, Trp, Ser, Lys, Ala, Cys, Gly, or Thr
RXAREFIEIX

SEQ ID NO: 113535 - protein, 11 aa, Artificial Sequence
  Description of Artificial Sequence: Synthetic peptide
  Seed: RKAREFIEILF (MAGC3_HUMAN)
  misc_feature (2)..(2): Xaa can be Arg, Gln, Lys, Met, His, Gly, Ala, Phe, Pro, Glu, Asn, Trp, Asp, Ser, Ile, Cys, Thr, Tyr, Val, or Leu
  misc_feature (11)..(11): Xaa can be Phe, Met, Leu, Tyr, Ile, Val, Ser, Glu, Gly, Asp, Lys, Gln, Asn, Trp, Thr, Cys, Arg, His, Ala, or Pro
RXAREFIEILX

SEQ ID NO: 113536 - protein, 9 aa, Artificial Sequence
  Description of Artificial Sequence: Synthetic peptide
  Seed: RKKATDKDY (MAGC3_HUMAN)
  misc_feature (2)..(2): Xaa can be Gln, Met, Lys, Glu, Ile, Leu, Ser, Ala, Arg, His, Val, Asn, Asp, Gly, or Thr
  misc_feature (9)..(9): Xaa can be Tyr, Phe, Met, Leu, Val, Trp, His, or Ile
RXKATDKDX

SEQ ID NO: 113537 - protein, 11 aa, Artificial Sequence
  Description of Artificial Sequence: Synthetic peptide
  Seed: RLDEESSSEEE (MAGC3_HUMAN)
  misc_feature (2)..(2): Xaa can be Arg, Gly, Ala, Gln, Phe, Ile, Val, Asp, Trp, Glu, Leu, Tyr, Asn, Ser, Met, Lys, Thr, His, Pro, or Cys
  misc_feature (11)..(11): Xaa can be Lys, Arg, Glu, Phe, Gln, Tyr, Asn, Leu, His, Ala, Asp, Val, Ile, Met, or Trp
RXDEESSSEEX

SEQ ID NO: 113538 - protein, 9 aa, Artificial Sequence
  Description of Artificial Sequence: Synthetic peptide
  Seed: RLLILILSV (MAGC3_HUMAN)
  misc_feature (2)..(2): Xaa can be Gln, Met, Leu, Ile, Ser, Ala, Thr, Val, Glu, Tyr, Asn, Gly, Asp, Cys, Phe, Trp, Pro, His, Arg, or Lys
  misc_feature (9)..(9): Xaa can be Tyr, Phe, Arg, Val, Leu, Ile, Lys, Trp, Met, His, Ala, Cys, Thr, Ser, Pro, or Gly
RXLILILSX

SEQ ID NO: 113539 - protein, 10 aa, Artificial Sequence
  Description of Artificial Sequence: Synthetic peptide
  Seed: RLLILILSVI (MAGC3_HUMAN)
  misc_feature (2)..(2): Xaa can be Leu, Met, Gln, Ser, Trp, Asp, Glu, Val, Pro, Asn, Ile, Arg, Gly, Phe, Ala, Thr, His, Cys, Lys, or Tyr
  misc_feature (10)..(10): Xaa can be Ile, Ala, Leu, Val, Thr, Met, Cys, Phe, Gly, Lys, Tyr, Trp, Asn, Arg, Pro, His, Glu, Gln, Asp, or Ser
RXLILILSVX

SEQ ID NO: 113540 - protein, 10 aa, Artificial Sequence
  Description of Artificial Sequence: Synthetic peptide
  Seed: RLWGEKAGSL (MAGC3_HUMAN)
  misc_feature (2)..(2): Xaa can be Gln, Leu, Met, Ile, Val, Ala, Thr, Ser, Glu, Phe, Gly, Tyr, Lys, Asn, Pro, Cys, Trp, His, Arg, or Asp
  misc_feature (10)..(10): Xaa can be Tyr, Trp, Phe, Arg, Val, Met, Lys, Ile, Leu, Ala, Cys, His, or Thr
RXWGEKAGSX

SEQ ID NO: 113541 - protein, 10 aa, Artificial Sequence
  Description of Artificial Sequence: Synthetic peptide
  Seed: RMDSLVLCPT (MAGC3_HUMAN)
  misc_feature (2)..(2): Xaa can be Leu, Met, Ile, Val, Thr, Gln, Ser, or Ala
  misc_feature (10)..(10): Xaa can be Val, Ile, Leu, Met, Ala, Cys, or Thr
RXDSLVLCPX

SEQ ID NO: 113542 - protein, 11 aa, Artificial Sequence
  Description of Artificial Sequence: Synthetic peptide
  Seed: RMDSLVLCPTY (MAGC3_HUMAN)
  misc_feature (2)..(2): Xaa can be Thr, Ser, Met, Gln, Ile, Val, Tyr, Phe, Gly, His, Arg, Asn, Cys, Asp, Leu, Lys, Pro, Trp, Glu, or Ala
  misc_feature (11)..(11): Xaa can be Tyr, Phe, Trp, Lys, Met, or His
RXDSLVLCPTX

SEQ ID NO: 113543 - protein, 9 aa, Artificial Sequence
  Description of Artificial Sequence: Synthetic peptide
  Seed: RPAREVLEF (MAGC3_HUMAN)
  misc_feature (2)..(2): Xaa can be Arg, Pro, Gln, Ala, Met, Val, Ile, Glu, Thr, Gly, Ser, Asn, Lys, Leu, His, Phe, Asp, Cys, Trp, or Tyr
  misc_feature (9)..(9): Xaa can be Tyr, Trp, Ile, Phe, Leu, Met, Lys, Arg, Val, His, Cys, Ala, Gly, Gln, Thr, Asn, Ser, Pro, or Glu
RXAREVLEX

SEQ ID NO: 113544 - protein, 10 aa, Artificial Sequence
  Description of Artificial Sequence: Synthetic peptide
  Seed: RPAREVLEFL (MAGC3_HUMAN)
  misc_feature (2)..(2): Xaa can be Thr, Val, Ser, Tyr, Met, Pro, Trp, Phe, Ile, Gln, Leu, His, Glu, Cys, Arg, Gly, Lys, Asn, Asp, or Ala
  misc_feature (10)..(10): Xaa can be Ile, Ala, Met, Tyr, Lys, Leu, Ser, Val, Arg, Gly, Thr, His, Phe, Cys, or Pro
RXAREVLEFX

SEQ ID NO: 113545 - protein, 9 aa, Artificial Sequence
  Description of Artificial Sequence: Synthetic peptide
  Seed: RQEDGRRGL (MAGC3_HUMAN)
  misc_feature (2)..(2): Xaa can be Arg, Glu, Gln, Thr, Met, Val, His, Ile, Tyr, Ala, Leu, Ser, Asp, Phe, Lys, Trp, Gly, Asn, or Cys
  misc_feature (9)..(9): Xaa can be Leu, Tyr, Phe, Met, Ile, Val, Trp, Lys, Thr, Cys, Ala, Arg, Asn, Glu, Pro, Gly, His, Gln, or Ser
RXEDGRRGX

SEQ ID NO: 113546 - protein, 9 aa, Artificial Sequence
  Description of Artificial Sequence: Synthetic peptide
  Seed: RRAVSVKQR (MAGC3_HUMAN)
  misc_feature (2)..(2): Xaa can be Arg, Gln, Lys, Asn, Gly, Tyr, His, Ala, Glu, Trp, Met, Val, Thr, Ser, Phe, Leu, or Ile
  misc_feature (9)..(9): Xaa can be Leu, Phe, Tyr, Met, Lys, Ile, Arg, Val, Trp, Pro, Glu, Cys, Ser, His, Thr, Gln, Ala, Gly, or Asn
RXAVSVKQX

SEQ ID NO: 113547 - protein, 10 aa, Artificial Sequence
  Description of Artificial Sequence: Synthetic peptide
  Seed: RRAVSVKQRE (MAGC3_HUMAN)
  misc_feature (2)..(2): Xaa can be Arg, Gln, or Lys
  misc_feature (10)..(10): Xaa can be Phe, Lys, Arg, Tyr, Met, Leu, His, Ala, Cys, Trp, Val, Glu, Gly, Gln, Ile, Ser, Asn, or Th r
RXAVSVKQRX

SEQ ID NO: 113548 - protein, 8 aa, Artificial Sequence
  Description of Artificial Sequence: Synthetic peptide
  Seed: RRGTGYTL (MAGC3_HUMAN)
  misc_feature (2)..(2): Xaa can be Arg, His, Ala, Ser, Gln, Tyr, Gly, Asn, Trp, Phe, Lys, Glu, Thr, Pro, Met, Val, Ile, Asp, or Leu
  misc_feature (8)..(8): Xaa can be Leu, Phe, Met, Tyr, Ile, Val, Arg, Trp, or Lys
RXGTGYTX

SEQ ID NO: 113549 - protein, 9 aa, Artificial Sequence
  Description of Artificial Sequence: Synthetic peptide
  Seed: RRGTGYTLS (MAGC3_HUMAN)
  misc_feature (2)..(2): Xaa can be Arg, Gln, Lys, or His
  misc_feature (9)..(9): Xaa can be Leu, Phe, Met, Ile, Val, Trp, Cys, Ala, Ser, Gly, Pro, Tyr, or Thr
RXGTGYTLX

SEQ ID NO: 113550 - protein, 10 aa, Artificial Sequence
  Description of Artificial Sequence: Synthetic peptide
  Seed: RRGTGYTLSL (MAGC3_HUMAN)
  misc_feature (2)..(2): Xaa can be Arg, Gln, Gly, Tyr, His, Ala, Lys, Phe, or Glu
  misc_feature (10)..(10): Xaa can be Phe, Leu, Tyr, Lys, Met, Arg, Trp, Ile, Thr, Val, Cys, Ala, Gln, Gly, His, or Asn
RXGTGYTLSX

SEQ ID NO: 113551 - protein, 11 aa, Artificial Sequence
  Description of Artificial Sequence: Synthetic peptide
  Seed: RRGTGYTLSLP (MAGC3_HUMAN)
  misc_feature (2)..(2): Xaa can be , or Arg
  misc_feature (11)..(11): Xaa can be Phe, Asn, Gln, Leu, Trp, Val, Cys, Arg, Tyr, Glu, Asp, Lys, Ala, Gly, Ile, Ser, His, Met, Pro, or Thr
RXGTGYTLSLX

SEQ ID NO: 113552 - protein, 8 aa, Artificial Sequence
  Description of Artificial Sequence: Synthetic peptide
  Seed: RSAEGSVL (MAGC3_HUMAN)
  misc_feature (2)..(2): Xaa can be Ala, Thr, Ser, Val, Ile, Gln, Arg, Gly, Met, Leu, Asn, Cys, Asp, Glu, Pro, His, Tyr, or Ph e
  misc_feature (8)..(8): Xaa can be Leu, Tyr, Phe, Met, Ile, His, Val, Lys, Ala, Trp, or Arg
RXAEGSVX

SEQ ID NO: 113553 - protein, 10 aa, Artificial Sequence
  Description of Artificial Sequence: Synthetic peptide
  Seed: RSAEGSVLDL (MAGC3_HUMAN)
  misc_feature (2)..(2): Xaa can be Thr, Ala, Gln, Met, Ile, Val, Leu, Ser, Glu, Arg, Gly, Asn, Phe, Cys, Tyr, Asp, His, Lys, Pro, or Trp
  misc_feature (10)..(10): Xaa can be Trp, Leu, Phe, Met, Tyr, Lys, Arg, Val, Ile, His, Cys, or Ala
RXAEGSVLDX

SEQ ID NO: 113554 - protein, 9 aa, Artificial Sequence
  Description of Artificial Sequence: Synthetic peptide
  Seed: RTLSGSPGL (MAGC3_HUMAN)
  misc_feature (2)..(2): Xaa can be Arg, Thr, Met, Ser, Leu, Gln, Val, Ala, Tyr, Ile, Gly, Trp, Phe, Glu, Asn, Asp, Lys, His, Cys, or Pro
  misc_feature (9)..(9): Xaa can be Phe, Leu, Tyr, Arg, Lys, Trp, Met, Ile, Val, Ala, His, Thr, Ser, Cys, Gly, Pro, Asn, Glu, or Gln
RXLSGSPGX

SEQ ID NO: 113555 - protein, 11 aa, Artificial Sequence
  Description of Artificial Sequence: Synthetic peptide
  Seed: RTLSGSPGLQL (MAGC3_HUMAN)
  misc_feature (2)..(2): Xaa can be Arg, Gln, Met, Leu, Val, Gly, Ile, Thr, Ala, Glu, Ser, Asn, His, Asp, Lys, Trp, Phe, Tyr, Cys, or Pro
  misc_feature (11)..(11): Xaa can be Arg, Trp, Tyr, Lys, Leu, Phe, Met, Ile, His, Val, Ala, Cys, Gln, Thr, Glu, Asn, Pro, Ser, Gly, or Asp
RXLSGSPGLQX

SEQ ID NO: 113556 - protein, 9 aa, Artificial Sequence
  Description of Artificial Sequence: Synthetic peptide
  Seed: RTLWKDSDL (MAGC3_HUMAN)
  misc_feature (2)..(2): Xaa can be Ala, Ser, Thr, Val, Cys, Ile, Leu, Asn, Gly, or Met
  misc_feature (9)..(9): Xaa can be Trp, Phe, Tyr, Leu, Ile, Met, or Val
RXLWKDSDX

SEQ ID NO: 113557 - protein, 11 aa, Artificial Sequence
  Description of Artificial Sequence: Synthetic peptide
  Seed: RYALDEKVAEL (MAGC3_HUMAN)
  misc_feature (2)..(2): Xaa can be Arg, Tyr, His, Phe, Trp, Leu, Met, Gln, Asn, Lys, Asp, Glu, Pro, Ile, Val, Gly, Cys, Ala, Thr, or Ser
  misc_feature (11)..(11): Xaa can be Ile, Leu, Met, Val, Ala, Phe, Trp, Tyr, or Cys
RXALDEKVAEX

SEQ ID NO: 113558 - protein, 9 aa, Artificial Sequence
  Description of Artificial Sequence: Synthetic peptide
  Seed: SAEGSVLDL (MAGC3_HUMAN)
  misc_feature (2)..(2): Xaa can be Ala, Phe, Tyr, Leu, Val, Gly, Gln, Met, Ile, Trp, Thr, Ser, Pro, Arg, Cys, His, Asn, Glu, Asp, or Lys
  misc_feature (9)..(9): Xaa can be Leu, Met, Lys, Arg, Ile, Phe, Tyr, Val, Trp, Cys, Ala, or His
SXEGSVLDX

SEQ ID NO: 113559 - protein, 10 aa, Artificial Sequence
  Description of Artificial Sequence: Synthetic peptide
  Seed: SAEGSVLDLA (MAGC3_HUMAN)
  misc_feature (2)..(2): Xaa can be Glu, Ala, Phe, Gln, Asn, Asp, Lys, Pro, Ser, Val, Leu, Trp, Thr, Arg, His, Ile, Cys, Tyr, Met, or Gly
  misc_feature (10)..(10): Xaa can be Ala, or Val
SXEGSVLDLX

SEQ ID NO: 113560 - protein, 8 aa, Artificial Sequence
  Description of Artificial Sequence: Synthetic peptide
  Seed: SAFHLGHL (MAGC3_HUMAN)
  misc_feature (2)..(2): Xaa can be Gln, Ala, Ser, Gly, Thr, Glu, Met, or Val
  misc_feature (8)..(8): Xaa can be Val, Tyr, Ile, Leu, Phe, or Met
SXFHLGHX

SEQ ID NO: 113561 - protein, 9 aa, Artificial Sequence
  Description of Artificial Sequence: Synthetic peptide
  Seed: SAFHLGHLR (MAGC3_HUMAN)
  misc_feature (2)..(2): Xaa can be Ala, Thr, Met, Val, Leu, Ser, Trp, Gly, Ile, Phe, Tyr, Gln, Cys, Asn, Pro, Glu, Arg, Lys, His, or Asp
  misc_feature (9)..(9): Xaa can be Tyr, Arg, Lys, Phe, Met, Leu, Val, Trp, Ile, His, Ala, Gln, Thr, Cys, or Glu
SXFHLGHLX

SEQ ID NO: 113562 - protein, 10 aa, Artificial Sequence
  Description of Artificial Sequence: Synthetic peptide
  Seed: SAFHLGHLRE (MAGC3_HUMAN)
  misc_feature (2)..(2): Xaa can be Tyr, Leu, Trp, Phe, Val, Met, Ser, Thr, Gln, Ile, Ala, Gly, His, Pro, Cys, Lys, Asn, Asp, Arg, or Glu
  misc_feature (10)..(10): Xaa can be Arg, Lys, Ala, Glu, Phe, Ser, Gly, Gln, Pro, Trp, Leu, Asp, Cys, His, Ile, Tyr, Met, Thr, Val, or Asn
SXFHLGHLRX

SEQ ID NO: 113563 - protein, 11 aa, Artificial Sequence
  Description of Artificial Sequence: Synthetic peptide
  Seed: SAFHLGHLREV (MAGC3_HUMAN)
  misc_feature (2)..(2): Xaa can be Ala, or Ser
  misc_feature (11)..(11): Xaa can be Tyr, Ile, Leu, Phe, Val, or Met
SXFHLGHLREX

SEQ ID NO: 113564 - protein, 8 aa, Artificial Sequence
  Description of Artificial Sequence: Synthetic peptide
  Seed: SAFPSWYM (MAGC3_HUMAN)
  misc_feature (2)..(2): Xaa can be Thr, Ser, Ala, Ile, Asn, Leu, Gly, Asp, Cys, Val, Gln, Met, Pro, or Phe
  misc_feature (8)..(8): Xaa can be Trp, Leu, Val, Ile, Phe, Tyr, or Met
SXFPSWYX

SEQ ID NO: 113565 - protein, 10 aa, Artificial Sequence
  Description of Artificial Sequence: Synthetic peptide
  Seed: SAFPSWYMDA (MAGC3_HUMAN)
  misc_feature (2)..(2): Xaa can be Thr, Val, Ile, Ala, Ser, Met, or Leu
  misc_feature (10)..(10): Xaa can be Val, Ile, Ala, Leu, or Met
SXFPSWYMDX

SEQ ID NO: 113566 - protein, 11 aa, Artificial Sequence
  Description of Artificial Sequence: Synthetic peptide
  Seed: SAFPSWYMDAL (MAGC3_HUMAN)
  misc_feature (2)..(2): Xaa can be Pro, Ala, Ser, Val, Thr, Gln, Gly, Arg, Leu, Phe, Asp, Ile, Asn, Cys, Glu, Met, Trp, His, Tyr, or Lys
  misc_feature (11)..(11): Xaa can be Leu, Met, Tyr, Phe, Ile, Val, His, or Ala
SXFPSWYMDAX

SEQ ID NO: 113567 - protein, 8 aa, Artificial Sequence
  Description of Artificial Sequence: Synthetic peptide
  Seed: SAIGPIQR (MAGC3_HUMAN)
  misc_feature (2)..(2): Xaa can be Ala, Ser, Thr, Val, Gly, Arg, Ile, Gln, Asp, Leu, Phe, Asn, Met, Glu, Trp, Tyr, Pro, His, or Cys
  misc_feature (8)..(8): Xaa can be Arg, Lys, Tyr, Leu, Phe, Met, His, Val, or Ile
SXIGPIQX

SEQ ID NO: 113568 - protein, 9 aa, Artificial Sequence
  Description of Artificial Sequence: Synthetic peptide
  Seed: SAIGPIQRP (MAGC3_HUMAN)
  misc_feature (2)..(2): Xaa can be Ala, Ser, Val, Thr, Gln, Ile, Gly, Leu, Met, Glu, Asn, Asp, Cys, Pro, Phe, Lys, Tyr, Arg, Trp, or His
  misc_feature (9)..(9): Xaa can be Tyr, Phe, Met, Leu, His, Lys, Arg, Trp, Val, Ile, Ala, Cys, Gln, Pro, Asn, Ser, Gly, or Th r
SXIGPIQRX

SEQ ID NO: 113569 - protein, 10 aa, Artificial Sequence
  Description of Artificial Sequence: Synthetic peptide
  Seed: SAIGPIQRPA (MAGC3_HUMAN)
  misc_feature (2)..(2): Xaa can be Pro, Ala, Ser, Val, Gln, Ile, Met, Gly, Thr, Leu, Glu, Asn, Asp, Cys, Phe, or Lys
  misc_feature (10)..(10): Xaa can be Tyr, Lys, Phe, Arg, Met, Leu, His, Trp, Ala, Val, Ile, Gln, Thr, Cys, Glu, Pro, Gly, Asn, or Ser
SXIGPIQRPX

SEQ ID NO: 113570 - protein, 11 aa, Artificial Sequence
  Description of Artificial Sequence: Synthetic peptide
  Seed: SAIGPIQRPAR (MAGC3_HUMAN)
  misc_feature (2)..(2): Xaa can be Trp, Phe, Leu, Gln, Gly, Tyr, Val, Ala, Thr, Ser, Met, Ile, Asn, or Arg
  misc_feature (11)..(11): Xaa can be Arg, or Lys
SXIGPIQRPAX

SEQ ID NO: 113571 - protein, 9 aa, Artificial Sequence
  Description of Artificial Sequence: Synthetic peptide
  Seed: SALAGFADV (MAGC3_HUMAN)
  misc_feature (2)..(2): Xaa can be Leu, Gln, Met, Ile, Ser, Ala, Val, Thr, Gly, Glu, Pro, Phe, Arg, Asn, Cys, Tyr, His, or As p
  misc_feature (9)..(9): Xaa can be Leu, Lys, Tyr, Met, Phe, Arg, Ile, Val, His, Ala, Thr, Trp, Cys, or Ser
SXLAGFADX

SEQ ID NO: 113572 - protein, 10 aa, Artificial Sequence
  Description of Artificial Sequence: Synthetic peptide
  Seed: SALAGFADVL (MAGC3_HUMAN)
  misc_feature (2)..(2): Xaa can be Met, Leu, Ala, Val, Ser, Thr, Gly, Ile, Gln, Asn, Asp, Glu, Phe, Trp, Arg, Tyr, Lys, Pro, His, or Cys
  misc_feature (10)..(10): Xaa can be Leu, Val, Met, Ile, Ala, Lys, Arg, Tyr, Phe, His, Gly, Trp, Gln, Asp, Asn, Glu, Cys, Thr, Ser, or Pro
SXLAGFADVX

SEQ ID NO: 113573 - protein, 9 aa, Artificial Sequence
  Description of Artificial Sequence: Synthetic peptide
  Seed: SASPSVMST (MAGC3_HUMAN)
  misc_feature (2)..(2): Xaa can be Pro, Ala, Ser, Val, Ile, Thr, Gln, Gly, Tyr, Phe, Leu, Glu, Asn, Met, Cys, Arg, His, Asp, Trp, or Lys
  misc_feature (9)..(9): Xaa can be Met, Val, Leu, Ile, Tyr, Phe, Lys, Arg, Ala, Trp, His, Cys, Thr, Gln, Ser, Pro, Glu, Asn, Gly, or Asp
SXSPSVMSX

SEQ ID NO: 113574 - protein, 11 aa, Artificial Sequence
  Description of Artificial Sequence: Synthetic peptide
  Seed: SASPSVMSTNF (MAGC3_HUMAN)
  misc_feature (2)..(2): Xaa can be Ala, Ser, Thr, Arg, Met, Gln, Val, Ile, Leu, Gly, Glu, Phe, Cys, Pro, His, Tyr, Asn, Asp, Trp, or Lys
  misc_feature (11)..(11): Xaa can be Trp, Tyr, Phe, Leu, Lys, Met, Arg, His, Ile, Val, Cys, or Ala
SXSPSVMSTNX

SEQ ID NO: 113575 - protein, 8 aa, Artificial Sequence
  Description of Artificial Sequence: Synthetic peptide
  Seed: SCSSPLLW (MAGC3_HUMAN)
  misc_feature (2)..(2): Xaa can be Ser, Thr, Ala, Leu, Asp, His, Val, Gly, Pro, Arg, Ile, Cys, Met, Phe, Glu, Tyr, Asn, Gln, or Trp
  misc_feature (8)..(8): Xaa can be Trp, Leu, Phe, Ile, or Tyr
SXSSPLLX

SEQ ID NO: 113576 - protein, 10 aa, Artificial Sequence
  Description of Artificial Sequence: Synthetic peptide
  Seed: SCSSPLLWTR (MAGC3_HUMAN)
  misc_feature (2)..(2): Xaa can be Met, Leu, Thr, Ile, Val, Ala, Ser, Gln, Tyr, Asn, Trp, Asp, Gly, His, Cys, Glu, Arg, Phe, Pro, or Lys
  misc_feature (10)..(10): Xaa can be Lys, Arg, Tyr, Leu, Phe, Met, Val, Ile, His, or Ala
SXSSPLLWTX

SEQ ID NO: 113577 - protein, 9 aa, Artificial Sequence
  Description of Artificial Sequence: Synthetic peptide
  Seed: SCVPEEVIW (MAGC3_HUMAN)
  misc_feature (2)..(2): Xaa can be Pro, Thr, Ser, Ala, Val, Phe, Met, Leu, Gly, Asn, Cys, Ile, Lys, Gln, Tyr, Arg, Glu, Asp, or Trp
  misc_feature (9)..(9): Xaa can be Trp, Phe, Leu, Met, Tyr, Ile, Val, or His
SXVPEEVIX

SEQ ID NO: 113578 - protein, 11 aa, Artificial Sequence
  Description of Artificial Sequence: Synthetic peptide
  Seed: SDEQGMPQNRL (MAGC3_HUMAN)
  misc_feature (2)..(2): Xaa can be Glu, Asp, or Gln
  misc_feature (11)..(11): Xaa can be Leu, Phe, Val, Ile, Trp, Tyr, or Met
SXEQGMPQNRX

SEQ ID NO: 113579 - protein, 9 aa, Artificial Sequence
  Description of Artificial Sequence: Synthetic peptide
  Seed: SDGSLGQWV (MAGC3_HUMAN)
  misc_feature (2)..(2): Xaa can be Glu, or Asp
  misc_feature (9)..(9): Xaa can be Val, Ala, Ser, Ile, Gly, Met, Phe, Cys, Pro, Leu, or Thr
SXGSLGQWX

SEQ ID NO: 113580 - protein, 10 aa, Artificial Sequence
  Description of Artificial Sequence: Synthetic peptide
  Seed: SDGSLGQWVK (MAGC3_HUMAN)
  misc_feature (2)..(2): Xaa can be Ser, Leu, Ile, Met, Val, Thr, Ala, Asp, Gly, Glu, Asn, Gln, or Cys
  misc_feature (10)..(10): Xaa can be Tyr, Lys, or Arg
SXGSLGQWVX

SEQ ID NO: 113581 - protein, 9 aa, Artificial Sequence
  Description of Artificial Sequence: Synthetic peptide
  Seed: SDLHFGSQP (MAGC3_HUMAN)
  misc_feature (2)..(2): Xaa can be Glu, Asp, or Gln
  misc_feature (9)..(9): Xaa can be Leu, Cys, Ala, Val, Ile, Thr, Pro, Met, Asp, Phe, Gly, Glu, Gln, Tyr, Trp, or Ser
SXLHFGSQX

SEQ ID NO: 113582 - protein, 8 aa, Artificial Sequence
  Description of Artificial Sequence: Synthetic peptide
  Seed: SDQRMDSL (MAGC3_HUMAN)
  misc_feature (2)..(2): Xaa can be Glu, Asp, or Gln
  misc_feature (8)..(8): Xaa can be Leu, Val, Ile, Phe, Met, Tyr, Ala, or Cys
SXQRMDSX

SEQ ID NO: 113583 - protein, 9 aa, Artificial Sequence
  Description of Artificial Sequence: Synthetic peptide
  Seed: SDQRMDSLV (MAGC3_HUMAN)
  misc_feature (2)..(2): Xaa can be Glu, Asp, or Gln
  misc_feature (9)..(9): Xaa can be Met, Ala, Val, Phe, Leu, Ile, Tyr, Lys, Gly, Thr, Ser, Pro, Trp, or Cys
SXQRMDSLX

SEQ ID NO: 113584 - protein, 10 aa, Artificial Sequence
  Description of Artificial Sequence: Synthetic peptide
  Seed: SDQRMDSLVL (MAGC3_HUMAN)
  misc_feature (2)..(2): Xaa can be Glu, Met, Gln, Ile, Thr, Asn, Pro, Phe, Trp, Cys, Asp, Val, Lys, Leu, Gly, His, Arg, Ala, Ser, or Tyr
  misc_feature (10)..(10): Xaa can be Phe, Ile, Trp, Met, His, Leu, Val, Tyr, Ala, Thr, Gly, Ser, Cys, or Pro
SXQRMDSLVX

SEQ ID NO: 113585 - protein, 8 aa, Artificial Sequence
  Description of Artificial Sequence: Synthetic peptide
  Seed: SEEEDTAT (MAGC3_HUMAN)
  misc_feature (2)..(2): Xaa can be , or Glu
  misc_feature (8)..(8): Xaa can be Pro, Ile, Met, Thr, Ala, Leu, Cys, Phe, or Val
SXEEDTAX

SEQ ID NO: 113586 - protein, 9 aa, Artificial Sequence
  Description of Artificial Sequence: Synthetic peptide
  Seed: SEEEDTATW (MAGC3_HUMAN)
  misc_feature (2)..(2): Xaa can be Glu, Asp, Gln, Ile, Val, Met, Leu, Ser, Ala, Thr, Phe, Tyr, Pro, Asn, Gly, Trp, His, Arg, Cys, or Lys
  misc_feature (9)..(9): Xaa can be Phe, Tyr, Trp, Leu, Met, Ile, Val, Lys, Arg, Cys, Pro, Ala, Thr, His, Gln, Asn, Glu, Ser, Asp, or Gly
SXEEDTATX

SEQ ID NO: 113587 - protein, 10 aa, Artificial Sequence
  Description of Artificial Sequence: Synthetic peptide
  Seed: SEEEDTATWH (MAGC3_HUMAN)
  misc_feature (2)..(2): Xaa can be Glu, Gln, or Asp
  misc_feature (10)..(10): Xaa can be Phe, Trp, Tyr, Leu, Ile, Val, His, or Met
SXEEDTATWX

SEQ ID NO: 113588 - protein, 11 aa, Artificial Sequence
  Description of Artificial Sequence: Synthetic peptide
  Seed: SEEEDTATWHA (MAGC3_HUMAN)
  misc_feature (2)..(2): Xaa can be Glu, or Gln
  misc_feature (11)..(11): Xaa can be Cys, Pro, Ile, Leu, Met, Val, Trp, Ser, Phe, Ala, Thr, or Gly
SXEEDTATWHX

SEQ ID NO: 113589 - protein, 8 aa, Artificial Sequence
  Description of Artificial Sequence: Synthetic peptide
  Seed: SEEVIWEV (MAGC3_HUMAN)
  misc_feature (2)..(2): Xaa can be Glu, Asp, or Gln
  misc_feature (8)..(8): Xaa can be Leu, Phe, Met, Ile, Ala, Val, Trp, Cys, Thr, Pro, Ser, Tyr, or Gly
SXEVIWEX

SEQ ID NO: 113590 - protein, 9 aa, Artificial Sequence
  Description of Artificial Sequence: Synthetic peptide
  Seed: SEEVIWEVL (MAGC3_HUMAN)
  misc_feature (2)..(2): Xaa can be Glu, Asp, Gln, His, Arg, Phe, Tyr, Ala, Trp, Lys, Ile, Val, Gly, Ser, Thr, Leu, Met, or As n
  misc_feature (9)..(9): Xaa can be Leu, Met, Phe, Ile, Val, Trp, Tyr, Ala, Cys, Pro, Thr, Ser, Arg, Gly, Gln, His, Lys, Asn, Asp, or Glu
SXEVIWEVX

SEQ ID NO: 113591 - protein, 11 aa, Artificial Sequence
  Description of Artificial Sequence: Synthetic peptide
  Seed: SEEVIWEVLNA (MAGC3_HUMAN)
  misc_feature (2)..(2): Xaa can be , or Glu
  misc_feature (11)..(11): Xaa can be Ala, Phe, Pro, Leu, Cys, Ile, Met, Thr, or Val
SXEVIWEVLNX

SEQ ID NO: 113592 - protein, 8 aa, Artificial Sequence
  Description of Artificial Sequence: Synthetic peptide
  Seed: SEGPEAFC (MAGC3_HUMAN)
  misc_feature (2)..(2): Xaa can be , or Glu
  misc_feature (8)..(8): Xaa can be Ile, Met, Ala, Cys, Pro, Val, or Leu
SXGPEAFX

SEQ ID NO: 113593 - protein, 11 aa, Artificial Sequence
  Description of Artificial Sequence: Synthetic peptide
  Seed: SEGPEAFCEES (MAGC3_HUMAN)
  misc_feature (2)..(2): Xaa can be Glu, Asp, or Gln
  misc_feature (11)..(11): Xaa can be Leu, Cys, Met, Gly, Val, Tyr, Thr, Ser, Ile, Phe, Ala, Pro, or Trp
SXGPEAFCEEX

SEQ ID NO: 113594 - protein, 8 aa, Artificial Sequence
  Description of Artificial Sequence: Synthetic peptide
  Seed: SEPLFTYT (MAGC3_HUMAN)
  misc_feature (2)..(2): Xaa can be , or Glu
  misc_feature (8)..(8): Xaa can be Met, Cys, Pro, Phe, Leu, Thr, Ala, Ile, or Val
SXPLFTYX

SEQ ID NO: 113595 - protein, 9 aa, Artificial Sequence
  Description of Artificial Sequence: Synthetic peptide
  Seed: SEPLFTYTL (MAGC3_HUMAN)
  misc_feature (2)..(2): Xaa can be Arg, Glu, His, Asp, Gln, Ala, Pro, Tyr, Leu, Lys, Met, Phe, Val, Thr, Ile, Gly, Ser, Asn, Trp, or Cys
  misc_feature (9)..(9): Xaa can be Leu, Phe, Met, Ile, Tyr, Val, Ala, Trp, Cys, Thr, Pro, Ser, Gly, His, Lys, or Arg
SXPLFTYTX

SEQ ID NO: 113596 - protein, 8 aa, Artificial Sequence
  Description of Artificial Sequence: Synthetic peptide
  Seed: SESLPRYA (MAGC3_HUMAN)
  misc_feature (2)..(2): Xaa can be Glu, Asp, or Gln
  misc_feature (8)..(8): Xaa can be Leu, Phe, Ile, Val, Tyr, Met, Pro, Trp, Ala, Cys, or Thr
SXSLPRYX

SEQ ID NO: 113597 - protein, 9 aa, Artificial Sequence
  Description of Artificial Sequence: Synthetic peptide
  Seed: SESLPRYAL (MAGC3_HUMAN)
  misc_feature (2)..(2): Xaa can be Glu, His, Gln, Asp, Arg, Lys, Leu, Ser, Met, Pro, Ile, Asn, Val, Gly, Ala, Tyr, Thr, Phe, Cys, or Trp
  misc_feature (9)..(9): Xaa can be Leu, Tyr, Met, Phe, Ile, Val, Trp, Ala, Pro, Cys, Thr, Gly, Ser, Lys, His, Asp, Arg, Glu, Asn, or Gln
SXSLPRYAX

SEQ ID NO: 113598 - protein, 10 aa, Artificial Sequence
  Description of Artificial Sequence: Synthetic peptide
  Seed: SESLPRYALD (MAGC3_HUMAN)
  misc_feature (2)..(2): Xaa can be , or Glu
  misc_feature (10)..(10): Xaa can be Glu, Thr, Trp, Asn, Pro, Gln, Arg, Leu, Ala, Cys, Asp, Ser, Tyr, Val, Ile, Lys, His, Met, Gly, or Phe
SXSLPRYALX

SEQ ID NO: 113599 - protein, 10 aa, Artificial Sequence
  Description of Artificial Sequence: Synthetic peptide
  Seed: SGLRSAEGSV (MAGC3_HUMAN)
  misc_feature (2)..(2): Xaa can be Met, Phe, Leu, Gly, Ile, Ala, Pro, Gln, Tyr, Cys, Thr, His, Asp, Lys, Ser, Trp, Asn, Glu, Val, or Arg
  misc_feature (10)..(10): Xaa can be Val, Leu, Ile, or Ala
SXLRSAEGSX

SEQ ID NO: 113600 - protein, 8 aa, Artificial Sequence
  Description of Artificial Sequence: Synthetic peptide
  Seed: SGSPGLQL (MAGC3_HUMAN)
  misc_feature (2)..(2): Xaa can be Ala, Ser, Thr, Val, Met, Leu, Ile, Gly, Gln, Arg, Asn, Cys, Phe, Glu, Asp, His, Tyr, Pro, Trp, or Lys
  misc_feature (8)..(8): Xaa can be Leu, Met, Phe, Tyr, Ile, Val, Lys, Arg, His, Trp, Ala, Cys, Thr, or Gln
SXSPGLQX

SEQ ID NO: 113601 - protein, 11 aa, Artificial Sequence
  Description of Artificial Sequence: Synthetic peptide
  Seed: SGSPGLQLSDL (MAGC3_HUMAN)
  misc_feature (2)..(2): Xaa can be Ala, Ser, Val, Gly, Ile, or Met
  misc_feature (11)..(11): Xaa can be Leu, Phe, or Met
SXSPGLQLSDX

SEQ ID NO: 113602 - protein, 9 aa, Artificial Sequence
  Description of Artificial Sequence: Synthetic peptide
  Seed: SIIPSAFPS (MAGC3_HUMAN)
  misc_feature (2)..(2): Xaa can be Gln, Leu, Met, Thr, Val, Ile, Ala, Ser, Gly, Glu, Phe, Trp, Cys, Tyr, Asn, or Asp
  misc_feature (9)..(9): Xaa can be Val, Ile, Leu, Ala, Met, Thr, Phe, Ser, Cys, Pro, Gly, or Trp
SXIPSAFPX

SEQ ID NO: 113603 - protein, 10 aa, Artificial Sequence
  Description of Artificial Sequence: Synthetic peptide
  Seed: SIIPSAFPSW (MAGC3_HUMAN)
  misc_feature (2)..(2): Xaa can be Ala, Ser, Thr, Val, Met, Gln, Tyr, Ile, Gly, Pro, Leu, Glu, Asn, Trp, Phe, Lys, Cys, His, Asp, or Arg
  misc_feature (10)..(10): Xaa can be Phe, Trp, Tyr, Leu, Met, Val, Ile, His, Lys, Arg, Ala, Cys, Gln, Thr, or Ser
SXIPSAFPSX

SEQ ID NO: 113604 - protein, 11 aa, Artificial Sequence
  Description of Artificial Sequence: Synthetic peptide
  Seed: SIIPSAFPSWY (MAGC3_HUMAN)
  misc_feature (2)..(2): Xaa can be Gln, Met, Thr, Ser, Ile, Leu, Val, Phe, Ala, Tyr, Gly, Asn, Cys, Trp, Glu, or Pro
  misc_feature (11)..(11): Xaa can be Tyr, Phe, Lys, Arg, Met, Leu, Trp, or His
SXIPSAFPSWX

SEQ ID NO: 113605 - protein, 10 aa, Artificial Sequence
  Description of Artificial Sequence: Synthetic peptide
  Seed: SKLSSIIPSA (MAGC3_HUMAN)
  misc_feature (2)..(2): Xaa can be Leu, Tyr, Phe, Met, Gly, Ala, Thr, Val, Arg, His, Ser, Gln, Cys, Glu, Ile, Trp, Pro, Lys, Asn, or Asp
  misc_feature (10)..(10): Xaa can be Val, Thr, Leu, Ile, Ala, Met, Cys, Phe, or Ser
SXLSSIIPSX

SEQ ID NO: 113606 - protein, 11 aa, Artificial Sequence
  Description of Artificial Sequence: Synthetic peptide
  Seed: SKLSSIIPSAF (MAGC3_HUMAN)
  misc_feature (2)..(2): Xaa can be Gln, Lys, Ser, His, Met, Thr, Ala, Leu, Arg, Val, Glu, Gly, Asp, Phe, Ile, Asn, Cys, Trp, Tyr, or Pro
  misc_feature (11)..(11): Xaa can be Phe, Trp, Tyr, Met, Leu, Ile, or His
SXLSSIIPSAX

SEQ ID NO: 113607 - protein, 9 aa, Artificial Sequence
  Description of Artificial Sequence: Synthetic peptide
  Seed: SLGQWVKNT (MAGC3_HUMAN)
  misc_feature (2)..(2): Xaa can be Leu, Met, Gln, Ile, or Val
  misc_feature (9)..(9): Xaa can be Val, Cys, Met, Leu, Ile, Ala, or Thr
SXGQWVKNX

SEQ ID NO: 113608 - protein, 10 aa, Artificial Sequence
  Description of Artificial Sequence: Synthetic peptide
  Seed: SLIDDQGMPK (MAGC3_HUMAN)
  misc_feature (2)..(2): Xaa can be Ala, Val, Arg, Ser, Thr, Ile, Met, Gln, Leu, Gly, Tyr, Glu, Phe, Cys, Trp, His, Pro, Asn, Lys, or Asp
  misc_feature (10)..(10): Xaa can be Lys, Phe, Tyr, Arg, Met, Leu, Trp, His, Ile, Val, Gln, Ala, Glu, Cys, Asn, Thr, or Ser
SXIDDQGMPX

SEQ ID NO: 113609 - protein, 9 aa, Artificial Sequence
  Description of Artificial Sequence: Synthetic peptide
  Seed: SLPAVSPGK (MAGC3_HUMAN)
  misc_feature (2)..(2): Xaa can be Ala, Ser, Thr, Leu, Ile, Val, Met, Gly, Tyr, Gln, Phe, Asn, Cys, Pro, Trp, Glu, or Asp
  misc_feature (9)..(9): Xaa can be Arg, Lys, Met, Phe, Leu, Tyr, Ile, Val, His, Ala, Trp, or Cys
SXPAVSPGX

SEQ ID NO: 113610 - protein, 10 aa, Artificial Sequence
  Description of Artificial Sequence: Synthetic peptide
  Seed: SLPAVSPGKR (MAGC3_HUMAN)
  misc_feature (2)..(2): Xaa can be Val, Ala, Ser, Thr, Ile, Met, Gly, Leu, Cys, Phe, Asp, Tyr, Asn, Gln, Glu, Trp, Pro, or Hi s
  misc_feature (10)..(10): Xaa can be Arg, Lys, Tyr, Phe, Leu, Met, Ile, Val, Trp, His, or Gln
SXPAVSPGKX

SEQ ID NO: 113611 - protein, 11 aa, Artificial Sequence
  Description of Artificial Sequence: Synthetic peptide
  Seed: SLPAVSPGKRL (MAGC3_HUMAN)
  misc_feature (2)..(2): Xaa can be Met, Gln, Leu, Ala, Ser, Ile, Gly, Val, Thr, or Cys
  misc_feature (11)..(11): Xaa can be Leu, Met, Val, Ile, Phe, or Trp
SXPAVSPGKRX

SEQ ID NO: 113612 - protein, 8 aa, Artificial Sequence
  Description of Artificial Sequence: Synthetic peptide
  Seed: SLPESEPL (MAGC3_HUMAN)
  misc_feature (2)..(2): Xaa can be Ala, Thr, Val, Ile, Ser, Gly, Leu, Gln, Phe, Cys, Pro, Met, or Tyr
  misc_feature (8)..(8): Xaa can be Leu, Met, Ile, Phe, or Val
SXPESEPX

SEQ ID NO: 113613 - protein, 9 aa, Artificial Sequence
  Description of Artificial Sequence: Synthetic peptide
  Seed: SLPESEPLF (MAGC3_HUMAN)
  misc_feature (2)..(2): Xaa can be Leu, Tyr, Ala, Met, Ile, Arg, Phe, Val, Gln, Thr, Ser, Asn, Glu, Pro, Asp, Gly, Trp, Cys, His, or Lys
  misc_feature (9)..(9): Xaa can be Ile, Met, Leu, Val, Phe, Tyr, Lys, Trp, Arg, Cys, His, Ala, Thr, or Ser
SXPESEPLX

SEQ ID NO: 113614 - protein, 10 aa, Artificial Sequence
  Description of Artificial Sequence: Synthetic peptide
  Seed: SLPESEPLFT (MAGC3_HUMAN)
  misc_feature (2)..(2): Xaa can be Leu, Met, Ile, Val, Ala, Gln, Thr, or Ser
  misc_feature (10)..(10): Xaa can be Val, Leu, Ile, Met, Ala, Phe, Cys, Thr, or Tyr
SXPESEPLFX

SEQ ID NO: 113615 - protein, 11 aa, Artificial Sequence
  Description of Artificial Sequence: Synthetic peptide
  Seed: SLPESEPLFTY (MAGC3_HUMAN)
  misc_feature (2)..(2): Xaa can be Met, Ile, Leu, Val, Gln, Thr, Ser, Ala, Phe, Gly, Cys, Tyr, Asn, Glu, Trp, Asp, Lys, His, Arg, or Pro
  misc_feature (11)..(11): Xaa can be Tyr, Trp, Phe, Lys, Arg, Met, Leu, Val, Ile, His, Ala, Cys, Thr, or Ser
SXPESEPLFTX

SEQ ID NO: 113616 - protein, 10 aa, Artificial Sequence
  Description of Artificial Sequence: Synthetic peptide
  Seed: SLPRYALDEK (MAGC3_HUMAN)
  misc_feature (2)..(2): Xaa can be Met, Leu, Val, Thr, Ile, Ser, Gln, or Ala
  misc_feature (10)..(10): Xaa can be Lys, or Arg
SXPRYALDEX

SEQ ID NO: 113617 - protein, 11 aa, Artificial Sequence
  Description of Artificial Sequence: Synthetic peptide
  Seed: SLPRYALDEKV (MAGC3_HUMAN)
  misc_feature (2)..(2): Xaa can be Leu, or Met
  misc_feature (11)..(11): Xaa can be Leu, or Val
SXPRYALDEKX

SEQ ID NO: 113618 - protein, 8 aa, Artificial Sequence
  Description of Artificial Sequence: Synthetic peptide
  Seed: SLRRAVSV (MAGC3_HUMAN)
  misc_feature (2)..(2): Xaa can be Met, Ile, Pro, Leu, Gln, Arg, Phe, Asn, Val, Lys, Ala, Tyr, Gly, Trp, Ser, Thr, or His
  misc_feature (8)..(8): Xaa can be Leu, Met, Ile, Phe, Val, or Ala
SXRRAVSX

SEQ ID NO: 113619 - protein, 9 aa, Artificial Sequence
  Description of Artificial Sequence: Synthetic peptide
  Seed: SLRRAVSVK (MAGC3_HUMAN)
  misc_feature (2)..(2): Xaa can be Thr, Val, Met, Ala, Ser, Ile, Tyr, Phe, Gln, Leu, Trp, Gly, Asn, Cys, His, Glu, Pro, Asp, Arg, or Lys
  misc_feature (9)..(9): Xaa can be Lys, Val, Ala, Arg, Tyr, Ile, Met, Ser, Leu, Gly, Thr, Phe, Pro, Cys, Gln, Asn, Glu, His, Trp, or Asp
SXRRAVSVX

SEQ ID NO: 113620 - protein, 10 aa, Artificial Sequence
  Description of Artificial Sequence: Synthetic peptide
  Seed: SLRRAVSVKQ (MAGC3_HUMAN)
  misc_feature (2)..(2): Xaa can be Met, Leu, Ser, Val, Gln, Ile, or Thr
  misc_feature (10)..(10): Xaa can be Lys, Cys, Arg, Val, Leu, Ile, Ala, Gln, Met, Thr, Pro, Ser, Trp, Phe, His, Gly, Tyr, Asn, Asp, or Glu
SXRRAVSVKX

SEQ ID NO: 113621 - protein, 11 aa, Artificial Sequence
  Description of Artificial Sequence: Synthetic peptide
  Seed: SLRRAVSVKQR (MAGC3_HUMAN)
  misc_feature (2)..(2): Xaa can be Ile, Val, Thr, Met, Trp, Leu, Phe, Tyr, Gln, or Ser
  misc_feature (11)..(11): Xaa can be Arg, or Lys
SXRRAVSVKQX

SEQ ID NO: 113622 - protein, 10 aa, Artificial Sequence
  Description of Artificial Sequence: Synthetic peptide
  Seed: SLTEVDPDHF (MAGC3_HUMAN)
  misc_feature (2)..(2): Xaa can be Gln, Leu, Met, Ile, Val, Glu, Thr, Ala, Pro, Ser, or Phe
  misc_feature (10)..(10): Xaa can be Tyr, Trp, Phe, Leu, Val, Ile, or Met
SXTEVDPDHX

SEQ ID NO: 113623 - protein, 11 aa, Artificial Sequence
  Description of Artificial Sequence: Synthetic peptide
  Seed: SLTEVDPDHFY (MAGC3_HUMAN)
  misc_feature (2)..(2): Xaa can be Ala, Val, Thr, Gln, Ser, Glu, Met, Leu, Ile, Pro, Gly, Cys, Phe, Asn, Trp, Tyr, or Asp
  misc_feature (11)..(11): Xaa can be Lys, Tyr, Arg, Phe, His, Met, Leu, or Trp
SXTEVDPDHFX

SEQ ID NO: 113624 - protein, 8 aa, Artificial Sequence
  Description of Artificial Sequence: Synthetic peptide
  Seed: SLVLCPTY (MAGC3_HUMAN)
  misc_feature (2)..(2): Xaa can be Gln, Met, Val, Pro, Glu, Ala, Ser, Leu, Ile, Gly, Arg, Lys, Asp, Phe, Asn, His, Thr, or Ty r
  misc_feature (8)..(8): Xaa can be Tyr, Phe, Met, or Leu
SXVLCPTX

SEQ ID NO: 113625 - protein, 9 aa, Artificial Sequence
  Description of Artificial Sequence: Synthetic peptide
  Seed: SLVLCPTYF (MAGC3_HUMAN)
  misc_feature (2)..(2): Xaa can be Met, Tyr, Val, Leu, Ile, Gln, Ala, Ser, Phe, Thr, Gly, Trp, Glu, Asn, Lys, Cys, Pro, Arg, His, or Asp
  misc_feature (9)..(9): Xaa can be Tyr, Phe, Leu, Met, Trp, Arg, Ile, Lys, Val, His, Ala, Thr, or Cys
SXVLCPTYX

SEQ ID NO: 113626 - protein, 10 aa, Artificial Sequence
  Description of Artificial Sequence: Synthetic peptide
  Seed: SLVLCPTYFK (MAGC3_HUMAN)
  misc_feature (2)..(2): Xaa can be Thr, Tyr, Ser, Phe, Met, Ala, Leu, Val, Arg, Gln, Cys, Asn, Glu, Ile, Gly, His, Trp, Lys, Pro, or Asp
  misc_feature (10)..(10): Xaa can be Lys, Arg, Tyr, His, or Gln
SXVLCPTYFX

SEQ ID NO: 113627 - protein, 11 aa, Artificial Sequence
  Description of Artificial Sequence: Synthetic peptide
  Seed: SLVLCPTYFKL (MAGC3_HUMAN)
  misc_feature (2)..(2): Xaa can be His, Asp, Leu, Glu, Ser, Ala, Phe, Asn, Met, Tyr, Arg, Lys, Thr, Pro, Gly, Val, Gln, Cys, Ile, or Trp
  misc_feature (11)..(11): Xaa can be Asp, Thr, Leu, Glu, Val, Asn, Lys, Arg, His, Ser, Ile, Cys, Phe, Tyr, Pro, Met, Gln, Gly, Ala, or Trp
SXVLCPTYFKX

SEQ ID NO: 113628 - protein, 10 aa, Artificial Sequence
  Description of Artificial Sequence: Synthetic peptide
  Seed: SMIFIKGSCV (MAGC3_HUMAN)
  misc_feature (2)..(2): Xaa can be Met, Leu, Val, Ile, Gln, Thr, Ser, Glu, Cys, Gly, Phe, Asn, Tyr, Ala, Arg, Asp, Pro, His, Trp, or Lys
  misc_feature (10)..(10): Xaa can be Val, Leu, Ile, or Ala
SXIFIKGSCX

SEQ ID NO: 113629 - protein, 11 aa, Artificial Sequence
  Description of Artificial Sequence: Synthetic peptide
  Seed: SPGKRLWGEKA (MAGC3_HUMAN)
  misc_feature (2)..(2): Xaa can be , or Pro
  misc_feature (11)..(11): Xaa can be , or Ala
SXGKRLWGEKX

SEQ ID NO: 113630 - protein, 9 aa, Artificial Sequence
  Description of Artificial Sequence: Synthetic peptide
  Seed: SPGLQLSDL (MAGC3_HUMAN)
  misc_feature (2)..(2): Xaa can be , or Pro
  misc_feature (9)..(9): Xaa can be Ile, Ala, Phe, Val, Met, or Leu
SXGLQLSDX

SEQ ID NO: 113631 - protein, 9 aa, Artificial Sequence
  Description of Artificial Sequence: Synthetic peptide
  Seed: SPLDSCSSP (MAGC3_HUMAN)
  misc_feature (2)..(2): Xaa can be Pro, Ala, Val, or Ile
  misc_feature (9)..(9): Xaa can be Leu, Ala, Met, Ile, Phe, Val, Trp, Thr, Gly, Lys, Cys, Ser, Arg, Pro, or Tyr
SXLDSCSSX

SEQ ID NO: 113632 - protein, 10 aa, Artificial Sequence
  Description of Artificial Sequence: Synthetic peptide
  Seed: SPLDSCSSPL (MAGC3_HUMAN)
  misc_feature (2)..(2): Xaa can be Pro, Met, Ala, Val, Leu, Ile, Ser, Thr, Phe, Gln, Lys, His, Tyr, Asn, Glu, Gly, Cys, Trp, Asp, or Arg
  misc_feature (10)..(10): Xaa can be Ile, Leu, Met, Val, Ala, Tyr, Trp, Phe, Thr, Cys, His, Gly, Ser, Lys, Arg, or Pro
SXLDSCSSPX

SEQ ID NO: 113633 - protein, 11 aa, Artificial Sequence
  Description of Artificial Sequence: Synthetic peptide
  Seed: SPLDSCSSPLL (MAGC3_HUMAN)
  misc_feature (2)..(2): Xaa can be Pro, Ala, Ser, Thr, or Val
  misc_feature (11)..(11): Xaa can be Trp, Tyr, Gln, Gly, Leu, His, Asp, Val, Ser, Phe, Lys, Glu, Arg, Cys, Met, Thr, Ala, Ile, Pro, or Asn
SXLDSCSSPLX

SEQ ID NO: 113634 - protein, 8 aa, Artificial Sequence
  Description of Artificial Sequence: Synthetic peptide
  Seed: SPLLWTRL (MAGC3_HUMAN)
  misc_feature (2)..(2): Xaa can be , or Pro
  misc_feature (8)..(8): Xaa can be Met, Val, Leu, Ala, or Ile
SXLLWTRX

SEQ ID NO: 113635 - protein, 9 aa, Artificial Sequence
  Description of Artificial Sequence: Synthetic peptide
  Seed: SPPEIPPQG (MAGC3_HUMAN)
  misc_feature (2)..(2): Xaa can be Pro, Ala, Gly, Ile, Ser, Val, Thr, Met, Gln, Cys, Leu, Phe, Asp, Asn, Glu, or Tyr
  misc_feature (9)..(9): Xaa can be Leu, Val, Ile, Met, Ala, Cys, Phe, Ser, Tyr, Thr, Pro, His, Lys, Gly, Gln, Trp, Arg, Asp, Glu, or Asn
SXPEIPPQX

SEQ ID NO: 113636 - protein, 10 aa, Artificial Sequence
  Description of Artificial Sequence: Synthetic peptide
  Seed: SPPEIPPQGP (MAGC3_HUMAN)
  misc_feature (2)..(2): Xaa can be Pro, Ala, Val, Leu, Met, or Ile
  misc_feature (10)..(10): Xaa can be Leu, Ala, Met, Phe, Val, Cys, Arg, Thr, Gln, Tyr, Gly, Lys, Ile, Pro, Asn, Ser, Trp, or Gl u
SXPEIPPQGX

SEQ ID NO: 113637 - protein, 11 aa, Artificial Sequence
  Description of Artificial Sequence: Synthetic peptide
  Seed: SPPEIPPQGPP (MAGC3_HUMAN)
  misc_feature (2)..(2): Xaa can be Pro, or Ala
  misc_feature (11)..(11): Xaa can be Met, Leu, Ala, Gly, Phe, Trp, Gln, Ser, Lys, Cys, His, Arg, Pro, Tyr, Ile, Thr, or Val
SXPEIPPQGPX

SEQ ID NO: 113638 - protein, 9 aa, Artificial Sequence
  Description of Artificial Sequence: Synthetic peptide
  Seed: SPPQSPLDS (MAGC3_HUMAN)
  misc_feature (2)..(2): Xaa can be Pro, Ala, or Val
  misc_feature (9)..(9): Xaa can be Ala, Phe, Val, Pro, Ser, Gly, Ile, Thr, Met, Leu, or Cys
SXPQSPLDX

SEQ ID NO: 113639 - protein, 10 aa, Artificial Sequence
  Description of Artificial Sequence: Synthetic peptide
  Seed: SPPQSPLDSC (MAGC3_HUMAN)
  misc_feature (2)..(2): Xaa can be Pro, or Ala
  misc_feature (10)..(10): Xaa can be Met, Leu, Ala, Cys, Gly, Ser, Phe, Val, Pro, Ile, Arg, Thr, Lys, or Tyr
SXPQSPLDSX

SEQ ID NO: 113640 - protein, 8 aa, Artificial Sequence
  Description of Artificial Sequence: Synthetic peptide
  Seed: SPQGPPQS (MAGC3_HUMAN)
  misc_feature (2)..(2): Xaa can be , or Pro
  misc_feature (8)..(8): Xaa can be Ile, Leu, Pro, Val, Phe, Thr, Ala, Cys, Ser, or Met
SXQGPPQX

SEQ ID NO: 113641 - protein, 9 aa, Artificial Sequence
  Description of Artificial Sequence: Synthetic peptide
  Seed: SPQGPPQSP (MAGC3_HUMAN)
  misc_feature (2)..(2): Xaa can be Pro, Ala, His, Val, Arg, Gln, Gly, Ile, Thr, Met, Leu, Glu, Ser, Lys, Cys, Tyr, Phe, Asn, Asp, or Trp
  misc_feature (9)..(9): Xaa can be Leu, Met, Phe, Ala, Tyr, Val, Ile, Cys, Pro, Thr, Gly, Ser, Trp, His, Lys, Arg, Glu, Asp, Gln, or Asn
SXQGPPQSX

SEQ ID NO: 113642 - protein, 10 aa, Artificial Sequence
  Description of Artificial Sequence: Synthetic peptide
  Seed: SPQGPPQSPP (MAGC3_HUMAN)
  misc_feature (2)..(2): Xaa can be Pro, Ala, Val, or Ile
  misc_feature (10)..(10): Xaa can be Ala, Met, Leu, Phe, Val, Cys, Ser, His, Thr, Ile, Gln, Glu, Lys, Trp, Arg, Gly, Asp, Asn, Tyr, or Pro
SXQGPPQSPX

SEQ ID NO: 113643 - protein, 11 aa, Artificial Sequence
  Description of Artificial Sequence: Synthetic peptide
  Seed: SPQGPPQSPPQ (MAGC3_HUMAN)
  misc_feature (2)..(2): Xaa can be Pro, Gly, Arg, Ala, Val, Asn, Ile, Ser, Gln, Thr, Met, His, Glu, Lys, Cys, Asp, or Leu
  misc_feature (11)..(11): Xaa can be Lys, Asn, Arg, Leu, Phe, His, Ala, Met, Glu, Gln, Val, Tyr, Asp, Pro, Ile, Cys, Ser, Trp, Gly, or Thr
SXQGPPQSPPX

SEQ ID NO: 113644 - protein, 9 aa, Artificial Sequence
  Description of Artificial Sequence: Synthetic peptide
  Seed: SPSVMSTNF (MAGC3_HUMAN)
  misc_feature (2)..(2): Xaa can be Pro, Gln, His, Ala, Met, Val, Ser, Leu, Glu, Arg, Ile, Gly, Thr, Asp, Trp, Phe, Lys, Tyr, Asn, or Cys
  misc_feature (9)..(9): Xaa can be Tyr, Phe, Met, Trp, Leu, Ile, Val, Ala, Gly, Thr, Cys, His, Pro, or Ser
SXSVMSTNX

SEQ ID NO: 113645 - protein, 11 aa, Artificial Sequence
  Description of Artificial Sequence: Synthetic peptide
  Seed: SPSVMSTNFCP (MAGC3_HUMAN)
  misc_feature (2)..(2): Xaa can be , or Pro
  misc_feature (11)..(11): Xaa can be Ile, Val, Ala, Phe, Leu, Pro, Cys, Met, or Thr
SXSVMSTNFCX

SEQ ID NO: 113646 - protein, 9 aa, Artificial Sequence
  Description of Artificial Sequence: Synthetic peptide
  Seed: SPVVLPPQP (MAGC3_HUMAN)
  misc_feature (2)..(2): Xaa can be Pro, Ala, Val, Gly, Ser, Ile, or Thr
  misc_feature (9)..(9): Xaa can be Val, Ile, Leu, Ala, Phe, Met, Cys, Trp, Lys, Gln, His, Tyr, Glu, Arg, Pro, Thr, Gly, Ser, or Asn
SXVVLPPQX

SEQ ID NO: 113647 - protein, 10 aa, Artificial Sequence
  Description of Artificial Sequence: Synthetic peptide
  Seed: SPVVLPPQPQ (MAGC3_HUMAN)
  misc_feature (2)..(2): Xaa can be Pro, or Ala
  misc_feature (10)..(10): Xaa can be Ala, Ser, Gln, Phe, Lys, Ile, Tyr, Leu, Gly, Met, Glu, Val, His, Pro, Thr, Arg, Asn, or Cy s
SXVVLPPQPX

SEQ ID NO: 113648 - protein, 11 aa, Artificial Sequence
  Description of Artificial Sequence: Synthetic peptide
  Seed: SPVVLPPQPQP (MAGC3_HUMAN)
  misc_feature (2)..(2): Xaa can be , or Pro
  misc_feature (11)..(11): Xaa can be Met, Pro, Ala, Ser, Tyr, Trp, Cys, Phe, Leu, Val, Thr, Gly, or Ile
SXVVLPPQPQX

SEQ ID NO: 113649 - protein, 9 aa, Artificial Sequence
  Description of Artificial Sequence: Synthetic peptide
  Seed: SQPEGKFSL (MAGC3_HUMAN)
  misc_feature (2)..(2): Xaa can be Glu, Arg, Ala, Pro, Gln, His, Tyr, Met, Ser, Val, Ile, Asp, Leu, Thr, Phe, Gly, Trp, Asn, Lys, or Cys
  misc_feature (9)..(9): Xaa can be Met, Leu, Phe, Val, Tyr, Ile, Ala, Trp, Lys, Cys, Arg, His, Thr, Pro, Ser, Gln, Gly, Asp, or Glu
SXPEGKFSX

SEQ ID NO: 113650 - protein, 10 aa, Artificial Sequence
  Description of Artificial Sequence: Synthetic peptide
  Seed: SQPEGKFSLR (MAGC3_HUMAN)
  misc_feature (2)..(2): Xaa can be Thr, Ala, Val, Leu, Met, Ser, Ile, Gly, Gln, Glu, Tyr, Phe, Cys, Trp, Asn, Pro, Asp, Lys, His, or Arg
  misc_feature (10)..(10): Xaa can be Tyr, Arg, Lys, Leu, Met, Phe, Trp, His, Val, Ile, Gln, or Ala
SXPEGKFSLX

SEQ ID NO: 113651 - protein, 11 aa, Artificial Sequence
  Description of Artificial Sequence: Synthetic peptide
  Seed: SQPEGKFSLRR (MAGC3_HUMAN)
  misc_feature (2)..(2): Xaa can be Met, Leu, Gln, Ile, Ser, Thr, Val, Ala, Asn, Tyr, Gly, Phe, or Trp
  misc_feature (11)..(11): Xaa can be Arg, Lys, or Tyr
SXPEGKFSLRX

SEQ ID NO: 113652 - protein, 10 aa, Artificial Sequence
  Description of Artificial Sequence: Synthetic peptide
  Seed: SSEEEDTATW (MAGC3_HUMAN)
  misc_feature (2)..(2): Xaa can be Met, Glu, Gln, Leu, Thr, Ile, Val, Ser, Phe, Gly, Ala, Pro, Tyr, Asp, Asn, Cys, Trp, Lys, Arg, or His
  misc_feature (10)..(10): Xaa can be Trp, Tyr, Phe, Lys, Arg, Leu, His, Met, Ile, or Val
SXEEEDTATX

SEQ ID NO: 113653 - protein, 11 aa, Artificial Sequence
  Description of Artificial Sequence: Synthetic peptide
  Seed: SSEEEDTATWH (MAGC3_HUMAN)
  misc_feature (2)..(2): Xaa can be Thr, Met, Leu, Ala, Ser, Val, Ile, Gly, Phe, Gln, Asn, Cys, Glu, Tyr, Asp, Trp, or Pro
  misc_feature (11)..(11): Xaa can be Tyr, Lys, Arg, Phe, His, Trp, Met, Leu, or Gln
SXEEEDTATWX

SEQ ID NO: 113654 - protein, 8 aa, Artificial Sequence
  Description of Artificial Sequence: Synthetic peptide
  Seed: SSIIPSAF (MAGC3_HUMAN)
  misc_feature (2)..(2): Xaa can be Ala, Thr, Ser, Gln, Gly, Val, Ile, Met, Leu, Asn, Glu, Phe, Lys, Asp, Cys, His, Arg, Pro, or Tyr
  misc_feature (8)..(8): Xaa can be Tyr, Phe, Lys, Leu, Trp, Met, Arg, His, Ile, Val, or Ala
SXIIPSAX

SEQ ID NO: 113655 - protein, 11 aa, Artificial Sequence
  Description of Artificial Sequence: Synthetic peptide
  Seed: SSIIPSAFPSW (MAGC3_HUMAN)
  misc_feature (2)..(2): Xaa can be Thr, Ser, Ala, Val, Cys, Phe, Leu, Ile, Gly, Met, Gln, Arg, Lys, Asn, Asp, or Pro
  misc_feature (11)..(11): Xaa can be Trp, Phe, Tyr, Met, Leu, or Ile
SXIIPSAFPSX

SEQ ID NO: 113656 - protein, 8 aa, Artificial Sequence
  Description of Artificial Sequence: Synthetic peptide
  Seed: SSPLLWTR (MAGC3_HUMAN)
  misc_feature (2)..(2): Xaa can be Met, Trp, Tyr, Phe, Gln, Thr, Arg, Leu, Ala, Val, Ile, Lys, Asn, or Ser
  misc_feature (8)..(8): Xaa can be Arg, or Lys
SXPLLWTX

SEQ ID NO: 113657 - protein, 9 aa, Artificial Sequence
  Description of Artificial Sequence: Synthetic peptide
  Seed: SSPLLWTRL (MAGC3_HUMAN)
  misc_feature (2)..(2): Xaa can be Ser, Ala, Val, Thr, Gly, Arg, Ile, Met, Leu, Gln, Cys, Glu, His, Pro, Asn, Phe, or Tyr
  misc_feature (9)..(9): Xaa can be Leu, Trp, Met, Ile, Val, Phe, or Tyr
SXPLLWTRX

SEQ ID NO: 113658 - protein, 11 aa, Artificial Sequence
  Description of Artificial Sequence: Synthetic peptide
  Seed: SSSEEEDTATW (MAGC3_HUMAN)
  misc_feature (2)..(2): Xaa can be Glu, Ala, Met, Thr, Ile, Gln, Val, Ser, Leu, Gly, Pro, Arg, Cys, Lys, Phe, His, Asn, Trp, Tyr, or Asp
  misc_feature (11)..(11): Xaa can be Tyr, Arg, Phe, Lys, Trp, Leu, Met, Ile, His, Val, Gln, Cys, Ala, or Thr
SXSEEEDTATX

SEQ ID NO: 113659 - protein, 10 aa, Artificial Sequence
  Description of Artificial Sequence: Synthetic peptide
  Seed: SVIFIKGNCA (MAGC3_HUMAN)
  misc_feature (2)..(2): Xaa can be Thr, Val, Ile, Ser, or Ala
  misc_feature (10)..(10): Xaa can be Val, Ile, Ala, or Leu
SXIFIKGNCX

SEQ ID NO: 113660 - protein, 11 aa, Artificial Sequence
  Description of Artificial Sequence: Synthetic peptide
  Seed: SVKQREEPQDW (MAGC3_HUMAN)
  misc_feature (2)..(2): Xaa can be Ser, Thr, Ala, Leu, Asn, Met, Cys, Ile, Gln, Val, or Gly
  misc_feature (11)..(11): Xaa can be Trp, or Phe
SXKQREEPQDX

SEQ ID NO: 113661 - protein, 9 aa, Artificial Sequence
  Description of Artificial Sequence: Synthetic peptide
  Seed: SVLDLANPQ (MAGC3_HUMAN)
  misc_feature (2)..(2): Xaa can be Thr, Val, Ala, Ile, Ser, Gln, Asp, Asn, Pro, Gly, Met, Leu, Tyr, Phe, Trp, Glu, or Cys
  misc_feature (9)..(9): Xaa can be Arg, Lys, Tyr, Leu, His, Met, Gln, Phe, or Val
SXLDLANPX

SEQ ID NO: 113662 - protein, 11 aa, Artificial Sequence
  Description of Artificial Sequence: Synthetic peptide
  Seed: SVLDLANPQGL (MAGC3_HUMAN)
  misc_feature (2)..(2): Xaa can be Leu, Gln, Met, Ile, Val, Ser, Ala, Thr, Glu, Gly, Cys, Asn, Phe, Asp, Tyr, Trp, Pro, His, Arg, or Lys
  misc_feature (11)..(11): Xaa can be Lys, Arg, Trp, Tyr, Leu, Phe, Ile, Met, Val, His, Ala, Cys, or Thr
SXLDLANPQGX

SEQ ID NO: 113663 - protein, 10 aa, Artificial Sequence
  Description of Artificial Sequence: Synthetic peptide
  Seed: SWYMDALKDM (MAGC3_HUMAN)
  misc_feature (2)..(2): Xaa can be Tyr, Ser, Val, Glu, Phe, Pro, Thr, Ala, Asp, Cys, Lys, Arg, Gly, Trp, Leu, His, Gln, Met, Asn, or Ile
  misc_feature (10)..(10): Xaa can be Trp, Leu, Phe, Tyr, Ile, Met, or Val
SXYMDALKDX

SEQ ID NO: 113664 - protein, 8 aa, Artificial Sequence
  Description of Artificial Sequence: Synthetic peptide
  Seed: SYFFEDTL (MAGC3_HUMAN)
  misc_feature (2)..(2): Xaa can be Tyr, Trp, or Phe
  misc_feature (8)..(8): Xaa can be Leu, Phe, Met, Ile, Trp, or Tyr
SXFFEDTX

SEQ ID NO: 113665 - protein, 10 aa, Artificial Sequence
  Description of Artificial Sequence: Synthetic peptide
  Seed: SYFFEDTLDL (MAGC3_HUMAN)
  misc_feature (2)..(2): Xaa can be Tyr, Trp, Phe, His, Met, Arg, Asp, Gly, Ser, Ala, Lys, Asn, Val, Ile, Leu, Thr, Gln, Glu, Cys, or Pro
  misc_feature (10)..(10): Xaa can be Leu, Met, Phe, Trp, Tyr, Ile, or Val
SXFFEDTLDX

SEQ ID NO: 113666 - protein, 9 aa, Artificial Sequence
  Description of Artificial Sequence: Synthetic peptide
  Seed: TAMASASPS (MAGC3_HUMAN)
  misc_feature (2)..(2): Xaa can be Pro, Ala, Val, Met, Ile, Thr, Ser, Gly, Tyr, Phe, Asn, Gln, Cys, Leu, Glu, Trp, His, or Ly s
  misc_feature (9)..(9): Xaa can be Tyr, Phe, Met, Trp, Leu, His, Ala, Ile, Val, Ser, Thr, Asn, Gln, Cys, Glu, or Gly
TXMASASPX

SEQ ID NO: 113667 - protein, 10 aa, Artificial Sequence
  Description of Artificial Sequence: Synthetic peptide
  Seed: TAMASASPSV (MAGC3_HUMAN)
  misc_feature (2)..(2): Xaa can be Leu, Ser, Met, Val, Thr, Ala, Ile, Gln, Gly, Pro, Cys, Glu, Phe, Asn, Tyr, His, Lys, Arg, Trp, or Asp
  misc_feature (10)..(10): Xaa can be Ala, Val, Leu, Ile, Met, Tyr, Phe, Thr, His, or Cys
TXMASASPSX

SEQ ID NO: 113668 - protein, 11 aa, Artificial Sequence
  Description of Artificial Sequence: Synthetic peptide
  Seed: TAMASASPSVM (MAGC3_HUMAN)
  misc_feature (2)..(2): Xaa can be Pro, Ala, Met, Gln, Thr, Val, Ile, Ser, Gly, Leu, Glu, Asp, Asn, Lys, Tyr, Cys, Trp, Phe, Arg, or His
  misc_feature (11)..(11): Xaa can be Phe, Tyr, Met, Lys, Arg, Leu, His, Trp, Ile, Val, Ala, Ser, Thr, Cys, Gly, or Pro
TXMASASPSVX

SEQ ID NO: 113669 - protein, 10 aa, Artificial Sequence
  Description of Artificial Sequence: Synthetic peptide
  Seed: TCATYALSPV (MAGC3_HUMAN)
  misc_feature (2)..(2): Xaa can be Val, Thr, Ser, Ala, Ile, Met, Leu, Asn, Arg, Tyr, Pro, Cys, Lys, Gly, Trp, Phe, Glu, Asp, Gln, or His
  misc_feature (10)..(10): Xaa can be Val, Ile, Leu, Ala, Met, or Thr
TXATYALSPX

SEQ ID NO: 113670 - protein, 10 aa, Artificial Sequence
  Description of Artificial Sequence: Synthetic peptide
  Seed: TDDATAMASA (MAGC3_HUMAN)
  misc_feature (2)..(2): Xaa can be Glu, Asp, or Gln
  misc_feature (10)..(10): Xaa can be Leu, Ala, Val, Cys, Pro, Trp, Gly, Ile, Thr, Tyr, Ser, Met, or Phe
TXDATAMASX

SEQ ID NO: 113671 - protein, 8 aa, Artificial Sequence
  Description of Artificial Sequence: Synthetic peptide
  Seed: TDKDYSAF (MAGC3_HUMAN)
  misc_feature (2)..(2): Xaa can be Glu, or Asp
  misc_feature (8)..(8): Xaa can be Met, Ile, Phe, Leu, Val, Ala, or Cys
TXKDYSAX

SEQ ID NO: 113672 - protein, 10 aa, Artificial Sequence
  Description of Artificial Sequence: Synthetic peptide
  Seed: TDKDYSAFHL (MAGC3_HUMAN)
  misc_feature (2)..(2): Xaa can be Glu, or Asp
  misc_feature (10)..(10): Xaa can be Leu, Phe, Val, Met, or Ile
TXKDYSAFHX

SEQ ID NO: 113673 - protein, 10 aa, Artificial Sequence
  Description of Artificial Sequence: Synthetic peptide
  Seed: TDMDPDNHSY (MAGC3_HUMAN)
  misc_feature (2)..(2): Xaa can be Glu, Pro, Ala, Val, Met, Ser, Thr, Gln, Ile, Gly, His, Leu, Asp, Tyr, Phe, Asn, Trp, Cys, Arg, or Lys
  misc_feature (10)..(10): Xaa can be Trp, Leu, Met, Lys, Tyr, Phe, Arg, His, Val, Ile, Ala, Gln, Cys, Ser, Thr, Gly, or Pro
TXMDPDNHSX

SEQ ID NO: 113674 - protein, 11 aa, Artificial Sequence
  Description of Artificial Sequence: Synthetic peptide
  Seed: TDMDPDNHSYF (MAGC3_HUMAN)
  misc_feature (2)..(2): Xaa can be Ala, Glu, Thr, Val, Ser, Ile, Met, Gly, Gln, Leu, Asp, Asn, Pro, Phe, Cys, Tyr, Arg, Lys, His, or Trp
  misc_feature (11)..(11): Xaa can be Trp, Tyr, Phe, Met, Leu, Lys, His, Arg, Val, Ile, Gln, Cys, Ala, Ser, Gly, Thr, Pro, Glu, or Asn
TXMDPDNHSYX

SEQ ID NO: 113675 - protein, 9 aa, Artificial Sequence
  Description of Artificial Sequence: Synthetic peptide
  Seed: TEASPQQKK (MAGC3_HUMAN)
  misc_feature (2)..(2): Xaa can be Glu, Ala, Val, Arg, Ser, Thr, Asp, Gln, Ile, Met, Leu, Gly, Asn, Phe, Tyr, Cys, Pro, Trp, Lys, or His
  misc_feature (9)..(9): Xaa can be Lys, Tyr, Phe, Arg, Leu, Met, Ile, Val, Trp, His, Ala, Gln, Cys, or Thr
TXASPQQKX

SEQ ID NO: 113676 - protein, 10 aa, Artificial Sequence
  Description of Artificial Sequence: Synthetic peptide
  Seed: TEASPQQKKG (MAGC3_HUMAN)
  misc_feature (2)..(2): Xaa can be Glu, or Asp
  misc_feature (10)..(10): Xaa can be Ala, Cys, Leu, Met, Gly, Ser, Pro, Thr, Ile, Phe, or Val
TXASPQQKKX

SEQ ID NO: 113677 - protein, 8 aa, Artificial Sequence
  Description of Artificial Sequence: Synthetic peptide
  Seed: TEVDPDHF (MAGC3_HUMAN)
  misc_feature (2)..(2): Xaa can be Glu, Asp, or Gln
  misc_feature (8)..(8): Xaa can be Met, Trp, Leu, Phe, Tyr, Val, Cys, Pro, Ile, Ala, or Thr
TXVDPDHX

SEQ ID NO: 113678 - protein, 9 aa, Artificial Sequence
  Description of Artificial Sequence: Synthetic peptide
  Seed: TEVDPDHFY (MAGC3_HUMAN)
  misc_feature (2)..(2): Xaa can be Glu, Asp, Gln, Ala, Thr, Ser, Val, Ile, Met, Leu, Gly, Pro, Phe, Tyr, Asn, His, Cys, Lys, Arg, or Trp
  misc_feature (9)..(9): Xaa can be Phe, Tyr, Met, Lys, Arg, Leu, Trp, His, Ile, Val, Ala, Cys, Thr, Pro, Gln, Ser, Asp, Glu, or Gly
TXVDPDHFX

SEQ ID NO: 113679 - protein, 10 aa, Artificial Sequence
  Description of Artificial Sequence: Synthetic peptide
  Seed: TEVDPDHFYV (MAGC3_HUMAN)
  misc_feature (2)..(2): Xaa can be Glu, Gln, Asp, Leu, Met, Phe, Thr, Val, Ile, Ala, Arg, Lys, Tyr, Asn, Cys, Ser, His, Pro, Gly, or Trp
  misc_feature (10)..(10): Xaa can be Val, Leu, Ile, Ala, Met, Trp, Cys, Thr, Tyr, Phe, Arg, Ser, Gly, His, Lys, or Pro
TXVDPDHFYX

SEQ ID NO: 113680 - protein, 11 aa, Artificial Sequence
  Description of Artificial Sequence: Synthetic peptide
  Seed: TEVDPDHFYVF (MAGC3_HUMAN)
  misc_feature (2)..(2): Xaa can be Glu, Gln, Asp, Met, Leu, Pro, Ala, Lys, Ile, Val, Arg, Thr, Ser, Cys, Tyr, Phe, Gly, or Hi s
  misc_feature (11)..(11): Xaa can be Tyr, Phe, Trp, Leu, Met, Ile, Val, Cys, Ala, His, Gly, Ser, Thr, or Pro
TXVDPDHFYVX

SEQ ID NO: 113681 - protein, 10 aa, Artificial Sequence
  Description of Artificial Sequence: Synthetic peptide
  Seed: TFSDGSLGQW (MAGC3_HUMAN)
  misc_feature (2)..(2): Xaa can be Tyr, Ala, Gln, Met, Leu, Ser, Thr, Trp, Val, Phe, Ile, Gly, Glu, Cys, Asn, His, Asp, Lys, Pro, or Arg
  misc_feature (10)..(10): Xaa can be Trp, Lys, Phe, Arg, Leu, Tyr, Met, Ile, Val, or His
TXSDGSLGQX

SEQ ID NO: 113682 - protein, 9 aa, Artificial Sequence
  Description of Artificial Sequence: Synthetic peptide
  Seed: TGYFPMIFR (MAGC3_HUMAN)
  misc_feature (2)..(2): Xaa can be Thr, Met, Leu, Val, Ile, Ser, Ala, Asn, Gly, Gln, Trp, Tyr, Phe, Pro, Glu, Asp, Cys, Lys, His, or Arg
  misc_feature (9)..(9): Xaa can be Arg, Lys, His, Tyr, Gln, Leu, Met, Phe, Val, Glu, Ile, Ala, Ser, or Asn
TXYFPMIFX

SEQ ID NO: 113683 - protein, 10 aa, Artificial Sequence
  Description of Artificial Sequence: Synthetic peptide
  Seed: TGYFPMIFRK (MAGC3_HUMAN)
  misc_feature (2)..(2): Xaa can be Asn, Ile, Thr, Val, Gln, Leu, Ser, Met, Gly, Trp, Ala, Phe, Tyr, Pro, Lys, Arg, His, Cys, Glu, or Asp
  misc_feature (10)..(10): Xaa can be Lys, Arg, His, Tyr, Ala, Gln, Leu, Phe, Ser, Val, Glu, Trp, Thr, Asn, Ile, Cys, Asp, Gly, Pro, or Met
TXYFPMIFRX

SEQ ID NO: 113684 - protein, 9 aa, Artificial Sequence
  Description of Artificial Sequence: Synthetic peptide
  Seed: TGYTLSLPA (MAGC3_HUMAN)
  misc_feature (2)..(2): Xaa can be Pro, Ala, Gly, or Val
  misc_feature (9)..(9): Xaa can be Ala, Cys, Leu, Val, Trp, Asn, Ser, Asp, Lys, Ile, Thr, His, Gln, Phe, Glu, Met, Gly, Arg, Tyr, or Pro
TXYTLSLPX

SEQ ID NO: 113685 - protein, 9 aa, Artificial Sequence
  Description of Artificial Sequence: Synthetic peptide
  Seed: TKAEMLTTV (MAGC3_HUMAN)
  misc_feature (2)..(2): Xaa can be Arg, His, Gln, Gly, Ala, Lys, Leu, Met, Tyr, Glu, Pro, Asn, Ser, Trp, Thr, Ile, Phe, Val, Cys, or Asp
  misc_feature (9)..(9): Xaa can be Leu, Met, Phe, Ile, Val, Tyr, Ala, Cys, Lys, Trp, Thr, Pro, Arg, Gly, Ser, or His
TXAEMLTTX

SEQ ID NO: 113686 - protein, 8 aa, Artificial Sequence
  Description of Artificial Sequence: Synthetic peptide
  Seed: TLDEKVDK (MAGC3_HUMAN)
  misc_feature (2)..(2): Xaa can be Ala, Ser, Thr, Phe, Val, Ile, Leu, Met, Tyr, Gln, Gly, Asn, or Trp
  misc_feature (8)..(8): Xaa can be Lys, Tyr, Arg, Phe, Leu, Met, Ile, or Val
TXDEKVDX

SEQ ID NO: 113687 - protein, 9 aa, Artificial Sequence
  Description of Artificial Sequence: Synthetic peptide
  Seed: TLDEKVDKL (MAGC3_HUMAN)
  misc_feature (2)..(2): Xaa can be Phe, Tyr, Ala, Ser, Thr, Ile, Val, Leu, Glu, Met, Trp, Arg, Gln, Gly, His, Asn, Pro, Cys, Asp, or Lys
  misc_feature (9)..(9): Xaa can be Val, Lys, Phe, Ile, Trp, Tyr, Met, Leu, Cys, Arg, Ala, Thr, His, Ser, Gln, Pro, Gly, or Gl u
TXDEKVDKX

SEQ ID NO: 113688 - protein, 10 aa, Artificial Sequence
  Description of Artificial Sequence: Synthetic peptide
  Seed: TLDEKVDKLV (MAGC3_HUMAN)
  misc_feature (2)..(2): Xaa can be Ala, Tyr, Phe, Met, Leu, Trp, Val, Ser, Ile, Thr, Cys, Gln, Gly, Pro, Asn, Glu, Asp, or Hi s
  misc_feature (10)..(10): Xaa can be Met, Phe, Leu, Ile, Val, Tyr, Trp, Cys, Ala, Thr, or Lys
TXDEKVDKLX

SEQ ID NO: 113689 - protein, 10 aa, Artificial Sequence
  Description of Artificial Sequence: Synthetic peptide
  Seed: TLDLTCEGSL (MAGC3_HUMAN)
  misc_feature (2)..(2): Xaa can be Phe, Tyr, Ala, Trp, Thr, Val, Ile, Leu, Ser, Met, Cys, Gly, Gln, or Pro
  misc_feature (10)..(10): Xaa can be Leu, Phe, Met, Ile, Val, Tyr, or Trp
TXDLTCEGSX

SEQ ID NO: 113690 - protein, 10 aa, Artificial Sequence
  Description of Artificial Sequence: Synthetic peptide
  Seed: TLDLTYEGSL (MAGC3_HUMAN)
  misc_feature (2)..(2): Xaa can be Ala, Ser, Leu, Ile, Val, Thr, Gly, Met, Phe, Cys, or Gln
  misc_feature (10)..(10): Xaa can be Leu, Phe, Met, Ile, Val, or Tyr
TXDLTYEGSX

SEQ ID NO: 113691 - protein, 10 aa, Artificial Sequence
  Description of Artificial Sequence: Synthetic peptide
  Seed: TLSGSPGLQL (MAGC3_HUMAN)
  misc_feature (2)..(2): Xaa can be Gly, Arg, Ala, Gln, Leu, Met, Ile, Val, Thr, Ser, Pro, Glu, Tyr, Cys, Phe, His, Asp, Asn, Trp, or Lys
  misc_feature (10)..(10): Xaa can be Tyr, Phe, Leu, Lys, Arg, Met, Val, Trp, Ile, His, Ala, Cys, Gln, Glu, Gly, or Asn
TXSGSPGLQX

SEQ ID NO: 113692 - protein, 11 aa, Artificial Sequence
  Description of Artificial Sequence: Synthetic peptide
  Seed: TLSLPAVSPGK (MAGC3_HUMAN)
  misc_feature (2)..(2): Xaa can be Ala, Thr, Val, Ile, Gly, Ser, Leu, Asn, Met, Gln, or Arg
  misc_feature (11)..(11): Xaa can be Lys, Arg, Met, Leu, or Phe
TXSLPAVSPGX

SEQ ID NO: 113693 - protein, 10 aa, Artificial Sequence
  Description of Artificial Sequence: Synthetic peptide
  Seed: TLWKDSDLPT (MAGC3_HUMAN)
  misc_feature (2)..(2): Xaa can be Met, Leu, Ile, Val, Gln, or Thr
  misc_feature (10)..(10): Xaa can be Val, Ile, Leu, Thr, Ala, Cys, or Met
TXWKDSDLPX

SEQ ID NO: 113694 - protein, 11 aa, Artificial Sequence
  Description of Artificial Sequence: Synthetic peptide
  Seed: TLWKDSDLPTW (MAGC3_HUMAN)
  misc_feature (2)..(2): Xaa can be Thr, Ser, Gln, Leu, Met, Ile, Ala, Val, Glu, Pro, Gly, Cys, Asn, Phe, Lys, Asp, Arg, Trp, or Tyr
  misc_feature (11)..(11): Xaa can be Trp, Tyr, Phe, Leu, Met, Ile, or Val
TXWKDSDLPTX

SEQ ID NO: 113695 - protein, 9 aa, Artificial Sequence
  Description of Artificial Sequence: Synthetic peptide
  Seed: TRAEMQMNV (MAGC3_HUMAN)
  misc_feature (2)..(2): Xaa can be Arg, His, Gln, Tyr, Glu, Ala, Phe, Met, Gly, Ser, Lys, Leu, Thr, Val, Ile, Trp, Asn, Asp, Pro, or Cys
  misc_feature (9)..(9): Xaa can be Leu, Met, Phe, Tyr, Ile, Lys, Val, Trp, Cys, Ala, Pro, Thr, Arg, His, Ser, or Gln
TXAEMQMNX

SEQ ID NO: 113696 - protein, 10 aa, Artificial Sequence
  Description of Artificial Sequence: Synthetic peptide
  Seed: TRAEMQMNVI (MAGC3_HUMAN)
  misc_feature (2)..(2): Xaa can be , or Arg
  misc_feature (10)..(10): Xaa can be Thr, Tyr, Ile, Lys, Phe, Met, Cys, Leu, Trp, Ala, Val, Arg, or Pro
TXAEMQMNVX

SEQ ID NO: 113697 - protein, 9 aa, Artificial Sequence
  Description of Artificial Sequence: Synthetic peptide
  Seed: TRLDEESSS (MAGC3_HUMAN)
  misc_feature (2)..(2): Xaa can be Arg, or Gln
  misc_feature (9)..(9): Xaa can be Leu, Ile, Ala, Cys, Ser, Gly, Thr, Pro, Met, or Val
TXLDEESSX

SEQ ID NO: 113698 - protein, 11 aa, Artificial Sequence
  Description of Artificial Sequence: Synthetic peptide
  Seed: TRLDEESSSEE (MAGC3_HUMAN)
  misc_feature (2)..(2): Xaa can be Arg, Gly, Gln, Asp, Ile, Asn, Ala, Val, Glu, Ser, Lys, Leu, Thr, or Met
  misc_feature (11)..(11): Xaa can be Lys, Glu, Phe, Arg, Tyr, Leu, His, Asn, Gln, Asp, Met, Ile, or Trp
TXLDEESSSEX

SEQ ID NO: 113699 - protein, 9 aa, Artificial Sequence
  Description of Artificial Sequence: Synthetic peptide
  Seed: TSDQRMDSL (MAGC3_HUMAN)
  misc_feature (2)..(2): Xaa can be Ile, Glu, Ala, Leu, Met, Thr, Val, Ser, Arg, Phe, Tyr, Gly, Trp, Gln, Asn, Asp, Cys, Pro, Lys, or His
  misc_feature (9)..(9): Xaa can be Leu, Val, Ile, Phe, Met, Tyr, Trp, Lys, Cys, Ala, Arg, His, Thr, or Pro
TXDQRMDSX

SEQ ID NO: 113700 - protein, 10 aa, Artificial Sequence
  Description of Artificial Sequence: Synthetic peptide
  Seed: TSDQRMDSLV (MAGC3_HUMAN)
  misc_feature (2)..(2): Xaa can be Ala, Val, Met, Ile, Ser, Thr, Leu, Cys, Phe, Gln, Gly, Pro, or Asn
  misc_feature (10)..(10): Xaa can be Leu, Phe, Met, Val, Ile, Tyr, or Trp
TXDQRMDSLX

SEQ ID NO: 113701 - protein, 11 aa, Artificial Sequence
  Description of Artificial Sequence: Synthetic peptide
  Seed: TSDQRMDSLVL (MAGC3_HUMAN)
  misc_feature (2)..(2): Xaa can be Ala, Ile, Val, Ser, Thr, Arg, Met, Glu, His, Phe, Cys, Gln, Leu, Tyr, Trp, Asn, Asp, Pro, Lys, or Gly
  misc_feature (11)..(11): Xaa can be Met, Phe, Tyr, Leu, Val, Ile, or Trp
TXDQRMDSLVX

SEQ ID NO: 113702 - protein, 8 aa, Artificial Sequence
  Description of Artificial Sequence: Synthetic peptide
  Seed: TTDDATAM (MAGC3_HUMAN)
  misc_feature (2)..(2): Xaa can be Ala, Thr, Phe, Ser, Tyr, Ile, Val, Leu, Met, Trp, Gly, Gln, Asn, Asp, Cys, Pro, His, Arg, Glu, or Lys
  misc_feature (8)..(8): Xaa can be Leu, Ile, Phe, Met, Val, Tyr, Lys, Arg, Trp, Cys, Ala, Thr, or His
TXDDATAX

SEQ ID NO: 113703 - protein, 9 aa, Artificial Sequence
  Description of Artificial Sequence: Synthetic peptide
  Seed: TTDDATAMA (MAGC3_HUMAN)
  misc_feature (2)..(2): Xaa can be Ala, Thr, Val, Ser, Leu, Ile, Phe, Met, Gln, Gly, Cys, Tyr, Asn, Trp, Pro, Asp, Glu, His, Lys, or Arg
  misc_feature (9)..(9): Xaa can be Ile, Phe, Met, Val, Leu, Tyr, Lys, Arg, Cys, Ala, Trp, His, Thr, Ser, Gln, Pro, Glu, Asn, or Gly
TXDDATAMX

SEQ ID NO: 113704 - protein, 10 aa, Artificial Sequence
  Description of Artificial Sequence: Synthetic peptide
  Seed: TTDDATAMAS (MAGC3_HUMAN)
  misc_feature (2)..(2): Xaa can be Val, Ala, Met, Ser, Thr, Ile, Leu, Phe, Gln, Cys, Asn, Tyr, Gly, Trp, Glu, Pro, Asp, Lys, Arg, or His
  misc_feature (10)..(10): Xaa can be Met, Leu, Val, Phe, Ile, Lys, Tyr, Arg, Trp, Cys, His, Ala, Thr, Gln, Gly, Ser, Glu, Pro, or Asn
TXDDATAMAX

SEQ ID NO: 113705 - protein, 11 aa, Artificial Sequence
  Description of Artificial Sequence: Synthetic peptide
  Seed: TTDDATAMASA (MAGC3_HUMAN)
  misc_feature (2)..(2): Xaa can be Ala, Thr, Ser, Leu, Ile, Val, Gly, Met, Phe, Cys, Gln, Asn, Trp, Tyr, Glu, Asp, Pro, His, Lys, or Arg
  misc_feature (11)..(11): Xaa can be Tyr, Leu, Met, Lys, Phe, Ile, Val, Arg, Trp, Cys, His, Ala, Thr, Gln, Ser, Glu, Pro, Gly, or Asn
TXDDATAMASX

SEQ ID NO: 113706 - protein, 10 aa, Artificial Sequence
  Description of Artificial Sequence: Synthetic peptide
  Seed: TTVIKKYKDY (MAGC3_HUMAN)
  misc_feature (2)..(2): Xaa can be , or Thr
  misc_feature (10)..(10): Xaa can be , or Tyr
TXVIKKYKDX

SEQ ID NO: 113707 - protein, 9 aa, Artificial Sequence
  Description of Artificial Sequence: Synthetic peptide
  Seed: TVIKKYKDY (MAGC3_HUMAN)
  misc_feature (2)..(2): Xaa can be Ala, Ser, Val, Thr, Gln, Ile, Gly, Met, Leu, Phe, Glu, Pro, Asp, Tyr, or Trp
  misc_feature (9)..(9): Xaa can be Tyr, Phe, Met, Leu, Ile, Trp, Val, or His
TXIKKYKDX

SEQ ID NO: 113708 - protein, 10 aa, Artificial Sequence
  Description of Artificial Sequence: Synthetic peptide
  Seed: TWRRGTGYTL (MAGC3_HUMAN)
  misc_feature (2)..(2): Xaa can be Tyr, Trp, Arg, Phe, Val, Gln, Ala, Pro, Met, His, Glu, Gly, Asn, Ser, Asp, Ile, Leu, Cys, Thr, or Lys
  misc_feature (10)..(10): Xaa can be Leu, Phe, Trp, Met, Ile, Val, or Tyr
TXRRGTGYTX

SEQ ID NO: 113709 - protein, 8 aa, Artificial Sequence
  Description of Artificial Sequence: Synthetic peptide
  Seed: TYALSPVV (MAGC3_HUMAN)
  misc_feature (2)..(2): Xaa can be Tyr, Phe, or Trp
  misc_feature (8)..(8): Xaa can be Tyr, Leu, Phe, Met, Ile, or Val
TXALSPVX

SEQ ID NO: 113710 - protein, 9 aa, Artificial Sequence
  Description of Artificial Sequence: Synthetic peptide
  Seed: TYALSPVVL (MAGC3_HUMAN)
  misc_feature (2)..(2): Xaa can be Ala, Arg, Tyr, His, Ser, Phe, Val, Thr, Ile, Met, Asn, Leu, Gly, Gln, Trp, Asp, Pro, Glu, Cys, or Lys
  misc_feature (9)..(9): Xaa can be Met, Phe, Leu, Ile, Lys, Tyr, Val, Arg, Trp, His, Ala, Cys, Pro, or Thr
TXALSPVVX

SEQ ID NO: 113711 - protein, 9 aa, Artificial Sequence
  Description of Artificial Sequence: Synthetic peptide
  Seed: TYFKLWRTL (MAGC3_HUMAN)
  misc_feature (2)..(2): Xaa can be Arg, Tyr, Phe, Gln, Trp, Met, Ala, Glu, Thr, Ser, His, Leu, Val, Lys, Asn, Asp, Gly, Ile, or Cys
  misc_feature (9)..(9): Xaa can be Tyr, Leu, Phe, Met, Ile, Val, Trp, His, Ala, Arg, Cys, or Lys
TXFKLWRTX

SEQ ID NO: 113712 - protein, 10 aa, Artificial Sequence
  Description of Artificial Sequence: Synthetic peptide
  Seed: TYFKLWRTLS (MAGC3_HUMAN)
  misc_feature (2)..(2): Xaa can be Tyr, Trp, Phe, Gln, His, or Met
  misc_feature (10)..(10): Xaa can be Phe, Met, Trp, Ile, Leu, Val, Ser, Gly, Ala, Thr, Cys, Arg, Tyr, Pro, or Lys
TXFKLWRTLX

SEQ ID NO: 113713 - protein, 8 aa, Artificial Sequence
  Description of Artificial Sequence: Synthetic peptide
  Seed: TYTGYFPM (MAGC3_HUMAN)
  misc_feature (2)..(2): Xaa can be Tyr, or Phe
  misc_feature (8)..(8): Xaa can be Met, Tyr, Phe, Leu, or Ile
TXTGYFPX

SEQ ID NO: 113714 - protein, 9 aa, Artificial Sequence
  Description of Artificial Sequence: Synthetic peptide
  Seed: TYTGYFPMI (MAGC3_HUMAN)
  misc_feature (2)..(2): Xaa can be Arg, Tyr, Phe, Trp, Met, Gln, His, Ala, Leu, Asn, Ile, Ser, Val, Cys, Gly, or Thr
  misc_feature (9)..(9): Xaa can be Phe, Met, Leu, Trp, Tyr, Ile, Val, His, Arg, Cys, or Lys
TXTGYFPMX

SEQ ID NO: 113715 - protein, 10 aa, Artificial Sequence
  Description of Artificial Sequence: Synthetic peptide
  Seed: TYTGYFPMIF (MAGC3_HUMAN)
  misc_feature (2)..(2): Xaa can be Tyr, Trp, Arg, Phe, Ser, Thr, Gly, Lys, Ile, Met, Val, Ala, Cys, Pro, His, Asp, Glu, Asn, Gln, or Leu
  misc_feature (10)..(10): Xaa can be Tyr, Trp, Phe, Met, Leu, Ile, or Val
TXTGYFPMIX

SEQ ID NO: 113716 - protein, 11 aa, Artificial Sequence
  Description of Artificial Sequence: Synthetic peptide
  Seed: TYTGYFPMIFR (MAGC3_HUMAN)
  misc_feature (2)..(2): Xaa can be Arg, Leu, Phe, Tyr, Val, Gly, Trp, Glu, Ala, Gln, Thr, Ser, His, Lys, Asn, Ile, Met, Asp, Pro, or Cys
  misc_feature (11)..(11): Xaa can be Arg, or Lys
TXTGYFPMIFX

SEQ ID NO: 113717 - protein, 8 aa, Artificial Sequence
  Description of Artificial Sequence: Synthetic peptide
  Seed: VAELVQFL (MAGC3_HUMAN)
  misc_feature (2)..(2): Xaa can be Ala, Ser, Thr, Gly, Ile, Leu, Gln, Asn, Phe, Cys, Tyr, Arg, Val, or His
  misc_feature (8)..(8): Xaa can be Leu, Lys, Phe, Ile, Met, Val, or Tyr
VXELVQFX

SEQ ID NO: 113718 - protein, 9 aa, Artificial Sequence
  Description of Artificial Sequence: Synthetic peptide
  Seed: VAELVQFLL (MAGC3_HUMAN)
  misc_feature (2)..(2): Xaa can be Ser, Thr, Ala, Arg, Gly, Val, Gln, Ile, Asn, Tyr, Phe, Met, Cys, Leu, Pro, Trp, His, Asp, or Glu
  misc_feature (9)..(9): Xaa can be Trp, Phe, Leu, Met, Lys, Ile, Val, Tyr, or Arg
VXELVQFLX

SEQ ID NO: 113719 - protein, 10 aa, Artificial Sequence
  Description of Artificial Sequence: Synthetic peptide
  Seed: VAELVQFLLL (MAGC3_HUMAN)
  misc_feature (2)..(2): Xaa can be Arg, Glu, Asp, Cys, Thr, Val, Gly, Gln, Ala, Phe, Tyr, Met, Pro, Ile, His, Trp, Ser, Leu, Asn, or Lys
  misc_feature (10)..(10): Xaa can be Met, Leu, Ile, Phe, or Val
VXELVQFLLX

SEQ ID NO: 113720 - protein, 8 aa, Artificial Sequence
  Description of Artificial Sequence: Synthetic peptide
  Seed: VDKLVQFL (MAGC3_HUMAN)
  misc_feature (2)..(2): Xaa can be Glu, Gln, Asp, Met, His, Asn, Ala, Ser, Gly, Arg, or Leu
  misc_feature (8)..(8): Xaa can be Ile, Leu, Val, Phe, Met, Ala, Thr, Tyr, Cys, or Pro
VXKLVQFX

SEQ ID NO: 113721 - protein, 9 aa, Artificial Sequence
  Description of Artificial Sequence: Synthetic peptide
  Seed: VDKLVQFLL (MAGC3_HUMAN)
  misc_feature (2)..(2): Xaa can be Glu, Asp, or Gln
  misc_feature (9)..(9): Xaa can be Leu, Val, Ile, Phe, Ala, Met, Trp, Cys, Tyr, Gly, Thr, Ser, or Pro
VXKLVQFLX

SEQ ID NO: 113722 - protein, 9 aa, Artificial Sequence
  Description of Artificial Sequence: Synthetic peptide
  Seed: VDPDHFYVF (MAGC3_HUMAN)
  misc_feature (2)..(2): Xaa can be Ala, Arg, Tyr, Thr, Gln, Val, Ser, Glu, Asn, Gly, Leu, Met, Ile, Phe, His, Asp, Cys, Trp, Pro, or Lys
  misc_feature (9)..(9): Xaa can be Phe, Val, Met, Leu, Ile, Tyr, Trp, Cys, Ala, Lys, His, Arg, Thr, Ser, Pro, Gln, or Gly
VXPDHFYVX

SEQ ID NO: 113723 - protein, 8 aa, Artificial Sequence
  Description of Artificial Sequence: Synthetic peptide
  Seed: VFVNTLDL (MAGC3_HUMAN)
  misc_feature (2)..(2): Xaa can be Tyr, or Phe
  misc_feature (8)..(8): Xaa can be Tyr, Phe, Met, Leu, or Ile
VXVNTLDX

SEQ ID NO: 113724 - protein, 9 aa, Artificial Sequence
  Description of Artificial Sequence: Synthetic peptide
  Seed: VIKKYKDYF (MAGC3_HUMAN)
  misc_feature (2)..(2): Xaa can be Ala, Thr, Ser, Gln, Val, Met, Ile, Leu, Glu, Cys, Gly, Pro, Asn, Phe, Tyr, Trp, Asp, His, or Lys
  misc_feature (9)..(9): Xaa can be Tyr, Phe, Trp, Met, Leu, Ile, His, or Val
VXKKYKDYX

SEQ ID NO: 113725 - protein, 11 aa, Artificial Sequence
  Description of Artificial Sequence: Synthetic peptide
  Seed: VIKKYKDYFPM (MAGC3_HUMAN)
  misc_feature (2)..(2): Xaa can be Gln, Thr, Ile, Leu, Asp, Gly, Val, Asn, Cys, Ser, Arg, Trp, Phe, Pro, Met, Glu, Ala, Tyr, Lys, or His
  misc_feature (11)..(11): Xaa can be Phe, Tyr, Met, or Leu
VXKKYKDYFPX

SEQ ID NO: 113726 - protein, 9 aa, Artificial Sequence
  Description of Artificial Sequence: Synthetic peptide
  Seed: VINTYTGYF (MAGC3_HUMAN)
  misc_feature (2)..(2): Xaa can be Tyr, Ala, Gln, Ile, Ser, Thr, Phe, Met, Val, Gly, Trp, Leu, Lys, Asn, Cys, Pro, Glu, Arg, His, or Asp
  misc_feature (9)..(9): Xaa can be Tyr, Phe, Met, Leu, Trp, Ile, Val, His, Ala, Cys, or Lys
VXNTYTGYX

SEQ ID NO: 113727 - protein, 11 aa, Artificial Sequence
  Description of Artificial Sequence: Synthetic peptide
  Seed: VINTYTGYFPM (MAGC3_HUMAN)
  misc_feature (2)..(2): Xaa can be Ser, Thr, Asp, Glu, Phe, Val, Gly, Gln, Trp, Cys, Pro, His, Arg, Tyr, Lys, Ile, Leu, Asn, Met, or Ala
  misc_feature (11)..(11): Xaa can be Trp, Met, Tyr, Phe, or Leu
VXNTYTGYFPX

SEQ ID NO: 113728 - protein, 9 aa, Artificial Sequence
  Description of Artificial Sequence: Synthetic peptide
  Seed: VIWEVLNAI (MAGC3_HUMAN)
  misc_feature (2)..(2): Xaa can be Leu, Met, Ala, Gln, Ile, Val, Pro, Thr, Ser, Arg, Asn, Glu, Gly, Phe, Cys, Tyr, Asp, Trp, His, or Lys
  misc_feature (9)..(9): Xaa can be Met, Phe, Trp, Leu, Val, Ile, Tyr, Arg, Lys, Ala, His, Cys, Thr, Pro, Ser, Gly, Gln, or Gl u
VXWEVLNAX

SEQ ID NO: 113729 - protein, 9 aa, Artificial Sequence
  Description of Artificial Sequence: Synthetic peptide
  Seed: VIWEVLSAI (MAGC3_HUMAN)
  misc_feature (2)..(2): Xaa can be Met, Leu, Ala, Gln, Ile, Val, Thr, Ser, Gly, Asn, Phe, Glu, Cys, Asp, Tyr, Pro, Trp, His, Arg, or Lys
  misc_feature (9)..(9): Xaa can be Ile, Met, Tyr, Phe, Val, Leu, Arg, Trp, Lys, Ala, His, Thr, Cys, Ser, Pro, Gln, Glu, or Gl y
VXWEVLSAX

SEQ ID NO: 113730 - protein, 8 aa, Artificial Sequence
  Description of Artificial Sequence: Synthetic peptide
  Seed: VKNTCATY (MAGC3_HUMAN)
  misc_feature (2)..(2): Xaa can be Gln, Met, Lys, Leu, His, Arg, Ala, Ser, or Glu
  misc_feature (8)..(8): Xaa can be Phe, Tyr, Met, or Leu
VXNTCATX

SEQ ID NO: 113731 - protein, 10 aa, Artificial Sequence
  Description of Artificial Sequence: Synthetic peptide
  Seed: VKNTCATYAL (MAGC3_HUMAN)
  misc_feature (2)..(2): Xaa can be Gln, Lys, Met, His, Ala, Arg, Leu, Glu, Ser, Val, Thr, Ile, Tyr, Phe, or Asn
  misc_feature (10)..(10): Xaa can be Phe, Tyr, Met, Leu, Trp, Ile, His, or Val
VXNTCATYAX

SEQ ID NO: 113732 - protein, 8 aa, Artificial Sequence
  Description of Artificial Sequence: Synthetic peptide
  Seed: VLCPTYFK (MAGC3_HUMAN)
  misc_feature (2)..(2): Xaa can be Met, Leu, Trp, Gln, Phe, Tyr, Val, Ile, Thr, Ser, Asn, Arg, Cys, Ala, His, Lys, or Gly
  misc_feature (8)..(8): Xaa can be Arg, or Lys
VXCPTYFX

SEQ ID NO: 113733 - protein, 9 aa, Artificial Sequence
  Description of Artificial Sequence: Synthetic peptide
  Seed: VLCPTYFKL (MAGC3_HUMAN)
  misc_feature (2)..(2): Xaa can be Tyr, Ser, Met, Leu, Gln, Ala, Thr, Val, Ile, Trp, Phe, Glu, Asn, Gly, Cys, Arg, His, Asp, Pro, or Lys
  misc_feature (9)..(9): Xaa can be Tyr, Phe, Trp, Leu, Val, Ile, Met, Arg, Lys, Ala, His, Cys, Thr, or Gly
VXCPTYFKX

SEQ ID NO: 113734 - protein, 10 aa, Artificial Sequence
  Description of Artificial Sequence: Synthetic peptide
  Seed: VLCPTYFKLW (MAGC3_HUMAN)
  misc_feature (2)..(2): Xaa can be Thr, Tyr, Ser, Ala, Trp, Phe, Val, Met, Gly, Cys, Leu, Gln, Ile, Pro, Asn, His, Glu, Arg, Asp, or Lys
  misc_feature (10)..(10): Xaa can be Trp, Phe, Tyr, Leu, Ile, Met, Val, or Cys
VXCPTYFKLX

SEQ ID NO: 113735 - protein, 11 aa, Artificial Sequence
  Description of Artificial Sequence: Synthetic peptide
  Seed: VLCPTYFKLWR (MAGC3_HUMAN)
  misc_feature (2)..(2): Xaa can be Tyr, Ser, Met, Ile, Leu, Trp, Thr, Val, Gln, Phe, Asn, Ala, or Gly
  misc_feature (11)..(11): Xaa can be Arg, or Lys
VXCPTYFKLWX

SEQ ID NO: 113736 - protein, 11 aa, Artificial Sequence
  Description of Artificial Sequence: Synthetic peptide
  Seed: VLDATFSDGSL (MAGC3_HUMAN)
  misc_feature (2)..(2): Xaa can be Ala, Trp, Tyr, Phe, Thr, Val, Gly, Ser, Ile, Leu, Met, Cys, Pro, Asn, Gln, or His
  misc_feature (11)..(11): Xaa can be Leu, Phe, Met, Ile, Val, Trp, Tyr, Cys, or Ala
VXDATFSDGSX

SEQ ID NO: 113737 - protein, 10 aa, Artificial Sequence
  Description of Artificial Sequence: Synthetic peptide
  Seed: VLDLANPQGL (MAGC3_HUMAN)
  misc_feature (2)..(2): Xaa can be Ala, Ser, Thr, Tyr, Phe, Met, Leu, Ile, Trp, Val, Gln, Gly, Cys, Pro, Asn, Arg, His, Glu, or Asp
  misc_feature (10)..(10): Xaa can be Leu, Phe, Met, Ile, Val, Tyr, Trp, Cys, Ala, or Thr
VXDLANPQGX

SEQ ID NO: 113738 - protein, 11 aa, Artificial Sequence
  Description of Artificial Sequence: Synthetic peptide
  Seed: VLEFLSKLSSI (MAGC3_HUMAN)
  misc_feature (2)..(2): Xaa can be Leu, Met, or Ile
  misc_feature (11)..(11): Xaa can be Val, Leu, Ala, or Ile
VXEFLSKLSSX

SEQ ID NO: 113739 - protein, 10 aa, Artificial Sequence
  Description of Artificial Sequence: Synthetic peptide
  Seed: VLNAIGPWSA (MAGC3_HUMAN)
  misc_feature (2)..(2): Xaa can be Met, Leu, Val, Ile, Gln, Thr, Ser, or Ala
  misc_feature (10)..(10): Xaa can be Val, Ile, Leu, Met, Ala, Thr, or Cys
VXNAIGPWSX

SEQ ID NO: 113740 - protein, 11 aa, Artificial Sequence
  Description of Artificial Sequence: Synthetic peptide
  Seed: VLNAIGPWSAL (MAGC3_HUMAN)
  misc_feature (2)..(2): Xaa can be Ala, Leu, Ser, Val, Met, Pro, Thr, Ile, Gly, Glu, Gln, Lys, Tyr, Asn, Asp, Trp, Cys, Arg, His, or Phe
  misc_feature (11)..(11): Xaa can be Leu, Met, Val, Ile, Phe, Ala, Tyr, or Cys
VXNAIGPWSAX

SEQ ID NO: 113741 - protein, 9 aa, Artificial Sequence
  Description of Artificial Sequence: Synthetic peptide
  Seed: VLPPQPQPR (MAGC3_HUMAN)
  misc_feature (2)..(2): Xaa can be Ala, Leu, Ser, Ile, Val, Thr, Met, Cys, Gly, Gln, Asn, Phe, Pro, Tyr, Glu, Asp, Trp, His, Arg, or Lys
  misc_feature (9)..(9): Xaa can be Ile, Tyr, Met, Leu, Phe, Val, Arg, Lys, His, Ala, Cys, Trp, Thr, Pro, Ser, Gln, Gly, Asn, or Glu
VXPPQPQPX

SEQ ID NO: 113742 - protein, 10 aa, Artificial Sequence
  Description of Artificial Sequence: Synthetic peptide
  Seed: VLPPQPQPRK (MAGC3_HUMAN)
  misc_feature (2)..(2): Xaa can be Met, Leu, Ile, Val, Thr, Gln, Ser, Ala, Phe, Pro, Gly, or Asn
  misc_feature (10)..(10): Xaa can be Lys, Arg, Tyr, Leu, Met, Phe, or Val
VXPPQPQPRX

SEQ ID NO: 113743 - protein, 11 aa, Artificial Sequence
  Description of Artificial Sequence: Synthetic peptide
  Seed: VLPPQPQPRKK (MAGC3_HUMAN)
  misc_feature (2)..(2): Xaa can be Leu, Ile, Met, Val, Thr, Gln, Ser, or Ala
  misc_feature (11)..(11): Xaa can be Lys, Arg, Leu, Tyr, Met, or Phe
VXPPQPQPRKX

SEQ ID NO: 113744 - protein, 10 aa, Artificial Sequence
  Description of Artificial Sequence: Synthetic peptide
  Seed: VLSAIGPIQR (MAGC3_HUMAN)
  misc_feature (2)..(2): Xaa can be Ser, Thr, Ala, Val, Gly, Met, Leu, Ile, Cys, Phe, Trp, Asp, Tyr, Glu, Gln, Pro, Asn, His, or Arg
  misc_feature (10)..(10): Xaa can be Arg, Lys, Tyr, Leu, Phe, Met, Val, Trp, Ile, or His
VXSAIGPIQX

SEQ ID NO: 113745 - protein, 8 aa, Artificial Sequence
  Description of Artificial Sequence: Synthetic peptide
  Seed: VLSRLALW (MAGC3_HUMAN)
  misc_feature (2)..(2): Xaa can be Thr, Ser, Ala, Gly, Leu, Asn, Val, Ile, Asp, Pro, Trp, Cys, Phe, Met, or Gln
  misc_feature (8)..(8): Xaa can be Trp, Phe, or Leu
VXSRLALX

SEQ ID NO: 113746 - protein, 9 aa, Artificial Sequence
  Description of Artificial Sequence: Synthetic peptide
  Seed: VPEEVIWEV (MAGC3_HUMAN)
  misc_feature (2)..(2): Xaa can be Pro, Ala, Ser, Ile, Thr, Leu, Met, Tyr, Phe, Val, Gly, Cys, Gln, Trp, Asn, Glu, Asp, or Hi s
  misc_feature (9)..(9): Xaa can be Leu, Met, Val, Ile, Phe, Trp, Tyr, Cys, Ala, Thr, Ser, His, or Pro
VXEEVIWEX

SEQ ID NO: 113747 - protein, 10 aa, Artificial Sequence
  Description of Artificial Sequence: Synthetic peptide
  Seed: VPEEVIWEVL (MAGC3_HUMAN)
  misc_feature (2)..(2): Xaa can be Pro, Glu, Ala, Cys, Ser, Arg, His, Thr, Lys, Trp, Ile, Val, Phe, Gln, Gly, Leu, Tyr, Asp, Met, or Asn
  misc_feature (10)..(10): Xaa can be Met, Leu, Val, Phe, Trp, Ile, Ala, or Tyr
VXEEVIWEVX

SEQ ID NO: 113748 - protein, 8 aa, Artificial Sequence
  Description of Artificial Sequence: Synthetic peptide
  Seed: VQFLLLKY (MAGC3_HUMAN)
  misc_feature (2)..(2): Xaa can be Gln, Lys, Met, Pro, Ser, Glu, Ala, Asn, Tyr, Val, Trp, Leu, Thr, Arg, Ile, Asp, Gly, Phe, or His
  misc_feature (8)..(8): Xaa can be Tyr, Phe, Met, or Leu
VXFLLLKX

SEQ ID NO: 113749 - protein, 10 aa, Artificial Sequence
  Description of Artificial Sequence: Synthetic peptide
  Seed: VQFLLLKYQA (MAGC3_HUMAN)
  misc_feature (2)..(2): Xaa can be Gln, Thr, Val, Ile, Leu, Met, or Ser
  misc_feature (10)..(10): Xaa can be Val, Ile, Leu, or Ala
VXFLLLKYQX

SEQ ID NO: 113750 - protein, 8 aa, Artificial Sequence
  Description of Artificial Sequence: Synthetic peptide
  Seed: VSPGKRLW (MAGC3_HUMAN)
  misc_feature (2)..(2): Xaa can be Ser, Thr, Leu, Asn, Asp, Gly, Cys, Ala, Gln, Ile, Met, or Val
  misc_feature (8)..(8): Xaa can be Trp, or Phe
VXPGKRLX

SEQ ID NO: 113751 - protein, 9 aa, Artificial Sequence
  Description of Artificial Sequence: Synthetic peptide
  Seed: VTKAEMLTT (MAGC3_HUMAN)
  misc_feature (2)..(2): Xaa can be Thr, Ser, Val, Tyr, Ala, Met, Ile, Gln, Leu, Gly, Phe, Asn, or Trp
  misc_feature (9)..(9): Xaa can be Lys, Ala, Ile, Val, Leu, Ser, Met, Thr, or Gly
VXKAEMLTX

SEQ ID NO: 113752 - protein, 10 aa, Artificial Sequence
  Description of Artificial Sequence: Synthetic peptide
  Seed: VTKAEMLTTV (MAGC3_HUMAN)
  misc_feature (2)..(2): Xaa can be Met, Leu, Val, Ile, Gln, Thr, Ser, Ala, Gly, Tyr, or Phe
  misc_feature (10)..(10): Xaa can be Lys, Val, Ala, Leu, Ile, Met, Cys, Ser, or Thr
VXKAEMLTTX

SEQ ID NO: 113753 - protein, 10 aa, Artificial Sequence
  Description of Artificial Sequence: Synthetic peptide
  Seed: VVLPPQPQPR (MAGC3_HUMAN)
  misc_feature (2)..(2): Xaa can be Ala, Thr, Val, Ser, Ile, Met, Gly, Leu, Gln, Asn, Cys, Pro, Phe, Glu, Tyr, Asp, Trp, Lys, or His
  misc_feature (10)..(10): Xaa can be Arg, Tyr, Lys, Phe, Met, Leu, His, Val, Ile, Ala, Trp, Ser, Cys, Gln, or Thr
VXLPPQPQPX

SEQ ID NO: 113754 - protein, 11 aa, Artificial Sequence
  Description of Artificial Sequence: Synthetic peptide
  Seed: VVLPPQPQPRK (MAGC3_HUMAN)
  misc_feature (2)..(2): Xaa can be Leu, Met, Ile, Thr, Val, Trp, Tyr, Ser, Asn, Gln, Phe, Gly, Ala, or Asp
  misc_feature (11)..(11): Xaa can be Lys, Arg, Tyr, Leu, or Met
VXLPPQPQPRX

SEQ ID NO: 113755 - protein, 8 aa, Artificial Sequence
  Description of Artificial Sequence: Synthetic peptide
  Seed: WESEGPEA (MAGC3_HUMAN)
  misc_feature (2)..(2): Xaa can be Glu, or Asp
  misc_feature (8)..(8): Xaa can be Ile, Leu, Val, Met, Pro, Thr, Ser, Ala, Phe, or Cys
WXSEGPEX

SEQ ID NO: 113756 - protein, 9 aa, Artificial Sequence
  Description of Artificial Sequence: Synthetic peptide
  Seed: WESEGPEAF (MAGC3_HUMAN)
  misc_feature (2)..(2): Xaa can be Glu, Ala, Gln, His, Ser, Asp, Val, Ile, Leu, Thr, Met, Asn, Arg, Gly, Lys, Pro, Tyr, Phe, Cys, or Trp
  misc_feature (9)..(9): Xaa can be Tyr, Phe, Met, Leu, Ile, Trp, Val, His, Lys, Ala, Arg, Cys, Thr, Pro, Glu, Asp, Gly, Ser, Gln, or Asn
WXSEGPEAX

SEQ ID NO: 113757 - protein, 10 aa, Artificial Sequence
  Description of Artificial Sequence: Synthetic peptide
  Seed: WESEGPEAFC (MAGC3_HUMAN)
  misc_feature (2)..(2): Xaa can be , or Glu
  misc_feature (10)..(10): Xaa can be Ile, Phe, Ala, Cys, Tyr, Pro, Trp, Ser, Val, Thr, Gly, Leu, or Met
WXSEGPEAFX

SEQ ID NO: 113758 - protein, 9 aa, Artificial Sequence
  Description of Artificial Sequence: Synthetic peptide
  Seed: WEVLNAIGP (MAGC3_HUMAN)
  misc_feature (2)..(2): Xaa can be Glu, Asp, or Gln
  misc_feature (9)..(9): Xaa can be Leu, Val, Ile, Met, Ala, Thr, Pro, Phe, Ser, Cys, Gly, or Tyr
WXVLNAIGX

SEQ ID NO: 113759 - protein, 10 aa, Artificial Sequence
  Description of Artificial Sequence: Synthetic peptide
  Seed: WEVLNAIGPW (MAGC3_HUMAN)
  misc_feature (2)..(2): Xaa can be Ser, Glu, Thr, Ala, Asp, Leu, Gln, Gly, Cys, Met, Phe, Pro, His, Tyr, Lys, Ile, Asn, Val, Trp, or Arg
  misc_feature (10)..(10): Xaa can be Trp, Tyr, Phe, or Met
WXVLNAIGPX

SEQ ID NO: 113760 - protein, 9 aa, Artificial Sequence
  Description of Artificial Sequence: Synthetic peptide
  Seed: WEVLSAIGP (MAGC3_HUMAN)
  misc_feature (2)..(2): Xaa can be Glu, or Asp
  misc_feature (9)..(9): Xaa can be Val, Ile, Ala, Leu, Phe, Gly, Pro, Ser, Met, Thr, or Cys
WXVLSAIGX

SEQ ID NO: 113761 - protein, 10 aa, Artificial Sequence
  Description of Artificial Sequence: Synthetic peptide
  Seed: WEVLSAIGPI (MAGC3_HUMAN)
  misc_feature (2)..(2): Xaa can be Glu, Leu, Met, Thr, Gln, Gly, Ser, Trp, Tyr, Val, Asn, Ala, Lys, Arg, Asp, Ile, Pro, His, Cys, or Phe
  misc_feature (10)..(10): Xaa can be Ala, Ile, Val, Leu, Met, Thr, Cys, Pro, or Phe
WXVLSAIGPX

SEQ ID NO: 113762 - protein, 9 aa, Artificial Sequence
  Description of Artificial Sequence: Synthetic peptide
  Seed: WHALPESES (MAGC3_HUMAN)
  misc_feature (2)..(2): Xaa can be His, Arg, or Gln
  misc_feature (9)..(9): Xaa can be Leu, Ile, Ala, Val, Cys, Pro, Phe, Met, Ser, or Thr
WXALPESEX

SEQ ID NO: 113763 - protein, 10 aa, Artificial Sequence
  Description of Artificial Sequence: Synthetic peptide
  Seed: WHALPESESL (MAGC3_HUMAN)
  misc_feature (2)..(2): Xaa can be His, Arg, or Gln
  misc_feature (10)..(10): Xaa can be Phe, Leu, Val, Ala, Met, Thr, Tyr, Cys, Trp, or Ile
WXALPESESX

SEQ ID NO: 113764 - protein, 9 aa, Artificial Sequence
  Description of Artificial Sequence: Synthetic peptide
  Seed: WKDSDLPTW (MAGC3_HUMAN)
  misc_feature (2)..(2): Xaa can be Phe, Trp, Tyr, Ser, Thr, Ala, Cys, Asn, Val, Leu, Gly, Glu, Ile, Arg, Asp, Met, Lys, Pro, or Gln
  misc_feature (9)..(9): Xaa can be Trp, Phe, Leu, Ile, Met, or Val
WXDSDLPTX

SEQ ID NO: 113765 - protein, 9 aa, Artificial Sequence
  Description of Artificial Sequence: Synthetic peptide
  Seed: WPLNEKRTL (MAGC3_HUMAN)
  misc_feature (2)..(2): Xaa can be Pro, Ala, Arg, His, Val, Met, Gln, Leu, Ser, Gly, Thr, Lys, Glu, or Ile
  misc_feature (9)..(9): Xaa can be Leu, Met, Trp, Ile, Tyr, Val, Phe, Ala, Thr, Cys, Ser, or Pro
WXLNEKRTX

SEQ ID NO: 113766 - protein, 10 aa, Artificial Sequence
  Description of Artificial Sequence: Synthetic peptide
  Seed: WPLNEKRTLW (MAGC3_HUMAN)
  misc_feature (2)..(2): Xaa can be Thr, Pro, Ser, Ala, Gln, Val, Ile, Gly, Asp, Phe, Glu, Met, Trp, Leu, Asn, or Cys
  misc_feature (10)..(10): Xaa can be Trp, Phe, or Tyr
WXLNEKRTLX

SEQ ID NO: 113767 - protein, 9 aa, Artificial Sequence
  Description of Artificial Sequence: Synthetic peptide
  Seed: WRRGTGYTL (MAGC3_HUMAN)
  misc_feature (2)..(2): Xaa can be Gln, Arg, His, Tyr, Met, Phe, Lys, Glu, Ala, Trp, Leu, Pro, Ser, Ile, Val, Thr, Gly, Asn, Cys, or Asp
  misc_feature (9)..(9): Xaa can be Tyr, Phe, Met, Leu, Trp, Ile, Val, His, Ala, Cys, Thr, Gly, Lys, Pro, Ser, or Arg
WXRGTGYTX

SEQ ID NO: 113768 - protein, 11 aa, Artificial Sequence
  Description of Artificial Sequence: Synthetic peptide
  Seed: WRRGTGYTLSL (MAGC3_HUMAN)
  misc_feature (2)..(2): Xaa can be Arg, His, Tyr, or Gln
  misc_feature (11)..(11): Xaa can be Phe, Tyr, Met, Val, Ile, Leu, Cys, His, Arg, Trp, or Lys
WXRGTGYTLSX

SEQ ID NO: 113769 - protein, 10 aa, Artificial Sequence
  Description of Artificial Sequence: Synthetic peptide
  Seed: WRTLSGSPGL (MAGC3_HUMAN)
  misc_feature (2)..(2): Xaa can be Arg, His, Met, Gln, Leu, Glu, Val, Asp, Gly, Tyr, Ala, Thr, Trp, Ile, Asn, Cys, Pro, Lys, Phe, or Ser
  misc_feature (10)..(10): Xaa can be Val, Leu, Ile, Met, Phe, Arg, Lys, Tyr, or Trp
WXTLSGSPGX

SEQ ID NO: 113770 - protein, 10 aa, Artificial Sequence
  Description of Artificial Sequence: Synthetic peptide
  Seed: WSALAGFADV (MAGC3_HUMAN)
  misc_feature (2)..(2): Xaa can be Thr, Gln, Val, Leu, Met, Ile, Ser, Ala, Phe, Trp, Gly, or Tyr
  misc_feature (10)..(10): Xaa can be Val, Leu, Ile, Met, or Ala
WXALAGFADX

SEQ ID NO: 113771 - protein, 11 aa, Artificial Sequence
  Description of Artificial Sequence: Synthetic peptide
  Seed: WSALAGFADVL (MAGC3_HUMAN)
  misc_feature (2)..(2): Xaa can be Met, Leu, Gln, Phe, Thr, Arg, His, Ala, Ile, Asn, Ser, Glu, Tyr, Lys, Pro, Gly, Cys, Val, Asp, or Trp
  misc_feature (11)..(11): Xaa can be Val, Leu, Ile, Met, or Ala
WXALAGFADVX

SEQ ID NO: 113772 - protein, 9 aa, Artificial Sequence
  Description of Artificial Sequence: Synthetic peptide
  Seed: WVKNTCATY (MAGC3_HUMAN)
  misc_feature (2)..(2): Xaa can be Gln, Met, Ala, Ser, Tyr, Leu, Lys, Thr, Pro, Ile, Phe, Val, Gly, His, Trp, Asn, Glu, Arg, Asp, or Cys
  misc_feature (9)..(9): Xaa can be Phe, Tyr, Met, Leu, Trp, His, Arg, Ile, Lys, Val, Ala, Gly, Ser, or Thr
WXKNTCATX

SEQ ID NO: 113773 - protein, 10 aa, Artificial Sequence
  Description of Artificial Sequence: Synthetic peptide
  Seed: WVKNTCATYA (MAGC3_HUMAN)
  misc_feature (2)..(2): Xaa can be Met, Val, Leu, Gln, Ile, Thr, Ala, Ser, Gly, or Glu
  misc_feature (10)..(10): Xaa can be Tyr, Met, Phe, Val, Gly, Ile, His, Trp, Ala, Leu, Cys, Asp, Ser, Glu, Gln, Pro, Thr, Asn, Arg, or Lys
WXKNTCATYX

SEQ ID NO: 113774 - protein, 9 aa, Artificial Sequence
  Description of Artificial Sequence: Synthetic peptide
  Seed: WYMDALKDM (MAGC3_HUMAN)
  misc_feature (2)..(2): Xaa can be Tyr, Phe, Arg, Trp, Ala, Met, Gln, His, Leu, or Val
  misc_feature (9)..(9): Xaa can be Met, Tyr, Phe, Leu, Ile, Trp, Val, His, or Ala
WXMDALKDX

SEQ ID NO: 113775 - protein, 9 aa, Artificial Sequence
  Description of Artificial Sequence: Synthetic peptide
  Seed: YALDEKVAE (MAGC3_HUMAN)
  misc_feature (2)..(2): Xaa can be Ala, Ser, Val, Thr, Gly, Ile, Gln, Met, Leu, Glu, Asn, Asp, Cys, Phe, Pro, Tyr, Lys, Trp, or Arg
  misc_feature (9)..(9): Xaa can be Tyr, Phe, Met, Leu, His, Lys, Ile, Trp, Val, Arg, Ala, Cys, Gln, Thr, Ser, Asn, Pro, Gly, or Glu
YXLDEKVAX

SEQ ID NO: 113776 - protein, 10 aa, Artificial Sequence
  Description of Artificial Sequence: Synthetic peptide
  Seed: YALDEKVAEL (MAGC3_HUMAN)
  misc_feature (2)..(2): Xaa can be Leu, Met, Pro, Ala, Tyr, Arg, Gly, Trp, Gln, Glu, Phe, Ile, Val, Thr, Asn, Ser, Asp, Cys, His, or Lys
  misc_feature (10)..(10): Xaa can be Phe, Thr, Trp, Cys, Met, Tyr, Ser, Leu, Ala, Ile, Val, Lys, Arg, His, Gln, Pro, Gly, Glu, or Asn
YXLDEKVAEX

SEQ ID NO: 113777 - protein, 11 aa, Artificial Sequence
  Description of Artificial Sequence: Synthetic peptide
  Seed: YALDEKVAELV (MAGC3_HUMAN)
  misc_feature (2)..(2): Xaa can be Val, Glu, Gly, Ala, Gln, Tyr, Pro, Cys, Trp, Ser, Phe, Arg, Leu, Thr, Met, Lys, Ile, Asp, His, or Asn
  misc_feature (11)..(11): Xaa can be Cys, Leu, Glu, Thr, Met, Lys, Val, Ala, Trp, Ser, Asp, Gln, Asn, Pro, Phe, Tyr, Ile, His, Gly, or Arg
YXLDEKVAELX

SEQ ID NO: 113778 - protein, 8 aa, Artificial Sequence
  Description of Artificial Sequence: Synthetic peptide
  Seed: YALSPVVL (MAGC3_HUMAN)
  misc_feature (2)..(2): Xaa can be Ala, Arg, Ser, Gly, Val, Tyr, Thr, Phe, Ile, Pro, Asn, Leu, Gln, Met, Trp, Asp, His, Lys, Glu, or Cys
  misc_feature (8)..(8): Xaa can be Leu, Tyr, Phe, Met, Ile, Val, Lys, His, Arg, Trp, Ala, or Cys
YXLSPVVX

SEQ ID NO: 113779 - protein, 9 aa, Artificial Sequence
  Description of Artificial Sequence: Synthetic peptide
  Seed: YALSPVVLP (MAGC3_HUMAN)
  misc_feature (2)..(2): Xaa can be Ala, Thr, Val, Ser, Ile, Gly, Gln, Leu, Pro, Cys, Asn, Met, Asp, Glu, Tyr, Phe, Trp, Lys, or Arg
  misc_feature (9)..(9): Xaa can be Tyr, Phe, Leu, Met, Lys, His, Val, Arg, Ile, Ala, Trp, Cys, Ser, Thr, Gln, Asn, or Pro
YXLSPVVLX

SEQ ID NO: 113780 - protein, 10 aa, Artificial Sequence
  Description of Artificial Sequence: Synthetic peptide
  Seed: YALSPVVLPP (MAGC3_HUMAN)
  misc_feature (2)..(2): Xaa can be Glu, Thr, Ser, Asp, Asn, Phe, Gly, Val, His, Tyr, Lys, Met, Arg, Ala, Leu, Trp, Gln, Cys, Pro, or Ile
  misc_feature (10)..(10): Xaa can be Ser, Met, Ala, Leu, Phe, Gly, Thr, Ile, Cys, Pro, or Val
YXLSPVVLPX

SEQ ID NO: 113781 - protein, 11 aa, Artificial Sequence
  Description of Artificial Sequence: Synthetic peptide
  Seed: YEGSLIDDQGM (MAGC3_HUMAN)
  misc_feature (2)..(2): Xaa can be , or Glu
  misc_feature (11)..(11): Xaa can be Ala, Val, Leu, Phe, Thr, Ile, Cys, or Met
YXGSLIDDQGX

SEQ ID NO: 113782 - protein, 9 aa, Artificial Sequence
  Description of Artificial Sequence: Synthetic peptide
  Seed: YFFEDTLDL (MAGC3_HUMAN)
  misc_feature (2)..(2): Xaa can be Pro, Met, Ala, Leu, Gln, Tyr, Ile, Arg, Ser, Val, Thr, Phe, Gly, Glu, Cys, Asn, Trp, Lys, His, or Asp
  misc_feature (9)..(9): Xaa can be Leu, Phe, Tyr, Met, Lys, Ile, Val, His, Arg, Trp, Ala, Cys, Thr, Ser, Gln, Pro, Gly, Asn, Glu, or Asp
YXFEDTLDX

SEQ ID NO: 113783 - protein, 11 aa, Artificial Sequence
  Description of Artificial Sequence: Synthetic peptide
  Seed: YFFEDTLDLTY (MAGC3_HUMAN)
  misc_feature (2)..(2): Xaa can be Arg, Pro, Gln, Ser, Ala, Thr, Tyr, Met, Val, Phe, Ile, Trp, Cys, Leu, Gly, His, Glu, Lys, Asp, or Asn
  misc_feature (11)..(11): Xaa can be Phe, Tyr, Lys, Met, Leu, Trp, Arg, His, Ile, Val, Ala, Gln, Cys, Ser, or Thr
YXFEDTLDLTX

SEQ ID NO: 113784 - protein, 8 aa, Artificial Sequence
  Description of Artificial Sequence: Synthetic peptide
  Seed: YFKLWRTL (MAGC3_HUMAN)
  misc_feature (2)..(2): Xaa can be Met, Phe, Tyr, Trp, Arg, Leu, Pro, Ile, His, Gln, Val, Ala, Ser, Asn, Gly, or Thr
  misc_feature (8)..(8): Xaa can be Phe, Leu, Met, Ile, Tyr, Val, Trp, or Ala
YXKLWRTX

SEQ ID NO: 113785 - protein, 10 aa, Artificial Sequence
  Description of Artificial Sequence: Synthetic peptide
  Seed: YFPMIFGKAH (MAGC3_HUMAN)
  misc_feature (2)..(2): Xaa can be Tyr, Phe, Trp, His, Met, Ala, Arg, Ser, Thr, Val, Gln, Gly, Leu, or Ile
  misc_feature (10)..(10): Xaa can be Met, Tyr, Phe, Leu, Ile, Val, His, Trp, or Ala
YXPMIFGKAX

SEQ ID NO: 113786 - protein, 9 aa, Artificial Sequence
  Description of Artificial Sequence: Synthetic peptide
  Seed: YFPMIFRKA (MAGC3_HUMAN)
  misc_feature (2)..(2): Xaa can be Tyr, Phe, Trp, Met, Leu, Ile, His, Arg, Ala, Ser, Val, Thr, Gln, Gly, or Pro
  misc_feature (9)..(9): Xaa can be Met, Tyr, Phe, Leu, Val, Ile, His, Trp, Ala, or Thr
YXPMIFRKX

SEQ ID NO: 113787 - protein, 10 aa, Artificial Sequence
  Description of Artificial Sequence: Synthetic peptide
  Seed: YFPMIFRKAR (MAGC3_HUMAN)
  misc_feature (2)..(2): Xaa can be Tyr, Trp, Phe, Leu, Thr, Ile, Met, Ser, Gln, Val, Cys, Asn, Ala, His, Gly, or Pro
  misc_feature (10)..(10): Xaa can be Arg, or Lys
YXPMIFRKAX

SEQ ID NO: 113788 - protein, 9 aa, Artificial Sequence
  Description of Artificial Sequence: Synthetic peptide
  Seed: YKDYFPMIF (MAGC3_HUMAN)
  misc_feature (2)..(2): Xaa can be Tyr, Ala, Arg, Ser, Thr, Phe, His, Gln, Trp, Val, Gly, Ile, Met, Leu, Asn, Cys, Lys, Asp, Pro, or Glu
  misc_feature (9)..(9): Xaa can be Tyr, Ile, Leu, Phe, Val, Met, Trp, Cys, Lys, Ala, Arg, His, Thr, Ser, or Gln
YXDYFPMIX

SEQ ID NO: 113789 - protein, 11 aa, Artificial Sequence
  Description of Artificial Sequence: Synthetic peptide
  Seed: YKDYFPMIFGK (MAGC3_HUMAN)
  misc_feature (2)..(2): Xaa can be Ser, Ile, Val, Arg, His, Gly, Pro, Thr, Ala, Trp, Cys, Gln, Phe, Leu, Asp, Met, Glu, Tyr, Asn, or Lys
  misc_feature (11)..(11): Xaa can be Arg, or Lys
YXDYFPMIFGX

SEQ ID NO: 113790 - protein, 8 aa, Artificial Sequence
  Description of Artificial Sequence: Synthetic peptide
  Seed: YMDALKDM (MAGC3_HUMAN)
  misc_feature (2)..(2): Xaa can be Phe, Ala, Tyr, Ile, Gly, Ser, Thr, Trp, Val, Gln, Arg, Met, Cys, Leu, Asn, His, Asp, Pro, Glu, or Lys
  misc_feature (8)..(8): Xaa can be Leu, Met, Phe, Ile, Val, Tyr, Trp, or Cys
YXDALKDX

SEQ ID NO: 113791 - protein, 11 aa, Artificial Sequence
  Description of Artificial Sequence: Synthetic peptide
  Seed: YMDALKDMEDR (MAGC3_HUMAN)
  misc_feature (2)..(2): Xaa can be Thr, Ser, Val, Met, Ile, Leu, Gly, Gln, Ala, Asn, Phe, or Cys
  misc_feature (11)..(11): Xaa can be Tyr, Lys, Arg, His, Phe, or Trp
YXDALKDMEDX

SEQ ID NO: 113792 - protein, 9 aa, Artificial Sequence
  Description of Artificial Sequence: Synthetic peptide
  Seed: YQAKEPLTR (MAGC3_HUMAN)
  misc_feature (2)..(2): Xaa can be Ala, Arg, Ser, Thr, Val, Gln, Ile, Met, Tyr, Leu, Phe, Gly, Lys, Glu, Pro, Cys, Asn, Asp, Trp, or His
  misc_feature (9)..(9): Xaa can be Ile, Phe, Tyr, Met, Val, Leu, Arg, Lys, His, Trp, Ala, Cys, Thr, Gln, Glu, Pro, Asn, Gly, or Ser
YXAKEPLTX

SEQ ID NO: 113793 - protein, 10 aa, Artificial Sequence
  Description of Artificial Sequence: Synthetic peptide
  Seed: YQAKEPLTRA (MAGC3_HUMAN)
  misc_feature (2)..(2): Xaa can be Leu, Met, Gln, Ile, Val, Thr, Ala, Glu, Ser, or Phe
  misc_feature (10)..(10): Xaa can be Val, Leu, Ile, Met, Ala, Thr, Cys, Phe, Ser, or Gly
YXAKEPLTRX

SEQ ID NO: 113794 - protein, 9 aa, Artificial Sequence
  Description of Artificial Sequence: Synthetic peptide
  Seed: YQTKEPVTK (MAGC3_HUMAN)
  misc_feature (2)..(2): Xaa can be Ala, Arg, Thr, Val, Tyr, Ser, Ile, Gln, Phe, Gly, Met, Leu, Glu, Asn, Trp, Lys, Pro, Cys, Asp, or His
  misc_feature (9)..(9): Xaa can be Phe, Leu, Met, Tyr, Val, Ile, Lys, Arg, Trp, His, Cys, Ala, Gln, Thr, Ser, Pro, Glu, or As n
YXTKEPVTX

SEQ ID NO: 113795 - protein, 9 aa, Artificial Sequence
  Description of Artificial Sequence: Synthetic peptide
  Seed: YSAFHLGHL (MAGC3_HUMAN)
  misc_feature (2)..(2): Xaa can be Leu, Met, Gln, Ile, Ala, Thr, Val, Ser, Tyr, Arg, Gly, Phe, Glu, Asn, Pro, Asp, Lys, Cys, Trp, or His
  misc_feature (9)..(9): Xaa can be Leu, Tyr, Phe, Met, Trp, Val, Ile, Arg, Lys, His, Ala, Thr, Cys, Ser, Pro, Gly, Glu, or Gl n
YXAFHLGHX

SEQ ID NO: 113796 - protein, 10 aa, Artificial Sequence
  Description of Artificial Sequence: Synthetic peptide
  Seed: YSAFHLGHLR (MAGC3_HUMAN)
  misc_feature (2)..(2): Xaa can be Thr, Val, Met, Ile, Ser, Phe, Leu, Ala, Asp, Gly, Glu, Gln, Trp, Arg, Lys, His, Tyr, Cys, Asn, or Pro
  misc_feature (10)..(10): Xaa can be Tyr, Arg, Lys, Met, His, Phe, Val, Leu, or Gln
YXAFHLGHLX

SEQ ID NO: 113797 - protein, 11 aa, Artificial Sequence
  Description of Artificial Sequence: Synthetic peptide
  Seed: YSAFHLGHLRE (MAGC3_HUMAN)
  misc_feature (2)..(2): Xaa can be Ser, Val, Ala, Ile, Thr, Met, Phe, Pro, Asn, Leu, Tyr, Glu, His, Asp, Gln, or Trp
  misc_feature (11)..(11): Xaa can be Arg, Lys, Asn, Ile, Tyr, Gln, Ser, Pro, Val, Asp, Met, His, Ala, Phe, Glu, Trp, Gly, Leu, Cys, or Thr
YXAFHLGHLRX

SEQ ID NO: 113798 - protein, 8 aa, Artificial Sequence
  Description of Artificial Sequence: Synthetic peptide
  Seed: YTGYFPMI (MAGC3_HUMAN)
  misc_feature (2)..(2): Xaa can be Ala, Ser, Thr, Gly, Val, Ile, or Cys
  misc_feature (8)..(8): Xaa can be Leu, Phe, Met, Tyr, Val, Ile, or Trp
YXGYFPMX

SEQ ID NO: 113799 - protein, 9 aa, Artificial Sequence
  Description of Artificial Sequence: Synthetic peptide
  Seed: YTGYFPMIF (MAGC3_HUMAN)
  misc_feature (2)..(2): Xaa can be Pro, Ala, Tyr, Arg, Ser, Met, Thr, Gln, Val, Phe, Ile, Leu, Trp, Lys, Gly, Asn, Cys, His, Glu, or Asp
  misc_feature (9)..(9): Xaa can be Tyr, Trp, Phe, Met, Leu, Ile, Val, His, Lys, Ala, Cys, Thr, Arg, Gly, Gln, Ser, Asn, or Gl u
YXGYFPMIX

SEQ ID NO: 113800 - protein, 10 aa, Artificial Sequence
  Description of Artificial Sequence: Synthetic peptide
  Seed: YTGYFPMIFR (MAGC3_HUMAN)
  misc_feature (2)..(2): Xaa can be Thr, Val, Met, Ile, Phe, Trp, Ser, Tyr, Leu, Ala, Gly, Lys, Gln, Asp, Arg, Cys, Pro, Asn, His, or Glu
  misc_feature (10)..(10): Xaa can be Lys, Arg, Tyr, His, or Gln
YXGYFPMIFX

SEQ ID NO: 113801 - protein, 11 aa, Artificial Sequence
  Description of Artificial Sequence: Synthetic peptide
  Seed: YTGYFPMIFRK (MAGC3_HUMAN)
  misc_feature (2)..(2): Xaa can be Tyr, Met, Thr, Ala, Phe, Ser, Val, Gln, Trp, Ile, Leu, His, Pro, Asp, Cys, Glu, Lys, Arg, Asn, or Gly
  misc_feature (11)..(11): Xaa can be Lys, Arg, His, Tyr, Met, Leu, Phe, Cys, Ile, Ser, Gln, Val, Trp, Glu, Ala, Gly, Pro, Asp, Asn, or Thr
YXGYFPMIFRX

SEQ ID NO: 113802 - protein, 9 aa, Artificial Sequence
  Description of Artificial Sequence: Synthetic peptide
  Seed: YTLDEKVDK (MAGC3_HUMAN)
  misc_feature (2)..(2): Xaa can be Ala, Ile, Ser, Thr, Val, Gly, Leu, Met, Gln, Phe, Cys, Asn, Tyr, Glu, Trp, Asp, or Pro
  misc_feature (9)..(9): Xaa can be Tyr, Lys, Arg, Phe, Leu, Met, His, Ile, Val, Trp, or Ala
YXLDEKVDX

SEQ ID NO: 113803 - protein, 10 aa, Artificial Sequence
  Description of Artificial Sequence: Synthetic peptide
  Seed: YTLDEKVDKL (MAGC3_HUMAN)
  misc_feature (2)..(2): Xaa can be Met, Leu, Ile, Gln, Thr, Val, Ala, Ser, Tyr, Gly, Phe, Asn, Glu, Pro, Trp, Asp, Lys, Cys, Arg, or His
  misc_feature (10)..(10): Xaa can be Leu, Met, Trp, Tyr, Val, Ala, Ile, Cys, Phe, Arg, Lys, Thr, His, Ser, or Gly
YXLDEKVDKX

SEQ ID NO: 113804 - protein, 11 aa, Artificial Sequence
  Description of Artificial Sequence: Synthetic peptide
  Seed: YTLDEKVDKLV (MAGC3_HUMAN)
  misc_feature (2)..(2): Xaa can be Ala, Thr, Ser, or Val
  misc_feature (11)..(11): Xaa can be Leu, Met, Val, Ile, or Phe
YXLDEKVDKLX

SEQ ID NO: 113805 - protein, 8 aa, Artificial Sequence
  Description of Artificial Sequence: Synthetic peptide
  Seed: YTLSLPAV (MAGC3_HUMAN)
  misc_feature (2)..(2): Xaa can be Gln, Ser, Thr, Gly, Leu, Ala, Met, Glu, Asp, Val, Ile, Pro, Lys, Phe, His, or Asn
  misc_feature (8)..(8): Xaa can be Ile, Leu, Val, Met, Phe, Tyr, Ala, Cys, or Thr
YXLSLPAX

SEQ ID NO: 113806 - protein, 9 aa, Artificial Sequence
  Description of Artificial Sequence: Synthetic peptide
  Seed: YVFVNTLDL (MAGC3_HUMAN)
  misc_feature (2)..(2): Xaa can be Pro, Tyr, Ala, Gln, Met, Arg, Thr, Leu, Ser, Phe, Ile, Val, Gly, Glu, Asn, Lys, His, Trp, Asp, or Cys
  misc_feature (9)..(9): Xaa can be Tyr, Val, Met, Ile, Phe, Leu, Trp, His, Ala, Lys, Cys, Thr, Arg, Ser, Gly, Gln, Asn, Pro, Glu, or Asp
YXFVNTLDX

SEQ ID NO: 113807 - protein, 10 aa, Artificial Sequence
  Description of Artificial Sequence: Synthetic peptide
  Seed: YVFVNTLDLT (MAGC3_HUMAN)
  misc_feature (2)..(2): Xaa can be Met, Gln, Leu, Ile, Val, Ser, Ala, Thr, Gly, Phe, Trp, Cys, or Asn
  misc_feature (10)..(10): Xaa can be Val, Leu, Ala, Met, Ile, Thr, Phe, Ser, Cys, Pro, or Gly
YXFVNTLDLX

SEQ ID NO: 113808 - protein, 9 aa, Artificial Sequence
  Description of Artificial Sequence: Synthetic peptide
  Seed: AGIGILTVI (MAR1_HUMAN)
AAIGILTVL

SEQ ID NO: 113809 - protein, 9 aa, Artificial Sequence
  Description of Artificial Sequence: Synthetic peptide
  Seed: AEQSPPPYS (MAR1_HUMAN)
AEQSPPPYA

SEQ ID NO: 113810 - protein, 9 aa, Artificial Sequence
  Description of Artificial Sequence: Synthetic peptide
  Seed: ALMDKSLHV (MAR1_HUMAN)
AMMDKSLHV

SEQ ID NO: 113811 - protein, 9 aa, Artificial Sequence
  Description of Artificial Sequence: Synthetic peptide
  Seed: ALMDKSLHV (MAR1_HUMAN)
AVMDKSLHL

SEQ ID NO: 113812 - protein, 10 aa, Artificial Sequence
  Description of Artificial Sequence: Synthetic peptide
  Seed: DAHFIYGYPK (MAR1_HUMAN)
DTHFIYGYPK

SEQ ID NO: 113813 - protein, 9 aa, Artificial Sequence
  Description of Artificial Sequence: Synthetic peptide
  Seed: EAAGIGILT (MAR1_HUMAN)
ETAGIGILV

SEQ ID NO: 113814 - protein, 9 aa, Artificial Sequence
  Description of Artificial Sequence: Synthetic peptide
  Seed: GILTVILGV (MAR1_HUMAN)
GMLTVILGV

SEQ ID NO: 113815 - protein, 9 aa, Artificial Sequence
  Description of Artificial Sequence: Synthetic peptide
  Seed: GTQCALTRR (MAR1_HUMAN)
GTQCALTRK

SEQ ID NO: 113816 - protein, 8 aa, Artificial Sequence
  Description of Artificial Sequence: Synthetic peptide
  Seed: HRDSKVSL (MAR1_HUMAN)
HYDSKVSL

SEQ ID NO: 113817 - protein, 10 aa, Artificial Sequence
  Description of Artificial Sequence: Synthetic peptide
  Seed: KGHGHSYTTA (MAR1_HUMAN)
KTHGHSYTTK

SEQ ID NO: 113818 - protein, 8 aa, Artificial Sequence
  Description of Artificial Sequence: Synthetic peptide
  Seed: LMDKSLHV (MAR1_HUMAN)
LADKSLHL

SEQ ID NO: 113819 - protein, 8 aa, Artificial Sequence
  Description of Artificial Sequence: Synthetic peptide
  Seed: LMDKSLHV (MAR1_HUMAN)
LFDKSLHL

SEQ ID NO: 113820 - protein, 10 aa, Artificial Sequence
  Description of Artificial Sequence: Synthetic peptide
  Seed: LSAEQSPPPY (MAR1_HUMAN)
LMAEQSPPPY

SEQ ID NO: 113821 - protein, 9 aa, Artificial Sequence
  Description of Artificial Sequence: Synthetic peptide
  Seed: LLIGCWYCR (MAR1_HUMAN)
LTIGCWYCR

SEQ ID NO: 113822 - protein, 10 aa, Artificial Sequence
  Description of Artificial Sequence: Synthetic peptide
  Seed: LLLIGCWYCR (MAR1_HUMAN)
LYLIGCWYCR

SEQ ID NO: 113823 - protein, 10 aa, Artificial Sequence
  Description of Artificial Sequence: Synthetic peptide
  Seed: MPREDAHFIY (MAR1_HUMAN)
MLREDAHFIY

SEQ ID NO: 113824 - protein, 9 aa, Artificial Sequence
  Description of Artificial Sequence: Synthetic peptide
  Seed: MPREDAHFI (MAR1_HUMAN)
MPREDAHFA

SEQ ID NO: 113825 - protein, 10 aa, Artificial Sequence
  Description of Artificial Sequence: Synthetic peptide
  Seed: MPREDAHFIY (MAR1_HUMAN)
MPREDAHFIF

SEQ ID NO: 113826 - protein, 9 aa, Artificial Sequence
  Description of Artificial Sequence: Synthetic peptide
  Seed: MPREDAHFI (MAR1_HUMAN)
MPREDAHFL

SEQ ID NO: 113827 - protein, 9 aa, Artificial Sequence
  Description of Artificial Sequence: Synthetic peptide
  Seed: MPREDAHFI (MAR1_HUMAN)
MPREDAHFM

SEQ ID NO: 113828 - protein, 9 aa, Artificial Sequence
  Description of Artificial Sequence: Synthetic peptide
  Seed: NAPPAYEKL (MAR1_HUMAN)
NRPPAYEKL

SEQ ID NO: 113829 - protein, 10 aa, Artificial Sequence
  Description of Artificial Sequence: Synthetic peptide
  Seed: REDAHFIYGY (MAR1_HUMAN)
REDAHFIYGW

SEQ ID NO: 113830 - protein, 10 aa, Artificial Sequence
  Description of Artificial Sequence: Synthetic peptide
  Seed: REDAHFIYGY (MAR1_HUMAN)
RLDAHFIYGY

SEQ ID NO: 113831 - protein, 10 aa, Artificial Sequence
  Description of Artificial Sequence: Synthetic peptide
  Seed: RNGYRALMDK (MAR1_HUMAN)
RMGYRALMDK

SEQ ID NO: 113832 - protein, 10 aa, Artificial Sequence
  Description of Artificial Sequence: Synthetic peptide
  Seed: REDAHFIYGY (MAR1_HUMAN)
RQDAHFIYGY

SEQ ID NO: 113833 - protein, 9 aa, Artificial Sequence
  Description of Artificial Sequence: Synthetic peptide
  Seed: RRNGYRALM (MAR1_HUMAN)
RRNGYRALL

SEQ ID NO: 113834 - protein, 9 aa, Artificial Sequence
  Description of Artificial Sequence: Synthetic peptide
  Seed: RRNGYRALM (MAR1_HUMAN)
RRNGYRALY

SEQ ID NO: 113835 - protein, 10 aa, Artificial Sequence
  Description of Artificial Sequence: Synthetic peptide
  Seed: RNGYRALMDK (MAR1_HUMAN)
RTGYRALMDK

SEQ ID NO: 113836 - protein, 9 aa, Artificial Sequence
  Description of Artificial Sequence: Synthetic peptide
  Seed: TTAEEAAGI (MAR1_HUMAN)
TTAEEAAGV

SEQ ID NO: 113837 - protein, 9 aa, Artificial Sequence
  Description of Artificial Sequence: Synthetic peptide
  Seed: VVPNAPPAY (MAR1_HUMAN)
VAPNAPPAM

SEQ ID NO: 113838 - protein, 9 aa, Artificial Sequence
  Description of Artificial Sequence: Synthetic peptide
  Seed: VVPNAPPAY (MAR1_HUMAN)
VAPNAPPAY

SEQ ID NO: 113839 - protein, 9 aa, Artificial Sequence
  Description of Artificial Sequence: Synthetic peptide
  Seed: VVPNAPPAY (MAR1_HUMAN)
VIPNAPPAL

SEQ ID NO: 113840 - protein, 9 aa, Artificial Sequence
  Description of Artificial Sequence: Synthetic peptide
  Seed: VVPNAPPAY (MAR1_HUMAN)
VMPNAPPAY

SEQ ID NO: 113841 - protein, 9 aa, Artificial Sequence
  Description of Artificial Sequence: Synthetic peptide
  Seed: VVPNAPPAY (MAR1_HUMAN)
VRPNAPPAL

SEQ ID NO: 113842 - protein, 11 aa, Artificial Sequence
  Description of Artificial Sequence: Synthetic peptide
  Seed: YCRRRNGYRAL (MAR1_HUMAN)
YMRRRNGYRAL

SEQ ID NO: 113843 - protein, 9 aa, Artificial Sequence
  Description of Artificial Sequence: Synthetic peptide
  Seed: YRALMDKSL (MAR1_HUMAN)
YRALMDKSA

SEQ ID NO: 113844 - protein, 9 aa, Homo sapiens
  Native (MAR1_HUMAN)
AAGIGILTV

SEQ ID NO: 113845 - protein, 9 aa, Homo sapiens
  Native (MAR1_HUMAN)
AEEAAGIGI

SEQ ID NO: 113846 - protein, 10 aa, Homo sapiens
  Native (MAR1_HUMAN)
AEEAAGIGIL

SEQ ID NO: 113847 - protein, 10 aa, Homo sapiens
  Native (MAR1_HUMAN)
AEQSPPPYSP

SEQ ID NO: 113848 - protein, 9 aa, Homo sapiens
  Native (MAR1_HUMAN)
ALMDKSLHV

SEQ ID NO: 113849 - protein, 10 aa, Homo sapiens
  Native (MAR1_HUMAN)
DAHFIYGYPK

SEQ ID NO: 113850 - protein, 9 aa, Homo sapiens
  Native (MAR1_HUMAN)
DHRDSKVSL

SEQ ID NO: 113851 - protein, 10 aa, Homo sapiens
  Native (MAR1_HUMAN)
EAAGIGILTV

SEQ ID NO: 113852 - protein, 9 aa, Homo sapiens
  Native (MAR1_HUMAN)
EEAAGIGIL

SEQ ID NO: 113853 - protein, 9 aa, Homo sapiens
  Native (MAR1_HUMAN)
GILTVILGV

SEQ ID NO: 113854 - protein, 9 aa, Homo sapiens
  Native (MAR1_HUMAN)
GTQCALTRR

SEQ ID NO: 113855 - protein, 9 aa, Homo sapiens
  Native (MAR1_HUMAN)
LHVGTQCAL

SEQ ID NO: 113856 - protein, 9 aa, Homo sapiens
  Native (MAR1_HUMAN)
LLIGCWYCR

SEQ ID NO: 113857 - protein, 10 aa, Homo sapiens
  Native (MAR1_HUMAN)
LSAEQSPPPY

SEQ ID NO: 113858 - protein, 10 aa, Homo sapiens
  Native (MAR1_HUMAN)
MPREDAHFIY

SEQ ID NO: 113859 - protein, 9 aa, Homo sapiens
  Native (MAR1_HUMAN)
NAPPAYEKL

SEQ ID NO: 113860 - protein, 9 aa, Homo sapiens
  Native (MAR1_HUMAN)
QEKNCEPVV

SEQ ID NO: 113861 - protein, 10 aa, Homo sapiens
  Native (MAR1_HUMAN)
RDSKVSLQEK

SEQ ID NO: 113862 - protein, 10 aa, Homo sapiens
  Native (MAR1_HUMAN)
REDAHFIYGY

SEQ ID NO: 113863 - protein, 9 aa, Homo sapiens
  Native (MAR1_HUMAN)
RRNGYRALM

SEQ ID NO: 113864 - protein, 10 aa, Homo sapiens
  Native (MAR1_HUMAN)
SLQEKNCEPV

SEQ ID NO: 113865 - protein, 9 aa, Homo sapiens
  Native (MAR1_HUMAN)
TTAEEAAGI

SEQ ID NO: 113866 - protein, 9 aa, Homo sapiens
  Native (MAR1_HUMAN)
VILGVLLLI

SEQ ID NO: 113867 - protein, 9 aa, Homo sapiens
  Native (MAR1_HUMAN)
VVPNAPPAY

SEQ ID NO: 113868 - protein, 10 aa, Homo sapiens
  Native (MAR1_HUMAN)
YPKKGHGHSY

SEQ ID NO: 113869 - protein, 9 aa, Homo sapiens
  Native (MAR1_HUMAN)
YRALMDKSL

SEQ ID NO: 113870 - protein, 9 aa, Artificial Sequence
  Description of Artificial Sequence: Synthetic peptide
  Seed: HSYTTAEEA (MAR1_HUMAN)
HSYTTAEEV

SEQ ID NO: 113871 - protein, 11 aa, Artificial Sequence
  Description of Artificial Sequence: Synthetic peptide
  Seed: RALMDKSLHVG (MAR1_HUMAN)
RLLMDKSLHVL

SEQ ID NO: 113872 - protein, 10 aa, Artificial Sequence
  Description of Artificial Sequence: Synthetic peptide
  Seed: RNGYRALMDK (MAR1_HUMAN)
RIGYRALMDK

SEQ ID NO: 113873 - protein, 9 aa, Artificial Sequence
  Description of Artificial Sequence: Synthetic peptide
  Seed: EPVVPNAPP (MAR1_HUMAN)
EPVVPNAPA

SEQ ID NO: 113874 - protein, 9 aa, Artificial Sequence
  Description of Artificial Sequence: Synthetic peptide
  Seed: ALMDKSLHV (MAR1_HUMAN)
AYMDKSLHY

SEQ ID NO: 113875 - protein, 9 aa, Artificial Sequence
  Description of Artificial Sequence: Synthetic peptide
  Seed: NAPPAYEKL (MAR1_HUMAN)
NQPPAYEKF

SEQ ID NO: 113876 - protein, 10 aa, Artificial Sequence
  Description of Artificial Sequence: Synthetic peptide
  Seed: KGHGHSYTTA (MAR1_HUMAN)
KLHGHSYTTK

SEQ ID NO: 113877 - protein, 9 aa, Artificial Sequence
  Description of Artificial Sequence: Synthetic peptide
  Seed: NAPPAYEKL (MAR1_HUMAN)
NCPPAYEKL

SEQ ID NO: 113878 - protein, 9 aa, Artificial Sequence
  Description of Artificial Sequence: Synthetic peptide
  Seed: YPKKGHGHS (MAR1_HUMAN)
YPKKGHGHI

SEQ ID NO: 113879 - protein, 9 aa, Artificial Sequence
  Description of Artificial Sequence: Synthetic peptide
  Seed: LLIGCWYCR (MAR1_HUMAN)
LYIGCWYCK

SEQ ID NO: 113880 - protein, 9 aa, Artificial Sequence
  Description of Artificial Sequence: Synthetic peptide
  Seed: HFIYGYPKK (MAR1_HUMAN)
HSIYGYPKK

SEQ ID NO: 113881 - protein, 9 aa, Artificial Sequence
  Description of Artificial Sequence: Synthetic peptide
  Seed: EDAHFIYGY (MAR1_HUMAN)
EAAHFIYGF

SEQ ID NO: 113882 - protein, 10 aa, Artificial Sequence
  Description of Artificial Sequence: Synthetic peptide
  Seed: RRRNGYRALM (MAR1_HUMAN)
RSRNGYRALF

SEQ ID NO: 113883 - protein, 8 aa, Artificial Sequence
  Description of Artificial Sequence: Synthetic peptide
  Seed: HRDSKVSL (MAR1_HUMAN)
HWDSKVSF

SEQ ID NO: 113884 - protein, 9 aa, Artificial Sequence
  Description of Artificial Sequence: Synthetic peptide
  Seed: NAPPAYEKL (MAR1_HUMAN)
NQPPAYEKY

SEQ ID NO: 113885 - protein, 10 aa, Artificial Sequence
  Description of Artificial Sequence: Synthetic peptide
  Seed: RDSKVSLQEK (MAR1_HUMAN)
RGSKVSLQEK

SEQ ID NO: 113886 - protein, 9 aa, Artificial Sequence
  Description of Artificial Sequence: Synthetic peptide
  Seed: EDAHFIYGY (MAR1_HUMAN)
EIAHFIYGM

SEQ ID NO: 113887 - protein, 10 aa, Artificial Sequence
  Description of Artificial Sequence: Synthetic peptide
  Seed: RALMDKSLHV (MAR1_HUMAN)
RRLMDKSLHA

SEQ ID NO: 113888 - protein, 10 aa, Artificial Sequence
  Description of Artificial Sequence: Synthetic peptide
  Seed: APPAYEKLSA (MAR1_HUMAN)
APPAYEKLSL

SEQ ID NO: 113889 - protein, 10 aa, Artificial Sequence
  Description of Artificial Sequence: Synthetic peptide
  Seed: YGYPKKGHGH (MAR1_HUMAN)
YIYPKKGHGY

SEQ ID NO: 113890 - protein, 9 aa, Artificial Sequence
  Description of Artificial Sequence: Synthetic peptide
  Seed: EAAGIGILT (MAR1_HUMAN)
EAAGIGILA

SEQ ID NO: 113891 - protein, 10 aa, Artificial Sequence
  Description of Artificial Sequence: Synthetic peptide
  Seed: RALMDKSLHV (MAR1_HUMAN)
RGLMDKSLHA

SEQ ID NO: 113892 - protein, 9 aa, Artificial Sequence
  Description of Artificial Sequence: Synthetic peptide
  Seed: VILGVLLLI (MAR1_HUMAN)
VTLGVLLLF

SEQ ID NO: 113893 - protein, 9 aa, Artificial Sequence
  Description of Artificial Sequence: Synthetic peptide
  Seed: AGIGILTVI (MAR1_HUMAN)
AAIGILTVH

SEQ ID NO: 113894 - protein, 10 aa, Artificial Sequence
  Description of Artificial Sequence: Synthetic peptide
  Seed: QEKNCEPVVP (MAR1_HUMAN)
QEKNCEPVVA

SEQ ID NO: 113895 - protein, 9 aa, Artificial Sequence
  Description of Artificial Sequence: Synthetic peptide
  Seed: ALMDKSLHV (MAR1_HUMAN)
ASMDKSLHF

SEQ ID NO: 113896 - protein, 10 aa, Artificial Sequence
  Description of Artificial Sequence: Synthetic peptide
  Seed: RRNGYRALMD (MAR1_HUMAN)
RRNGYRALML

SEQ ID NO: 113897 - protein, 10 aa, Artificial Sequence
  Description of Artificial Sequence: Synthetic peptide
  Seed: ALMDKSLHVG (MAR1_HUMAN)
AFMDKSLHVL

SEQ ID NO: 113898 - protein, 9 aa, Artificial Sequence
  Description of Artificial Sequence: Synthetic peptide
  Seed: VILGVLLLI (MAR1_HUMAN)
VMLGVLLLR

SEQ ID NO: 113899 - protein, 9 aa, Artificial Sequence
  Description of Artificial Sequence: Synthetic peptide
  Seed: RRRNGYRAL (MAR1_HUMAN)
RIRNGYRAY

SEQ ID NO: 113900 - protein, 9 aa, Artificial Sequence
  Description of Artificial Sequence: Synthetic peptide
  Seed: NAPPAYEKL (MAR1_HUMAN)
NLPPAYEKI

SEQ ID NO: 113901 - protein, 10 aa, Artificial Sequence
  Description of Artificial Sequence: Synthetic peptide
  Seed: ALMDKSLHVG (MAR1_HUMAN)
ALMDKSLHVF

SEQ ID NO: 113902 - protein, 9 aa, Artificial Sequence
  Description of Artificial Sequence: Synthetic peptide
  Seed: ALMDKSLHV (MAR1_HUMAN)
AQMDKSLHW

SEQ ID NO: 113903 - protein, 9 aa, Artificial Sequence
  Description of Artificial Sequence: Synthetic peptide
  Seed: AHFIYGYPK (MAR1_HUMAN)
AFFIYGYPK

SEQ ID NO: 113904 - protein, 11 aa, Artificial Sequence
  Description of Artificial Sequence: Synthetic peptide
  Seed: YRALMDKSLHV (MAR1_HUMAN)
YQALMDKSLHV

SEQ ID NO: 113905 - protein, 11 aa, Artificial Sequence
  Description of Artificial Sequence: Synthetic peptide
  Seed: KSLHVGTQCAL (MAR1_HUMAN)
KILHVGTQCAW

SEQ ID NO: 113906 - protein, 9 aa, Artificial Sequence
  Description of Artificial Sequence: Synthetic peptide
  Seed: VILGVLLLI (MAR1_HUMAN)
VQLGVLLLR

SEQ ID NO: 113907 - protein, 9 aa, Artificial Sequence
  Description of Artificial Sequence: Synthetic peptide
  Seed: ALMDKSLHV (MAR1_HUMAN)
ARMDKSLHF

SEQ ID NO: 113908 - protein, 10 aa, Artificial Sequence
  Description of Artificial Sequence: Synthetic peptide
  Seed: YPKKGHGHSY (MAR1_HUMAN)
YIKKGHGHSF

SEQ ID NO: 113909 - protein, 9 aa, Artificial Sequence
  Description of Artificial Sequence: Synthetic peptide
  Seed: AGIGILTVI (MAR1_HUMAN)
AAIGILTVY

SEQ ID NO: 113910 - protein, 9 aa, Artificial Sequence
  Description of Artificial Sequence: Synthetic peptide
  Seed: YRALMDKSL (MAR1_HUMAN)
YMALMDKSF

SEQ ID NO: 113911 - protein, 9 aa, Artificial Sequence
  Description of Artificial Sequence: Synthetic peptide
  Seed: GYPKKGHGH (MAR1_HUMAN)
GFPKKGHGL

SEQ ID NO: 113912 - protein, 11 aa, Artificial Sequence
  Description of Artificial Sequence: Synthetic peptide
  Seed: RALMDKSLHVG (MAR1_HUMAN)
RKLMDKSLHVV

SEQ ID NO: 113913 - protein, 10 aa, Artificial Sequence
  Description of Artificial Sequence: Synthetic peptide
  Seed: RRRNGYRALM (MAR1_HUMAN)
RKRNGYRALM

SEQ ID NO: 113914 - protein, 10 aa, Artificial Sequence
  Description of Artificial Sequence: Synthetic peptide
  Seed: EEAAGIGILT (MAR1_HUMAN)
EPAAGIGILV

SEQ ID NO: 113915 - protein, 10 aa, Artificial Sequence
  Description of Artificial Sequence: Synthetic peptide
  Seed: LLLIGCWYCR (MAR1_HUMAN)
LYLIGCWYCK

SEQ ID NO: 113916 - protein, 9 aa, Artificial Sequence
  Description of Artificial Sequence: Synthetic peptide
  Seed: ALMDKSLHV (MAR1_HUMAN)
AMMDKSLHA

SEQ ID NO: 113917 - protein, 8 aa, Artificial Sequence
  Description of Artificial Sequence: Synthetic peptide
  Seed: LMDKSLHV (MAR1_HUMAN)
LTDKSLHI

SEQ ID NO: 113918 - protein, 11 aa, Artificial Sequence
  Description of Artificial Sequence: Synthetic peptide
  Seed: VLLLIGCWYCR (MAR1_HUMAN)
VMLLIGCWYCR

SEQ ID NO: 113919 - protein, 10 aa, Artificial Sequence
  Description of Artificial Sequence: Synthetic peptide
  Seed: FDHRDSKVSL (MAR1_HUMAN)
FEHRDSKVSL

SEQ ID NO: 113920 - protein, 9 aa, Artificial Sequence
  Description of Artificial Sequence: Synthetic peptide
  Seed: AHFIYGYPK (MAR1_HUMAN)
ASFIYGYPR

SEQ ID NO: 113921 - protein, 9 aa, Artificial Sequence
  Description of Artificial Sequence: Synthetic peptide
  Seed: KSLHVGTQC (MAR1_HUMAN)
KALHVGTQF

SEQ ID NO: 113922 - protein, 10 aa, Artificial Sequence
  Description of Artificial Sequence: Synthetic peptide
  Seed: KGHGHSYTTA (MAR1_HUMAN)
KSHGHSYTTK

SEQ ID NO: 113923 - protein, 10 aa, Artificial Sequence
  Description of Artificial Sequence: Synthetic peptide
  Seed: TVILGVLLLI (MAR1_HUMAN)
TIILGVLLLV

SEQ ID NO: 113924 - protein, 10 aa, Artificial Sequence
  Description of Artificial Sequence: Synthetic peptide
  Seed: EEAAGIGILT (MAR1_HUMAN)
EEAAGIGILI

SEQ ID NO: 113925 - protein, 8 aa, Artificial Sequence
  Description of Artificial Sequence: Synthetic peptide
  Seed: LMDKSLHV (MAR1_HUMAN)
LTDKSLHL

SEQ ID NO: 113926 - protein, 9 aa, Artificial Sequence
  Description of Artificial Sequence: Synthetic peptide
  Seed: GFDHRDSKV (MAR1_HUMAN)
GSDHRDSKM

SEQ ID NO: 113927 - protein, 9 aa, Artificial Sequence
  Description of Artificial Sequence: Synthetic peptide
  Seed: VILGVLLLI (MAR1_HUMAN)
VALGVLLLR

SEQ ID NO: 113928 - protein, 11 aa, Artificial Sequence
  Description of Artificial Sequence: Synthetic peptide
  Seed: KSLHVGTQCAL (MAR1_HUMAN)
KGLHVGTQCAW

SEQ ID NO: 113929 - protein, 10 aa, Artificial Sequence
  Description of Artificial Sequence: Synthetic peptide
  Seed: RDSKVSLQEK (MAR1_HUMAN)
RHSKVSLQEK

SEQ ID NO: 113930 - protein, 9 aa, Artificial Sequence
  Description of Artificial Sequence: Synthetic peptide
  Seed: LTVILGVLL (MAR1_HUMAN)
LSVILGVLW

SEQ ID NO: 113931 - protein, 9 aa, Artificial Sequence
  Description of Artificial Sequence: Synthetic peptide
  Seed: EAAGIGILT (MAR1_HUMAN)
ETAGIGILS

SEQ ID NO: 113932 - protein, 10 aa, Artificial Sequence
  Description of Artificial Sequence: Synthetic peptide
  Seed: SLHVGTQCAL (MAR1_HUMAN)
SMHVGTQCAY

SEQ ID NO: 113933 - protein, 9 aa, Artificial Sequence
  Description of Artificial Sequence: Synthetic peptide
  Seed: AEQSPPPYS (MAR1_HUMAN)
AEQSPPPYV

SEQ ID NO: 113934 - protein, 11 aa, Artificial Sequence
  Description of Artificial Sequence: Synthetic peptide
  Seed: YRALMDKSLHV (MAR1_HUMAN)
YRALMDKSLHM

SEQ ID NO: 113935 - protein, 9 aa, Artificial Sequence
  Description of Artificial Sequence: Synthetic peptide
  Seed: NAPPAYEKL (MAR1_HUMAN)
NSPPAYEKL

SEQ ID NO: 113936 - protein, 9 aa, Artificial Sequence
  Description of Artificial Sequence: Synthetic peptide
  Seed: YEKLSAEQS (MAR1_HUMAN)
YEKLSAEQC

SEQ ID NO: 113937 - protein, 9 aa, Artificial Sequence
  Description of Artificial Sequence: Synthetic peptide
  Seed: EDAHFIYGY (MAR1_HUMAN)
ETAHFIYGY

SEQ ID NO: 113938 - protein, 9 aa, Artificial Sequence
  Description of Artificial Sequence: Synthetic peptide
  Seed: HFIYGYPKK (MAR1_HUMAN)
HVIYGYPKR

SEQ ID NO: 113939 - protein, 9 aa, Artificial Sequence
  Description of Artificial Sequence: Synthetic peptide
  Seed: RRNGYRALM (MAR1_HUMAN)
RYNGYRALL

SEQ ID NO: 113940 - protein, 9 aa, Artificial Sequence
  Description of Artificial Sequence: Synthetic peptide
  Seed: NAPPAYEKL (MAR1_HUMAN)
NHPPAYEKV

SEQ ID NO: 113941 - protein, 9 aa, Artificial Sequence
  Description of Artificial Sequence: Synthetic peptide
  Seed: NAPPAYEKL (MAR1_HUMAN)
NIPPAYEKM

SEQ ID NO: 113942 - protein, 9 aa, Artificial Sequence
  Description of Artificial Sequence: Synthetic peptide
  Seed: GILTVILGV (MAR1_HUMAN)
GLLTVILGT

SEQ ID NO: 113943 - protein, 9 aa, Artificial Sequence
  Description of Artificial Sequence: Synthetic peptide
  Seed: EGFDHRDSK (MAR1_HUMAN)
EMFDHRDSK

SEQ ID NO: 113944 - protein, 11 aa, Artificial Sequence
  Description of Artificial Sequence: Synthetic peptide
  Seed: ALMDKSLHVGT (MAR1_HUMAN)
ALMDKSLHVGI

SEQ ID NO: 113945 - protein, 9 aa, Artificial Sequence
  Description of Artificial Sequence: Synthetic peptide
  Seed: VILGVLLLI (MAR1_HUMAN)
VQLGVLLLI

SEQ ID NO: 113946 - protein, 9 aa, Artificial Sequence
  Description of Artificial Sequence: Synthetic peptide
  Seed: HSYTTAEEA (MAR1_HUMAN)
HLYTTAEEY

SEQ ID NO: 113947 - protein, 9 aa, Artificial Sequence
  Description of Artificial Sequence: Synthetic peptide
  Seed: EQSPPPYSP (MAR1_HUMAN)
EESPPPYSV

SEQ ID NO: 113948 - protein, 11 aa, Artificial Sequence
  Description of Artificial Sequence: Synthetic peptide
  Seed: KSLHVGTQCAL (MAR1_HUMAN)
KALHVGTQCAW

SEQ ID NO: 113949 - protein, 10 aa, Artificial Sequence
  Description of Artificial Sequence: Synthetic peptide
  Seed: RALMDKSLHV (MAR1_HUMAN)
RVLMDKSLHI

SEQ ID NO: 113950 - protein, 9 aa, Artificial Sequence
  Description of Artificial Sequence: Synthetic peptide
  Seed: SAEQSPPPY (MAR1_HUMAN)
SMEQSPPPF

SEQ ID NO: 113951 - protein, 9 aa, Artificial Sequence
  Description of Artificial Sequence: Synthetic peptide
  Seed: VVPNAPPAY (MAR1_HUMAN)
VTPNAPPAI

SEQ ID NO: 113952 - protein, 9 aa, Artificial Sequence
  Description of Artificial Sequence: Synthetic peptide
  Seed: VLLLIGCWY (MAR1_HUMAN)
VFLLIGCWY

SEQ ID NO: 113953 - protein, 9 aa, Artificial Sequence
  Description of Artificial Sequence: Synthetic peptide
  Seed: LTVILGVLL (MAR1_HUMAN)
LLVILGVLV

SEQ ID NO: 113954 - protein, 11 aa, Artificial Sequence
  Description of Artificial Sequence: Synthetic peptide
  Seed: KSLHVGTQCAL (MAR1_HUMAN)
KALHVGTQCAF

SEQ ID NO: 113955 - protein, 10 aa, Artificial Sequence
  Description of Artificial Sequence: Synthetic peptide
  Seed: SLHVGTQCAL (MAR1_HUMAN)
SIHVGTQCAF

SEQ ID NO: 113956 - protein, 9 aa, Artificial Sequence
  Description of Artificial Sequence: Synthetic peptide
  Seed: LTVILGVLL (MAR1_HUMAN)
LAVILGVLL

SEQ ID NO: 113957 - protein, 11 aa, Artificial Sequence
  Description of Artificial Sequence: Synthetic peptide
  Seed: CWYCRRRNGYR (MAR1_HUMAN)
CTYCRRRNGYR

SEQ ID NO: 113958 - protein, 9 aa, Artificial Sequence
  Description of Artificial Sequence: Synthetic peptide
  Seed: RRNGYRALM (MAR1_HUMAN)
RRNGYRALK

SEQ ID NO: 113959 - protein, 9 aa, Artificial Sequence
  Description of Artificial Sequence: Synthetic peptide
  Seed: AGIGILTVI (MAR1_HUMAN)
ATIGILTVI

SEQ ID NO: 113960 - protein, 9 aa, Artificial Sequence
  Description of Artificial Sequence: Synthetic peptide
  Seed: EGFDHRDSK (MAR1_HUMAN)
EVFDHRDSF

SEQ ID NO: 113961 - protein, 9 aa, Artificial Sequence
  Description of Artificial Sequence: Synthetic peptide
  Seed: REDAHFIYG (MAR1_HUMAN)
RDDAHFIYF

SEQ ID NO: 113962 - protein, 9 aa, Artificial Sequence
  Description of Artificial Sequence: Synthetic peptide
  Seed: AGIGILTVI (MAR1_HUMAN)
AQIGILTVA

SEQ ID NO: 113963 - protein, 10 aa, Artificial Sequence
  Description of Artificial Sequence: Synthetic peptide
  Seed: EAAGIGILTV (MAR1_HUMAN)
EMAGIGILTL

SEQ ID NO: 113964 - protein, 10 aa, Artificial Sequence
  Description of Artificial Sequence: Synthetic peptide
  Seed: VPNAPPAYEK (MAR1_HUMAN)
VPNAPPAYEI

SEQ ID NO: 113965 - protein, 9 aa, Artificial Sequence
  Description of Artificial Sequence: Synthetic peptide
  Seed: VVPNAPPAY (MAR1_HUMAN)
VMPNAPPAL

SEQ ID NO: 113966 - protein, 9 aa, Artificial Sequence
  Description of Artificial Sequence: Synthetic peptide
  Seed: EQSPPPYSP (MAR1_HUMAN)
EESPPPYST

SEQ ID NO: 113967 - protein, 10 aa, Artificial Sequence
  Description of Artificial Sequence: Synthetic peptide
  Seed: YPKKGHGHSY (MAR1_HUMAN)
YAKKGHGHSF

SEQ ID NO: 113968 - protein, 10 aa, Artificial Sequence
  Description of Artificial Sequence: Synthetic peptide
  Seed: VPNAPPAYEK (MAR1_HUMAN)
VTNAPPAYEK

SEQ ID NO: 113969 - protein, 9 aa, Artificial Sequence
  Description of Artificial Sequence: Synthetic peptide
  Seed: RRRNGYRAL (MAR1_HUMAN)
RWRNGYRAM

SEQ ID NO: 113970 - protein, 9 aa, Artificial Sequence
  Description of Artificial Sequence: Synthetic peptide
  Seed: AAGIGILTV (MAR1_HUMAN)
ASGIGILTV

SEQ ID NO: 113971 - protein, 10 aa, Artificial Sequence
  Description of Artificial Sequence: Synthetic peptide
  Seed: REDAHFIYGY (MAR1_HUMAN)
RTDAHFIYGY

SEQ ID NO: 113972 - protein, 9 aa, Artificial Sequence
  Description of Artificial Sequence: Synthetic peptide
  Seed: RRRNGYRAL (MAR1_HUMAN)
RTRNGYRAF

SEQ ID NO: 113973 - protein, 8 aa, Artificial Sequence
  Description of Artificial Sequence: Synthetic peptide
  Seed: LMDKSLHV (MAR1_HUMAN)
LVDKSLHM

SEQ ID NO: 113974 - protein, 10 aa, Artificial Sequence
  Description of Artificial Sequence: Synthetic peptide
  Seed: ALMDKSLHVG (MAR1_HUMAN)
ATMDKSLHVA

SEQ ID NO: 113975 - protein, 9 aa, Artificial Sequence
  Description of Artificial Sequence: Synthetic peptide
  Seed: REDAHFIYG (MAR1_HUMAN)
RDDAHFIYM

SEQ ID NO: 113976 - protein, 9 aa, Artificial Sequence
  Description of Artificial Sequence: Synthetic peptide
  Seed: AGIGILTVI (MAR1_HUMAN)
AMIGILTVL

SEQ ID NO: 113977 - protein, 9 aa, Artificial Sequence
  Description of Artificial Sequence: Synthetic peptide
  Seed: VILGVLLLI (MAR1_HUMAN)
VTLGVLLLI

SEQ ID NO: 113978 - protein, 9 aa, Artificial Sequence
  Description of Artificial Sequence: Synthetic peptide
  Seed: EQSPPPYSP (MAR1_HUMAN)
EHSPPPYSA

SEQ ID NO: 113979 - protein, 10 aa, Artificial Sequence
  Description of Artificial Sequence: Synthetic peptide
  Seed: YGYPKKGHGH (MAR1_HUMAN)
YAYPKKGHGH

SEQ ID NO: 113980 - protein, 11 aa, Artificial Sequence
  Description of Artificial Sequence: Synthetic peptide
  Seed: YRALMDKSLHV (MAR1_HUMAN)
YGALMDKSLHI

SEQ ID NO: 113981 - protein, 9 aa, Artificial Sequence
  Description of Artificial Sequence: Synthetic peptide
  Seed: LHVGTQCAL (MAR1_HUMAN)
LHVGTQCAM

SEQ ID NO: 113982 - protein, 9 aa, Artificial Sequence
  Description of Artificial Sequence: Synthetic peptide
  Seed: VGTQCALTR (MAR1_HUMAN)
VVTQCALTR

SEQ ID NO: 113983 - protein, 9 aa, Artificial Sequence
  Description of Artificial Sequence: Synthetic peptide
  Seed: KSLHVGTQC (MAR1_HUMAN)
KTLHVGTQL

SEQ ID NO: 113984 - protein, 9 aa, Artificial Sequence
  Description of Artificial Sequence: Synthetic peptide
  Seed: VVPNAPPAY (MAR1_HUMAN)
VPPNAPPAY

SEQ ID NO: 113985 - protein, 10 aa, Artificial Sequence
  Description of Artificial Sequence: Synthetic peptide
  Seed: RALMDKSLHV (MAR1_HUMAN)
RNLMDKSLHV

SEQ ID NO: 113986 - protein, 10 aa, Artificial Sequence
  Description of Artificial Sequence: Synthetic peptide
  Seed: MPREDAHFIY (MAR1_HUMAN)
MKREDAHFIY

SEQ ID NO: 113987 - protein, 10 aa, Artificial Sequence
  Description of Artificial Sequence: Synthetic peptide
  Seed: APPAYEKLSA (MAR1_HUMAN)
AFPAYEKLSM

SEQ ID NO: 113988 - protein, 10 aa, Artificial Sequence
  Description of Artificial Sequence: Synthetic peptide
  Seed: ALMDKSLHVG (MAR1_HUMAN)
ALMDKSLHVH

SEQ ID NO: 113989 - protein, 11 aa, Artificial Sequence
  Description of Artificial Sequence: Synthetic peptide
  Seed: YRALMDKSLHV (MAR1_HUMAN)
YIALMDKSLHL

SEQ ID NO: 113990 - protein, 11 aa, Artificial Sequence
  Description of Artificial Sequence: Synthetic peptide
  Seed: YCRRRNGYRAL (MAR1_HUMAN)
YMRRRNGYRAF

SEQ ID NO: 113991 - protein, 9 aa, Artificial Sequence
  Description of Artificial Sequence: Synthetic peptide
  Seed: TTAEEAAGI (MAR1_HUMAN)
TLAEEAAGI

SEQ ID NO: 113992 - protein, 10 aa, Artificial Sequence
  Description of Artificial Sequence: Synthetic peptide
  Seed: LLIGCWYCRR (MAR1_HUMAN)
LQIGCWYCRR

SEQ ID NO: 113993 - protein, 10 aa, Artificial Sequence
  Description of Artificial Sequence: Synthetic peptide
  Seed: TVILGVLLLI (MAR1_HUMAN)
TQILGVLLLL

SEQ ID NO: 113994 - protein, 10 aa, Artificial Sequence
  Description of Artificial Sequence: Synthetic peptide
  Seed: RRRNGYRALM (MAR1_HUMAN)
RVRNGYRALM

SEQ ID NO: 113995 - protein, 9 aa, Artificial Sequence
  Description of Artificial Sequence: Synthetic peptide
  Seed: AAGIGILTV (MAR1_HUMAN)
ALGIGILTA

SEQ ID NO: 113996 - protein, 10 aa, Artificial Sequence
  Description of Artificial Sequence: Synthetic peptide
  Seed: EEAAGIGILT (MAR1_HUMAN)
ESAAGIGILV

SEQ ID NO: 113997 - protein, 9 aa, Artificial Sequence
  Description of Artificial Sequence: Synthetic peptide
  Seed: ALMDKSLHV (MAR1_HUMAN)
AMMDKSLHI

SEQ ID NO: 113998 - protein, 9 aa, Artificial Sequence
  Description of Artificial Sequence: Synthetic peptide
  Seed: MPREDAHFI (MAR1_HUMAN)
MAREDAHFF

SEQ ID NO: 113999 - protein, 11 aa, Artificial Sequence
  Description of Artificial Sequence: Synthetic peptide
  Seed: YRALMDKSLHV (MAR1_HUMAN)
YYALMDKSLHA

SEQ ID NO: 114000 - protein, 10 aa, Artificial Sequence
  Description of Artificial Sequence: Synthetic peptide
  Seed: YTTAEEAAGI (MAR1_HUMAN)
YLTAEEAAGI

SEQ ID NO: 114001 - protein, 9 aa, Artificial Sequence
  Description of Artificial Sequence: Synthetic peptide
  Seed: VILGVLLLI (MAR1_HUMAN)
VSLGVLLLR

SEQ ID NO: 114002 - protein, 10 aa, Artificial Sequence
  Description of Artificial Sequence: Synthetic peptide
  Seed: APPAYEKLSA (MAR1_HUMAN)
AMPAYEKLSM

SEQ ID NO: 114003 - protein, 9 aa, Artificial Sequence
  Description of Artificial Sequence: Synthetic peptide
  Seed: VVPNAPPAY (MAR1_HUMAN)
VIPNAPPAI

SEQ ID NO: 114004 - protein, 9 aa, Artificial Sequence
  Description of Artificial Sequence: Synthetic peptide
  Seed: RRNGYRALM (MAR1_HUMAN)
RLNGYRALF

SEQ ID NO: 114005 - protein, 10 aa, Artificial Sequence
  Description of Artificial Sequence: Synthetic peptide
  Seed: RRRNGYRALM (MAR1_HUMAN)
RVRNGYRALK

SEQ ID NO: 114006 - protein, 10 aa, Artificial Sequence
  Description of Artificial Sequence: Synthetic peptide
  Seed: TVILGVLLLI (MAR1_HUMAN)
TQILGVLLLI

SEQ ID NO: 114007 - protein, 9 aa, Artificial Sequence
  Description of Artificial Sequence: Synthetic peptide
  Seed: RRRNGYRAL (MAR1_HUMAN)
RHRNGYRAM

SEQ ID NO: 114008 - protein, 10 aa, Artificial Sequence
  Description of Artificial Sequence: Synthetic peptide
  Seed: TVILGVLLLI (MAR1_HUMAN)
TLILGVLLLA

SEQ ID NO: 114009 - protein, 10 aa, Artificial Sequence
  Description of Artificial Sequence: Synthetic peptide
  Seed: YTTAEEAAGI (MAR1_HUMAN)
YATAEEAAGI

SEQ ID NO: 114010 - protein, 9 aa, Artificial Sequence
  Description of Artificial Sequence: Synthetic peptide
  Seed: REDAHFIYG (MAR1_HUMAN)
REDAHFIYL

SEQ ID NO: 114011 - protein, 9 aa, Artificial Sequence
  Description of Artificial Sequence: Synthetic peptide
  Seed: EAAGIGILT (MAR1_HUMAN)
EMAGIGILV

SEQ ID NO: 114012 - protein, 8 aa, Artificial Sequence
  Description of Artificial Sequence: Synthetic peptide
  Seed: HRDSKVSL (MAR1_HUMAN)
HWDSKVSM

SEQ ID NO: 114013 - protein, 9 aa, Artificial Sequence
  Description of Artificial Sequence: Synthetic peptide
  Seed: AHFIYGYPK (MAR1_HUMAN)
AGFIYGYPR

SEQ ID NO: 114014 - protein, 9 aa, Artificial Sequence
  Description of Artificial Sequence: Synthetic peptide
  Seed: HSYTTAEEA (MAR1_HUMAN)
HAYTTAEEL

SEQ ID NO: 114015 - protein, 9 aa, Artificial Sequence
  Description of Artificial Sequence: Synthetic peptide
  Seed: HSYTTAEEA (MAR1_HUMAN)
HQYTTAEEL

SEQ ID NO: 114016 - protein, 10 aa, Artificial Sequence
  Description of Artificial Sequence: Synthetic peptide
  Seed: YGYPKKGHGH (MAR1_HUMAN)
YVYPKKGHGF

SEQ ID NO: 114017 - protein, 11 aa, Artificial Sequence
  Description of Artificial Sequence: Synthetic peptide
  Seed: TTAEEAAGIGI (MAR1_HUMAN)
TTAEEAAGIGF

SEQ ID NO: 114018 - protein, 10 aa, Artificial Sequence
  Description of Artificial Sequence: Synthetic peptide
  Seed: AEQSPPPYSP (MAR1_HUMAN)
AEQSPPPYSA

SEQ ID NO: 114019 - protein, 10 aa, Artificial Sequence
  Description of Artificial Sequence: Synthetic peptide
  Seed: GILTVILGVL (MAR1_HUMAN)
GLLTVILGVA

SEQ ID NO: 114020 - protein, 11 aa, Artificial Sequence
  Description of Artificial Sequence: Synthetic peptide
  Seed: TTAEEAAGIGI (MAR1_HUMAN)
TLAEEAAGIGL

SEQ ID NO: 114021 - protein, 10 aa, Artificial Sequence
  Description of Artificial Sequence: Synthetic peptide
  Seed: RALMDKSLHV (MAR1_HUMAN)
RSLMDKSLHA

SEQ ID NO: 114022 - protein, 9 aa, Artificial Sequence
  Description of Artificial Sequence: Synthetic peptide
  Seed: AAGIGILTV (MAR1_HUMAN)
ARGIGILTM

SEQ ID NO: 114023 - protein, 9 aa, Artificial Sequence
  Description of Artificial Sequence: Synthetic peptide
  Seed: EGFDHRDSK (MAR1_HUMAN)
ESFDHRDSK

SEQ ID NO: 114024 - protein, 9 aa, Artificial Sequence
  Description of Artificial Sequence: Synthetic peptide
  Seed: RRNGYRALM (MAR1_HUMAN)
RHNGYRALF

SEQ ID NO: 114025 - protein, 9 aa, Artificial Sequence
  Description of Artificial Sequence: Synthetic peptide
  Seed: ALMDKSLHV (MAR1_HUMAN)
ARMDKSLHI

SEQ ID NO: 114026 - protein, 8 aa, Artificial Sequence
  Description of Artificial Sequence: Synthetic peptide
  Seed: LMDKSLHV (MAR1_HUMAN)
LVDKSLHF

SEQ ID NO: 114027 - protein, 9 aa, Artificial Sequence
  Description of Artificial Sequence: Synthetic peptide
  Seed: RRRNGYRAL (MAR1_HUMAN)
RKRNGYRAL

SEQ ID NO: 114028 - protein, 10 aa, Artificial Sequence
  Description of Artificial Sequence: Synthetic peptide
  Seed: RRRNGYRALM (MAR1_HUMAN)
RSRNGYRALM

SEQ ID NO: 114029 - protein, 8 aa, Artificial Sequence
  Description of Artificial Sequence: Synthetic peptide
  Seed: LMDKSLHV (MAR1_HUMAN)
LFDKSLHV

SEQ ID NO: 114030 - protein, 10 aa, Artificial Sequence
  Description of Artificial Sequence: Synthetic peptide
  Seed: APPAYEKLSA (MAR1_HUMAN)
ARPAYEKLSL

SEQ ID NO: 114031 - protein, 9 aa, Artificial Sequence
  Description of Artificial Sequence: Synthetic peptide
  Seed: TTAEEAAGI (MAR1_HUMAN)
TVAEEAAGL

SEQ ID NO: 114032 - protein, 9 aa, Artificial Sequence
  Description of Artificial Sequence: Synthetic peptide
  Seed: VVPNAPPAY (MAR1_HUMAN)
VVPNAPPAI

SEQ ID NO: 114033 - protein, 10 aa, Artificial Sequence
  Description of Artificial Sequence: Synthetic peptide
  Seed: RRRNGYRALM (MAR1_HUMAN)
RARNGYRALM

SEQ ID NO: 114034 - protein, 9 aa, Artificial Sequence
  Description of Artificial Sequence: Synthetic peptide
  Seed: AHFIYGYPK (MAR1_HUMAN)
AVFIYGYPR

SEQ ID NO: 114035 - protein, 9 aa, Artificial Sequence
  Description of Artificial Sequence: Synthetic peptide
  Seed: YRALMDKSL (MAR1_HUMAN)
YAALMDKSY

SEQ ID NO: 114036 - protein, 9 aa, Artificial Sequence
  Description of Artificial Sequence: Synthetic peptide
  Seed: HSYTTAEEA (MAR1_HUMAN)
HMYTTAEEF

SEQ ID NO: 114037 - protein, 10 aa, Artificial Sequence
  Description of Artificial Sequence: Synthetic peptide
  Seed: RALMDKSLHV (MAR1_HUMAN)
RHLMDKSLHV

SEQ ID NO: 114038 - protein, 10 aa, Artificial Sequence
  Description of Artificial Sequence: Synthetic peptide
  Seed: KGHGHSYTTA (MAR1_HUMAN)
KSHGHSYTTA

SEQ ID NO: 114039 - protein, 10 aa, Artificial Sequence
  Description of Artificial Sequence: Synthetic peptide
  Seed: YPKKGHGHSY (MAR1_HUMAN)
YQKKGHGHSF

SEQ ID NO: 114040 - protein, 10 aa, Artificial Sequence
  Description of Artificial Sequence: Synthetic peptide
  Seed: RRRNGYRALM (MAR1_HUMAN)
RPRNGYRALF

SEQ ID NO: 114041 - protein, 9 aa, Artificial Sequence
  Description of Artificial Sequence: Synthetic peptide
  Seed: TTAEEAAGI (MAR1_HUMAN)
TAAEEAAGV

SEQ ID NO: 114042 - protein, 9 aa, Artificial Sequence
  Description of Artificial Sequence: Synthetic peptide
  Seed: LHVGTQCAL (MAR1_HUMAN)
LHVGTQCAI

SEQ ID NO: 114043 - protein, 10 aa, Artificial Sequence
  Description of Artificial Sequence: Synthetic peptide
  Seed: LLLIGCWYCR (MAR1_HUMAN)
LHLIGCWYCR

SEQ ID NO: 114044 - protein, 9 aa, Artificial Sequence
  Description of Artificial Sequence: Synthetic peptide
  Seed: KSLHVGTQC (MAR1_HUMAN)
KTLHVGTQW

SEQ ID NO: 114045 - protein, 8 aa, Artificial Sequence
  Description of Artificial Sequence: Synthetic peptide
  Seed: LMDKSLHV (MAR1_HUMAN)
LADKSLHM

SEQ ID NO: 114046 - protein, 9 aa, Artificial Sequence
  Description of Artificial Sequence: Synthetic peptide
  Seed: TTAEEAAGI (MAR1_HUMAN)
TSAEEAAGV

SEQ ID NO: 114047 - protein, 9 aa, Artificial Sequence
  Description of Artificial Sequence: Synthetic peptide
  Seed: GFDHRDSKV (MAR1_HUMAN)
GWDHRDSKM

SEQ ID NO: 114048 - protein, 9 aa, Artificial Sequence
  Description of Artificial Sequence: Synthetic peptide
  Seed: VILGVLLLI (MAR1_HUMAN)
VILGVLLLF

SEQ ID NO: 114049 - protein, 11 aa, Artificial Sequence
  Description of Artificial Sequence: Synthetic peptide
  Seed: RALMDKSLHVG (MAR1_HUMAN)
RSLMDKSLHVL

SEQ ID NO: 114050 - protein, 10 aa, Artificial Sequence
  Description of Artificial Sequence: Synthetic peptide
  Seed: RALMDKSLHV (MAR1_HUMAN)
RALMDKSLHI

SEQ ID NO: 114051 - protein, 9 aa, Artificial Sequence
  Description of Artificial Sequence: Synthetic peptide
  Seed: VVPNAPPAY (MAR1_HUMAN)
VCPNAPPAI

SEQ ID NO: 114052 - protein, 9 aa, Artificial Sequence
  Description of Artificial Sequence: Synthetic peptide
  Seed: GILTVILGV (MAR1_HUMAN)
GMLTVILGA

SEQ ID NO: 114053 - protein, 9 aa, Artificial Sequence
  Description of Artificial Sequence: Synthetic peptide
  Seed: EDAHFIYGY (MAR1_HUMAN)
ETAHFIYGF

SEQ ID NO: 114054 - protein, 10 aa, Artificial Sequence
  Description of Artificial Sequence: Synthetic peptide
  Seed: RALMDKSLHV (MAR1_HUMAN)
RLLMDKSLHL

SEQ ID NO: 114055 - protein, 9 aa, Artificial Sequence
  Description of Artificial Sequence: Synthetic peptide
  Seed: RRNGYRALM (MAR1_HUMAN)
RSNGYRALF

SEQ ID NO: 114056 - protein, 10 aa, Artificial Sequence
  Description of Artificial Sequence: Synthetic peptide
  Seed: APPAYEKLSA (MAR1_HUMAN)
ANPAYEKLSM

SEQ ID NO: 114057 - protein, 9 aa, Artificial Sequence
  Description of Artificial Sequence: Synthetic peptide
  Seed: RRRNGYRAL (MAR1_HUMAN)
RIRNGYRAF

SEQ ID NO: 114058 - protein, 9 aa, Artificial Sequence
  Description of Artificial Sequence: Synthetic peptide
  Seed: TVILGVLLL (MAR1_HUMAN)
TTILGVLLV

SEQ ID NO: 114059 - protein, 9 aa, Artificial Sequence
  Description of Artificial Sequence: Synthetic peptide
  Seed: HSYTTAEEA (MAR1_HUMAN)
HGYTTAEEF

SEQ ID NO: 114060 - protein, 10 aa, Artificial Sequence
  Description of Artificial Sequence: Synthetic peptide
  Seed: EEAAGIGILT (MAR1_HUMAN)
ESAAGIGILL

SEQ ID NO: 114061 - protein, 9 aa, Artificial Sequence
  Description of Artificial Sequence: Synthetic peptide
  Seed: ALMDKSLHV (MAR1_HUMAN)
AQMDKSLHA

SEQ ID NO: 114062 - protein, 8 aa, Artificial Sequence
  Description of Artificial Sequence: Synthetic peptide
  Seed: HRDSKVSL (MAR1_HUMAN)
HYDSKVSF

SEQ ID NO: 114063 - protein, 9 aa, Artificial Sequence
  Description of Artificial Sequence: Synthetic peptide
  Seed: VVPNAPPAY (MAR1_HUMAN)
VWPNAPPAY

SEQ ID NO: 114064 - protein, 11 aa, Artificial Sequence
  Description of Artificial Sequence: Synthetic peptide
  Seed: YCRRRNGYRAL (MAR1_HUMAN)
YARRRNGYRAL

SEQ ID NO: 114065 - protein, 9 aa, Artificial Sequence
  Description of Artificial Sequence: Synthetic peptide
  Seed: VVPNAPPAY (MAR1_HUMAN)
VNPNAPPAM

SEQ ID NO: 114066 - protein, 10 aa, Artificial Sequence
  Description of Artificial Sequence: Synthetic peptide
  Seed: EAAGIGILTV (MAR1_HUMAN)
EAAGIGILTI

SEQ ID NO: 114067 - protein, 9 aa, Artificial Sequence
  Description of Artificial Sequence: Synthetic peptide
  Seed: NAPPAYEKL (MAR1_HUMAN)
NVPPAYEKM

SEQ ID NO: 114068 - protein, 9 aa, Artificial Sequence
  Description of Artificial Sequence: Synthetic peptide
  Seed: MPREDAHFI (MAR1_HUMAN)
MLREDAHFY

SEQ ID NO: 114069 - protein, 10 aa, Artificial Sequence
  Description of Artificial Sequence: Synthetic peptide
  Seed: RALMDKSLHV (MAR1_HUMAN)
RSLMDKSLHL

SEQ ID NO: 114070 - protein, 9 aa, Artificial Sequence
  Description of Artificial Sequence: Synthetic peptide
  Seed: REDAHFIYG (MAR1_HUMAN)
REDAHFIYM

SEQ ID NO: 114071 - protein, 9 aa, Artificial Sequence
  Description of Artificial Sequence: Synthetic peptide
  Seed: TTAEEAAGI (MAR1_HUMAN)
TVAEEAAGV

SEQ ID NO: 114072 - protein, 10 aa, Artificial Sequence
  Description of Artificial Sequence: Synthetic peptide
  Seed: EAAGIGILTV (MAR1_HUMAN)
ETAGIGILTM

SEQ ID NO: 114073 - protein, 10 aa, Artificial Sequence
  Description of Artificial Sequence: Synthetic peptide
  Seed: MPREDAHFIY (MAR1_HUMAN)
MHREDAHFIY

SEQ ID NO: 114074 - protein, 9 aa, Artificial Sequence
  Description of Artificial Sequence: Synthetic peptide
  Seed: KSLHVGTQC (MAR1_HUMAN)
KALHVGTQW

SEQ ID NO: 114075 - protein, 9 aa, Artificial Sequence
  Description of Artificial Sequence: Synthetic peptide
  Seed: HSYTTAEEA (MAR1_HUMAN)
HHYTTAEEM

SEQ ID NO: 114076 - protein, 9 aa, Artificial Sequence
  Description of Artificial Sequence: Synthetic peptide
  Seed: GILTVILGV (MAR1_HUMAN)
GVLTVILGR

SEQ ID NO: 114077 - protein, 10 aa, Artificial Sequence
  Description of Artificial Sequence: Synthetic peptide
  Seed: YTTAEEAAGI (MAR1_HUMAN)
YWTAEEAAGV

SEQ ID NO: 114078 - protein, 9 aa, Artificial Sequence
  Description of Artificial Sequence: Synthetic peptide
  Seed: RRRNGYRAL (MAR1_HUMAN)
RARNGYRAF

SEQ ID NO: 114079 - protein, 9 aa, Artificial Sequence
  Description of Artificial Sequence: Synthetic peptide
  Seed: YRALMDKSL (MAR1_HUMAN)
YHALMDKSF

SEQ ID NO: 114080 - protein, 11 aa, Artificial Sequence
  Description of Artificial Sequence: Synthetic peptide
  Seed: YRALMDKSLHV (MAR1_HUMAN)
YIALMDKSLHV

SEQ ID NO: 114081 - protein, 8 aa, Artificial Sequence
  Description of Artificial Sequence: Synthetic peptide
  Seed: LMDKSLHV (MAR1_HUMAN)
LYDKSLHV

SEQ ID NO: 114082 - protein, 10 aa, Artificial Sequence
  Description of Artificial Sequence: Synthetic peptide
  Seed: EAAGIGILTV (MAR1_HUMAN)
EIAGIGILTR

SEQ ID NO: 114083 - protein, 10 aa, Artificial Sequence
  Description of Artificial Sequence: Synthetic peptide
  Seed: RRRNGYRALM (MAR1_HUMAN)
RFRNGYRALY

SEQ ID NO: 114084 - protein, 10 aa, Artificial Sequence
  Description of Artificial Sequence: Synthetic peptide
  Seed: MPREDAHFIY (MAR1_HUMAN)
MPREDAHFIM

SEQ ID NO: 114085 - protein, 10 aa, Artificial Sequence
  Description of Artificial Sequence: Synthetic peptide
  Seed: RALMDKSLHV (MAR1_HUMAN)
RWLMDKSLHL

SEQ ID NO: 114086 - protein, 8 aa, Artificial Sequence
  Description of Artificial Sequence: Synthetic peptide
  Seed: LMDKSLHV (MAR1_HUMAN)
LGDKSLHL

SEQ ID NO: 114087 - protein, 9 aa, Artificial Sequence
  Description of Artificial Sequence: Synthetic peptide
  Seed: LLIGCWYCR (MAR1_HUMAN)
LNIGCWYCR

SEQ ID NO: 114088 - protein, 10 aa, Artificial Sequence
  Description of Artificial Sequence: Synthetic peptide
  Seed: RRRNGYRALM (MAR1_HUMAN)
RWRNGYRALF

SEQ ID NO: 114089 - protein, 10 aa, Artificial Sequence
  Description of Artificial Sequence: Synthetic peptide
  Seed: EAAGIGILTV (MAR1_HUMAN)
ELAGIGILTR

SEQ ID NO: 114090 - protein, 9 aa, Artificial Sequence
  Description of Artificial Sequence: Synthetic peptide
  Seed: VILGVLLLI (MAR1_HUMAN)
VMLGVLLLK

SEQ ID NO: 114091 - protein, 9 aa, Artificial Sequence
  Description of Artificial Sequence: Synthetic peptide
  Seed: ALMDKSLHV (MAR1_HUMAN)
AFMDKSLHY

SEQ ID NO: 114092 - protein, 9 aa, Artificial Sequence
  Description of Artificial Sequence: Synthetic peptide
  Seed: ILTVILGVL (MAR1_HUMAN)
IMTVILGVV

SEQ ID NO: 114093 - protein, 10 aa, Artificial Sequence
  Description of Artificial Sequence: Synthetic peptide
  Seed: REDAHFIYGY (MAR1_HUMAN)
RWDAHFIYGY

SEQ ID NO: 114094 - protein, 9 aa, Artificial Sequence
  Description of Artificial Sequence: Synthetic peptide
  Seed: VILGVLLLI (MAR1_HUMAN)
VALGVLLLY

SEQ ID NO: 114095 - protein, 10 aa, Artificial Sequence
  Description of Artificial Sequence: Synthetic peptide
  Seed: LLIGCWYCRR (MAR1_HUMAN)
LMIGCWYCRR

SEQ ID NO: 114096 - protein, 9 aa, Artificial Sequence
  Description of Artificial Sequence: Synthetic peptide
  Seed: VGTQCALTR (MAR1_HUMAN)
VMTQCALTR

SEQ ID NO: 114097 - protein, 11 aa, Artificial Sequence
  Description of Artificial Sequence: Synthetic peptide
  Seed: MPREDAHFIYG (MAR1_HUMAN)
MPREDAHFIYA

SEQ ID NO: 114098 - protein, 10 aa, Artificial Sequence
  Description of Artificial Sequence: Synthetic peptide
  Seed: YGYPKKGHGH (MAR1_HUMAN)
YSYPKKGHGF

SEQ ID NO: 114099 - protein, 9 aa, Artificial Sequence
  Description of Artificial Sequence: Synthetic peptide
  Seed: VVPNAPPAY (MAR1_HUMAN)
VPPNAPPAM

SEQ ID NO: 114100 - protein, 9 aa, Artificial Sequence
  Description of Artificial Sequence: Synthetic peptide
  Seed: RRRNGYRAL (MAR1_HUMAN)
RYRNGYRAM

SEQ ID NO: 114101 - protein, 9 aa, Artificial Sequence
  Description of Artificial Sequence: Synthetic peptide
  Seed: DSKVSLQEK (MAR1_HUMAN)
DTKVSLQEK

SEQ ID NO: 114102 - protein, 9 aa, Artificial Sequence
  Description of Artificial Sequence: Synthetic peptide
  Seed: VILGVLLLI (MAR1_HUMAN)
VTLGVLLLY

SEQ ID NO: 114103 - protein, 9 aa, Artificial Sequence
  Description of Artificial Sequence: Synthetic peptide
  Seed: GFDHRDSKV (MAR1_HUMAN)
GYDHRDSKM

SEQ ID NO: 114104 - protein, 9 aa, Artificial Sequence
  Description of Artificial Sequence: Synthetic peptide
  Seed: AGIGILTVI (MAR1_HUMAN)
AVIGILTVA

SEQ ID NO: 114105 - protein, 10 aa, Artificial Sequence
  Description of Artificial Sequence: Synthetic peptide
  Seed: YTTAEEAAGI (MAR1_HUMAN)
YPTAEEAAGV

SEQ ID NO: 114106 - protein, 10 aa, Artificial Sequence
  Description of Artificial Sequence: Synthetic peptide
  Seed: REDAHFIYGY (MAR1_HUMAN)
RSDAHFIYGY

SEQ ID NO: 114107 - protein, 9 aa, Artificial Sequence
  Description of Artificial Sequence: Synthetic peptide
  Seed: VILGVLLLI (MAR1_HUMAN)
VTLGVLLLR

SEQ ID NO: 114108 - protein, 10 aa, Artificial Sequence
  Description of Artificial Sequence: Synthetic peptide
  Seed: VPNAPPAYEK (MAR1_HUMAN)
VPNAPPAYET

SEQ ID NO: 114109 - protein, 9 aa, Artificial Sequence
  Description of Artificial Sequence: Synthetic peptide
  Seed: HSYTTAEEA (MAR1_HUMAN)
HAYTTAEEI

SEQ ID NO: 114110 - protein, 9 aa, Artificial Sequence
  Description of Artificial Sequence: Synthetic peptide
  Seed: AEQSPPPYS (MAR1_HUMAN)
AEQSPPPYP

SEQ ID NO: 114111 - protein, 10 aa, Artificial Sequence
  Description of Artificial Sequence: Synthetic peptide
  Seed: EAAGIGILTV (MAR1_HUMAN)
ETAGIGILTV

SEQ ID NO: 114112 - protein, 9 aa, Artificial Sequence
  Description of Artificial Sequence: Synthetic peptide
  Seed: TVILGVLLL (MAR1_HUMAN)
TSILGVLLM

SEQ ID NO: 114113 - protein, 10 aa, Artificial Sequence
  Description of Artificial Sequence: Synthetic peptide
  Seed: LSAEQSPPPY (MAR1_HUMAN)
LAAEQSPPPY

SEQ ID NO: 114114 - protein, 9 aa, Artificial Sequence
  Description of Artificial Sequence: Synthetic peptide
  Seed: GILTVILGV (MAR1_HUMAN)
GLLTVILGL

SEQ ID NO: 114115 - protein, 9 aa, Artificial Sequence
  Description of Artificial Sequence: Synthetic peptide
  Seed: ALMDKSLHV (MAR1_HUMAN)
AMMDKSLHM

SEQ ID NO: 114116 - protein, 10 aa, Artificial Sequence
  Description of Artificial Sequence: Synthetic peptide
  Seed: LLIGCWYCRR (MAR1_HUMAN)
LWIGCWYCRK

SEQ ID NO: 114117 - protein, 11 aa, Artificial Sequence
  Description of Artificial Sequence: Synthetic peptide
  Seed: KSLHVGTQCAL (MAR1_HUMAN)
KVLHVGTQCAW

SEQ ID NO: 114118 - protein, 9 aa, Artificial Sequence
  Description of Artificial Sequence: Synthetic peptide
  Seed: VILGVLLLI (MAR1_HUMAN)
VALGVLLLV

SEQ ID NO: 114119 - protein, 9 aa, Artificial Sequence
  Description of Artificial Sequence: Synthetic peptide
  Seed: ALMDKSLHV (MAR1_HUMAN)
AGMDKSLHF

SEQ ID NO: 114120 - protein, 9 aa, Artificial Sequence
  Description of Artificial Sequence: Synthetic peptide
  Seed: LLLIGCWYC (MAR1_HUMAN)
LILIGCWYA

SEQ ID NO: 114121 - protein, 9 aa, Artificial Sequence
  Description of Artificial Sequence: Synthetic peptide
  Seed: AGIGILTVI (MAR1_HUMAN)
ATIGILTVM

SEQ ID NO: 114122 - protein, 11 aa, Artificial Sequence
  Description of Artificial Sequence: Synthetic peptide
  Seed: EEAAGIGILTV (MAR1_HUMAN)
EEAAGIGILTL

SEQ ID NO: 114123 - protein, 10 aa, Artificial Sequence
  Description of Artificial Sequence: Synthetic peptide
  Seed: DAHFIYGYPK (MAR1_HUMAN)
DLHFIYGYPR

SEQ ID NO: 114124 - protein, 9 aa, Artificial Sequence
  Description of Artificial Sequence: Synthetic peptide
  Seed: KSLHVGTQC (MAR1_HUMAN)
KSLHVGTQL

SEQ ID NO: 114125 - protein, 10 aa, Artificial Sequence
  Description of Artificial Sequence: Synthetic peptide
  Seed: ALMDKSLHVG (MAR1_HUMAN)
ALMDKSLHVV

SEQ ID NO: 114126 - protein, 10 aa, Artificial Sequence
  Description of Artificial Sequence: Synthetic peptide
  Seed: SLHVGTQCAL (MAR1_HUMAN)
SQHVGTQCAY

SEQ ID NO: 114127 - protein, 9 aa, Artificial Sequence
  Description of Artificial Sequence: Synthetic peptide
  Seed: ALMDKSLHV (MAR1_HUMAN)
AIMDKSLHR

SEQ ID NO: 114128 - protein, 9 aa, Artificial Sequence
  Description of Artificial Sequence: Synthetic peptide
  Seed: AGIGILTVI (MAR1_HUMAN)
ASIGILTVM

SEQ ID NO: 114129 - protein, 11 aa, Artificial Sequence
  Description of Artificial Sequence: Synthetic peptide
  Seed: KSLHVGTQCAL (MAR1_HUMAN)
KTLHVGTQCAF

SEQ ID NO: 114130 - protein, 11 aa, Artificial Sequence
  Description of Artificial Sequence: Synthetic peptide
  Seed: YRALMDKSLHV (MAR1_HUMAN)
YAALMDKSLHM

SEQ ID NO: 114131 - protein, 9 aa, Artificial Sequence
  Description of Artificial Sequence: Synthetic peptide
  Seed: AAGIGILTV (MAR1_HUMAN)
AQGIGILTW

SEQ ID NO: 114132 - protein, 11 aa, Artificial Sequence
  Description of Artificial Sequence: Synthetic peptide
  Seed: YRALMDKSLHV (MAR1_HUMAN)
YHALMDKSLHV

SEQ ID NO: 114133 - protein, 9 aa, Artificial Sequence
  Description of Artificial Sequence: Synthetic peptide
  Seed: AGIGILTVI (MAR1_HUMAN)
ASIGILTVL

SEQ ID NO: 114134 - protein, 10 aa, Artificial Sequence
  Description of Artificial Sequence: Synthetic peptide
  Seed: GILTVILGVL (MAR1_HUMAN)
GLLTVILGVM

SEQ ID NO: 114135 - protein, 9 aa, Artificial Sequence
  Description of Artificial Sequence: Synthetic peptide
  Seed: EQSPPPYSP (MAR1_HUMAN)
EHSPPPYSI

SEQ ID NO: 114136 - protein, 8 aa, Artificial Sequence
  Description of Artificial Sequence: Synthetic peptide
  Seed: LMDKSLHV (MAR1_HUMAN)
LSDKSLHM

SEQ ID NO: 114137 - protein, 10 aa, Artificial Sequence
  Description of Artificial Sequence: Synthetic peptide
  Seed: RRRNGYRALM (MAR1_HUMAN)
RMRNGYRALK

SEQ ID NO: 114138 - protein, 10 aa, Artificial Sequence
  Description of Artificial Sequence: Synthetic peptide
  Seed: EEAAGIGILT (MAR1_HUMAN)
EYAAGIGILI

SEQ ID NO: 114139 - protein, 9 aa, Artificial Sequence
  Description of Artificial Sequence: Synthetic peptide
  Seed: RRRNGYRAL (MAR1_HUMAN)
RHRNGYRAF

SEQ ID NO: 114140 - protein, 9 aa, Artificial Sequence
  Description of Artificial Sequence: Synthetic peptide
  Seed: EGFDHRDSK (MAR1_HUMAN)
EWFDHRDSR

SEQ ID NO: 114141 - protein, 10 aa, Artificial Sequence
  Description of Artificial Sequence: Synthetic peptide
  Seed: YTTAEEAAGI (MAR1_HUMAN)
YCTAEEAAGI

SEQ ID NO: 114142 - protein, 9 aa, Artificial Sequence
  Description of Artificial Sequence: Synthetic peptide
  Seed: LLIGCWYCR (MAR1_HUMAN)
LMIGCWYCK

SEQ ID NO: 114143 - protein, 11 aa, Artificial Sequence
  Description of Artificial Sequence: Synthetic peptide
  Seed: YRALMDKSLHV (MAR1_HUMAN)
YGALMDKSLHV

SEQ ID NO: 114144 - protein, 10 aa, Artificial Sequence
  Description of Artificial Sequence: Synthetic peptide
  Seed: EAAGIGILTV (MAR1_HUMAN)
EAAGIGILTA

SEQ ID NO: 114145 - protein, 9 aa, Artificial Sequence
  Description of Artificial Sequence: Synthetic peptide
  Seed: VVPNAPPAY (MAR1_HUMAN)
VFPNAPPAF

SEQ ID NO: 114146 - protein, 9 aa, Artificial Sequence
  Description of Artificial Sequence: Synthetic peptide
  Seed: ALMDKSLHV (MAR1_HUMAN)
ALMDKSLHW

SEQ ID NO: 114147 - protein, 9 aa, Artificial Sequence
  Description of Artificial Sequence: Synthetic peptide
  Seed: EAAGIGILT (MAR1_HUMAN)
ECAGIGILV

SEQ ID NO: 114148 - protein, 10 aa, Artificial Sequence
  Description of Artificial Sequence: Synthetic peptide
  Seed: EEAAGIGILT (MAR1_HUMAN)
EHAAGIGILI

SEQ ID NO: 114149 - protein, 9 aa, Artificial Sequence
  Description of Artificial Sequence: Synthetic peptide
  Seed: YRALMDKSL (MAR1_HUMAN)
YLALMDKSF

SEQ ID NO: 114150 - protein, 9 aa, Artificial Sequence
  Description of Artificial Sequence: Synthetic peptide
  Seed: AGIGILTVI (MAR1_HUMAN)
AIIGILTVY

SEQ ID NO: 114151 - protein, 10 aa, Artificial Sequence
  Description of Artificial Sequence: Synthetic peptide
  Seed: ALMDKSLHVG (MAR1_HUMAN)
AAMDKSLHVL

SEQ ID NO: 114152 - protein, 9 aa, Artificial Sequence
  Description of Artificial Sequence: Synthetic peptide
  Seed: VVPNAPPAY (MAR1_HUMAN)
VSPNAPPAL

SEQ ID NO: 114153 - protein, 10 aa, Artificial Sequence
  Description of Artificial Sequence: Synthetic peptide
  Seed: RALMDKSLHV (MAR1_HUMAN)
RFLMDKSLHV

SEQ ID NO: 114154 - protein, 9 aa, Artificial Sequence
  Description of Artificial Sequence: Synthetic peptide
  Seed: DSKVSLQEK (MAR1_HUMAN)
DMKVSLQER

SEQ ID NO: 114155 - protein, 8 aa, Artificial Sequence
  Description of Artificial Sequence: Synthetic peptide
  Seed: LMDKSLHV (MAR1_HUMAN)
LDDKSLHL

SEQ ID NO: 114156 - protein, 9 aa, Artificial Sequence
  Description of Artificial Sequence: Synthetic peptide
  Seed: RRNGYRALM (MAR1_HUMAN)
RWNGYRALM

SEQ ID NO: 114157 - protein, 10 aa, Artificial Sequence
  Description of Artificial Sequence: Synthetic peptide
  Seed: EEAAGIGILT (MAR1_HUMAN)
ECAAGIGILV

SEQ ID NO: 114158 - protein, 10 aa, Artificial Sequence
  Description of Artificial Sequence: Synthetic peptide
  Seed: RRRNGYRALM (MAR1_HUMAN)
RLRNGYRALM

SEQ ID NO: 114159 - protein, 11 aa, Artificial Sequence
  Description of Artificial Sequence: Synthetic peptide
  Seed: MPREDAHFIYG (MAR1_HUMAN)
MPREDAHFIYY

SEQ ID NO: 114160 - protein, 10 aa, Artificial Sequence
  Description of Artificial Sequence: Synthetic peptide
  Seed: RRRNGYRALM (MAR1_HUMAN)
RARNGYRALL

SEQ ID NO: 114161 - protein, 9 aa, Artificial Sequence
  Description of Artificial Sequence: Synthetic peptide
  Seed: AGIGILTVI (MAR1_HUMAN)
AAIGILTVM

SEQ ID NO: 114162 - protein, 9 aa, Artificial Sequence
  Description of Artificial Sequence: Synthetic peptide
  Seed: ALMDKSLHV (MAR1_HUMAN)
AHMDKSLHL

SEQ ID NO: 114163 - protein, 9 aa, Artificial Sequence
  Description of Artificial Sequence: Synthetic peptide
  Seed: AGIGILTVI (MAR1_HUMAN)
ASIGILTVF

SEQ ID NO: 114164 - protein, 10 aa, Artificial Sequence
  Description of Artificial Sequence: Synthetic peptide
  Seed: TVILGVLLLI (MAR1_HUMAN)
TMILGVLLLI

SEQ ID NO: 114165 - protein, 9 aa, Artificial Sequence
  Description of Artificial Sequence: Synthetic peptide
  Seed: VVPNAPPAY (MAR1_HUMAN)
VSPNAPPAM

SEQ ID NO: 114166 - protein, 10 aa, Artificial Sequence
  Description of Artificial Sequence: Synthetic peptide
  Seed: APPAYEKLSA (MAR1_HUMAN)
ACPAYEKLSM

SEQ ID NO: 114167 - protein, 11 aa, Artificial Sequence
  Description of Artificial Sequence: Synthetic peptide
  Seed: YRALMDKSLHV (MAR1_HUMAN)
YTALMDKSLHM

SEQ ID NO: 114168 - protein, 9 aa, Artificial Sequence
  Description of Artificial Sequence: Synthetic peptide
  Seed: GFDHRDSKV (MAR1_HUMAN)
GWDHRDSKL

SEQ ID NO: 114169 - protein, 9 aa, Artificial Sequence
  Description of Artificial Sequence: Synthetic peptide
  Seed: VILGVLLLI (MAR1_HUMAN)
VALGVLLLM

SEQ ID NO: 114170 - protein, 10 aa, Artificial Sequence
  Description of Artificial Sequence: Synthetic peptide
  Seed: LSAEQSPPPY (MAR1_HUMAN)
LTAEQSPPPF

SEQ ID NO: 114171 - protein, 9 aa, Artificial Sequence
  Description of Artificial Sequence: Synthetic peptide
  Seed: AHFIYGYPK (MAR1_HUMAN)
AWFIYGYPK

SEQ ID NO: 114172 - protein, 10 aa, Artificial Sequence
  Description of Artificial Sequence: Synthetic peptide
  Seed: YPKKGHGHSY (MAR1_HUMAN)
YAKKGHGHSM

SEQ ID NO: 114173 - protein, 10 aa, Artificial Sequence
  Description of Artificial Sequence: Synthetic peptide
  Seed: REDAHFIYGY (MAR1_HUMAN)
RFDAHFIYGY

SEQ ID NO: 114174 - protein, 11 aa, Artificial Sequence
  Description of Artificial Sequence: Synthetic peptide
  Seed: CWYCRRRNGYR (MAR1_HUMAN)
CVYCRRRNGYR

SEQ ID NO: 114175 - protein, 9 aa, Artificial Sequence
  Description of Artificial Sequence: Synthetic peptide
  Seed: YRALMDKSL (MAR1_HUMAN)
YHALMDKSA

SEQ ID NO: 114176 - protein, 9 aa, Artificial Sequence
  Description of Artificial Sequence: Synthetic peptide
  Seed: ALMDKSLHV (MAR1_HUMAN)
ANMDKSLHY

SEQ ID NO: 114177 - protein, 9 aa, Artificial Sequence
  Description of Artificial Sequence: Synthetic peptide
  Seed: LLIGCWYCR (MAR1_HUMAN)
LIIGCWYCR

SEQ ID NO: 114178 - protein, 9 aa, Artificial Sequence
  Description of Artificial Sequence: Synthetic peptide
  Seed: VVPNAPPAY (MAR1_HUMAN)
VFPNAPPAM

SEQ ID NO: 114179 - protein, 10 aa, Artificial Sequence
  Description of Artificial Sequence: Synthetic peptide
  Seed: MPREDAHFIY (MAR1_HUMAN)
MQREDAHFIY

SEQ ID NO: 114180 - protein, 10 aa, Artificial Sequence
  Description of Artificial Sequence: Synthetic peptide
  Seed: APPAYEKLSA (MAR1_HUMAN)
AVPAYEKLSM

SEQ ID NO: 114181 - protein, 10 aa, Artificial Sequence
  Description of Artificial Sequence: Synthetic peptide
  Seed: EAAGIGILTV (MAR1_HUMAN)
EMAGIGILTI

SEQ ID NO: 114182 - protein, 9 aa, Artificial Sequence
  Description of Artificial Sequence: Synthetic peptide
  Seed: AEEAAGIGI (MAR1_HUMAN)
AEEAAGIGL

SEQ ID NO: 114183 - protein, 9 aa, Artificial Sequence
  Description of Artificial Sequence: Synthetic peptide
  Seed: HSYTTAEEA (MAR1_HUMAN)
HVYTTAEEY

SEQ ID NO: 114184 - protein, 8 aa, Artificial Sequence
  Description of Artificial Sequence: Synthetic peptide
  Seed: LMDKSLHV (MAR1_HUMAN)
LSDKSLHL

SEQ ID NO: 114185 - protein, 11 aa, Artificial Sequence
  Description of Artificial Sequence: Synthetic peptide
  Seed: YRALMDKSLHV (MAR1_HUMAN)
YWALMDKSLHL

SEQ ID NO: 114186 - protein, 10 aa, Artificial Sequence
  Description of Artificial Sequence: Synthetic peptide
  Seed: APPAYEKLSA (MAR1_HUMAN)
ACPAYEKLSL

SEQ ID NO: 114187 - protein, 10 aa, Artificial Sequence
  Description of Artificial Sequence: Synthetic peptide
  Seed: APPAYEKLSA (MAR1_HUMAN)
AWPAYEKLSM

SEQ ID NO: 114188 - protein, 10 aa, Artificial Sequence
  Description of Artificial Sequence: Synthetic peptide
  Seed: LLIGCWYCRR (MAR1_HUMAN)
LGIGCWYCRR

SEQ ID NO: 114189 - protein, 9 aa, Artificial Sequence
  Description of Artificial Sequence: Synthetic peptide
  Seed: RRRNGYRAL (MAR1_HUMAN)
RRRNGYRAF

SEQ ID NO: 114190 - protein, 10 aa, Artificial Sequence
  Description of Artificial Sequence: Synthetic peptide
  Seed: REDAHFIYGY (MAR1_HUMAN)
REDAHFIYGA

SEQ ID NO: 114191 - protein, 9 aa, Artificial Sequence
  Description of Artificial Sequence: Synthetic peptide
  Seed: ALMDKSLHV (MAR1_HUMAN)
AGMDKSLHY

SEQ ID NO: 114192 - protein, 10 aa, Artificial Sequence
  Description of Artificial Sequence: Synthetic peptide
  Seed: YPKKGHGHSY (MAR1_HUMAN)
YLKKGHGHSF

SEQ ID NO: 114193 - protein, 10 aa, Artificial Sequence
  Description of Artificial Sequence: Synthetic peptide
  Seed: RDSKVSLQEK (MAR1_HUMAN)
RWSKVSLQEK

SEQ ID NO: 114194 - protein, 10 aa, Artificial Sequence
  Description of Artificial Sequence: Synthetic peptide
  Seed: RRRNGYRALM (MAR1_HUMAN)
RWRNGYRALY

SEQ ID NO: 114195 - protein, 9 aa, Artificial Sequence
  Description of Artificial Sequence: Synthetic peptide
  Seed: NAPPAYEKL (MAR1_HUMAN)
NVPPAYEKK

SEQ ID NO: 114196 - protein, 10 aa, Artificial Sequence
  Description of Artificial Sequence: Synthetic peptide
  Seed: ALMDKSLHVG (MAR1_HUMAN)
ALMDKSLHVA

SEQ ID NO: 114197 - protein, 9 aa, Artificial Sequence
  Description of Artificial Sequence: Synthetic peptide
  Seed: AGIGILTVI (MAR1_HUMAN)
ASIGILTVV

SEQ ID NO: 114198 - protein, 9 aa, Artificial Sequence
  Description of Artificial Sequence: Synthetic peptide
  Seed: NAPPAYEKL (MAR1_HUMAN)
NMPPAYEKM

SEQ ID NO: 114199 - protein, 9 aa, Artificial Sequence
  Description of Artificial Sequence: Synthetic peptide
  Seed: GILTVILGV (MAR1_HUMAN)
GLLTVILGA

SEQ ID NO: 114200 - protein, 11 aa, Artificial Sequence
  Description of Artificial Sequence: Synthetic peptide
  Seed: KSLHVGTQCAL (MAR1_HUMAN)
KSLHVGTQCAW

SEQ ID NO: 114201 - protein, 9 aa, Artificial Sequence
  Description of Artificial Sequence: Synthetic peptide
  Seed: EDAHFIYGY (MAR1_HUMAN)
EEAHFIYGW

SEQ ID NO: 114202 - protein, 9 aa, Artificial Sequence
  Description of Artificial Sequence: Synthetic peptide
  Seed: ALMDKSLHV (MAR1_HUMAN)
AVMDKSLHA

SEQ ID NO: 114203 - protein, 9 aa, Artificial Sequence
  Description of Artificial Sequence: Synthetic peptide
  Seed: GTQCALTRR (MAR1_HUMAN)
GMQCALTRK

SEQ ID NO: 114204 - protein, 9 aa, Artificial Sequence
  Description of Artificial Sequence: Synthetic peptide
  Seed: ALMDKSLHV (MAR1_HUMAN)
AMMDKSLHC

SEQ ID NO: 114205 - protein, 9 aa, Artificial Sequence
  Description of Artificial Sequence: Synthetic peptide
  Seed: TVILGVLLL (MAR1_HUMAN)
TSILGVLLV

SEQ ID NO: 114206 - protein, 9 aa, Artificial Sequence
  Description of Artificial Sequence: Synthetic peptide
  Seed: NAPPAYEKL (MAR1_HUMAN)
NLPPAYEKV

SEQ ID NO: 114207 - protein, 11 aa, Artificial Sequence
  Description of Artificial Sequence: Synthetic peptide
  Seed: YRALMDKSLHV (MAR1_HUMAN)
YDALMDKSLHI

SEQ ID NO: 114208 - protein, 10 aa, Artificial Sequence
  Description of Artificial Sequence: Synthetic peptide
  Seed: LLIGCWYCRR (MAR1_HUMAN)
LWIGCWYCRR

SEQ ID NO: 114209 - protein, 9 aa, Artificial Sequence
  Description of Artificial Sequence: Synthetic peptide
  Seed: ALMDKSLHV (MAR1_HUMAN)
ATMDKSLHW

SEQ ID NO: 114210 - protein, 10 aa, Artificial Sequence
  Description of Artificial Sequence: Synthetic peptide
  Seed: YGYPKKGHGH (MAR1_HUMAN)
YQYPKKGHGY

SEQ ID NO: 114211 - protein, 9 aa, Artificial Sequence
  Description of Artificial Sequence: Synthetic peptide
  Seed: ALMDKSLHV (MAR1_HUMAN)
ATMDKSLHL

SEQ ID NO: 114212 - protein, 10 aa, Artificial Sequence
  Description of Artificial Sequence: Synthetic peptide
  Seed: ALMDKSLHVG (MAR1_HUMAN)
ALMDKSLHVQ

SEQ ID NO: 114213 - protein, 10 aa, Artificial Sequence
  Description of Artificial Sequence: Synthetic peptide
  Seed: APPAYEKLSA (MAR1_HUMAN)
AWPAYEKLSL

SEQ ID NO: 114214 - protein, 9 aa, Artificial Sequence
  Description of Artificial Sequence: Synthetic peptide
  Seed: TVILGVLLL (MAR1_HUMAN)
TTILGVLLY

SEQ ID NO: 114215 - protein, 9 aa, Artificial Sequence
  Description of Artificial Sequence: Synthetic peptide
  Seed: VVPNAPPAY (MAR1_HUMAN)
VSPNAPPAF

SEQ ID NO: 114216 - protein, 9 aa, Artificial Sequence
  Description of Artificial Sequence: Synthetic peptide
  Seed: YEKLSAEQS (MAR1_HUMAN)
YEKLSAEQA

SEQ ID NO: 114217 - protein, 9 aa, Artificial Sequence
  Description of Artificial Sequence: Synthetic peptide
  Seed: VILGVLLLI (MAR1_HUMAN)
VSLGVLLLM

SEQ ID NO: 114218 - protein, 11 aa, Artificial Sequence
  Description of Artificial Sequence: Synthetic peptide
  Seed: GIGILTVILGV (MAR1_HUMAN)
GMGILTVILGV

SEQ ID NO: 114219 - protein, 10 aa, Artificial Sequence
  Description of Artificial Sequence: Synthetic peptide
  Seed: YTTAEEAAGI (MAR1_HUMAN)
YHTAEEAAGI

SEQ ID NO: 114220 - protein, 10 aa, Artificial Sequence
  Description of Artificial Sequence: Synthetic peptide
  Seed: APPAYEKLSA (MAR1_HUMAN)
AYPAYEKLSL

SEQ ID NO: 114221 - protein, 10 aa, Artificial Sequence
  Description of Artificial Sequence: Synthetic peptide
  Seed: REDAHFIYGY (MAR1_HUMAN)
RIDAHFIYGY

SEQ ID NO: 114222 - protein, 11 aa, Artificial Sequence
  Description of Artificial Sequence: Synthetic peptide
  Seed: YRALMDKSLHV (MAR1_HUMAN)
YCALMDKSLHI

SEQ ID NO: 114223 - protein, 9 aa, Artificial Sequence
  Description of Artificial Sequence: Synthetic peptide
  Seed: YPKKGHGHS (MAR1_HUMAN)
YPKKGHGHL

SEQ ID NO: 114224 - protein, 10 aa, Artificial Sequence
  Description of Artificial Sequence: Synthetic peptide
  Seed: YTTAEEAAGI (MAR1_HUMAN)
YQTAEEAAGL

SEQ ID NO: 114225 - protein, 9 aa, Artificial Sequence
  Description of Artificial Sequence: Synthetic peptide
  Seed: RRRNGYRAL (MAR1_HUMAN)
RQRNGYRAW

SEQ ID NO: 114226 - protein, 9 aa, Artificial Sequence
  Description of Artificial Sequence: Synthetic peptide
  Seed: AGIGILTVI (MAR1_HUMAN)
AAIGILTVA

SEQ ID NO: 114227 - protein, 9 aa, Artificial Sequence
  Description of Artificial Sequence: Synthetic peptide
  Seed: VVPNAPPAY (MAR1_HUMAN)
VSPNAPPAI

SEQ ID NO: 114228 - protein, 9 aa, Artificial Sequence
  Description of Artificial Sequence: Synthetic peptide
  Seed: AGIGILTVI (MAR1_HUMAN)
AIIGILTVF

SEQ ID NO: 114229 - protein, 9 aa, Artificial Sequence
  Description of Artificial Sequence: Synthetic peptide
  Seed: AGIGILTVI (MAR1_HUMAN)
AIIGILTVI

SEQ ID NO: 114230 - protein, 9 aa, Artificial Sequence
  Description of Artificial Sequence: Synthetic peptide
  Seed: LLIGCWYCR (MAR1_HUMAN)
LVIGCWYCK

SEQ ID NO: 114231 - protein, 9 aa, Artificial Sequence
  Description of Artificial Sequence: Synthetic peptide
  Seed: TVILGVLLL (MAR1_HUMAN)
TMILGVLLV

SEQ ID NO: 114232 - protein, 10 aa, Artificial Sequence
  Description of Artificial Sequence: Synthetic peptide
  Seed: ALMDKSLHVG (MAR1_HUMAN)
ADMDKSLHVV

SEQ ID NO: 114233 - protein, 10 aa, Artificial Sequence
  Description of Artificial Sequence: Synthetic peptide
  Seed: RALMDKSLHV (MAR1_HUMAN)
RRLMDKSLHV

SEQ ID NO: 114234 - protein, 9 aa, Artificial Sequence
  Description of Artificial Sequence: Synthetic peptide
  Seed: VILGVLLLI (MAR1_HUMAN)
VSLGVLLLV

SEQ ID NO: 114235 - protein, 10 aa, Artificial Sequence
  Description of Artificial Sequence: Synthetic peptide
  Seed: RALMDKSLHV (MAR1_HUMAN)
RHLMDKSLHL

SEQ ID NO: 114236 - protein, 10 aa, Artificial Sequence
  Description of Artificial Sequence: Synthetic peptide
  Seed: DAHFIYGYPK (MAR1_HUMAN)
DFHFIYGYPR

SEQ ID NO: 114237 - protein, 9 aa, Artificial Sequence
  Description of Artificial Sequence: Synthetic peptide
  Seed: VILGVLLLI (MAR1_HUMAN)
VMLGVLLLY

SEQ ID NO: 114238 - protein, 10 aa, Artificial Sequence
  Description of Artificial Sequence: Synthetic peptide
  Seed: REDAHFIYGY (MAR1_HUMAN)
RMDAHFIYGY

SEQ ID NO: 114239 - protein, 10 aa, Artificial Sequence
  Description of Artificial Sequence: Synthetic peptide
  Seed: AHFIYGYPKK (MAR1_HUMAN)
AQFIYGYPKR

SEQ ID NO: 114240 - protein, 9 aa, Artificial Sequence
  Description of Artificial Sequence: Synthetic peptide
  Seed: GTQCALTRR (MAR1_HUMAN)
GVQCALTRR

SEQ ID NO: 114241 - protein, 10 aa, Artificial Sequence
  Description of Artificial Sequence: Synthetic peptide
  Seed: RDSKVSLQEK (MAR1_HUMAN)
RYSKVSLQEA

SEQ ID NO: 114242 - protein, 10 aa, Artificial Sequence
  Description of Artificial Sequence: Synthetic peptide
  Seed: RALMDKSLHV (MAR1_HUMAN)
RTLMDKSLHA

SEQ ID NO: 114243 - protein, 9 aa, Artificial Sequence
  Description of Artificial Sequence: Synthetic peptide
  Seed: SLHVGTQCA (MAR1_HUMAN)
SLHVGTQCL

SEQ ID NO: 114244 - protein, 10 aa, Artificial Sequence
  Description of Artificial Sequence: Synthetic peptide
  Seed: ALMDKSLHVG (MAR1_HUMAN)
AMMDKSLHVR

SEQ ID NO: 114245 - protein, 10 aa, Artificial Sequence
  Description of Artificial Sequence: Synthetic peptide
  Seed: YTTAEEAAGI (MAR1_HUMAN)
YGTAEEAAGV

SEQ ID NO: 114246 - protein, 9 aa, Artificial Sequence
  Description of Artificial Sequence: Synthetic peptide
  Seed: SAEQSPPPY (MAR1_HUMAN)
SKEQSPPPF

SEQ ID NO: 114247 - protein, 10 aa, Artificial Sequence
  Description of Artificial Sequence: Synthetic peptide
  Seed: RALMDKSLHV (MAR1_HUMAN)
RVLMDKSLHA

SEQ ID NO: 114248 - protein, 9 aa, Artificial Sequence
  Description of Artificial Sequence: Synthetic peptide
  Seed: LLLIGCWYC (MAR1_HUMAN)
LMLIGCWYM

SEQ ID NO: 114249 - protein, 9 aa, Artificial Sequence
  Description of Artificial Sequence: Synthetic peptide
  Seed: VGTQCALTR (MAR1_HUMAN)
VTTQCALTK

SEQ ID NO: 114250 - protein, 9 aa, Artificial Sequence
  Description of Artificial Sequence: Synthetic peptide
  Seed: LIGCWYCRR (MAR1_HUMAN)
LFGCWYCRR

SEQ ID NO: 114251 - protein, 9 aa, Artificial Sequence
  Description of Artificial Sequence: Synthetic peptide
  Seed: GFDHRDSKV (MAR1_HUMAN)
GFDHRDSKM

SEQ ID NO: 114252 - protein, 9 aa, Artificial Sequence
  Description of Artificial Sequence: Synthetic peptide
  Seed: ALMDKSLHV (MAR1_HUMAN)
AIMDKSLHY

SEQ ID NO: 114253 - protein, 9 aa, Artificial Sequence
  Description of Artificial Sequence: Synthetic peptide
  Seed: YPKKGHGHS (MAR1_HUMAN)
YPKKGHGHV

SEQ ID NO: 114254 - protein, 11 aa, Artificial Sequence
  Description of Artificial Sequence: Synthetic peptide
  Seed: ALMDKSLHVGT (MAR1_HUMAN)
AFMDKSLHVGV

SEQ ID NO: 114255 - protein, 9 aa, Artificial Sequence
  Description of Artificial Sequence: Synthetic peptide
  Seed: GILTVILGV (MAR1_HUMAN)
GMLTVILGM

SEQ ID NO: 114256 - protein, 9 aa, Artificial Sequence
  Description of Artificial Sequence: Synthetic peptide
  Seed: VILGVLLLI (MAR1_HUMAN)
VLLGVLLLL

SEQ ID NO: 114257 - protein, 9 aa, Artificial Sequence
  Description of Artificial Sequence: Synthetic peptide
  Seed: ALMDKSLHV (MAR1_HUMAN)
AAMDKSLHW

SEQ ID NO: 114258 - protein, 10 aa, Artificial Sequence
  Description of Artificial Sequence: Synthetic peptide
  Seed: RRNGYRALMD (MAR1_HUMAN)
RRNGYRALMF

SEQ ID NO: 114259 - protein, 10 aa, Artificial Sequence
  Description of Artificial Sequence: Synthetic peptide
  Seed: APPAYEKLSA (MAR1_HUMAN)
AQPAYEKLSM

SEQ ID NO: 114260 - protein, 9 aa, Artificial Sequence
  Description of Artificial Sequence: Synthetic peptide
  Seed: EDAHFIYGY (MAR1_HUMAN)
ESAHFIYGY

SEQ ID NO: 114261 - protein, 9 aa, Artificial Sequence
  Description of Artificial Sequence: Synthetic peptide
  Seed: NAPPAYEKL (MAR1_HUMAN)
NWPPAYEKM

SEQ ID NO: 114262 - protein, 9 aa, Artificial Sequence
  Description of Artificial Sequence: Synthetic peptide
  Seed: SAEQSPPPY (MAR1_HUMAN)
SLEQSPPPY

SEQ ID NO: 114263 - protein, 9 aa, Artificial Sequence
  Description of Artificial Sequence: Synthetic peptide
  Seed: TVILGVLLL (MAR1_HUMAN)
TAILGVLLW

SEQ ID NO: 114264 - protein, 9 aa, Artificial Sequence
  Description of Artificial Sequence: Synthetic peptide
  Seed: AAGIGILTV (MAR1_HUMAN)
AVGIGILTL

SEQ ID NO: 114265 - protein, 9 aa, Artificial Sequence
  Description of Artificial Sequence: Synthetic peptide
  Seed: YRALMDKSL (MAR1_HUMAN)
YYALMDKSL

SEQ ID NO: 114266 - protein, 10 aa, Artificial Sequence
  Description of Artificial Sequence: Synthetic peptide
  Seed: SLHVGTQCAL (MAR1_HUMAN)
SIHVGTQCAY

SEQ ID NO: 114267 - protein, 9 aa, Artificial Sequence
  Description of Artificial Sequence: Synthetic peptide
  Seed: RRRNGYRAL (MAR1_HUMAN)
RFRNGYRAI

SEQ ID NO: 114268 - protein, 9 aa, Artificial Sequence
  Description of Artificial Sequence: Synthetic peptide
  Seed: NAPPAYEKL (MAR1_HUMAN)
NVPPAYEKV

SEQ ID NO: 114269 - protein, 10 aa, Artificial Sequence
  Description of Artificial Sequence: Synthetic peptide
  Seed: YGYPKKGHGH (MAR1_HUMAN)
YAYPKKGHGM

SEQ ID NO: 114270 - protein, 10 aa, Artificial Sequence
  Description of Artificial Sequence: Synthetic peptide
  Seed: RRRNGYRALM (MAR1_HUMAN)
RCRNGYRALL

SEQ ID NO: 114271 - protein, 10 aa, Artificial Sequence
  Description of Artificial Sequence: Synthetic peptide
  Seed: RRRNGYRALM (MAR1_HUMAN)
RHRNGYRALY

SEQ ID NO: 114272 - protein, 10 aa, Artificial Sequence
  Description of Artificial Sequence: Synthetic peptide
  Seed: YGYPKKGHGH (MAR1_HUMAN)
YSYPKKGHGY

SEQ ID NO: 114273 - protein, 10 aa, Artificial Sequence
  Description of Artificial Sequence: Synthetic peptide
  Seed: YPKKGHGHSY (MAR1_HUMAN)
YMKKGHGHSY

SEQ ID NO: 114274 - protein, 10 aa, Artificial Sequence
  Description of Artificial Sequence: Synthetic peptide
  Seed: LLLIGCWYCR (MAR1_HUMAN)
LMLIGCWYCK

SEQ ID NO: 114275 - protein, 9 aa, Artificial Sequence
  Description of Artificial Sequence: Synthetic peptide
  Seed: ALMDKSLHV (MAR1_HUMAN)
AEMDKSLHY

SEQ ID NO: 114276 - protein, 10 aa, Artificial Sequence
  Description of Artificial Sequence: Synthetic peptide
  Seed: RALMDKSLHV (MAR1_HUMAN)
RQLMDKSLHL

SEQ ID NO: 114277 - protein, 9 aa, Artificial Sequence
  Description of Artificial Sequence: Synthetic peptide
  Seed: AGIGILTVI (MAR1_HUMAN)
ATIGILTVY

SEQ ID NO: 114278 - protein, 10 aa, Artificial Sequence
  Description of Artificial Sequence: Synthetic peptide
  Seed: IGILTVILGV (MAR1_HUMAN)
IMILTVILGI

SEQ ID NO: 114279 - protein, 9 aa, Artificial Sequence
  Description of Artificial Sequence: Synthetic peptide
  Seed: AGIGILTVI (MAR1_HUMAN)
ATIGILTVL

SEQ ID NO: 114280 - protein, 9 aa, Artificial Sequence
  Description of Artificial Sequence: Synthetic peptide
  Seed: LLLIGCWYC (MAR1_HUMAN)
LALIGCWYV

SEQ ID NO: 114281 - protein, 9 aa, Artificial Sequence
  Description of Artificial Sequence: Synthetic peptide
  Seed: AGIGILTVI (MAR1_HUMAN)
AQIGILTVI

SEQ ID NO: 114282 - protein, 9 aa, Artificial Sequence
  Description of Artificial Sequence: Synthetic peptide
  Seed: KSLHVGTQC (MAR1_HUMAN)
KALHVGTQV

SEQ ID NO: 114283 - protein, 9 aa, Artificial Sequence
  Description of Artificial Sequence: Synthetic peptide
  Seed: TVILGVLLL (MAR1_HUMAN)
TQILGVLLY

SEQ ID NO: 114284 - protein, 10 aa, Artificial Sequence
  Description of Artificial Sequence: Synthetic peptide
  Seed: ALMDKSLHVG (MAR1_HUMAN)
AMMDKSLHVV

SEQ ID NO: 114285 - protein, 11 aa, Artificial Sequence
  Description of Artificial Sequence: Synthetic peptide
  Seed: RALMDKSLHVG (MAR1_HUMAN)
RFLMDKSLHVL

SEQ ID NO: 114286 - protein, 9 aa, Artificial Sequence
  Description of Artificial Sequence: Synthetic peptide
  Seed: ALMDKSLHV (MAR1_HUMAN)
ARMDKSLHY

SEQ ID NO: 114287 - protein, 9 aa, Artificial Sequence
  Description of Artificial Sequence: Synthetic peptide
  Seed: GILTVILGV (MAR1_HUMAN)
GMLTVILGI

SEQ ID NO: 114288 - protein, 10 aa, Artificial Sequence
  Description of Artificial Sequence: Synthetic peptide
  Seed: ALMDKSLHVG (MAR1_HUMAN)
ALMDKSLHVK

SEQ ID NO: 114289 - protein, 10 aa, Artificial Sequence
  Description of Artificial Sequence: Synthetic peptide
  Seed: RRNGYRALMD (MAR1_HUMAN)
RRNGYRALMK

SEQ ID NO: 114290 - protein, 11 aa, Artificial Sequence
  Description of Artificial Sequence: Synthetic peptide
  Seed: RALMDKSLHVG (MAR1_HUMAN)
RMLMDKSLHVV

SEQ ID NO: 114291 - protein, 10 aa, Artificial Sequence
  Description of Artificial Sequence: Synthetic peptide
  Seed: LLLIGCWYCR (MAR1_HUMAN)
LQLIGCWYCK

SEQ ID NO: 114292 - protein, 9 aa, Artificial Sequence
  Description of Artificial Sequence: Synthetic peptide
  Seed: YEKLSAEQS (MAR1_HUMAN)
YEKLSAEQL

SEQ ID NO: 114293 - protein, 9 aa, Artificial Sequence
  Description of Artificial Sequence: Synthetic peptide
  Seed: AGIGILTVI (MAR1_HUMAN)
ATIGILTVF

SEQ ID NO: 114294 - protein, 10 aa, Artificial Sequence
  Description of Artificial Sequence: Synthetic peptide
  Seed: RALMDKSLHV (MAR1_HUMAN)
RFLMDKSLHM

SEQ ID NO: 114295 - protein, 10 aa, Artificial Sequence
  Description of Artificial Sequence: Synthetic peptide
  Seed: AEQSPPPYSP (MAR1_HUMAN)
AEQSPPPYSL

SEQ ID NO: 114296 - protein, 10 aa, Artificial Sequence
  Description of Artificial Sequence: Synthetic peptide
  Seed: RNGYRALMDK (MAR1_HUMAN)
RSGYRALMDK

SEQ ID NO: 114297 - protein, 11 aa, Artificial Sequence
  Description of Artificial Sequence: Synthetic peptide
  Seed: RALMDKSLHVG (MAR1_HUMAN)
RVLMDKSLHVV

SEQ ID NO: 114298 - protein, 9 aa, Artificial Sequence
  Description of Artificial Sequence: Synthetic peptide
  Seed: HSYTTAEEA (MAR1_HUMAN)
HHYTTAEEI

SEQ ID NO: 114299 - protein, 9 aa, Artificial Sequence
  Description of Artificial Sequence: Synthetic peptide
  Seed: EQSPPPYSP (MAR1_HUMAN)
EESPPPYSP

SEQ ID NO: 114300 - protein, 9 aa, Artificial Sequence
  Description of Artificial Sequence: Synthetic peptide
  Seed: ALMDKSLHV (MAR1_HUMAN)
AGMDKSLHI

SEQ ID NO: 114301 - protein, 9 aa, Artificial Sequence
  Description of Artificial Sequence: Synthetic peptide
  Seed: SAEQSPPPY (MAR1_HUMAN)
SIEQSPPPL

SEQ ID NO: 114302 - protein, 10 aa, Artificial Sequence
  Description of Artificial Sequence: Synthetic peptide
  Seed: YPKKGHGHSY (MAR1_HUMAN)
YMKKGHGHSM

SEQ ID NO: 114303 - protein, 10 aa, Artificial Sequence
  Description of Artificial Sequence: Synthetic peptide
  Seed: EAAGIGILTV (MAR1_HUMAN)
EMAGIGILTK

SEQ ID NO: 114304 - protein, 9 aa, Artificial Sequence
  Description of Artificial Sequence: Synthetic peptide
  Seed: ALMDKSLHV (MAR1_HUMAN)
AGMDKSLHM

SEQ ID NO: 114305 - protein, 9 aa, Artificial Sequence
  Description of Artificial Sequence: Synthetic peptide
  Seed: LHVGTQCAL (MAR1_HUMAN)
LVVGTQCAF

SEQ ID NO: 114306 - protein, 10 aa, Artificial Sequence
  Description of Artificial Sequence: Synthetic peptide
  Seed: MPREDAHFIY (MAR1_HUMAN)
MPREDAHFII

SEQ ID NO: 114307 - protein, 9 aa, Artificial Sequence
  Description of Artificial Sequence: Synthetic peptide
  Seed: LLLIGCWYC (MAR1_HUMAN)
LMLIGCWYT

SEQ ID NO: 114308 - protein, 9 aa, Artificial Sequence
  Description of Artificial Sequence: Synthetic peptide
  Seed: ALMDKSLHV (MAR1_HUMAN)
ATMDKSLHA

SEQ ID NO: 114309 - protein, 10 aa, Artificial Sequence
  Description of Artificial Sequence: Synthetic peptide
  Seed: YTTAEEAAGI (MAR1_HUMAN)
YITAEEAAGV

SEQ ID NO: 114310 - protein, 10 aa, Artificial Sequence
  Description of Artificial Sequence: Synthetic peptide
  Seed: ALMDKSLHVG (MAR1_HUMAN)
AIMDKSLHVI

SEQ ID NO: 114311 - protein, 9 aa, Artificial Sequence
  Description of Artificial Sequence: Synthetic peptide
  Seed: HSYTTAEEA (MAR1_HUMAN)
HAYTTAEEH

SEQ ID NO: 114312 - protein, 9 aa, Artificial Sequence
  Description of Artificial Sequence: Synthetic peptide
  Seed: RRRNGYRAL (MAR1_HUMAN)
RVRNGYRAF

SEQ ID NO: 114313 - protein, 9 aa, Artificial Sequence
  Description of Artificial Sequence: Synthetic peptide
  Seed: AGIGILTVI (MAR1_HUMAN)
ARIGILTVV

SEQ ID NO: 114314 - protein, 9 aa, Artificial Sequence
  Description of Artificial Sequence: Synthetic peptide
  Seed: SAEQSPPPY (MAR1_HUMAN)
SPEQSPPPY

SEQ ID NO: 114315 - protein, 9 aa, Artificial Sequence
  Description of Artificial Sequence: Synthetic peptide
  Seed: RRRNGYRAL (MAR1_HUMAN)
RVRNGYRAY

SEQ ID NO: 114316 - protein, 11 aa, Artificial Sequence
  Description of Artificial Sequence: Synthetic peptide
  Seed: YRALMDKSLHV (MAR1_HUMAN)
YIALMDKSLHM

SEQ ID NO: 114317 - protein, 9 aa, Artificial Sequence
  Description of Artificial Sequence: Synthetic peptide
  Seed: EGFDHRDSK (MAR1_HUMAN)
EVFDHRDSL

SEQ ID NO: 114318 - protein, 10 aa, Artificial Sequence
  Description of Artificial Sequence: Synthetic peptide
  Seed: RRRNGYRALM (MAR1_HUMAN)
RLRNGYRALY

SEQ ID NO: 114319 - protein, 9 aa, Artificial Sequence
  Description of Artificial Sequence: Synthetic peptide
  Seed: TTAEEAAGI (MAR1_HUMAN)
TMAEEAAGV

SEQ ID NO: 114320 - protein, 10 aa, Artificial Sequence
  Description of Artificial Sequence: Synthetic peptide
  Seed: ALMDKSLHVG (MAR1_HUMAN)
AMMDKSLHVE

SEQ ID NO: 114321 - protein, 9 aa, Artificial Sequence
  Description of Artificial Sequence: Synthetic peptide
  Seed: VVPNAPPAY (MAR1_HUMAN)
VVPNAPPAK

SEQ ID NO: 114322 - protein, 9 aa, Artificial Sequence
  Description of Artificial Sequence: Synthetic peptide
  Seed: TVILGVLLL (MAR1_HUMAN)
TIILGVLLV

SEQ ID NO: 114323 - protein, 9 aa, Artificial Sequence
  Description of Artificial Sequence: Synthetic peptide
  Seed: GILTVILGV (MAR1_HUMAN)
GLLTVILGV

SEQ ID NO: 114324 - protein, 10 aa, Artificial Sequence
  Description of Artificial Sequence: Synthetic peptide
  Seed: EEAAGIGILT (MAR1_HUMAN)
EIAAGIGILV

SEQ ID NO: 114325 - protein, 9 aa, Artificial Sequence
  Description of Artificial Sequence: Synthetic peptide
  Seed: VVPNAPPAY (MAR1_HUMAN)
VHPNAPPAM

SEQ ID NO: 114326 - protein, 11 aa, Artificial Sequence
  Description of Artificial Sequence: Synthetic peptide
  Seed: YRALMDKSLHV (MAR1_HUMAN)
YWALMDKSLHI

SEQ ID NO: 114327 - protein, 9 aa, Artificial Sequence
  Description of Artificial Sequence: Synthetic peptide
  Seed: VVPNAPPAY (MAR1_HUMAN)
VGPNAPPAV

SEQ ID NO: 114328 - protein, 9 aa, Artificial Sequence
  Description of Artificial Sequence: Synthetic peptide
  Seed: NAPPAYEKL (MAR1_HUMAN)
NRPPAYEKF

SEQ ID NO: 114329 - protein, 10 aa, Artificial Sequence
  Description of Artificial Sequence: Synthetic peptide
  Seed: AEQSPPPYSP (MAR1_HUMAN)
AEQSPPPYSM

SEQ ID NO: 114330 - protein, 9 aa, Artificial Sequence
  Description of Artificial Sequence: Synthetic peptide
  Seed: GFDHRDSKV (MAR1_HUMAN)
GADHRDSKM

SEQ ID NO: 114331 - protein, 9 aa, Artificial Sequence
  Description of Artificial Sequence: Synthetic peptide
  Seed: SLHVGTQCA (MAR1_HUMAN)
SVHVGTQCV

SEQ ID NO: 114332 - protein, 10 aa, Artificial Sequence
  Description of Artificial Sequence: Synthetic peptide
  Seed: TVILGVLLLI (MAR1_HUMAN)
TPILGVLLLV

SEQ ID NO: 114333 - protein, 10 aa, Artificial Sequence
  Description of Artificial Sequence: Synthetic peptide
  Seed: LLLIGCWYCR (MAR1_HUMAN)
LRLIGCWYCR

SEQ ID NO: 114334 - protein, 10 aa, Artificial Sequence
  Description of Artificial Sequence: Synthetic peptide
  Seed: TVILGVLLLI (MAR1_HUMAN)
TWILGVLLLV

SEQ ID NO: 114335 - protein, 9 aa, Artificial Sequence
  Description of Artificial Sequence: Synthetic peptide
  Seed: NAPPAYEKL (MAR1_HUMAN)
NYPPAYEKI

SEQ ID NO: 114336 - protein, 9 aa, Artificial Sequence
  Description of Artificial Sequence: Synthetic peptide
  Seed: NAPPAYEKL (MAR1_HUMAN)
NPPPAYEKI

SEQ ID NO: 114337 - protein, 9 aa, Artificial Sequence
  Description of Artificial Sequence: Synthetic peptide
  Seed: REDAHFIYG (MAR1_HUMAN)
REDAHFIYC

SEQ ID NO: 114338 - protein, 10 aa, Artificial Sequence
  Description of Artificial Sequence: Synthetic peptide
  Seed: RALMDKSLHV (MAR1_HUMAN)
RTLMDKSLHI

SEQ ID NO: 114339 - protein, 9 aa, Artificial Sequence
  Description of Artificial Sequence: Synthetic peptide
  Seed: AGIGILTVI (MAR1_HUMAN)
AVIGILTVF

SEQ ID NO: 114340 - protein, 10 aa, Artificial Sequence
  Description of Artificial Sequence: Synthetic peptide
  Seed: EEAAGIGILT (MAR1_HUMAN)
EFAAGIGILI

SEQ ID NO: 114341 - protein, 10 aa, Artificial Sequence
  Description of Artificial Sequence: Synthetic peptide
  Seed: RRRNGYRALM (MAR1_HUMAN)
RYRNGYRALL

SEQ ID NO: 114342 - protein, 10 aa, Artificial Sequence
  Description of Artificial Sequence: Synthetic peptide
  Seed: LSAEQSPPPY (MAR1_HUMAN)
LLAEQSPPPF

SEQ ID NO: 114343 - protein, 10 aa, Artificial Sequence
  Description of Artificial Sequence: Synthetic peptide
  Seed: RALMDKSLHV (MAR1_HUMAN)
RSLMDKSLHI

SEQ ID NO: 114344 - protein, 9 aa, Artificial Sequence
  Description of Artificial Sequence: Synthetic peptide
  Seed: VILGVLLLI (MAR1_HUMAN)
VSLGVLLLW

SEQ ID NO: 114345 - protein, 11 aa, Artificial Sequence
  Description of Artificial Sequence: Synthetic peptide
  Seed: RALMDKSLHVG (MAR1_HUMAN)
RFLMDKSLHVI

SEQ ID NO: 114346 - protein, 9 aa, Artificial Sequence
  Description of Artificial Sequence: Synthetic peptide
  Seed: VILGVLLLI (MAR1_HUMAN)
VMLGVLLLM

SEQ ID NO: 114347 - protein, 9 aa, Artificial Sequence
  Description of Artificial Sequence: Synthetic peptide
  Seed: EGFDHRDSK (MAR1_HUMAN)
ETFDHRDSF

SEQ ID NO: 114348 - protein, 9 aa, Artificial Sequence
  Description of Artificial Sequence: Synthetic peptide
  Seed: RRRNGYRAL (MAR1_HUMAN)
RMRNGYRAL

SEQ ID NO: 114349 - protein, 9 aa, Artificial Sequence
  Description of Artificial Sequence: Synthetic peptide
  Seed: ALMDKSLHV (MAR1_HUMAN)
AAMDKSLHM

SEQ ID NO: 114350 - protein, 10 aa, Artificial Sequence
  Description of Artificial Sequence: Synthetic peptide
  Seed: ALMDKSLHVG (MAR1_HUMAN)
AMMDKSLHVG

SEQ ID NO: 114351 - protein, 10 aa, Artificial Sequence
  Description of Artificial Sequence: Synthetic peptide
  Seed: EEAAGIGILT (MAR1_HUMAN)
EMAAGIGILL

SEQ ID NO: 114352 - protein, 9 aa, Artificial Sequence
  Description of Artificial Sequence: Synthetic peptide
  Seed: SAEQSPPPY (MAR1_HUMAN)
SVEQSPPPL

SEQ ID NO: 114353 - protein, 10 aa, Artificial Sequence
  Description of Artificial Sequence: Synthetic peptide
  Seed: APPAYEKLSA (MAR1_HUMAN)
AHPAYEKLSL

SEQ ID NO: 114354 - protein, 9 aa, Artificial Sequence
  Description of Artificial Sequence: Synthetic peptide
  Seed: AHFIYGYPK (MAR1_HUMAN)
ANFIYGYPR

SEQ ID NO: 114355 - protein, 9 aa, Artificial Sequence
  Description of Artificial Sequence: Synthetic peptide
  Seed: ALMDKSLHV (MAR1_HUMAN)
ATMDKSLHI

SEQ ID NO: 114356 - protein, 9 aa, Artificial Sequence
  Description of Artificial Sequence: Synthetic peptide
  Seed: VILGVLLLI (MAR1_HUMAN)
VMLGVLLLI

SEQ ID NO: 114357 - protein, 11 aa, Artificial Sequence
  Description of Artificial Sequence: Synthetic peptide
  Seed: YRALMDKSLHV (MAR1_HUMAN)
YVALMDKSLHL

SEQ ID NO: 114358 - protein, 9 aa, Artificial Sequence
  Description of Artificial Sequence: Synthetic peptide
  Seed: AAGIGILTV (MAR1_HUMAN)
ALGIGILTL

SEQ ID NO: 114359 - protein, 9 aa, Artificial Sequence
  Description of Artificial Sequence: Synthetic peptide
  Seed: YRALMDKSL (MAR1_HUMAN)
YHALMDKSM

SEQ ID NO: 114360 - protein, 9 aa, Artificial Sequence
  Description of Artificial Sequence: Synthetic peptide
  Seed: AGIGILTVI (MAR1_HUMAN)
ALIGILTVV

SEQ ID NO: 114361 - protein, 9 aa, Artificial Sequence
  Description of Artificial Sequence: Synthetic peptide
  Seed: AGIGILTVI (MAR1_HUMAN)
AQIGILTVF

SEQ ID NO: 114362 - protein, 9 aa, Artificial Sequence
  Description of Artificial Sequence: Synthetic peptide
  Seed: HSYTTAEEA (MAR1_HUMAN)
HPYTTAEEL

SEQ ID NO: 114363 - protein, 11 aa, Artificial Sequence
  Description of Artificial Sequence: Synthetic peptide
  Seed: RALMDKSLHVG (MAR1_HUMAN)
RGLMDKSLHVV

SEQ ID NO: 114364 - protein, 9 aa, Artificial Sequence
  Description of Artificial Sequence: Synthetic peptide
  Seed: GILTVILGV (MAR1_HUMAN)
GQLTVILGI

SEQ ID NO: 114365 - protein, 10 aa, Artificial Sequence
  Description of Artificial Sequence: Synthetic peptide
  Seed: RALMDKSLHV (MAR1_HUMAN)
RTLMDKSLHL

SEQ ID NO: 114366 - protein, 11 aa, Artificial Sequence
  Description of Artificial Sequence: Synthetic peptide
  Seed: YCRRRNGYRAL (MAR1_HUMAN)
YMRRRNGYRAI

SEQ ID NO: 114367 - protein, 10 aa, Artificial Sequence
  Description of Artificial Sequence: Synthetic peptide
  Seed: EAAGIGILTV (MAR1_HUMAN)
ETAGIGILTT

SEQ ID NO: 114368 - protein, 9 aa, Artificial Sequence
  Description of Artificial Sequence: Synthetic peptide
  Seed: ALMDKSLHV (MAR1_HUMAN)
AVMDKSLHM

SEQ ID NO: 114369 - protein, 9 aa, Artificial Sequence
  Description of Artificial Sequence: Synthetic peptide
  Seed: VILGVLLLI (MAR1_HUMAN)
VMLGVLLLV

SEQ ID NO: 114370 - protein, 9 aa, Artificial Sequence
  Description of Artificial Sequence: Synthetic peptide
  Seed: YRALMDKSL (MAR1_HUMAN)
YSALMDKSF

SEQ ID NO: 114371 - protein, 10 aa, Artificial Sequence
  Description of Artificial Sequence: Synthetic peptide
  Seed: RRRNGYRALM (MAR1_HUMAN)
RGRNGYRALM

SEQ ID NO: 114372 - protein, 9 aa, Artificial Sequence
  Description of Artificial Sequence: Synthetic peptide
  Seed: NAPPAYEKL (MAR1_HUMAN)
NSPPAYEKF

SEQ ID NO: 114373 - protein, 10 aa, Artificial Sequence
  Description of Artificial Sequence: Synthetic peptide
  Seed: APPAYEKLSA (MAR1_HUMAN)
ARPAYEKLSM

SEQ ID NO: 114374 - protein, 9 aa, Artificial Sequence
  Description of Artificial Sequence: Synthetic peptide
  Seed: SAEQSPPPY (MAR1_HUMAN)
SMEQSPPPM

SEQ ID NO: 114375 - protein, 9 aa, Artificial Sequence
  Description of Artificial Sequence: Synthetic peptide
  Seed: HSYTTAEEA (MAR1_HUMAN)
HRYTTAEEV

SEQ ID NO: 114376 - protein, 9 aa, Artificial Sequence
  Description of Artificial Sequence: Synthetic peptide
  Seed: RRRNGYRAL (MAR1_HUMAN)
RKRNGYRAM

SEQ ID NO: 114377 - protein, 9 aa, Artificial Sequence
  Description of Artificial Sequence: Synthetic peptide
  Seed: GFDHRDSKV (MAR1_HUMAN)
GSDHRDSKI

SEQ ID NO: 114378 - protein, 9 aa, Artificial Sequence
  Description of Artificial Sequence: Synthetic peptide
  Seed: VILGVLLLI (MAR1_HUMAN)
VMLGVLLLL

SEQ ID NO: 114379 - protein, 9 aa, Artificial Sequence
  Description of Artificial Sequence: Synthetic peptide
  Seed: TTAEEAAGI (MAR1_HUMAN)
TTAEEAAGL

SEQ ID NO: 114380 - protein, 10 aa, Artificial Sequence
  Description of Artificial Sequence: Synthetic peptide
  Seed: RALMDKSLHV (MAR1_HUMAN)
RMLMDKSLHV

SEQ ID NO: 114381 - protein, 9 aa, Artificial Sequence
  Description of Artificial Sequence: Synthetic peptide
  Seed: TVILGVLLL (MAR1_HUMAN)
TQILGVLLL

SEQ ID NO: 114382 - protein, 11 aa, Artificial Sequence
  Description of Artificial Sequence: Synthetic peptide
  Seed: GIGILTVILGV (MAR1_HUMAN)
GLGILTVILGV

SEQ ID NO: 114383 - protein, 10 aa, Artificial Sequence
  Description of Artificial Sequence: Synthetic peptide
  Seed: RRRNGYRALM (MAR1_HUMAN)
RFRNGYRALL

SEQ ID NO: 114384 - protein, 9 aa, Artificial Sequence
  Description of Artificial Sequence: Synthetic peptide
  Seed: AEQSPPPYS (MAR1_HUMAN)
AEQSPPPYF

SEQ ID NO: 114385 - protein, 9 aa, Artificial Sequence
  Description of Artificial Sequence: Synthetic peptide
  Seed: AAGIGILTV (MAR1_HUMAN)
ASGIGILTF

SEQ ID NO: 114386 - protein, 10 aa, Artificial Sequence
  Description of Artificial Sequence: Synthetic peptide
  Seed: ALMDKSLHVG (MAR1_HUMAN)
AVMDKSLHVT

SEQ ID NO: 114387 - protein, 9 aa, Artificial Sequence
  Description of Artificial Sequence: Synthetic peptide
  Seed: KSLHVGTQC (MAR1_HUMAN)
KSLHVGTQI

SEQ ID NO: 114388 - protein, 11 aa, Artificial Sequence
  Description of Artificial Sequence: Synthetic peptide
  Seed: YRALMDKSLHV (MAR1_HUMAN)
YKALMDKSLHM

SEQ ID NO: 114389 - protein, 9 aa, Artificial Sequence
  Description of Artificial Sequence: Synthetic peptide
  Seed: ALMDKSLHV (MAR1_HUMAN)
AQMDKSLHY

SEQ ID NO: 114390 - protein, 10 aa, Artificial Sequence
  Description of Artificial Sequence: Synthetic peptide
  Seed: RDSKVSLQEK (MAR1_HUMAN)
RISKVSLQEA

SEQ ID NO: 114391 - protein, 11 aa, Artificial Sequence
  Description of Artificial Sequence: Synthetic peptide
  Seed: RALMDKSLHVG (MAR1_HUMAN)
RALMDKSLHVV

SEQ ID NO: 114392 - protein, 9 aa, Artificial Sequence
  Description of Artificial Sequence: Synthetic peptide
  Seed: TTAEEAAGI (MAR1_HUMAN)
TQAEEAAGL

SEQ ID NO: 114393 - protein, 9 aa, Artificial Sequence
  Description of Artificial Sequence: Synthetic peptide
  Seed: RRNGYRALM (MAR1_HUMAN)
RQNGYRALW

SEQ ID NO: 114394 - protein, 8 aa, Artificial Sequence
  Description of Artificial Sequence: Synthetic peptide
  Seed: VPNAPPAY (MAR1_HUMAN)
VANAPPAL

SEQ ID NO: 114395 - protein, 9 aa, Artificial Sequence
  Description of Artificial Sequence: Synthetic peptide
  Seed: RRNGYRALM (MAR1_HUMAN)
RMNGYRALF

SEQ ID NO: 114396 - protein, 9 aa, Artificial Sequence
  Description of Artificial Sequence: Synthetic peptide
  Seed: MPREDAHFI (MAR1_HUMAN)
MVREDAHFM

SEQ ID NO: 114397 - protein, 9 aa, Artificial Sequence
  Description of Artificial Sequence: Synthetic peptide
  Seed: YEKLSAEQS (MAR1_HUMAN)
YEKLSAEQV

SEQ ID NO: 114398 - protein, 9 aa, Artificial Sequence
  Description of Artificial Sequence: Synthetic peptide
  Seed: ALMDKSLHV (MAR1_HUMAN)
ASMDKSLHM

SEQ ID NO: 114399 - protein, 9 aa, Artificial Sequence
  Description of Artificial Sequence: Synthetic peptide
  Seed: LHVGTQCAL (MAR1_HUMAN)
LQVGTQCAF

SEQ ID NO: 114400 - protein, 9 aa, Artificial Sequence
  Description of Artificial Sequence: Synthetic peptide
  Seed: NAPPAYEKL (MAR1_HUMAN)
NYPPAYEKF

SEQ ID NO: 114401 - protein, 11 aa, Artificial Sequence
  Description of Artificial Sequence: Synthetic peptide
  Seed: YRALMDKSLHV (MAR1_HUMAN)
YCALMDKSLHV

SEQ ID NO: 114402 - protein, 10 aa, Artificial Sequence
  Description of Artificial Sequence: Synthetic peptide
  Seed: RRRNGYRALM (MAR1_HUMAN)
RYRNGYRALY

SEQ ID NO: 114403 - protein, 11 aa, Artificial Sequence
  Description of Artificial Sequence: Synthetic peptide
  Seed: YRALMDKSLHV (MAR1_HUMAN)
YLALMDKSLHL

SEQ ID NO: 114404 - protein, 10 aa, Artificial Sequence
  Description of Artificial Sequence: Synthetic peptide
  Seed: KGHGHSYTTA (MAR1_HUMAN)
KTHGHSYTTA

SEQ ID NO: 114405 - protein, 10 aa, Artificial Sequence
  Description of Artificial Sequence: Synthetic peptide
  Seed: EEAAGIGILT (MAR1_HUMAN)
EHAAGIGILV

SEQ ID NO: 114406 - protein, 9 aa, Artificial Sequence
  Description of Artificial Sequence: Synthetic peptide
  Seed: AEQSPPPYS (MAR1_HUMAN)
AEQSPPPYM

SEQ ID NO: 114407 - protein, 10 aa, Artificial Sequence
  Description of Artificial Sequence: Synthetic peptide
  Seed: EAAGIGILTV (MAR1_HUMAN)
EVAGIGILTI

SEQ ID NO: 114408 - protein, 9 aa, Artificial Sequence
  Description of Artificial Sequence: Synthetic peptide
  Seed: TVILGVLLL (MAR1_HUMAN)
TQILGVLLW

SEQ ID NO: 114409 - protein, 9 aa, Artificial Sequence
  Description of Artificial Sequence: Synthetic peptide
  Seed: VILGVLLLI (MAR1_HUMAN)
VVLGVLLLF

SEQ ID NO: 114410 - protein, 10 aa, Artificial Sequence
  Description of Artificial Sequence: Synthetic peptide
  Seed: REDAHFIYGY (MAR1_HUMAN)
RQDAHFIYGM

SEQ ID NO: 114411 - protein, 9 aa, Artificial Sequence
  Description of Artificial Sequence: Synthetic peptide
  Seed: RRRNGYRAL (MAR1_HUMAN)
RERNGYRAY

SEQ ID NO: 114412 - protein, 9 aa, Artificial Sequence
  Description of Artificial Sequence: Synthetic peptide
  Seed: YRALMDKSL (MAR1_HUMAN)
YQALMDKSL

SEQ ID NO: 114413 - protein, 9 aa, Artificial Sequence
  Description of Artificial Sequence: Synthetic peptide
  Seed: YRALMDKSL (MAR1_HUMAN)
YWALMDKSY

SEQ ID NO: 114414 - protein, 9 aa, Artificial Sequence
  Description of Artificial Sequence: Synthetic peptide
  Seed: AAGIGILTV (MAR1_HUMAN)
ATGIGILTM

SEQ ID NO: 114415 - protein, 9 aa, Artificial Sequence
  Description of Artificial Sequence: Synthetic peptide
  Seed: VILGVLLLI (MAR1_HUMAN)
VALGVLLLF

SEQ ID NO: 114416 - protein, 9 aa, Artificial Sequence
  Description of Artificial Sequence: Synthetic peptide
  Seed: RRNGYRALM (MAR1_HUMAN)
RFNGYRALL

SEQ ID NO: 114417 - protein, 9 aa, Artificial Sequence
  Description of Artificial Sequence: Synthetic peptide
  Seed: EGFDHRDSK (MAR1_HUMAN)
ETFDHRDSM

SEQ ID NO: 114418 - protein, 11 aa, Artificial Sequence
  Description of Artificial Sequence: Synthetic peptide
  Seed: YRALMDKSLHV (MAR1_HUMAN)
YNALMDKSLHL

SEQ ID NO: 114419 - protein, 9 aa, Artificial Sequence
  Description of Artificial Sequence: Synthetic peptide
  Seed: AGIGILTVI (MAR1_HUMAN)
ALIGILTVA

SEQ ID NO: 114420 - protein, 9 aa, Artificial Sequence
  Description of Artificial Sequence: Synthetic peptide
  Seed: NAPPAYEKL (MAR1_HUMAN)
NTPPAYEKK

SEQ ID NO: 114421 - protein, 10 aa, Artificial Sequence
  Description of Artificial Sequence: Synthetic peptide
  Seed: YGYPKKGHGH (MAR1_HUMAN)
YTYPKKGHGY

SEQ ID NO: 114422 - protein, 10 aa, Artificial Sequence
  Description of Artificial Sequence: Synthetic peptide
  Seed: YTTAEEAAGI (MAR1_HUMAN)
YETAEEAAGV

SEQ ID NO: 114423 - protein, 9 aa, Artificial Sequence
  Description of Artificial Sequence: Synthetic peptide
  Seed: ALMDKSLHV (MAR1_HUMAN)
ASMDKSLHK

SEQ ID NO: 114424 - protein, 9 aa, Artificial Sequence
  Description of Artificial Sequence: Synthetic peptide
  Seed: HSYTTAEEA (MAR1_HUMAN)
HAYTTAEEF

SEQ ID NO: 114425 - protein, 9 aa, Artificial Sequence
  Description of Artificial Sequence: Synthetic peptide
  Seed: VVPNAPPAY (MAR1_HUMAN)
VWPNAPPAL

SEQ ID NO: 114426 - protein, 8 aa, Artificial Sequence
  Description of Artificial Sequence: Synthetic peptide
  Seed: HRDSKVSL (MAR1_HUMAN)
HFDSKVSF

SEQ ID NO: 114427 - protein, 10 aa, Artificial Sequence
  Description of Artificial Sequence: Synthetic peptide
  Seed: EAAGIGILTV (MAR1_HUMAN)
EAAGIGILTR

SEQ ID NO: 114428 - protein, 10 aa, Artificial Sequence
  Description of Artificial Sequence: Synthetic peptide
  Seed: RRRNGYRALM (MAR1_HUMAN)
RCRNGYRALM

SEQ ID NO: 114429 - protein, 9 aa, Artificial Sequence
  Description of Artificial Sequence: Synthetic peptide
  Seed: ALMDKSLHV (MAR1_HUMAN)
AIMDKSLHK

SEQ ID NO: 114430 - protein, 11 aa, Artificial Sequence
  Description of Artificial Sequence: Synthetic peptide
  Seed: YRALMDKSLHV (MAR1_HUMAN)
YIALMDKSLHI

SEQ ID NO: 114431 - protein, 11 aa, Artificial Sequence
  Description of Artificial Sequence: Synthetic peptide
  Seed: RALMDKSLHVG (MAR1_HUMAN)
RYLMDKSLHVM

SEQ ID NO: 114432 - protein, 11 aa, Artificial Sequence
  Description of Artificial Sequence: Synthetic peptide
  Seed: YRALMDKSLHV (MAR1_HUMAN)
YNALMDKSLHM

SEQ ID NO: 114433 - protein, 9 aa, Artificial Sequence
  Description of Artificial Sequence: Synthetic peptide
  Seed: LHVGTQCAL (MAR1_HUMAN)
LLVGTQCAF

SEQ ID NO: 114434 - protein, 9 aa, Artificial Sequence
  Description of Artificial Sequence: Synthetic peptide
  Seed: AAGIGILTV (MAR1_HUMAN)
ATGIGILTY

SEQ ID NO: 114435 - protein, 9 aa, Artificial Sequence
  Description of Artificial Sequence: Synthetic peptide
  Seed: ALMDKSLHV (MAR1_HUMAN)
AIMDKSLHV

SEQ ID NO: 114436 - protein, 11 aa, Artificial Sequence
  Description of Artificial Sequence: Synthetic peptide
  Seed: ALMDKSLHVGT (MAR1_HUMAN)
AMMDKSLHVGL

SEQ ID NO: 114437 - protein, 9 aa, Artificial Sequence
  Description of Artificial Sequence: Synthetic peptide
  Seed: YRALMDKSL (MAR1_HUMAN)
YWALMDKSM

SEQ ID NO: 114438 - protein, 9 aa, Artificial Sequence
  Description of Artificial Sequence: Synthetic peptide
  Seed: VVPNAPPAY (MAR1_HUMAN)
VNPNAPPAL

SEQ ID NO: 114439 - protein, 9 aa, Artificial Sequence
  Description of Artificial Sequence: Synthetic peptide
  Seed: CPQEGFDHR (MAR1_HUMAN)
CVQEGFDHR

SEQ ID NO: 114440 - protein, 10 aa, Artificial Sequence
  Description of Artificial Sequence: Synthetic peptide
  Seed: RDSKVSLQEK (MAR1_HUMAN)
RYSKVSLQEK

SEQ ID NO: 114441 - protein, 9 aa, Artificial Sequence
  Description of Artificial Sequence: Synthetic peptide
  Seed: SAEQSPPPY (MAR1_HUMAN)
STEQSPPPY

SEQ ID NO: 114442 - protein, 9 aa, Artificial Sequence
  Description of Artificial Sequence: Synthetic peptide
  Seed: VILGVLLLI (MAR1_HUMAN)
VLLGVLLLV

SEQ ID NO: 114443 - protein, 10 aa, Artificial Sequence
  Description of Artificial Sequence: Synthetic peptide
  Seed: LSAEQSPPPY (MAR1_HUMAN)
LLAEQSPPPY

SEQ ID NO: 114444 - protein, 9 aa, Artificial Sequence
  Description of Artificial Sequence: Synthetic peptide
  Seed: LHVGTQCAL (MAR1_HUMAN)
LEVGTQCAM

SEQ ID NO: 114445 - protein, 10 aa, Artificial Sequence
  Description of Artificial Sequence: Synthetic peptide
  Seed: LLLIGCWYCR (MAR1_HUMAN)
LFLIGCWYCK

SEQ ID NO: 114446 - protein, 10 aa, Artificial Sequence
  Description of Artificial Sequence: Synthetic peptide
  Seed: RALMDKSLHV (MAR1_HUMAN)
RCLMDKSLHI

SEQ ID NO: 114447 - protein, 10 aa, Artificial Sequence
  Description of Artificial Sequence: Synthetic peptide
  Seed: SLHVGTQCAL (MAR1_HUMAN)
SAHVGTQCAY

SEQ ID NO: 114448 - protein, 9 aa, Artificial Sequence
  Description of Artificial Sequence: Synthetic peptide
  Seed: NAPPAYEKL (MAR1_HUMAN)
NWPPAYEKF

SEQ ID NO: 114449 - protein, 9 aa, Artificial Sequence
  Description of Artificial Sequence: Synthetic peptide
  Seed: TVILGVLLL (MAR1_HUMAN)
TMILGVLLI

SEQ ID NO: 114450 - protein, 9 aa, Artificial Sequence
  Description of Artificial Sequence: Synthetic peptide
  Seed: VVPNAPPAY (MAR1_HUMAN)
VYPNAPPAM

SEQ ID NO: 114451 - protein, 9 aa, Artificial Sequence
  Description of Artificial Sequence: Synthetic peptide
  Seed: NAPPAYEKL (MAR1_HUMAN)
NSPPAYEKM

SEQ ID NO: 114452 - protein, 10 aa, Artificial Sequence
  Description of Artificial Sequence: Synthetic peptide
  Seed: LLIGCWYCRR (MAR1_HUMAN)
LYIGCWYCRK

SEQ ID NO: 114453 - protein, 9 aa, Artificial Sequence
  Description of Artificial Sequence: Synthetic peptide
  Seed: TVILGVLLL (MAR1_HUMAN)
TTILGVLLF

SEQ ID NO: 114454 - protein, 9 aa, Artificial Sequence
  Description of Artificial Sequence: Synthetic peptide
  Seed: GILTVILGV (MAR1_HUMAN)
GMLTVILGR

SEQ ID NO: 114455 - protein, 9 aa, Artificial Sequence
  Description of Artificial Sequence: Synthetic peptide
  Seed: VVPNAPPAY (MAR1_HUMAN)
VTPNAPPAM

SEQ ID NO: 114456 - protein, 9 aa, Artificial Sequence
  Description of Artificial Sequence: Synthetic peptide
  Seed: LHVGTQCAL (MAR1_HUMAN)
LNVGTQCAF

SEQ ID NO: 114457 - protein, 10 aa, Artificial Sequence
  Description of Artificial Sequence: Synthetic peptide
  Seed: APPAYEKLSA (MAR1_HUMAN)
AGPAYEKLSL

SEQ ID NO: 114458 - protein, 10 aa, Artificial Sequence
  Description of Artificial Sequence: Synthetic peptide
  Seed: ALMDKSLHVG (MAR1_HUMAN)
AVMDKSLHVL

SEQ ID NO: 114459 - protein, 9 aa, Artificial Sequence
  Description of Artificial Sequence: Synthetic peptide
  Seed: SAEQSPPPY (MAR1_HUMAN)
SQEQSPPPF

SEQ ID NO: 114460 - protein, 10 aa, Artificial Sequence
  Description of Artificial Sequence: Synthetic peptide
  Seed: LLIGCWYCRR (MAR1_HUMAN)
LSIGCWYCRR

SEQ ID NO: 114461 - protein, 8 aa, Artificial Sequence
  Description of Artificial Sequence: Synthetic peptide
  Seed: AGIGILTV (MAR1_HUMAN)
AQIGILTI

SEQ ID NO: 114462 - protein, 11 aa, Artificial Sequence
  Description of Artificial Sequence: Synthetic peptide
  Seed: RALMDKSLHVG (MAR1_HUMAN)
RWLMDKSLHVV

SEQ ID NO: 114463 - protein, 9 aa, Artificial Sequence
  Description of Artificial Sequence: Synthetic peptide
  Seed: YRALMDKSL (MAR1_HUMAN)
YRALMDKSY

SEQ ID NO: 114464 - protein, 9 aa, Artificial Sequence
  Description of Artificial Sequence: Synthetic peptide
  Seed: TVILGVLLL (MAR1_HUMAN)
TTILGVLLI

SEQ ID NO: 114465 - protein, 9 aa, Artificial Sequence
  Description of Artificial Sequence: Synthetic peptide
  Seed: YRALMDKSL (MAR1_HUMAN)
YWALMDKSF

SEQ ID NO: 114466 - protein, 9 aa, Artificial Sequence
  Description of Artificial Sequence: Synthetic peptide
  Seed: EGFDHRDSK (MAR1_HUMAN)
EQFDHRDSR

SEQ ID NO: 114467 - protein, 10 aa, Artificial Sequence
  Description of Artificial Sequence: Synthetic peptide
  Seed: LSAEQSPPPY (MAR1_HUMAN)
LTAEQSPPPW

SEQ ID NO: 114468 - protein, 10 aa, Artificial Sequence
  Description of Artificial Sequence: Synthetic peptide
  Seed: RRRNGYRALM (MAR1_HUMAN)
RTRNGYRALY

SEQ ID NO: 114469 - protein, 9 aa, Artificial Sequence
  Description of Artificial Sequence: Synthetic peptide
  Seed: RRRNGYRAL (MAR1_HUMAN)
RYRNGYRAL

SEQ ID NO: 114470 - protein, 9 aa, Artificial Sequence
  Description of Artificial Sequence: Synthetic peptide
  Seed: NGYRALMDK (MAR1_HUMAN)
NVYRALMDK

SEQ ID NO: 114471 - protein, 9 aa, Artificial Sequence
  Description of Artificial Sequence: Synthetic peptide
  Seed: RRRNGYRAL (MAR1_HUMAN)
RWRNGYRAY

SEQ ID NO: 114472 - protein, 10 aa, Artificial Sequence
  Description of Artificial Sequence: Synthetic peptide
  Seed: YTTAEEAAGI (MAR1_HUMAN)
YKTAEEAAGI

SEQ ID NO: 114473 - protein, 9 aa, Artificial Sequence
  Description of Artificial Sequence: Synthetic peptide
  Seed: DSKVSLQEK (MAR1_HUMAN)
DLKVSLQER

SEQ ID NO: 114474 - protein, 9 aa, Artificial Sequence
  Description of Artificial Sequence: Synthetic peptide
  Seed: ALMDKSLHV (MAR1_HUMAN)
ALMDKSLHF

SEQ ID NO: 114475 - protein, 9 aa, Artificial Sequence
  Description of Artificial Sequence: Synthetic peptide
  Seed: HFIYGYPKK (MAR1_HUMAN)
HFIYGYPKR

SEQ ID NO: 114476 - protein, 10 aa, Artificial Sequence
  Description of Artificial Sequence: Synthetic peptide
  Seed: RALMDKSLHV (MAR1_HUMAN)
RQLMDKSLHI

SEQ ID NO: 114477 - protein, 10 aa, Artificial Sequence
  Description of Artificial Sequence: Synthetic peptide
  Seed: RALMDKSLHV (MAR1_HUMAN)
RLLMDKSLHI

SEQ ID NO: 114478 - protein, 9 aa, Artificial Sequence
  Description of Artificial Sequence: Synthetic peptide
  Seed: ALMDKSLHV (MAR1_HUMAN)
ASMDKSLHV

SEQ ID NO: 114479 - protein, 10 aa, Artificial Sequence
  Description of Artificial Sequence: Synthetic peptide
  Seed: IGILTVILGV (MAR1_HUMAN)
IQILTVILGV

SEQ ID NO: 114480 - protein, 9 aa, Artificial Sequence
  Description of Artificial Sequence: Synthetic peptide
  Seed: DHRDSKVSL (MAR1_HUMAN)
DMRDSKVSL

SEQ ID NO: 114481 - protein, 10 aa, Artificial Sequence
  Description of Artificial Sequence: Synthetic peptide
  Seed: APPAYEKLSA (MAR1_HUMAN)
AIPAYEKLSM

SEQ ID NO: 114482 - protein, 9 aa, Artificial Sequence
  Description of Artificial Sequence: Synthetic peptide
  Seed: AAGIGILTV (MAR1_HUMAN)
AMGIGILTL

SEQ ID NO: 114483 - protein, 9 aa, Artificial Sequence
  Description of Artificial Sequence: Synthetic peptide
  Seed: ALMDKSLHV (MAR1_HUMAN)
AVMDKSLHK

SEQ ID NO: 114484 - protein, 9 aa, Artificial Sequence
  Description of Artificial Sequence: Synthetic peptide
  Seed: ALMDKSLHV (MAR1_HUMAN)
ASMDKSLHR

SEQ ID NO: 114485 - protein, 10 aa, Artificial Sequence
  Description of Artificial Sequence: Synthetic peptide
  Seed: ALMDKSLHVG (MAR1_HUMAN)
ARMDKSLHVV

SEQ ID NO: 114486 - protein, 9 aa, Artificial Sequence
  Description of Artificial Sequence: Synthetic peptide
  Seed: AGIGILTVI (MAR1_HUMAN)
ASIGILTVI

SEQ ID NO: 114487 - protein, 10 aa, Artificial Sequence
  Description of Artificial Sequence: Synthetic peptide
  Seed: RDSKVSLQEK (MAR1_HUMAN)
RTSKVSLQEA

SEQ ID NO: 114488 - protein, 9 aa, Artificial Sequence
  Description of Artificial Sequence: Synthetic peptide
  Seed: YRALMDKSL (MAR1_HUMAN)
YKALMDKSM

SEQ ID NO: 114489 - protein, 9 aa, Artificial Sequence
  Description of Artificial Sequence: Synthetic peptide
  Seed: VILGVLLLI (MAR1_HUMAN)
VQLGVLLLV

SEQ ID NO: 114490 - protein, 9 aa, Artificial Sequence
  Description of Artificial Sequence: Synthetic peptide
  Seed: ALMDKSLHV (MAR1_HUMAN)
ALMDKSLHL

SEQ ID NO: 114491 - protein, 9 aa, Artificial Sequence
  Description of Artificial Sequence: Synthetic peptide
  Seed: SLHVGTQCA (MAR1_HUMAN)
SMHVGTQCI

SEQ ID NO: 114492 - protein, 9 aa, Artificial Sequence
  Description of Artificial Sequence: Synthetic peptide
  Seed: LIGCWYCRR (MAR1_HUMAN)
LMGCWYCRR

SEQ ID NO: 114493 - protein, 10 aa, Artificial Sequence
  Description of Artificial Sequence: Synthetic peptide
  Seed: REDAHFIYGY (MAR1_HUMAN)
RYDAHFIYGY

SEQ ID NO: 114494 - protein, 10 aa, Artificial Sequence
  Description of Artificial Sequence: Synthetic peptide
  Seed: RRRNGYRALM (MAR1_HUMAN)
RQRNGYRALY

SEQ ID NO: 114495 - protein, 9 aa, Artificial Sequence
  Description of Artificial Sequence: Synthetic peptide
  Seed: RRNGYRALM (MAR1_HUMAN)
RRNGYRALR

SEQ ID NO: 114496 - protein, 10 aa, Artificial Sequence
  Description of Artificial Sequence: Synthetic peptide
  Seed: ALMDKSLHVG (MAR1_HUMAN)
AMMDKSLHVN

SEQ ID NO: 114497 - protein, 9 aa, Artificial Sequence
  Description of Artificial Sequence: Synthetic peptide
  Seed: AGIGILTVI (MAR1_HUMAN)
ALIGILTVT

SEQ ID NO: 114498 - protein, 9 aa, Artificial Sequence
  Description of Artificial Sequence: Synthetic peptide
  Seed: TTAEEAAGI (MAR1_HUMAN)
TTAEEAAGA

SEQ ID NO: 114499 - protein, 9 aa, Artificial Sequence
  Description of Artificial Sequence: Synthetic peptide
  Seed: VILGVLLLI (MAR1_HUMAN)
VGLGVLLLW

SEQ ID NO: 114500 - protein, 11 aa, Artificial Sequence
  Description of Artificial Sequence: Synthetic peptide
  Seed: YRALMDKSLHV (MAR1_HUMAN)
YFALMDKSLHI

SEQ ID NO: 114501 - protein, 10 aa, Artificial Sequence
  Description of Artificial Sequence: Synthetic peptide
  Seed: EEAAGIGILT (MAR1_HUMAN)
ENAAGIGILI

SEQ ID NO: 114502 - protein, 9 aa, Artificial Sequence
  Description of Artificial Sequence: Synthetic peptide
  Seed: EAAGIGILT (MAR1_HUMAN)
ETAGIGILA

SEQ ID NO: 114503 - protein, 10 aa, Artificial Sequence
  Description of Artificial Sequence: Synthetic peptide
  Seed: RDSKVSLQEK (MAR1_HUMAN)
RSSKVSLQEK

SEQ ID NO: 114504 - protein, 9 aa, Artificial Sequence
  Description of Artificial Sequence: Synthetic peptide
  Seed: LHVGTQCAL (MAR1_HUMAN)
LQVGTQCAM

SEQ ID NO: 114505 - protein, 10 aa, Artificial Sequence
  Description of Artificial Sequence: Synthetic peptide
  Seed: YTTAEEAAGI (MAR1_HUMAN)
YHTAEEAAGV

SEQ ID NO: 114506 - protein, 9 aa, Artificial Sequence
  Description of Artificial Sequence: Synthetic peptide
  Seed: ALMDKSLHV (MAR1_HUMAN)
AGMDKSLHV

SEQ ID NO: 114507 - protein, 11 aa, Artificial Sequence
  Description of Artificial Sequence: Synthetic peptide
  Seed: YCRRRNGYRAL (MAR1_HUMAN)
YVRRRNGYRAL

SEQ ID NO: 114508 - protein, 10 aa, Artificial Sequence
  Description of Artificial Sequence: Synthetic peptide
  Seed: LLLIGCWYCR (MAR1_HUMAN)
LVLIGCWYCR

SEQ ID NO: 114509 - protein, 10 aa, Artificial Sequence
  Description of Artificial Sequence: Synthetic peptide
  Seed: RRRNGYRALM (MAR1_HUMAN)
RDRNGYRALK

SEQ ID NO: 114510 - protein, 9 aa, Artificial Sequence
  Description of Artificial Sequence: Synthetic peptide
  Seed: VVPNAPPAY (MAR1_HUMAN)
VMPNAPPAM

SEQ ID NO: 114511 - protein, 9 aa, Artificial Sequence
  Description of Artificial Sequence: Synthetic peptide
  Seed: AAGIGILTV (MAR1_HUMAN)
AMGIGILTI

SEQ ID NO: 114512 - protein, 9 aa, Artificial Sequence
  Description of Artificial Sequence: Synthetic peptide
  Seed: VVPNAPPAY (MAR1_HUMAN)
VGPNAPPAM

SEQ ID NO: 114513 - protein, 10 aa, Artificial Sequence
  Description of Artificial Sequence: Synthetic peptide
  Seed: RRRNGYRALM (MAR1_HUMAN)
RQRNGYRALM

SEQ ID NO: 114514 - protein, 9 aa, Artificial Sequence
  Description of Artificial Sequence: Synthetic peptide
  Seed: EDAHFIYGY (MAR1_HUMAN)
ESAHFIYGF

SEQ ID NO: 114515 - protein, 10 aa, Artificial Sequence
  Description of Artificial Sequence: Synthetic peptide
  Seed: RRRNGYRALM (MAR1_HUMAN)
RNRNGYRALF

SEQ ID NO: 114516 - protein, 9 aa, Artificial Sequence
  Description of Artificial Sequence: Synthetic peptide
  Seed: TVILGVLLL (MAR1_HUMAN)
TSILGVLLW

SEQ ID NO: 114517 - protein, 9 aa, Artificial Sequence
  Description of Artificial Sequence: Synthetic peptide
  Seed: RRNGYRALM (MAR1_HUMAN)
RFNGYRALF

SEQ ID NO: 114518 - protein, 9 aa, Artificial Sequence
  Description of Artificial Sequence: Synthetic peptide
  Seed: HSYTTAEEA (MAR1_HUMAN)
HLYTTAEEF

SEQ ID NO: 114519 - protein, 9 aa, Artificial Sequence
  Description of Artificial Sequence: Synthetic peptide
  Seed: VVPNAPPAY (MAR1_HUMAN)
VQPNAPPAL

SEQ ID NO: 114520 - protein, 9 aa, Artificial Sequence
  Description of Artificial Sequence: Synthetic peptide
  Seed: SAEQSPPPY (MAR1_HUMAN)
SMEQSPPPY

SEQ ID NO: 114521 - protein, 9 aa, Artificial Sequence
  Description of Artificial Sequence: Synthetic peptide
  Seed: GFDHRDSKV (MAR1_HUMAN)
GYDHRDSKF

SEQ ID NO: 114522 - protein, 9 aa, Artificial Sequence
  Description of Artificial Sequence: Synthetic peptide
  Seed: NAPPAYEKL (MAR1_HUMAN)
NEPPAYEKL

SEQ ID NO: 114523 - protein, 9 aa, Artificial Sequence
  Description of Artificial Sequence: Synthetic peptide
  Seed: ALMDKSLHV (MAR1_HUMAN)
ARMDKSLHV

SEQ ID NO: 114524 - protein, 10 aa, Artificial Sequence
  Description of Artificial Sequence: Synthetic peptide
  Seed: ALMDKSLHVG (MAR1_HUMAN)
ALMDKSLHVI

SEQ ID NO: 114525 - protein, 10 aa, Artificial Sequence
  Description of Artificial Sequence: Synthetic peptide
  Seed: APPAYEKLSA (MAR1_HUMAN)
AEPAYEKLSL

SEQ ID NO: 114526 - protein, 9 aa, Artificial Sequence
  Description of Artificial Sequence: Synthetic peptide
  Seed: VILGVLLLI (MAR1_HUMAN)
VQLGVLLLF

SEQ ID NO: 114527 - protein, 10 aa, Artificial Sequence
  Description of Artificial Sequence: Synthetic peptide
  Seed: IGILTVILGV (MAR1_HUMAN)
ILILTVILGI

SEQ ID NO: 114528 - protein, 10 aa, Artificial Sequence
  Description of Artificial Sequence: Synthetic peptide
  Seed: AHFIYGYPKK (MAR1_HUMAN)
AWFIYGYPKR

SEQ ID NO: 114529 - protein, 10 aa, Artificial Sequence
  Description of Artificial Sequence: Synthetic peptide
  Seed: RRRNGYRALM (MAR1_HUMAN)
RTRNGYRALF

SEQ ID NO: 114530 - protein, 10 aa, Artificial Sequence
  Description of Artificial Sequence: Synthetic peptide
  Seed: RRRNGYRALM (MAR1_HUMAN)
RVRNGYRALF

SEQ ID NO: 114531 - protein, 9 aa, Artificial Sequence
  Description of Artificial Sequence: Synthetic peptide
  Seed: AGIGILTVI (MAR1_HUMAN)
ARIGILTVL

SEQ ID NO: 114532 - protein, 9 aa, Artificial Sequence
  Description of Artificial Sequence: Synthetic peptide
  Seed: RRRNGYRAL (MAR1_HUMAN)
RLRNGYRAY

SEQ ID NO: 114533 - protein, 10 aa, Artificial Sequence
  Description of Artificial Sequence: Synthetic peptide
  Seed: EEAAGIGILT (MAR1_HUMAN)
ETAAGIGILM

SEQ ID NO: 114534 - protein, 8 aa, Artificial Sequence
  Description of Artificial Sequence: Synthetic peptide
  Seed: LMDKSLHV (MAR1_HUMAN)
LWDKSLHM

SEQ ID NO: 114535 - protein, 9 aa, Artificial Sequence
  Description of Artificial Sequence: Synthetic peptide
  Seed: EGFDHRDSK (MAR1_HUMAN)
EYFDHRDSK

SEQ ID NO: 114536 - protein, 10 aa, Artificial Sequence
  Description of Artificial Sequence: Synthetic peptide
  Seed: RALMDKSLHV (MAR1_HUMAN)
RLLMDKSLHA

SEQ ID NO: 114537 - protein, 10 aa, Artificial Sequence
  Description of Artificial Sequence: Synthetic peptide
  Seed: YPKKGHGHSY (MAR1_HUMAN)
YRKKGHGHSF

SEQ ID NO: 114538 - protein, 10 aa, Artificial Sequence
  Description of Artificial Sequence: Synthetic peptide
  Seed: TVILGVLLLI (MAR1_HUMAN)
TDILGVLLLV

SEQ ID NO: 114539 - protein, 9 aa, Artificial Sequence
  Description of Artificial Sequence: Synthetic peptide
  Seed: MPREDAHFI (MAR1_HUMAN)
MPREDAHFY

SEQ ID NO: 114540 - protein, 9 aa, Artificial Sequence
  Description of Artificial Sequence: Synthetic peptide
  Seed: MPREDAHFI (MAR1_HUMAN)
MPREDAHFF

SEQ ID NO: 114541 - protein, 8 aa, Artificial Sequence
  Description of Artificial Sequence: Synthetic peptide
  Seed: LMDKSLHV (MAR1_HUMAN)
LIDKSLHL

SEQ ID NO: 114542 - protein, 9 aa, Artificial Sequence
  Description of Artificial Sequence: Synthetic peptide
  Seed: ALMDKSLHV (MAR1_HUMAN)
AAMDKSLHY

SEQ ID NO: 114543 - protein, 9 aa, Artificial Sequence
  Description of Artificial Sequence: Synthetic peptide
  Seed: AGIGILTVI (MAR1_HUMAN)
AVIGILTVY

SEQ ID NO: 114544 - protein, 11 aa, Artificial Sequence
  Description of Artificial Sequence: Synthetic peptide
  Seed: YRALMDKSLHV (MAR1_HUMAN)
YQALMDKSLHM

SEQ ID NO: 114545 - protein, 10 aa, Artificial Sequence
  Description of Artificial Sequence: Synthetic peptide
  Seed: ALMDKSLHVG (MAR1_HUMAN)
AQMDKSLHVI

SEQ ID NO: 114546 - protein, 11 aa, Artificial Sequence
  Description of Artificial Sequence: Synthetic peptide
  Seed: RALMDKSLHVG (MAR1_HUMAN)
RQLMDKSLHVV

SEQ ID NO: 114547 - protein, 9 aa, Artificial Sequence
  Description of Artificial Sequence: Synthetic peptide
  Seed: ALMDKSLHV (MAR1_HUMAN)
AYMDKSLHF

SEQ ID NO: 114548 - protein, 10 aa, Artificial Sequence
  Description of Artificial Sequence: Synthetic peptide
  Seed: YTTAEEAAGI (MAR1_HUMAN)
YDTAEEAAGI

SEQ ID NO: 114549 - protein, 9 aa, Artificial Sequence
  Description of Artificial Sequence: Synthetic peptide
  Seed: GFDHRDSKV (MAR1_HUMAN)
GADHRDSKF

SEQ ID NO: 114550 - protein, 9 aa, Artificial Sequence
  Description of Artificial Sequence: Synthetic peptide
  Seed: VILGVLLLI (MAR1_HUMAN)
VSLGVLLLY

SEQ ID NO: 114551 - protein, 9 aa, Artificial Sequence
  Description of Artificial Sequence: Synthetic peptide
  Seed: REDAHFIYG (MAR1_HUMAN)
REDAHFIYF

SEQ ID NO: 114552 - protein, 9 aa, Artificial Sequence
  Description of Artificial Sequence: Synthetic peptide
  Seed: HFIYGYPKK (MAR1_HUMAN)
HYIYGYPKR

SEQ ID NO: 114553 - protein, 9 aa, Artificial Sequence
  Description of Artificial Sequence: Synthetic peptide
  Seed: GFDHRDSKV (MAR1_HUMAN)
GFDHRDSKI

SEQ ID NO: 114554 - protein, 9 aa, Artificial Sequence
  Description of Artificial Sequence: Synthetic peptide
  Seed: VVPNAPPAY (MAR1_HUMAN)
VVPNAPPAL

SEQ ID NO: 114555 - protein, 10 aa, Artificial Sequence
  Description of Artificial Sequence: Synthetic peptide
  Seed: RALMDKSLHV (MAR1_HUMAN)
RILMDKSLHI

SEQ ID NO: 114556 - protein, 9 aa, Artificial Sequence
  Description of Artificial Sequence: Synthetic peptide
  Seed: LHVGTQCAL (MAR1_HUMAN)
LVVGTQCAY

SEQ ID NO: 114557 - protein, 10 aa, Artificial Sequence
  Description of Artificial Sequence: Synthetic peptide
  Seed: RRRNGYRALM (MAR1_HUMAN)
RMRNGYRALM

SEQ ID NO: 114558 - protein, 10 aa, Artificial Sequence
  Description of Artificial Sequence: Synthetic peptide
  Seed: ALMDKSLHVG (MAR1_HUMAN)
ALMDKSLHVD

SEQ ID NO: 114559 - protein, 10 aa, Artificial Sequence
  Description of Artificial Sequence: Synthetic peptide
  Seed: ALMDKSLHVG (MAR1_HUMAN)
AAMDKSLHVA

SEQ ID NO: 114560 - protein, 10 aa, Artificial Sequence
  Description of Artificial Sequence: Synthetic peptide
  Seed: YTTAEEAAGI (MAR1_HUMAN)
YLTAEEAAGM

SEQ ID NO: 114561 - protein, 10 aa, Artificial Sequence
  Description of Artificial Sequence: Synthetic peptide
  Seed: LLLIGCWYCR (MAR1_HUMAN)
LNLIGCWYCR

SEQ ID NO: 114562 - protein, 10 aa, Artificial Sequence
  Description of Artificial Sequence: Synthetic peptide
  Seed: RRRNGYRALM (MAR1_HUMAN)
RGRNGYRALF

SEQ ID NO: 114563 - protein, 10 aa, Artificial Sequence
  Description of Artificial Sequence: Synthetic peptide
  Seed: EEAAGIGILT (MAR1_HUMAN)
EMAAGIGILI

SEQ ID NO: 114564 - protein, 10 aa, Artificial Sequence
  Description of Artificial Sequence: Synthetic peptide
  Seed: RDSKVSLQEK (MAR1_HUMAN)
RVSKVSLQEA

SEQ ID NO: 114565 - protein, 8 aa, Artificial Sequence
  Description of Artificial Sequence: Synthetic peptide
  Seed: NAPPAYEK (MAR1_HUMAN)
NAPPAYEL

SEQ ID NO: 114566 - protein, 9 aa, Artificial Sequence
  Description of Artificial Sequence: Synthetic peptide
  Seed: YRALMDKSL (MAR1_HUMAN)
YMALMDKSY

SEQ ID NO: 114567 - protein, 9 aa, Artificial Sequence
  Description of Artificial Sequence: Synthetic peptide
  Seed: TVILGVLLL (MAR1_HUMAN)
TAILGVLLF

SEQ ID NO: 114568 - protein, 10 aa, Artificial Sequence
  Description of Artificial Sequence: Synthetic peptide
  Seed: ALMDKSLHVG (MAR1_HUMAN)
AHMDKSLHVV

SEQ ID NO: 114569 - protein, 9 aa, Artificial Sequence
  Description of Artificial Sequence: Synthetic peptide
  Seed: HFIYGYPKK (MAR1_HUMAN)
HGIYGYPKR

SEQ ID NO: 114570 - protein, 9 aa, Artificial Sequence
  Description of Artificial Sequence: Synthetic peptide
  Seed: TVILGVLLL (MAR1_HUMAN)
TQILGVLLV

SEQ ID NO: 114571 - protein, 9 aa, Artificial Sequence
  Description of Artificial Sequence: Synthetic peptide
  Seed: ALMDKSLHV (MAR1_HUMAN)
AVMDKSLHR

SEQ ID NO: 114572 - protein, 9 aa, Artificial Sequence
  Description of Artificial Sequence: Synthetic peptide
  Seed: AHFIYGYPK (MAR1_HUMAN)
ASFIYGYPK

SEQ ID NO: 114573 - protein, 9 aa, Artificial Sequence
  Description of Artificial Sequence: Synthetic peptide
  Seed: EDAHFIYGY (MAR1_HUMAN)
EVAHFIYGV

SEQ ID NO: 114574 - protein, 10 aa, Artificial Sequence
  Description of Artificial Sequence: Synthetic peptide
  Seed: YPKKGHGHSY (MAR1_HUMAN)
YMKKGHGHSF

SEQ ID NO: 114575 - protein, 11 aa, Artificial Sequence
  Description of Artificial Sequence: Synthetic peptide
  Seed: CWYCRRRNGYR (MAR1_HUMAN)
CMYCRRRNGYR

SEQ ID NO: 114576 - protein, 10 aa, Artificial Sequence
  Description of Artificial Sequence: Synthetic peptide
  Seed: SLHVGTQCAL (MAR1_HUMAN)
SVHVGTQCAF

SEQ ID NO: 114577 - protein, 9 aa, Artificial Sequence
  Description of Artificial Sequence: Synthetic peptide
  Seed: VLLLIGCWY (MAR1_HUMAN)
VMLLIGCWY

SEQ ID NO: 114578 - protein, 9 aa, Artificial Sequence
  Description of Artificial Sequence: Synthetic peptide
  Seed: ALMDKSLHV (MAR1_HUMAN)
AAMDKSLHR

SEQ ID NO: 114579 - protein, 11 aa, Artificial Sequence
  Description of Artificial Sequence: Synthetic peptide
  Seed: YRALMDKSLHV (MAR1_HUMAN)
YAALMDKSLHI

SEQ ID NO: 114580 - protein, 9 aa, Artificial Sequence
  Description of Artificial Sequence: Synthetic peptide
  Seed: HSYTTAEEA (MAR1_HUMAN)
HTYTTAEEL

SEQ ID NO: 114581 - protein, 9 aa, Artificial Sequence
  Description of Artificial Sequence: Synthetic peptide
  Seed: VILGVLLLI (MAR1_HUMAN)
VLLGVLLLI

SEQ ID NO: 114582 - protein, 10 aa, Artificial Sequence
  Description of Artificial Sequence: Synthetic peptide
  Seed: LTVILGVLLL (MAR1_HUMAN)
LSVILGVLLW

SEQ ID NO: 114583 - protein, 9 aa, Artificial Sequence
  Description of Artificial Sequence: Synthetic peptide
  Seed: YRALMDKSL (MAR1_HUMAN)
YQALMDKSF

SEQ ID NO: 114584 - protein, 9 aa, Artificial Sequence
  Description of Artificial Sequence: Synthetic peptide
  Seed: GILTVILGV (MAR1_HUMAN)
GLLTVILGR

SEQ ID NO: 114585 - protein, 10 aa, Artificial Sequence
  Description of Artificial Sequence: Synthetic peptide
  Seed: APPAYEKLSA (MAR1_HUMAN)
ANPAYEKLSL

SEQ ID NO: 114586 - protein, 9 aa, Artificial Sequence
  Description of Artificial Sequence: Synthetic peptide
  Seed: EDAHFIYGY (MAR1_HUMAN)
ELAHFIYGY

SEQ ID NO: 114587 - protein, 9 aa, Artificial Sequence
  Description of Artificial Sequence: Synthetic peptide
  Seed: YRALMDKSL (MAR1_HUMAN)
YWALMDKSL

SEQ ID NO: 114588 - protein, 9 aa, Artificial Sequence
  Description of Artificial Sequence: Synthetic peptide
  Seed: NAPPAYEKL (MAR1_HUMAN)
NTPPAYEKM

SEQ ID NO: 114589 - protein, 10 aa, Artificial Sequence
  Description of Artificial Sequence: Synthetic peptide
  Seed: RRRNGYRALM (MAR1_HUMAN)
RGRNGYRALK

SEQ ID NO: 114590 - protein, 9 aa, Artificial Sequence
  Description of Artificial Sequence: Synthetic peptide
  Seed: RRRNGYRAL (MAR1_HUMAN)
RFRNGYRAL

SEQ ID NO: 114591 - protein, 10 aa, Artificial Sequence
  Description of Artificial Sequence: Synthetic peptide
  Seed: SLHVGTQCAL (MAR1_HUMAN)
SQHVGTQCAF

SEQ ID NO: 114592 - protein, 9 aa, Artificial Sequence
  Description of Artificial Sequence: Synthetic peptide
  Seed: HSYTTAEEA (MAR1_HUMAN)
HPYTTAEEA

SEQ ID NO: 114593 - protein, 9 aa, Artificial Sequence
  Description of Artificial Sequence: Synthetic peptide
  Seed: DHRDSKVSL (MAR1_HUMAN)
DHRDSKVSA

SEQ ID NO: 114594 - protein, 11 aa, Artificial Sequence
  Description of Artificial Sequence: Synthetic peptide
  Seed: YRALMDKSLHV (MAR1_HUMAN)
YMALMDKSLHL

SEQ ID NO: 114595 - protein, 10 aa, Artificial Sequence
  Description of Artificial Sequence: Synthetic peptide
  Seed: APPAYEKLSA (MAR1_HUMAN)
AKPAYEKLSL

SEQ ID NO: 114596 - protein, 9 aa, Artificial Sequence
  Description of Artificial Sequence: Synthetic peptide
  Seed: EDAHFIYGY (MAR1_HUMAN)
EYAHFIYGY

SEQ ID NO: 114597 - protein, 9 aa, Artificial Sequence
  Description of Artificial Sequence: Synthetic peptide
  Seed: VVPNAPPAY (MAR1_HUMAN)
VYPNAPPAI

SEQ ID NO: 114598 - protein, 9 aa, Artificial Sequence
  Description of Artificial Sequence: Synthetic peptide
  Seed: ALMDKSLHV (MAR1_HUMAN)
AIMDKSLHL

SEQ ID NO: 114599 - protein, 9 aa, Artificial Sequence
  Description of Artificial Sequence: Synthetic peptide
  Seed: LTVILGVLL (MAR1_HUMAN)
LAVILGVLW

SEQ ID NO: 114600 - protein, 8 aa, Artificial Sequence
  Description of Artificial Sequence: Synthetic peptide
  Seed: LMDKSLHV (MAR1_HUMAN)
LTDKSLHV

SEQ ID NO: 114601 - protein, 8 aa, Artificial Sequence
  Description of Artificial Sequence: Synthetic peptide
  Seed: LMDKSLHV (MAR1_HUMAN)
LIDKSLHF

SEQ ID NO: 114602 - protein, 9 aa, Artificial Sequence
  Description of Artificial Sequence: Synthetic peptide
  Seed: TVILGVLLL (MAR1_HUMAN)
TVILGVLLY

SEQ ID NO: 114603 - protein, 9 aa, Artificial Sequence
  Description of Artificial Sequence: Synthetic peptide
  Seed: LLIGCWYCR (MAR1_HUMAN)
LAIGCWYCR

SEQ ID NO: 114604 - protein, 9 aa, Artificial Sequence
  Description of Artificial Sequence: Synthetic peptide
  Seed: NAPPAYEKL (MAR1_HUMAN)
NYPPAYEKL

SEQ ID NO: 114605 - protein, 10 aa, Artificial Sequence
  Description of Artificial Sequence: Synthetic peptide
  Seed: YPKKGHGHSY (MAR1_HUMAN)
YLKKGHGHSY

SEQ ID NO: 114606 - protein, 10 aa, Artificial Sequence
  Description of Artificial Sequence: Synthetic peptide
  Seed: RALMDKSLHV (MAR1_HUMAN)
RLLMDKSLHV

SEQ ID NO: 114607 - protein, 10 aa, Artificial Sequence
  Description of Artificial Sequence: Synthetic peptide
  Seed: RALMDKSLHV (MAR1_HUMAN)
RELMDKSLHL

SEQ ID NO: 114608 - protein, 10 aa, Artificial Sequence
  Description of Artificial Sequence: Synthetic peptide
  Seed: RALMDKSLHV (MAR1_HUMAN)
RWLMDKSLHI

SEQ ID NO: 114609 - protein, 10 aa, Artificial Sequence
  Description of Artificial Sequence: Synthetic peptide
  Seed: YPKKGHGHSY (MAR1_HUMAN)
YTKKGHGHSY

SEQ ID NO: 114610 - protein, 10 aa, Artificial Sequence
  Description of Artificial Sequence: Synthetic peptide
  Seed: RALMDKSLHV (MAR1_HUMAN)
RGLMDKSLHI

SEQ ID NO: 114611 - protein, 10 aa, Artificial Sequence
  Description of Artificial Sequence: Synthetic peptide
  Seed: EEAAGIGILT (MAR1_HUMAN)
ERAAGIGILV

SEQ ID NO: 114612 - protein, 10 aa, Artificial Sequence
  Description of Artificial Sequence: Synthetic peptide
  Seed: DAHFIYGYPK (MAR1_HUMAN)
DSHFIYGYPK

SEQ ID NO: 114613 - protein, 10 aa, Artificial Sequence
  Description of Artificial Sequence: Synthetic peptide
  Seed: RDSKVSLQEK (MAR1_HUMAN)
RTSKVSLQEV

SEQ ID NO: 114614 - protein, 10 aa, Artificial Sequence
  Description of Artificial Sequence: Synthetic peptide
  Seed: RRRNGYRALM (MAR1_HUMAN)
RDRNGYRALL

SEQ ID NO: 114615 - protein, 9 aa, Artificial Sequence
  Description of Artificial Sequence: Synthetic peptide
  Seed: HSYTTAEEA (MAR1_HUMAN)
HVYTTAEEM

SEQ ID NO: 114616 - protein, 9 aa, Artificial Sequence
  Description of Artificial Sequence: Synthetic peptide
  Seed: ALMDKSLHV (MAR1_HUMAN)
AQMDKSLHV

SEQ ID NO: 114617 - protein, 9 aa, Artificial Sequence
  Description of Artificial Sequence: Synthetic peptide
  Seed: GILTVILGV (MAR1_HUMAN)
GLLTVILGM

SEQ ID NO: 114618 - protein, 9 aa, Artificial Sequence
  Description of Artificial Sequence: Synthetic peptide
  Seed: EGFDHRDSK (MAR1_HUMAN)
EIFDHRDSY

SEQ ID NO: 114619 - protein, 9 aa, Artificial Sequence
  Description of Artificial Sequence: Synthetic peptide
  Seed: AGIGILTVI (MAR1_HUMAN)
AAIGILTVI

SEQ ID NO: 114620 - protein, 9 aa, Artificial Sequence
  Description of Artificial Sequence: Synthetic peptide
  Seed: TVILGVLLL (MAR1_HUMAN)
TAILGVLLV

SEQ ID NO: 114621 - protein, 9 aa, Artificial Sequence
  Description of Artificial Sequence: Synthetic peptide
  Seed: LLLIGCWYC (MAR1_HUMAN)
LILIGCWYI

SEQ ID NO: 114622 - protein, 9 aa, Artificial Sequence
  Description of Artificial Sequence: Synthetic peptide
  Seed: TVILGVLLL (MAR1_HUMAN)
TLILGVLLI

SEQ ID NO: 114623 - protein, 10 aa, Artificial Sequence
  Description of Artificial Sequence: Synthetic peptide
  Seed: LLIGCWYCRR (MAR1_HUMAN)
LMIGCWYCRK

SEQ ID NO: 114624 - protein, 10 aa, Artificial Sequence
  Description of Artificial Sequence: Synthetic peptide
  Seed: TVILGVLLLI (MAR1_HUMAN)
TRILGVLLLV

SEQ ID NO: 114625 - protein, 9 aa, Artificial Sequence
  Description of Artificial Sequence: Synthetic peptide
  Seed: VVPNAPPAY (MAR1_HUMAN)
VAPNAPPAF

SEQ ID NO: 114626 - protein, 10 aa, Artificial Sequence
  Description of Artificial Sequence: Synthetic peptide
  Seed: RDSKVSLQEK (MAR1_HUMAN)
RASKVSLQEK

SEQ ID NO: 114627 - protein, 9 aa, Artificial Sequence
  Description of Artificial Sequence: Synthetic peptide
  Seed: LLIGCWYCR (MAR1_HUMAN)
LIIGCWYCK

SEQ ID NO: 114628 - protein, 10 aa, Artificial Sequence
  Description of Artificial Sequence: Synthetic peptide
  Seed: AHFIYGYPKK (MAR1_HUMAN)
AMFIYGYPKR

SEQ ID NO: 114629 - protein, 9 aa, Artificial Sequence
  Description of Artificial Sequence: Synthetic peptide
  Seed: EDAHFIYGY (MAR1_HUMAN)
EVAHFIYGM

SEQ ID NO: 114630 - protein, 10 aa, Artificial Sequence
  Description of Artificial Sequence: Synthetic peptide
  Seed: MPREDAHFIY (MAR1_HUMAN)
MPREDAHFIW

SEQ ID NO: 114631 - protein, 8 aa, Artificial Sequence
  Description of Artificial Sequence: Synthetic peptide
  Seed: LMDKSLHV (MAR1_HUMAN)
LGDKSLHV

SEQ ID NO: 114632 - protein, 9 aa, Artificial Sequence
  Description of Artificial Sequence: Synthetic peptide
  Seed: EDAHFIYGY (MAR1_HUMAN)
ETAHFIYGL

SEQ ID NO: 114633 - protein, 10 aa, Artificial Sequence
  Description of Artificial Sequence: Synthetic peptide
  Seed: YTTAEEAAGI (MAR1_HUMAN)
YETAEEAAGI

SEQ ID NO: 114634 - protein, 9 aa, Artificial Sequence
  Description of Artificial Sequence: Synthetic peptide
  Seed: NAPPAYEKL (MAR1_HUMAN)
NYPPAYEKY

SEQ ID NO: 114635 - protein, 9 aa, Artificial Sequence
  Description of Artificial Sequence: Synthetic peptide
  Seed: EGFDHRDSK (MAR1_HUMAN)
ETFDHRDSR

SEQ ID NO: 114636 - protein, 9 aa, Artificial Sequence
  Description of Artificial Sequence: Synthetic peptide
  Seed: RRRNGYRAL (MAR1_HUMAN)
RWRNGYRAF

SEQ ID NO: 114637 - protein, 11 aa, Artificial Sequence
  Description of Artificial Sequence: Synthetic peptide
  Seed: YRALMDKSLHV (MAR1_HUMAN)
YCALMDKSLHM

SEQ ID NO: 114638 - protein, 9 aa, Artificial Sequence
  Description of Artificial Sequence: Synthetic peptide
  Seed: EQSPPPYSP (MAR1_HUMAN)
ERSPPPYSA

SEQ ID NO: 114639 - protein, 10 aa, Artificial Sequence
  Description of Artificial Sequence: Synthetic peptide
  Seed: ALMDKSLHVG (MAR1_HUMAN)
AVMDKSLHVV

SEQ ID NO: 114640 - protein, 11 aa, Artificial Sequence
  Description of Artificial Sequence: Synthetic peptide
  Seed: LLIGCWYCRRR (MAR1_HUMAN)
LMIGCWYCRRR

SEQ ID NO: 114641 - protein, 9 aa, Artificial Sequence
  Description of Artificial Sequence: Synthetic peptide
  Seed: TTAEEAAGI (MAR1_HUMAN)
TIAEEAAGL

SEQ ID NO: 114642 - protein, 11 aa, Artificial Sequence
  Description of Artificial Sequence: Synthetic peptide
  Seed: RALMDKSLHVG (MAR1_HUMAN)
RMLMDKSLHVA

SEQ ID NO: 114643 - protein, 11 aa, Artificial Sequence
  Description of Artificial Sequence: Synthetic peptide
  Seed: YRALMDKSLHV (MAR1_HUMAN)
YLALMDKSLHM

SEQ ID NO: 114644 - protein, 9 aa, Artificial Sequence
  Description of Artificial Sequence: Synthetic peptide
  Seed: EAAGIGILT (MAR1_HUMAN)
EMAGIGILI

SEQ ID NO: 114645 - protein, 10 aa, Artificial Sequence
  Description of Artificial Sequence: Synthetic peptide
  Seed: ALMDKSLHVG (MAR1_HUMAN)
AKMDKSLHVV

SEQ ID NO: 114646 - protein, 10 aa, Artificial Sequence
  Description of Artificial Sequence: Synthetic peptide
  Seed: RALMDKSLHV (MAR1_HUMAN)
RDLMDKSLHA

SEQ ID NO: 114647 - protein, 9 aa, Artificial Sequence
  Description of Artificial Sequence: Synthetic peptide
  Seed: TTAEEAAGI (MAR1_HUMAN)
TTAEEAAGM

SEQ ID NO: 114648 - protein, 10 aa, Artificial Sequence
  Description of Artificial Sequence: Synthetic peptide
  Seed: RALMDKSLHV (MAR1_HUMAN)
RPLMDKSLHA

SEQ ID NO: 114649 - protein, 9 aa, Artificial Sequence
  Description of Artificial Sequence: Synthetic peptide
  Seed: VILGVLLLI (MAR1_HUMAN)
VTLGVLLLM

SEQ ID NO: 114650 - protein, 11 aa, Artificial Sequence
  Description of Artificial Sequence: Synthetic peptide
  Seed: YRALMDKSLHV (MAR1_HUMAN)
YEALMDKSLHL

SEQ ID NO: 114651 - protein, 10 aa, Artificial Sequence
  Description of Artificial Sequence: Synthetic peptide
  Seed: ALMDKSLHVG (MAR1_HUMAN)
ALMDKSLHVY

SEQ ID NO: 114652 - protein, 9 aa, Artificial Sequence
  Description of Artificial Sequence: Synthetic peptide
  Seed: EDAHFIYGY (MAR1_HUMAN)
EWAHFIYGY

SEQ ID NO: 114653 - protein, 10 aa, Artificial Sequence
  Description of Artificial Sequence: Synthetic peptide
  Seed: ALMDKSLHVG (MAR1_HUMAN)
AQMDKSLHVV

SEQ ID NO: 114654 - protein, 9 aa, Artificial Sequence
  Description of Artificial Sequence: Synthetic peptide
  Seed: LTVILGVLL (MAR1_HUMAN)
LSVILGVLY

SEQ ID NO: 114655 - protein, 11 aa, Artificial Sequence
  Description of Artificial Sequence: Synthetic peptide
  Seed: ALMDKSLHVGT (MAR1_HUMAN)
AMMDKSLHVGI

SEQ ID NO: 114656 - protein, 10 aa, Artificial Sequence
  Description of Artificial Sequence: Synthetic peptide
  Seed: RRRNGYRALM (MAR1_HUMAN)
RHRNGYRALK

SEQ ID NO: 114657 - protein, 10 aa, Artificial Sequence
  Description of Artificial Sequence: Synthetic peptide
  Seed: LSAEQSPPPY (MAR1_HUMAN)
LPAEQSPPPM

SEQ ID NO: 114658 - protein, 10 aa, Artificial Sequence
  Description of Artificial Sequence: Synthetic peptide
  Seed: KGHGHSYTTA (MAR1_HUMAN)
KMHGHSYTTK

SEQ ID NO: 114659 - protein, 9 aa, Artificial Sequence
  Description of Artificial Sequence: Synthetic peptide
  Seed: VVPNAPPAY (MAR1_HUMAN)
VTPNAPPAF

SEQ ID NO: 114660 - protein, 9 aa, Artificial Sequence
  Description of Artificial Sequence: Synthetic peptide
  Seed: AAGIGILTV (MAR1_HUMAN)
ASGIGILTM

SEQ ID NO: 114661 - protein, 9 aa, Artificial Sequence
  Description of Artificial Sequence: Synthetic peptide
  Seed: GVLLLIGCW (MAR1_HUMAN)
GSLLLIGCW

SEQ ID NO: 114662 - protein, 9 aa, Artificial Sequence
  Description of Artificial Sequence: Synthetic peptide
  Seed: LIGCWYCRR (MAR1_HUMAN)
LQGCWYCRR

SEQ ID NO: 114663 - protein, 9 aa, Artificial Sequence
  Description of Artificial Sequence: Synthetic peptide
  Seed: YRALMDKSL (MAR1_HUMAN)
YRALMDKSM

SEQ ID NO: 114664 - protein, 9 aa, Artificial Sequence
  Description of Artificial Sequence: Synthetic peptide
  Seed: EGFDHRDSK (MAR1_HUMAN)
ELFDHRDSR

SEQ ID NO: 114665 - protein, 10 aa, Artificial Sequence
  Description of Artificial Sequence: Synthetic peptide
  Seed: RRRNGYRALM (MAR1_HUMAN)
RVRNGYRALL

SEQ ID NO: 114666 - protein, 10 aa, Artificial Sequence
  Description of Artificial Sequence: Synthetic peptide
  Seed: SLHVGTQCAL (MAR1_HUMAN)
SQHVGTQCAM

SEQ ID NO: 114667 - protein, 10 aa, Artificial Sequence
  Description of Artificial Sequence: Synthetic peptide
  Seed: RALMDKSLHV (MAR1_HUMAN)
RFLMDKSLHA

SEQ ID NO: 114668 - protein, 9 aa, Artificial Sequence
  Description of Artificial Sequence: Synthetic peptide
  Seed: EQSPPPYSP (MAR1_HUMAN)
EESPPPYSA

SEQ ID NO: 114669 - protein, 10 aa, Artificial Sequence
  Description of Artificial Sequence: Synthetic peptide
  Seed: APPAYEKLSA (MAR1_HUMAN)
ADPAYEKLSM

SEQ ID NO: 114670 - protein, 9 aa, Artificial Sequence
  Description of Artificial Sequence: Synthetic peptide
  Seed: ALMDKSLHV (MAR1_HUMAN)
ANMDKSLHL

SEQ ID NO: 114671 - protein, 10 aa, Artificial Sequence
  Description of Artificial Sequence: Synthetic peptide
  Seed: APPAYEKLSA (MAR1_HUMAN)
AIPAYEKLSL

SEQ ID NO: 114672 - protein, 9 aa, Artificial Sequence
  Description of Artificial Sequence: Synthetic peptide
  Seed: SAEQSPPPY (MAR1_HUMAN)
SQEQSPPPY

SEQ ID NO: 114673 - protein, 9 aa, Artificial Sequence
  Description of Artificial Sequence: Synthetic peptide
  Seed: YRALMDKSL (MAR1_HUMAN)
YRALMDKSI

SEQ ID NO: 114674 - protein, 9 aa, Artificial Sequence
  Description of Artificial Sequence: Synthetic peptide
  Seed: NAPPAYEKL (MAR1_HUMAN)
NVPPAYEKL

SEQ ID NO: 114675 - protein, 10 aa, Artificial Sequence
  Description of Artificial Sequence: Synthetic peptide
  Seed: VPNAPPAYEK (MAR1_HUMAN)
VPNAPPAYEV

SEQ ID NO: 114676 - protein, 9 aa, Artificial Sequence
  Description of Artificial Sequence: Synthetic peptide
  Seed: NAPPAYEKL (MAR1_HUMAN)
NRPPAYEKY

SEQ ID NO: 114677 - protein, 9 aa, Artificial Sequence
  Description of Artificial Sequence: Synthetic peptide
  Seed: NAPPAYEKL (MAR1_HUMAN)
NIPPAYEKV

SEQ ID NO: 114678 - protein, 10 aa, Artificial Sequence
  Description of Artificial Sequence: Synthetic peptide
  Seed: IGILTVILGV (MAR1_HUMAN)
IHILTVILGV

SEQ ID NO: 114679 - protein, 10 aa, Artificial Sequence
  Description of Artificial Sequence: Synthetic peptide
  Seed: TVILGVLLLI (MAR1_HUMAN)
TNILGVLLLV

SEQ ID NO: 114680 - protein, 9 aa, Artificial Sequence
  Description of Artificial Sequence: Synthetic peptide
  Seed: AAGIGILTV (MAR1_HUMAN)
AIGIGILTV

SEQ ID NO: 114681 - protein, 9 aa, Artificial Sequence
  Description of Artificial Sequence: Synthetic peptide
  Seed: RRNGYRALM (MAR1_HUMAN)
RSNGYRALY

SEQ ID NO: 114682 - protein, 9 aa, Artificial Sequence
  Description of Artificial Sequence: Synthetic peptide
  Seed: NAPPAYEKL (MAR1_HUMAN)
NWPPAYEKY

SEQ ID NO: 114683 - protein, 8 aa, Artificial Sequence
  Description of Artificial Sequence: Synthetic peptide
  Seed: LMDKSLHV (MAR1_HUMAN)
LWDKSLHI

SEQ ID NO: 114684 - protein, 9 aa, Artificial Sequence
  Description of Artificial Sequence: Synthetic peptide
  Seed: VILGVLLLI (MAR1_HUMAN)
VVLGVLLLY

SEQ ID NO: 114685 - protein, 10 aa, Artificial Sequence
  Description of Artificial Sequence: Synthetic peptide
  Seed: RRRNGYRALM (MAR1_HUMAN)
RQRNGYRALL

SEQ ID NO: 114686 - protein, 9 aa, Artificial Sequence
  Description of Artificial Sequence: Synthetic peptide
  Seed: MPREDAHFI (MAR1_HUMAN)
MTREDAHFY

SEQ ID NO: 114687 - protein, 9 aa, Artificial Sequence
  Description of Artificial Sequence: Synthetic peptide
  Seed: TTAEEAAGI (MAR1_HUMAN)
TVAEEAAGI

SEQ ID NO: 114688 - protein, 9 aa, Artificial Sequence
  Description of Artificial Sequence: Synthetic peptide
  Seed: HFIYGYPKK (MAR1_HUMAN)
HVIYGYPKK

SEQ ID NO: 114689 - protein, 10 aa, Artificial Sequence
  Description of Artificial Sequence: Synthetic peptide
  Seed: IGILTVILGV (MAR1_HUMAN)
IRILTVILGV

SEQ ID NO: 114690 - protein, 10 aa, Artificial Sequence
  Description of Artificial Sequence: Synthetic peptide
  Seed: LLIGCWYCRR (MAR1_HUMAN)
LIIGCWYCRR

SEQ ID NO: 114691 - protein, 10 aa, Artificial Sequence
  Description of Artificial Sequence: Synthetic peptide
  Seed: GILTVILGVL (MAR1_HUMAN)
GMLTVILGVM

SEQ ID NO: 114692 - protein, 9 aa, Artificial Sequence
  Description of Artificial Sequence: Synthetic peptide
  Seed: RRRNGYRAL (MAR1_HUMAN)
RFRNGYRAF

SEQ ID NO: 114693 - protein, 9 aa, Artificial Sequence
  Description of Artificial Sequence: Synthetic peptide
  Seed: ALMDKSLHV (MAR1_HUMAN)
ALMDKSLHM

SEQ ID NO: 114694 - protein, 9 aa, Artificial Sequence
  Description of Artificial Sequence: Synthetic peptide
  Seed: SAEQSPPPY (MAR1_HUMAN)
SPEQSPPPF

SEQ ID NO: 114695 - protein, 10 aa, Artificial Sequence
  Description of Artificial Sequence: Synthetic peptide
  Seed: TVILGVLLLI (MAR1_HUMAN)
TEILGVLLLV

SEQ ID NO: 114696 - protein, 9 aa, Artificial Sequence
  Description of Artificial Sequence: Synthetic peptide
  Seed: ALMDKSLHV (MAR1_HUMAN)
AEMDKSLHV

SEQ ID NO: 114697 - protein, 9 aa, Artificial Sequence
  Description of Artificial Sequence: Synthetic peptide
  Seed: TTAEEAAGI (MAR1_HUMAN)
TIAEEAAGI

SEQ ID NO: 114698 - protein, 10 aa, Artificial Sequence
  Description of Artificial Sequence: Synthetic peptide
  Seed: AEQSPPPYSP (MAR1_HUMAN)
AEQSPPPYSC

SEQ ID NO: 114699 - protein, 9 aa, Artificial Sequence
  Description of Artificial Sequence: Synthetic peptide
  Seed: EQSPPPYSP (MAR1_HUMAN)
EHSPPPYST

SEQ ID NO: 114700 - protein, 9 aa, Artificial Sequence
  Description of Artificial Sequence: Synthetic peptide
  Seed: YEKLSAEQS (MAR1_HUMAN)
YEKLSAEQP

SEQ ID NO: 114701 - protein, 9 aa, Artificial Sequence
  Description of Artificial Sequence: Synthetic peptide
  Seed: GYPKKGHGH (MAR1_HUMAN)
GYPKKGHGY

SEQ ID NO: 114702 - protein, 9 aa, Artificial Sequence
  Description of Artificial Sequence: Synthetic peptide
  Seed: AGIGILTVI (MAR1_HUMAN)
AAIGILTVV

SEQ ID NO: 114703 - protein, 11 aa, Artificial Sequence
  Description of Artificial Sequence: Synthetic peptide
  Seed: YRALMDKSLHV (MAR1_HUMAN)
YTALMDKSLHA

SEQ ID NO: 114704 - protein, 9 aa, Artificial Sequence
  Description of Artificial Sequence: Synthetic peptide
  Seed: ALMDKSLHV (MAR1_HUMAN)
AVMDKSLHI

SEQ ID NO: 114705 - protein, 10 aa, Artificial Sequence
  Description of Artificial Sequence: Synthetic peptide
  Seed: YPKKGHGHSY (MAR1_HUMAN)
YPKKGHGHSA

SEQ ID NO: 114706 - protein, 9 aa, Artificial Sequence
  Description of Artificial Sequence: Synthetic peptide
  Seed: EDAHFIYGY (MAR1_HUMAN)
ESAHFIYGM

SEQ ID NO: 114707 - protein, 10 aa, Artificial Sequence
  Description of Artificial Sequence: Synthetic peptide
  Seed: YPKKGHGHSY (MAR1_HUMAN)
YIKKGHGHSY

SEQ ID NO: 114708 - protein, 10 aa, Artificial Sequence
  Description of Artificial Sequence: Synthetic peptide
  Seed: RDSKVSLQEK (MAR1_HUMAN)
RESKVSLQEK

SEQ ID NO: 114709 - protein, 9 aa, Artificial Sequence
  Description of Artificial Sequence: Synthetic peptide
  Seed: EDAHFIYGY (MAR1_HUMAN)
EAAHFIYGY

SEQ ID NO: 114710 - protein, 9 aa, Artificial Sequence
  Description of Artificial Sequence: Synthetic peptide
  Seed: TTAEEAAGI (MAR1_HUMAN)
TLAEEAAGA

SEQ ID NO: 114711 - protein, 9 aa, Artificial Sequence
  Description of Artificial Sequence: Synthetic peptide
  Seed: AHFIYGYPK (MAR1_HUMAN)
AGFIYGYPK

SEQ ID NO: 114712 - protein, 9 aa, Artificial Sequence
  Description of Artificial Sequence: Synthetic peptide
  Seed: NAPPAYEKL (MAR1_HUMAN)
NPPPAYEKW

SEQ ID NO: 114713 - protein, 10 aa, Artificial Sequence
  Description of Artificial Sequence: Synthetic peptide
  Seed: ALMDKSLHVG (MAR1_HUMAN)
ALMDKSLHVL

SEQ ID NO: 114714 - protein, 10 aa, Artificial Sequence
  Description of Artificial Sequence: Synthetic peptide
  Seed: LSAEQSPPPY (MAR1_HUMAN)
LMAEQSPPPF

SEQ ID NO: 114715 - protein, 9 aa, Artificial Sequence
  Description of Artificial Sequence: Synthetic peptide
  Seed: MPREDAHFI (MAR1_HUMAN)
MAREDAHFM

SEQ ID NO: 114716 - protein, 10 aa, Artificial Sequence
  Description of Artificial Sequence: Synthetic peptide
  Seed: AEQSPPPYSP (MAR1_HUMAN)
AEQSPPPYSV

SEQ ID NO: 114717 - protein, 10 aa, Artificial Sequence
  Description of Artificial Sequence: Synthetic peptide
  Seed: AHFIYGYPKK (MAR1_HUMAN)
AFFIYGYPKR

SEQ ID NO: 114718 - protein, 9 aa, Artificial Sequence
  Description of Artificial Sequence: Synthetic peptide
  Seed: ALMDKSLHV (MAR1_HUMAN)
AIMDKSLHW

SEQ ID NO: 114719 - protein, 9 aa, Artificial Sequence
  Description of Artificial Sequence: Synthetic peptide
  Seed: GFDHRDSKV (MAR1_HUMAN)
GVDHRDSKL

SEQ ID NO: 114720 - protein, 9 aa, Artificial Sequence
  Description of Artificial Sequence: Synthetic peptide
  Seed: RRNGYRALM (MAR1_HUMAN)
RLNGYRALM

SEQ ID NO: 114721 - protein, 10 aa, Artificial Sequence
  Description of Artificial Sequence: Synthetic peptide
  Seed: REDAHFIYGY (MAR1_HUMAN)
RADAHFIYGY

SEQ ID NO: 114722 - protein, 10 aa, Artificial Sequence
  Description of Artificial Sequence: Synthetic peptide
  Seed: RDSKVSLQEK (MAR1_HUMAN)
RCSKVSLQEK

SEQ ID NO: 114723 - protein, 9 aa, Artificial Sequence
  Description of Artificial Sequence: Synthetic peptide
  Seed: AGIGILTVI (MAR1_HUMAN)
AAIGILTVF

SEQ ID NO: 114724 - protein, 9 aa, Artificial Sequence
  Description of Artificial Sequence: Synthetic peptide
  Seed: TRRCPQEGF (MAR1_HUMAN)
TQRCPQEGF

SEQ ID NO: 114725 - protein, 10 aa, Artificial Sequence
  Description of Artificial Sequence: Synthetic peptide
  Seed: GILTVILGVL (MAR1_HUMAN)
GLLTVILGVL

SEQ ID NO: 114726 - protein, 9 aa, Artificial Sequence
  Description of Artificial Sequence: Synthetic peptide
  Seed: VILGVLLLI (MAR1_HUMAN)
VTLGVLLLV

SEQ ID NO: 114727 - protein, 11 aa, Artificial Sequence
  Description of Artificial Sequence: Synthetic peptide
  Seed: YRALMDKSLHV (MAR1_HUMAN)
YTALMDKSLHV

SEQ ID NO: 114728 - protein, 10 aa, Artificial Sequence
  Description of Artificial Sequence: Synthetic peptide
  Seed: LLLIGCWYCR (MAR1_HUMAN)
LTLIGCWYCR

SEQ ID NO: 114729 - protein, 9 aa, Artificial Sequence
  Description of Artificial Sequence: Synthetic peptide
  Seed: NAPPAYEKL (MAR1_HUMAN)
NMPPAYEKF

SEQ ID NO: 114730 - protein, 10 aa, Artificial Sequence
  Description of Artificial Sequence: Synthetic peptide
  Seed: APPAYEKLSA (MAR1_HUMAN)
AEPAYEKLSM

SEQ ID NO: 114731 - protein, 9 aa, Artificial Sequence
  Description of Artificial Sequence: Synthetic peptide
  Seed: AHFIYGYPK (MAR1_HUMAN)
AFFIYGYPR

SEQ ID NO: 114732 - protein, 10 aa, Artificial Sequence
  Description of Artificial Sequence: Synthetic peptide
  Seed: LSAEQSPPPY (MAR1_HUMAN)
LPAEQSPPPY

SEQ ID NO: 114733 - protein, 9 aa, Artificial Sequence
  Description of Artificial Sequence: Synthetic peptide
  Seed: VVPNAPPAY (MAR1_HUMAN)
VQPNAPPAF

SEQ ID NO: 114734 - protein, 9 aa, Artificial Sequence
  Description of Artificial Sequence: Synthetic peptide
  Seed: YRALMDKSL (MAR1_HUMAN)
YQALMDKSM

SEQ ID NO: 114735 - protein, 10 aa, Artificial Sequence
  Description of Artificial Sequence: Synthetic peptide
  Seed: DAHFIYGYPK (MAR1_HUMAN)
DWHFIYGYPR

SEQ ID NO: 114736 - protein, 10 aa, Artificial Sequence
  Description of Artificial Sequence: Synthetic peptide
  Seed: LLIGCWYCRR (MAR1_HUMAN)
LAIGCWYCRR

SEQ ID NO: 114737 - protein, 9 aa, Artificial Sequence
  Description of Artificial Sequence: Synthetic peptide
  Seed: NAPPAYEKL (MAR1_HUMAN)
NQPPAYEKL

SEQ ID NO: 114738 - protein, 11 aa, Artificial Sequence
  Description of Artificial Sequence: Synthetic peptide
  Seed: TTAEEAAGIGI (MAR1_HUMAN)
TTAEEAAGIGW

SEQ ID NO: 114739 - protein, 9 aa, Artificial Sequence
  Description of Artificial Sequence: Synthetic peptide
  Seed: EGFDHRDSK (MAR1_HUMAN)
EGFDHRDSR

SEQ ID NO: 114740 - protein, 10 aa, Artificial Sequence
  Description of Artificial Sequence: Synthetic peptide
  Seed: APPAYEKLSA (MAR1_HUMAN)
ASPAYEKLSL

SEQ ID NO: 114741 - protein, 8 aa, Artificial Sequence
  Description of Artificial Sequence: Synthetic peptide
  Seed: VPNAPPAY (MAR1_HUMAN)
VPNAPPAA

SEQ ID NO: 114742 - protein, 10 aa, Artificial Sequence
  Description of Artificial Sequence: Synthetic peptide
  Seed: RDSKVSLQEK (MAR1_HUMAN)
RLSKVSLQEK

SEQ ID NO: 114743 - protein, 10 aa, Artificial Sequence
  Description of Artificial Sequence: Synthetic peptide
  Seed: MPREDAHFIY (MAR1_HUMAN)
MPREDAHFIV

SEQ ID NO: 114744 - protein, 10 aa, Artificial Sequence
  Description of Artificial Sequence: Synthetic peptide
  Seed: RRRNGYRALM (MAR1_HUMAN)
RDRNGYRALM

SEQ ID NO: 114745 - protein, 9 aa, Artificial Sequence
  Description of Artificial Sequence: Synthetic peptide
  Seed: VILGVLLLI (MAR1_HUMAN)
VVLGVLLLL

SEQ ID NO: 114746 - protein, 9 aa, Artificial Sequence
  Description of Artificial Sequence: Synthetic peptide
  Seed: VVPNAPPAY (MAR1_HUMAN)
VAPNAPPAW

SEQ ID NO: 114747 - protein, 10 aa, Artificial Sequence
  Description of Artificial Sequence: Synthetic peptide
  Seed: LLLIGCWYCR (MAR1_HUMAN)
LQLIGCWYCR

SEQ ID NO: 114748 - protein, 10 aa, Artificial Sequence
  Description of Artificial Sequence: Synthetic peptide
  Seed: YTTAEEAAGI (MAR1_HUMAN)
YPTAEEAAGI

SEQ ID NO: 114749 - protein, 10 aa, Artificial Sequence
  Description of Artificial Sequence: Synthetic peptide
  Seed: RALMDKSLHV (MAR1_HUMAN)
RMLMDKSLHM

SEQ ID NO: 114750 - protein, 9 aa, Artificial Sequence
  Description of Artificial Sequence: Synthetic peptide
  Seed: VILGVLLLI (MAR1_HUMAN)
VALGVLLLW

SEQ ID NO: 114751 - protein, 11 aa, Artificial Sequence
  Description of Artificial Sequence: Synthetic peptide
  Seed: VPNAPPAYEKL (MAR1_HUMAN)
VPNAPPAYEKA

SEQ ID NO: 114752 - protein, 9 aa, Artificial Sequence
  Description of Artificial Sequence: Synthetic peptide
  Seed: QEKNCEPVV (MAR1_HUMAN)
QEKNCEPVY

SEQ ID NO: 114753 - protein, 9 aa, Artificial Sequence
  Description of Artificial Sequence: Synthetic peptide
  Seed: GILTVILGV (MAR1_HUMAN)
GALTVILGV

SEQ ID NO: 114754 - protein, 9 aa, Artificial Sequence
  Description of Artificial Sequence: Synthetic peptide
  Seed: EDAHFIYGY (MAR1_HUMAN)
EEAHFIYGY

SEQ ID NO: 114755 - protein, 9 aa, Artificial Sequence
  Description of Artificial Sequence: Synthetic peptide
  Seed: RRNGYRALM (MAR1_HUMAN)
RQNGYRALL

SEQ ID NO: 114756 - protein, 11 aa, Artificial Sequence
  Description of Artificial Sequence: Synthetic peptide
  Seed: RALMDKSLHVG (MAR1_HUMAN)
RWLMDKSLHVI

SEQ ID NO: 114757 - protein, 9 aa, Artificial Sequence
  Description of Artificial Sequence: Synthetic peptide
  Seed: AGIGILTVI (MAR1_HUMAN)
ALIGILTVM

SEQ ID NO: 114758 - protein, 9 aa, Artificial Sequence
  Description of Artificial Sequence: Synthetic peptide
  Seed: VVPNAPPAY (MAR1_HUMAN)
VTPNAPPAY

SEQ ID NO: 114759 - protein, 10 aa, Artificial Sequence
  Description of Artificial Sequence: Synthetic peptide
  Seed: LLLIGCWYCR (MAR1_HUMAN)
LKLIGCWYCR

SEQ ID NO: 114760 - protein, 9 aa, Artificial Sequence
  Description of Artificial Sequence: Synthetic peptide
  Seed: NAPPAYEKL (MAR1_HUMAN)
NLPPAYEKL

SEQ ID NO: 114761 - protein, 9 aa, Artificial Sequence
  Description of Artificial Sequence: Synthetic peptide
  Seed: AGIGILTVI (MAR1_HUMAN)
AIIGILTVV

SEQ ID NO: 114762 - protein, 10 aa, Artificial Sequence
  Description of Artificial Sequence: Synthetic peptide
  Seed: DAHFIYGYPK (MAR1_HUMAN)
DYHFIYGYPK

SEQ ID NO: 114763 - protein, 10 aa, Artificial Sequence
  Description of Artificial Sequence: Synthetic peptide
  Seed: EAAGIGILTV (MAR1_HUMAN)
EVAGIGILTL

SEQ ID NO: 114764 - protein, 10 aa, Artificial Sequence
  Description of Artificial Sequence: Synthetic peptide
  Seed: LSAEQSPPPY (MAR1_HUMAN)
LKAEQSPPPY

SEQ ID NO: 114765 - protein, 9 aa, Artificial Sequence
  Description of Artificial Sequence: Synthetic peptide
  Seed: HSYTTAEEA (MAR1_HUMAN)
HGYTTAEEY

SEQ ID NO: 114766 - protein, 11 aa, Artificial Sequence
  Description of Artificial Sequence: Synthetic peptide
  Seed: YRALMDKSLHV (MAR1_HUMAN)
YEALMDKSLHA

SEQ ID NO: 114767 - protein, 11 aa, Artificial Sequence
  Description of Artificial Sequence: Synthetic peptide
  Seed: YRALMDKSLHV (MAR1_HUMAN)
YQALMDKSLHL

SEQ ID NO: 114768 - protein, 10 aa, Artificial Sequence
  Description of Artificial Sequence: Synthetic peptide
  Seed: RRRNGYRALM (MAR1_HUMAN)
RMRNGYRALL

SEQ ID NO: 114769 - protein, 9 aa, Artificial Sequence
  Description of Artificial Sequence: Synthetic peptide
  Seed: YRALMDKSL (MAR1_HUMAN)
YRALMDKSF

SEQ ID NO: 114770 - protein, 10 aa, Artificial Sequence
  Description of Artificial Sequence: Synthetic peptide
  Seed: GILTVILGVL (MAR1_HUMAN)
GMLTVILGVI

SEQ ID NO: 114771 - protein, 10 aa, Artificial Sequence
  Description of Artificial Sequence: Synthetic peptide
  Seed: APPAYEKLSA (MAR1_HUMAN)
AYPAYEKLSM

SEQ ID NO: 114772 - protein, 10 aa, Artificial Sequence
  Description of Artificial Sequence: Synthetic peptide
  Seed: RRRNGYRALM (MAR1_HUMAN)
RRRNGYRALR

SEQ ID NO: 114773 - protein, 10 aa, Artificial Sequence
  Description of Artificial Sequence: Synthetic peptide
  Seed: RRRNGYRALM (MAR1_HUMAN)
RSRNGYRALK

SEQ ID NO: 114774 - protein, 9 aa, Artificial Sequence
  Description of Artificial Sequence: Synthetic peptide
  Seed: LHVGTQCAL (MAR1_HUMAN)
LKVGTQCAF

SEQ ID NO: 114775 - protein, 11 aa, Artificial Sequence
  Description of Artificial Sequence: Synthetic peptide
  Seed: RALMDKSLHVG (MAR1_HUMAN)
RTLMDKSLHVV

SEQ ID NO: 114776 - protein, 9 aa, Artificial Sequence
  Description of Artificial Sequence: Synthetic peptide
  Seed: VILGVLLLI (MAR1_HUMAN)
VILGVLLLK

SEQ ID NO: 114777 - protein, 9 aa, Artificial Sequence
  Description of Artificial Sequence: Synthetic peptide
  Seed: TTAEEAAGI (MAR1_HUMAN)
TLAEEAAGL

SEQ ID NO: 114778 - protein, 9 aa, Artificial Sequence
  Description of Artificial Sequence: Synthetic peptide
  Seed: KSLHVGTQC (MAR1_HUMAN)
KSLHVGTQM

SEQ ID NO: 114779 - protein, 10 aa, Artificial Sequence
  Description of Artificial Sequence: Synthetic peptide
  Seed: GILTVILGVL (MAR1_HUMAN)
GLLTVILGVI

SEQ ID NO: 114780 - protein, 9 aa, Artificial Sequence
  Description of Artificial Sequence: Synthetic peptide
  Seed: ALMDKSLHV (MAR1_HUMAN)
AMMDKSLHR

SEQ ID NO: 114781 - protein, 9 aa, Artificial Sequence
  Description of Artificial Sequence: Synthetic peptide
  Seed: AHFIYGYPK (MAR1_HUMAN)
ATFIYGYPR

SEQ ID NO: 114782 - protein, 10 aa, Artificial Sequence
  Description of Artificial Sequence: Synthetic peptide
  Seed: YTTAEEAAGI (MAR1_HUMAN)
YCTAEEAAGV

SEQ ID NO: 114783 - protein, 9 aa, Artificial Sequence
  Description of Artificial Sequence: Synthetic peptide
  Seed: AEQSPPPYS (MAR1_HUMAN)
AEQSPPPYC

SEQ ID NO: 114784 - protein, 8 aa, Artificial Sequence
  Description of Artificial Sequence: Synthetic peptide
  Seed: LMDKSLHV (MAR1_HUMAN)
LSDKSLHV

SEQ ID NO: 114785 - protein, 10 aa, Artificial Sequence
  Description of Artificial Sequence: Synthetic peptide
  Seed: RALMDKSLHV (MAR1_HUMAN)
RYLMDKSLHM

SEQ ID NO: 114786 - protein, 9 aa, Artificial Sequence
  Description of Artificial Sequence: Synthetic peptide
  Seed: GILTVILGV (MAR1_HUMAN)
GMLTVILGT

SEQ ID NO: 114787 - protein, 10 aa, Artificial Sequence
  Description of Artificial Sequence: Synthetic peptide
  Seed: EEAAGIGILT (MAR1_HUMAN)
EIAAGIGILL

SEQ ID NO: 114788 - protein, 9 aa, Artificial Sequence
  Description of Artificial Sequence: Synthetic peptide
  Seed: RRRNGYRAL (MAR1_HUMAN)
RQRNGYRAA

SEQ ID NO: 114789 - protein, 10 aa, Artificial Sequence
  Description of Artificial Sequence: Synthetic peptide
  Seed: FDHRDSKVSL (MAR1_HUMAN)
FEHRDSKVSM

SEQ ID NO: 114790 - protein, 9 aa, Artificial Sequence
  Description of Artificial Sequence: Synthetic peptide
  Seed: NAPPAYEKL (MAR1_HUMAN)
NIPPAYEKI

SEQ ID NO: 114791 - protein, 10 aa, Artificial Sequence
  Description of Artificial Sequence: Synthetic peptide
  Seed: EEAAGIGILT (MAR1_HUMAN)
ELAAGIGILI

SEQ ID NO: 114792 - protein, 10 aa, Artificial Sequence
  Description of Artificial Sequence: Synthetic peptide
  Seed: RDSKVSLQEK (MAR1_HUMAN)
RRSKVSLQEK

SEQ ID NO: 114793 - protein, 9 aa, Artificial Sequence
  Description of Artificial Sequence: Synthetic peptide
  Seed: DSKVSLQEK (MAR1_HUMAN)
DIKVSLQER

SEQ ID NO: 114794 - protein, 9 aa, Artificial Sequence
  Description of Artificial Sequence: Synthetic peptide
  Seed: TVILGVLLL (MAR1_HUMAN)
TVILGVLLW

SEQ ID NO: 114795 - protein, 8 aa, Artificial Sequence
  Description of Artificial Sequence: Synthetic peptide
  Seed: VPNAPPAY (MAR1_HUMAN)
VPNAPPAL

SEQ ID NO: 114796 - protein, 11 aa, Artificial Sequence
  Description of Artificial Sequence: Synthetic peptide
  Seed: YRALMDKSLHV (MAR1_HUMAN)
YTALMDKSLHI

SEQ ID NO: 114797 - protein, 9 aa, Artificial Sequence
  Description of Artificial Sequence: Synthetic peptide
  Seed: KSLHVGTQC (MAR1_HUMAN)
KALHVGTQI

SEQ ID NO: 114798 - protein, 9 aa, Artificial Sequence
  Description of Artificial Sequence: Synthetic peptide
  Seed: HSYTTAEEA (MAR1_HUMAN)
HIYTTAEEL

SEQ ID NO: 114799 - protein, 9 aa, Artificial Sequence
  Description of Artificial Sequence: Synthetic peptide
  Seed: DHRDSKVSL (MAR1_HUMAN)
DQRDSKVSL

SEQ ID NO: 114800 - protein, 10 aa, Artificial Sequence
  Description of Artificial Sequence: Synthetic peptide
  Seed: KGHGHSYTTA (MAR1_HUMAN)
KGHGHSYTTK

SEQ ID NO: 114801 - protein, 9 aa, Artificial Sequence
  Description of Artificial Sequence: Synthetic peptide
  Seed: HSYTTAEEA (MAR1_HUMAN)
HQYTTAEEI

SEQ ID NO: 114802 - protein, 9 aa, Artificial Sequence
  Description of Artificial Sequence: Synthetic peptide
  Seed: YRALMDKSL (MAR1_HUMAN)
YYALMDKSM

SEQ ID NO: 114803 - protein, 9 aa, Artificial Sequence
  Description of Artificial Sequence: Synthetic peptide
  Seed: RRRNGYRAL (MAR1_HUMAN)
RYRNGYRAY

SEQ ID NO: 114804 - protein, 10 aa, Artificial Sequence
  Description of Artificial Sequence: Synthetic peptide
  Seed: LSAEQSPPPY (MAR1_HUMAN)
LSAEQSPPPW

SEQ ID NO: 114805 - protein, 10 aa, Artificial Sequence
  Description of Artificial Sequence: Synthetic peptide
  Seed: REDAHFIYGY (MAR1_HUMAN)
RVDAHFIYGY

SEQ ID NO: 114806 - protein, 10 aa, Artificial Sequence
  Description of Artificial Sequence: Synthetic peptide
  Seed: YTTAEEAAGI (MAR1_HUMAN)
YITAEEAAGL

SEQ ID NO: 114807 - protein, 10 aa, Artificial Sequence
  Description of Artificial Sequence: Synthetic peptide
  Seed: RRRNGYRALM (MAR1_HUMAN)
RTRNGYRALM

SEQ ID NO: 114808 - protein, 9 aa, Artificial Sequence
  Description of Artificial Sequence: Synthetic peptide
  Seed: KSLHVGTQC (MAR1_HUMAN)
KVLHVGTQF

SEQ ID NO: 114809 - protein, 9 aa, Artificial Sequence
  Description of Artificial Sequence: Synthetic peptide
  Seed: EAAGIGILT (MAR1_HUMAN)
EIAGIGILA

SEQ ID NO: 114810 - protein, 9 aa, Artificial Sequence
  Description of Artificial Sequence: Synthetic peptide
  Seed: HSYTTAEEA (MAR1_HUMAN)
HSYTTAEEH

SEQ ID NO: 114811 - protein, 9 aa, Artificial Sequence
  Description of Artificial Sequence: Synthetic peptide
  Seed: AGIGILTVI (MAR1_HUMAN)
AQIGILTVM

SEQ ID NO: 114812 - protein, 9 aa, Artificial Sequence
  Description of Artificial Sequence: Synthetic peptide
  Seed: RRRNGYRAL (MAR1_HUMAN)
RHRNGYRAY

SEQ ID NO: 114813 - protein, 9 aa, Artificial Sequence
  Description of Artificial Sequence: Synthetic peptide
  Seed: VVPNAPPAY (MAR1_HUMAN)
VSPNAPPAV

SEQ ID NO: 114814 - protein, 10 aa, Artificial Sequence
  Description of Artificial Sequence: Synthetic peptide
  Seed: ALMDKSLHVG (MAR1_HUMAN)
AIMDKSLHVM

SEQ ID NO: 114815 - protein, 10 aa, Artificial Sequence
  Description of Artificial Sequence: Synthetic peptide
  Seed: EAAGIGILTV (MAR1_HUMAN)
ESAGIGILTI

SEQ ID NO: 114816 - protein, 9 aa, Artificial Sequence
  Description of Artificial Sequence: Synthetic peptide
  Seed: HFIYGYPKK (MAR1_HUMAN)
HSIYGYPKR

SEQ ID NO: 114817 - protein, 9 aa, Artificial Sequence
  Description of Artificial Sequence: Synthetic peptide
  Seed: AAGIGILTV (MAR1_HUMAN)
ARGIGILTY

SEQ ID NO: 114818 - protein, 9 aa, Artificial Sequence
  Description of Artificial Sequence: Synthetic peptide
  Seed: SAEQSPPPY (MAR1_HUMAN)
SAEQSPPPL

SEQ ID NO: 114819 - protein, 9 aa, Artificial Sequence
  Description of Artificial Sequence: Synthetic peptide
  Seed: QEKNCEPVV (MAR1_HUMAN)
QEKNCEPVW

SEQ ID NO: 114820 - protein, 9 aa, Artificial Sequence
  Description of Artificial Sequence: Synthetic peptide
  Seed: AAGIGILTV (MAR1_HUMAN)
AAGIGILTY

SEQ ID NO: 114821 - protein, 8 aa, Artificial Sequence
  Description of Artificial Sequence: Synthetic peptide
  Seed: LMDKSLHV (MAR1_HUMAN)
LLDKSLHM

SEQ ID NO: 114822 - protein, 9 aa, Artificial Sequence
  Description of Artificial Sequence: Synthetic peptide
  Seed: KSLHVGTQC (MAR1_HUMAN)
KTLHVGTQY

SEQ ID NO: 114823 - protein, 10 aa, Artificial Sequence
  Description of Artificial Sequence: Synthetic peptide
  Seed: RALMDKSLHV (MAR1_HUMAN)
RVLMDKSLHV

SEQ ID NO: 114824 - protein, 9 aa, Artificial Sequence
  Description of Artificial Sequence: Synthetic peptide
  Seed: EAAGIGILT (MAR1_HUMAN)
ELAGIGILV

SEQ ID NO: 114825 - protein, 10 aa, Artificial Sequence
  Description of Artificial Sequence: Synthetic peptide
  Seed: EEAAGIGILT (MAR1_HUMAN)
ENAAGIGILV

SEQ ID NO: 114826 - protein, 9 aa, Artificial Sequence
  Description of Artificial Sequence: Synthetic peptide
  Seed: GILTVILGV (MAR1_HUMAN)
GSLTVILGV

SEQ ID NO: 114827 - protein, 11 aa, Artificial Sequence
  Description of Artificial Sequence: Synthetic peptide
  Seed: RALMDKSLHVG (MAR1_HUMAN)
RILMDKSLHVV

SEQ ID NO: 114828 - protein, 9 aa, Artificial Sequence
  Description of Artificial Sequence: Synthetic peptide
  Seed: AEQSPPPYS (MAR1_HUMAN)
AEQSPPPYT

SEQ ID NO: 114829 - protein, 9 aa, Artificial Sequence
  Description of Artificial Sequence: Synthetic peptide
  Seed: AAGIGILTV (MAR1_HUMAN)
ATGIGILTW

SEQ ID NO: 114830 - protein, 9 aa, Artificial Sequence
  Description of Artificial Sequence: Synthetic peptide
  Seed: SLHVGTQCA (MAR1_HUMAN)
SMHVGTQCL

SEQ ID NO: 114831 - protein, 10 aa, Artificial Sequence
  Description of Artificial Sequence: Synthetic peptide
  Seed: RRRNGYRALM (MAR1_HUMAN)
RQRNGYRALF

SEQ ID NO: 114832 - protein, 9 aa, Artificial Sequence
  Description of Artificial Sequence: Synthetic peptide
  Seed: LHVGTQCAL (MAR1_HUMAN)
LEVGTQCAY

SEQ ID NO: 114833 - protein, 10 aa, Artificial Sequence
  Description of Artificial Sequence: Synthetic peptide
  Seed: ALMDKSLHVG (MAR1_HUMAN)
AIMDKSLHVV

SEQ ID NO: 114834 - protein, 9 aa, Artificial Sequence
  Description of Artificial Sequence: Synthetic peptide
  Seed: LLIGCWYCR (MAR1_HUMAN)
LAIGCWYCK

SEQ ID NO: 114835 - protein, 9 aa, Artificial Sequence
  Description of Artificial Sequence: Synthetic peptide
  Seed: ALMDKSLHV (MAR1_HUMAN)
AAMDKSLHH

SEQ ID NO: 114836 - protein, 9 aa, Artificial Sequence
  Description of Artificial Sequence: Synthetic peptide
  Seed: LLIGCWYCR (MAR1_HUMAN)
LGIGCWYCR

SEQ ID NO: 114837 - protein, 9 aa, Artificial Sequence
  Description of Artificial Sequence: Synthetic peptide
  Seed: VVPNAPPAY (MAR1_HUMAN)
VYPNAPPAF

SEQ ID NO: 114838 - protein, 9 aa, Artificial Sequence
  Description of Artificial Sequence: Synthetic peptide
  Seed: VILGVLLLI (MAR1_HUMAN)
VILGVLLLM

SEQ ID NO: 114839 - protein, 9 aa, Artificial Sequence
  Description of Artificial Sequence: Synthetic peptide
  Seed: EAAGIGILT (MAR1_HUMAN)
ESAGIGILV

SEQ ID NO: 114840 - protein, 9 aa, Artificial Sequence
  Description of Artificial Sequence: Synthetic peptide
  Seed: YRALMDKSL (MAR1_HUMAN)
YHALMDKSI

SEQ ID NO: 114841 - protein, 9 aa, Artificial Sequence
  Description of Artificial Sequence: Synthetic peptide
  Seed: LHVGTQCAL (MAR1_HUMAN)
LRVGTQCAF

SEQ ID NO: 114842 - protein, 10 aa, Artificial Sequence
  Description of Artificial Sequence: Synthetic peptide
  Seed: LLIGCWYCRR (MAR1_HUMAN)
LTIGCWYCRR

SEQ ID NO: 114843 - protein, 11 aa, Artificial Sequence
  Description of Artificial Sequence: Synthetic peptide
  Seed: RALMDKSLHVG (MAR1_HUMAN)
RNLMDKSLHVV

SEQ ID NO: 114844 - protein, 10 aa, Artificial Sequence
  Description of Artificial Sequence: Synthetic peptide
  Seed: TVILGVLLLI (MAR1_HUMAN)
TMILGVLLLV

SEQ ID NO: 114845 - protein, 9 aa, Artificial Sequence
  Description of Artificial Sequence: Synthetic peptide
  Seed: IGCWYCRRR (MAR1_HUMAN)
IMCWYCRRR

SEQ ID NO: 114846 - protein, 9 aa, Artificial Sequence
  Description of Artificial Sequence: Synthetic peptide
  Seed: VILGVLLLI (MAR1_HUMAN)
VMLGVLLLF

SEQ ID NO: 114847 - protein, 9 aa, Artificial Sequence
  Description of Artificial Sequence: Synthetic peptide
  Seed: VILGVLLLI (MAR1_HUMAN)
VVLGVLLLR

SEQ ID NO: 114848 - protein, 10 aa, Artificial Sequence
  Description of Artificial Sequence: Synthetic peptide
  Seed: EEAAGIGILT (MAR1_HUMAN)
EAAAGIGILI

SEQ ID NO: 114849 - protein, 9 aa, Artificial Sequence
  Description of Artificial Sequence: Synthetic peptide
  Seed: NAPPAYEKL (MAR1_HUMAN)
NMPPAYEKI

SEQ ID NO: 114850 - protein, 9 aa, Artificial Sequence
  Description of Artificial Sequence: Synthetic peptide
  Seed: AAGIGILTV (MAR1_HUMAN)
AQGIGILTM

SEQ ID NO: 114851 - protein, 10 aa, Artificial Sequence
  Description of Artificial Sequence: Synthetic peptide
  Seed: RALMDKSLHV (MAR1_HUMAN)
RELMDKSLHV

SEQ ID NO: 114852 - protein, 9 aa, Artificial Sequence
  Description of Artificial Sequence: Synthetic peptide
  Seed: TVILGVLLL (MAR1_HUMAN)
TQILGVLLF

SEQ ID NO: 114853 - protein, 9 aa, Artificial Sequence
  Description of Artificial Sequence: Synthetic peptide
  Seed: ALMDKSLHV (MAR1_HUMAN)
AIMDKSLHM

SEQ ID NO: 114854 - protein, 10 aa, Artificial Sequence
  Description of Artificial Sequence: Synthetic peptide
  Seed: EEAAGIGILT (MAR1_HUMAN)
EDAAGIGILI

SEQ ID NO: 114855 - protein, 9 aa, Artificial Sequence
  Description of Artificial Sequence: Synthetic peptide
  Seed: AHFIYGYPK (MAR1_HUMAN)
AYFIYGYPK

SEQ ID NO: 114856 - protein, 10 aa, Artificial Sequence
  Description of Artificial Sequence: Synthetic peptide
  Seed: LSAEQSPPPY (MAR1_HUMAN)
LKAEQSPPPF

SEQ ID NO: 114857 - protein, 10 aa, Artificial Sequence
  Description of Artificial Sequence: Synthetic peptide
  Seed: KGHGHSYTTA (MAR1_HUMAN)
KTHGHSYTTI

SEQ ID NO: 114858 - protein, 11 aa, Artificial Sequence
  Description of Artificial Sequence: Synthetic peptide
  Seed: YCRRRNGYRAL (MAR1_HUMAN)
YMRRRNGYRAM

SEQ ID NO: 114859 - protein, 10 aa, Artificial Sequence
  Description of Artificial Sequence: Synthetic peptide
  Seed: YTTAEEAAGI (MAR1_HUMAN)
YRTAEEAAGI

SEQ ID NO: 114860 - protein, 9 aa, Artificial Sequence
  Description of Artificial Sequence: Synthetic peptide
  Seed: AGIGILTVI (MAR1_HUMAN)
AMIGILTVT

SEQ ID NO: 114861 - protein, 9 aa, Artificial Sequence
  Description of Artificial Sequence: Synthetic peptide
  Seed: TVILGVLLL (MAR1_HUMAN)
TSILGVLLI

SEQ ID NO: 114862 - protein, 10 aa, Artificial Sequence
  Description of Artificial Sequence: Synthetic peptide
  Seed: MPREDAHFIY (MAR1_HUMAN)
MKREDAHFIF

SEQ ID NO: 114863 - protein, 11 aa, Artificial Sequence
  Description of Artificial Sequence: Synthetic peptide
  Seed: RALMDKSLHVG (MAR1_HUMAN)
RMLMDKSLHVI

SEQ ID NO: 114864 - protein, 9 aa, Artificial Sequence
  Description of Artificial Sequence: Synthetic peptide
  Seed: EDAHFIYGY (MAR1_HUMAN)
EVAHFIYGL

SEQ ID NO: 114865 - protein, 8 aa, Artificial Sequence
  Description of Artificial Sequence: Synthetic peptide
  Seed: LMDKSLHV (MAR1_HUMAN)
LIDKSLHI

SEQ ID NO: 114866 - protein, 10 aa, Artificial Sequence
  Description of Artificial Sequence: Synthetic peptide
  Seed: DAHFIYGYPK (MAR1_HUMAN)
DMHFIYGYPK

SEQ ID NO: 114867 - protein, 10 aa, Artificial Sequence
  Description of Artificial Sequence: Synthetic peptide
  Seed: AHFIYGYPKK (MAR1_HUMAN)
AAFIYGYPKR

SEQ ID NO: 114868 - protein, 9 aa, Artificial Sequence
  Description of Artificial Sequence: Synthetic peptide
  Seed: YRALMDKSL (MAR1_HUMAN)
YYALMDKSY

SEQ ID NO: 114869 - protein, 10 aa, Artificial Sequence
  Description of Artificial Sequence: Synthetic peptide
  Seed: YPKKGHGHSY (MAR1_HUMAN)
YKKKGHGHSF

SEQ ID NO: 114870 - protein, 9 aa, Artificial Sequence
  Description of Artificial Sequence: Synthetic peptide
  Seed: GFDHRDSKV (MAR1_HUMAN)
GYDHRDSKL

SEQ ID NO: 114871 - protein, 9 aa, Artificial Sequence
  Description of Artificial Sequence: Synthetic peptide
  Seed: VVPNAPPAY (MAR1_HUMAN)
VCPNAPPAL

SEQ ID NO: 114872 - protein, 9 aa, Artificial Sequence
  Description of Artificial Sequence: Synthetic peptide
  Seed: EGFDHRDSK (MAR1_HUMAN)
EIFDHRDSK

SEQ ID NO: 114873 - protein, 9 aa, Artificial Sequence
  Description of Artificial Sequence: Synthetic peptide
  Seed: AAGIGILTV (MAR1_HUMAN)
ASGIGILTI

SEQ ID NO: 114874 - protein, 10 aa, Artificial Sequence
  Description of Artificial Sequence: Synthetic peptide
  Seed: ALMDKSLHVG (MAR1_HUMAN)
AMMDKSLHVC

SEQ ID NO: 114875 - protein, 9 aa, Artificial Sequence
  Description of Artificial Sequence: Synthetic peptide
  Seed: MPREDAHFI (MAR1_HUMAN)
MPREDAHFW

SEQ ID NO: 114876 - protein, 9 aa, Artificial Sequence
  Description of Artificial Sequence: Synthetic peptide
  Seed: HSYTTAEEA (MAR1_HUMAN)
HQYTTAEEA

SEQ ID NO: 114877 - protein, 10 aa, Artificial Sequence
  Description of Artificial Sequence: Synthetic peptide
  Seed: IGILTVILGV (MAR1_HUMAN)
ICILTVILGV

SEQ ID NO: 114878 - protein, 9 aa, Artificial Sequence
  Description of Artificial Sequence: Synthetic peptide
  Seed: DSKVSLQEK (MAR1_HUMAN)
DSKVSLQER

SEQ ID NO: 114879 - protein, 9 aa, Artificial Sequence
  Description of Artificial Sequence: Synthetic peptide
  Seed: ALMDKSLHV (MAR1_HUMAN)
AVMDKSLHW

SEQ ID NO: 114880 - protein, 9 aa, Artificial Sequence
  Description of Artificial Sequence: Synthetic peptide
  Seed: MPREDAHFI (MAR1_HUMAN)
MMREDAHFY

SEQ ID NO: 114881 - protein, 10 aa, Artificial Sequence
  Description of Artificial Sequence: Synthetic peptide
  Seed: APPAYEKLSA (MAR1_HUMAN)
AVPAYEKLSL

SEQ ID NO: 114882 - protein, 10 aa, Artificial Sequence
  Description of Artificial Sequence: Synthetic peptide
  Seed: EEAAGIGILT (MAR1_HUMAN)
EEAAGIGILV

SEQ ID NO: 114883 - protein, 11 aa, Artificial Sequence
  Description of Artificial Sequence: Synthetic peptide
  Seed: YCRRRNGYRAL (MAR1_HUMAN)
YLRRRNGYRAL

SEQ ID NO: 114884 - protein, 9 aa, Artificial Sequence
  Description of Artificial Sequence: Synthetic peptide
  Seed: AHFIYGYPK (MAR1_HUMAN)
AAFIYGYPK

SEQ ID NO: 114885 - protein, 10 aa, Artificial Sequence
  Description of Artificial Sequence: Synthetic peptide
  Seed: AEEAAGIGIL (MAR1_HUMAN)
AEEAAGIGIA

SEQ ID NO: 114886 - protein, 9 aa, Artificial Sequence
  Description of Artificial Sequence: Synthetic peptide
  Seed: AGIGILTVI (MAR1_HUMAN)
ALIGILTVL

SEQ ID NO: 114887 - protein, 9 aa, Artificial Sequence
  Description of Artificial Sequence: Synthetic peptide
  Seed: LLIGCWYCR (MAR1_HUMAN)
LSIGCWYCK

SEQ ID NO: 114888 - protein, 9 aa, Artificial Sequence
  Description of Artificial Sequence: Synthetic peptide
  Seed: HSYTTAEEA (MAR1_HUMAN)
HAYTTAEEM

SEQ ID NO: 114889 - protein, 9 aa, Artificial Sequence
  Description of Artificial Sequence: Synthetic peptide
  Seed: NAPPAYEKL (MAR1_HUMAN)
NSPPAYEKI

SEQ ID NO: 114890 - protein, 9 aa, Artificial Sequence
  Description of Artificial Sequence: Synthetic peptide
  Seed: VVPNAPPAY (MAR1_HUMAN)
VIPNAPPAM

SEQ ID NO: 114891 - protein, 9 aa, Artificial Sequence
  Description of Artificial Sequence: Synthetic peptide
  Seed: AAGIGILTV (MAR1_HUMAN)
AQGIGILTL

SEQ ID NO: 114892 - protein, 9 aa, Artificial Sequence
  Description of Artificial Sequence: Synthetic peptide
  Seed: VVPNAPPAY (MAR1_HUMAN)
VMPNAPPAF

SEQ ID NO: 114893 - protein, 8 aa, Artificial Sequence
  Description of Artificial Sequence: Synthetic peptide
  Seed: VPNAPPAY (MAR1_HUMAN)
VANAPPAY

SEQ ID NO: 114894 - protein, 10 aa, Artificial Sequence
  Description of Artificial Sequence: Synthetic peptide
  Seed: EAAGIGILTV (MAR1_HUMAN)
ETAGIGILTK

SEQ ID NO: 114895 - protein, 10 aa, Artificial Sequence
  Description of Artificial Sequence: Synthetic peptide
  Seed: ALMDKSLHVG (MAR1_HUMAN)
ALMDKSLHVT

SEQ ID NO: 114896 - protein, 10 aa, Artificial Sequence
  Description of Artificial Sequence: Synthetic peptide
  Seed: FDHRDSKVSL (MAR1_HUMAN)
FEHRDSKVSV

SEQ ID NO: 114897 - protein, 11 aa, Artificial Sequence
  Description of Artificial Sequence: Synthetic peptide
  Seed: YRALMDKSLHV (MAR1_HUMAN)
YSALMDKSLHM

SEQ ID NO: 114898 - protein, 9 aa, Artificial Sequence
  Description of Artificial Sequence: Synthetic peptide
  Seed: LHVGTQCAL (MAR1_HUMAN)
LRVGTQCAY

SEQ ID NO: 114899 - protein, 10 aa, Artificial Sequence
  Description of Artificial Sequence: Synthetic peptide
  Seed: RRNGYRALMD (MAR1_HUMAN)
RRNGYRALMY

SEQ ID NO: 114900 - protein, 9 aa, Artificial Sequence
  Description of Artificial Sequence: Synthetic peptide
  Seed: ALMDKSLHV (MAR1_HUMAN)
ATMDKSLHY

SEQ ID NO: 114901 - protein, 9 aa, Artificial Sequence
  Description of Artificial Sequence: Synthetic peptide
  Seed: LLLIGCWYC (MAR1_HUMAN)
LMLIGCWYI

SEQ ID NO: 114902 - protein, 9 aa, Artificial Sequence
  Description of Artificial Sequence: Synthetic peptide
  Seed: VVPNAPPAY (MAR1_HUMAN)
VRPNAPPAV

SEQ ID NO: 114903 - protein, 10 aa, Artificial Sequence
  Description of Artificial Sequence: Synthetic peptide
  Seed: YTTAEEAAGI (MAR1_HUMAN)
YMTAEEAAGV

SEQ ID NO: 114904 - protein, 9 aa, Artificial Sequence
  Description of Artificial Sequence: Synthetic peptide
  Seed: RRNGYRALM (MAR1_HUMAN)
RANGYRALY

SEQ ID NO: 114905 - protein, 10 aa, Artificial Sequence
  Description of Artificial Sequence: Synthetic peptide
  Seed: MPREDAHFIY (MAR1_HUMAN)
MMREDAHFIM

SEQ ID NO: 114906 - protein, 10 aa, Artificial Sequence
  Description of Artificial Sequence: Synthetic peptide
  Seed: RRRNGYRALM (MAR1_HUMAN)
RPRNGYRALK

SEQ ID NO: 114907 - protein, 10 aa, Artificial Sequence
  Description of Artificial Sequence: Synthetic peptide
  Seed: ALMDKSLHVG (MAR1_HUMAN)
AMMDKSLHVD

SEQ ID NO: 114908 - protein, 9 aa, Artificial Sequence
  Description of Artificial Sequence: Synthetic peptide
  Seed: AAGIGILTV (MAR1_HUMAN)
ARGIGILTL

SEQ ID NO: 114909 - protein, 9 aa, Artificial Sequence
  Description of Artificial Sequence: Synthetic peptide
  Seed: HFIYGYPKK (MAR1_HUMAN)
HLIYGYPKR

SEQ ID NO: 114910 - protein, 10 aa, Artificial Sequence
  Description of Artificial Sequence: Synthetic peptide
  Seed: ALMDKSLHVG (MAR1_HUMAN)
AWMDKSLHVV

SEQ ID NO: 114911 - protein, 8 aa, Artificial Sequence
  Description of Artificial Sequence: Synthetic peptide
  Seed: LMDKSLHV (MAR1_HUMAN)
LIDKSLHM

SEQ ID NO: 114912 - protein, 9 aa, Artificial Sequence
  Description of Artificial Sequence: Synthetic peptide
  Seed: LTVILGVLL (MAR1_HUMAN)
LTVILGVLW

SEQ ID NO: 114913 - protein, 10 aa, Artificial Sequence
  Description of Artificial Sequence: Synthetic peptide
  Seed: YTTAEEAAGI (MAR1_HUMAN)
YRTAEEAAGV

SEQ ID NO: 114914 - protein, 11 aa, Artificial Sequence
  Description of Artificial Sequence: Synthetic peptide
  Seed: YCRRRNGYRAL (MAR1_HUMAN)
YPRRRNGYRAL

SEQ ID NO: 114915 - protein, 9 aa, Artificial Sequence
  Description of Artificial Sequence: Synthetic peptide
  Seed: RRNGYRALM (MAR1_HUMAN)
RKNGYRALY

SEQ ID NO: 114916 - protein, 10 aa, Artificial Sequence
  Description of Artificial Sequence: Synthetic peptide
  Seed: LSAEQSPPPY (MAR1_HUMAN)
LVAEQSPPPY

SEQ ID NO: 114917 - protein, 9 aa, Artificial Sequence
  Description of Artificial Sequence: Synthetic peptide
  Seed: RRNGYRALM (MAR1_HUMAN)
RQNGYRALY

SEQ ID NO: 114918 - protein, 10 aa, Artificial Sequence
  Description of Artificial Sequence: Synthetic peptide
  Seed: TVILGVLLLI (MAR1_HUMAN)
TFILGVLLLV

SEQ ID NO: 114919 - protein, 10 aa, Artificial Sequence
  Description of Artificial Sequence: Synthetic peptide
  Seed: EEAAGIGILT (MAR1_HUMAN)
EWAAGIGILV

SEQ ID NO: 114920 - protein, 10 aa, Artificial Sequence
  Description of Artificial Sequence: Synthetic peptide
  Seed: RALMDKSLHV (MAR1_HUMAN)
RVLMDKSLHL

SEQ ID NO: 114921 - protein, 10 aa, Artificial Sequence
  Description of Artificial Sequence: Synthetic peptide
  Seed: RRRNGYRALM (MAR1_HUMAN)
RFRNGYRALM

SEQ ID NO: 114922 - protein, 11 aa, Artificial Sequence
  Description of Artificial Sequence: Synthetic peptide
  Seed: YRALMDKSLHV (MAR1_HUMAN)
YDALMDKSLHL

SEQ ID NO: 114923 - protein, 8 aa, Artificial Sequence
  Description of Artificial Sequence: Synthetic peptide
  Seed: LMDKSLHV (MAR1_HUMAN)
LYDKSLHM

SEQ ID NO: 114924 - protein, 9 aa, Artificial Sequence
  Description of Artificial Sequence: Synthetic peptide
  Seed: EAAGIGILT (MAR1_HUMAN)
ENAGIGILV

SEQ ID NO: 114925 - protein, 10 aa, Artificial Sequence
  Description of Artificial Sequence: Synthetic peptide
  Seed: RRRNGYRALM (MAR1_HUMAN)
RNRNGYRALM

SEQ ID NO: 114926 - protein, 9 aa, Artificial Sequence
  Description of Artificial Sequence: Synthetic peptide
  Seed: NGYRALMDK (MAR1_HUMAN)
NSYRALMDK

SEQ ID NO: 114927 - protein, 10 aa, Artificial Sequence
  Description of Artificial Sequence: Synthetic peptide
  Seed: IGILTVILGV (MAR1_HUMAN)
IMILTVILGA

SEQ ID NO: 114928 - protein, 9 aa, Artificial Sequence
  Description of Artificial Sequence: Synthetic peptide
  Seed: GILTVILGV (MAR1_HUMAN)
GQLTVILGM

SEQ ID NO: 114929 - protein, 8 aa, Artificial Sequence
  Description of Artificial Sequence: Synthetic peptide
  Seed: LMDKSLHV (MAR1_HUMAN)
LGDKSLHI

SEQ ID NO: 114930 - protein, 8 aa, Artificial Sequence
  Description of Artificial Sequence: Synthetic peptide
  Seed: HRDSKVSL (MAR1_HUMAN)
HYDSKVSM

SEQ ID NO: 114931 - protein, 9 aa, Artificial Sequence
  Description of Artificial Sequence: Synthetic peptide
  Seed: NAPPAYEKL (MAR1_HUMAN)
NVPPAYEKF

SEQ ID NO: 114932 - protein, 8 aa, Artificial Sequence
  Description of Artificial Sequence: Synthetic peptide
  Seed: HRDSKVSL (MAR1_HUMAN)
HYDSKVSI

SEQ ID NO: 114933 - protein, 10 aa, Artificial Sequence
  Description of Artificial Sequence: Synthetic peptide
  Seed: YTTAEEAAGI (MAR1_HUMAN)
YYTAEEAAGI

SEQ ID NO: 114934 - protein, 9 aa, Artificial Sequence
  Description of Artificial Sequence: Synthetic peptide
  Seed: VVPNAPPAY (MAR1_HUMAN)
VLPNAPPAY

SEQ ID NO: 114935 - protein, 9 aa, Artificial Sequence
  Description of Artificial Sequence: Synthetic peptide
  Seed: HSYTTAEEA (MAR1_HUMAN)
HSYTTAEEF

SEQ ID NO: 114936 - protein, 10 aa, Artificial Sequence
  Description of Artificial Sequence: Synthetic peptide
  Seed: YTTAEEAAGI (MAR1_HUMAN)
YMTAEEAAGM

SEQ ID NO: 114937 - protein, 10 aa, Artificial Sequence
  Description of Artificial Sequence: Synthetic peptide
  Seed: EEAAGIGILT (MAR1_HUMAN)
ETAAGIGILL

SEQ ID NO: 114938 - protein, 10 aa, Artificial Sequence
  Description of Artificial Sequence: Synthetic peptide
  Seed: RALMDKSLHV (MAR1_HUMAN)
RGLMDKSLHV

SEQ ID NO: 114939 - protein, 9 aa, Artificial Sequence
  Description of Artificial Sequence: Synthetic peptide
  Seed: CEPVVPNAP (MAR1_HUMAN)
CEPVVPNAA

SEQ ID NO: 114940 - protein, 10 aa, Artificial Sequence
  Description of Artificial Sequence: Synthetic peptide
  Seed: DAHFIYGYPK (MAR1_HUMAN)
DIHFIYGYPK

SEQ ID NO: 114941 - protein, 10 aa, Artificial Sequence
  Description of Artificial Sequence: Synthetic peptide
  Seed: LTVILGVLLL (MAR1_HUMAN)
LSVILGVLLY

SEQ ID NO: 114942 - protein, 10 aa, Artificial Sequence
  Description of Artificial Sequence: Synthetic peptide
  Seed: RRRNGYRALM (MAR1_HUMAN)
RYRNGYRALM

SEQ ID NO: 114943 - protein, 10 aa, Artificial Sequence
  Description of Artificial Sequence: Synthetic peptide
  Seed: APPAYEKLSA (MAR1_HUMAN)
ASPAYEKLSM

SEQ ID NO: 114944 - protein, 9 aa, Artificial Sequence
  Description of Artificial Sequence: Synthetic peptide
  Seed: EAAGIGILT (MAR1_HUMAN)
EIAGIGILV

SEQ ID NO: 114945 - protein, 9 aa, Artificial Sequence
  Description of Artificial Sequence: Synthetic peptide
  Seed: ALMDKSLHV (MAR1_HUMAN)
ANMDKSLHV

SEQ ID NO: 114946 - protein, 9 aa, Artificial Sequence
  Description of Artificial Sequence: Synthetic peptide
  Seed: LIGCWYCRR (MAR1_HUMAN)
LTGCWYCRR

SEQ ID NO: 114947 - protein, 9 aa, Artificial Sequence
  Description of Artificial Sequence: Synthetic peptide
  Seed: TVILGVLLL (MAR1_HUMAN)
TMILGVLLA

SEQ ID NO: 114948 - protein, 10 aa, Artificial Sequence
  Description of Artificial Sequence: Synthetic peptide
  Seed: YGYPKKGHGH (MAR1_HUMAN)
YTYPKKGHGF

SEQ ID NO: 114949 - protein, 11 aa, Artificial Sequence
  Description of Artificial Sequence: Synthetic peptide
  Seed: YRALMDKSLHV (MAR1_HUMAN)
YVALMDKSLHV

SEQ ID NO: 114950 - protein, 10 aa, Artificial Sequence
  Description of Artificial Sequence: Synthetic peptide
  Seed: TVILGVLLLI (MAR1_HUMAN)
TQILGVLLLA

SEQ ID NO: 114951 - protein, 11 aa, Artificial Sequence
  Description of Artificial Sequence: Synthetic peptide
  Seed: YRALMDKSLHV (MAR1_HUMAN)
YFALMDKSLHA

SEQ ID NO: 114952 - protein, 11 aa, Artificial Sequence
  Description of Artificial Sequence: Synthetic peptide
  Seed: EEAAGIGILTV (MAR1_HUMAN)
EEAAGIGILTA

SEQ ID NO: 114953 - protein, 10 aa, Artificial Sequence
  Description of Artificial Sequence: Synthetic peptide
  Seed: GILTVILGVL (MAR1_HUMAN)
GMLTVILGVA

SEQ ID NO: 114954 - protein, 9 aa, Artificial Sequence
  Description of Artificial Sequence: Synthetic peptide
  Seed: SAEQSPPPY (MAR1_HUMAN)
SPEQSPPPM

SEQ ID NO: 114955 - protein, 11 aa, Artificial Sequence
  Description of Artificial Sequence: Synthetic peptide
  Seed: YRALMDKSLHV (MAR1_HUMAN)
YYALMDKSLHL

SEQ ID NO: 114956 - protein, 9 aa, Artificial Sequence
  Description of Artificial Sequence: Synthetic peptide
  Seed: ALMDKSLHV (MAR1_HUMAN)
AQMDKSLHL

SEQ ID NO: 114957 - protein, 10 aa, Artificial Sequence
  Description of Artificial Sequence: Synthetic peptide
  Seed: IGILTVILGV (MAR1_HUMAN)
IAILTVILGV

SEQ ID NO: 114958 - protein, 9 aa, Artificial Sequence
  Description of Artificial Sequence: Synthetic peptide
  Seed: AHFIYGYPK (MAR1_HUMAN)
ATFIYGYPK

SEQ ID NO: 114959 - protein, 11 aa, Artificial Sequence
  Description of Artificial Sequence: Synthetic peptide
  Seed: YRALMDKSLHV (MAR1_HUMAN)
YAALMDKSLHV

SEQ ID NO: 114960 - protein, 10 aa, Artificial Sequence
  Description of Artificial Sequence: Synthetic peptide
  Seed: RRRNGYRALM (MAR1_HUMAN)
RPRNGYRALY

SEQ ID NO: 114961 - protein, 10 aa, Artificial Sequence
  Description of Artificial Sequence: Synthetic peptide
  Seed: EEAAGIGILT (MAR1_HUMAN)
EEAAGIGILA

SEQ ID NO: 114962 - protein, 9 aa, Artificial Sequence
  Description of Artificial Sequence: Synthetic peptide
  Seed: TVILGVLLL (MAR1_HUMAN)
TMILGVLLY

SEQ ID NO: 114963 - protein, 9 aa, Artificial Sequence
  Description of Artificial Sequence: Synthetic peptide
  Seed: HFIYGYPKK (MAR1_HUMAN)
HAIYGYPKK

SEQ ID NO: 114964 - protein, 10 aa, Artificial Sequence
  Description of Artificial Sequence: Synthetic peptide
  Seed: MPREDAHFIY (MAR1_HUMAN)
MLREDAHFIF

SEQ ID NO: 114965 - protein, 10 aa, Artificial Sequence
  Description of Artificial Sequence: Synthetic peptide
  Seed: REDAHFIYGY (MAR1_HUMAN)
RMDAHFIYGF

SEQ ID NO: 114966 - protein, 9 aa, Artificial Sequence
  Description of Artificial Sequence: Synthetic peptide
  Seed: NAPPAYEKL (MAR1_HUMAN)
NSPPAYEKW

SEQ ID NO: 114967 - protein, 9 aa, Artificial Sequence
  Description of Artificial Sequence: Synthetic peptide
  Seed: YRALMDKSL (MAR1_HUMAN)
YFALMDKSL

SEQ ID NO: 114968 - protein, 10 aa, Artificial Sequence
  Description of Artificial Sequence: Synthetic peptide
  Seed: RDSKVSLQEK (MAR1_HUMAN)
RMSKVSLQEK

SEQ ID NO: 114969 - protein, 9 aa, Artificial Sequence
  Description of Artificial Sequence: Synthetic peptide
  Seed: NAPPAYEKL (MAR1_HUMAN)
NLPPAYEKF

SEQ ID NO: 114970 - protein, 11 aa, Artificial Sequence
  Description of Artificial Sequence: Synthetic peptide
  Seed: EAAGIGILTVI (MAR1_HUMAN)
EVAGIGILTVV

SEQ ID NO: 114971 - protein, 9 aa, Artificial Sequence
  Description of Artificial Sequence: Synthetic peptide
  Seed: AAGIGILTV (MAR1_HUMAN)
AQGIGILTV

SEQ ID NO: 114972 - protein, 9 aa, Artificial Sequence
  Description of Artificial Sequence: Synthetic peptide
  Seed: RRRNGYRAL (MAR1_HUMAN)
RSRNGYRAY

SEQ ID NO: 114973 - protein, 9 aa, Artificial Sequence
  Description of Artificial Sequence: Synthetic peptide
  Seed: LHVGTQCAL (MAR1_HUMAN)
LMVGTQCAY

SEQ ID NO: 114974 - protein, 11 aa, Artificial Sequence
  Description of Artificial Sequence: Synthetic peptide
  Seed: YRALMDKSLHV (MAR1_HUMAN)
YPALMDKSLHI

SEQ ID NO: 114975 - protein, 8 aa, Artificial Sequence
  Description of Artificial Sequence: Synthetic peptide
  Seed: LMDKSLHV (MAR1_HUMAN)
LADKSLHF

SEQ ID NO: 114976 - protein, 10 aa, Artificial Sequence
  Description of Artificial Sequence: Synthetic peptide
  Seed: RRRNGYRALM (MAR1_HUMAN)
RGRNGYRALL

SEQ ID NO: 114977 - protein, 10 aa, Artificial Sequence
  Description of Artificial Sequence: Synthetic peptide
  Seed: RDSKVSLQEK (MAR1_HUMAN)
RKSKVSLQEK

SEQ ID NO: 114978 - protein, 9 aa, Artificial Sequence
  Description of Artificial Sequence: Synthetic peptide
  Seed: VVPNAPPAY (MAR1_HUMAN)
VLPNAPPAI

SEQ ID NO: 114979 - protein, 10 aa, Artificial Sequence
  Description of Artificial Sequence: Synthetic peptide
  Seed: RALMDKSLHV (MAR1_HUMAN)
RCLMDKSLHL

SEQ ID NO: 114980 - protein, 9 aa, Artificial Sequence
  Description of Artificial Sequence: Synthetic peptide
  Seed: TTAEEAAGI (MAR1_HUMAN)
TLAEEAAGV

SEQ ID NO: 114981 - protein, 9 aa, Artificial Sequence
  Description of Artificial Sequence: Synthetic peptide
  Seed: VILGVLLLI (MAR1_HUMAN)
VQLGVLLLL

SEQ ID NO: 114982 - protein, 10 aa, Artificial Sequence
  Description of Artificial Sequence: Synthetic peptide
  Seed: RDSKVSLQEK (MAR1_HUMAN)
RFSKVSLQEK

SEQ ID NO: 114983 - protein, 9 aa, Artificial Sequence
  Description of Artificial Sequence: Synthetic peptide
  Seed: TTAEEAAGI (MAR1_HUMAN)
TQAEEAAGV

SEQ ID NO: 114984 - protein, 9 aa, Artificial Sequence
  Description of Artificial Sequence: Synthetic peptide
  Seed: GTQCALTRR (MAR1_HUMAN)
GVQCALTRK

SEQ ID NO: 114985 - protein, 9 aa, Artificial Sequence
  Description of Artificial Sequence: Synthetic peptide
  Seed: NAPPAYEKL (MAR1_HUMAN)
NFPPAYEKY

SEQ ID NO: 114986 - protein, 9 aa, Artificial Sequence
  Description of Artificial Sequence: Synthetic peptide
  Seed: AEEAAGIGI (MAR1_HUMAN)
AEEAAGIGM

SEQ ID NO: 114987 - protein, 10 aa, Artificial Sequence
  Description of Artificial Sequence: Synthetic peptide
  Seed: APPAYEKLSA (MAR1_HUMAN)
AHPAYEKLSM

SEQ ID NO: 114988 - protein, 11 aa, Artificial Sequence
  Description of Artificial Sequence: Synthetic peptide
  Seed: YRALMDKSLHV (MAR1_HUMAN)
YWALMDKSLHM

SEQ ID NO: 114989 - protein, 9 aa, Artificial Sequence
  Description of Artificial Sequence: Synthetic peptide
  Seed: HFIYGYPKK (MAR1_HUMAN)
HMIYGYPKR

SEQ ID NO: 114990 - protein, 9 aa, Artificial Sequence
  Description of Artificial Sequence: Synthetic peptide
  Seed: RRNGYRALM (MAR1_HUMAN)
RENGYRALM

SEQ ID NO: 114991 - protein, 9 aa, Artificial Sequence
  Description of Artificial Sequence: Synthetic peptide
  Seed: NGYRALMDK (MAR1_HUMAN)
NIYRALMDK

SEQ ID NO: 114992 - protein, 10 aa, Artificial Sequence
  Description of Artificial Sequence: Synthetic peptide
  Seed: APPAYEKLSA (MAR1_HUMAN)
AQPAYEKLSL

SEQ ID NO: 114993 - protein, 10 aa, Artificial Sequence
  Description of Artificial Sequence: Synthetic peptide
  Seed: TVILGVLLLI (MAR1_HUMAN)
TGILGVLLLV

SEQ ID NO: 114994 - protein, 9 aa, Artificial Sequence
  Description of Artificial Sequence: Synthetic peptide
  Seed: SLHVGTQCA (MAR1_HUMAN)
SLHVGTQCI

SEQ ID NO: 114995 - protein, 10 aa, Artificial Sequence
  Description of Artificial Sequence: Synthetic peptide
  Seed: RDSKVSLQEK (MAR1_HUMAN)
RVSKVSLQEV

SEQ ID NO: 114996 - protein, 9 aa, Artificial Sequence
  Description of Artificial Sequence: Synthetic peptide
  Seed: AGIGILTVI (MAR1_HUMAN)
ASIGILTVY

SEQ ID NO: 114997 - protein, 11 aa, Artificial Sequence
  Description of Artificial Sequence: Synthetic peptide
  Seed: YRALMDKSLHV (MAR1_HUMAN)
YWALMDKSLHA

SEQ ID NO: 114998 - protein, 9 aa, Artificial Sequence
  Description of Artificial Sequence: Synthetic peptide
  Seed: ALMDKSLHV (MAR1_HUMAN)
AAMDKSLHF

SEQ ID NO: 114999 - protein, 9 aa, Artificial Sequence
  Description of Artificial Sequence: Synthetic peptide
  Seed: VVPNAPPAY (MAR1_HUMAN)
VWPNAPPAM

SEQ ID NO: 115000 - protein, 11 aa, Artificial Sequence
  Description of Artificial Sequence: Synthetic peptide
  Seed: RALMDKSLHVG (MAR1_HUMAN)
RMLMDKSLHVL

SEQ ID NO: 115001 - protein, 10 aa, Artificial Sequence
  Description of Artificial Sequence: Synthetic peptide
  Seed: YTTAEEAAGI (MAR1_HUMAN)
YVTAEEAAGL

SEQ ID NO: 115002 - protein, 9 aa, Artificial Sequence
  Description of Artificial Sequence: Synthetic peptide
  Seed: TVILGVLLL (MAR1_HUMAN)
TLILGVLLY

SEQ ID NO: 115003 - protein, 10 aa, Artificial Sequence
  Description of Artificial Sequence: Synthetic peptide
  Seed: YTTAEEAAGI (MAR1_HUMAN)
YNTAEEAAGV

SEQ ID NO: 115004 - protein, 10 aa, Artificial Sequence
  Description of Artificial Sequence: Synthetic peptide
  Seed: RRRNGYRALM (MAR1_HUMAN)
RIRNGYRALF

SEQ ID NO: 115005 - protein, 11 aa, Artificial Sequence
  Description of Artificial Sequence: Synthetic peptide
  Seed: YRALMDKSLHV (MAR1_HUMAN)
YMALMDKSLHV

SEQ ID NO: 115006 - protein, 11 aa, Artificial Sequence
  Description of Artificial Sequence: Synthetic peptide
  Seed: ALMDKSLHVGT (MAR1_HUMAN)
ALMDKSLHVGM

SEQ ID NO: 115007 - protein, 9 aa, Artificial Sequence
  Description of Artificial Sequence: Synthetic peptide
  Seed: LTVILGVLL (MAR1_HUMAN)
LTVILGVLY

SEQ ID NO: 115008 - protein, 9 aa, Artificial Sequence
  Description of Artificial Sequence: Synthetic peptide
  Seed: RRRNGYRAL (MAR1_HUMAN)
RMRNGYRAY

SEQ ID NO: 115009 - protein, 10 aa, Artificial Sequence
  Description of Artificial Sequence: Synthetic peptide
  Seed: KGHGHSYTTA (MAR1_HUMAN)
KAHGHSYTTK

SEQ ID NO: 115010 - protein, 9 aa, Artificial Sequence
  Description of Artificial Sequence: Synthetic peptide
  Seed: LLLIGCWYC (MAR1_HUMAN)
LQLIGCWYV

SEQ ID NO: 115011 - protein, 9 aa, Artificial Sequence
  Description of Artificial Sequence: Synthetic peptide
  Seed: RRNGYRALM (MAR1_HUMAN)
RQNGYRALI

SEQ ID NO: 115012 - protein, 9 aa, Artificial Sequence
  Description of Artificial Sequence: Synthetic peptide
  Seed: HSYTTAEEA (MAR1_HUMAN)
HSYTTAEEY

SEQ ID NO: 115013 - protein, 9 aa, Artificial Sequence
  Description of Artificial Sequence: Synthetic peptide
  Seed: VVPNAPPAY (MAR1_HUMAN)
VRPNAPPAM

SEQ ID NO: 115014 - protein, 9 aa, Artificial Sequence
  Description of Artificial Sequence: Synthetic peptide
  Seed: HSYTTAEEA (MAR1_HUMAN)
HAYTTAEEY

SEQ ID NO: 115015 - protein, 9 aa, Artificial Sequence
  Description of Artificial Sequence: Synthetic peptide
  Seed: TVILGVLLL (MAR1_HUMAN)
TGILGVLLW

SEQ ID NO: 115016 - protein, 10 aa, Artificial Sequence
  Description of Artificial Sequence: Synthetic peptide
  Seed: YPKKGHGHSY (MAR1_HUMAN)
YVKKGHGHSY

SEQ ID NO: 115017 - protein, 9 aa, Artificial Sequence
  Description of Artificial Sequence: Synthetic peptide
  Seed: LHVGTQCAL (MAR1_HUMAN)
LSVGTQCAF

SEQ ID NO: 115018 - protein, 9 aa, Artificial Sequence
  Description of Artificial Sequence: Synthetic peptide
  Seed: NAPPAYEKL (MAR1_HUMAN)
NVPPAYEKI

SEQ ID NO: 115019 - protein, 10 aa, Artificial Sequence
  Description of Artificial Sequence: Synthetic peptide
  Seed: YGYPKKGHGH (MAR1_HUMAN)
YAYPKKGHGY

SEQ ID NO: 115020 - protein, 10 aa, Artificial Sequence
  Description of Artificial Sequence: Synthetic peptide
  Seed: RRNGYRALMD (MAR1_HUMAN)
RRNGYRALMR

SEQ ID NO: 115021 - protein, 10 aa, Artificial Sequence
  Description of Artificial Sequence: Synthetic peptide
  Seed: TVILGVLLLI (MAR1_HUMAN)
TYILGVLLLV

SEQ ID NO: 115022 - protein, 8 aa, Artificial Sequence
  Description of Artificial Sequence: Synthetic peptide
  Seed: LMDKSLHV (MAR1_HUMAN)
LQDKSLHL

SEQ ID NO: 115023 - protein, 10 aa, Artificial Sequence
  Description of Artificial Sequence: Synthetic peptide
  Seed: AHFIYGYPKK (MAR1_HUMAN)
AMFIYGYPKK

SEQ ID NO: 115024 - protein, 10 aa, Artificial Sequence
  Description of Artificial Sequence: Synthetic peptide
  Seed: RDSKVSLQEK (MAR1_HUMAN)
RISKVSLQEK

SEQ ID NO: 115025 - protein, 10 aa, Artificial Sequence
  Description of Artificial Sequence: Synthetic peptide
  Seed: YGYPKKGHGH (MAR1_HUMAN)
YSYPKKGHGL

SEQ ID NO: 115026 - protein, 9 aa, Artificial Sequence
  Description of Artificial Sequence: Synthetic peptide
  Seed: EDAHFIYGY (MAR1_HUMAN)
EIAHFIYGF

SEQ ID NO: 115027 - protein, 9 aa, Artificial Sequence
  Description of Artificial Sequence: Synthetic peptide
  Seed: AGIGILTVI (MAR1_HUMAN)
ASIGILTVH

SEQ ID NO: 115028 - protein, 9 aa, Artificial Sequence
  Description of Artificial Sequence: Synthetic peptide
  Seed: TVILGVLLL (MAR1_HUMAN)
TVILGVLLV

SEQ ID NO: 115029 - protein, 9 aa, Artificial Sequence
  Description of Artificial Sequence: Synthetic peptide
  Seed: SAEQSPPPY (MAR1_HUMAN)
SKEQSPPPY

SEQ ID NO: 115030 - protein, 10 aa, Artificial Sequence
  Description of Artificial Sequence: Synthetic peptide
  Seed: GILTVILGVL (MAR1_HUMAN)
GVLTVILGVV

SEQ ID NO: 115031 - protein, 11 aa, Artificial Sequence
  Description of Artificial Sequence: Synthetic peptide
  Seed: AEEAAGIGILT (MAR1_HUMAN)
AEEAAGIGILM

SEQ ID NO: 115032 - protein, 9 aa, Artificial Sequence
  Description of Artificial Sequence: Synthetic peptide
  Seed: ALMDKSLHV (MAR1_HUMAN)
ALMDKSLHY

SEQ ID NO: 115033 - protein, 9 aa, Artificial Sequence
  Description of Artificial Sequence: Synthetic peptide
  Seed: VVPNAPPAY (MAR1_HUMAN)
VFPNAPPAY

SEQ ID NO: 115034 - protein, 9 aa, Artificial Sequence
  Description of Artificial Sequence: Synthetic peptide
  Seed: EQSPPPYSP (MAR1_HUMAN)
EESPPPYSM

SEQ ID NO: 115035 - protein, 11 aa, Artificial Sequence
  Description of Artificial Sequence: Synthetic peptide
  Seed: YRALMDKSLHV (MAR1_HUMAN)
YGALMDKSLHM

SEQ ID NO: 115036 - protein, 9 aa, Artificial Sequence
  Description of Artificial Sequence: Synthetic peptide
  Seed: EGFDHRDSK (MAR1_HUMAN)
ETFDHRDSK

SEQ ID NO: 115037 - protein, 9 aa, Artificial Sequence
  Description of Artificial Sequence: Synthetic peptide
  Seed: AGIGILTVI (MAR1_HUMAN)
AMIGILTVM

SEQ ID NO: 115038 - protein, 9 aa, Artificial Sequence
  Description of Artificial Sequence: Synthetic peptide
  Seed: EGFDHRDSK (MAR1_HUMAN)
EVFDHRDSY

SEQ ID NO: 115039 - protein, 9 aa, Artificial Sequence
  Description of Artificial Sequence: Synthetic peptide
  Seed: GILTVILGV (MAR1_HUMAN)
GILTVILGL

SEQ ID NO: 115040 - protein, 9 aa, Artificial Sequence
  Description of Artificial Sequence: Synthetic peptide
  Seed: ALMDKSLHV (MAR1_HUMAN)
ATMDKSLHM

SEQ ID NO: 115041 - protein, 9 aa, Artificial Sequence
  Description of Artificial Sequence: Synthetic peptide
  Seed: TVILGVLLL (MAR1_HUMAN)
TAILGVLLM

SEQ ID NO: 115042 - protein, 11 aa, Artificial Sequence
  Description of Artificial Sequence: Synthetic peptide
  Seed: YRALMDKSLHV (MAR1_HUMAN)
YKALMDKSLHV

SEQ ID NO: 115043 - protein, 9 aa, Artificial Sequence
  Description of Artificial Sequence: Synthetic peptide
  Seed: EGFDHRDSK (MAR1_HUMAN)
EAFDHRDSL

SEQ ID NO: 115044 - protein, 10 aa, Artificial Sequence
  Description of Artificial Sequence: Synthetic peptide
  Seed: YTTAEEAAGI (MAR1_HUMAN)
YFTAEEAAGI

SEQ ID NO: 115045 - protein, 11 aa, Artificial Sequence
  Description of Artificial Sequence: Synthetic peptide
  Seed: YCRRRNGYRAL (MAR1_HUMAN)
YMRRRNGYRAV

SEQ ID NO: 115046 - protein, 10 aa, Artificial Sequence
  Description of Artificial Sequence: Synthetic peptide
  Seed: LLLIGCWYCR (MAR1_HUMAN)
LSLIGCWYCK

SEQ ID NO: 115047 - protein, 9 aa, Artificial Sequence
  Description of Artificial Sequence: Synthetic peptide
  Seed: AGIGILTVI (MAR1_HUMAN)
AIIGILTVM

SEQ ID NO: 115048 - protein, 9 aa, Artificial Sequence
  Description of Artificial Sequence: Synthetic peptide
  Seed: ALMDKSLHV (MAR1_HUMAN)
AAMDKSLHL

SEQ ID NO: 115049 - protein, 10 aa, Artificial Sequence
  Description of Artificial Sequence: Synthetic peptide
  Seed: TVILGVLLLI (MAR1_HUMAN)
TMILGVLLLA

SEQ ID NO: 115050 - protein, 11 aa, Artificial Sequence
  Description of Artificial Sequence: Synthetic peptide
  Seed: YRALMDKSLHV (MAR1_HUMAN)
YVALMDKSLHM

SEQ ID NO: 115051 - protein, 10 aa, Artificial Sequence
  Description of Artificial Sequence: Synthetic peptide
  Seed: PVVPNAPPAY (MAR1_HUMAN)
PMVPNAPPAY

SEQ ID NO: 115052 - protein, 9 aa, Artificial Sequence
  Description of Artificial Sequence: Synthetic peptide
  Seed: RRNGYRALM (MAR1_HUMAN)
RKNGYRALM

SEQ ID NO: 115053 - protein, 9 aa, Artificial Sequence
  Description of Artificial Sequence: Synthetic peptide
  Seed: ALMDKSLHV (MAR1_HUMAN)
AIMDKSLHF

SEQ ID NO: 115054 - protein, 9 aa, Artificial Sequence
  Description of Artificial Sequence: Synthetic peptide
  Seed: SLHVGTQCA (MAR1_HUMAN)
SMHVGTQCV

SEQ ID NO: 115055 - protein, 11 aa, Artificial Sequence
  Description of Artificial Sequence: Synthetic peptide
  Seed: YCRRRNGYRAL (MAR1_HUMAN)
YIRRRNGYRAL

SEQ ID NO: 115056 - protein, 8 aa, Artificial Sequence
  Description of Artificial Sequence: Synthetic peptide
  Seed: LMDKSLHV (MAR1_HUMAN)
LNDKSLHL

SEQ ID NO: 115057 - protein, 9 aa, Artificial Sequence
  Description of Artificial Sequence: Synthetic peptide
  Seed: RRNGYRALM (MAR1_HUMAN)
RANGYRALM

SEQ ID NO: 115058 - protein, 10 aa, Artificial Sequence
  Description of Artificial Sequence: Synthetic peptide
  Seed: EAAGIGILTV (MAR1_HUMAN)
EMAGIGILTR

SEQ ID NO: 115059 - protein, 10 aa, Artificial Sequence
  Description of Artificial Sequence: Synthetic peptide
  Seed: TVILGVLLLI (MAR1_HUMAN)
TSILGVLLLV

SEQ ID NO: 115060 - protein, 9 aa, Artificial Sequence
  Description of Artificial Sequence: Synthetic peptide
  Seed: VVPNAPPAY (MAR1_HUMAN)
VIPNAPPAV

SEQ ID NO: 115061 - protein, 10 aa, Artificial Sequence
  Description of Artificial Sequence: Synthetic peptide
  Seed: APPAYEKLSA (MAR1_HUMAN)
ATPAYEKLSM

SEQ ID NO: 115062 - protein, 10 aa, Artificial Sequence
  Description of Artificial Sequence: Synthetic peptide
  Seed: ALMDKSLHVG (MAR1_HUMAN)
ALMDKSLHVS

SEQ ID NO: 115063 - protein, 9 aa, Artificial Sequence
  Description of Artificial Sequence: Synthetic peptide
  Seed: LLLIGCWYC (MAR1_HUMAN)
LLLIGCWYI

SEQ ID NO: 115064 - protein, 9 aa, Artificial Sequence
  Description of Artificial Sequence: Synthetic peptide
  Seed: QEKNCEPVV (MAR1_HUMAN)
QEKNCEPVI

SEQ ID NO: 115065 - protein, 9 aa, Artificial Sequence
  Description of Artificial Sequence: Synthetic peptide
  Seed: EAAGIGILT (MAR1_HUMAN)
EVAGIGILM

SEQ ID NO: 115066 - protein, 10 aa, Artificial Sequence
  Description of Artificial Sequence: Synthetic peptide
  Seed: LSAEQSPPPY (MAR1_HUMAN)
LPAEQSPPPF

SEQ ID NO: 115067 - protein, 9 aa, Artificial Sequence
  Description of Artificial Sequence: Synthetic peptide
  Seed: GFDHRDSKV (MAR1_HUMAN)
GTDHRDSKM

SEQ ID NO: 115068 - protein, 10 aa, Artificial Sequence
  Description of Artificial Sequence: Synthetic peptide
  Seed: EAAGIGILTV (MAR1_HUMAN)
EIAGIGILTV

SEQ ID NO: 115069 - protein, 9 aa, Artificial Sequence
  Description of Artificial Sequence: Synthetic peptide
  Seed: RRRNGYRAL (MAR1_HUMAN)
RERNGYRAM

SEQ ID NO: 115070 - protein, 9 aa, Artificial Sequence
  Description of Artificial Sequence: Synthetic peptide
  Seed: LLLIGCWYC (MAR1_HUMAN)
LLLIGCWYL

SEQ ID NO: 115071 - protein, 9 aa, Artificial Sequence
  Description of Artificial Sequence: Synthetic peptide
  Seed: GILTVILGV (MAR1_HUMAN)
GTLTVILGR

SEQ ID NO: 115072 - protein, 9 aa, Artificial Sequence
  Description of Artificial Sequence: Synthetic peptide
  Seed: AAGIGILTV (MAR1_HUMAN)
AAGIGILTW

SEQ ID NO: 115073 - protein, 9 aa, Artificial Sequence
  Description of Artificial Sequence: Synthetic peptide
  Seed: VVPNAPPAY (MAR1_HUMAN)
VLPNAPPAM

SEQ ID NO: 115074 - protein, 10 aa, Artificial Sequence
  Description of Artificial Sequence: Synthetic peptide
  Seed: ALMDKSLHVG (MAR1_HUMAN)
ACMDKSLHVV

SEQ ID NO: 115075 - protein, 9 aa, Artificial Sequence
  Description of Artificial Sequence: Synthetic peptide
  Seed: GTQCALTRR (MAR1_HUMAN)
GSQCALTRK

SEQ ID NO: 115076 - protein, 9 aa, Artificial Sequence
  Description of Artificial Sequence: Synthetic peptide
  Seed: EAAGIGILT (MAR1_HUMAN)
ESAGIGILM

SEQ ID NO: 115077 - protein, 9 aa, Artificial Sequence
  Description of Artificial Sequence: Synthetic peptide
  Seed: VVPNAPPAY (MAR1_HUMAN)
VGPNAPPAF

SEQ ID NO: 115078 - protein, 9 aa, Artificial Sequence
  Description of Artificial Sequence: Synthetic peptide
  Seed: REDAHFIYG (MAR1_HUMAN)
RDDAHFIYL

SEQ ID NO: 115079 - protein, 9 aa, Artificial Sequence
  Description of Artificial Sequence: Synthetic peptide
  Seed: REDAHFIYG (MAR1_HUMAN)
REDAHFIYT

SEQ ID NO: 115080 - protein, 9 aa, Artificial Sequence
  Description of Artificial Sequence: Synthetic peptide
  Seed: TTAEEAAGI (MAR1_HUMAN)
TQAEEAAGI

SEQ ID NO: 115081 - protein, 10 aa, Artificial Sequence
  Description of Artificial Sequence: Synthetic peptide
  Seed: YTTAEEAAGI (MAR1_HUMAN)
YKTAEEAAGV

SEQ ID NO: 115082 - protein, 10 aa, Artificial Sequence
  Description of Artificial Sequence: Synthetic peptide
  Seed: ALMDKSLHVG (MAR1_HUMAN)
AMMDKSLHVY

SEQ ID NO: 115083 - protein, 9 aa, Artificial Sequence
  Description of Artificial Sequence: Synthetic peptide
  Seed: TVILGVLLL (MAR1_HUMAN)
TMILGVLLF

SEQ ID NO: 115084 - protein, 10 aa, Artificial Sequence
  Description of Artificial Sequence: Synthetic peptide
  Seed: LTRRCPQEGF (MAR1_HUMAN)
LSRRCPQEGW

SEQ ID NO: 115085 - protein, 11 aa, Artificial Sequence
  Description of Artificial Sequence: Synthetic peptide
  Seed: YRALMDKSLHV (MAR1_HUMAN)
YCALMDKSLHL

SEQ ID NO: 115086 - protein, 10 aa, Artificial Sequence
  Description of Artificial Sequence: Synthetic peptide
  Seed: RRRNGYRALM (MAR1_HUMAN)
RERNGYRALF

SEQ ID NO: 115087 - protein, 9 aa, Artificial Sequence
  Description of Artificial Sequence: Synthetic peptide
  Seed: ALMDKSLHV (MAR1_HUMAN)
AGMDKSLHL

SEQ ID NO: 115088 - protein, 9 aa, Artificial Sequence
  Description of Artificial Sequence: Synthetic peptide
  Seed: NAPPAYEKL (MAR1_HUMAN)
NLPPAYEKY

SEQ ID NO: 115089 - protein, 10 aa, Artificial Sequence
  Description of Artificial Sequence: Synthetic peptide
  Seed: YTTAEEAAGI (MAR1_HUMAN)
YQTAEEAAGI

SEQ ID NO: 115090 - protein, 10 aa, Artificial Sequence
  Description of Artificial Sequence: Synthetic peptide
  Seed: TVILGVLLLI (MAR1_HUMAN)
THILGVLLLV

SEQ ID NO: 115091 - protein, 10 aa, Artificial Sequence
  Description of Artificial Sequence: Synthetic peptide
  Seed: YPKKGHGHSY (MAR1_HUMAN)
YRKKGHGHSY

SEQ ID NO: 115092 - protein, 11 aa, Artificial Sequence
  Description of Artificial Sequence: Synthetic peptide
  Seed: YRALMDKSLHV (MAR1_HUMAN)
YEALMDKSLHV

SEQ ID NO: 115093 - protein, 10 aa, Artificial Sequence
  Description of Artificial Sequence: Synthetic peptide
  Seed: YPKKGHGHSY (MAR1_HUMAN)
YYKKGHGHSF

SEQ ID NO: 115094 - protein, 10 aa, Artificial Sequence
  Description of Artificial Sequence: Synthetic peptide
  Seed: VPNAPPAYEK (MAR1_HUMAN)
VVNAPPAYEK

SEQ ID NO: 115095 - protein, 9 aa, Artificial Sequence
  Description of Artificial Sequence: Synthetic peptide
  Seed: RRNGYRALM (MAR1_HUMAN)
RYNGYRALM

SEQ ID NO: 115096 - protein, 10 aa, Artificial Sequence
  Description of Artificial Sequence: Synthetic peptide
  Seed: EEAAGIGILT (MAR1_HUMAN)
EKAAGIGILV

SEQ ID NO: 115097 - protein, 10 aa, Artificial Sequence
  Description of Artificial Sequence: Synthetic peptide
  Seed: APPAYEKLSA (MAR1_HUMAN)
AKPAYEKLSM

SEQ ID NO: 115098 - protein, 10 aa, Artificial Sequence
  Description of Artificial Sequence: Synthetic peptide
  Seed: RRRNGYRALM (MAR1_HUMAN)
RARNGYRALY

SEQ ID NO: 115099 - protein, 9 aa, Artificial Sequence
  Description of Artificial Sequence: Synthetic peptide
  Seed: LHVGTQCAL (MAR1_HUMAN)
LEVGTQCAF

SEQ ID NO: 115100 - protein, 10 aa, Artificial Sequence
  Description of Artificial Sequence: Synthetic peptide
  Seed: AHFIYGYPKK (MAR1_HUMAN)
AYFIYGYPKR

SEQ ID NO: 115101 - protein, 9 aa, Artificial Sequence
  Description of Artificial Sequence: Synthetic peptide
  Seed: YRALMDKSL (MAR1_HUMAN)
YYALMDKSI

SEQ ID NO: 115102 - protein, 9 aa, Artificial Sequence
  Description of Artificial Sequence: Synthetic peptide
  Seed: AAGIGILTV (MAR1_HUMAN)
ATGIGILTV

SEQ ID NO: 115103 - protein, 9 aa, Artificial Sequence
  Description of Artificial Sequence: Synthetic peptide
  Seed: VILGVLLLI (MAR1_HUMAN)
VSLGVLLLL

SEQ ID NO: 115104 - protein, 9 aa, Artificial Sequence
  Description of Artificial Sequence: Synthetic peptide
  Seed: GYPKKGHGH (MAR1_HUMAN)
GYPKKGHGL

SEQ ID NO: 115105 - protein, 9 aa, Artificial Sequence
  Description of Artificial Sequence: Synthetic peptide
  Seed: VVPNAPPAY (MAR1_HUMAN)
VGPNAPPAL

SEQ ID NO: 115106 - protein, 10 aa, Artificial Sequence
  Description of Artificial Sequence: Synthetic peptide
  Seed: KGHGHSYTTA (MAR1_HUMAN)
KTHGHSYTTL

SEQ ID NO: 115107 - protein, 9 aa, Artificial Sequence
  Description of Artificial Sequence: Synthetic peptide
  Seed: LLLIGCWYC (MAR1_HUMAN)
LMLIGCWYV

SEQ ID NO: 115108 - protein, 9 aa, Artificial Sequence
  Description of Artificial Sequence: Synthetic peptide
  Seed: EGFDHRDSK (MAR1_HUMAN)
ENFDHRDSR

SEQ ID NO: 115109 - protein, 10 aa, Artificial Sequence
  Description of Artificial Sequence: Synthetic peptide
  Seed: EEAAGIGILT (MAR1_HUMAN)
EAAAGIGILV

SEQ ID NO: 115110 - protein, 10 aa, Artificial Sequence
  Description of Artificial Sequence: Synthetic peptide
  Seed: TVILGVLLLI (MAR1_HUMAN)
TKILGVLLLV

SEQ ID NO: 115111 - protein, 10 aa, Artificial Sequence
  Description of Artificial Sequence: Synthetic peptide
  Seed: EEAAGIGILT (MAR1_HUMAN)
EYAAGIGILV

SEQ ID NO: 115112 - protein, 11 aa, Artificial Sequence
  Description of Artificial Sequence: Synthetic peptide
  Seed: RALMDKSLHVG (MAR1_HUMAN)
RYLMDKSLHVL

SEQ ID NO: 115113 - protein, 10 aa, Artificial Sequence
  Description of Artificial Sequence: Synthetic peptide
  Seed: YTTAEEAAGI (MAR1_HUMAN)
YLTAEEAAGV

SEQ ID NO: 115114 - protein, 9 aa, Artificial Sequence
  Description of Artificial Sequence: Synthetic peptide
  Seed: AGIGILTVI (MAR1_HUMAN)
AMIGILTVV

SEQ ID NO: 115115 - protein, 9 aa, Artificial Sequence
  Description of Artificial Sequence: Synthetic peptide
  Seed: VILGVLLLI (MAR1_HUMAN)
VMLGVLLLW

SEQ ID NO: 115116 - protein, 9 aa, Artificial Sequence
  Description of Artificial Sequence: Synthetic peptide
  Seed: TVILGVLLL (MAR1_HUMAN)
TSILGVLLL

SEQ ID NO: 115117 - protein, 9 aa, Artificial Sequence
  Description of Artificial Sequence: Synthetic peptide
  Seed: EAAGIGILT (MAR1_HUMAN)
EAAGIGILI

SEQ ID NO: 115118 - protein, 9 aa, Artificial Sequence
  Description of Artificial Sequence: Synthetic peptide
  Seed: VILGVLLLI (MAR1_HUMAN)
VILGVLLLV

SEQ ID NO: 115119 - protein, 10 aa, Artificial Sequence
  Description of Artificial Sequence: Synthetic peptide
  Seed: RALMDKSLHV (MAR1_HUMAN)
RYLMDKSLHA

SEQ ID NO: 115120 - protein, 10 aa, Artificial Sequence
  Description of Artificial Sequence: Synthetic peptide
  Seed: RRRNGYRALM (MAR1_HUMAN)
RFRNGYRALF

SEQ ID NO: 115121 - protein, 9 aa, Artificial Sequence
  Description of Artificial Sequence: Synthetic peptide
  Seed: MPREDAHFI (MAR1_HUMAN)
MMREDAHFF

SEQ ID NO: 115122 - protein, 10 aa, Artificial Sequence
  Description of Artificial Sequence: Synthetic peptide
  Seed: EAAGIGILTV (MAR1_HUMAN)
ESAGIGILTA

SEQ ID NO: 115123 - protein, 9 aa, Artificial Sequence
  Description of Artificial Sequence: Synthetic peptide
  Seed: EAAGIGILT (MAR1_HUMAN)
ETAGIGILL

SEQ ID NO: 115124 - protein, 9 aa, Artificial Sequence
  Description of Artificial Sequence: Synthetic peptide
  Seed: LHVGTQCAL (MAR1_HUMAN)
LMVGTQCAM

SEQ ID NO: 115125 - protein, 9 aa, Artificial Sequence
  Description of Artificial Sequence: Synthetic peptide
  Seed: VVPNAPPAY (MAR1_HUMAN)
VFPNAPPAL

SEQ ID NO: 115126 - protein, 10 aa, Artificial Sequence
  Description of Artificial Sequence: Synthetic peptide
  Seed: RALMDKSLHV (MAR1_HUMAN)
RFLMDKSLHL

SEQ ID NO: 115127 - protein, 10 aa, Artificial Sequence
  Description of Artificial Sequence: Synthetic peptide
  Seed: RALMDKSLHV (MAR1_HUMAN)
RILMDKSLHA

SEQ ID NO: 115128 - protein, 10 aa, Artificial Sequence
  Description of Artificial Sequence: Synthetic peptide
  Seed: FDHRDSKVSL (MAR1_HUMAN)
FEHRDSKVSA

SEQ ID NO: 115129 - protein, 9 aa, Artificial Sequence
  Description of Artificial Sequence: Synthetic peptide
  Seed: AHFIYGYPK (MAR1_HUMAN)
AYFIYGYPR

SEQ ID NO: 115130 - protein, 9 aa, Artificial Sequence
  Description of Artificial Sequence: Synthetic peptide
  Seed: REDAHFIYG (MAR1_HUMAN)
REDAHFIYV

SEQ ID NO: 115131 - protein, 9 aa, Artificial Sequence
  Description of Artificial Sequence: Synthetic peptide
  Seed: DSKVSLQEK (MAR1_HUMAN)
DAKVSLQER

SEQ ID NO: 115132 - protein, 9 aa, Artificial Sequence
  Description of Artificial Sequence: Synthetic peptide
  Seed: YRALMDKSL (MAR1_HUMAN)
YHALMDKSL

SEQ ID NO: 115133 - protein, 10 aa, Artificial Sequence
  Description of Artificial Sequence: Synthetic peptide
  Seed: AEQSPPPYSP (MAR1_HUMAN)
AEQSPPPYSF

SEQ ID NO: 115134 - protein, 10 aa, Artificial Sequence
  Description of Artificial Sequence: Synthetic peptide
  Seed: VPNAPPAYEK (MAR1_HUMAN)
VPNAPPAYEA

SEQ ID NO: 115135 - protein, 10 aa, Artificial Sequence
  Description of Artificial Sequence: Synthetic peptide
  Seed: EAAGIGILTV (MAR1_HUMAN)
EAAGIGILTK

SEQ ID NO: 115136 - protein, 9 aa, Artificial Sequence
  Description of Artificial Sequence: Synthetic peptide
  Seed: EDAHFIYGY (MAR1_HUMAN)
EMAHFIYGY

SEQ ID NO: 115137 - protein, 10 aa, Artificial Sequence
  Description of Artificial Sequence: Synthetic peptide
  Seed: AHFIYGYPKK (MAR1_HUMAN)
AVFIYGYPKR

SEQ ID NO: 115138 - protein, 9 aa, Artificial Sequence
  Description of Artificial Sequence: Synthetic peptide
  Seed: RRNGYRALM (MAR1_HUMAN)
RINGYRALF

SEQ ID NO: 115139 - protein, 10 aa, Artificial Sequence
  Description of Artificial Sequence: Synthetic peptide
  Seed: RALMDKSLHV (MAR1_HUMAN)
RTLMDKSLHV

SEQ ID NO: 115140 - protein, 8 aa, Artificial Sequence
  Description of Artificial Sequence: Synthetic peptide
  Seed: HRDSKVSL (MAR1_HUMAN)
HFDSKVSI

SEQ ID NO: 115141 - protein, 10 aa, Artificial Sequence
  Description of Artificial Sequence: Synthetic peptide
  Seed: IGILTVILGV (MAR1_HUMAN)
IYILTVILGV

SEQ ID NO: 115142 - protein, 9 aa, Artificial Sequence
  Description of Artificial Sequence: Synthetic peptide
  Seed: AGIGILTVI (MAR1_HUMAN)
AVIGILTVI

SEQ ID NO: 115143 - protein, 10 aa, Artificial Sequence
  Description of Artificial Sequence: Synthetic peptide
  Seed: AHFIYGYPKK (MAR1_HUMAN)
AGFIYGYPKR

SEQ ID NO: 115144 - protein, 10 aa, Artificial Sequence
  Description of Artificial Sequence: Synthetic peptide
  Seed: YTTAEEAAGI (MAR1_HUMAN)
YSTAEEAAGI

SEQ ID NO: 115145 - protein, 10 aa, Artificial Sequence
  Description of Artificial Sequence: Synthetic peptide
  Seed: REDAHFIYGY (MAR1_HUMAN)
RQDAHFIYGF

SEQ ID NO: 115146 - protein, 9 aa, Artificial Sequence
  Description of Artificial Sequence: Synthetic peptide
  Seed: TVILGVLLL (MAR1_HUMAN)
TLILGVLLV

SEQ ID NO: 115147 - protein, 10 aa, Artificial Sequence
  Description of Artificial Sequence: Synthetic peptide
  Seed: LSAEQSPPPY (MAR1_HUMAN)
LMAEQSPPPM

SEQ ID NO: 115148 - protein, 11 aa, Artificial Sequence
  Description of Artificial Sequence: Synthetic peptide
  Seed: MPREDAHFIYG (MAR1_HUMAN)
MPREDAHFIYF

SEQ ID NO: 115149 - protein, 10 aa, Artificial Sequence
  Description of Artificial Sequence: Synthetic peptide
  Seed: YTTAEEAAGI (MAR1_HUMAN)
YFTAEEAAGV

SEQ ID NO: 115150 - protein, 9 aa, Artificial Sequence
  Description of Artificial Sequence: Synthetic peptide
  Seed: RRNGYRALM (MAR1_HUMAN)
RMNGYRALY

SEQ ID NO: 115151 - protein, 9 aa, Artificial Sequence
  Description of Artificial Sequence: Synthetic peptide
  Seed: LLLIGCWYC (MAR1_HUMAN)
LQLIGCWYA

SEQ ID NO: 115152 - protein, 8 aa, Artificial Sequence
  Description of Artificial Sequence: Synthetic peptide
  Seed: LMDKSLHV (MAR1_HUMAN)
LWDKSLHL

SEQ ID NO: 115153 - protein, 10 aa, Artificial Sequence
  Description of Artificial Sequence: Synthetic peptide
  Seed: HVGTQCALTR (MAR1_HUMAN)
HTGTQCALTK

SEQ ID NO: 115154 - protein, 9 aa, Artificial Sequence
  Description of Artificial Sequence: Synthetic peptide
  Seed: HSYTTAEEA (MAR1_HUMAN)
HAYTTAEEV

SEQ ID NO: 115155 - protein, 9 aa, Artificial Sequence
  Description of Artificial Sequence: Synthetic peptide
  Seed: TVILGVLLL (MAR1_HUMAN)
TSILGVLLY

SEQ ID NO: 115156 - protein, 10 aa, Artificial Sequence
  Description of Artificial Sequence: Synthetic peptide
  Seed: ALMDKSLHVG (MAR1_HUMAN)
AMMDKSLHVP

SEQ ID NO: 115157 - protein, 9 aa, Artificial Sequence
  Description of Artificial Sequence: Synthetic peptide
  Seed: HSYTTAEEA (MAR1_HUMAN)
HSYTTAEEM

SEQ ID NO: 115158 - protein, 9 aa, Artificial Sequence
  Description of Artificial Sequence: Synthetic peptide
  Seed: KSLHVGTQC (MAR1_HUMAN)
KSLHVGTQV

SEQ ID NO: 115159 - protein, 9 aa, Artificial Sequence
  Description of Artificial Sequence: Synthetic peptide
  Seed: RRRNGYRAL (MAR1_HUMAN)
RQRNGYRAH

SEQ ID NO: 115160 - protein, 9 aa, Artificial Sequence
  Description of Artificial Sequence: Synthetic peptide
  Seed: VVPNAPPAY (MAR1_HUMAN)
VQPNAPPAM

SEQ ID NO: 115161 - protein, 10 aa, Artificial Sequence
  Description of Artificial Sequence: Synthetic peptide
  Seed: RALMDKSLHV (MAR1_HUMAN)
RYLMDKSLHI

SEQ ID NO: 115162 - protein, 9 aa, Artificial Sequence
  Description of Artificial Sequence: Synthetic peptide
  Seed: VILGVLLLI (MAR1_HUMAN)
VSLGVLLLK

SEQ ID NO: 115163 - protein, 10 aa, Artificial Sequence
  Description of Artificial Sequence: Synthetic peptide
  Seed: EEAAGIGILT (MAR1_HUMAN)
ESAAGIGILA

SEQ ID NO: 115164 - protein, 9 aa, Artificial Sequence
  Description of Artificial Sequence: Synthetic peptide
  Seed: VILGVLLLI (MAR1_HUMAN)
VMLGVLLLT

SEQ ID NO: 115165 - protein, 9 aa, Artificial Sequence
  Description of Artificial Sequence: Synthetic peptide
  Seed: AAGIGILTV (MAR1_HUMAN)
ARGIGILTF

SEQ ID NO: 115166 - protein, 9 aa, Artificial Sequence
  Description of Artificial Sequence: Synthetic peptide
  Seed: GYPKKGHGH (MAR1_HUMAN)
GFPKKGHGM

SEQ ID NO: 115167 - protein, 10 aa, Artificial Sequence
  Description of Artificial Sequence: Synthetic peptide
  Seed: RRRNGYRALM (MAR1_HUMAN)
RQRNGYRALK

SEQ ID NO: 115168 - protein, 10 aa, Artificial Sequence
  Description of Artificial Sequence: Synthetic peptide
  Seed: RALMDKSLHV (MAR1_HUMAN)
RNLMDKSLHL

SEQ ID NO: 115169 - protein, 9 aa, Artificial Sequence
  Description of Artificial Sequence: Synthetic peptide
  Seed: EAAGIGILT (MAR1_HUMAN)
ETAGIGILM

SEQ ID NO: 115170 - protein, 9 aa, Artificial Sequence
  Description of Artificial Sequence: Synthetic peptide
  Seed: VILGVLLLI (MAR1_HUMAN)
VILGVLLLR

SEQ ID NO: 115171 - protein, 10 aa, Artificial Sequence
  Description of Artificial Sequence: Synthetic peptide
  Seed: REDAHFIYGY (MAR1_HUMAN)
REDAHFIYGL

SEQ ID NO: 115172 - protein, 10 aa, Artificial Sequence
  Description of Artificial Sequence: Synthetic peptide
  Seed: LLIGCWYCRR (MAR1_HUMAN)
LVIGCWYCRR

SEQ ID NO: 115173 - protein, 10 aa, Artificial Sequence
  Description of Artificial Sequence: Synthetic peptide
  Seed: RRRNGYRALM (MAR1_HUMAN)
RKRNGYRALY

SEQ ID NO: 115174 - protein, 11 aa, Artificial Sequence
  Description of Artificial Sequence: Synthetic peptide
  Seed: YRALMDKSLHV (MAR1_HUMAN)
YVALMDKSLHA

SEQ ID NO: 115175 - protein, 9 aa, Artificial Sequence
  Description of Artificial Sequence: Synthetic peptide
  Seed: AEEAAGIGI (MAR1_HUMAN)
AEEAAGIGW

SEQ ID NO: 115176 - protein, 10 aa, Artificial Sequence
  Description of Artificial Sequence: Synthetic peptide
  Seed: AHFIYGYPKK (MAR1_HUMAN)
AIFIYGYPKR

SEQ ID NO: 115177 - protein, 10 aa, Artificial Sequence
  Description of Artificial Sequence: Synthetic peptide
  Seed: ALMDKSLHVG (MAR1_HUMAN)
AMMDKSLHVI

SEQ ID NO: 115178 - protein, 11 aa, Artificial Sequence
  Description of Artificial Sequence: Synthetic peptide
  Seed: RALMDKSLHVG (MAR1_HUMAN)
RHLMDKSLHVV

SEQ ID NO: 115179 - protein, 9 aa, Artificial Sequence
  Description of Artificial Sequence: Synthetic peptide
  Seed: QEKNCEPVV (MAR1_HUMAN)
QEKNCEPVL

SEQ ID NO: 115180 - protein, 9 aa, Artificial Sequence
  Description of Artificial Sequence: Synthetic peptide
  Seed: MPREDAHFI (MAR1_HUMAN)
MAREDAHFY

SEQ ID NO: 115181 - protein, 10 aa, Artificial Sequence
  Description of Artificial Sequence: Synthetic peptide
  Seed: ALMDKSLHVG (MAR1_HUMAN)
AMMDKSLHVT

SEQ ID NO: 115182 - protein, 10 aa, Artificial Sequence
  Description of Artificial Sequence: Synthetic peptide
  Seed: YTTAEEAAGI (MAR1_HUMAN)
YNTAEEAAGI

SEQ ID NO: 115183 - protein, 9 aa, Artificial Sequence
  Description of Artificial Sequence: Synthetic peptide
  Seed: AGIGILTVI (MAR1_HUMAN)
AMIGILTVI

SEQ ID NO: 115184 - protein, 9 aa, Artificial Sequence
  Description of Artificial Sequence: Synthetic peptide
  Seed: REDAHFIYG (MAR1_HUMAN)
REDAHFIYP

SEQ ID NO: 115185 - protein, 9 aa, Artificial Sequence
  Description of Artificial Sequence: Synthetic peptide
  Seed: KSLHVGTQC (MAR1_HUMAN)
KTLHVGTQM

SEQ ID NO: 115186 - protein, 8 aa, Artificial Sequence
  Description of Artificial Sequence: Synthetic peptide
  Seed: LMDKSLHV (MAR1_HUMAN)
LYDKSLHF

SEQ ID NO: 115187 - protein, 9 aa, Artificial Sequence
  Description of Artificial Sequence: Synthetic peptide
  Seed: NAPPAYEKL (MAR1_HUMAN)
NTPPAYEKW

SEQ ID NO: 115188 - protein, 9 aa, Artificial Sequence
  Description of Artificial Sequence: Synthetic peptide
  Seed: VILGVLLLI (MAR1_HUMAN)
VTLGVLLLA

SEQ ID NO: 115189 - protein, 9 aa, Artificial Sequence
  Description of Artificial Sequence: Synthetic peptide
  Seed: AAGIGILTV (MAR1_HUMAN)
AQGIGILTI

SEQ ID NO: 115190 - protein, 9 aa, Artificial Sequence
  Description of Artificial Sequence: Synthetic peptide
  Seed: LIGCWYCRR (MAR1_HUMAN)
LLGCWYCRR

SEQ ID NO: 115191 - protein, 10 aa, Artificial Sequence
  Description of Artificial Sequence: Synthetic peptide
  Seed: RRRNGYRALM (MAR1_HUMAN)
RTRNGYRALK

SEQ ID NO: 115192 - protein, 9 aa, Artificial Sequence
  Description of Artificial Sequence: Synthetic peptide
  Seed: ALMDKSLHV (MAR1_HUMAN)
AFMDKSLHF

SEQ ID NO: 115193 - protein, 10 aa, Artificial Sequence
  Description of Artificial Sequence: Synthetic peptide
  Seed: YTTAEEAAGI (MAR1_HUMAN)
YDTAEEAAGV

SEQ ID NO: 115194 - protein, 9 aa, Artificial Sequence
  Description of Artificial Sequence: Synthetic peptide
  Seed: LLLIGCWYC (MAR1_HUMAN)
LLLIGCWYM

SEQ ID NO: 115195 - protein, 10 aa, Artificial Sequence
  Description of Artificial Sequence: Synthetic peptide
  Seed: LTRRCPQEGF (MAR1_HUMAN)
LTRRCPQEGW

SEQ ID NO: 115196 - protein, 9 aa, Artificial Sequence
  Description of Artificial Sequence: Synthetic peptide
  Seed: SAEQSPPPY (MAR1_HUMAN)
SAEQSPPPM

SEQ ID NO: 115197 - protein, 10 aa, Artificial Sequence
  Description of Artificial Sequence: Synthetic peptide
  Seed: APPAYEKLSA (MAR1_HUMAN)
AMPAYEKLSL

SEQ ID NO: 115198 - protein, 11 aa, Artificial Sequence
  Description of Artificial Sequence: Synthetic peptide
  Seed: YRALMDKSLHV (MAR1_HUMAN)
YDALMDKSLHV

SEQ ID NO: 115199 - protein, 10 aa, Artificial Sequence
  Description of Artificial Sequence: Synthetic peptide
  Seed: DAHFIYGYPK (MAR1_HUMAN)
DFHFIYGYPK

SEQ ID NO: 115200 - protein, 10 aa, Artificial Sequence
  Description of Artificial Sequence: Synthetic peptide
  Seed: RRRNGYRALM (MAR1_HUMAN)
RYRNGYRALK

SEQ ID NO: 115201 - protein, 10 aa, Artificial Sequence
  Description of Artificial Sequence: Synthetic peptide
  Seed: SLHVGTQCAL (MAR1_HUMAN)
SMHVGTQCAF

SEQ ID NO: 115202 - protein, 9 aa, Artificial Sequence
  Description of Artificial Sequence: Synthetic peptide
  Seed: EGFDHRDSK (MAR1_HUMAN)
EFFDHRDSK

SEQ ID NO: 115203 - protein, 10 aa, Artificial Sequence
  Description of Artificial Sequence: Synthetic peptide
  Seed: ALMDKSLHVG (MAR1_HUMAN)
AMMDKSLHVW

SEQ ID NO: 115204 - protein, 8 aa, Artificial Sequence
  Description of Artificial Sequence: Synthetic peptide
  Seed: HRDSKVSL (MAR1_HUMAN)
HWDSKVSL

SEQ ID NO: 115205 - protein, 8 aa, Artificial Sequence
  Description of Artificial Sequence: Synthetic peptide
  Seed: KKGHGHSY (MAR1_HUMAN)
KQGHGHSY

SEQ ID NO: 115206 - protein, 10 aa, Artificial Sequence
  Description of Artificial Sequence: Synthetic peptide
  Seed: EAAGIGILTV (MAR1_HUMAN)
ETAGIGILTR

SEQ ID NO: 115207 - protein, 9 aa, Artificial Sequence
  Description of Artificial Sequence: Synthetic peptide
  Seed: RRNGYRALM (MAR1_HUMAN)
RHNGYRALY

SEQ ID NO: 115208 - protein, 8 aa, Artificial Sequence
  Description of Artificial Sequence: Synthetic peptide
  Seed: VPNAPPAY (MAR1_HUMAN)
VANAPPAF

SEQ ID NO: 115209 - protein, 9 aa, Artificial Sequence
  Description of Artificial Sequence: Synthetic peptide
  Seed: ALMDKSLHV (MAR1_HUMAN)
AYMDKSLHL

SEQ ID NO: 115210 - protein, 8 aa, Artificial Sequence
  Description of Artificial Sequence: Synthetic peptide
  Seed: VPNAPPAY (MAR1_HUMAN)
VSNAPPAL

SEQ ID NO: 115211 - protein, 9 aa, Artificial Sequence
  Description of Artificial Sequence: Synthetic peptide
  Seed: HFIYGYPKK (MAR1_HUMAN)
HTIYGYPKR

SEQ ID NO: 115212 - protein, 9 aa, Artificial Sequence
  Description of Artificial Sequence: Synthetic peptide
  Seed: NAPPAYEKL (MAR1_HUMAN)
NAPPAYEKV

SEQ ID NO: 115213 - protein, 10 aa, Artificial Sequence
  Description of Artificial Sequence: Synthetic peptide
  Seed: LLLIGCWYCR (MAR1_HUMAN)
LILIGCWYCR

SEQ ID NO: 115214 - protein, 11 aa, Artificial Sequence
  Description of Artificial Sequence: Synthetic peptide
  Seed: ALMDKSLHVGT (MAR1_HUMAN)
AYMDKSLHVGV

SEQ ID NO: 115215 - protein, 10 aa, Artificial Sequence
  Description of Artificial Sequence: Synthetic peptide
  Seed: RRRNGYRALM (MAR1_HUMAN)
RVRNGYRALY

SEQ ID NO: 115216 - protein, 10 aa, Artificial Sequence
  Description of Artificial Sequence: Synthetic peptide
  Seed: RALMDKSLHV (MAR1_HUMAN)
RGLMDKSLHL

SEQ ID NO: 115217 - protein, 10 aa, Artificial Sequence
  Description of Artificial Sequence: Synthetic peptide
  Seed: ALMDKSLHVG (MAR1_HUMAN)
AEMDKSLHVV

SEQ ID NO: 115218 - protein, 10 aa, Artificial Sequence
  Description of Artificial Sequence: Synthetic peptide
  Seed: YPKKGHGHSY (MAR1_HUMAN)
YKKKGHGHSY

SEQ ID NO: 115219 - protein, 10 aa, Artificial Sequence
  Description of Artificial Sequence: Synthetic peptide
  Seed: EAAGIGILTV (MAR1_HUMAN)
ETAGIGILTA

SEQ ID NO: 115220 - protein, 10 aa, Artificial Sequence
  Description of Artificial Sequence: Synthetic peptide
  Seed: AHFIYGYPKK (MAR1_HUMAN)
ALFIYGYPKR

SEQ ID NO: 115221 - protein, 9 aa, Artificial Sequence
  Description of Artificial Sequence: Synthetic peptide
  Seed: KSLHVGTQC (MAR1_HUMAN)
KCLHVGTQW

SEQ ID NO: 115222 - protein, 9 aa, Artificial Sequence
  Description of Artificial Sequence: Synthetic peptide
  Seed: EAAGIGILT (MAR1_HUMAN)
ETAGIGILI

SEQ ID NO: 115223 - protein, 9 aa, Artificial Sequence
  Description of Artificial Sequence: Synthetic peptide
  Seed: EDAHFIYGY (MAR1_HUMAN)
EIAHFIYGY

SEQ ID NO: 115224 - protein, 11 aa, Artificial Sequence
  Description of Artificial Sequence: Synthetic peptide
  Seed: RALMDKSLHVG (MAR1_HUMAN)
RFLMDKSLHVM

SEQ ID NO: 115225 - protein, 10 aa, Artificial Sequence
  Description of Artificial Sequence: Synthetic peptide
  Seed: LSAEQSPPPY (MAR1_HUMAN)
LQAEQSPPPF

SEQ ID NO: 115226 - protein, 9 aa, Artificial Sequence
  Description of Artificial Sequence: Synthetic peptide
  Seed: DHRDSKVSL (MAR1_HUMAN)
DLRDSKVSL

SEQ ID NO: 115227 - protein, 9 aa, Artificial Sequence
  Description of Artificial Sequence: Synthetic peptide
  Seed: AGIGILTVI (MAR1_HUMAN)
AGIGILTVY

SEQ ID NO: 115228 - protein, 10 aa, Artificial Sequence
  Description of Artificial Sequence: Synthetic peptide
  Seed: IGILTVILGV (MAR1_HUMAN)
IFILTVILGV

SEQ ID NO: 115229 - protein, 10 aa, Artificial Sequence
  Description of Artificial Sequence: Synthetic peptide
  Seed: EEAAGIGILT (MAR1_HUMAN)
EWAAGIGILI

SEQ ID NO: 115230 - protein, 9 aa, Artificial Sequence
  Description of Artificial Sequence: Synthetic peptide
  Seed: AEQSPPPYS (MAR1_HUMAN)
AEQSPPPYL

SEQ ID NO: 115231 - protein, 9 aa, Artificial Sequence
  Description of Artificial Sequence: Synthetic peptide
  Seed: YEKLSAEQS (MAR1_HUMAN)
YEKLSAEQF

SEQ ID NO: 115232 - protein, 9 aa, Artificial Sequence
  Description of Artificial Sequence: Synthetic peptide
  Seed: VVPNAPPAY (MAR1_HUMAN)
VTPNAPPAV

SEQ ID NO: 115233 - protein, 10 aa, Artificial Sequence
  Description of Artificial Sequence: Synthetic peptide
  Seed: KGHGHSYTTA (MAR1_HUMAN)
KVHGHSYTTA

SEQ ID NO: 115234 - protein, 9 aa, Artificial Sequence
  Description of Artificial Sequence: Synthetic peptide
  Seed: HFIYGYPKK (MAR1_HUMAN)
HTIYGYPKK

SEQ ID NO: 115235 - protein, 9 aa, Artificial Sequence
  Description of Artificial Sequence: Synthetic peptide
  Seed: KSLHVGTQC (MAR1_HUMAN)
KSLHVGTQY

SEQ ID NO: 115236 - protein, 9 aa, Artificial Sequence
  Description of Artificial Sequence: Synthetic peptide
  Seed: ALMDKSLHV (MAR1_HUMAN)
AQMDKSLHF

SEQ ID NO: 115237 - protein, 9 aa, Artificial Sequence
  Description of Artificial Sequence: Synthetic peptide
  Seed: GILTVILGV (MAR1_HUMAN)
GILTVILGI

SEQ ID NO: 115238 - protein, 9 aa, Artificial Sequence
  Description of Artificial Sequence: Synthetic peptide
  Seed: AGIGILTVI (MAR1_HUMAN)
AIIGILTVL

SEQ ID NO: 115239 - protein, 10 aa, Artificial Sequence
  Description of Artificial Sequence: Synthetic peptide
  Seed: GILTVILGVL (MAR1_HUMAN)
GQLTVILGVV

SEQ ID NO: 115240 - protein, 11 aa, Artificial Sequence
  Description of Artificial Sequence: Synthetic peptide
  Seed: RALMDKSLHVG (MAR1_HUMAN)
RKLMDKSLHVI

SEQ ID NO: 115241 - protein, 9 aa, Artificial Sequence
  Description of Artificial Sequence: Synthetic peptide
  Seed: VVPNAPPAY (MAR1_HUMAN)
VFPNAPPAI

SEQ ID NO: 115242 - protein, 9 aa, Artificial Sequence
  Description of Artificial Sequence: Synthetic peptide
  Seed: EGFDHRDSK (MAR1_HUMAN)
ESFDHRDSR

SEQ ID NO: 115243 - protein, 9 aa, Artificial Sequence
  Description of Artificial Sequence: Synthetic peptide
  Seed: VILGVLLLI (MAR1_HUMAN)
VLLGVLLLF

SEQ ID NO: 115244 - protein, 11 aa, Artificial Sequence
  Description of Artificial Sequence: Synthetic peptide
  Seed: YCRRRNGYRAL (MAR1_HUMAN)
YLRRRNGYRAM

SEQ ID NO: 115245 - protein, 9 aa, Artificial Sequence
  Description of Artificial Sequence: Synthetic peptide
  Seed: LLIGCWYCR (MAR1_HUMAN)
LFIGCWYCK

SEQ ID NO: 115246 - protein, 9 aa, Artificial Sequence
  Description of Artificial Sequence: Synthetic peptide
  Seed: REDAHFIYG (MAR1_HUMAN)
REDAHFIYI

SEQ ID NO: 115247 - protein, 8 aa, Artificial Sequence
  Description of Artificial Sequence: Synthetic peptide
  Seed: LMDKSLHV (MAR1_HUMAN)
LYDKSLHL

SEQ ID NO: 115248 - protein, 11 aa, Artificial Sequence
  Description of Artificial Sequence: Synthetic peptide
  Seed: RALMDKSLHVG (MAR1_HUMAN)
RSLMDKSLHVV

SEQ ID NO: 115249 - protein, 10 aa, Artificial Sequence
  Description of Artificial Sequence: Synthetic peptide
  Seed: LLIGCWYCRR (MAR1_HUMAN)
LTIGCWYCRK

SEQ ID NO: 115250 - protein, 9 aa, Artificial Sequence
  Description of Artificial Sequence: Synthetic peptide
  Seed: EDAHFIYGY (MAR1_HUMAN)
ETAHFIYGV

SEQ ID NO: 115251 - protein, 9 aa, Artificial Sequence
  Description of Artificial Sequence: Synthetic peptide
  Seed: GFDHRDSKV (MAR1_HUMAN)
GFDHRDSKF

SEQ ID NO: 115252 - protein, 11 aa, Artificial Sequence
  Description of Artificial Sequence: Synthetic peptide
  Seed: YRALMDKSLHV (MAR1_HUMAN)
YDALMDKSLHA

SEQ ID NO: 115253 - protein, 10 aa, Artificial Sequence
  Description of Artificial Sequence: Synthetic peptide
  Seed: RALMDKSLHV (MAR1_HUMAN)
RNLMDKSLHI

SEQ ID NO: 115254 - protein, 9 aa, Artificial Sequence
  Description of Artificial Sequence: Synthetic peptide
  Seed: DSKVSLQEK (MAR1_HUMAN)
DYKVSLQER

SEQ ID NO: 115255 - protein, 9 aa, Artificial Sequence
  Description of Artificial Sequence: Synthetic peptide
  Seed: HSYTTAEEA (MAR1_HUMAN)
HQYTTAEEY

SEQ ID NO: 115256 - protein, 10 aa, Artificial Sequence
  Description of Artificial Sequence: Synthetic peptide
  Seed: RDSKVSLQEK (MAR1_HUMAN)
RMSKVSLQEA

SEQ ID NO: 115257 - protein, 11 aa, Artificial Sequence
  Description of Artificial Sequence: Synthetic peptide
  Seed: YRALMDKSLHV (MAR1_HUMAN)
YGALMDKSLHA

SEQ ID NO: 115258 - protein, 10 aa, Artificial Sequence
  Description of Artificial Sequence: Synthetic peptide
  Seed: RALMDKSLHV (MAR1_HUMAN)
RWLMDKSLHV

SEQ ID NO: 115259 - protein, 10 aa, Artificial Sequence
  Description of Artificial Sequence: Synthetic peptide
  Seed: AHFIYGYPKK (MAR1_HUMAN)
AYFIYGYPKK

SEQ ID NO: 115260 - protein, 9 aa, Artificial Sequence
  Description of Artificial Sequence: Synthetic peptide
  Seed: AGIGILTVI (MAR1_HUMAN)
AQIGILTVL

SEQ ID NO: 115261 - protein, 10 aa, Artificial Sequence
  Description of Artificial Sequence: Synthetic peptide
  Seed: YTTAEEAAGI (MAR1_HUMAN)
YMTAEEAAGA

SEQ ID NO: 115262 - protein, 9 aa, Artificial Sequence
  Description of Artificial Sequence: Synthetic peptide
  Seed: GFDHRDSKV (MAR1_HUMAN)
GADHRDSKV

SEQ ID NO: 115263 - protein, 9 aa, Artificial Sequence
  Description of Artificial Sequence: Synthetic peptide
  Seed: DSKVSLQEK (MAR1_HUMAN)
DVKVSLQEK

SEQ ID NO: 115264 - protein, 10 aa, Artificial Sequence
  Description of Artificial Sequence: Synthetic peptide
  Seed: KGHGHSYTTA (MAR1_HUMAN)
KQHGHSYTTK

SEQ ID NO: 115265 - protein, 9 aa, Artificial Sequence
  Description of Artificial Sequence: Synthetic peptide
  Seed: VVPNAPPAY (MAR1_HUMAN)
VPPNAPPAF

SEQ ID NO: 115266 - protein, 10 aa, Artificial Sequence
  Description of Artificial Sequence: Synthetic peptide
  Seed: YPKKGHGHSY (MAR1_HUMAN)
YSKKGHGHSM

SEQ ID NO: 115267 - protein, 10 aa, Artificial Sequence
  Description of Artificial Sequence: Synthetic peptide
  Seed: ALMDKSLHVG (MAR1_HUMAN)
AMMDKSLHVM

SEQ ID NO: 115268 - protein, 11 aa, Artificial Sequence
  Description of Artificial Sequence: Synthetic peptide
  Seed: YCRRRNGYRAL (MAR1_HUMAN)
YLRRRNGYRAI

SEQ ID NO: 115269 - protein, 9 aa, Artificial Sequence
  Description of Artificial Sequence: Synthetic peptide
  Seed: YPKKGHGHS (MAR1_HUMAN)
YPKKGHGHM

SEQ ID NO: 115270 - protein, 10 aa, Artificial Sequence
  Description of Artificial Sequence: Synthetic peptide
  Seed: LLIGCWYCRR (MAR1_HUMAN)
LFIGCWYCRR

SEQ ID NO: 115271 - protein, 9 aa, Artificial Sequence
  Description of Artificial Sequence: Synthetic peptide
  Seed: GILTVILGV (MAR1_HUMAN)
GVLTVILGA

SEQ ID NO: 115272 - protein, 10 aa, Artificial Sequence
  Description of Artificial Sequence: Synthetic peptide
  Seed: RDSKVSLQEK (MAR1_HUMAN)
RTSKVSLQEK

SEQ ID NO: 115273 - protein, 11 aa, Artificial Sequence
  Description of Artificial Sequence: Synthetic peptide
  Seed: YRALMDKSLHV (MAR1_HUMAN)
YTALMDKSLHL

SEQ ID NO: 115274 - protein, 11 aa, Artificial Sequence
  Description of Artificial Sequence: Synthetic peptide
  Seed: YRALMDKSLHV (MAR1_HUMAN)
YNALMDKSLHA

SEQ ID NO: 115275 - protein, 9 aa, Artificial Sequence
  Description of Artificial Sequence: Synthetic peptide
  Seed: ALMDKSLHV (MAR1_HUMAN)
ASMDKSLHY

SEQ ID NO: 115276 - protein, 9 aa, Artificial Sequence
  Description of Artificial Sequence: Synthetic peptide
  Seed: AGIGILTVI (MAR1_HUMAN)
AVIGILTVM

SEQ ID NO: 115277 - protein, 9 aa, Artificial Sequence
  Description of Artificial Sequence: Synthetic peptide
  Seed: AGIGILTVI (MAR1_HUMAN)
ARIGILTVM

SEQ ID NO: 115278 - protein, 9 aa, Artificial Sequence
  Description of Artificial Sequence: Synthetic peptide
  Seed: LHVGTQCAL (MAR1_HUMAN)
LHVGTQCAA

SEQ ID NO: 115279 - protein, 9 aa, Artificial Sequence
  Description of Artificial Sequence: Synthetic peptide
  Seed: LLLIGCWYC (MAR1_HUMAN)
LVLIGCWYL

SEQ ID NO: 115280 - protein, 9 aa, Artificial Sequence
  Description of Artificial Sequence: Synthetic peptide
  Seed: YRALMDKSL (MAR1_HUMAN)
YKALMDKSF

SEQ ID NO: 115281 - protein, 11 aa, Artificial Sequence
  Description of Artificial Sequence: Synthetic peptide
  Seed: YRALMDKSLHV (MAR1_HUMAN)
YRALMDKSLHI

SEQ ID NO: 115282 - protein, 9 aa, Artificial Sequence
  Description of Artificial Sequence: Synthetic peptide
  Seed: RRNGYRALM (MAR1_HUMAN)
RFNGYRALY

SEQ ID NO: 115283 - protein, 10 aa, Artificial Sequence
  Description of Artificial Sequence: Synthetic peptide
  Seed: RALMDKSLHV (MAR1_HUMAN)
RELMDKSLHA

SEQ ID NO: 115284 - protein, 11 aa, Artificial Sequence
  Description of Artificial Sequence: Synthetic peptide
  Seed: TTAEEAAGIGI (MAR1_HUMAN)
TVAEEAAGIGW

SEQ ID NO: 115285 - protein, 10 aa, Artificial Sequence
  Description of Artificial Sequence: Synthetic peptide
  Seed: RRRNGYRALM (MAR1_HUMAN)
RIRNGYRALM

SEQ ID NO: 115286 - protein, 11 aa, Artificial Sequence
  Description of Artificial Sequence: Synthetic peptide
  Seed: YRALMDKSLHV (MAR1_HUMAN)
YSALMDKSLHA

SEQ ID NO: 115287 - protein, 9 aa, Artificial Sequence
  Description of Artificial Sequence: Synthetic peptide
  Seed: RRRNGYRAL (MAR1_HUMAN)
RMRNGYRAM

SEQ ID NO: 115288 - protein, 10 aa, Artificial Sequence
  Description of Artificial Sequence: Synthetic peptide
  Seed: YPKKGHGHSY (MAR1_HUMAN)
YHKKGHGHSY

SEQ ID NO: 115289 - protein, 9 aa, Artificial Sequence
  Description of Artificial Sequence: Synthetic peptide
  Seed: VGTQCALTR (MAR1_HUMAN)
VATQCALTL

SEQ ID NO: 115290 - protein, 11 aa, Artificial Sequence
  Description of Artificial Sequence: Synthetic peptide
  Seed: CWYCRRRNGYR (MAR1_HUMAN)
CFYCRRRNGYR

SEQ ID NO: 115291 - protein, 9 aa, Artificial Sequence
  Description of Artificial Sequence: Synthetic peptide
  Seed: QEKNCEPVV (MAR1_HUMAN)
QEKNCEPVM

SEQ ID NO: 115292 - protein, 9 aa, Artificial Sequence
  Description of Artificial Sequence: Synthetic peptide
  Seed: GFDHRDSKV (MAR1_HUMAN)
GLDHRDSKL

SEQ ID NO: 115293 - protein, 10 aa, Artificial Sequence
  Description of Artificial Sequence: Synthetic peptide
  Seed: EEAAGIGILT (MAR1_HUMAN)
EAAAGIGILL

SEQ ID NO: 115294 - protein, 11 aa, Artificial Sequence
  Description of Artificial Sequence: Synthetic peptide
  Seed: YRALMDKSLHV (MAR1_HUMAN)
YCALMDKSLHA

SEQ ID NO: 115295 - protein, 9 aa, Artificial Sequence
  Description of Artificial Sequence: Synthetic peptide
  Seed: LLLIGCWYC (MAR1_HUMAN)
LMLIGCWYA

SEQ ID NO: 115296 - protein, 8 aa, Artificial Sequence
  Description of Artificial Sequence: Synthetic peptide
  Seed: HRDSKVSL (MAR1_HUMAN)
HFDSKVSL

SEQ ID NO: 115297 - protein, 8 aa, Artificial Sequence
  Description of Artificial Sequence: Synthetic peptide
  Seed: VPNAPPAY (MAR1_HUMAN)
VANAPPAM

SEQ ID NO: 115298 - protein, 11 aa, Artificial Sequence
  Description of Artificial Sequence: Synthetic peptide
  Seed: TTAEEAAGIGI (MAR1_HUMAN)
TMAEEAAGIGL

SEQ ID NO: 115299 - protein, 11 aa, Artificial Sequence
  Description of Artificial Sequence: Synthetic peptide
  Seed: YRALMDKSLHV (MAR1_HUMAN)
YGALMDKSLHL

SEQ ID NO: 115300 - protein, 10 aa, Artificial Sequence
  Description of Artificial Sequence: Synthetic peptide
  Seed: EAAGIGILTV (MAR1_HUMAN)
ESAGIGILTV

SEQ ID NO: 115301 - protein, 9 aa, Artificial Sequence
  Description of Artificial Sequence: Synthetic peptide
  Seed: AEEAAGIGI (MAR1_HUMAN)
AEEAAGIGV

SEQ ID NO: 115302 - protein, 10 aa, Artificial Sequence
  Description of Artificial Sequence: Synthetic peptide
  Seed: YTTAEEAAGI (MAR1_HUMAN)
YVTAEEAAGI

SEQ ID NO: 115303 - protein, 10 aa, Artificial Sequence
  Description of Artificial Sequence: Synthetic peptide
  Seed: TVILGVLLLI (MAR1_HUMAN)
TLILGVLLLV

SEQ ID NO: 115304 - protein, 9 aa, Artificial Sequence
  Description of Artificial Sequence: Synthetic peptide
  Seed: AAGIGILTV (MAR1_HUMAN)
AMGIGILTA

SEQ ID NO: 115305 - protein, 8 aa, Artificial Sequence
  Description of Artificial Sequence: Synthetic peptide
  Seed: LMDKSLHV (MAR1_HUMAN)
LFDKSLHM

SEQ ID NO: 115306 - protein, 11 aa, Artificial Sequence
  Description of Artificial Sequence: Synthetic peptide
  Seed: YRALMDKSLHV (MAR1_HUMAN)
YAALMDKSLHA

SEQ ID NO: 115307 - protein, 9 aa, Artificial Sequence
  Description of Artificial Sequence: Synthetic peptide
  Seed: HSYTTAEEA (MAR1_HUMAN)
HQYTTAEEV

SEQ ID NO: 115308 - protein, 9 aa, Artificial Sequence
  Description of Artificial Sequence: Synthetic peptide
  Seed: LLIGCWYCR (MAR1_HUMAN)
LWIGCWYCK

SEQ ID NO: 115309 - protein, 9 aa, Artificial Sequence
  Description of Artificial Sequence: Synthetic peptide
  Seed: VILGVLLLI (MAR1_HUMAN)
VMLGVLLLA

SEQ ID NO: 115310 - protein, 9 aa, Artificial Sequence
  Description of Artificial Sequence: Synthetic peptide
  Seed: AHFIYGYPK (MAR1_HUMAN)
AIFIYGYPR

SEQ ID NO: 115311 - protein, 11 aa, Artificial Sequence
  Description of Artificial Sequence: Synthetic peptide
  Seed: YRALMDKSLHV (MAR1_HUMAN)
YQALMDKSLHI

SEQ ID NO: 115312 - protein, 9 aa, Artificial Sequence
  Description of Artificial Sequence: Synthetic peptide
  Seed: GILTVILGV (MAR1_HUMAN)
GVLTVILGI

SEQ ID NO: 115313 - protein, 10 aa, Artificial Sequence
  Description of Artificial Sequence: Synthetic peptide
  Seed: KGHGHSYTTA (MAR1_HUMAN)
KSHGHSYTTV

SEQ ID NO: 115314 - protein, 10 aa, Artificial Sequence
  Description of Artificial Sequence: Synthetic peptide
  Seed: RRRNGYRALM (MAR1_HUMAN)
RTRNGYRALL

SEQ ID NO: 115315 - protein, 9 aa, Artificial Sequence
  Description of Artificial Sequence: Synthetic peptide
  Seed: KSLHVGTQC (MAR1_HUMAN)
KTLHVGTQI

SEQ ID NO: 115316 - protein, 9 aa, Artificial Sequence
  Description of Artificial Sequence: Synthetic peptide
  Seed: TVILGVLLL (MAR1_HUMAN)
TSILGVLLF

SEQ ID NO: 115317 - protein, 9 aa, Artificial Sequence
  Description of Artificial Sequence: Synthetic peptide
  Seed: VILGVLLLI (MAR1_HUMAN)
VTLGVLLLL

SEQ ID NO: 115318 - protein, 10 aa, Artificial Sequence
  Description of Artificial Sequence: Synthetic peptide
  Seed: RDSKVSLQEK (MAR1_HUMAN)
RNSKVSLQEK

SEQ ID NO: 115319 - protein, 10 aa, Artificial Sequence
  Description of Artificial Sequence: Synthetic peptide
  Seed: RRRNGYRALM (MAR1_HUMAN)
RNRNGYRALK

SEQ ID NO: 115320 - protein, 10 aa, Artificial Sequence
  Description of Artificial Sequence: Synthetic peptide
  Seed: YTTAEEAAGI (MAR1_HUMAN)
YWTAEEAAGI

SEQ ID NO: 115321 - protein, 10 aa, Artificial Sequence
  Description of Artificial Sequence: Synthetic peptide
  Seed: RALMDKSLHV (MAR1_HUMAN)
RCLMDKSLHA

SEQ ID NO: 115322 - protein, 10 aa, Artificial Sequence
  Description of Artificial Sequence: Synthetic peptide
  Seed: ALMDKSLHVG (MAR1_HUMAN)
AVMDKSLHVA

SEQ ID NO: 115323 - protein, 9 aa, Artificial Sequence
  Description of Artificial Sequence: Synthetic peptide
  Seed: GFDHRDSKV (MAR1_HUMAN)
GIDHRDSKL

SEQ ID NO: 115324 - protein, 9 aa, Artificial Sequence
  Description of Artificial Sequence: Synthetic peptide
  Seed: HSYTTAEEA (MAR1_HUMAN)
HPYTTAEEM

SEQ ID NO: 115325 - protein, 9 aa, Artificial Sequence
  Description of Artificial Sequence: Synthetic peptide
  Seed: VVPNAPPAY (MAR1_HUMAN)
VVPNAPPAV

SEQ ID NO: 115326 - protein, 10 aa, Artificial Sequence
  Description of Artificial Sequence: Synthetic peptide
  Seed: RALMDKSLHV (MAR1_HUMAN)
RRLMDKSLHL

SEQ ID NO: 115327 - protein, 11 aa, Artificial Sequence
  Description of Artificial Sequence: Synthetic peptide
  Seed: YRALMDKSLHV (MAR1_HUMAN)
YYALMDKSLHM

SEQ ID NO: 115328 - protein, 8 aa, Artificial Sequence
  Description of Artificial Sequence: Synthetic peptide
  Seed: LMDKSLHV (MAR1_HUMAN)
LTDKSLHM

SEQ ID NO: 115329 - protein, 10 aa, Artificial Sequence
  Description of Artificial Sequence: Synthetic peptide
  Seed: RALMDKSLHV (MAR1_HUMAN)
RKLMDKSLHA

SEQ ID NO: 115330 - protein, 11 aa, Artificial Sequence
  Description of Artificial Sequence: Synthetic peptide
  Seed: ALMDKSLHVGT (MAR1_HUMAN)
AMMDKSLHVGM

SEQ ID NO: 115331 - protein, 10 aa, Artificial Sequence
  Description of Artificial Sequence: Synthetic peptide
  Seed: IGILTVILGV (MAR1_HUMAN)
ISILTVILGV

SEQ ID NO: 115332 - protein, 10 aa, Artificial Sequence
  Description of Artificial Sequence: Synthetic peptide
  Seed: RRNGYRALMD (MAR1_HUMAN)
RRNGYRALMV

SEQ ID NO: 115333 - protein, 11 aa, Artificial Sequence
  Description of Artificial Sequence: Synthetic peptide
  Seed: MPREDAHFIYG (MAR1_HUMAN)
MPREDAHFIYM

SEQ ID NO: 115334 - protein, 9 aa, Artificial Sequence
  Description of Artificial Sequence: Synthetic peptide
  Seed: GILTVILGV (MAR1_HUMAN)
GVLTVILGV

SEQ ID NO: 115335 - protein, 9 aa, Artificial Sequence
  Description of Artificial Sequence: Synthetic peptide
  Seed: VILGVLLLI (MAR1_HUMAN)
VSLGVLLLF

SEQ ID NO: 115336 - protein, 9 aa, Artificial Sequence
  Description of Artificial Sequence: Synthetic peptide
  Seed: AAGIGILTV (MAR1_HUMAN)
ASGIGILTY

SEQ ID NO: 115337 - protein, 10 aa, Artificial Sequence
  Description of Artificial Sequence: Synthetic peptide
  Seed: EEAAGIGILT (MAR1_HUMAN)
EFAAGIGILV

SEQ ID NO: 115338 - protein, 10 aa, Artificial Sequence
  Description of Artificial Sequence: Synthetic peptide
  Seed: DAHFIYGYPK (MAR1_HUMAN)
DNHFIYGYPR

SEQ ID NO: 115339 - protein, 10 aa, Artificial Sequence
  Description of Artificial Sequence: Synthetic peptide
  Seed: RRRNGYRALM (MAR1_HUMAN)
RWRNGYRALL

SEQ ID NO: 115340 - protein, 9 aa, Artificial Sequence
  Description of Artificial Sequence: Synthetic peptide
  Seed: YRALMDKSL (MAR1_HUMAN)
YHALMDKSY

SEQ ID NO: 115341 - protein, 9 aa, Artificial Sequence
  Description of Artificial Sequence: Synthetic peptide
  Seed: LHVGTQCAL (MAR1_HUMAN)
LSVGTQCAY

SEQ ID NO: 115342 - protein, 9 aa, Artificial Sequence
  Description of Artificial Sequence: Synthetic peptide
  Seed: EAAGIGILT (MAR1_HUMAN)
EAAGIGILV

SEQ ID NO: 115343 - protein, 11 aa, Artificial Sequence
  Description of Artificial Sequence: Synthetic peptide
  Seed: KSLHVGTQCAL (MAR1_HUMAN)
KTLHVGTQCAW

SEQ ID NO: 115344 - protein, 9 aa, Artificial Sequence
  Description of Artificial Sequence: Synthetic peptide
  Seed: NAPPAYEKL (MAR1_HUMAN)
NFPPAYEKL

SEQ ID NO: 115345 - protein, 10 aa, Artificial Sequence
  Description of Artificial Sequence: Synthetic peptide
  Seed: SLQEKNCEPV (MAR1_HUMAN)
SMQEKNCEPV

SEQ ID NO: 115346 - protein, 10 aa, Artificial Sequence
  Description of Artificial Sequence: Synthetic peptide
  Seed: ALMDKSLHVG (MAR1_HUMAN)
AMMDKSLHVQ

SEQ ID NO: 115347 - protein, 9 aa, Artificial Sequence
  Description of Artificial Sequence: Synthetic peptide
  Seed: HSYTTAEEA (MAR1_HUMAN)
HTYTTAEEF

SEQ ID NO: 115348 - protein, 10 aa, Artificial Sequence
  Description of Artificial Sequence: Synthetic peptide
  Seed: EAAGIGILTV (MAR1_HUMAN)
EVAGIGILTA

SEQ ID NO: 115349 - protein, 9 aa, Artificial Sequence
  Description of Artificial Sequence: Synthetic peptide
  Seed: ALMDKSLHV (MAR1_HUMAN)
AIMDKSLHA

SEQ ID NO: 115350 - protein, 10 aa, Artificial Sequence
  Description of Artificial Sequence: Synthetic peptide
  Seed: SLHVGTQCAL (MAR1_HUMAN)
SLHVGTQCAF

SEQ ID NO: 115351 - protein, 10 aa, Artificial Sequence
  Description of Artificial Sequence: Synthetic peptide
  Seed: RALMDKSLHV (MAR1_HUMAN)
RMLMDKSLHL

SEQ ID NO: 115352 - protein, 9 aa, Artificial Sequence
  Description of Artificial Sequence: Synthetic peptide
  Seed: NAPPAYEKL (MAR1_HUMAN)
NFPPAYEKF

SEQ ID NO: 115353 - protein, 9 aa, Artificial Sequence
  Description of Artificial Sequence: Synthetic peptide
  Seed: KSLHVGTQC (MAR1_HUMAN)
KILHVGTQW

SEQ ID NO: 115354 - protein, 11 aa, Artificial Sequence
  Description of Artificial Sequence: Synthetic peptide
  Seed: RRCPQEGFDHR (MAR1_HUMAN)
RRCPQEGFDHF

SEQ ID NO: 115355 - protein, 9 aa, Artificial Sequence
  Description of Artificial Sequence: Synthetic peptide
  Seed: RRNGYRALM (MAR1_HUMAN)
RYNGYRALF

SEQ ID NO: 115356 - protein, 10 aa, Artificial Sequence
  Description of Artificial Sequence: Synthetic peptide
  Seed: RALMDKSLHV (MAR1_HUMAN)
RHLMDKSLHA

SEQ ID NO: 115357 - protein, 9 aa, Artificial Sequence
  Description of Artificial Sequence: Synthetic peptide
  Seed: ALMDKSLHV (MAR1_HUMAN)
ALMDKSLHC

SEQ ID NO: 115358 - protein, 10 aa, Artificial Sequence
  Description of Artificial Sequence: Synthetic peptide
  Seed: EEAAGIGILT (MAR1_HUMAN)
ETAAGIGILI

SEQ ID NO: 115359 - protein, 8 aa, Artificial Sequence
  Description of Artificial Sequence: Synthetic peptide
  Seed: KKGHGHSY (MAR1_HUMAN)
KQGHGHSF

SEQ ID NO: 115360 - protein, 10 aa, Artificial Sequence
  Description of Artificial Sequence: Synthetic peptide
  Seed: RRRNGYRALM (MAR1_HUMAN)
RERNGYRALM

SEQ ID NO: 115361 - protein, 9 aa, Artificial Sequence
  Description of Artificial Sequence: Synthetic peptide
  Seed: ALMDKSLHV (MAR1_HUMAN)
AWMDKSLHY

SEQ ID NO: 115362 - protein, 10 aa, Artificial Sequence
  Description of Artificial Sequence: Synthetic peptide
  Seed: KGHGHSYTTA (MAR1_HUMAN)
KYHGHSYTTK

SEQ ID NO: 115363 - protein, 10 aa, Artificial Sequence
  Description of Artificial Sequence: Synthetic peptide
  Seed: RALMDKSLHV (MAR1_HUMAN)
RFLMDKSLHI

SEQ ID NO: 115364 - protein, 9 aa, Artificial Sequence
  Description of Artificial Sequence: Synthetic peptide
  Seed: VVPNAPPAY (MAR1_HUMAN)
VSPNAPPAY

SEQ ID NO: 115365 - protein, 9 aa, Artificial Sequence
  Description of Artificial Sequence: Synthetic peptide
  Seed: HSYTTAEEA (MAR1_HUMAN)
HHYTTAEEL

SEQ ID NO: 115366 - protein, 9 aa, Artificial Sequence
  Description of Artificial Sequence: Synthetic peptide
  Seed: LLLIGCWYC (MAR1_HUMAN)
LLLIGCWYA

SEQ ID NO: 115367 - protein, 9 aa, Artificial Sequence
  Description of Artificial Sequence: Synthetic peptide
  Seed: EQSPPPYSP (MAR1_HUMAN)
EHSPPPYSV

SEQ ID NO: 115368 - protein, 10 aa, Artificial Sequence
  Description of Artificial Sequence: Synthetic peptide
  Seed: ALMDKSLHVG (MAR1_HUMAN)
AMMDKSLHVL

SEQ ID NO: 115369 - protein, 9 aa, Artificial Sequence
  Description of Artificial Sequence: Synthetic peptide
  Seed: ALMDKSLHV (MAR1_HUMAN)
AAMDKSLHI

SEQ ID NO: 115370 - protein, 11 aa, Artificial Sequence
  Description of Artificial Sequence: Synthetic peptide
  Seed: RALMDKSLHVG (MAR1_HUMAN)
RYLMDKSLHVA

SEQ ID NO: 115371 - protein, 9 aa, Artificial Sequence
  Description of Artificial Sequence: Synthetic peptide
  Seed: RRNGYRALM (MAR1_HUMAN)
RVNGYRALY

SEQ ID NO: 115372 - protein, 9 aa, Artificial Sequence
  Description of Artificial Sequence: Synthetic peptide
  Seed: VILGVLLLI (MAR1_HUMAN)
VLLGVLLLA

SEQ ID NO: 115373 - protein, 10 aa, Artificial Sequence
  Description of Artificial Sequence: Synthetic peptide
  Seed: MPREDAHFIY (MAR1_HUMAN)
MAREDAHFIF

SEQ ID NO: 115374 - protein, 11 aa, Artificial Sequence
  Description of Artificial Sequence: Synthetic peptide
  Seed: KSLHVGTQCAL (MAR1_HUMAN)
KCLHVGTQCAW

SEQ ID NO: 115375 - protein, 9 aa, Artificial Sequence
  Description of Artificial Sequence: Synthetic peptide
  Seed: EAAGIGILT (MAR1_HUMAN)
EAAGIGILL

SEQ ID NO: 115376 - protein, 9 aa, Artificial Sequence
  Description of Artificial Sequence: Synthetic peptide
  Seed: LLIGCWYCR (MAR1_HUMAN)
LVIGCWYCR

SEQ ID NO: 115377 - protein, 9 aa, Artificial Sequence
  Description of Artificial Sequence: Synthetic peptide
  Seed: QEKNCEPVV (MAR1_HUMAN)
QEKNCEPVP

SEQ ID NO: 115378 - protein, 10 aa, Artificial Sequence
  Description of Artificial Sequence: Synthetic peptide
  Seed: LSAEQSPPPY (MAR1_HUMAN)
LQAEQSPPPM

SEQ ID NO: 115379 - protein, 10 aa, Artificial Sequence
  Description of Artificial Sequence: Synthetic peptide
  Seed: ALMDKSLHVG (MAR1_HUMAN)
ALMDKSLHVC

SEQ ID NO: 115380 - protein, 8 aa, Artificial Sequence
  Description of Artificial Sequence: Synthetic peptide
  Seed: LMDKSLHV (MAR1_HUMAN)
LQDKSLHM

SEQ ID NO: 115381 - protein, 11 aa, Artificial Sequence
  Description of Artificial Sequence: Synthetic peptide
  Seed: YRALMDKSLHV (MAR1_HUMAN)
YKALMDKSLHL

SEQ ID NO: 115382 - protein, 11 aa, Artificial Sequence
  Description of Artificial Sequence: Synthetic peptide
  Seed: YRALMDKSLHV (MAR1_HUMAN)
YHALMDKSLHM

SEQ ID NO: 115383 - protein, 10 aa, Artificial Sequence
  Description of Artificial Sequence: Synthetic peptide
  Seed: IGILTVILGV (MAR1_HUMAN)
IKILTVILGV

SEQ ID NO: 115384 - protein, 10 aa, Artificial Sequence
  Description of Artificial Sequence: Synthetic peptide
  Seed: RRRNGYRALM (MAR1_HUMAN)
RCRNGYRALY

SEQ ID NO: 115385 - protein, 9 aa, Artificial Sequence
  Description of Artificial Sequence: Synthetic peptide
  Seed: LLLIGCWYC (MAR1_HUMAN)
LILIGCWYL

SEQ ID NO: 115386 - protein, 11 aa, Artificial Sequence
  Description of Artificial Sequence: Synthetic peptide
  Seed: AEEAAGIGILT (MAR1_HUMAN)
AEEAAGIGILL

SEQ ID NO: 115387 - protein, 10 aa, Artificial Sequence
  Description of Artificial Sequence: Synthetic peptide
  Seed: EAAGIGILTV (MAR1_HUMAN)
EIAGIGILTL

SEQ ID NO: 115388 - protein, 10 aa, Artificial Sequence
  Description of Artificial Sequence: Synthetic peptide
  Seed: LLLIGCWYCR (MAR1_HUMAN)
LGLIGCWYCR

SEQ ID NO: 115389 - protein, 9 aa, Artificial Sequence
  Description of Artificial Sequence: Synthetic peptide
  Seed: TVILGVLLL (MAR1_HUMAN)
TTILGVLLL

SEQ ID NO: 115390 - protein, 10 aa, Artificial Sequence
  Description of Artificial Sequence: Synthetic peptide
  Seed: IGILTVILGV (MAR1_HUMAN)
IDILTVILGV

SEQ ID NO: 115391 - protein, 10 aa, Artificial Sequence
  Description of Artificial Sequence: Synthetic peptide
  Seed: YGYPKKGHGH (MAR1_HUMAN)
YGYPKKGHGF

SEQ ID NO: 115392 - protein, 9 aa, Artificial Sequence
  Description of Artificial Sequence: Synthetic peptide
  Seed: HSYTTAEEA (MAR1_HUMAN)
HHYTTAEEP

SEQ ID NO: 115393 - protein, 11 aa, Artificial Sequence
  Description of Artificial Sequence: Synthetic peptide
  Seed: YRALMDKSLHV (MAR1_HUMAN)
YRALMDKSLHA

SEQ ID NO: 115394 - protein, 9 aa, Artificial Sequence
  Description of Artificial Sequence: Synthetic peptide
  Seed: LHVGTQCAL (MAR1_HUMAN)
LKVGTQCAL

SEQ ID NO: 115395 - protein, 10 aa, Artificial Sequence
  Description of Artificial Sequence: Synthetic peptide
  Seed: EEAAGIGILT (MAR1_HUMAN)
ECAAGIGILI

SEQ ID NO: 115396 - protein, 10 aa, Artificial Sequence
  Description of Artificial Sequence: Synthetic peptide
  Seed: EEAAGIGILT (MAR1_HUMAN)
EQAAGIGILV

SEQ ID NO: 115397 - protein, 10 aa, Artificial Sequence
  Description of Artificial Sequence: Synthetic peptide
  Seed: YGYPKKGHGH (MAR1_HUMAN)
YAYPKKGHGF

SEQ ID NO: 115398 - protein, 9 aa, Artificial Sequence
  Description of Artificial Sequence: Synthetic peptide
  Seed: KSLHVGTQC (MAR1_HUMAN)
KGLHVGTQW

SEQ ID NO: 115399 - protein, 9 aa, Artificial Sequence
  Description of Artificial Sequence: Synthetic peptide
  Seed: YRALMDKSL (MAR1_HUMAN)
YFALMDKSM

SEQ ID NO: 115400 - protein, 10 aa, Artificial Sequence
  Description of Artificial Sequence: Synthetic peptide
  Seed: RRRNGYRALM (MAR1_HUMAN)
RGRNGYRALY

SEQ ID NO: 115401 - protein, 9 aa, Artificial Sequence
  Description of Artificial Sequence: Synthetic peptide
  Seed: ILTVILGVL (MAR1_HUMAN)
ILTVILGVV

SEQ ID NO: 115402 - protein, 10 aa, Artificial Sequence
  Description of Artificial Sequence: Synthetic peptide
  Seed: RDSKVSLQEK (MAR1_HUMAN)
RWSKVSLQEA

SEQ ID NO: 115403 - protein, 10 aa, Artificial Sequence
  Description of Artificial Sequence: Synthetic peptide
  Seed: EEAAGIGILT (MAR1_HUMAN)
ESAAGIGILI

SEQ ID NO: 115404 - protein, 10 aa, Artificial Sequence
  Description of Artificial Sequence: Synthetic peptide
  Seed: RRRNGYRALM (MAR1_HUMAN)
RKRNGYRALF

SEQ ID NO: 115405 - protein, 11 aa, Artificial Sequence
  Description of Artificial Sequence: Synthetic peptide
  Seed: CWYCRRRNGYR (MAR1_HUMAN)
CSYCRRRNGYR

SEQ ID NO: 115406 - protein, 10 aa, Artificial Sequence
  Description of Artificial Sequence: Synthetic peptide
  Seed: YTTAEEAAGI (MAR1_HUMAN)
YSTAEEAAGV

SEQ ID NO: 115407 - protein, 9 aa, Artificial Sequence
  Description of Artificial Sequence: Synthetic peptide
  Seed: ALMDKSLHV (MAR1_HUMAN)
ASMDKSLHL

SEQ ID NO: 115408 - protein, 10 aa, Artificial Sequence
  Description of Artificial Sequence: Synthetic peptide
  Seed: YTTAEEAAGI (MAR1_HUMAN)
YYTAEEAAGV

SEQ ID NO: 115409 - protein, 10 aa, Artificial Sequence
  Description of Artificial Sequence: Synthetic peptide
  Seed: ALMDKSLHVG (MAR1_HUMAN)
AMMDKSLHVS

SEQ ID NO: 115410 - protein, 9 aa, Artificial Sequence
  Description of Artificial Sequence: Synthetic peptide
  Seed: HSYTTAEEA (MAR1_HUMAN)
HPYTTAEEP

SEQ ID NO: 115411 - protein, 10 aa, Artificial Sequence
  Description of Artificial Sequence: Synthetic peptide
  Seed: APPAYEKLSA (MAR1_HUMAN)
ADPAYEKLSL

SEQ ID NO: 115412 - protein, 9 aa, Artificial Sequence
  Description of Artificial Sequence: Synthetic peptide
  Seed: NAPPAYEKL (MAR1_HUMAN)
NFPPAYEKM

SEQ ID NO: 115413 - protein, 10 aa, Artificial Sequence
  Description of Artificial Sequence: Synthetic peptide
  Seed: RALMDKSLHV (MAR1_HUMAN)
RKLMDKSLHL

SEQ ID NO: 115414 - protein, 9 aa, Artificial Sequence
  Description of Artificial Sequence: Synthetic peptide
  Seed: YRALMDKSL (MAR1_HUMAN)
YFALMDKSY

SEQ ID NO: 115415 - protein, 9 aa, Artificial Sequence
  Description of Artificial Sequence: Synthetic peptide
  Seed: LHVGTQCAL (MAR1_HUMAN)
LKVGTQCAY

SEQ ID NO: 115416 - protein, 10 aa, Artificial Sequence
  Description of Artificial Sequence: Synthetic peptide
  Seed: EEAAGIGILT (MAR1_HUMAN)
EKAAGIGILI

SEQ ID NO: 115417 - protein, 9 aa, Artificial Sequence
  Description of Artificial Sequence: Synthetic peptide
  Seed: GYPKKGHGH (MAR1_HUMAN)
GYPKKGHGF

SEQ ID NO: 115418 - protein, 10 aa, Artificial Sequence
  Description of Artificial Sequence: Synthetic peptide
  Seed: RALMDKSLHV (MAR1_HUMAN)
RMLMDKSLHI

SEQ ID NO: 115419 - protein, 9 aa, Artificial Sequence
  Description of Artificial Sequence: Synthetic peptide
  Seed: VILGVLLLI (MAR1_HUMAN)
VTLGVLLLK

SEQ ID NO: 115420 - protein, 10 aa, Artificial Sequence
  Description of Artificial Sequence: Synthetic peptide
  Seed: EAAGIGILTV (MAR1_HUMAN)
EVAGIGILTV

SEQ ID NO: 115421 - protein, 10 aa, Artificial Sequence
  Description of Artificial Sequence: Synthetic peptide
  Seed: MPREDAHFIY (MAR1_HUMAN)
MHREDAHFIF

SEQ ID NO: 115422 - protein, 10 aa, Artificial Sequence
  Description of Artificial Sequence: Synthetic peptide
  Seed: SLHVGTQCAL (MAR1_HUMAN)
SMHVGTQCAM

SEQ ID NO: 115423 - protein, 9 aa, Artificial Sequence
  Description of Artificial Sequence: Synthetic peptide
  Seed: VVPNAPPAY (MAR1_HUMAN)
VLPNAPPAV

SEQ ID NO: 115424 - protein, 9 aa, Artificial Sequence
  Description of Artificial Sequence: Synthetic peptide
  Seed: VVPNAPPAY (MAR1_HUMAN)
VFPNAPPAV

SEQ ID NO: 115425 - protein, 9 aa, Artificial Sequence
  Description of Artificial Sequence: Synthetic peptide
  Seed: KSLHVGTQC (MAR1_HUMAN)
KMLHVGTQW

SEQ ID NO: 115426 - protein, 9 aa, Artificial Sequence
  Description of Artificial Sequence: Synthetic peptide
  Seed: VVPNAPPAY (MAR1_HUMAN)
VRPNAPPAY

SEQ ID NO: 115427 - protein, 10 aa, Artificial Sequence
  Description of Artificial Sequence: Synthetic peptide
  Seed: RRRNGYRALM (MAR1_HUMAN)
RDRNGYRALF

SEQ ID NO: 115428 - protein, 10 aa, Artificial Sequence
  Description of Artificial Sequence: Synthetic peptide
  Seed: RRRNGYRALM (MAR1_HUMAN)
RARNGYRALF

SEQ ID NO: 115429 - protein, 9 aa, Artificial Sequence
  Description of Artificial Sequence: Synthetic peptide
  Seed: RRRNGYRAL (MAR1_HUMAN)
RTRNGYRAY

SEQ ID NO: 115430 - protein, 9 aa, Artificial Sequence
  Description of Artificial Sequence: Synthetic peptide
  Seed: LLIGCWYCR (MAR1_HUMAN)
LTIGCWYCK

SEQ ID NO: 115431 - protein, 10 aa, Artificial Sequence
  Description of Artificial Sequence: Synthetic peptide
  Seed: RNGYRALMDK (MAR1_HUMAN)
RMGYRALMDY

SEQ ID NO: 115432 - protein, 9 aa, Artificial Sequence
  Description of Artificial Sequence: Synthetic peptide
  Seed: VILGVLLLI (MAR1_HUMAN)
VVLGVLLLV

SEQ ID NO: 115433 - protein, 9 aa, Artificial Sequence
  Description of Artificial Sequence: Synthetic peptide
  Seed: LHVGTQCAL (MAR1_HUMAN)
LQVGTQCAL

SEQ ID NO: 115434 - protein, 9 aa, Artificial Sequence
  Description of Artificial Sequence: Synthetic peptide
  Seed: TVILGVLLL (MAR1_HUMAN)
TLILGVLLF

SEQ ID NO: 115435 - protein, 10 aa, Artificial Sequence
  Description of Artificial Sequence: Synthetic peptide
  Seed: TVILGVLLLI (MAR1_HUMAN)
TQILGVLLLV

SEQ ID NO: 115436 - protein, 9 aa, Artificial Sequence
  Description of Artificial Sequence: Synthetic peptide
  Seed: EAAGIGILT (MAR1_HUMAN)
EVAGIGILT

SEQ ID NO: 115437 - protein, 9 aa, Artificial Sequence
  Description of Artificial Sequence: Synthetic peptide
  Seed: EAAGIGILT (MAR1_HUMAN)
EIAGIGILI

SEQ ID NO: 115438 - protein, 9 aa, Artificial Sequence
  Description of Artificial Sequence: Synthetic peptide
  Seed: RRNGYRALM (MAR1_HUMAN)
RENGYRALF

SEQ ID NO: 115439 - protein, 10 aa, Artificial Sequence
  Description of Artificial Sequence: Synthetic peptide
  Seed: ALMDKSLHVG (MAR1_HUMAN)
AQMDKSLHVL

SEQ ID NO: 115440 - protein, 10 aa, Artificial Sequence
  Description of Artificial Sequence: Synthetic peptide
  Seed: RALMDKSLHV (MAR1_HUMAN)
RDLMDKSLHV

SEQ ID NO: 115441 - protein, 10 aa, Artificial Sequence
  Description of Artificial Sequence: Synthetic peptide
  Seed: APPAYEKLSA (MAR1_HUMAN)
ATPAYEKLSL

SEQ ID NO: 115442 - protein, 9 aa, Artificial Sequence
  Description of Artificial Sequence: Synthetic peptide
  Seed: KSLHVGTQC (MAR1_HUMAN)
KVLHVGTQW

SEQ ID NO: 115443 - protein, 11 aa, Artificial Sequence
  Description of Artificial Sequence: Synthetic peptide
  Seed: RALMDKSLHVG (MAR1_HUMAN)
RYLMDKSLHVI

SEQ ID NO: 115444 - protein, 9 aa, Artificial Sequence
  Description of Artificial Sequence: Synthetic peptide
  Seed: EAAGIGILT (MAR1_HUMAN)
ELAGIGILI

SEQ ID NO: 115445 - protein, 9 aa, Artificial Sequence
  Description of Artificial Sequence: Synthetic peptide
  Seed: IGCWYCRRR (MAR1_HUMAN)
ITCWYCRRR

SEQ ID NO: 115446 - protein, 10 aa, Artificial Sequence
  Description of Artificial Sequence: Synthetic peptide
  Seed: RRRNGYRALM (MAR1_HUMAN)
RERNGYRALK

SEQ ID NO: 115447 - protein, 9 aa, Artificial Sequence
  Description of Artificial Sequence: Synthetic peptide
  Seed: VVPNAPPAY (MAR1_HUMAN)
VWPNAPPAF

SEQ ID NO: 115448 - protein, 10 aa, Artificial Sequence
  Description of Artificial Sequence: Synthetic peptide
  Seed: EEAAGIGILT (MAR1_HUMAN)
EMAAGIGILV

SEQ ID NO: 115449 - protein, 8 aa, Artificial Sequence
  Description of Artificial Sequence: Synthetic peptide
  Seed: LMDKSLHV (MAR1_HUMAN)
LADKSLHV

SEQ ID NO: 115450 - protein, 9 aa, Artificial Sequence
  Description of Artificial Sequence: Synthetic peptide
  Seed: GFDHRDSKV (MAR1_HUMAN)
GSDHRDSKL

SEQ ID NO: 115451 - protein, 10 aa, Artificial Sequence
  Description of Artificial Sequence: Synthetic peptide
  Seed: MPREDAHFIY (MAR1_HUMAN)
MQREDAHFIF

SEQ ID NO: 115452 - protein, 11 aa, Artificial Sequence
  Description of Artificial Sequence: Synthetic peptide
  Seed: RALMDKSLHVG (MAR1_HUMAN)
RWLMDKSLHVL

SEQ ID NO: 115453 - protein, 9 aa, Artificial Sequence
  Description of Artificial Sequence: Synthetic peptide
  Seed: RRNGYRALM (MAR1_HUMAN)
RINGYRALY

SEQ ID NO: 115454 - protein, 9 aa, Artificial Sequence
  Description of Artificial Sequence: Synthetic peptide
  Seed: SAEQSPPPY (MAR1_HUMAN)
SQEQSPPPM

SEQ ID NO: 115455 - protein, 9 aa, Artificial Sequence
  Description of Artificial Sequence: Synthetic peptide
  Seed: RRRNGYRAL (MAR1_HUMAN)
RNRNGYRAF

SEQ ID NO: 115456 - protein, 11 aa, Artificial Sequence
  Description of Artificial Sequence: Synthetic peptide
  Seed: YRALMDKSLHV (MAR1_HUMAN)
YPALMDKSLHV

SEQ ID NO: 115457 - protein, 9 aa, Artificial Sequence
  Description of Artificial Sequence: Synthetic peptide
  Seed: ALMDKSLHV (MAR1_HUMAN)
AAMDKSLHA

SEQ ID NO: 115458 - protein, 9 aa, Artificial Sequence
  Description of Artificial Sequence: Synthetic peptide
  Seed: AGIGILTVI (MAR1_HUMAN)
ALIGILTVI

SEQ ID NO: 115459 - protein, 10 aa, Artificial Sequence
  Description of Artificial Sequence: Synthetic peptide
  Seed: LLLIGCWYCR (MAR1_HUMAN)
LMLIGCWYCR

SEQ ID NO: 115460 - protein, 9 aa, Artificial Sequence
  Description of Artificial Sequence: Synthetic peptide
  Seed: HSYTTAEEA (MAR1_HUMAN)
HHYTTAEET

SEQ ID NO: 115461 - protein, 9 aa, Artificial Sequence
  Description of Artificial Sequence: Synthetic peptide
  Seed: GFDHRDSKV (MAR1_HUMAN)
GADHRDSKL

SEQ ID NO: 115462 - protein, 10 aa, Artificial Sequence
  Description of Artificial Sequence: Synthetic peptide
  Seed: IGILTVILGV (MAR1_HUMAN)
ILILTVILGL

SEQ ID NO: 115463 - protein, 9 aa, Artificial Sequence
  Description of Artificial Sequence: Synthetic peptide
  Seed: AAGIGILTV (MAR1_HUMAN)
ASGIGILTW

SEQ ID NO: 115464 - protein, 10 aa, Artificial Sequence
  Description of Artificial Sequence: Synthetic peptide
  Seed: ALMDKSLHVG (MAR1_HUMAN)
AVMDKSLHVM

SEQ ID NO: 115465 - protein, 9 aa, Artificial Sequence
  Description of Artificial Sequence: Synthetic peptide
  Seed: GILTVILGV (MAR1_HUMAN)
GTLTVILGL

SEQ ID NO: 115466 - protein, 8 aa, Artificial Sequence
  Description of Artificial Sequence: Synthetic peptide
  Seed: LMDKSLHV (MAR1_HUMAN)
LSDKSLHI

SEQ ID NO: 115467 - protein, 10 aa, Artificial Sequence
  Description of Artificial Sequence: Synthetic peptide
  Seed: RRRNGYRALM (MAR1_HUMAN)
RRRNGYRALF

SEQ ID NO: 115468 - protein, 11 aa, Artificial Sequence
  Description of Artificial Sequence: Synthetic peptide
  Seed: ALMDKSLHVGT (MAR1_HUMAN)
AMMDKSLHVGV

SEQ ID NO: 115469 - protein, 10 aa, Artificial Sequence
  Description of Artificial Sequence: Synthetic peptide
  Seed: ALMDKSLHVG (MAR1_HUMAN)
ANMDKSLHVV

SEQ ID NO: 115470 - protein, 9 aa, Artificial Sequence
  Description of Artificial Sequence: Synthetic peptide
  Seed: RRRNGYRAL (MAR1_HUMAN)
RMRNGYRAF

SEQ ID NO: 115471 - protein, 9 aa, Artificial Sequence
  Description of Artificial Sequence: Synthetic peptide
  Seed: EAAGIGILT (MAR1_HUMAN)
EVAGIGILA

SEQ ID NO: 115472 - protein, 9 aa, Artificial Sequence
  Description of Artificial Sequence: Synthetic peptide
  Seed: ALMDKSLHV (MAR1_HUMAN)
ALMDKSLHT

SEQ ID NO: 115473 - protein, 10 aa, Artificial Sequence
  Description of Artificial Sequence: Synthetic peptide
  Seed: YTTAEEAAGI (MAR1_HUMAN)
YMTAEEAAGI

SEQ ID NO: 115474 - protein, 9 aa, Artificial Sequence
  Description of Artificial Sequence: Synthetic peptide
  Seed: LLLIGCWYC (MAR1_HUMAN)
LQLIGCWYI

SEQ ID NO: 115475 - protein, 9 aa, Artificial Sequence
  Description of Artificial Sequence: Synthetic peptide
  Seed: RRRNGYRAL (MAR1_HUMAN)
RSRNGYRAF

SEQ ID NO: 115476 - protein, 10 aa, Artificial Sequence
  Description of Artificial Sequence: Synthetic peptide
  Seed: TVILGVLLLI (MAR1_HUMAN)
TMILGVLLLL

SEQ ID NO: 115477 - protein, 9 aa, Artificial Sequence
  Description of Artificial Sequence: Synthetic peptide
  Seed: LLIGCWYCR (MAR1_HUMAN)
LLIGCWYCK

SEQ ID NO: 115478 - protein, 9 aa, Artificial Sequence
  Description of Artificial Sequence: Synthetic peptide
  Seed: VVPNAPPAY (MAR1_HUMAN)
VCPNAPPAM

SEQ ID NO: 115479 - protein, 9 aa, Artificial Sequence
  Description of Artificial Sequence: Synthetic peptide
  Seed: AEEAAGIGI (MAR1_HUMAN)
AEEAAGIGP

SEQ ID NO: 115480 - protein, 9 aa, Artificial Sequence
  Description of Artificial Sequence: Synthetic peptide
  Seed: TVILGVLLL (MAR1_HUMAN)
TIILGVLLY

SEQ ID NO: 115481 - protein, 9 aa, Artificial Sequence
  Description of Artificial Sequence: Synthetic peptide
  Seed: VILGVLLLI (MAR1_HUMAN)
VNLGVLLLW

SEQ ID NO: 115482 - protein, 9 aa, Artificial Sequence
  Description of Artificial Sequence: Synthetic peptide
  Seed: AHFIYGYPK (MAR1_HUMAN)
AVFIYGYPK

SEQ ID NO: 115483 - protein, 9 aa, Artificial Sequence
  Description of Artificial Sequence: Synthetic peptide
  Seed: RRNGYRALM (MAR1_HUMAN)
RMNGYRALL

SEQ ID NO: 115484 - protein, 9 aa, Artificial Sequence
  Description of Artificial Sequence: Synthetic peptide
  Seed: AGIGILTVI (MAR1_HUMAN)
ARIGILTVI

SEQ ID NO: 115485 - protein, 10 aa, Artificial Sequence
  Description of Artificial Sequence: Synthetic peptide
  Seed: EAAGIGILTV (MAR1_HUMAN)
ETAGIGILTI

SEQ ID NO: 115486 - protein, 9 aa, Artificial Sequence
  Description of Artificial Sequence: Synthetic peptide
  Seed: LTVILGVLL (MAR1_HUMAN)
LSVILGVLF

SEQ ID NO: 115487 - protein, 9 aa, Artificial Sequence
  Description of Artificial Sequence: Synthetic peptide
  Seed: AGIGILTVI (MAR1_HUMAN)
AGIGILTVL

SEQ ID NO: 115488 - protein, 9 aa, Artificial Sequence
  Description of Artificial Sequence: Synthetic peptide
  Seed: TVILGVLLL (MAR1_HUMAN)
TLILGVLLL

SEQ ID NO: 115489 - protein, 11 aa, Artificial Sequence
  Description of Artificial Sequence: Synthetic peptide
  Seed: YRALMDKSLHV (MAR1_HUMAN)
YFALMDKSLHM

SEQ ID NO: 115490 - protein, 10 aa, Artificial Sequence
  Description of Artificial Sequence: Synthetic peptide
  Seed: LLLIGCWYCR (MAR1_HUMAN)
LWLIGCWYCK

SEQ ID NO: 115491 - protein, 9 aa, Artificial Sequence
  Description of Artificial Sequence: Synthetic peptide
  Seed: RRRNGYRAL (MAR1_HUMAN)
RYRNGYRAI

SEQ ID NO: 115492 - protein, 9 aa, Artificial Sequence
  Description of Artificial Sequence: Synthetic peptide
  Seed: EDAHFIYGY (MAR1_HUMAN)
ETAHFIYGM

SEQ ID NO: 115493 - protein, 9 aa, Artificial Sequence
  Description of Artificial Sequence: Synthetic peptide
  Seed: NAPPAYEKL (MAR1_HUMAN)
NVPPAYEKR

SEQ ID NO: 115494 - protein, 9 aa, Artificial Sequence
  Description of Artificial Sequence: Synthetic peptide
  Seed: EAAGIGILT (MAR1_HUMAN)
ESAGIGILT

SEQ ID NO: 115495 - protein, 10 aa, Artificial Sequence
  Description of Artificial Sequence: Synthetic peptide
  Seed: YPKKGHGHSY (MAR1_HUMAN)
YQKKGHGHSM

SEQ ID NO: 115496 - protein, 10 aa, Artificial Sequence
  Description of Artificial Sequence: Synthetic peptide
  Seed: RNGYRALMDK (MAR1_HUMAN)
RLGYRALMDY

SEQ ID NO: 115497 - protein, 9 aa, Artificial Sequence
  Description of Artificial Sequence: Synthetic peptide
  Seed: RRRNGYRAL (MAR1_HUMAN)
RWRNGYRAL

SEQ ID NO: 115498 - protein, 9 aa, Artificial Sequence
  Description of Artificial Sequence: Synthetic peptide
  Seed: GTQCALTRR (MAR1_HUMAN)
GSQCALTRR

SEQ ID NO: 115499 - protein, 9 aa, Artificial Sequence
  Description of Artificial Sequence: Synthetic peptide
  Seed: EQSPPPYSP (MAR1_HUMAN)
EESPPPYSI

SEQ ID NO: 115500 - protein, 10 aa, Artificial Sequence
  Description of Artificial Sequence: Synthetic peptide
  Seed: GILTVILGVL (MAR1_HUMAN)
GMLTVILGVL

SEQ ID NO: 115501 - protein, 9 aa, Artificial Sequence
  Description of Artificial Sequence: Synthetic peptide
  Seed: AGIGILTVI (MAR1_HUMAN)
AQIGILTVV

SEQ ID NO: 115502 - protein, 9 aa, Artificial Sequence
  Description of Artificial Sequence: Synthetic peptide
  Seed: GFDHRDSKV (MAR1_HUMAN)
GVDHRDSKM

SEQ ID NO: 115503 - protein, 9 aa, Artificial Sequence
  Description of Artificial Sequence: Synthetic peptide
  Seed: AGIGILTVI (MAR1_HUMAN)
AIIGILTVA

SEQ ID NO: 115504 - protein, 10 aa, Artificial Sequence
  Description of Artificial Sequence: Synthetic peptide
  Seed: RALMDKSLHV (MAR1_HUMAN)
RDLMDKSLHL

SEQ ID NO: 115505 - protein, 9 aa, Artificial Sequence
  Description of Artificial Sequence: Synthetic peptide
  Seed: VVPNAPPAY (MAR1_HUMAN)
VAPNAPPAA

SEQ ID NO: 115506 - protein, 9 aa, Artificial Sequence
  Description of Artificial Sequence: Synthetic peptide
  Seed: LHVGTQCAL (MAR1_HUMAN)
LQVGTQCAI

SEQ ID NO: 115507 - protein, 9 aa, Artificial Sequence
  Description of Artificial Sequence: Synthetic peptide
  Seed: ALMDKSLHV (MAR1_HUMAN)
AMMDKSLHY

SEQ ID NO: 115508 - protein, 9 aa, Artificial Sequence
  Description of Artificial Sequence: Synthetic peptide
  Seed: VGTQCALTR (MAR1_HUMAN)
VTTQCALTR

SEQ ID NO: 115509 - protein, 9 aa, Artificial Sequence
  Description of Artificial Sequence: Synthetic peptide
  Seed: TTAEEAAGI (MAR1_HUMAN)
TIAEEAAGV

SEQ ID NO: 115510 - protein, 9 aa, Artificial Sequence
  Description of Artificial Sequence: Synthetic peptide
  Seed: RRNGYRALM (MAR1_HUMAN)
RENGYRALY

SEQ ID NO: 115511 - protein, 11 aa, Artificial Sequence
  Description of Artificial Sequence: Synthetic peptide
  Seed: YCRRRNGYRAL (MAR1_HUMAN)
YIRRRNGYRAM

SEQ ID NO: 115512 - protein, 9 aa, Artificial Sequence
  Description of Artificial Sequence: Synthetic peptide
  Seed: EAAGIGILT (MAR1_HUMAN)
ESAGIGILL

SEQ ID NO: 115513 - protein, 10 aa, Artificial Sequence
  Description of Artificial Sequence: Synthetic peptide
  Seed: LSAEQSPPPY (MAR1_HUMAN)
LQAEQSPPPY

SEQ ID NO: 115514 - protein, 9 aa, Artificial Sequence
  Description of Artificial Sequence: Synthetic peptide
  Seed: EGFDHRDSK (MAR1_HUMAN)
EAFDHRDSK

SEQ ID NO: 115515 - protein, 11 aa, Artificial Sequence
  Description of Artificial Sequence: Synthetic peptide
  Seed: YRALMDKSLHV (MAR1_HUMAN)
YKALMDKSLHI

SEQ ID NO: 115516 - protein, 11 aa, Artificial Sequence
  Description of Artificial Sequence: Synthetic peptide
  Seed: YRALMDKSLHV (MAR1_HUMAN)
YAALMDKSLHL

SEQ ID NO: 115517 - protein, 10 aa, Artificial Sequence
  Description of Artificial Sequence: Synthetic peptide
  Seed: EAAGIGILTV (MAR1_HUMAN)
ETAGIGILTL

SEQ ID NO: 115518 - protein, 9 aa, Artificial Sequence
  Description of Artificial Sequence: Synthetic peptide
  Seed: VILGVLLLI (MAR1_HUMAN)
VVLGVLLLA

SEQ ID NO: 115519 - protein, 9 aa, Artificial Sequence
  Description of Artificial Sequence: Synthetic peptide
  Seed: SLHVGTQCA (MAR1_HUMAN)
SLHVGTQCV

SEQ ID NO: 115520 - protein, 9 aa, Artificial Sequence
  Description of Artificial Sequence: Synthetic peptide
  Seed: DHRDSKVSL (MAR1_HUMAN)
DHRDSKVSY

SEQ ID NO: 115521 - protein, 10 aa, Artificial Sequence
  Description of Artificial Sequence: Synthetic peptide
  Seed: ALMDKSLHVG (MAR1_HUMAN)
AIMDKSLHVA

SEQ ID NO: 115522 - protein, 9 aa, Artificial Sequence
  Description of Artificial Sequence: Synthetic peptide
  Seed: RRNGYRALM (MAR1_HUMAN)
RANGYRALF

SEQ ID NO: 115523 - protein, 10 aa, Artificial Sequence
  Description of Artificial Sequence: Synthetic peptide
  Seed: EEAAGIGILT (MAR1_HUMAN)
EIAAGIGILA

SEQ ID NO: 115524 - protein, 9 aa, Artificial Sequence
  Description of Artificial Sequence: Synthetic peptide
  Seed: LLLIGCWYC (MAR1_HUMAN)
LMLIGCWYL

SEQ ID NO: 115525 - protein, 9 aa, Artificial Sequence
  Description of Artificial Sequence: Synthetic peptide
  Seed: RRNGYRALM (MAR1_HUMAN)
RTNGYRALF

SEQ ID NO: 115526 - protein, 10 aa, Artificial Sequence
  Description of Artificial Sequence: Synthetic peptide
  Seed: RNGYRALMDK (MAR1_HUMAN)
RMGYRALMDR

SEQ ID NO: 115527 - protein, 11 aa, Artificial Sequence
  Description of Artificial Sequence: Synthetic peptide
  Seed: YRALMDKSLHV (MAR1_HUMAN)
YHALMDKSLHL

SEQ ID NO: 115528 - protein, 9 aa, Artificial Sequence
  Description of Artificial Sequence: Synthetic peptide
  Seed: AAGIGILTV (MAR1_HUMAN)
AAGIGILTL

SEQ ID NO: 115529 - protein, 9 aa, Artificial Sequence
  Description of Artificial Sequence: Synthetic peptide
  Seed: EEAAGIGIL (MAR1_HUMAN)
EEAAGIGIV

SEQ ID NO: 115530 - protein, 8 aa, Artificial Sequence
  Description of Artificial Sequence: Synthetic peptide
  Seed: HRDSKVSL (MAR1_HUMAN)
HHDSKVSL

SEQ ID NO: 115531 - protein, 10 aa, Artificial Sequence
  Description of Artificial Sequence: Synthetic peptide
  Seed: RRRNGYRALM (MAR1_HUMAN)
RRRNGYRALK

SEQ ID NO: 115532 - protein, 11 aa, Artificial Sequence
  Description of Artificial Sequence: Synthetic peptide
  Seed: EPVVPNAPPAY (MAR1_HUMAN)
EPVVPNAPPAL

SEQ ID NO: 115533 - protein, 11 aa, Artificial Sequence
  Description of Artificial Sequence: Synthetic peptide
  Seed: YRALMDKSLHV (MAR1_HUMAN)
YHALMDKSLHA

SEQ ID NO: 115534 - protein, 9 aa, Artificial Sequence
  Description of Artificial Sequence: Synthetic peptide
  Seed: RRRNGYRAL (MAR1_HUMAN)
RQRNGYRAY

SEQ ID NO: 115535 - protein, 10 aa, Artificial Sequence
  Description of Artificial Sequence: Synthetic peptide
  Seed: TVILGVLLLI (MAR1_HUMAN)
TTILGVLLLA

SEQ ID NO: 115536 - protein, 10 aa, Artificial Sequence
  Description of Artificial Sequence: Synthetic peptide
  Seed: HVGTQCALTR (MAR1_HUMAN)
HTGTQCALTR

SEQ ID NO: 115537 - protein, 9 aa, Artificial Sequence
  Description of Artificial Sequence: Synthetic peptide
  Seed: VILGVLLLI (MAR1_HUMAN)
VLLGVLLLT

SEQ ID NO: 115538 - protein, 9 aa, Artificial Sequence
  Description of Artificial Sequence: Synthetic peptide
  Seed: TTAEEAAGI (MAR1_HUMAN)
TMAEEAAGA

SEQ ID NO: 115539 - protein, 9 aa, Artificial Sequence
  Description of Artificial Sequence: Synthetic peptide
  Seed: EAAGIGILT (MAR1_HUMAN)
ESAGIGILA

SEQ ID NO: 115540 - protein, 11 aa, Artificial Sequence
  Description of Artificial Sequence: Synthetic peptide
  Seed: YRALMDKSLHV (MAR1_HUMAN)
YLALMDKSLHV

SEQ ID NO: 115541 - protein, 9 aa, Artificial Sequence
  Description of Artificial Sequence: Synthetic peptide
  Seed: ALMDKSLHV (MAR1_HUMAN)
ATMDKSLHR

SEQ ID NO: 115542 - protein, 10 aa, Artificial Sequence
  Description of Artificial Sequence: Synthetic peptide
  Seed: MPREDAHFIY (MAR1_HUMAN)
MAREDAHFIY

SEQ ID NO: 115543 - protein, 11 aa, Artificial Sequence
  Description of Artificial Sequence: Synthetic peptide
  Seed: KSLHVGTQCAL (MAR1_HUMAN)
KTLHVGTQCAY

SEQ ID NO: 115544 - protein, 9 aa, Artificial Sequence
  Description of Artificial Sequence: Synthetic peptide
  Seed: HSYTTAEEA (MAR1_HUMAN)
HTYTTAEEY

SEQ ID NO: 115545 - protein, 9 aa, Artificial Sequence
  Description of Artificial Sequence: Synthetic peptide
  Seed: ALMDKSLHV (MAR1_HUMAN)
AMMDKSLHF

SEQ ID NO: 115546 - protein, 10 aa, Artificial Sequence
  Description of Artificial Sequence: Synthetic peptide
  Seed: LLLIGCWYCR (MAR1_HUMAN)
LTLIGCWYCK

SEQ ID NO: 115547 - protein, 9 aa, Artificial Sequence
  Description of Artificial Sequence: Synthetic peptide
  Seed: ALMDKSLHV (MAR1_HUMAN)
ATMDKSLHF

SEQ ID NO: 115548 - protein, 9 aa, Artificial Sequence
  Description of Artificial Sequence: Synthetic peptide
  Seed: LHVGTQCAL (MAR1_HUMAN)
LMVGTQCAF

SEQ ID NO: 115549 - protein, 10 aa, Artificial Sequence
  Description of Artificial Sequence: Synthetic peptide
  Seed: TVILGVLLLI (MAR1_HUMAN)
TLILGVLLLI

SEQ ID NO: 115550 - protein, 10 aa, Artificial Sequence
  Description of Artificial Sequence: Synthetic peptide
  Seed: YGYPKKGHGH (MAR1_HUMAN)
YVYPKKGHGY

SEQ ID NO: 115551 - protein, 9 aa, Artificial Sequence
  Description of Artificial Sequence: Synthetic peptide
  Seed: YEKLSAEQS (MAR1_HUMAN)
YEKLSAEQM

SEQ ID NO: 115552 - protein, 10 aa, Artificial Sequence
  Description of Artificial Sequence: Synthetic peptide
  Seed: YTTAEEAAGI (MAR1_HUMAN)
YVTAEEAAGV

SEQ ID NO: 115553 - protein, 9 aa, Artificial Sequence
  Description of Artificial Sequence: Synthetic peptide
  Seed: AEEAAGIGI (MAR1_HUMAN)
AEEAAGIGT

SEQ ID NO: 115554 - protein, 10 aa, Artificial Sequence
  Description of Artificial Sequence: Synthetic peptide
  Seed: EEAAGIGILT (MAR1_HUMAN)
EVAAGIGILL

SEQ ID NO: 115555 - protein, 10 aa, Artificial Sequence
  Description of Artificial Sequence: Synthetic peptide
  Seed: MPREDAHFIY (MAR1_HUMAN)
MMREDAHFIF

SEQ ID NO: 115556 - protein, 9 aa, Artificial Sequence
  Description of Artificial Sequence: Synthetic peptide
  Seed: HSYTTAEEA (MAR1_HUMAN)
HIYTTAEEM

SEQ ID NO: 115557 - protein, 10 aa, Artificial Sequence
  Description of Artificial Sequence: Synthetic peptide
  Seed: RALMDKSLHV (MAR1_HUMAN)
RILMDKSLHV

SEQ ID NO: 115558 - protein, 9 aa, Artificial Sequence
  Description of Artificial Sequence: Synthetic peptide
  Seed: YPKKGHGHS (MAR1_HUMAN)
YPKKGHGHF

SEQ ID NO: 115559 - protein, 9 aa, Artificial Sequence
  Description of Artificial Sequence: Synthetic peptide
  Seed: GYPKKGHGH (MAR1_HUMAN)
GYPKKGHGM

SEQ ID NO: 115560 - protein, 9 aa, Artificial Sequence
  Description of Artificial Sequence: Synthetic peptide
  Seed: HSYTTAEEA (MAR1_HUMAN)
HPYTTAEEV

SEQ ID NO: 115561 - protein, 9 aa, Artificial Sequence
  Description of Artificial Sequence: Synthetic peptide
  Seed: ALMDKSLHV (MAR1_HUMAN)
AMMDKSLHT

SEQ ID NO: 115562 - protein, 9 aa, Artificial Sequence
  Description of Artificial Sequence: Synthetic peptide
  Seed: LLLIGCWYC (MAR1_HUMAN)
LTLIGCWYV

SEQ ID NO: 115563 - protein, 9 aa, Artificial Sequence
  Description of Artificial Sequence: Synthetic peptide
  Seed: LHVGTQCAL (MAR1_HUMAN)
LMVGTQCAL

SEQ ID NO: 115564 - protein, 10 aa, Artificial Sequence
  Description of Artificial Sequence: Synthetic peptide
  Seed: YGYPKKGHGH (MAR1_HUMAN)
YAYPKKGHGL

SEQ ID NO: 115565 - protein, 10 aa, Artificial Sequence
  Description of Artificial Sequence: Synthetic peptide
  Seed: EEAAGIGILT (MAR1_HUMAN)
EPAAGIGILI

SEQ ID NO: 115566 - protein, 9 aa, Artificial Sequence
  Description of Artificial Sequence: Synthetic peptide
  Seed: AHFIYGYPK (MAR1_HUMAN)
AMFIYGYPK

SEQ ID NO: 115567 - protein, 10 aa, Artificial Sequence
  Description of Artificial Sequence: Synthetic peptide
  Seed: ALMDKSLHVG (MAR1_HUMAN)
ASMDKSLHVV

SEQ ID NO: 115568 - protein, 9 aa, Artificial Sequence
  Description of Artificial Sequence: Synthetic peptide
  Seed: VILGVLLLI (MAR1_HUMAN)
VALGVLLLL

SEQ ID NO: 115569 - protein, 10 aa, Artificial Sequence
  Description of Artificial Sequence: Synthetic peptide
  Seed: YGYPKKGHGH (MAR1_HUMAN)
YIYPKKGHGF

SEQ ID NO: 115570 - protein, 10 aa, Artificial Sequence
  Description of Artificial Sequence: Synthetic peptide
  Seed: VGTQCALTRR (MAR1_HUMAN)
VMTQCALTRR

SEQ ID NO: 115571 - protein, 9 aa, Artificial Sequence
  Description of Artificial Sequence: Synthetic peptide
  Seed: TVILGVLLL (MAR1_HUMAN)
TQILGVLLM

SEQ ID NO: 115572 - protein, 10 aa, Artificial Sequence
  Description of Artificial Sequence: Synthetic peptide
  Seed: MPREDAHFIY (MAR1_HUMAN)
MPREDAHFIA

SEQ ID NO: 115573 - protein, 9 aa, Artificial Sequence
  Description of Artificial Sequence: Synthetic peptide
  Seed: AAGIGILTV (MAR1_HUMAN)
AMGIGILTV

SEQ ID NO: 115574 - protein, 11 aa, Artificial Sequence
  Description of Artificial Sequence: Synthetic peptide
  Seed: YRALMDKSLHV (MAR1_HUMAN)
YLALMDKSLHI

SEQ ID NO: 115575 - protein, 10 aa, Artificial Sequence
  Description of Artificial Sequence: Synthetic peptide
  Seed: RRRNGYRALM (MAR1_HUMAN)
RHRNGYRALF

SEQ ID NO: 115576 - protein, 10 aa, Artificial Sequence
  Description of Artificial Sequence: Synthetic peptide
  Seed: LLLIGCWYCR (MAR1_HUMAN)
LWLIGCWYCR

SEQ ID NO: 115577 - protein, 10 aa, Artificial Sequence
  Description of Artificial Sequence: Synthetic peptide
  Seed: ALMDKSLHVG (MAR1_HUMAN)
AQMDKSLHVA

SEQ ID NO: 115578 - protein, 9 aa, Artificial Sequence
  Description of Artificial Sequence: Synthetic peptide
  Seed: HSYTTAEEA (MAR1_HUMAN)
HPYTTAEET

SEQ ID NO: 115579 - protein, 9 aa, Artificial Sequence
  Description of Artificial Sequence: Synthetic peptide
  Seed: LLIGCWYCR (MAR1_HUMAN)
LQIGCWYCR

SEQ ID NO: 115580 - protein, 9 aa, Artificial Sequence
  Description of Artificial Sequence: Synthetic peptide
  Seed: LLLIGCWYC (MAR1_HUMAN)
LLLIGCWYV

SEQ ID NO: 115581 - protein, 9 aa, Artificial Sequence
  Description of Artificial Sequence: Synthetic peptide
  Seed: RRRNGYRAL (MAR1_HUMAN)
RQRNGYRAI

SEQ ID NO: 115582 - protein, 8 aa, Artificial Sequence
  Description of Artificial Sequence: Synthetic peptide
  Seed: LMDKSLHV (MAR1_HUMAN)
LFDKSLHF

SEQ ID NO: 115583 - protein, 8 aa, Artificial Sequence
  Description of Artificial Sequence: Synthetic peptide
  Seed: LMDKSLHV (MAR1_HUMAN)
LTDKSLHF

SEQ ID NO: 115584 - protein, 10 aa, Artificial Sequence
  Description of Artificial Sequence: Synthetic peptide
  Seed: DAHFIYGYPK (MAR1_HUMAN)
DVHFIYGYPR

SEQ ID NO: 115585 - protein, 9 aa, Artificial Sequence
  Description of Artificial Sequence: Synthetic peptide
  Seed: VVPNAPPAY (MAR1_HUMAN)
VMPNAPPAV

SEQ ID NO: 115586 - protein, 10 aa, Artificial Sequence
  Description of Artificial Sequence: Synthetic peptide
  Seed: EEAAGIGILT (MAR1_HUMAN)
EVAAGIGILV

SEQ ID NO: 115587 - protein, 10 aa, Artificial Sequence
  Description of Artificial Sequence: Synthetic peptide
  Seed: EEAAGIGILT (MAR1_HUMAN)
EIAAGIGILI

SEQ ID NO: 115588 - protein, 9 aa, Artificial Sequence
  Description of Artificial Sequence: Synthetic peptide
  Seed: LHVGTQCAL (MAR1_HUMAN)
LKVGTQCAM

SEQ ID NO: 115589 - protein, 9 aa, Artificial Sequence
  Description of Artificial Sequence: Synthetic peptide
  Seed: VILGVLLLI (MAR1_HUMAN)
VQLGVLLLM

SEQ ID NO: 115590 - protein, 9 aa, Artificial Sequence
  Description of Artificial Sequence: Synthetic peptide
  Seed: NAPPAYEKL (MAR1_HUMAN)
NPPPAYEKY

SEQ ID NO: 115591 - protein, 9 aa, Artificial Sequence
  Description of Artificial Sequence: Synthetic peptide
  Seed: EQSPPPYSP (MAR1_HUMAN)
EESPPPYSL

SEQ ID NO: 115592 - protein, 9 aa, Artificial Sequence
  Description of Artificial Sequence: Synthetic peptide
  Seed: RRRNGYRAL (MAR1_HUMAN)
RKRNGYRAY

SEQ ID NO: 115593 - protein, 9 aa, Artificial Sequence
  Description of Artificial Sequence: Synthetic peptide
  Seed: EEAAGIGIL (MAR1_HUMAN)
EEAAGIGIW

SEQ ID NO: 115594 - protein, 11 aa, Artificial Sequence
  Description of Artificial Sequence: Synthetic peptide
  Seed: RALMDKSLHVG (MAR1_HUMAN)
RFLMDKSLHVA

SEQ ID NO: 115595 - protein, 9 aa, Artificial Sequence
  Description of Artificial Sequence: Synthetic peptide
  Seed: KSLHVGTQC (MAR1_HUMAN)
KALHVGTQY

SEQ ID NO: 115596 - protein, 10 aa, Artificial Sequence
  Description of Artificial Sequence: Synthetic peptide
  Seed: GILTVILGVL (MAR1_HUMAN)
GMLTVILGVV

SEQ ID NO: 115597 - protein, 11 aa, Artificial Sequence
  Description of Artificial Sequence: Synthetic peptide
  Seed: EEAAGIGILTV (MAR1_HUMAN)
EEAAGIGILTF

SEQ ID NO: 115598 - protein, 11 aa, Artificial Sequence
  Description of Artificial Sequence: Synthetic peptide
  Seed: YRALMDKSLHV (MAR1_HUMAN)
YSALMDKSLHV

SEQ ID NO: 115599 - protein, 9 aa, Artificial Sequence
  Description of Artificial Sequence: Synthetic peptide
  Seed: VILGVLLLI (MAR1_HUMAN)
VVLGVLLLI

SEQ ID NO: 115600 - protein, 9 aa, Artificial Sequence
  Description of Artificial Sequence: Synthetic peptide
  Seed: KSLHVGTQC (MAR1_HUMAN)
KTLHVGTQF

SEQ ID NO: 115601 - protein, 9 aa, Artificial Sequence
  Description of Artificial Sequence: Synthetic peptide
  Seed: NGYRALMDK (MAR1_HUMAN)
NAYRALMDK

SEQ ID NO: 115602 - protein, 9 aa, Artificial Sequence
  Description of Artificial Sequence: Synthetic peptide
  Seed: EAAGIGILT (MAR1_HUMAN)
EIAGIGILL

SEQ ID NO: 115603 - protein, 10 aa, Artificial Sequence
  Description of Artificial Sequence: Synthetic peptide
  Seed: APPAYEKLSA (MAR1_HUMAN)
ALPAYEKLSL

SEQ ID NO: 115604 - protein, 9 aa, Artificial Sequence
  Description of Artificial Sequence: Synthetic peptide
  Seed: LHVGTQCAL (MAR1_HUMAN)
LTVGTQCAF

SEQ ID NO: 115605 - protein, 9 aa, Artificial Sequence
  Description of Artificial Sequence: Synthetic peptide
  Seed: VVPNAPPAY (MAR1_HUMAN)
VYPNAPPAV

SEQ ID NO: 115606 - protein, 10 aa, Artificial Sequence
  Description of Artificial Sequence: Synthetic peptide
  Seed: EAAGIGILTV (MAR1_HUMAN)
EIAGIGILTI

SEQ ID NO: 115607 - protein, 10 aa, Artificial Sequence
  Description of Artificial Sequence: Synthetic peptide
  Seed: SLHVGTQCAL (MAR1_HUMAN)
SLHVGTQCAV

SEQ ID NO: 115608 - protein, 9 aa, Artificial Sequence
  Description of Artificial Sequence: Synthetic peptide
  Seed: NAPPAYEKL (MAR1_HUMAN)
NPPPAYEKV

SEQ ID NO: 115609 - protein, 11 aa, Artificial Sequence
  Description of Artificial Sequence: Synthetic peptide
  Seed: RALMDKSLHVG (MAR1_HUMAN)
RCLMDKSLHVV

SEQ ID NO: 115610 - protein, 9 aa, Artificial Sequence
  Description of Artificial Sequence: Synthetic peptide
  Seed: NAPPAYEKL (MAR1_HUMAN)
NTPPAYEKR

SEQ ID NO: 115611 - protein, 10 aa, Artificial Sequence
  Description of Artificial Sequence: Synthetic peptide
  Seed: LSAEQSPPPY (MAR1_HUMAN)
LIAEQSPPPY

SEQ ID NO: 115612 - protein, 8 aa, Artificial Sequence
  Description of Artificial Sequence: Synthetic peptide
  Seed: LMDKSLHV (MAR1_HUMAN)
LMDKSLHL

SEQ ID NO: 115613 - protein, 9 aa, Artificial Sequence
  Description of Artificial Sequence: Synthetic peptide
  Seed: AAGIGILTV (MAR1_HUMAN)
ALGIGILTI

SEQ ID NO: 115614 - protein, 10 aa, Artificial Sequence
  Description of Artificial Sequence: Synthetic peptide
  Seed: ALMDKSLHVG (MAR1_HUMAN)
ALMDKSLHVN

SEQ ID NO: 115615 - protein, 11 aa, Artificial Sequence
  Description of Artificial Sequence: Synthetic peptide
  Seed: RALMDKSLHVG (MAR1_HUMAN)
RLLMDKSLHVV

SEQ ID NO: 115616 - protein, 10 aa, Artificial Sequence
  Description of Artificial Sequence: Synthetic peptide
  Seed: YPKKGHGHSY (MAR1_HUMAN)
YPKKGHGHSM

SEQ ID NO: 115617 - protein, 9 aa, Artificial Sequence
  Description of Artificial Sequence: Synthetic peptide
  Seed: NAPPAYEKL (MAR1_HUMAN)
NAPPAYEKF

SEQ ID NO: 115618 - protein, 10 aa, Artificial Sequence
  Description of Artificial Sequence: Synthetic peptide
  Seed: RDSKVSLQEK (MAR1_HUMAN)
RFSKVSLQEA

SEQ ID NO: 115619 - protein, 9 aa, Artificial Sequence
  Description of Artificial Sequence: Synthetic peptide
  Seed: RRNGYRALM (MAR1_HUMAN)
RQNGYRALM

SEQ ID NO: 115620 - protein, 10 aa, Artificial Sequence
  Description of Artificial Sequence: Synthetic peptide
  Seed: SLHVGTQCAL (MAR1_HUMAN)
SLHVGTQCAY

SEQ ID NO: 115621 - protein, 8 aa, Artificial Sequence
  Description of Artificial Sequence: Synthetic peptide
  Seed: LMDKSLHV (MAR1_HUMAN)
LLDKSLHL

SEQ ID NO: 115622 - protein, 10 aa, Artificial Sequence
  Description of Artificial Sequence: Synthetic peptide
  Seed: MPREDAHFIY (MAR1_HUMAN)
MQREDAHFIL

SEQ ID NO: 115623 - protein, 9 aa, Artificial Sequence
  Description of Artificial Sequence: Synthetic peptide
  Seed: MPREDAHFI (MAR1_HUMAN)
MIREDAHFY

SEQ ID NO: 115624 - protein, 11 aa, Artificial Sequence
  Description of Artificial Sequence: Synthetic peptide
  Seed: YRALMDKSLHV (MAR1_HUMAN)
YMALMDKSLHA

SEQ ID NO: 115625 - protein, 9 aa, Artificial Sequence
  Description of Artificial Sequence: Synthetic peptide
  Seed: GILTVILGV (MAR1_HUMAN)
GILTVILGR

SEQ ID NO: 115626 - protein, 10 aa, Artificial Sequence
  Description of Artificial Sequence: Synthetic peptide
  Seed: YGYPKKGHGH (MAR1_HUMAN)
YSYPKKGHGM

SEQ ID NO: 115627 - protein, 9 aa, Artificial Sequence
  Description of Artificial Sequence: Synthetic peptide
  Seed: AHFIYGYPK (MAR1_HUMAN)
AAFIYGYPR

SEQ ID NO: 115628 - protein, 10 aa, Artificial Sequence
  Description of Artificial Sequence: Synthetic peptide
  Seed: YPKKGHGHSY (MAR1_HUMAN)
YPKKGHGHSI

SEQ ID NO: 115629 - protein, 8 aa, Artificial Sequence
  Description of Artificial Sequence: Synthetic peptide
  Seed: APPAYEKL (MAR1_HUMAN)
AAPAYEKL

SEQ ID NO: 115630 - protein, 8 aa, Artificial Sequence
  Description of Artificial Sequence: Synthetic peptide
  Seed: LMDKSLHV (MAR1_HUMAN)
LADKSLHI

SEQ ID NO: 115631 - protein, 9 aa, Artificial Sequence
  Description of Artificial Sequence: Synthetic peptide
  Seed: VVPNAPPAY (MAR1_HUMAN)
VGPNAPPAI

SEQ ID NO: 115632 - protein, 9 aa, Artificial Sequence
  Description of Artificial Sequence: Synthetic peptide
  Seed: TTAEEAAGI (MAR1_HUMAN)
TLAEEAAGM

SEQ ID NO: 115633 - protein, 10 aa, Artificial Sequence
  Description of Artificial Sequence: Synthetic peptide
  Seed: ALMDKSLHVG (MAR1_HUMAN)
AMMDKSLHVH

SEQ ID NO: 115634 - protein, 9 aa, Artificial Sequence
  Description of Artificial Sequence: Synthetic peptide
  Seed: NAPPAYEKL (MAR1_HUMAN)
NAPPAYEKM

SEQ ID NO: 115635 - protein, 10 aa, Artificial Sequence
  Description of Artificial Sequence: Synthetic peptide
  Seed: ALMDKSLHVG (MAR1_HUMAN)
ATMDKSLHVV

SEQ ID NO: 115636 - protein, 9 aa, Artificial Sequence
  Description of Artificial Sequence: Synthetic peptide
  Seed: MPREDAHFI (MAR1_HUMAN)
MAREDAHFW

SEQ ID NO: 115637 - protein, 10 aa, Artificial Sequence
  Description of Artificial Sequence: Synthetic peptide
  Seed: RRRNGYRALM (MAR1_HUMAN)
RSRNGYRALY

SEQ ID NO: 115638 - protein, 9 aa, Artificial Sequence
  Description of Artificial Sequence: Synthetic peptide
  Seed: EQSPPPYSP (MAR1_HUMAN)
EHSPPPYSL

SEQ ID NO: 115639 - protein, 9 aa, Artificial Sequence
  Description of Artificial Sequence: Synthetic peptide
  Seed: VILGVLLLI (MAR1_HUMAN)
VILGVLLLA

SEQ ID NO: 115640 - protein, 10 aa, Artificial Sequence
  Description of Artificial Sequence: Synthetic peptide
  Seed: RRRNGYRALM (MAR1_HUMAN)
RIRNGYRALY

SEQ ID NO: 115641 - protein, 10 aa, Artificial Sequence
  Description of Artificial Sequence: Synthetic peptide
  Seed: DAHFIYGYPK (MAR1_HUMAN)
DAHFIYGYPR

SEQ ID NO: 115642 - protein, 10 aa, Artificial Sequence
  Description of Artificial Sequence: Synthetic peptide
  Seed: KGHGHSYTTA (MAR1_HUMAN)
KTHGHSYTTV

SEQ ID NO: 115643 - protein, 9 aa, Artificial Sequence
  Description of Artificial Sequence: Synthetic peptide
  Seed: AEEAAGIGI (MAR1_HUMAN)
AEEAAGIGF

SEQ ID NO: 115644 - protein, 10 aa, Artificial Sequence
  Description of Artificial Sequence: Synthetic peptide
  Seed: RRRNGYRALM (MAR1_HUMAN)
RWRNGYRALK

SEQ ID NO: 115645 - protein, 9 aa, Artificial Sequence
  Description of Artificial Sequence: Synthetic peptide
  Seed: ALMDKSLHV (MAR1_HUMAN)
ASMDKSLHI

SEQ ID NO: 115646 - protein, 9 aa, Artificial Sequence
  Description of Artificial Sequence: Synthetic peptide
  Seed: EDAHFIYGY (MAR1_HUMAN)
ETAHFIYGI

SEQ ID NO: 115647 - protein, 11 aa, Artificial Sequence
  Description of Artificial Sequence: Synthetic peptide
  Seed: YRALMDKSLHV (MAR1_HUMAN)
YNALMDKSLHV

SEQ ID NO: 115648 - protein, 9 aa, Artificial Sequence
  Description of Artificial Sequence: Synthetic peptide
  Seed: NGYRALMDK (MAR1_HUMAN)
NTYRALMDR

SEQ ID NO: 115649 - protein, 10 aa, Artificial Sequence
  Description of Artificial Sequence: Synthetic peptide
  Seed: KGHGHSYTTA (MAR1_HUMAN)
KIHGHSYTTK

SEQ ID NO: 115650 - protein, 9 aa, Artificial Sequence
  Description of Artificial Sequence: Synthetic peptide
  Seed: ALMDKSLHV (MAR1_HUMAN)
AQMDKSLHM

SEQ ID NO: 115651 - protein, 10 aa, Artificial Sequence
  Description of Artificial Sequence: Synthetic peptide
  Seed: EAAGIGILTV (MAR1_HUMAN)
EAAGIGILTL

SEQ ID NO: 115652 - protein, 9 aa, Artificial Sequence
  Description of Artificial Sequence: Synthetic peptide
  Seed: GYPKKGHGH (MAR1_HUMAN)
GFPKKGHGF

SEQ ID NO: 115653 - protein, 11 aa, Artificial Sequence
  Description of Artificial Sequence: Synthetic peptide
  Seed: TTAEEAAGIGI (MAR1_HUMAN)
TSAEEAAGIGF

SEQ ID NO: 115654 - protein, 9 aa, Artificial Sequence
  Description of Artificial Sequence: Synthetic peptide
  Seed: GILTVILGV (MAR1_HUMAN)
GTLTVILGI

SEQ ID NO: 115655 - protein, 10 aa, Artificial Sequence
  Description of Artificial Sequence: Synthetic peptide
  Seed: SLHVGTQCAL (MAR1_HUMAN)
SMHVGTQCAV

SEQ ID NO: 115656 - protein, 10 aa, Artificial Sequence
  Description of Artificial Sequence: Synthetic peptide
  Seed: ALMDKSLHVG (MAR1_HUMAN)
ALMDKSLHVM

SEQ ID NO: 115657 - protein, 10 aa, Artificial Sequence
  Description of Artificial Sequence: Synthetic peptide
  Seed: RDSKVSLQEK (MAR1_HUMAN)
RVSKVSLQEK

SEQ ID NO: 115658 - protein, 9 aa, Artificial Sequence
  Description of Artificial Sequence: Synthetic peptide
  Seed: VVPNAPPAY (MAR1_HUMAN)
VLPNAPPAF

SEQ ID NO: 115659 - protein, 9 aa, Artificial Sequence
  Description of Artificial Sequence: Synthetic peptide
  Seed: AEQSPPPYS (MAR1_HUMAN)
AEQSPPPYI

SEQ ID NO: 115660 - protein, 9 aa, Artificial Sequence
  Description of Artificial Sequence: Synthetic peptide
  Seed: GILTVILGV (MAR1_HUMAN)
GQLTVILGV

SEQ ID NO: 115661 - protein, 9 aa, Artificial Sequence
  Description of Artificial Sequence: Synthetic peptide
  Seed: NAPPAYEKL (MAR1_HUMAN)
NSPPAYEKY

SEQ ID NO: 115662 - protein, 10 aa, Artificial Sequence
  Description of Artificial Sequence: Synthetic peptide
  Seed: ALMDKSLHVG (MAR1_HUMAN)
ALMDKSLHVW

SEQ ID NO: 115663 - protein, 9 aa, Artificial Sequence
  Description of Artificial Sequence: Synthetic peptide
  Seed: HFIYGYPKK (MAR1_HUMAN)
HAIYGYPKR

SEQ ID NO: 115664 - protein, 10 aa, Artificial Sequence
  Description of Artificial Sequence: Synthetic peptide
  Seed: RRNGYRALMD (MAR1_HUMAN)
RRNGYRALMM

SEQ ID NO: 115665 - protein, 9 aa, Artificial Sequence
  Description of Artificial Sequence: Synthetic peptide
  Seed: NAPPAYEKL (MAR1_HUMAN)
NYPPAYEKM

SEQ ID NO: 115666 - protein, 10 aa, Artificial Sequence
  Description of Artificial Sequence: Synthetic peptide
  Seed: ALMDKSLHVG (MAR1_HUMAN)
APMDKSLHVV

SEQ ID NO: 115667 - protein, 9 aa, Artificial Sequence
  Description of Artificial Sequence: Synthetic peptide
  Seed: VILGVLLLI (MAR1_HUMAN)
VLLGVLLLR

SEQ ID NO: 115668 - protein, 10 aa, Artificial Sequence
  Description of Artificial Sequence: Synthetic peptide
  Seed: RRRNGYRALM (MAR1_HUMAN)
RPRNGYRALL

SEQ ID NO: 115669 - protein, 9 aa, Artificial Sequence
  Description of Artificial Sequence: Synthetic peptide
  Seed: RRRNGYRAL (MAR1_HUMAN)
RQRNGYRAM

SEQ ID NO: 115670 - protein, 11 aa, Artificial Sequence
  Description of Artificial Sequence: Synthetic peptide
  Seed: YCRRRNGYRAL (MAR1_HUMAN)
YPRRRNGYRAM

SEQ ID NO: 115671 - protein, 10 aa, Artificial Sequence
  Description of Artificial Sequence: Synthetic peptide
  Seed: YTTAEEAAGI (MAR1_HUMAN)
YGTAEEAAGI

SEQ ID NO: 115672 - protein, 10 aa, Artificial Sequence
  Description of Artificial Sequence: Synthetic peptide
  Seed: KGHGHSYTTA (MAR1_HUMAN)
KFHGHSYTTK

SEQ ID NO: 115673 - protein, 9 aa, Artificial Sequence
  Description of Artificial Sequence: Synthetic peptide
  Seed: LHVGTQCAL (MAR1_HUMAN)
LIVGTQCAF

SEQ ID NO: 115674 - protein, 9 aa, Artificial Sequence
  Description of Artificial Sequence: Synthetic peptide
  Seed: EAAGIGILT (MAR1_HUMAN)
EVAGIGILV

SEQ ID NO: 115675 - protein, 10 aa, Artificial Sequence
  Description of Artificial Sequence: Synthetic peptide
  Seed: RRRNGYRALM (MAR1_HUMAN)
RIRNGYRALK

SEQ ID NO: 115676 - protein, 9 aa, Artificial Sequence
  Description of Artificial Sequence: Synthetic peptide
  Seed: AEEAAGIGI (MAR1_HUMAN)
AEEAAGIGA

SEQ ID NO: 115677 - protein, 9 aa, Artificial Sequence
  Description of Artificial Sequence: Synthetic peptide
  Seed: VVPNAPPAY (MAR1_HUMAN)
VLPNAPPAL

SEQ ID NO: 115678 - protein, 9 aa, Artificial Sequence
  Description of Artificial Sequence: Synthetic peptide
  Seed: EQSPPPYSP (MAR1_HUMAN)
EESPPPYSS

SEQ ID NO: 115679 - protein, 10 aa, Artificial Sequence
  Description of Artificial Sequence: Synthetic peptide
  Seed: ALMDKSLHVG (MAR1_HUMAN)
AVMDKSLHVI

SEQ ID NO: 115680 - protein, 9 aa, Artificial Sequence
  Description of Artificial Sequence: Synthetic peptide
  Seed: EGFDHRDSK (MAR1_HUMAN)
EYFDHRDSR

SEQ ID NO: 115681 - protein, 9 aa, Artificial Sequence
  Description of Artificial Sequence: Synthetic peptide
  Seed: ALMDKSLHV (MAR1_HUMAN)
AMMDKSLHK

SEQ ID NO: 115682 - protein, 9 aa, Artificial Sequence
  Description of Artificial Sequence: Synthetic peptide
  Seed: EAAGIGILT (MAR1_HUMAN)
EVAGIGILI

SEQ ID NO: 115683 - protein, 10 aa, Artificial Sequence
  Description of Artificial Sequence: Synthetic peptide
  Seed: DAHFIYGYPK (MAR1_HUMAN)
DIHFIYGYPR

SEQ ID NO: 115684 - protein, 9 aa, Artificial Sequence
  Description of Artificial Sequence: Synthetic peptide
  Seed: LTVILGVLL (MAR1_HUMAN)
LSVILGVLM

SEQ ID NO: 115685 - protein, 10 aa, Artificial Sequence
  Description of Artificial Sequence: Synthetic peptide
  Seed: AHFIYGYPKK (MAR1_HUMAN)
ASFIYGYPKR

SEQ ID NO: 115686 - protein, 9 aa, Artificial Sequence
  Description of Artificial Sequence: Synthetic peptide
  Seed: RRRNGYRAL (MAR1_HUMAN)
RYRNGYRAF

SEQ ID NO: 115687 - protein, 11 aa, Artificial Sequence
  Description of Artificial Sequence: Synthetic peptide
  Seed: YRALMDKSLHV (MAR1_HUMAN)
YHALMDKSLHI

SEQ ID NO: 115688 - protein, 10 aa, Artificial Sequence
  Description of Artificial Sequence: Synthetic peptide
  Seed: EEAAGIGILT (MAR1_HUMAN)
EQAAGIGILI

SEQ ID NO: 115689 - protein, 9 aa, Artificial Sequence
  Description of Artificial Sequence: Synthetic peptide
  Seed: EAAGIGILT (MAR1_HUMAN)
ESAGIGILI

SEQ ID NO: 115690 - protein, 11 aa, Artificial Sequence
  Description of Artificial Sequence: Synthetic peptide
  Seed: YRALMDKSLHV (MAR1_HUMAN)
YQALMDKSLHA

SEQ ID NO: 115691 - protein, 9 aa, Artificial Sequence
  Description of Artificial Sequence: Synthetic peptide
  Seed: NAPPAYEKL (MAR1_HUMAN)
NTPPAYEKF

SEQ ID NO: 115692 - protein, 10 aa, Artificial Sequence
  Description of Artificial Sequence: Synthetic peptide
  Seed: AHFIYGYPKK (MAR1_HUMAN)
AFFIYGYPKK

SEQ ID NO: 115693 - protein, 8 aa, Artificial Sequence
  Description of Artificial Sequence: Synthetic peptide
  Seed: LMDKSLHV (MAR1_HUMAN)
LVDKSLHI

SEQ ID NO: 115694 - protein, 9 aa, Artificial Sequence
  Description of Artificial Sequence: Synthetic peptide
  Seed: VVPNAPPAY (MAR1_HUMAN)
VRPNAPPAI

SEQ ID NO: 115695 - protein, 10 aa, Artificial Sequence
  Description of Artificial Sequence: Synthetic peptide
  Seed: LLLIGCWYCR (MAR1_HUMAN)
LALIGCWYCR

SEQ ID NO: 115696 - protein, 9 aa, Artificial Sequence
  Description of Artificial Sequence: Synthetic peptide
  Seed: LHVGTQCAL (MAR1_HUMAN)
LAVGTQCAF

SEQ ID NO: 115697 - protein, 10 aa, Artificial Sequence
  Description of Artificial Sequence: Synthetic peptide
  Seed: YTTAEEAAGI (MAR1_HUMAN)
YLTAEEAAGA

SEQ ID NO: 115698 - protein, 10 aa, Artificial Sequence
  Description of Artificial Sequence: Synthetic peptide
  Seed: RALMDKSLHV (MAR1_HUMAN)
RSLMDKSLHV

SEQ ID NO: 115699 - protein, 9 aa, Artificial Sequence
  Description of Artificial Sequence: Synthetic peptide
  Seed: HSYTTAEEA (MAR1_HUMAN)
HTYTTAEEM

SEQ ID NO: 115700 - protein, 9 aa, Artificial Sequence
  Description of Artificial Sequence: Synthetic peptide
  Seed: AAGIGILTV (MAR1_HUMAN)
ASGIGILTL

SEQ ID NO: 115701 - protein, 8 aa, Artificial Sequence
  Description of Artificial Sequence: Synthetic peptide
  Seed: HRDSKVSL (MAR1_HUMAN)
HYDSKVSV

SEQ ID NO: 115702 - protein, 10 aa, Artificial Sequence
  Description of Artificial Sequence: Synthetic peptide
  Seed: MPREDAHFIY (MAR1_HUMAN)
MPREDAHFIL

SEQ ID NO: 115703 - protein, 10 aa, Artificial Sequence
  Description of Artificial Sequence: Synthetic peptide
  Seed: DAHFIYGYPK (MAR1_HUMAN)
DQHFIYGYPR

SEQ ID NO: 115704 - protein, 9 aa, Artificial Sequence
  Description of Artificial Sequence: Synthetic peptide
  Seed: LLLIGCWYC (MAR1_HUMAN)
LILIGCWYV

SEQ ID NO: 115705 - protein, 9 aa, Artificial Sequence
  Description of Artificial Sequence: Synthetic peptide
  Seed: AGIGILTVI (MAR1_HUMAN)
AVIGILTVL

SEQ ID NO: 115706 - protein, 10 aa, Artificial Sequence
  Description of Artificial Sequence: Synthetic peptide
  Seed: RALMDKSLHV (MAR1_HUMAN)
RRLMDKSLHI

SEQ ID NO: 115707 - protein, 9 aa, Artificial Sequence
  Description of Artificial Sequence: Synthetic peptide
  Seed: LHVGTQCAL (MAR1_HUMAN)
LQVGTQCAW

SEQ ID NO: 115708 - protein, 10 aa, Artificial Sequence
  Description of Artificial Sequence: Synthetic peptide
  Seed: RALMDKSLHV (MAR1_HUMAN)
RCLMDKSLHV

SEQ ID NO: 115709 - protein, 9 aa, Artificial Sequence
  Description of Artificial Sequence: Synthetic peptide
  Seed: VVPNAPPAY (MAR1_HUMAN)
VTPNAPPAW

SEQ ID NO: 115710 - protein, 9 aa, Artificial Sequence
  Description of Artificial Sequence: Synthetic peptide
  Seed: HSYTTAEEA (MAR1_HUMAN)
HSYTTAEEL

SEQ ID NO: 115711 - protein, 10 aa, Artificial Sequence
  Description of Artificial Sequence: Synthetic peptide
  Seed: ALMDKSLHVG (MAR1_HUMAN)
ALMDKSLHVR

SEQ ID NO: 115712 - protein, 9 aa, Artificial Sequence
  Description of Artificial Sequence: Synthetic peptide
  Seed: GILTVILGV (MAR1_HUMAN)
GMLTVILGL

SEQ ID NO: 115713 - protein, 11 aa, Artificial Sequence
  Description of Artificial Sequence: Synthetic peptide
  Seed: AEEAAGIGILT (MAR1_HUMAN)
AEEAAGIGILA

SEQ ID NO: 115714 - protein, 9 aa, Artificial Sequence
  Description of Artificial Sequence: Synthetic peptide
  Seed: EGFDHRDSK (MAR1_HUMAN)
EVFDHRDSR

SEQ ID NO: 115715 - protein, 9 aa, Artificial Sequence
  Description of Artificial Sequence: Synthetic peptide
  Seed: MPREDAHFI (MAR1_HUMAN)
MIREDAHFF

SEQ ID NO: 115716 - protein, 10 aa, Artificial Sequence
  Description of Artificial Sequence: Synthetic peptide
  Seed: YPKKGHGHSY (MAR1_HUMAN)
YEKKGHGHSY

SEQ ID NO: 115717 - protein, 9 aa, Artificial Sequence
  Description of Artificial Sequence: Synthetic peptide
  Seed: EDAHFIYGY (MAR1_HUMAN)
EFAHFIYGY

SEQ ID NO: 115718 - protein, 9 aa, Artificial Sequence
  Description of Artificial Sequence: Synthetic peptide
  Seed: ALMDKSLHV (MAR1_HUMAN)
AQMDKSLHR

SEQ ID NO: 115719 - protein, 9 aa, Artificial Sequence
  Description of Artificial Sequence: Synthetic peptide
  Seed: NAPPAYEKL (MAR1_HUMAN)
NLPPAYEKM

SEQ ID NO: 115720 - protein, 9 aa, Artificial Sequence
  Description of Artificial Sequence: Synthetic peptide
  Seed: QEKNCEPVV (MAR1_HUMAN)
QEKNCEPVA

SEQ ID NO: 115721 - protein, 10 aa, Artificial Sequence
  Description of Artificial Sequence: Synthetic peptide
  Seed: YTTAEEAAGI (MAR1_HUMAN)
YQTAEEAAGV

SEQ ID NO: 115722 - protein, 10 aa, Artificial Sequence
  Description of Artificial Sequence: Synthetic peptide
  Seed: RRRNGYRALM (MAR1_HUMAN)
RWRNGYRALM

SEQ ID NO: 115723 - protein, 9 aa, Artificial Sequence
  Description of Artificial Sequence: Synthetic peptide
  Seed: VILGVLLLI (MAR1_HUMAN)
VTLGVLLLW

SEQ ID NO: 115724 - protein, 10 aa, Artificial Sequence
  Description of Artificial Sequence: Synthetic peptide
  Seed: TVILGVLLLI (MAR1_HUMAN)
TAILGVLLLV

SEQ ID NO: 115725 - protein, 10 aa, Artificial Sequence
  Description of Artificial Sequence: Synthetic peptide
  Seed: EAAGIGILTV (MAR1_HUMAN)
ESAGIGILTL

SEQ ID NO: 115726 - protein, 9 aa, Artificial Sequence
  Description of Artificial Sequence: Synthetic peptide
  Seed: NAPPAYEKL (MAR1_HUMAN)
NHPPAYEKF

SEQ ID NO: 115727 - protein, 9 aa, Artificial Sequence
  Description of Artificial Sequence: Synthetic peptide
  Seed: TRRCPQEGF (MAR1_HUMAN)
TQRCPQEGY

SEQ ID NO: 115728 - protein, 9 aa, Artificial Sequence
  Description of Artificial Sequence: Synthetic peptide
  Seed: KSLHVGTQC (MAR1_HUMAN)
KTLHVGTQV

SEQ ID NO: 115729 - protein, 11 aa, Artificial Sequence
  Description of Artificial Sequence: Synthetic peptide
  Seed: YRALMDKSLHV (MAR1_HUMAN)
YSALMDKSLHI

SEQ ID NO: 115730 - protein, 9 aa, Artificial Sequence
  Description of Artificial Sequence: Synthetic peptide
  Seed: VVPNAPPAY (MAR1_HUMAN)
VAPNAPPAL

SEQ ID NO: 115731 - protein, 9 aa, Artificial Sequence
  Description of Artificial Sequence: Synthetic peptide
  Seed: AHFIYGYPK (MAR1_HUMAN)
AWFIYGYPR

SEQ ID NO: 115732 - protein, 9 aa, Artificial Sequence
  Description of Artificial Sequence: Synthetic peptide
  Seed: EGFDHRDSK (MAR1_HUMAN)
EAFDHRDSR

SEQ ID NO: 115733 - protein, 10 aa, Artificial Sequence
  Description of Artificial Sequence: Synthetic peptide
  Seed: AEEAAGIGIL (MAR1_HUMAN)
AEEAAGIGIV

SEQ ID NO: 115734 - protein, 10 aa, Artificial Sequence
  Description of Artificial Sequence: Synthetic peptide
  Seed: TVILGVLLLI (MAR1_HUMAN)
TCILGVLLLV

SEQ ID NO: 115735 - protein, 10 aa, Artificial Sequence
  Description of Artificial Sequence: Synthetic peptide
  Seed: RRRNGYRALM (MAR1_HUMAN)
RRRNGYRALL

SEQ ID NO: 115736 - protein, 10 aa, Artificial Sequence
  Description of Artificial Sequence: Synthetic peptide
  Seed: YPKKGHGHSY (MAR1_HUMAN)
YAKKGHGHSY

SEQ ID NO: 115737 - protein, 10 aa, Artificial Sequence
  Description of Artificial Sequence: Synthetic peptide
  Seed: ALMDKSLHVG (MAR1_HUMAN)
ATMDKSLHVI

SEQ ID NO: 115738 - protein, 10 aa, Artificial Sequence
  Description of Artificial Sequence: Synthetic peptide
  Seed: YGYPKKGHGH (MAR1_HUMAN)
YGYPKKGHGY

SEQ ID NO: 115739 - protein, 9 aa, Artificial Sequence
  Description of Artificial Sequence: Synthetic peptide
  Seed: AGIGILTVI (MAR1_HUMAN)
ALIGILTVF

SEQ ID NO: 115740 - protein, 9 aa, Artificial Sequence
  Description of Artificial Sequence: Synthetic peptide
  Seed: EGFDHRDSK (MAR1_HUMAN)
EAFDHRDSY

SEQ ID NO: 115741 - protein, 10 aa, Artificial Sequence
  Description of Artificial Sequence: Synthetic peptide
  Seed: ALMDKSLHVG (MAR1_HUMAN)
AFMDKSLHVV

SEQ ID NO: 115742 - protein, 10 aa, Artificial Sequence
  Description of Artificial Sequence: Synthetic peptide
  Seed: RRRNGYRALM (MAR1_HUMAN)
RCRNGYRALK

SEQ ID NO: 115743 - protein, 10 aa, Artificial Sequence
  Description of Artificial Sequence: Synthetic peptide
  Seed: ALMDKSLHVG (MAR1_HUMAN)
AAMDKSLHVI

SEQ ID NO: 115744 - protein, 11 aa, Artificial Sequence
  Description of Artificial Sequence: Synthetic peptide
  Seed: YRALMDKSLHV (MAR1_HUMAN)
YKALMDKSLHA

SEQ ID NO: 115745 - protein, 9 aa, Artificial Sequence
  Description of Artificial Sequence: Synthetic peptide
  Seed: LIGCWYCRR (MAR1_HUMAN)
LVGCWYCRR

SEQ ID NO: 115746 - protein, 9 aa, Artificial Sequence
  Description of Artificial Sequence: Synthetic peptide
  Seed: VGTQCALTR (MAR1_HUMAN)
VATQCALTM

SEQ ID NO: 115747 - protein, 11 aa, Artificial Sequence
  Description of Artificial Sequence: Synthetic peptide
  Seed: TTAEEAAGIGI (MAR1_HUMAN)
TAAEEAAGIGW

SEQ ID NO: 115748 - protein, 9 aa, Artificial Sequence
  Description of Artificial Sequence: Synthetic peptide
  Seed: LLLIGCWYC (MAR1_HUMAN)
LVLIGCWYV

SEQ ID NO: 115749 - protein, 9 aa, Artificial Sequence
  Description of Artificial Sequence: Synthetic peptide
  Seed: HSYTTAEEA (MAR1_HUMAN)
HIYTTAEEF

SEQ ID NO: 115750 - protein, 8 aa, Artificial Sequence
  Description of Artificial Sequence: Synthetic peptide
  Seed: AGIGILTV (MAR1_HUMAN)
AQIGILTV

SEQ ID NO: 115751 - protein, 8 aa, Artificial Sequence
  Description of Artificial Sequence: Synthetic peptide
  Seed: LMDKSLHV (MAR1_HUMAN)
LFDKSLHI

SEQ ID NO: 115752 - protein, 10 aa, Artificial Sequence
  Description of Artificial Sequence: Synthetic peptide
  Seed: EAAGIGILTV (MAR1_HUMAN)
ELAGIGILTL

SEQ ID NO: 115753 - protein, 10 aa, Artificial Sequence
  Description of Artificial Sequence: Synthetic peptide
  Seed: APPAYEKLSA (MAR1_HUMAN)
AAPAYEKLSL

SEQ ID NO: 115754 - protein, 10 aa, Artificial Sequence
  Description of Artificial Sequence: Synthetic peptide
  Seed: RALMDKSLHV (MAR1_HUMAN)
RKLMDKSLHI

SEQ ID NO: 115755 - protein, 10 aa, Artificial Sequence
  Description of Artificial Sequence: Synthetic peptide
  Seed: IGILTVILGV (MAR1_HUMAN)
INILTVILGV

SEQ ID NO: 115756 - protein, 10 aa, Artificial Sequence
  Description of Artificial Sequence: Synthetic peptide
  Seed: ALMDKSLHVG (MAR1_HUMAN)
AGMDKSLHVV

SEQ ID NO: 115757 - protein, 10 aa, Artificial Sequence
  Description of Artificial Sequence: Synthetic peptide
  Seed: DAHFIYGYPK (MAR1_HUMAN)
DVHFIYGYPK

SEQ ID NO: 115758 - protein, 9 aa, Artificial Sequence
  Description of Artificial Sequence: Synthetic peptide
  Seed: ALMDKSLHV (MAR1_HUMAN)
AEMDKSLHI

SEQ ID NO: 115759 - protein, 9 aa, Artificial Sequence
  Description of Artificial Sequence: Synthetic peptide
  Seed: AGIGILTVI (MAR1_HUMAN)
AMIGILTVA

SEQ ID NO: 115760 - protein, 9 aa, Artificial Sequence
  Description of Artificial Sequence: Synthetic peptide
  Seed: NAPPAYEKL (MAR1_HUMAN)
NVPPAYEKY

SEQ ID NO: 115761 - protein, 10 aa, Artificial Sequence
  Description of Artificial Sequence: Synthetic peptide
  Seed: EEAAGIGILT (MAR1_HUMAN)
EVAAGIGILI

SEQ ID NO: 115762 - protein, 10 aa, Artificial Sequence
  Description of Artificial Sequence: Synthetic peptide
  Seed: ALMDKSLHVG (MAR1_HUMAN)
AAMDKSLHVV

SEQ ID NO: 115763 - protein, 10 aa, Artificial Sequence
  Description of Artificial Sequence: Synthetic peptide
  Seed: LLLIGCWYCR (MAR1_HUMAN)
LFLIGCWYCR

SEQ ID NO: 115764 - protein, 10 aa, Artificial Sequence
  Description of Artificial Sequence: Synthetic peptide
  Seed: IGILTVILGV (MAR1_HUMAN)
ITILTVILGV

SEQ ID NO: 115765 - protein, 9 aa, Artificial Sequence
  Description of Artificial Sequence: Synthetic peptide
  Seed: VILGVLLLI (MAR1_HUMAN)
VILGVLLLL

SEQ ID NO: 115766 - protein, 10 aa, Artificial Sequence
  Description of Artificial Sequence: Synthetic peptide
  Seed: ALMDKSLHVG (MAR1_HUMAN)
ATMDKSLHVL

SEQ ID NO: 115767 - protein, 9 aa, Artificial Sequence
  Description of Artificial Sequence: Synthetic peptide
  Seed: HSYTTAEEA (MAR1_HUMAN)
HVYTTAEEF

SEQ ID NO: 115768 - protein, 10 aa, Artificial Sequence
  Description of Artificial Sequence: Synthetic peptide
  Seed: RALMDKSLHV (MAR1_HUMAN)
RMLMDKSLHA

SEQ ID NO: 115769 - protein, 10 aa, Artificial Sequence
  Description of Artificial Sequence: Synthetic peptide
  Seed: DAHFIYGYPK (MAR1_HUMAN)
DTHFIYGYPR

SEQ ID NO: 115770 - protein, 11 aa, Artificial Sequence
  Description of Artificial Sequence: Synthetic peptide
  Seed: RALMDKSLHVG (MAR1_HUMAN)
RFLMDKSLHVV

SEQ ID NO: 115771 - protein, 10 aa, Artificial Sequence
  Description of Artificial Sequence: Synthetic peptide
  Seed: RALMDKSLHV (MAR1_HUMAN)
RILMDKSLHL

SEQ ID NO: 115772 - protein, 10 aa, Artificial Sequence
  Description of Artificial Sequence: Synthetic peptide
  Seed: YPKKGHGHSY (MAR1_HUMAN)
YVKKGHGHSF

SEQ ID NO: 115773 - protein, 10 aa, Artificial Sequence
  Description of Artificial Sequence: Synthetic peptide
  Seed: APPAYEKLSA (MAR1_HUMAN)
AFPAYEKLSL

SEQ ID NO: 115774 - protein, 9 aa, Artificial Sequence
  Description of Artificial Sequence: Synthetic peptide
  Seed: HSYTTAEEA (MAR1_HUMAN)
HHYTTAEEC

SEQ ID NO: 115775 - protein, 9 aa, Artificial Sequence
  Description of Artificial Sequence: Synthetic peptide
  Seed: RRRNGYRAL (MAR1_HUMAN)
RNRNGYRAY

SEQ ID NO: 115776 - protein, 9 aa, Artificial Sequence
  Description of Artificial Sequence: Synthetic peptide
  Seed: RRRNGYRAL (MAR1_HUMAN)
RQRNGYRAF

SEQ ID NO: 115777 - protein, 10 aa, Artificial Sequence
  Description of Artificial Sequence: Synthetic peptide
  Seed: IGILTVILGV (MAR1_HUMAN)
IIILTVILGV

SEQ ID NO: 115778 - protein, 9 aa, Artificial Sequence
  Description of Artificial Sequence: Synthetic peptide
  Seed: EGFDHRDSK (MAR1_HUMAN)
ELFDHRDSK

SEQ ID NO: 115779 - protein, 9 aa, Artificial Sequence
  Description of Artificial Sequence: Synthetic peptide
  Seed: VVPNAPPAY (MAR1_HUMAN)
VQPNAPPAY

SEQ ID NO: 115780 - protein, 9 aa, Artificial Sequence
  Description of Artificial Sequence: Synthetic peptide
  Seed: TTAEEAAGI (MAR1_HUMAN)
TMAEEAAGM

SEQ ID NO: 115781 - protein, 10 aa, Artificial Sequence
  Description of Artificial Sequence: Synthetic peptide
  Seed: IGILTVILGV (MAR1_HUMAN)
IPILTVILGV

SEQ ID NO: 115782 - protein, 10 aa, Artificial Sequence
  Description of Artificial Sequence: Synthetic peptide
  Seed: YTTAEEAAGI (MAR1_HUMAN)
YATAEEAAGV

SEQ ID NO: 115783 - protein, 11 aa, Artificial Sequence
  Description of Artificial Sequence: Synthetic peptide
  Seed: VPNAPPAYEKL (MAR1_HUMAN)
VPNAPPAYEKM

SEQ ID NO: 115784 - protein, 10 aa, Artificial Sequence
  Description of Artificial Sequence: Synthetic peptide
  Seed: IGILTVILGV (MAR1_HUMAN)
IVILTVILGV

SEQ ID NO: 115785 - protein, 9 aa, Artificial Sequence
  Description of Artificial Sequence: Synthetic peptide
  Seed: VVPNAPPAY (MAR1_HUMAN)
VRPNAPPAF

SEQ ID NO: 115786 - protein, 9 aa, Artificial Sequence
  Description of Artificial Sequence: Synthetic peptide
  Seed: EAAGIGILT (MAR1_HUMAN)
EVAGIGILL

SEQ ID NO: 115787 - protein, 9 aa, Artificial Sequence
  Description of Artificial Sequence: Synthetic peptide
  Seed: NAPPAYEKL (MAR1_HUMAN)
NTPPAYEKL

SEQ ID NO: 115788 - protein, 9 aa, Artificial Sequence
  Description of Artificial Sequence: Synthetic peptide
  Seed: GILTVILGV (MAR1_HUMAN)
GQLTVILGL

SEQ ID NO: 115789 - protein, 9 aa, Artificial Sequence
  Description of Artificial Sequence: Synthetic peptide
  Seed: AAGIGILTV (MAR1_HUMAN)
ATGIGILTL

SEQ ID NO: 115790 - protein, 10 aa, Artificial Sequence
  Description of Artificial Sequence: Synthetic peptide
  Seed: EEAAGIGILT (MAR1_HUMAN)
EDAAGIGILV

SEQ ID NO: 115791 - protein, 9 aa, Artificial Sequence
  Description of Artificial Sequence: Synthetic peptide
  Seed: LLIGCWYCR (MAR1_HUMAN)
LQIGCWYCK

SEQ ID NO: 115792 - protein, 9 aa, Artificial Sequence
  Description of Artificial Sequence: Synthetic peptide
  Seed: AGIGILTVI (MAR1_HUMAN)
ATIGILTVA

SEQ ID NO: 115793 - protein, 11 aa, Artificial Sequence
  Description of Artificial Sequence: Synthetic peptide
  Seed: YRALMDKSLHV (MAR1_HUMAN)
YEALMDKSLHM

SEQ ID NO: 115794 - protein, 9 aa, Artificial Sequence
  Description of Artificial Sequence: Synthetic peptide
  Seed: AAGIGILTV (MAR1_HUMAN)
AQGIGILTF

SEQ ID NO: 115795 - protein, 10 aa, Artificial Sequence
  Description of Artificial Sequence: Synthetic peptide
  Seed: DAHFIYGYPK (MAR1_HUMAN)
DSHFIYGYPR

SEQ ID NO: 115796 - protein, 10 aa, Artificial Sequence
  Description of Artificial Sequence: Synthetic peptide
  Seed: EAAGIGILTV (MAR1_HUMAN)
EVAGIGILTK

SEQ ID NO: 115797 - protein, 9 aa, Artificial Sequence
  Description of Artificial Sequence: Synthetic peptide
  Seed: NAPPAYEKL (MAR1_HUMAN)
NYPPAYEKW

SEQ ID NO: 115798 - protein, 10 aa, Artificial Sequence
  Description of Artificial Sequence: Synthetic peptide
  Seed: YPKKGHGHSY (MAR1_HUMAN)
YQKKGHGHSY

SEQ ID NO: 115799 - protein, 10 aa, Artificial Sequence
  Description of Artificial Sequence: Synthetic peptide
  Seed: RRRNGYRALM (MAR1_HUMAN)
RDRNGYRALY

SEQ ID NO: 115800 - protein, 8 aa, Artificial Sequence
  Description of Artificial Sequence: Synthetic peptide
  Seed: LMDKSLHV (MAR1_HUMAN)
LYDKSLHI

SEQ ID NO: 115801 - protein, 9 aa, Artificial Sequence
  Description of Artificial Sequence: Synthetic peptide
  Seed: VILGVLLLI (MAR1_HUMAN)
VLLGVLLLW

SEQ ID NO: 115802 - protein, 9 aa, Artificial Sequence
  Description of Artificial Sequence: Synthetic peptide
  Seed: LTVILGVLL (MAR1_HUMAN)
LMVILGVLV

SEQ ID NO: 115803 - protein, 10 aa, Artificial Sequence
  Description of Artificial Sequence: Synthetic peptide
  Seed: EAAGIGILTV (MAR1_HUMAN)
EQAGIGILTR

SEQ ID NO: 115804 - protein, 10 aa, Artificial Sequence
  Description of Artificial Sequence: Synthetic peptide
  Seed: EAAGIGILTV (MAR1_HUMAN)
EIAGIGILTK

SEQ ID NO: 115805 - protein, 9 aa, Artificial Sequence
  Description of Artificial Sequence: Synthetic peptide
  Seed: YRALMDKSL (MAR1_HUMAN)
YFALMDKSI

SEQ ID NO: 115806 - protein, 9 aa, Artificial Sequence
  Description of Artificial Sequence: Synthetic peptide
  Seed: EDAHFIYGY (MAR1_HUMAN)
EVAHFIYGF

SEQ ID NO: 115807 - protein, 9 aa, Artificial Sequence
  Description of Artificial Sequence: Synthetic peptide
  Seed: YRALMDKSL (MAR1_HUMAN)
YAALMDKSF

SEQ ID NO: 115808 - protein, 10 aa, Artificial Sequence
  Description of Artificial Sequence: Synthetic peptide
  Seed: RRRNGYRALM (MAR1_HUMAN)
RERNGYRALY

SEQ ID NO: 115809 - protein, 11 aa, Artificial Sequence
  Description of Artificial Sequence: Synthetic peptide
  Seed: YRALMDKSLHV (MAR1_HUMAN)
YSALMDKSLHL

SEQ ID NO: 115810 - protein, 9 aa, Artificial Sequence
  Description of Artificial Sequence: Synthetic peptide
  Seed: VGTQCALTR (MAR1_HUMAN)
VLTQCALTR

SEQ ID NO: 115811 - protein, 9 aa, Artificial Sequence
  Description of Artificial Sequence: Synthetic peptide
  Seed: VILGVLLLI (MAR1_HUMAN)
VALGVLLLI

SEQ ID NO: 115812 - protein, 9 aa, Artificial Sequence
  Description of Artificial Sequence: Synthetic peptide
  Seed: LHVGTQCAL (MAR1_HUMAN)
LHVGTQCAF

SEQ ID NO: 115813 - protein, 9 aa, Artificial Sequence
  Description of Artificial Sequence: Synthetic peptide
  Seed: EGFDHRDSK (MAR1_HUMAN)
EIFDHRDSR

SEQ ID NO: 115814 - protein, 10 aa, Artificial Sequence
  Description of Artificial Sequence: Synthetic peptide
  Seed: KGHGHSYTTA (MAR1_HUMAN)
KVHGHSYTTK

SEQ ID NO: 115815 - protein, 10 aa, Artificial Sequence
  Description of Artificial Sequence: Synthetic peptide
  Seed: IGILTVILGV (MAR1_HUMAN)
ILILTVILGV

SEQ ID NO: 115816 - protein, 9 aa, Artificial Sequence
  Description of Artificial Sequence: Synthetic peptide
  Seed: VILGVLLLI (MAR1_HUMAN)
VVLGVLLLK

SEQ ID NO: 115817 - protein, 10 aa, Artificial Sequence
  Description of Artificial Sequence: Synthetic peptide
  Seed: ALMDKSLHVG (MAR1_HUMAN)
ASMDKSLHVI

SEQ ID NO: 115818 - protein, 9 aa, Artificial Sequence
  Description of Artificial Sequence: Synthetic peptide
  Seed: YRALMDKSL (MAR1_HUMAN)
YMALMDKSM

SEQ ID NO: 115819 - protein, 9 aa, Artificial Sequence
  Description of Artificial Sequence: Synthetic peptide
  Seed: EQSPPPYSP (MAR1_HUMAN)
EESPPPYSC

SEQ ID NO: 115820 - protein, 10 aa, Artificial Sequence
  Description of Artificial Sequence: Synthetic peptide
  Seed: EEAAGIGILT (MAR1_HUMAN)
EVAAGIGILA

SEQ ID NO: 115821 - protein, 9 aa, Artificial Sequence
  Description of Artificial Sequence: Synthetic peptide
  Seed: AAGIGILTV (MAR1_HUMAN)
ATGIGILTF

SEQ ID NO: 115822 - protein, 9 aa, Artificial Sequence
  Description of Artificial Sequence: Synthetic peptide
  Seed: VVPNAPPAY (MAR1_HUMAN)
VIPNAPPAY

SEQ ID NO: 115823 - protein, 9 aa, Artificial Sequence
  Description of Artificial Sequence: Synthetic peptide
  Seed: VILGVLLLI (MAR1_HUMAN)
VSLGVLLLI

SEQ ID NO: 115824 - protein, 10 aa, Artificial Sequence
  Description of Artificial Sequence: Synthetic peptide
  Seed: MPREDAHFIY (MAR1_HUMAN)
MMREDAHFIY

SEQ ID NO: 115825 - protein, 9 aa, Artificial Sequence
  Description of Artificial Sequence: Synthetic peptide
  Seed: VILGVLLLI (MAR1_HUMAN)
VALGVLLLK

SEQ ID NO: 115826 - protein, 9 aa, Artificial Sequence
  Description of Artificial Sequence: Synthetic peptide
  Seed: GFDHRDSKV (MAR1_HUMAN)
GADHRDSKI

SEQ ID NO: 115827 - protein, 9 aa, Artificial Sequence
  Description of Artificial Sequence: Synthetic peptide
  Seed: GILTVILGV (MAR1_HUMAN)
GILTVILGA

SEQ ID NO: 115828 - protein, 10 aa, Artificial Sequence
  Description of Artificial Sequence: Synthetic peptide
  Seed: YPKKGHGHSY (MAR1_HUMAN)
YSKKGHGHSY

SEQ ID NO: 115829 - protein, 9 aa, Artificial Sequence
  Description of Artificial Sequence: Synthetic peptide
  Seed: NAPPAYEKL (MAR1_HUMAN)
NVPPAYEKW

SEQ ID NO: 115830 - protein, 9 aa, Artificial Sequence
  Description of Artificial Sequence: Synthetic peptide
  Seed: EGFDHRDSK (MAR1_HUMAN)
EVFDHRDSM

SEQ ID NO: 115831 - protein, 9 aa, Artificial Sequence
  Description of Artificial Sequence: Synthetic peptide
  Seed: HSYTTAEEA (MAR1_HUMAN)
HPYTTAEEI

SEQ ID NO: 115832 - protein, 9 aa, Artificial Sequence
  Description of Artificial Sequence: Synthetic peptide
  Seed: AHFIYGYPK (MAR1_HUMAN)
AQFIYGYPR

SEQ ID NO: 115833 - protein, 9 aa, Artificial Sequence
  Description of Artificial Sequence: Synthetic peptide
  Seed: EEAAGIGIL (MAR1_HUMAN)
EEAAGIGIY

SEQ ID NO: 115834 - protein, 10 aa, Artificial Sequence
  Description of Artificial Sequence: Synthetic peptide
  Seed: AEQSPPPYSP (MAR1_HUMAN)
AEQSPPPYSI

SEQ ID NO: 115835 - protein, 9 aa, Artificial Sequence
  Description of Artificial Sequence: Synthetic peptide
  Seed: YPKKGHGHS (MAR1_HUMAN)
YPKKGHGHA

SEQ ID NO: 115836 - protein, 10 aa, Artificial Sequence
  Description of Artificial Sequence: Synthetic peptide
  Seed: RRRNGYRALM (MAR1_HUMAN)
RLRNGYRALF

SEQ ID NO: 115837 - protein, 9 aa, Artificial Sequence
  Description of Artificial Sequence: Synthetic peptide
  Seed: ALMDKSLHV (MAR1_HUMAN)
AQMDKSLHI

SEQ ID NO: 115838 - protein, 9 aa, Artificial Sequence
  Description of Artificial Sequence: Synthetic peptide
  Seed: VVPNAPPAY (MAR1_HUMAN)
VYPNAPPAL

SEQ ID NO: 115839 - protein, 9 aa, Artificial Sequence
  Description of Artificial Sequence: Synthetic peptide
  Seed: EGFDHRDSK (MAR1_HUMAN)
EMFDHRDSR

SEQ ID NO: 115840 - protein, 9 aa, Artificial Sequence
  Description of Artificial Sequence: Synthetic peptide
  Seed: EDAHFIYGY (MAR1_HUMAN)
EVAHFIYGY

SEQ ID NO: 115841 - protein, 10 aa, Artificial Sequence
  Description of Artificial Sequence: Synthetic peptide
  Seed: YPKKGHGHSY (MAR1_HUMAN)
YPKKGHGHSW

SEQ ID NO: 115842 - protein, 9 aa, Artificial Sequence
  Description of Artificial Sequence: Synthetic peptide
  Seed: RRNGYRALM (MAR1_HUMAN)
RLNGYRALY

SEQ ID NO: 115843 - protein, 9 aa, Artificial Sequence
  Description of Artificial Sequence: Synthetic peptide
  Seed: ALMDKSLHV (MAR1_HUMAN)
ATMDKSLHV

SEQ ID NO: 115844 - protein, 11 aa, Artificial Sequence
  Description of Artificial Sequence: Synthetic peptide
  Seed: YRALMDKSLHV (MAR1_HUMAN)
YMALMDKSLHM

SEQ ID NO: 115845 - protein, 9 aa, Artificial Sequence
  Description of Artificial Sequence: Synthetic peptide
  Seed: EGFDHRDSK (MAR1_HUMAN)
EVFDHRDSK

SEQ ID NO: 115846 - protein, 9 aa, Artificial Sequence
  Description of Artificial Sequence: Synthetic peptide
  Seed: ALMDKSLHV (MAR1_HUMAN)
AVMDKSLHF

SEQ ID NO: 115847 - protein, 10 aa, Artificial Sequence
  Description of Artificial Sequence: Synthetic peptide
  Seed: RALMDKSLHV (MAR1_HUMAN)
RKLMDKSLHV

SEQ ID NO: 115848 - protein, 10 aa, Artificial Sequence
  Description of Artificial Sequence: Synthetic peptide
  Seed: LTVILGVLLL (MAR1_HUMAN)
LSVILGVLLF

SEQ ID NO: 115849 - protein, 8 aa, Artificial Sequence
  Description of Artificial Sequence: Synthetic peptide
  Seed: LMDKSLHV (MAR1_HUMAN)
LIDKSLHV

SEQ ID NO: 115850 - protein, 9 aa, Artificial Sequence
  Description of Artificial Sequence: Synthetic peptide
  Seed: RRNGYRALM (MAR1_HUMAN)
RYNGYRALY

SEQ ID NO: 115851 - protein, 10 aa, Artificial Sequence
  Description of Artificial Sequence: Synthetic peptide
  Seed: YPKKGHGHSY (MAR1_HUMAN)
YSKKGHGHSF

SEQ ID NO: 115852 - protein, 11 aa, Artificial Sequence
  Description of Artificial Sequence: Synthetic peptide
  Seed: EAAGIGILTVI (MAR1_HUMAN)
ESAGIGILTVV

SEQ ID NO: 115853 - protein, 10 aa, Artificial Sequence
  Description of Artificial Sequence: Synthetic peptide
  Seed: RRRNGYRALM (MAR1_HUMAN)
RSRNGYRALL

SEQ ID NO: 115854 - protein, 8 aa, Artificial Sequence
  Description of Artificial Sequence: Synthetic peptide
  Seed: HRDSKVSL (MAR1_HUMAN)
HFDSKVSV

SEQ ID NO: 115855 - protein, 10 aa, Artificial Sequence
  Description of Artificial Sequence: Synthetic peptide
  Seed: IGILTVILGV (MAR1_HUMAN)
IWILTVILGV

SEQ ID NO: 115856 - protein, 9 aa, Artificial Sequence
  Description of Artificial Sequence: Synthetic peptide
  Seed: KSLHVGTQC (MAR1_HUMAN)
KALHVGTQM

SEQ ID NO: 115857 - protein, 9 aa, Artificial Sequence
  Description of Artificial Sequence: Synthetic peptide
  Seed: GFDHRDSKV (MAR1_HUMAN)
GTDHRDSKL

SEQ ID NO: 115858 - protein, 9 aa, Artificial Sequence
  Description of Artificial Sequence: Synthetic peptide
  Seed: RRRNGYRAL (MAR1_HUMAN)
RMRNGYRAW

SEQ ID NO: 115859 - protein, 10 aa, Artificial Sequence
  Description of Artificial Sequence: Synthetic peptide
  Seed: APPAYEKLSA (MAR1_HUMAN)
AGPAYEKLSM

SEQ ID NO: 115860 - protein, 10 aa, Artificial Sequence
  Description of Artificial Sequence: Synthetic peptide
  Seed: RRRNGYRALM (MAR1_HUMAN)
RARNGYRALK

SEQ ID NO: 115861 - protein, 9 aa, Artificial Sequence
  Description of Artificial Sequence: Synthetic peptide
  Seed: RRNGYRALM (MAR1_HUMAN)
RRNGYRALI

SEQ ID NO: 115862 - protein, 10 aa, Artificial Sequence
  Description of Artificial Sequence: Synthetic peptide
  Seed: YTTAEEAAGI (MAR1_HUMAN)
YLTAEEAAGL

SEQ ID NO: 115863 - protein, 9 aa, Artificial Sequence
  Description of Artificial Sequence: Synthetic peptide
  Seed: PKKGHGHSY (MAR1_HUMAN)
PQKGHGHSY

SEQ ID NO: 115864 - protein, 10 aa, Artificial Sequence
  Description of Artificial Sequence: Synthetic peptide
  Seed: SLHVGTQCAL (MAR1_HUMAN)
SVHVGTQCAY

SEQ ID NO: 115865 - protein, 9 aa, Artificial Sequence
  Description of Artificial Sequence: Synthetic peptide
  Seed: AHFIYGYPK (MAR1_HUMAN)
AIFIYGYPK

SEQ ID NO: 115866 - protein, 10 aa, Artificial Sequence
  Description of Artificial Sequence: Synthetic peptide
  Seed: YPKKGHGHSY (MAR1_HUMAN)
YPKKGHGHSV

SEQ ID NO: 115867 - protein, 10 aa, Artificial Sequence
  Description of Artificial Sequence: Synthetic peptide
  Seed: RALMDKSLHV (MAR1_HUMAN)
RNLMDKSLHA

SEQ ID NO: 115868 - protein, 10 aa, Artificial Sequence
  Description of Artificial Sequence: Synthetic peptide
  Seed: RALMDKSLHV (MAR1_HUMAN)
RYLMDKSLHL

SEQ ID NO: 115869 - protein, 9 aa, Artificial Sequence
  Description of Artificial Sequence: Synthetic peptide
  Seed: EDAHFIYGY (MAR1_HUMAN)
EAAHFIYGM

SEQ ID NO: 115870 - protein, 10 aa, Artificial Sequence
  Description of Artificial Sequence: Synthetic peptide
  Seed: RRRNGYRALM (MAR1_HUMAN)
RNRNGYRALY

SEQ ID NO: 115871 - protein, 10 aa, Artificial Sequence
  Description of Artificial Sequence: Synthetic peptide
  Seed: EAAGIGILTV (MAR1_HUMAN)
EMAGIGILTV

SEQ ID NO: 115872 - protein, 11 aa, Artificial Sequence
  Description of Artificial Sequence: Synthetic peptide
  Seed: YRALMDKSLHV (MAR1_HUMAN)
YFALMDKSLHL

SEQ ID NO: 115873 - protein, 9 aa, Artificial Sequence
  Description of Artificial Sequence: Synthetic peptide
  Seed: ALMDKSLHV (MAR1_HUMAN)
ALMDKSLHI

SEQ ID NO: 115874 - protein, 10 aa, Artificial Sequence
  Description of Artificial Sequence: Synthetic peptide
  Seed: RRRNGYRALM (MAR1_HUMAN)
RIRNGYRALL

SEQ ID NO: 115875 - protein, 11 aa, Artificial Sequence
  Description of Artificial Sequence: Synthetic peptide
  Seed: ALMDKSLHVGT (MAR1_HUMAN)
ALMDKSLHVGL

SEQ ID NO: 115876 - protein, 9 aa, Artificial Sequence
  Description of Artificial Sequence: Synthetic peptide
  Seed: GVLLLIGCW (MAR1_HUMAN)
GTLLLIGCW

SEQ ID NO: 115877 - protein, 10 aa, Artificial Sequence
  Description of Artificial Sequence: Synthetic peptide
  Seed: LSAEQSPPPY (MAR1_HUMAN)
LTAEQSPPPY

SEQ ID NO: 115878 - protein, 9 aa, Artificial Sequence
  Description of Artificial Sequence: Synthetic peptide
  Seed: AAGIGILTV (MAR1_HUMAN)
AAGIGILTI

SEQ ID NO: 115879 - protein, 10 aa, Artificial Sequence
  Description of Artificial Sequence: Synthetic peptide
  Seed: MPREDAHFIY (MAR1_HUMAN)
MQREDAHFIM

SEQ ID NO: 115880 - protein, 11 aa, Artificial Sequence
  Description of Artificial Sequence: Synthetic peptide
  Seed: TTAEEAAGIGI (MAR1_HUMAN)
TSAEEAAGIGW

SEQ ID NO: 115881 - protein, 9 aa, Artificial Sequence
  Description of Artificial Sequence: Synthetic peptide
  Seed: YRALMDKSL (MAR1_HUMAN)
YQALMDKSY

SEQ ID NO: 115882 - protein, 9 aa, Artificial Sequence
  Description of Artificial Sequence: Synthetic peptide
  Seed: DSKVSLQEK (MAR1_HUMAN)
DFKVSLQER

SEQ ID NO: 115883 - protein, 9 aa, Artificial Sequence
  Description of Artificial Sequence: Synthetic peptide
  Seed: GFDHRDSKV (MAR1_HUMAN)
GIDHRDSKM

SEQ ID NO: 115884 - protein, 9 aa, Artificial Sequence
  Description of Artificial Sequence: Synthetic peptide
  Seed: RRNGYRALM (MAR1_HUMAN)
RMNGYRALM

SEQ ID NO: 115885 - protein, 10 aa, Artificial Sequence
  Description of Artificial Sequence: Synthetic peptide
  Seed: RRRNGYRALM (MAR1_HUMAN)
RFRNGYRALK

SEQ ID NO: 115886 - protein, 10 aa, Artificial Sequence
  Description of Artificial Sequence: Synthetic peptide
  Seed: RRRNGYRALM (MAR1_HUMAN)
RCRNGYRALF

SEQ ID NO: 115887 - protein, 10 aa, Artificial Sequence
  Description of Artificial Sequence: Synthetic peptide
  Seed: AHFIYGYPKK (MAR1_HUMAN)
ATFIYGYPKR

SEQ ID NO: 115888 - protein, 9 aa, Artificial Sequence
  Description of Artificial Sequence: Synthetic peptide
  Seed: CPQEGFDHR (MAR1_HUMAN)
CTQEGFDHR

SEQ ID NO: 115889 - protein, 9 aa, Artificial Sequence
  Description of Artificial Sequence: Synthetic peptide
  Seed: ALMDKSLHV (MAR1_HUMAN)
ASMDKSLHW

SEQ ID NO: 115890 - protein, 9 aa, Artificial Sequence
  Description of Artificial Sequence: Synthetic peptide
  Seed: RRRNGYRAL (MAR1_HUMAN)
RLRNGYRAM

SEQ ID NO: 115891 - protein, 11 aa, Artificial Sequence
  Description of Artificial Sequence: Synthetic peptide
  Seed: YRALMDKSLHV (MAR1_HUMAN)
YMALMDKSLHI

SEQ ID NO: 115892 - protein, 9 aa, Artificial Sequence
  Description of Artificial Sequence: Synthetic peptide
  Seed: TVILGVLLL (MAR1_HUMAN)
TAILGVLLL

SEQ ID NO: 115893 - protein, 9 aa, Artificial Sequence
  Description of Artificial Sequence: Synthetic peptide
  Seed: AHFIYGYPK (MAR1_HUMAN)
ALFIYGYPR

SEQ ID NO: 115894 - protein, 9 aa, Artificial Sequence
  Description of Artificial Sequence: Synthetic peptide
  Seed: GILTVILGV (MAR1_HUMAN)
GVLTVILGL

SEQ ID NO: 115895 - protein, 9 aa, Artificial Sequence
  Description of Artificial Sequence: Synthetic peptide
  Seed: NAPPAYEKL (MAR1_HUMAN)
NQPPAYEKV

SEQ ID NO: 115896 - protein, 9 aa, Artificial Sequence
  Description of Artificial Sequence: Synthetic peptide
  Seed: ALMDKSLHV (MAR1_HUMAN)
ALMDKSLHR

SEQ ID NO: 115897 - protein, 10 aa, Artificial Sequence
  Description of Artificial Sequence: Synthetic peptide
  Seed: EAAGIGILTV (MAR1_HUMAN)
ETAGIGILTY

SEQ ID NO: 115898 - protein, 9 aa, Artificial Sequence
  Description of Artificial Sequence: Synthetic peptide
  Seed: TTAEEAAGI (MAR1_HUMAN)
TMAEEAAGL

SEQ ID NO: 115899 - protein, 9 aa, Artificial Sequence
  Description of Artificial Sequence: Synthetic peptide
  Seed: EDAHFIYGY (MAR1_HUMAN)
EEAHFIYGF

SEQ ID NO: 115900 - protein, 9 aa, Artificial Sequence
  Description of Artificial Sequence: Synthetic peptide
  Seed: MPREDAHFI (MAR1_HUMAN)
MVREDAHFF

SEQ ID NO: 115901 - protein, 9 aa, Artificial Sequence
  Description of Artificial Sequence: Synthetic peptide
  Seed: LLIGCWYCR (MAR1_HUMAN)
LWIGCWYCR

SEQ ID NO: 115902 - protein, 10 aa, Artificial Sequence
  Description of Artificial Sequence: Synthetic peptide
  Seed: EAAGIGILTV (MAR1_HUMAN)
ELAGIGILTV

SEQ ID NO: 115903 - protein, 11 aa, Artificial Sequence
  Description of Artificial Sequence: Synthetic peptide
  Seed: YRALMDKSLHV (MAR1_HUMAN)
YPALMDKSLHM

SEQ ID NO: 115904 - protein, 11 aa, Artificial Sequence
  Description of Artificial Sequence: Synthetic peptide
  Seed: YRALMDKSLHV (MAR1_HUMAN)
YLALMDKSLHA

SEQ ID NO: 115905 - protein, 9 aa, Artificial Sequence
  Description of Artificial Sequence: Synthetic peptide
  Seed: NAPPAYEKL (MAR1_HUMAN)
NHPPAYEKM

SEQ ID NO: 115906 - protein, 9 aa, Artificial Sequence
  Description of Artificial Sequence: Synthetic peptide
  Seed: HFIYGYPKK (MAR1_HUMAN)
HIIYGYPKR

SEQ ID NO: 115907 - protein, 9 aa, Artificial Sequence
  Description of Artificial Sequence: Synthetic peptide
  Seed: NAPPAYEKL (MAR1_HUMAN)
NAPPAYEKW

SEQ ID NO: 115908 - protein, 9 aa, Artificial Sequence
  Description of Artificial Sequence: Synthetic peptide
  Seed: NGYRALMDK (MAR1_HUMAN)
NTYRALMDK

SEQ ID NO: 115909 - protein, 9 aa, Artificial Sequence
  Description of Artificial Sequence: Synthetic peptide
  Seed: RRNGYRALM (MAR1_HUMAN)
RKNGYRALF

SEQ ID NO: 115910 - protein, 10 aa, Artificial Sequence
  Description of Artificial Sequence: Synthetic peptide
  Seed: RALMDKSLHV (MAR1_HUMAN)
RQLMDKSLHA

SEQ ID NO: 115911 - protein, 9 aa, Artificial Sequence
  Description of Artificial Sequence: Synthetic peptide
  Seed: RRRNGYRAL (MAR1_HUMAN)
RQRNGYRAV

SEQ ID NO: 115912 - protein, 10 aa, Artificial Sequence
  Description of Artificial Sequence: Synthetic peptide
  Seed: YTTAEEAAGI (MAR1_HUMAN)
YITAEEAAGI

SEQ ID NO: 115913 - protein, 9 aa, Artificial Sequence
  Description of Artificial Sequence: Synthetic peptide
  Seed: YRALMDKSL (MAR1_HUMAN)
YKALMDKSY

SEQ ID NO: 115914 - protein, 10 aa, Artificial Sequence
  Description of Artificial Sequence: Synthetic peptide
  Seed: EAAGIGILTV (MAR1_HUMAN)
ESAGIGILTK

SEQ ID NO: 115915 - protein, 10 aa, Artificial Sequence
  Description of Artificial Sequence: Synthetic peptide
  Seed: EEAAGIGILT (MAR1_HUMAN)
ETAAGIGILV

SEQ ID NO: 115916 - protein, 10 aa, Artificial Sequence
  Description of Artificial Sequence: Synthetic peptide
  Seed: YPKKGHGHSY (MAR1_HUMAN)
YAKKGHGHSL

SEQ ID NO: 115917 - protein, 10 aa, Artificial Sequence
  Description of Artificial Sequence: Synthetic peptide
  Seed: IGILTVILGV (MAR1_HUMAN)
IMILTVILGL

SEQ ID NO: 115918 - protein, 9 aa, Artificial Sequence
  Description of Artificial Sequence: Synthetic peptide
  Seed: RRRNGYRAL (MAR1_HUMAN)
RARNGYRAY

SEQ ID NO: 115919 - protein, 9 aa, Artificial Sequence
  Description of Artificial Sequence: Synthetic peptide
  Seed: AGIGILTVI (MAR1_HUMAN)
AQIGILTVW

SEQ ID NO: 115920 - protein, 10 aa, Artificial Sequence
  Description of Artificial Sequence: Synthetic peptide
  Seed: LSAEQSPPPY (MAR1_HUMAN)
LSAEQSPPPF

SEQ ID NO: 115921 - protein, 10 aa, Artificial Sequence
  Description of Artificial Sequence: Synthetic peptide
  Seed: EEAAGIGILT (MAR1_HUMAN)
ERAAGIGILI

SEQ ID NO: 115922 - protein, 10 aa, Artificial Sequence
  Description of Artificial Sequence: Synthetic peptide
  Seed: DAHFIYGYPK (MAR1_HUMAN)
DGHFIYGYPR

SEQ ID NO: 115923 - protein, 9 aa, Artificial Sequence
  Description of Artificial Sequence: Synthetic peptide
  Seed: VILGVLLLI (MAR1_HUMAN)
VLLGVLLLM

SEQ ID NO: 115924 - protein, 9 aa, Artificial Sequence
  Description of Artificial Sequence: Synthetic peptide
  Seed: VVPNAPPAY (MAR1_HUMAN)
VIPNAPPAF

SEQ ID NO: 115925 - protein, 9 aa, Artificial Sequence
  Description of Artificial Sequence: Synthetic peptide
  Seed: AHFIYGYPK (MAR1_HUMAN)
ALFIYGYPK

SEQ ID NO: 115926 - protein, 9 aa, Artificial Sequence
  Description of Artificial Sequence: Synthetic peptide
  Seed: TVILGVLLL (MAR1_HUMAN)
TMILGVLLL

SEQ ID NO: 115927 - protein, 10 aa, Artificial Sequence
  Description of Artificial Sequence: Synthetic peptide
  Seed: IGILTVILGV (MAR1_HUMAN)
IEILTVILGV

SEQ ID NO: 115928 - protein, 9 aa, Artificial Sequence
  Description of Artificial Sequence: Synthetic peptide
  Seed: RRNGYRALM (MAR1_HUMAN)
RRNGYRALF

SEQ ID NO: 115929 - protein, 10 aa, Artificial Sequence
  Description of Artificial Sequence: Synthetic peptide
  Seed: RALMDKSLHV (MAR1_HUMAN)
RELMDKSLHI

SEQ ID NO: 115930 - protein, 10 aa, Artificial Sequence
  Description of Artificial Sequence: Synthetic peptide
  Seed: RRRNGYRALM (MAR1_HUMAN)
RLRNGYRALK

SEQ ID NO: 115931 - protein, 9 aa, Artificial Sequence
  Description of Artificial Sequence: Synthetic peptide
  Seed: AHFIYGYPK (MAR1_HUMAN)
AMFIYGYPR

SEQ ID NO: 115932 - protein, 9 aa, Artificial Sequence
  Description of Artificial Sequence: Synthetic peptide
  Seed: EGFDHRDSK (MAR1_HUMAN)
EIFDHRDSM

SEQ ID NO: 115933 - protein, 8 aa, Artificial Sequence
  Description of Artificial Sequence: Synthetic peptide
  Seed: LMDKSLHV (MAR1_HUMAN)
LGDKSLHM

SEQ ID NO: 115934 - protein, 9 aa, Artificial Sequence
  Description of Artificial Sequence: Synthetic peptide
  Seed: DSKVSLQEK (MAR1_HUMAN)
DVKVSLQER

SEQ ID NO: 115935 - protein, 9 aa, Artificial Sequence
  Description of Artificial Sequence: Synthetic peptide
  Seed: RRNGYRALM (MAR1_HUMAN)
RQNGYRALH

SEQ ID NO: 115936 - protein, 9 aa, Artificial Sequence
  Description of Artificial Sequence: Synthetic peptide
  Seed: YRALMDKSL (MAR1_HUMAN)
YHALMDKSV

SEQ ID NO: 115937 - protein, 10 aa, Artificial Sequence
  Description of Artificial Sequence: Synthetic peptide
  Seed: RRRNGYRALM (MAR1_HUMAN)
RPRNGYRALM

SEQ ID NO: 115938 - protein, 9 aa, Artificial Sequence
  Description of Artificial Sequence: Synthetic peptide
  Seed: HSYTTAEEA (MAR1_HUMAN)
HIYTTAEEY

SEQ ID NO: 115939 - protein, 9 aa, Artificial Sequence
  Description of Artificial Sequence: Synthetic peptide
  Seed: MPREDAHFI (MAR1_HUMAN)
MPREDAHFH

SEQ ID NO: 115940 - protein, 9 aa, Artificial Sequence
  Description of Artificial Sequence: Synthetic peptide
  Seed: YRALMDKSL (MAR1_HUMAN)
YFALMDKSF

SEQ ID NO: 115941 - protein, 8 aa, Artificial Sequence
  Description of Artificial Sequence: Synthetic peptide
  Seed: HRDSKVSL (MAR1_HUMAN)
HFDSKVSM

SEQ ID NO: 115942 - protein, 9 aa, Artificial Sequence
  Description of Artificial Sequence: Synthetic peptide
  Seed: VILGVLLLI (MAR1_HUMAN)
VVLGVLLLW

SEQ ID NO: 115943 - protein, 10 aa, Artificial Sequence
  Description of Artificial Sequence: Synthetic peptide
  Seed: LLLIGCWYCR (MAR1_HUMAN)
LSLIGCWYCR

SEQ ID NO: 115944 - protein, 11 aa, Artificial Sequence
  Description of Artificial Sequence: Synthetic peptide
  Seed: YRALMDKSLHV (MAR1_HUMAN)
YEALMDKSLHI

SEQ ID NO: 115945 - protein, 9 aa, Artificial Sequence
  Description of Artificial Sequence: Synthetic peptide
  Seed: EEAAGIGIL (MAR1_HUMAN)
EEAAGIGIA

SEQ ID NO: 115946 - protein, 9 aa, Artificial Sequence
  Description of Artificial Sequence: Synthetic peptide
  Seed: NAPPAYEKL (MAR1_HUMAN)
NTPPAYEKV

SEQ ID NO: 115947 - protein, 9 aa, Artificial Sequence
  Description of Artificial Sequence: Synthetic peptide
  Seed: EAAGIGILT (MAR1_HUMAN)
ETAGIGILT

SEQ ID NO: 115948 - protein, 9 aa, Artificial Sequence
  Description of Artificial Sequence: Synthetic peptide
  Seed: YRALMDKSL (MAR1_HUMAN)
YYALMDKSV

SEQ ID NO: 115949 - protein, 10 aa, Artificial Sequence
  Description of Artificial Sequence: Synthetic peptide
  Seed: RRRNGYRALM (MAR1_HUMAN)
RMRNGYRALY

SEQ ID NO: 115950 - protein, 9 aa, Artificial Sequence
  Description of Artificial Sequence: Synthetic peptide
  Seed: LIGCWYCRR (MAR1_HUMAN)
LYGCWYCRR

SEQ ID NO: 115951 - protein, 10 aa, Artificial Sequence
  Description of Artificial Sequence: Synthetic peptide
  Seed: EEAAGIGILT (MAR1_HUMAN)
ELAAGIGILV

SEQ ID NO: 115952 - protein, 9 aa, Artificial Sequence
  Description of Artificial Sequence: Synthetic peptide
  Seed: VILGVLLLI (MAR1_HUMAN)
VLLGVLLLK

SEQ ID NO: 115953 - protein, 9 aa, Artificial Sequence
  Description of Artificial Sequence: Synthetic peptide
  Seed: RRRNGYRAL (MAR1_HUMAN)
RFRNGYRAY

SEQ ID NO: 115954 - protein, 9 aa, Artificial Sequence
  Description of Artificial Sequence: Synthetic peptide
  Seed: EAAGIGILT (MAR1_HUMAN)
EIAGIGILM

SEQ ID NO: 115955 - protein, 9 aa, Artificial Sequence
  Description of Artificial Sequence: Synthetic peptide
  Seed: MPREDAHFI (MAR1_HUMAN)
MSREDAHFY

SEQ ID NO: 115956 - protein, 10 aa, Artificial Sequence
  Description of Artificial Sequence: Synthetic peptide
  Seed: RRRNGYRALM (MAR1_HUMAN)
RHRNGYRALL

SEQ ID NO: 115957 - protein, 9 aa, Artificial Sequence
  Description of Artificial Sequence: Synthetic peptide
  Seed: LLIGCWYCR (MAR1_HUMAN)
LMIGCWYCR

SEQ ID NO: 115958 - protein, 10 aa, Artificial Sequence
  Description of Artificial Sequence: Synthetic peptide
  Seed: YTTAEEAAGI (MAR1_HUMAN)
YTTAEEAAGV

SEQ ID NO: 115959 - protein, 11 aa, Artificial Sequence
  Description of Artificial Sequence: Synthetic peptide
  Seed: RALMDKSLHVG (MAR1_HUMAN)
RRLMDKSLHVV

SEQ ID NO: 115960 - protein, 9 aa, Artificial Sequence
  Description of Artificial Sequence: Synthetic peptide
  Seed: ALMDKSLHV (MAR1_HUMAN)
ALMDKSLHA

SEQ ID NO: 115961 - protein, 9 aa, Artificial Sequence
  Description of Artificial Sequence: Synthetic peptide
  Seed: EGFDHRDSK (MAR1_HUMAN)
EFFDHRDSR

SEQ ID NO: 115962 - protein, 11 aa, Artificial Sequence
  Description of Artificial Sequence: Synthetic peptide
  Seed: RALMDKSLHVG (MAR1_HUMAN)
RSLMDKSLHVI

SEQ ID NO: 115963 - protein, 9 aa, Artificial Sequence
  Description of Artificial Sequence: Synthetic peptide
  Seed: VVPNAPPAY (MAR1_HUMAN)
VMPNAPPAI

SEQ ID NO: 115964 - protein, 9 aa, Artificial Sequence
  Description of Artificial Sequence: Synthetic peptide
  Seed: EGFDHRDSK (MAR1_HUMAN)
ETFDHRDSY

SEQ ID NO: 115965 - protein, 11 aa, Artificial Sequence
  Description of Artificial Sequence: Synthetic peptide
  Seed: EAAGIGILTVI (MAR1_HUMAN)
ETAGIGILTVI

SEQ ID NO: 115966 - protein, 8 aa, Artificial Sequence
  Description of Artificial Sequence: Synthetic peptide
  Seed: LMDKSLHV (MAR1_HUMAN)
LGDKSLHF

SEQ ID NO: 115967 - protein, 11 aa, Artificial Sequence
  Description of Artificial Sequence: Synthetic peptide
  Seed: YRALMDKSLHV (MAR1_HUMAN)
YRALMDKSLHL

SEQ ID NO: 115968 - protein, 10 aa, Artificial Sequence
  Description of Artificial Sequence: Synthetic peptide
  Seed: APPAYEKLSA (MAR1_HUMAN)
AAPAYEKLSM

SEQ ID NO: 115969 - protein, 10 aa, Artificial Sequence
  Description of Artificial Sequence: Synthetic peptide
  Seed: MPREDAHFIY (MAR1_HUMAN)
MAREDAHFIW

SEQ ID NO: 115970 - protein, 9 aa, Artificial Sequence
  Description of Artificial Sequence: Synthetic peptide
  Seed: AAGIGILTV (MAR1_HUMAN)
ALGIGILTV

SEQ ID NO: 115971 - protein, 9 aa, Artificial Sequence
  Description of Artificial Sequence: Synthetic peptide
  Seed: ALMDKSLHV (MAR1_HUMAN)
AMMDKSLHL

SEQ ID NO: 115972 - protein, 10 aa, Artificial Sequence
  Description of Artificial Sequence: Synthetic peptide
  Seed: RRRNGYRALM (MAR1_HUMAN)
RKRNGYRALK

SEQ ID NO: 115973 - protein, 10 aa, Artificial Sequence
  Description of Artificial Sequence: Synthetic peptide
  Seed: RALMDKSLHV (MAR1_HUMAN)
RWLMDKSLHA

SEQ ID NO: 115974 - protein, 11 aa, Artificial Sequence
  Description of Artificial Sequence: Synthetic peptide
  Seed: YRALMDKSLHV (MAR1_HUMAN)
YYALMDKSLHV

SEQ ID NO: 115975 - protein, 10 aa, Artificial Sequence
  Description of Artificial Sequence: Synthetic peptide
  Seed: RNGYRALMDK (MAR1_HUMAN)
RLGYRALMDK

SEQ ID NO: 115976 - protein, 8 aa, Artificial Sequence
  Description of Artificial Sequence: Synthetic peptide
  Seed: HRDSKVSL (MAR1_HUMAN)
HWDSKVSI

SEQ ID NO: 115977 - protein, 9 aa, Artificial Sequence
  Description of Artificial Sequence: Synthetic peptide
  Seed: AAGIGILTV (MAR1_HUMAN)
ATGIGILTI

SEQ ID NO: 115978 - protein, 10 aa, Artificial Sequence
  Description of Artificial Sequence: Synthetic peptide
  Seed: DAHFIYGYPK (MAR1_HUMAN)
DYHFIYGYPR

SEQ ID NO: 115979 - protein, 10 aa, Artificial Sequence
  Description of Artificial Sequence: Synthetic peptide
  Seed: AHFIYGYPKK (MAR1_HUMAN)
ATFIYGYPKK

SEQ ID NO: 115980 - protein, 9 aa, Artificial Sequence
  Description of Artificial Sequence: Synthetic peptide
  Seed: HSYTTAEEA (MAR1_HUMAN)
HRYTTAEEA

SEQ ID NO: 115981 - protein, 9 aa, Artificial Sequence
  Description of Artificial Sequence: Synthetic peptide
  Seed: EGFDHRDSK (MAR1_HUMAN)
EAFDHRDSF

SEQ ID NO: 115982 - protein, 11 aa, Artificial Sequence
  Description of Artificial Sequence: Synthetic peptide
  Seed: ALMDKSLHVGT (MAR1_HUMAN)
ALMDKSLHVGV

SEQ ID NO: 115983 - protein, 9 aa, Artificial Sequence
  Description of Artificial Sequence: Synthetic peptide
  Seed: YRALMDKSL (MAR1_HUMAN)
YSALMDKSY

SEQ ID NO: 115984 - protein, 9 aa, Artificial Sequence
  Description of Artificial Sequence: Synthetic peptide
  Seed: DSKVSLQEK (MAR1_HUMAN)
DTKVSLQER

SEQ ID NO: 115985 - protein, 10 aa, Artificial Sequence
  Description of Artificial Sequence: Synthetic peptide
  Seed: RDSKVSLQEK (MAR1_HUMAN)
RQSKVSLQEK

SEQ ID NO: 115986 - protein, 9 aa, Artificial Sequence
  Description of Artificial Sequence: Synthetic peptide
  Seed: YEKLSAEQS (MAR1_HUMAN)
YEKLSAEQI

SEQ ID NO: 115987 - protein, 10 aa, Artificial Sequence
  Description of Artificial Sequence: Synthetic peptide
  Seed: YPKKGHGHSY (MAR1_HUMAN)
YPKKGHGHSL

SEQ ID NO: 115988 - protein, 9 aa, Artificial Sequence
  Description of Artificial Sequence: Synthetic peptide
  Seed: AAGIGILTV (MAR1_HUMAN)
AVGIGILTV

SEQ ID NO: 115989 - protein, 10 aa, Artificial Sequence
  Description of Artificial Sequence: Synthetic peptide
  Seed: YPKKGHGHSY (MAR1_HUMAN)
YTKKGHGHSF

SEQ ID NO: 115990 - protein, 9 aa, Artificial Sequence
  Description of Artificial Sequence: Synthetic peptide
  Seed: AGIGILTVI (MAR1_HUMAN)
AVIGILTVV

SEQ ID NO: 115991 - protein, 10 aa, Artificial Sequence
  Description of Artificial Sequence: Synthetic peptide
  Seed: EEAAGIGILT (MAR1_HUMAN)
ETAAGIGILT

SEQ ID NO: 115992 - protein, 9 aa, Artificial Sequence
  Description of Artificial Sequence: Synthetic peptide
  Seed: ALMDKSLHV (MAR1_HUMAN)
ALMDKSLHK

SEQ ID NO: 115993 - protein, 8 aa, Artificial Sequence
  Description of Artificial Sequence: Synthetic peptide
  Seed: VPNAPPAY (MAR1_HUMAN)
VQNAPPAY

SEQ ID NO: 115994 - protein, 9 aa, Artificial Sequence
  Description of Artificial Sequence: Synthetic peptide
  Seed: VVPNAPPAY (MAR1_HUMAN)
VWPNAPPAI

SEQ ID NO: 115995 - protein, 9 aa, Artificial Sequence
  Description of Artificial Sequence: Synthetic peptide
  Seed: EGFDHRDSK (MAR1_HUMAN)
ETFDHRDSL

SEQ ID NO: 115996 - protein, 11 aa, Artificial Sequence
  Description of Artificial Sequence: Synthetic peptide
  Seed: YRALMDKSLHV (MAR1_HUMAN)
YPALMDKSLHL

SEQ ID NO: 115997 - protein, 11 aa, Artificial Sequence
  Description of Artificial Sequence: Synthetic peptide
  Seed: EEAAGIGILTV (MAR1_HUMAN)
EEAAGIGILTW

SEQ ID NO: 115998 - protein, 11 aa, Artificial Sequence
  Description of Artificial Sequence: Synthetic peptide
  Seed: RALMDKSLHVG (MAR1_HUMAN)
RYLMDKSLHVV

SEQ ID NO: 115999 - protein, 9 aa, Artificial Sequence
  Description of Artificial Sequence: Synthetic peptide
  Seed: SAEQSPPPY (MAR1_HUMAN)
SSEQSPPPL

SEQ ID NO: 116000 - protein, 9 aa, Artificial Sequence
  Description of Artificial Sequence: Synthetic peptide
  Seed: KSLHVGTQC (MAR1_HUMAN)
KSLHVGTQF

SEQ ID NO: 116001 - protein, 10 aa, Artificial Sequence
  Description of Artificial Sequence: Synthetic peptide
  Seed: EAAGIGILTV (MAR1_HUMAN)
ESAGIGILTR

SEQ ID NO: 116002 - protein, 10 aa, Artificial Sequence
  Description of Artificial Sequence: Synthetic peptide
  Seed: EEAAGIGILT (MAR1_HUMAN)
ETAAGIGILA

SEQ ID NO: 116003 - protein, 9 aa, Artificial Sequence
  Description of Artificial Sequence: Synthetic peptide
  Seed: ALMDKSLHV (MAR1_HUMAN)
AAMDKSLHK

SEQ ID NO: 116004 - protein, 9 aa, Artificial Sequence
  Description of Artificial Sequence: Synthetic peptide
  Seed: AHFIYGYPK (MAR1_HUMAN)
AQFIYGYPK

SEQ ID NO: 116005 - protein, 9 aa, Artificial Sequence
  Description of Artificial Sequence: Synthetic peptide
  Seed: RRNGYRALM (MAR1_HUMAN)
RQNGYRALF

SEQ ID NO: 116006 - protein, 9 aa, Artificial Sequence
  Description of Artificial Sequence: Synthetic peptide
  Seed: AGIGILTVI (MAR1_HUMAN)
AMIGILTVF

SEQ ID NO: 116007 - protein, 10 aa, Artificial Sequence
  Description of Artificial Sequence: Synthetic peptide
  Seed: EAAGIGILTV (MAR1_HUMAN)
EVAGIGILTR

SEQ ID NO: 116008 - protein, 9 aa, Artificial Sequence
  Description of Artificial Sequence: Synthetic peptide
  Seed: RRRNGYRAL (MAR1_HUMAN)
RFRNGYRAM

SEQ ID NO: 116009 - protein, 9 aa, Artificial Sequence
  Description of Artificial Sequence: Synthetic peptide
  Seed: GTQCALTRR (MAR1_HUMAN)
GMQCALTRR

SEQ ID NO: 116010 - protein, 10 aa, Artificial Sequence
  Description of Artificial Sequence: Synthetic peptide
  Seed: RALMDKSLHV (MAR1_HUMAN)
RALMDKSLHA

SEQ ID NO: 116011 - protein, 9 aa, Artificial Sequence
  Description of Artificial Sequence: Synthetic peptide
  Seed: NAPPAYEKL (MAR1_HUMAN)
NHPPAYEKI

SEQ ID NO: 116012 - protein, 11 aa, Artificial Sequence
  Description of Artificial Sequence: Synthetic peptide
  Seed: YRALMDKSLHV (MAR1_HUMAN)
YFALMDKSLHV

SEQ ID NO: 116013 - protein, 9 aa, Artificial Sequence
  Description of Artificial Sequence: Synthetic peptide
  Seed: VVPNAPPAY (MAR1_HUMAN)
VVPNAPPAF

SEQ ID NO: 116014 - protein, 10 aa, Artificial Sequence
  Description of Artificial Sequence: Synthetic peptide
  Seed: RALMDKSLHV (MAR1_HUMAN)
RPLMDKSLHV

SEQ ID NO: 116015 - protein, 9 aa, Artificial Sequence
  Description of Artificial Sequence: Synthetic peptide
  Seed: ALMDKSLHV (MAR1_HUMAN)
AMMDKSLHW

SEQ ID NO: 116016 - protein, 9 aa, Artificial Sequence
  Description of Artificial Sequence: Synthetic peptide
  Seed: LHVGTQCAL (MAR1_HUMAN)
LAVGTQCAY

SEQ ID NO: 116017 - protein, 10 aa, Artificial Sequence
  Description of Artificial Sequence: Synthetic peptide
  Seed: AEEAAGIGIL (MAR1_HUMAN)
AEEAAGIGIW

SEQ ID NO: 116018 - protein, 9 aa, Artificial Sequence
  Description of Artificial Sequence: Synthetic peptide
  Seed: RRNGYRALM (MAR1_HUMAN)
RRNGYRALV

SEQ ID NO: 116019 - protein, 9 aa, Artificial Sequence
  Description of Artificial Sequence: Synthetic peptide
  Seed: ALMDKSLHV (MAR1_HUMAN)
ATMDKSLHK

SEQ ID NO: 116020 - protein, 9 aa, Artificial Sequence
  Description of Artificial Sequence: Synthetic peptide
  Seed: GILTVILGV (MAR1_HUMAN)
GLLTVILGI

SEQ ID NO: 116021 - protein, 9 aa, Artificial Sequence
  Description of Artificial Sequence: Synthetic peptide
  Seed: LHVGTQCAL (MAR1_HUMAN)
LLVGTQCAY

SEQ ID NO: 116022 - protein, 9 aa, Artificial Sequence
  Description of Artificial Sequence: Synthetic peptide
  Seed: GFDHRDSKV (MAR1_HUMAN)
GFDHRDSKL

SEQ ID NO: 116023 - protein, 10 aa, Artificial Sequence
  Description of Artificial Sequence: Synthetic peptide
  Seed: RRRNGYRALM (MAR1_HUMAN)
RKRNGYRALL

SEQ ID NO: 116024 - protein, 10 aa, Artificial Sequence
  Description of Artificial Sequence: Synthetic peptide
  Seed: YTTAEEAAGI (MAR1_HUMAN)
YMTAEEAAGL

SEQ ID NO: 116025 - protein, 9 aa, Artificial Sequence
  Description of Artificial Sequence: Synthetic peptide
  Seed: TVILGVLLL (MAR1_HUMAN)
TAILGVLLY

SEQ ID NO: 116026 - protein, 9 aa, Artificial Sequence
  Description of Artificial Sequence: Synthetic peptide
  Seed: KSLHVGTQC (MAR1_HUMAN)
KSLHVGTQW

SEQ ID NO: 116027 - protein, 9 aa, Artificial Sequence
  Description of Artificial Sequence: Synthetic peptide
  Seed: TTAEEAAGI (MAR1_HUMAN)
TMAEEAAGI

SEQ ID NO: 116028 - protein, 9 aa, Artificial Sequence
  Description of Artificial Sequence: Synthetic peptide
  Seed: GILTVILGV (MAR1_HUMAN)
GQLTVILGA

SEQ ID NO: 116029 - protein, 11 aa, Artificial Sequence
  Description of Artificial Sequence: Synthetic peptide
  Seed: YRALMDKSLHV (MAR1_HUMAN)
YVALMDKSLHI

SEQ ID NO: 116030 - protein, 10 aa, Artificial Sequence
  Description of Artificial Sequence: Synthetic peptide
  Seed: VPNAPPAYEK (MAR1_HUMAN)
VPNAPPAYEL

SEQ ID NO: 116031 - protein, 9 aa, Artificial Sequence
  Description of Artificial Sequence: Synthetic peptide
  Seed: LLIGCWYCR (MAR1_HUMAN)
LSIGCWYCR

SEQ ID NO: 116032 - protein, 9 aa, Artificial Sequence
  Description of Artificial Sequence: Synthetic peptide
  Seed: VVPNAPPAY (MAR1_HUMAN)
VWPNAPPAV

SEQ ID NO: 116033 - protein, 9 aa, Artificial Sequence
  Description of Artificial Sequence: Synthetic peptide
  Seed: LLLIGCWYC (MAR1_HUMAN)
LSLIGCWYV

SEQ ID NO: 116034 - protein, 9 aa, Artificial Sequence
  Description of Artificial Sequence: Synthetic peptide
  Seed: TVILGVLLL (MAR1_HUMAN)
TQILGVLLI

SEQ ID NO: 116035 - protein, 9 aa, Artificial Sequence
  Description of Artificial Sequence: Synthetic peptide
  Seed: VVPNAPPAY (MAR1_HUMAN)
VSPNAPPAW

SEQ ID NO: 116036 - protein, 9 aa, Artificial Sequence
  Description of Artificial Sequence: Synthetic peptide
  Seed: REDAHFIYG (MAR1_HUMAN)
REDAHFIYA

SEQ ID NO: 116037 - protein, 9 aa, Artificial Sequence
  Description of Artificial Sequence: Synthetic peptide
  Seed: RRNGYRALM (MAR1_HUMAN)
RVNGYRALF

SEQ ID NO: 116038 - protein, 9 aa, Artificial Sequence
  Description of Artificial Sequence: Synthetic peptide
  Seed: GILTVILGV (MAR1_HUMAN)
GTLTVILGV

SEQ ID NO: 116039 - protein, 11 aa, Artificial Sequence
  Description of Artificial Sequence: Synthetic peptide
  Seed: ALMDKSLHVGT (MAR1_HUMAN)
AIMDKSLHVGV

SEQ ID NO: 116040 - protein, 10 aa, Artificial Sequence
  Description of Artificial Sequence: Synthetic peptide
  Seed: LLIGCWYCRR (MAR1_HUMAN)
LFIGCWYCRK

SEQ ID NO: 116041 - protein, 9 aa, Artificial Sequence
  Description of Artificial Sequence: Synthetic peptide
  Seed: HSYTTAEEA (MAR1_HUMAN)
HHYTTAEEA

SEQ ID NO: 116042 - protein, 9 aa, Artificial Sequence
  Description of Artificial Sequence: Synthetic peptide
  Seed: NAPPAYEKL (MAR1_HUMAN)
NGPPAYEKM

SEQ ID NO: 116043 - protein, 10 aa, Artificial Sequence
  Description of Artificial Sequence: Synthetic peptide
  Seed: ALMDKSLHVG (MAR1_HUMAN)
AMMDKSLHVK

SEQ ID NO: 116044 - protein, 10 aa, Artificial Sequence
  Description of Artificial Sequence: Synthetic peptide
  Seed: RALMDKSLHV (MAR1_HUMAN)
RALMDKSLHL

SEQ ID NO: 116045 - protein, 11 aa, Artificial Sequence
  Description of Artificial Sequence: Synthetic peptide
  Seed: YRALMDKSLHV (MAR1_HUMAN)
YIALMDKSLHA

SEQ ID NO: 116046 - protein, 9 aa, Artificial Sequence
  Description of Artificial Sequence: Synthetic peptide
  Seed: VGTQCALTR (MAR1_HUMAN)
VVTQCALTK

SEQ ID NO: 116047 - protein, 9 aa, Artificial Sequence
  Description of Artificial Sequence: Synthetic peptide
  Seed: RRRNGYRAL (MAR1_HUMAN)
RERNGYRAF

SEQ ID NO: 116048 - protein, 10 aa, Artificial Sequence
  Description of Artificial Sequence: Synthetic peptide
  Seed: GILTVILGVL (MAR1_HUMAN)
GILTVILGVV

SEQ ID NO: 116049 - protein, 9 aa, Artificial Sequence
  Description of Artificial Sequence: Synthetic peptide
  Seed: MPREDAHFI (MAR1_HUMAN)
MVREDAHFY

SEQ ID NO: 116050 - protein, 10 aa, Artificial Sequence
  Description of Artificial Sequence: Synthetic peptide
  Seed: RRNGYRALMD (MAR1_HUMAN)
RRNGYRALMI

SEQ ID NO: 116051 - protein, 10 aa, Artificial Sequence
  Description of Artificial Sequence: Synthetic peptide
  Seed: RRRNGYRALM (MAR1_HUMAN)
RLRNGYRALL

SEQ ID NO: 116052 - protein, 10 aa, Artificial Sequence
  Description of Artificial Sequence: Synthetic peptide
  Seed: RALMDKSLHV (MAR1_HUMAN)
RPLMDKSLHI

SEQ ID NO: 116053 - protein, 9 aa, Artificial Sequence
  Description of Artificial Sequence: Synthetic peptide
  Seed: NAPPAYEKL (MAR1_HUMAN)
NMPPAYEKY

SEQ ID NO: 116054 - protein, 10 aa, Artificial Sequence
  Description of Artificial Sequence: Synthetic peptide
  Seed: RRRNGYRALM (MAR1_HUMAN)
RRRNGYRALY

SEQ ID NO: 116055 - protein, 8 aa, Artificial Sequence
  Description of Artificial Sequence: Synthetic peptide
  Seed: HRDSKVSL (MAR1_HUMAN)
HADSKVSL

SEQ ID NO: 116056 - protein, 8 aa, Artificial Sequence
  Description of Artificial Sequence: Synthetic peptide
  Seed: LMDKSLHV (MAR1_HUMAN)
LLDKSLHI

SEQ ID NO: 116057 - protein, 9 aa, Artificial Sequence
  Description of Artificial Sequence: Synthetic peptide
  Seed: LTVILGVLL (MAR1_HUMAN)
LTVILGVLF

SEQ ID NO: 116058 - protein, 10 aa, Artificial Sequence
  Description of Artificial Sequence: Synthetic peptide
  Seed: ALMDKSLHVG (MAR1_HUMAN)
AMMDKSLHVF

SEQ ID NO: 116059 - protein, 10 aa, Artificial Sequence
  Description of Artificial Sequence: Synthetic peptide
  Seed: RRRNGYRALM (MAR1_HUMAN)
RYRNGYRALF

SEQ ID NO: 116060 - protein, 9 aa, Artificial Sequence
  Description of Artificial Sequence: Synthetic peptide
  Seed: LLIGCWYCR (MAR1_HUMAN)
LFIGCWYCR

SEQ ID NO: 116061 - protein, 11 aa, Artificial Sequence
  Description of Artificial Sequence: Synthetic peptide
  Seed: KSLHVGTQCAL (MAR1_HUMAN)
KSLHVGTQCAF

SEQ ID NO: 116062 - protein, 10 aa, Artificial Sequence
  Description of Artificial Sequence: Synthetic peptide
  Seed: ALMDKSLHVG (MAR1_HUMAN)
AYMDKSLHVV

SEQ ID NO: 116063 - protein, 10 aa, Artificial Sequence
  Description of Artificial Sequence: Synthetic peptide
  Seed: TVILGVLLLI (MAR1_HUMAN)
TVILGVLLLV

SEQ ID NO: 116064 - protein, 9 aa, Artificial Sequence
  Description of Artificial Sequence: Synthetic peptide
  Seed: AGIGILTVI (MAR1_HUMAN)
ATIGILTVV

SEQ ID NO: 116065 - protein, 8 aa, Artificial Sequence
  Description of Artificial Sequence: Synthetic peptide
  Seed: LMDKSLHV (MAR1_HUMAN)
LVDKSLHV

SEQ ID NO: 116066 - protein, 9 aa, Artificial Sequence
  Description of Artificial Sequence: Synthetic peptide
  Seed: LLLIGCWYC (MAR1_HUMAN)
LVLIGCWYI

SEQ ID NO: 116067 - protein, 10 aa, Artificial Sequence
  Description of Artificial Sequence: Synthetic peptide
  Seed: LLIGCWYCRR (MAR1_HUMAN)
LVIGCWYCRK

SEQ ID NO: 116068 - protein, 9 aa, Artificial Sequence
  Description of Artificial Sequence: Synthetic peptide
  Seed: RRRNGYRAL (MAR1_HUMAN)
RQRNGYRAL

SEQ ID NO: 116069 - protein, 9 aa, Artificial Sequence
  Description of Artificial Sequence: Synthetic peptide
  Seed: ALMDKSLHV (MAR1_HUMAN)
AAMDKSLHV

SEQ ID NO: 116070 - protein, 9 aa, Artificial Sequence
  Description of Artificial Sequence: Synthetic peptide
  Seed: SAEQSPPPY (MAR1_HUMAN)
STEQSPPPL

SEQ ID NO: 116071 - protein, 11 aa, Artificial Sequence
  Description of Artificial Sequence: Synthetic peptide
  Seed: YRALMDKSLHV (MAR1_HUMAN)
YDALMDKSLHM

SEQ ID NO: 116072 - protein, 10 aa, Artificial Sequence
  Description of Artificial Sequence: Synthetic peptide
  Seed: APPAYEKLSA (MAR1_HUMAN)
ALPAYEKLSM

SEQ ID NO: 116073 - protein, 9 aa, Artificial Sequence
  Description of Artificial Sequence: Synthetic peptide
  Seed: VVPNAPPAY (MAR1_HUMAN)
VYPNAPPAY

SEQ ID NO: 116074 - protein, 9 aa, Artificial Sequence
  Description of Artificial Sequence: Synthetic peptide
  Seed: LLLIGCWYC (MAR1_HUMAN)
LQLIGCWYL

SEQ ID NO: 116075 - protein, 10 aa, Artificial Sequence
  Description of Artificial Sequence: Synthetic peptide
  Seed: TVILGVLLLI (MAR1_HUMAN)
TTILGVLLLI

SEQ ID NO: 116076 - protein, 9 aa, Artificial Sequence
  Description of Artificial Sequence: Synthetic peptide
  Seed: VVPNAPPAY (MAR1_HUMAN)
VPPNAPPAL

SEQ ID NO: 116077 - protein, 10 aa, Artificial Sequence
  Description of Artificial Sequence: Synthetic peptide
  Seed: RALMDKSLHV (MAR1_HUMAN)
RYLMDKSLHV

SEQ ID NO: 116078 - protein, 10 aa, Artificial Sequence
  Description of Artificial Sequence: Synthetic peptide
  Seed: ALMDKSLHVG (MAR1_HUMAN)
ALMDKSLHVP

SEQ ID NO: 116079 - protein, 9 aa, Artificial Sequence
  Description of Artificial Sequence: Synthetic peptide
  Seed: ALMDKSLHV (MAR1_HUMAN)
ARMDKSLHL

SEQ ID NO: 116080 - protein, 9 aa, Artificial Sequence
  Description of Artificial Sequence: Synthetic peptide
  Seed: TVILGVLLL (MAR1_HUMAN)
TTILGVLLW

SEQ ID NO: 116081 - protein, 10 aa, Artificial Sequence
  Description of Artificial Sequence: Synthetic peptide
  Seed: EEAAGIGILT (MAR1_HUMAN)
EGAAGIGILV

SEQ ID NO: 116082 - protein, 9 aa, Artificial Sequence
  Description of Artificial Sequence: Synthetic peptide
  Seed: NAPPAYEKL (MAR1_HUMAN)
NAPPAYEKI

SEQ ID NO: 116083 - protein, 9 aa, Artificial Sequence
  Description of Artificial Sequence: Synthetic peptide
  Seed: EAAGIGILT (MAR1_HUMAN)
EGAGIGILV

SEQ ID NO: 116084 - protein, 9 aa, Artificial Sequence
  Description of Artificial Sequence: Synthetic peptide
  Seed: AAGIGILTV (MAR1_HUMAN)
AAGIGILTF

SEQ ID NO: 116085 - protein, 9 aa, Artificial Sequence
  Description of Artificial Sequence: Synthetic peptide
  Seed: NAPPAYEKL (MAR1_HUMAN)
NHPPAYEKL

SEQ ID NO: 116086 - protein, 10 aa, Artificial Sequence
  Description of Artificial Sequence: Synthetic peptide
  Seed: IGILTVILGV (MAR1_HUMAN)
IMILTVILGV

SEQ ID NO: 116087 - protein, 9 aa, Artificial Sequence
  Description of Artificial Sequence: Synthetic peptide
  Seed: MPREDAHFI (MAR1_HUMAN)
MPREDAHFV

SEQ ID NO: 116088 - protein, 9 aa, Artificial Sequence
  Description of Artificial Sequence: Synthetic peptide
  Seed: AAGIGILTV (MAR1_HUMAN)
AAGIGILTM

SEQ ID NO: 116089 - protein, 11 aa, Artificial Sequence
  Description of Artificial Sequence: Synthetic peptide
  Seed: EEAAGIGILTV (MAR1_HUMAN)
EEAAGIGILTY

SEQ ID NO: 116090 - protein, 9 aa, Artificial Sequence
  Description of Artificial Sequence: Synthetic peptide
  Seed: NAPPAYEKL (MAR1_HUMAN)
NMPPAYEKL

SEQ ID NO: 116091 - protein, 10 aa, Artificial Sequence
  Description of Artificial Sequence: Synthetic peptide
  Seed: LLIGCWYCRR (MAR1_HUMAN)
LYIGCWYCRR

SEQ ID NO: 116092 - protein, 10 aa, Artificial Sequence
  Description of Artificial Sequence: Synthetic peptide
  Seed: RRRNGYRALM (MAR1_HUMAN)
RHRNGYRALM

SEQ ID NO: 116093 - protein, 9 aa, Artificial Sequence
  Description of Artificial Sequence: Synthetic peptide
  Seed: YRALMDKSL (MAR1_HUMAN)
YLALMDKSY

SEQ ID NO: 116094 - protein, 9 aa, Artificial Sequence
  Description of Artificial Sequence: Synthetic peptide
  Seed: LHVGTQCAL (MAR1_HUMAN)
LQVGTQCAY

SEQ ID NO: 116095 - protein, 10 aa, Artificial Sequence
  Description of Artificial Sequence: Synthetic peptide
  Seed: EEAAGIGILT (MAR1_HUMAN)
EGAAGIGILI

SEQ ID NO: 116096 - protein, 10 aa, Artificial Sequence
  Description of Artificial Sequence: Synthetic peptide
  Seed: ALMDKSLHVG (MAR1_HUMAN)
ALMDKSLHVE

SEQ ID NO: 116097 - protein, 9 aa, Artificial Sequence
  Description of Artificial Sequence: Synthetic peptide
  Seed: RRRNGYRAL (MAR1_HUMAN)
RKRNGYRAF

SEQ ID NO: 116098 - protein, 9 aa, Artificial Sequence
  Description of Artificial Sequence: Synthetic peptide
  Seed: GYPKKGHGH (MAR1_HUMAN)
GFPKKGHGY

SEQ ID NO: 116099 - protein, 10 aa, Artificial Sequence
  Description of Artificial Sequence: Synthetic peptide
  Seed: TVILGVLLLI (MAR1_HUMAN)
TLILGVLLLL

SEQ ID NO: 116100 - protein, 8 aa, Artificial Sequence
  Description of Artificial Sequence: Synthetic peptide
  Seed: LMDKSLHV (MAR1_HUMAN)
LSDKSLHF

SEQ ID NO: 116101 - protein, 10 aa, Artificial Sequence
  Description of Artificial Sequence: Synthetic peptide
  Seed: RALMDKSLHV (MAR1_HUMAN)
RHLMDKSLHI

SEQ ID NO: 116102 - protein, 9 aa, Artificial Sequence
  Description of Artificial Sequence: Synthetic peptide
  Seed: NAPPAYEKL (MAR1_HUMAN)
NGPPAYEKL

SEQ ID NO: 116103 - protein, 10 aa, Artificial Sequence
  Description of Artificial Sequence: Synthetic peptide
  Seed: RALMDKSLHV (MAR1_HUMAN)
RDLMDKSLHI

SEQ ID NO: 116104 - protein, 10 aa, Artificial Sequence
  Description of Artificial Sequence: Synthetic peptide
  Seed: YPKKGHGHSY (MAR1_HUMAN)
YPKKGHGHSF

SEQ ID NO: 116105 - protein, 9 aa, Artificial Sequence
  Description of Artificial Sequence: Synthetic peptide
  Seed: ALMDKSLHV (MAR1_HUMAN)
AVMDKSLHV

SEQ ID NO: 116106 - protein, 11 aa, Artificial Sequence
  Description of Artificial Sequence: Synthetic peptide
  Seed: EAAGIGILTVI (MAR1_HUMAN)
ETAGIGILTVV

SEQ ID NO: 116107 - protein, 9 aa, Artificial Sequence
  Description of Artificial Sequence: Synthetic peptide
  Seed: YRALMDKSL (MAR1_HUMAN)
YYALMDKSF

SEQ ID NO: 116108 - protein, 8 aa, Artificial Sequence
  Description of Artificial Sequence: Synthetic peptide
  Seed: LMDKSLHV (MAR1_HUMAN)
LVDKSLHL

SEQ ID NO: 116109 - protein, 9 aa, Artificial Sequence
  Description of Artificial Sequence: Synthetic peptide
  Seed: KSLHVGTQC (MAR1_HUMAN)
KLLHVGTQW

SEQ ID NO: 116110 - protein, 9 aa, Artificial Sequence
  Description of Artificial Sequence: Synthetic peptide
  Seed: NAPPAYEKL (MAR1_HUMAN)
NIPPAYEKL

SEQ ID NO: 116111 - protein, 9 aa, Artificial Sequence
  Description of Artificial Sequence: Synthetic peptide
  Seed: KSLHVGTQC (MAR1_HUMAN)
KALHVGTQL

SEQ ID NO: 116112 - protein, 9 aa, Artificial Sequence
  Description of Artificial Sequence: Synthetic peptide
  Seed: VVPNAPPAY (MAR1_HUMAN)
VTPNAPPAL

SEQ ID NO: 116113 - protein, 9 aa, Artificial Sequence
  Description of Artificial Sequence: Synthetic peptide
  Seed: EAAGIGILT (MAR1_HUMAN)
EAAGIGILM

SEQ ID NO: 116114 - protein, 10 aa, Artificial Sequence
  Description of Artificial Sequence: Synthetic peptide
  Seed: TVILGVLLLI (MAR1_HUMAN)
TTILGVLLLV

SEQ ID NO: 116115 - protein, 8 aa, Artificial Sequence
  Description of Artificial Sequence: Synthetic peptide
  Seed: LMDKSLHV (MAR1_HUMAN)
LWDKSLHF

SEQ ID NO: 116116 - protein, 9 aa, Artificial Sequence
  Description of Artificial Sequence: Synthetic peptide
  Seed: DHRDSKVSL (MAR1_HUMAN)
DRRDSKVSL

SEQ ID NO: 116117 - protein, 9 aa, Artificial Sequence
  Description of Artificial Sequence: Synthetic peptide
  Seed: VVPNAPPAY (MAR1_HUMAN)
VAPNAPPAV

SEQ ID NO: 116118 - protein, 10 aa, Artificial Sequence
  Description of Artificial Sequence: Synthetic peptide
  Seed: EAAGIGILTV (MAR1_HUMAN)
EVAGIGILTY

SEQ ID NO: 116119 - protein, 9 aa, Artificial Sequence
  Description of Artificial Sequence: Synthetic peptide
  Seed: RRRNGYRAL (MAR1_HUMAN)
RYRNGYRAV

SEQ ID NO: 116120 - protein, 9 aa, Artificial Sequence
  Description of Artificial Sequence: Synthetic peptide
  Seed: NAPPAYEKL (MAR1_HUMAN)
NRPPAYEKM

SEQ ID NO: 116121 - protein, 11 aa, Artificial Sequence
  Description of Artificial Sequence: Synthetic peptide
  Seed: YRALMDKSLHV (MAR1_HUMAN)
YWALMDKSLHV

SEQ ID NO: 116122 - protein, 10 aa, Artificial Sequence
  Description of Artificial Sequence: Synthetic peptide
  Seed: GILTVILGVL (MAR1_HUMAN)
GLLTVILGVV

SEQ ID NO: 116123 - protein, 9 aa, Artificial Sequence
  Description of Artificial Sequence: Synthetic peptide
  Seed: RRRNGYRAL (MAR1_HUMAN)
RARNGYRAM

SEQ ID NO: 116124 - protein, 10 aa, Artificial Sequence
  Description of Artificial Sequence: Synthetic peptide
  Seed: RALMDKSLHV (MAR1_HUMAN)
RPLMDKSLHL

SEQ ID NO: 116125 - protein, 10 aa, Artificial Sequence
  Description of Artificial Sequence: Synthetic peptide
  Seed: RRRNGYRALM (MAR1_HUMAN)
RNRNGYRALL

SEQ ID NO: 116126 - protein, 9 aa, Artificial Sequence
  Description of Artificial Sequence: Synthetic peptide
  Seed: LLIGCWYCR (MAR1_HUMAN)
LYIGCWYCR

SEQ ID NO: 116127 - protein, 9 aa, Artificial Sequence
  Description of Artificial Sequence: Synthetic peptide
  Seed: ALMDKSLHV (MAR1_HUMAN)
ANMDKSLHI

SEQ ID NO: 116128 - protein, 9 aa, Artificial Sequence
  Description of Artificial Sequence: Synthetic peptide
  Seed: TVILGVLLL (MAR1_HUMAN)
TTILGVLLM

SEQ ID NO: 116129 - protein, 10 aa, Artificial Sequence
  Description of Artificial Sequence: Synthetic peptide
  Seed: RRRNGYRALM (MAR1_HUMAN)
RERNGYRALL

SEQ ID NO: 116130 - protein, 9 aa, Artificial Sequence
  Description of Artificial Sequence: Synthetic peptide
  Seed: NAPPAYEKL (MAR1_HUMAN)
NAPPAYEKY

SEQ ID NO: 116131 - protein, 9 aa, Artificial Sequence
  Description of Artificial Sequence: Synthetic peptide
  Seed: RRRNGYRAL (MAR1_HUMAN)
RLRNGYRAF

SEQ ID NO: 116132 - protein, 10 aa, Artificial Sequence
  Description of Artificial Sequence: Synthetic peptide
  Seed: DAHFIYGYPK (MAR1_HUMAN)
DMHFIYGYPR

SEQ ID NO: 116133 - protein, 10 aa, Artificial Sequence
  Description of Artificial Sequence: Synthetic peptide
  Seed: RNGYRALMDK (MAR1_HUMAN)
RVGYRALMDK

SEQ ID NO: 116134 - protein, 9 aa, Artificial Sequence
  Description of Artificial Sequence: Synthetic peptide
  Seed: SLHVGTQCA (MAR1_HUMAN)
SIHVGTQCV

SEQ ID NO: 116135 - protein, 11 aa, Artificial Sequence
  Description of Artificial Sequence: Synthetic peptide
  Seed: YRALMDKSLHV (MAR1_HUMAN)
YPALMDKSLHA

SEQ ID NO: 116136 - protein, 9 aa, Artificial Sequence
  Description of Artificial Sequence: Synthetic peptide
  Seed: VILGVLLLI (MAR1_HUMAN)
VQLGVLLLA

SEQ ID NO: 116137 - protein, 10 aa, Artificial Sequence
  Description of Artificial Sequence: Synthetic peptide
  Seed: ALMDKSLHVG (MAR1_HUMAN)
AIMDKSLHVL

SEQ ID NO: 116138 - protein, 9 aa, Artificial Sequence
  Description of Artificial Sequence: Synthetic peptide
  Seed: ALMDKSLHV (MAR1_HUMAN)
ARMDKSLHM

SEQ ID NO: 116139 - protein, 9 aa, Artificial Sequence
  Description of Artificial Sequence: Synthetic peptide
  Seed: VVPNAPPAY (MAR1_HUMAN)
VAPNAPPAI

SEQ ID NO: 116140 - protein, 10 aa, Artificial Sequence
  Description of Artificial Sequence: Synthetic peptide
  Seed: APPAYEKLSA (MAR1_HUMAN)
APPAYEKLSM

SEQ ID NO: 116141 - protein, 9 aa, Artificial Sequence
  Description of Artificial Sequence: Synthetic peptide
  Seed: ALMDKSLHV (MAR1_HUMAN)
AVMDKSLHY

SEQ ID NO: 116142 - protein, 9 aa, Artificial Sequence
  Description of Artificial Sequence: Synthetic peptide
  Seed: NAPPAYEKL (MAR1_HUMAN)
NMPPAYEKV

SEQ ID NO: 116143 - protein, 9 aa, Artificial Sequence
  Description of Artificial Sequence: Synthetic peptide
  Seed: HSYTTAEEA (MAR1_HUMAN)
HMYTTAEEY

SEQ ID NO: 116144 - protein, 9 aa, Artificial Sequence
  Description of Artificial Sequence: Synthetic peptide
  Seed: HFIYGYPKK (MAR1_HUMAN)
HIIYGYPKK

SEQ ID NO: 116145 - protein, 9 aa, Artificial Sequence
  Description of Artificial Sequence: Synthetic peptide
  Seed: HSYTTAEEA (MAR1_HUMAN)
HVYTTAEEL

SEQ ID NO: 116146 - protein, 11 aa, Artificial Sequence
  Description of Artificial Sequence: Synthetic peptide
  Seed: YRALMDKSLHV (MAR1_HUMAN)
YYALMDKSLHI

SEQ ID NO: 116147 - protein, 9 aa, Artificial Sequence
  Description of Artificial Sequence: Synthetic peptide
  Seed: VILGVLLLI (MAR1_HUMAN)
VILGVLLLW

SEQ ID NO: 116148 - protein, 9 aa, Artificial Sequence
  Description of Artificial Sequence: Synthetic peptide
  Seed: VVPNAPPAY (MAR1_HUMAN)
VVPNAPPAM

SEQ ID NO: 116149 - protein, 9 aa, Artificial Sequence
  Description of Artificial Sequence: Synthetic peptide
  Seed: ALMDKSLHV (MAR1_HUMAN)
AEMDKSLHL

SEQ ID NO: 116150 - protein, 9 aa, Artificial Sequence
  Description of Artificial Sequence: Synthetic peptide
  Seed: ALMDKSLHV (MAR1_HUMAN)
AIMDKSLHI

SEQ ID NO: 116151 - protein, 11 aa, Artificial Sequence
  Description of Artificial Sequence: Synthetic peptide
  Seed: YCRRRNGYRAL (MAR1_HUMAN)
YLRRRNGYRAF

SEQ ID NO: 116152 - protein, 10 aa, Artificial Sequence
  Description of Artificial Sequence: Synthetic peptide
  Seed: RALMDKSLHV (MAR1_HUMAN)
RQLMDKSLHV

SEQ ID NO: 116153 - protein, 9 aa, Artificial Sequence
  Description of Artificial Sequence: Synthetic peptide
  Seed: VVPNAPPAY (MAR1_HUMAN)
VHPNAPPAL

SEQ ID NO: 116154 - protein, 10 aa, Artificial Sequence
  Description of Artificial Sequence: Synthetic peptide
  Seed: AEQSPPPYSP (MAR1_HUMAN)
AEQSPPPYST

SEQ ID NO: 116155 - protein, 9 aa, Artificial Sequence
  Description of Artificial Sequence: Synthetic peptide
  Seed: RRNGYRALM (MAR1_HUMAN)
RFNGYRALM

SEQ ID NO: 116156 - protein, 10 aa, Artificial Sequence
  Description of Artificial Sequence: Synthetic peptide
  Seed: RRRNGYRALM (MAR1_HUMAN)
RMRNGYRALF

SEQ ID NO: 116157 - protein, 11 aa, Artificial Sequence
  Description of Artificial Sequence: Synthetic peptide
  Seed: YRALMDKSLHV (MAR1_HUMAN)
YNALMDKSLHI

SEQ ID NO: 116158 - protein, 10 aa, Artificial Sequence
  Description of Artificial Sequence: Synthetic peptide
  Seed: RDSKVSLQEK (MAR1_HUMAN)
RPSKVSLQEK

SEQ ID NO: 116159 - protein, 9 aa, Artificial Sequence
  Description of Artificial Sequence: Synthetic peptide
  Seed: HSYTTAEEA (MAR1_HUMAN)
HHYTTAEEV

SEQ ID NO: 116160 - protein, 9 aa, Artificial Sequence
  Description of Artificial Sequence: Synthetic peptide
  Seed: LHVGTQCAL (MAR1_HUMAN)
LHVGTQCAY

SEQ ID NO: 116161 - protein, 10 aa, Artificial Sequence
  Description of Artificial Sequence: Synthetic peptide
  Seed: ALMDKSLHVG (MAR1_HUMAN)
AMMDKSLHVA

SEQ ID NO: 116162 - protein, 10 aa, Homo sapiens
  Native (MAR1_HUMAN)
KSLHVGTQCA

SEQ ID NO: 116163 - protein, 11 aa, Homo sapiens
  Native (MAR1_HUMAN)
CRRRNGYRALM

SEQ ID NO: 116164 - protein, 11 aa, Homo sapiens
  Native (MAR1_HUMAN)
EPVVPNAPPAY

SEQ ID NO: 116165 - protein, 10 aa, Homo sapiens
  Native (MAR1_HUMAN)
HVGTQCALTR

SEQ ID NO: 116166 - protein, 10 aa, Homo sapiens
  Native (MAR1_HUMAN)
AHFIYGYPKK

SEQ ID NO: 116167 - protein, 9 aa, Homo sapiens
  Native (MAR1_HUMAN)
EGFDHRDSK

SEQ ID NO: 116168 - protein, 11 aa, Homo sapiens
  Native (MAR1_HUMAN)
RALMDKSLHVG

SEQ ID NO: 116169 - protein, 11 aa, Homo sapiens
  Native (MAR1_HUMAN)
GIGILTVILGV

SEQ ID NO: 116170 - protein, 11 aa, Homo sapiens
  Native (MAR1_HUMAN)
GHSYTTAEEAA

SEQ ID NO: 116171 - protein, 10 aa, Homo sapiens
  Native (MAR1_HUMAN)
CEPVVPNAPP

SEQ ID NO: 116172 - protein, 11 aa, Homo sapiens
  Native (MAR1_HUMAN)
ALMDKSLHVGT

SEQ ID NO: 116173 - protein, 9 aa, Homo sapiens
  Native (MAR1_HUMAN)
GHGHSYTTA

SEQ ID NO: 116174 - protein, 11 aa, Homo sapiens
  Native (MAR1_HUMAN)
VPNAPPAYEKL

SEQ ID NO: 116175 - protein, 10 aa, Homo sapiens
  Native (MAR1_HUMAN)
TAEEAAGIGI

SEQ ID NO: 116176 - protein, 9 aa, Homo sapiens
  Native (MAR1_HUMAN)
VLLLIGCWY

SEQ ID NO: 116177 - protein, 9 aa, Homo sapiens
  Native (MAR1_HUMAN)
DSKVSLQEK

SEQ ID NO: 116178 - protein, 10 aa, Homo sapiens
  Native (MAR1_HUMAN)
YTTAEEAAGI

SEQ ID NO: 116179 - protein, 9 aa, Homo sapiens
  Native (MAR1_HUMAN)
TRRCPQEGF

SEQ ID NO: 116180 - protein, 9 aa, Homo sapiens
  Native (MAR1_HUMAN)
RRRNGYRAL

SEQ ID NO: 116181 - protein, 10 aa, Homo sapiens
  Native (MAR1_HUMAN)
KGHGHSYTTA

SEQ ID NO: 116182 - protein, 10 aa, Homo sapiens
  Native (MAR1_HUMAN)
CRRRNGYRAL

SEQ ID NO: 116183 - protein, 8 aa, Homo sapiens
  Native (MAR1_HUMAN)
CEPVVPNA

SEQ ID NO: 116184 - protein, 8 aa, Homo sapiens
  Native (MAR1_HUMAN)
REDAHFIY

SEQ ID NO: 116185 - protein, 10 aa, Homo sapiens
  Native (MAR1_HUMAN)
CWYCRRRNGY

SEQ ID NO: 116186 - protein, 8 aa, Homo sapiens
  Native (MAR1_HUMAN)
APPAYEKL

SEQ ID NO: 116187 - protein, 8 aa, Homo sapiens
  Native (MAR1_HUMAN)
QEKNCEPV

SEQ ID NO: 116188 - protein, 10 aa, Homo sapiens
  Native (MAR1_HUMAN)
RNGYRALMDK

SEQ ID NO: 116189 - protein, 10 aa, Homo sapiens
  Native (MAR1_HUMAN)
RRRNGYRALM

SEQ ID NO: 116190 - protein, 11 aa, Homo sapiens
  Native (MAR1_HUMAN)
SLQEKNCEPVV

SEQ ID NO: 116191 - protein, 9 aa, Homo sapiens
  Native (MAR1_HUMAN)
GVLLLIGCW

SEQ ID NO: 116192 - protein, 9 aa, Homo sapiens
  Native (MAR1_HUMAN)
AGIGILTVI

SEQ ID NO: 116193 - protein, 11 aa, Homo sapiens
  Native (MAR1_HUMAN)
YCRRRNGYRAL

SEQ ID NO: 116194 - protein, 11 aa, Homo sapiens
  Native (MAR1_HUMAN)
QEGFDHRDSKV

SEQ ID NO: 116195 - protein, 10 aa, Homo sapiens
  Native (MAR1_HUMAN)
TVILGVLLLI

SEQ ID NO: 116196 - protein, 11 aa, Homo sapiens
  Native (MAR1_HUMAN)
EAAGIGILTVI

SEQ ID NO: 116197 - protein, 10 aa, Homo sapiens
  Native (MAR1_HUMAN)
LLLIGCWYCR

SEQ ID NO: 116198 - protein, 10 aa, Homo sapiens
  Native (MAR1_HUMAN)
VGTQCALTRR

SEQ ID NO: 116199 - protein, 9 aa, Homo sapiens
  Native (MAR1_HUMAN)
NGYRALMDK

SEQ ID NO: 116200 - protein, 8 aa, Homo sapiens
  Native (MAR1_HUMAN)
LMDKSLHV

SEQ ID NO: 116201 - protein, 10 aa, Homo sapiens
  Native (MAR1_HUMAN)
ILTVILGVLL

SEQ ID NO: 116202 - protein, 9 aa, Homo sapiens
  Native (MAR1_HUMAN)
IGCWYCRRR

SEQ ID NO: 116203 - protein, 10 aa, Homo sapiens
  Native (MAR1_HUMAN)
QEKNCEPVVP

SEQ ID NO: 116204 - protein, 10 aa, Homo sapiens
  Native (MAR1_HUMAN)
APPAYEKLSA

SEQ ID NO: 116205 - protein, 11 aa, Homo sapiens
  Native (MAR1_HUMAN)
TTAEEAAGIGI

SEQ ID NO: 116206 - protein, 9 aa, Homo sapiens
  Native (MAR1_HUMAN)
PVVPNAPPA

SEQ ID NO: 116207 - protein, 11 aa, Homo sapiens
  Native (MAR1_HUMAN)
GFDHRDSKVSL

SEQ ID NO: 116208 - protein, 11 aa, Homo sapiens
  Native (MAR1_HUMAN)
AEEAAGIGILT

SEQ ID NO: 116209 - protein, 11 aa, Homo sapiens
  Native (MAR1_HUMAN)
RRRNGYRALMD

SEQ ID NO: 116210 - protein, 9 aa, Homo sapiens
  Native (MAR1_HUMAN)
EAAGIGILT

SEQ ID NO: 116211 - protein, 11 aa, Homo sapiens
  Native (MAR1_HUMAN)
LLLIGCWYCRR

SEQ ID NO: 116212 - protein, 9 aa, Homo sapiens
  Native (MAR1_HUMAN)
PKKGHGHSY

SEQ ID NO: 116213 - protein, 9 aa, Homo sapiens
  Native (MAR1_HUMAN)
EPVVPNAPP

SEQ ID NO: 116214 - protein, 11 aa, Homo sapiens
  Native (MAR1_HUMAN)
TAEEAAGIGIL

SEQ ID NO: 116215 - protein, 10 aa, Homo sapiens
  Native (MAR1_HUMAN)
YEKLSAEQSP

SEQ ID NO: 116216 - protein, 11 aa, Homo sapiens
  Native (MAR1_HUMAN)
HVGTQCALTRR

SEQ ID NO: 116217 - protein, 9 aa, Homo sapiens
  Native (MAR1_HUMAN)
YEKLSAEQS

SEQ ID NO: 116218 - protein, 11 aa, Homo sapiens
  Native (MAR1_HUMAN)
LLIGCWYCRRR

SEQ ID NO: 116219 - protein, 8 aa, Homo sapiens
  Native (MAR1_HUMAN)
HRDSKVSL

SEQ ID NO: 116220 - protein, 8 aa, Homo sapiens
  Native (MAR1_HUMAN)
LIGCWYCR

SEQ ID NO: 116221 - protein, 8 aa, Homo sapiens
  Native (MAR1_HUMAN)
NAPPAYEK

SEQ ID NO: 116222 - protein, 9 aa, Homo sapiens
  Native (MAR1_HUMAN)
ILTVILGVL

SEQ ID NO: 116223 - protein, 10 aa, Homo sapiens
  Native (MAR1_HUMAN)
GHSYTTAEEA

SEQ ID NO: 116224 - protein, 8 aa, Homo sapiens
  Native (MAR1_HUMAN)
TAEEAAGI

SEQ ID NO: 116225 - protein, 10 aa, Homo sapiens
  Native (MAR1_HUMAN)
AAGIGILTVI

SEQ ID NO: 116226 - protein, 9 aa, Homo sapiens
  Native (MAR1_HUMAN)
CEPVVPNAP

SEQ ID NO: 116227 - protein, 9 aa, Homo sapiens
  Native (MAR1_HUMAN)
SAEQSPPPY

SEQ ID NO: 116228 - protein, 11 aa, Homo sapiens
  Native (MAR1_HUMAN)
HRDSKVSLQEK

SEQ ID NO: 116229 - protein, 10 aa, Homo sapiens
  Native (MAR1_HUMAN)
RRCPQEGFDH

SEQ ID NO: 116230 - protein, 10 aa, Homo sapiens
  Native (MAR1_HUMAN)
GYRALMDKSL

SEQ ID NO: 116231 - protein, 10 aa, Homo sapiens
  Native (MAR1_HUMAN)
LLIGCWYCRR

SEQ ID NO: 116232 - protein, 9 aa, Homo sapiens
  Native (MAR1_HUMAN)
TVILGVLLL

SEQ ID NO: 116233 - protein, 11 aa, Homo sapiens
  Native (MAR1_HUMAN)
VVPNAPPAYEK

SEQ ID NO: 116234 - protein, 9 aa, Homo sapiens
  Native (MAR1_HUMAN)
HFIYGYPKK

SEQ ID NO: 116235 - protein, 8 aa, Homo sapiens
  Native (MAR1_HUMAN)
HFIYGYPK

SEQ ID NO: 116236 - protein, 8 aa, Homo sapiens
  Native (MAR1_HUMAN)
ILGVLLLI

SEQ ID NO: 116237 - protein, 8 aa, Homo sapiens
  Native (MAR1_HUMAN)
FDHRDSKV

SEQ ID NO: 116238 - protein, 11 aa, Homo sapiens
  Native (MAR1_HUMAN)
CEPVVPNAPPA

SEQ ID NO: 116239 - protein, 8 aa, Homo sapiens
  Native (MAR1_HUMAN)
AGIGILTV

SEQ ID NO: 116240 - protein, 10 aa, Homo sapiens
  Native (MAR1_HUMAN)
GVLLLIGCWY

SEQ ID NO: 116241 - protein, 9 aa, Homo sapiens
  Native (MAR1_HUMAN)
LIGCWYCRR

SEQ ID NO: 116242 - protein, 9 aa, Homo sapiens
  Native (MAR1_HUMAN)
HRDSKVSLQ

SEQ ID NO: 116243 - protein, 8 aa, Homo sapiens
  Native (MAR1_HUMAN)
EEAAGIGI

SEQ ID NO: 116244 - protein, 8 aa, Homo sapiens
  Native (MAR1_HUMAN)
HVGTQCAL

SEQ ID NO: 116245 - protein, 11 aa, Homo sapiens
  Native (MAR1_HUMAN)
RRNGYRALMDK

SEQ ID NO: 116246 - protein, 10 aa, Homo sapiens
  Native (MAR1_HUMAN)
LTVILGVLLL

SEQ ID NO: 116247 - protein, 9 aa, Homo sapiens
  Native (MAR1_HUMAN)
SLHVGTQCA

SEQ ID NO: 116248 - protein, 11 aa, Homo sapiens
  Native (MAR1_HUMAN)
VLLLIGCWYCR

SEQ ID NO: 116249 - protein, 9 aa, Homo sapiens
  Native (MAR1_HUMAN)
EQSPPPYSP

SEQ ID NO: 116250 - protein, 10 aa, Homo sapiens
  Native (MAR1_HUMAN)
GILTVILGVL

SEQ ID NO: 116251 - protein, 9 aa, Homo sapiens
  Native (MAR1_HUMAN)
GYPKKGHGH

SEQ ID NO: 116252 - protein, 10 aa, Homo sapiens
  Native (MAR1_HUMAN)
RALMDKSLHV

SEQ ID NO: 116253 - protein, 9 aa, Homo sapiens
  Native (MAR1_HUMAN)
PPAYEKLSA

SEQ ID NO: 116254 - protein, 10 aa, Homo sapiens
  Native (MAR1_HUMAN)
SLHVGTQCAL

SEQ ID NO: 116255 - protein, 11 aa, Homo sapiens
  Native (MAR1_HUMAN)
KLSAEQSPPPY

SEQ ID NO: 116256 - protein, 8 aa, Homo sapiens
  Native (MAR1_HUMAN)
IGILTVIL

SEQ ID NO: 116257 - protein, 10 aa, Homo sapiens
  Native (MAR1_HUMAN)
FDHRDSKVSL

SEQ ID NO: 116258 - protein, 9 aa, Homo sapiens
  Native (MAR1_HUMAN)
RALMDKSLH

SEQ ID NO: 116259 - protein, 8 aa, Homo sapiens
  Native (MAR1_HUMAN)
VPNAPPAY

SEQ ID NO: 116260 - protein, 9 aa, Homo sapiens
  Native (MAR1_HUMAN)
LTVILGVLL

SEQ ID NO: 116261 - protein, 8 aa, Homo sapiens
  Native (MAR1_HUMAN)
MPREDAHF

SEQ ID NO: 116262 - protein, 9 aa, Homo sapiens
  Native (MAR1_HUMAN)
REDAHFIYG

SEQ ID NO: 116263 - protein, 9 aa, Homo sapiens
  Native (MAR1_HUMAN)
GIGILTVIL

SEQ ID NO: 116264 - protein, 9 aa, Homo sapiens
  Native (MAR1_HUMAN)
VGTQCALTR

SEQ ID NO: 116265 - protein, 9 aa, Homo sapiens
  Native (MAR1_HUMAN)
LLLIGCWYC

SEQ ID NO: 116266 - protein, 11 aa, Homo sapiens
  Native (MAR1_HUMAN)
GYPKKGHGHSY

SEQ ID NO: 116267 - protein, 10 aa, Homo sapiens
  Native (MAR1_HUMAN)
EPVVPNAPPA

SEQ ID NO: 116268 - protein, 10 aa, Homo sapiens
  Native (MAR1_HUMAN)
IGILTVILGV

SEQ ID NO: 116269 - protein, 9 aa, Homo sapiens
  Native (MAR1_HUMAN)
CPQEGFDHR

SEQ ID NO: 116270 - protein, 10 aa, Homo sapiens
  Native (MAR1_HUMAN)
LGVLLLIGCW

SEQ ID NO: 116271 - protein, 10 aa, Homo sapiens
  Native (MAR1_HUMAN)
LTRRCPQEGF

SEQ ID NO: 116272 - protein, 8 aa, Homo sapiens
  Native (MAR1_HUMAN)
AEQSPPPY

SEQ ID NO: 116273 - protein, 9 aa, Homo sapiens
  Native (MAR1_HUMAN)
MPREDAHFI

SEQ ID NO: 116274 - protein, 9 aa, Homo sapiens
  Native (MAR1_HUMAN)
LQEKNCEPV

SEQ ID NO: 116275 - protein, 11 aa, Homo sapiens
  Native (MAR1_HUMAN)
RRCPQEGFDHR

SEQ ID NO: 116276 - protein, 10 aa, Homo sapiens
  Native (MAR1_HUMAN)
YGYPKKGHGH

SEQ ID NO: 116277 - protein, 8 aa, Homo sapiens
  Native (MAR1_HUMAN)
DAHFIYGY

SEQ ID NO: 116278 - protein, 9 aa, Homo sapiens
  Native (MAR1_HUMAN)
AEQSPPPYS

SEQ ID NO: 116279 - protein, 9 aa, Homo sapiens
  Native (MAR1_HUMAN)
KSLHVGTQC

SEQ ID NO: 116280 - protein, 8 aa, Homo sapiens
  Native (MAR1_HUMAN)
RRCPQEGF

SEQ ID NO: 116281 - protein, 10 aa, Homo sapiens
  Native (MAR1_HUMAN)
ALMDKSLHVG

SEQ ID NO: 116282 - protein, 9 aa, Homo sapiens
  Native (MAR1_HUMAN)
GFDHRDSKV

SEQ ID NO: 116283 - protein, 9 aa, Homo sapiens
  Native (MAR1_HUMAN)
AHFIYGYPK

SEQ ID NO: 116284 - protein, 10 aa, Homo sapiens
  Native (MAR1_HUMAN)
RRNGYRALMD

SEQ ID NO: 116285 - protein, 11 aa, Homo sapiens
  Native (MAR1_HUMAN)
KSLHVGTQCAL

SEQ ID NO: 116286 - protein, 8 aa, Homo sapiens
  Native (MAR1_HUMAN)
RRNGYRAL

SEQ ID NO: 116287 - protein, 9 aa, Homo sapiens
  Native (MAR1_HUMAN)
YPKKGHGHS

SEQ ID NO: 116288 - protein, 8 aa, Homo sapiens
  Native (MAR1_HUMAN)
LHVGTQCA

SEQ ID NO: 116289 - protein, 11 aa, Homo sapiens
  Native (MAR1_HUMAN)
DAHFIYGYPKK

SEQ ID NO: 116290 - protein, 9 aa, Homo sapiens
  Native (MAR1_HUMAN)
EDAHFIYGY

SEQ ID NO: 116291 - protein, 8 aa, Homo sapiens
  Native (MAR1_HUMAN)
ILTVILGV

SEQ ID NO: 116292 - protein, 11 aa, Homo sapiens
  Native (MAR1_HUMAN)
EEAAGIGILTV

SEQ ID NO: 116293 - protein, 10 aa, Homo sapiens
  Native (MAR1_HUMAN)
VPNAPPAYEK

SEQ ID NO: 116294 - protein, 11 aa, Homo sapiens
  Native (MAR1_HUMAN)
YPKKGHGHSYT

SEQ ID NO: 116295 - protein, 8 aa, Homo sapiens
  Native (MAR1_HUMAN)
KKGHGHSY

SEQ ID NO: 116296 - protein, 11 aa, Homo sapiens
  Native (MAR1_HUMAN)
YRALMDKSLHV

SEQ ID NO: 116297 - protein, 11 aa, Homo sapiens
  Native (MAR1_HUMAN)
MPREDAHFIYG

SEQ ID NO: 116298 - protein, 10 aa, Homo sapiens
  Native (MAR1_HUMAN)
LIGCWYCRRR

SEQ ID NO: 116299 - protein, 8 aa, Homo sapiens
  Native (MAR1_HUMAN)
TVILGVLL

SEQ ID NO: 116300 - protein, 10 aa, Homo sapiens
  Native (MAR1_HUMAN)
PVVPNAPPAY

SEQ ID NO: 116301 - protein, 11 aa, Homo sapiens
  Native (MAR1_HUMAN)
CWYCRRRNGYR

SEQ ID NO: 116302 - protein, 9 aa, Homo sapiens
  Native (MAR1_HUMAN)
PNAPPAYEK

SEQ ID NO: 116303 - protein, 10 aa, Homo sapiens
  Native (MAR1_HUMAN)
WYCRRRNGYR

SEQ ID NO: 116304 - protein, 9 aa, Homo sapiens
  Native (MAR1_HUMAN)
HSYTTAEEA

SEQ ID NO: 116305 - protein, 9 aa, Homo sapiens
  Native (MAR1_HUMAN)
WYCRRRNGY

SEQ ID NO: 116306 - protein, 10 aa, Homo sapiens
  Native (MAR1_HUMAN)
EEAAGIGILT

SEQ ID NO: 116307 - protein, 9 aa, Artificial Sequence
  Description of Artificial Sequence: Synthetic peptide
  Seed: AAGIGILTV (MAR1_HUMAN)
  misc_feature (2)..(2): Xaa can be Ala, Leu, Gln, Arg, Ser, Thr, Ile, Met, Val, Pro, Gly, Asn, Glu, Asp, Phe, Tyr, Cys, His, Lys, or Trp
  misc_feature (9)..(9): Xaa can be Tyr, Leu, Phe, Met, Val, Ile, Trp, Lys, Arg, Ala, His, Cys, Thr, Ser, or Gln
AXGIGILTX

SEQ ID NO: 116308 - protein, 10 aa, Artificial Sequence
  Description of Artificial Sequence: Synthetic peptide
  Seed: AAGIGILTVI (MAR1_HUMAN)
  misc_feature (2)..(2): Xaa can be Ala, Ser, Thr, Ile, Val, Gly, Gln, Met, Asn, Leu, Glu, or Asp
  misc_feature (10)..(10): Xaa can be Lys, Tyr, Leu, Arg, Phe, Met, Ile, Val, or Trp
AXGIGILTVX

SEQ ID NO: 116309 - protein, 9 aa, Artificial Sequence
  Description of Artificial Sequence: Synthetic peptide
  Seed: AEEAAGIGI (MAR1_HUMAN)
  misc_feature (2)..(2): Xaa can be Glu, Asp, or Gln
  misc_feature (9)..(9): Xaa can be Met, Pro, Tyr, Trp, Leu, Ala, Phe, Val, Cys, Ile, Thr, Gly, Ser, Arg, Asp, His, Glu, or Gl n
AXEAAGIGX

SEQ ID NO: 116310 - protein, 10 aa, Artificial Sequence
  Description of Artificial Sequence: Synthetic peptide
  Seed: AEEAAGIGIL (MAR1_HUMAN)
  misc_feature (2)..(2): Xaa can be Glu, Gln, Asp, Lys, Phe, Gly, His, Ala, Asn, Leu, Ile, Thr, Arg, Met, Pro, Tyr, Val, Trp, Ser, or Cys
  misc_feature (10)..(10): Xaa can be Leu, Pro, Val, Met, Ile, Phe, Ala, Trp, Tyr, Cys, Gly, Glu, Asp, Ser, or Thr
AXEAAGIGIX

SEQ ID NO: 116311 - protein, 11 aa, Artificial Sequence
  Description of Artificial Sequence: Synthetic peptide
  Seed: AEEAAGIGILT (MAR1_HUMAN)
  misc_feature (2)..(2): Xaa can be Glu, Asp, or Gln
  misc_feature (11)..(11): Xaa can be Leu, Ala, Cys, Ile, Val, Met, Gly, Phe, Asp, Thr, Pro, Trp, Tyr, or Ser
AXEAAGIGILX

SEQ ID NO: 116312 - protein, 8 aa, Artificial Sequence
  Description of Artificial Sequence: Synthetic peptide
  Seed: AEQSPPPY (MAR1_HUMAN)
  misc_feature (2)..(2): Xaa can be Glu, Gln, Lys, or Arg
  misc_feature (8)..(8): Xaa can be Tyr, Phe, Leu, Met, or Trp
AXQSPPPX

SEQ ID NO: 116313 - protein, 9 aa, Artificial Sequence
  Description of Artificial Sequence: Synthetic peptide
  Seed: AEQSPPPYS (MAR1_HUMAN)
  misc_feature (2)..(2): Xaa can be Glu, Asp, or Gln
  misc_feature (9)..(9): Xaa can be Met, Pro, Leu, Ala, Val, Cys, Ile, Phe, Ser, Thr, Trp, Asn, Gly, Arg, Glu, Tyr, Lys, Gln, or Asp
AXQSPPPYX

SEQ ID NO: 116314 - protein, 10 aa, Artificial Sequence
  Description of Artificial Sequence: Synthetic peptide
  Seed: AEQSPPPYSP (MAR1_HUMAN)
  misc_feature (2)..(2): Xaa can be Glu, Asp, or Gln
  misc_feature (10)..(10): Xaa can be Leu, Met, Cys, Phe, Ile, Val, Ala, Thr, Pro, Arg, Gln, Glu, Trp, Asn, Asp, Gly, His, Ser, Lys, or Tyr
AXQSPPPYSX

SEQ ID NO: 116315 - protein, 8 aa, Artificial Sequence
  Description of Artificial Sequence: Synthetic peptide
  Seed: AGIGILTV (MAR1_HUMAN)
  misc_feature (2)..(2): Xaa can be Gln, Glu, Ala, Asn, Val, Ser, Asp, Leu, Gly, Pro, His, Met, Ile, Thr, Lys, or Phe
  misc_feature (8)..(8): Xaa can be Val, Ile, Leu, Met, Phe, Ala, or Cys
AXIGILTX

SEQ ID NO: 116316 - protein, 9 aa, Artificial Sequence
  Description of Artificial Sequence: Synthetic peptide
  Seed: AGIGILTVI (MAR1_HUMAN)
  misc_feature (2)..(2): Xaa can be Ala, Gln, Met, Leu, Ser, Thr, Ile, Arg, Val, Pro, Asn, Glu, Gly, Cys, Asp, His, Phe, Lys, Tyr, or Trp
  misc_feature (9)..(9): Xaa can be Tyr, Phe, Leu, Met, Val, Ile, Lys, Arg, Trp, His, Ala, Cys, Thr, Pro, Ser, Gly, Gln, Asn, or Glu
AXIGILTVX

SEQ ID NO: 116317 - protein, 9 aa, Artificial Sequence
  Description of Artificial Sequence: Synthetic peptide
  Seed: AHFIYGYPK (MAR1_HUMAN)
  misc_feature (2)..(2): Xaa can be Thr, Ser, Val, Tyr, Phe, Met, Trp, Gln, Leu, Ala, Ile, Gly, Asn, His, Cys, Glu, Lys, Pro, Arg, or Asp
  misc_feature (9)..(9): Xaa can be Arg, Lys, His, Tyr, Ala, Leu, Val, Ile, or Met
AXFIYGYPX

SEQ ID NO: 116318 - protein, 10 aa, Artificial Sequence
  Description of Artificial Sequence: Synthetic peptide
  Seed: AHFIYGYPKK (MAR1_HUMAN)
  misc_feature (2)..(2): Xaa can be Met, Tyr, Phe, Trp, Thr, Ser, Gln, Val, Gly, Leu, Ala, Ile, Arg, His, Asn, Lys, Cys, Glu, Pro, or Asp
  misc_feature (10)..(10): Xaa can be Arg, Lys, His, Tyr, Gln, Pro, Val, Asp, Leu, Cys, Gly, Phe, Glu, Ile, Ser, Trp, Met, Asn, Thr, or Ala
AXFIYGYPKX

SEQ ID NO: 116319 - protein, 9 aa, Artificial Sequence
  Description of Artificial Sequence: Synthetic peptide
  Seed: ALMDKSLHV (MAR1_HUMAN)
  misc_feature (2)..(2): Xaa can be Met, Leu, Gln, Ala, Arg, Ser, Thr, Val, Ile, Glu, Tyr, Asn, Gly, Phe, Cys, His, Trp, Asp, Lys, or Pro
  misc_feature (9)..(9): Xaa can be Phe, Ile, Arg, Leu, Tyr, Met, Val, Trp, Lys, His, Cys, Ala, Thr, Ser, Pro, Gln, or Gly
AXMDKSLHX

SEQ ID NO: 116320 - protein, 10 aa, Artificial Sequence
  Description of Artificial Sequence: Synthetic peptide
  Seed: ALMDKSLHVG (MAR1_HUMAN)
  misc_feature (2)..(2): Xaa can be Leu, Met, Ile, Val, Gln, Thr, Ala, Tyr, Ser, Phe, Asn, Asp, Glu, Trp, Cys, His, Gly, Lys, Arg, or Pro
  misc_feature (10)..(10): Xaa can be Ile, Val, Leu, Ala, Met, Thr, Phe, Cys, Ser, Gly, Tyr, Pro, Asn, Asp, His, Arg, Glu, Trp, Gln, or Lys
AXMDKSLHVX

SEQ ID NO: 116321 - protein, 11 aa, Artificial Sequence
  Description of Artificial Sequence: Synthetic peptide
  Seed: ALMDKSLHVGT (MAR1_HUMAN)
  misc_feature (2)..(2): Xaa can be Leu, Met, Ile, Val, Gln, Thr, Tyr, Phe, Ala, Lys, Trp, or Ser
  misc_feature (11)..(11): Xaa can be Val, Leu, Ile, Met, Ala, Thr, Phe, Cys, or Ser
AXMDKSLHVGX

SEQ ID NO: 116322 - protein, 8 aa, Artificial Sequence
  Description of Artificial Sequence: Synthetic peptide
  Seed: APPAYEKL (MAR1_HUMAN)
  misc_feature (2)..(2): Xaa can be Ala, Pro, Ser, Gly, Cys, Gln, Ile, Phe, Leu, Met, Thr, or Val
  misc_feature (8)..(8): Xaa can be Leu, Met, Ile, Val, Ala, or Phe
AXPAYEKX

SEQ ID NO: 116323 - protein, 10 aa, Artificial Sequence
  Description of Artificial Sequence: Synthetic peptide
  Seed: APPAYEKLSA (MAR1_HUMAN)
  misc_feature (2)..(2): Xaa can be Pro, Arg, Gln, Gly, Lys, Cys, Ser, His, Trp, Thr, Asp, Ala, Leu, Phe, Val, Tyr, Ile, Glu, Met, or Asn
  misc_feature (10)..(10): Xaa can be Leu, Met, Val, Phe, Ile, Ala, Thr, Gly, Cys, Ser, Tyr, or Pro
AXPAYEKLSX

SEQ ID NO: 116324 - protein, 8 aa, Artificial Sequence
  Description of Artificial Sequence: Synthetic peptide
  Seed: CEPVVPNA (MAR1_HUMAN)
  misc_feature (2)..(2): Xaa can be , or Glu
  misc_feature (8)..(8): Xaa can be Phe, Ala, Ile, Val, Pro, Cys, Met, Leu, or Thr
CXPVVPNX

SEQ ID NO: 116325 - protein, 9 aa, Artificial Sequence
  Description of Artificial Sequence: Synthetic peptide
  Seed: CEPVVPNAP (MAR1_HUMAN)
  misc_feature (2)..(2): Xaa can be Glu, Asp, Gln, or Ala
  misc_feature (9)..(9): Xaa can be Leu, Val, Ile, Met, Ala, Pro, Phe, Gly, Cys, Ser, Tyr, or Thr
CXPVVPNAX

SEQ ID NO: 116326 - protein, 10 aa, Artificial Sequence
  Description of Artificial Sequence: Synthetic peptide
  Seed: CEPVVPNAPP (MAR1_HUMAN)
  misc_feature (2)..(2): Xaa can be , or Glu
  misc_feature (10)..(10): Xaa can be Leu, Gly, Val, Ile, Met, Ala, Thr, Phe, Cys, Pro, or Ser
CXPVVPNAPX

SEQ ID NO: 116327 - protein, 11 aa, Artificial Sequence
  Description of Artificial Sequence: Synthetic peptide
  Seed: CEPVVPNAPPA (MAR1_HUMAN)
  misc_feature (2)..(2): Xaa can be , or Glu
  misc_feature (11)..(11): Xaa can be Leu, Ile, Ala, Phe, Pro, Met, Cys, Ser, Val, or Thr
CXPVVPNAPPX

SEQ ID NO: 116328 - protein, 9 aa, Artificial Sequence
  Description of Artificial Sequence: Synthetic peptide
  Seed: CPQEGFDHR (MAR1_HUMAN)
  misc_feature (2)..(2): Xaa can be Phe, Ser, Tyr, Ala, Val, Ile, Thr, Gly, Met, Gln, Pro, Asn, His, Trp, or Leu
  misc_feature (9)..(9): Xaa can be Arg, or Lys
CXQEGFDHX

SEQ ID NO: 116329 - protein, 10 aa, Artificial Sequence
  Description of Artificial Sequence: Synthetic peptide
  Seed: CRRRNGYRAL (MAR1_HUMAN)
  misc_feature (2)..(2): Xaa can be , or Arg
  misc_feature (10)..(10): Xaa can be Leu, Met, Tyr, Lys, Phe, or Ile
CXRRNGYRAX

SEQ ID NO: 116330 - protein, 11 aa, Artificial Sequence
  Description of Artificial Sequence: Synthetic peptide
  Seed: CRRRNGYRALM (MAR1_HUMAN)
  misc_feature (2)..(2): Xaa can be Arg, Trp, Ser, Ile, Ala, Phe, Met, Leu, Thr, Asn, Gly, Tyr, Glu, Val, His, Asp, Cys, Pro, Lys, or Gln
  misc_feature (11)..(11): Xaa can be Phe, Lys, Leu, Arg, or Met
CXRRNGYRALX

SEQ ID NO: 116331 - protein, 10 aa, Artificial Sequence
  Description of Artificial Sequence: Synthetic peptide
  Seed: CWYCRRRNGY (MAR1_HUMAN)
  misc_feature (2)..(2): Xaa can be Ala, Phe, Gln, Tyr, Ser, Leu, Thr, Met, Val, Trp, or Ile
  misc_feature (10)..(10): Xaa can be , or Tyr
CXYCRRRNGX

SEQ ID NO: 116332 - protein, 11 aa, Artificial Sequence
  Description of Artificial Sequence: Synthetic peptide
  Seed: CWYCRRRNGYR (MAR1_HUMAN)
  misc_feature (2)..(2): Xaa can be Thr, Ala, Met, Gln, Ser, Leu, Val, Tyr, Ile, Phe, Trp, Gly, or Asn
  misc_feature (11)..(11): Xaa can be Arg, or Lys
CXYCRRRNGYX

SEQ ID NO: 116333 - protein, 8 aa, Artificial Sequence
  Description of Artificial Sequence: Synthetic peptide
  Seed: DAHFIYGY (MAR1_HUMAN)
  misc_feature (2)..(2): Xaa can be Gln, Met, Glu, or Ala
  misc_feature (8)..(8): Xaa can be Tyr, or Phe
DXHFIYGX

SEQ ID NO: 116334 - protein, 10 aa, Artificial Sequence
  Description of Artificial Sequence: Synthetic peptide
  Seed: DAHFIYGYPK (MAR1_HUMAN)
  misc_feature (2)..(2): Xaa can be Thr, Val, Ser, Tyr, Phe, Ile, Ala, Met, Leu, Cys, Trp, Gly, Gln, Asn, Lys, Asp, Pro, Arg, Glu, or His
  misc_feature (10)..(10): Xaa can be Arg, Lys, Tyr, His, Met, or Phe
DXHFIYGYPX

SEQ ID NO: 116335 - protein, 11 aa, Artificial Sequence
  Description of Artificial Sequence: Synthetic peptide
  Seed: DAHFIYGYPKK (MAR1_HUMAN)
  misc_feature (2)..(2): Xaa can be Ser, Thr, Val, Ala, Ile, or Met
  misc_feature (11)..(11): Xaa can be Arg, or Lys
DXHFIYGYPKX

SEQ ID NO: 116336 - protein, 9 aa, Artificial Sequence
  Description of Artificial Sequence: Synthetic peptide
  Seed: DHRDSKVSL (MAR1_HUMAN)
  misc_feature (2)..(2): Xaa can be His, Arg, Gln, Leu, Met, Lys, Glu, Asn, Pro, Phe, Ala, Ser, Gly, Ile, Val, Tyr, Trp, Thr, Asp, or Cys
  misc_feature (9)..(9): Xaa can be Leu, Met, Ile, Phe, Val, Tyr, Ala, Cys, Thr, Trp, Pro, or Ser
DXRDSKVSX

SEQ ID NO: 116337 - protein, 9 aa, Artificial Sequence
  Description of Artificial Sequence: Synthetic peptide
  Seed: DSKVSLQEK (MAR1_HUMAN)
  misc_feature (2)..(2): Xaa can be Val, Thr, Ile, Ala, Met, Leu, Ser, Trp, Gln, Glu, Asp, Phe, Asn, Pro, Gly, Cys, Tyr, His, Lys, or Arg
  misc_feature (9)..(9): Xaa can be Arg, Lys, Tyr, His, Met, Leu, Phe, or Val
DXKVSLQEX

SEQ ID NO: 116338 - protein, 9 aa, Artificial Sequence
  Description of Artificial Sequence: Synthetic peptide
  Seed: EAAGIGILT (MAR1_HUMAN)
  misc_feature (2)..(2): Xaa can be Thr, Val, Ser, Ala, Ile, Leu, Met, Gly, Asn, Gln, Cys, Phe, Pro, or Tyr
  misc_feature (9)..(9): Xaa can be Val, Ala, Ile, Leu, Met, Thr, Ser, Cys, Arg, Phe, Gly, or Pro
EXAGIGILX

SEQ ID NO: 116339 - protein, 10 aa, Artificial Sequence
  Description of Artificial Sequence: Synthetic peptide
  Seed: EAAGIGILTV (MAR1_HUMAN)
  misc_feature (2)..(2): Xaa can be Thr, Val, Ala, Ile, Met, Ser, Leu, Pro, Gln, Glu, Asn, Gly, Phe, Cys, Tyr, Trp, Asp, Lys, or His
  misc_feature (10)..(10): Xaa can be Arg, Lys, Val, Ile, Leu, Met, Phe, Thr, His, Ala, Tyr, Gln, Cys, Ser, Glu, Trp, or Asn
EXAGIGILTX

SEQ ID NO: 116340 - protein, 11 aa, Artificial Sequence
  Description of Artificial Sequence: Synthetic peptide
  Seed: EAAGIGILTVI (MAR1_HUMAN)
  misc_feature (2)..(2): Xaa can be Thr, Val, Ser, Ala, Ile, Pro, or Met
  misc_feature (11)..(11): Xaa can be Val, Ile, Leu, Ala, Met, Thr, Lys, Gln, Pro, Tyr, Arg, Asp, Gly, Trp, Glu, Phe, His, Cys, Asn, or Ser
EXAGIGILTVX

SEQ ID NO: 116341 - protein, 9 aa, Artificial Sequence
  Description of Artificial Sequence: Synthetic peptide
  Seed: EDAHFIYGY (MAR1_HUMAN)
  misc_feature (2)..(2): Xaa can be Thr, Val, Ile, Glu, Ala, Ser, Met, Leu, Gln, Asn, Pro, Asp, Gly, Trp, Phe, Lys, Tyr, Cys, or His
  misc_feature (9)..(9): Xaa can be Tyr, Phe, Met, Trp, Lys, Leu, Val, Ile, Ala, His, Thr, or Cys
EXAHFIYGX

SEQ ID NO: 116342 - protein, 8 aa, Artificial Sequence
  Description of Artificial Sequence: Synthetic peptide
  Seed: EEAAGIGI (MAR1_HUMAN)
  misc_feature (2)..(2): Xaa can be Glu, or Asp
  misc_feature (8)..(8): Xaa can be Phe, Val, Met, Leu, Ile, Cys, Thr, Pro, or Ala
EXAAGIGX

SEQ ID NO: 116343 - protein, 9 aa, Artificial Sequence
  Description of Artificial Sequence: Synthetic peptide
  Seed: EEAAGIGIL (MAR1_HUMAN)
  misc_feature (2)..(2): Xaa can be Glu, Gln, Asp, Ala, or Lys
  misc_feature (9)..(9): Xaa can be Trp, Tyr, Met, Ile, Val, Pro, Ala, Leu, Phe, Cys, Thr, Ser, His, or Gly
EXAAGIGIX

SEQ ID NO: 116344 - protein, 10 aa, Artificial Sequence
  Description of Artificial Sequence: Synthetic peptide
  Seed: EEAAGIGILT (MAR1_HUMAN)
  misc_feature (2)..(2): Xaa can be Glu, Thr, Gln, Val, Ser, His, Tyr, Trp, Gly, Phe, Cys, Asn, Asp, Lys, Leu, Met, Ala, Pro, Ile, or Arg
  misc_feature (10)..(10): Xaa can be Val, Ala, Ile, Thr, Leu, Met, Ser, Cys, Phe, Tyr, Gly, Pro, or Trp
EXAAGIGILX

SEQ ID NO: 116345 - protein, 11 aa, Artificial Sequence
  Description of Artificial Sequence: Synthetic peptide
  Seed: EEAAGIGILTV (MAR1_HUMAN)
  misc_feature (2)..(2): Xaa can be Glu, Gln, Asp, Val, Ser, His, Ala, Thr, Arg, Asn, or Lys
  misc_feature (11)..(11): Xaa can be Trp, Leu, Tyr, Phe, Ala, Met, Ile, Cys, His, Thr, Gly, Ser, Pro, Lys, or Val
EXAAGIGILTX

SEQ ID NO: 116346 - protein, 9 aa, Artificial Sequence
  Description of Artificial Sequence: Synthetic peptide
  Seed: EGFDHRDSK (MAR1_HUMAN)
  misc_feature (2)..(2): Xaa can be Val, Thr, Ile, Ala, Ser, Gln, Arg, Leu, Phe, Tyr, Met, Gly, Trp, Cys, Asn, Glu, His, Pro, Asp, or Lys
  misc_feature (9)..(9): Xaa can be Arg, Tyr, Lys, Met, Phe, Leu, His, Val, Ile, Trp, Gln, Ala, or Thr
EXFDHRDSX

SEQ ID NO: 116347 - protein, 9 aa, Artificial Sequence
  Description of Artificial Sequence: Synthetic peptide
  Seed: EPVVPNAPP (MAR1_HUMAN)
  misc_feature (2)..(2): Xaa can be Pro, Ala, or Val
  misc_feature (9)..(9): Xaa can be Ala, Leu, Val, Ile, Thr, Ser, Cys, Pro, Met, Gly, Lys, Tyr, or Phe
EXVVPNAPX

SEQ ID NO: 116348 - protein, 10 aa, Artificial Sequence
  Description of Artificial Sequence: Synthetic peptide
  Seed: EPVVPNAPPA (MAR1_HUMAN)
  misc_feature (2)..(2): Xaa can be Pro, or Ala
  misc_feature (10)..(10): Xaa can be Ala, Gly, Met, Val, Ile, Cys, Leu, Phe, Ser, Pro, Tyr, or Thr
EXVVPNAPPX

SEQ ID NO: 116349 - protein, 11 aa, Artificial Sequence
  Description of Artificial Sequence: Synthetic peptide
  Seed: EPVVPNAPPAY (MAR1_HUMAN)
  misc_feature (2)..(2): Xaa can be Pro, Ala, Met, Gln, Ser, Thr, Val, Gly, Ile, Glu, Leu, Asn, Cys, His, Arg, Lys, Tyr, or Ph e
  misc_feature (11)..(11): Xaa can be Tyr, Phe, Trp, Met, Leu, Ala, Ser, Pro, Ile, Gly, Thr, Cys, Lys, or Val
EXVVPNAPPAX

SEQ ID NO: 116350 - protein, 9 aa, Artificial Sequence
  Description of Artificial Sequence: Synthetic peptide
  Seed: EQSPPPYSP (MAR1_HUMAN)
  misc_feature (2)..(2): Xaa can be Glu, His, Arg, Asp, Gln, Lys, Pro, Ala, Asn, Tyr, Met, or Gly
  misc_feature (9)..(9): Xaa can be Ala, Val, Leu, Ile, Met, Cys, Phe, Pro, Ser, Thr, Gly, Tyr, Asn, Gln, Trp, Lys, Glu, Asp, or Arg
EXSPPPYSX

SEQ ID NO: 116351 - protein, 8 aa, Artificial Sequence
  Description of Artificial Sequence: Synthetic peptide
  Seed: FDHRDSKV (MAR1_HUMAN)
  misc_feature (2)..(2): Xaa can be Glu, or Asp
  misc_feature (8)..(8): Xaa can be Phe, Val, Ile, Leu, Met, or Tyr
FXHRDSKX

SEQ ID NO: 116352 - protein, 10 aa, Artificial Sequence
  Description of Artificial Sequence: Synthetic peptide
  Seed: FDHRDSKVSL (MAR1_HUMAN)
  misc_feature (2)..(2): Xaa can be Glu, or Asp
  misc_feature (10)..(10): Xaa can be Leu, Val, Phe, Ile, Met, Ala, Thr, Trp, Gly, Ser, Tyr, Cys, or Pro
FXHRDSKVSX

SEQ ID NO: 116353 - protein, 9 aa, Artificial Sequence
  Description of Artificial Sequence: Synthetic peptide
  Seed: GFDHRDSKV (MAR1_HUMAN)
  misc_feature (2)..(2): Xaa can be Phe, Ala, Tyr, Trp, Ser, Val, Thr, Arg, Met, Gly, Gln, Pro, Leu, Ile, His, Asn, Cys, Glu, Asp, or Lys
  misc_feature (9)..(9): Xaa can be Leu, Met, Val, Phe, Ile, Tyr, Cys, Ala, or Trp
GXDHRDSKX

SEQ ID NO: 116354 - protein, 11 aa, Artificial Sequence
  Description of Artificial Sequence: Synthetic peptide
  Seed: GFDHRDSKVSL (MAR1_HUMAN)
  misc_feature (2)..(2): Xaa can be Tyr, Phe, Arg, Trp, Gln, His, Ala, Gly, Glu, Ile, Thr, Leu, Val, Ser, or Met
  misc_feature (11)..(11): Xaa can be Leu, Met, Phe, Tyr, Ile, Val, or Trp
GXDHRDSKVSX

SEQ ID NO: 116355 - protein, 9 aa, Artificial Sequence
  Description of Artificial Sequence: Synthetic peptide
  Seed: GHGHSYTTA (MAR1_HUMAN)
  misc_feature (2)..(2): Xaa can be His, Arg, or Gln
  misc_feature (9)..(9): Xaa can be Ala, Ile, Val, Cys, Leu, Thr, or Met
GXGHSYTTX

SEQ ID NO: 116356 - protein, 10 aa, Artificial Sequence
  Description of Artificial Sequence: Synthetic peptide
  Seed: GHSYTTAEEA (MAR1_HUMAN)
  misc_feature (2)..(2): Xaa can be , or His
  misc_feature (10)..(10): Xaa can be Ala, Ile, Leu, or Val
GXSYTTAEEX

SEQ ID NO: 116357 - protein, 11 aa, Artificial Sequence
  Description of Artificial Sequence: Synthetic peptide
  Seed: GHSYTTAEEAA (MAR1_HUMAN)
  misc_feature (2)..(2): Xaa can be , or His
  misc_feature (11)..(11): Xaa can be Leu, Cys, or Ala
GXSYTTAEEAX

SEQ ID NO: 116358 - protein, 9 aa, Artificial Sequence
  Description of Artificial Sequence: Synthetic peptide
  Seed: GIGILTVIL (MAR1_HUMAN)
  misc_feature (2)..(2): Xaa can be Leu, Met, Ala, Ser, Ile, Thr, Val, or Gln
  misc_feature (9)..(9): Xaa can be Leu, Val, Met, Ile, Ala, or Phe
GXGILTVIX

SEQ ID NO: 116359 - protein, 11 aa, Artificial Sequence
  Description of Artificial Sequence: Synthetic peptide
  Seed: GIGILTVILGV (MAR1_HUMAN)
  misc_feature (2)..(2): Xaa can be Leu, Met, Thr, Asn, Val, His, Cys, Pro, Trp, Arg, Tyr, Glu, Gly, Lys, Asp, Phe, Ser, Ile, Gln, or Ala
  misc_feature (11)..(11): Xaa can be Val, Ile, or Leu
GXGILTVILGX

SEQ ID NO: 116360 - protein, 9 aa, Artificial Sequence
  Description of Artificial Sequence: Synthetic peptide
  Seed: GILTVILGV (MAR1_HUMAN)
  misc_feature (2)..(2): Xaa can be Met, Leu, Gln, Thr, Val, Ile, Ser, Ala, Glu, Gly, Cys, Asn, Phe, Tyr, Asp, Trp, or Pro
  misc_feature (9)..(9): Xaa can be Arg, Val, Lys, Ile, Leu, Met, Tyr, Ala, Thr, His, Ser, Phe, Cys, Gly, or Trp
GXLTVILGX

SEQ ID NO: 116361 - protein, 10 aa, Artificial Sequence
  Description of Artificial Sequence: Synthetic peptide
  Seed: GILTVILGVL (MAR1_HUMAN)
  misc_feature (2)..(2): Xaa can be Met, Gln, Leu, Val, Arg, Asn, Trp, Pro, Phe, Ile, Ser, Cys, Thr, Glu, Asp, Tyr, Lys, Ala, Gly, or His
  misc_feature (10)..(10): Xaa can be Leu, Ile, Val, Ala, Met, Ser, Asp, Gly, Lys, Pro, Trp, Arg, Glu, Thr, Cys, Tyr, Asn, Gln, Phe, or His
GXLTVILGVX

SEQ ID NO: 116362 - protein, 9 aa, Artificial Sequence
  Description of Artificial Sequence: Synthetic peptide
  Seed: GTQCALTRR (MAR1_HUMAN)
  misc_feature (2)..(2): Xaa can be Met, Leu, Thr, Phe, Pro, Val, Trp, Gln, Ser, Gly, Ala, Ile, Tyr, or Asn
  misc_feature (9)..(9): Xaa can be Arg, Lys, Leu, or Tyr
GXQCALTRX

SEQ ID NO: 116363 - protein, 9 aa, Artificial Sequence
  Description of Artificial Sequence: Synthetic peptide
  Seed: GVLLLIGCW (MAR1_HUMAN)
  misc_feature (2)..(2): Xaa can be Ser, Thr, Ala, Leu, Val, Ile, Gly, Met, Asn, or Cys
  misc_feature (9)..(9): Xaa can be Trp, or Phe
GXLLLIGCX

SEQ ID NO: 116364 - protein, 10 aa, Artificial Sequence
  Description of Artificial Sequence: Synthetic peptide
  Seed: GVLLLIGCWY (MAR1_HUMAN)
  misc_feature (2)..(2): Xaa can be Thr, Val, Met, Tyr, Leu, Ser, Gln, Ile, Phe, Ala, or Trp
  misc_feature (10)..(10): Xaa can be , or Tyr
GXLLLIGCWX

SEQ ID NO: 116365 - protein, 9 aa, Artificial Sequence
  Description of Artificial Sequence: Synthetic peptide
  Seed: GYPKKGHGH (MAR1_HUMAN)
  misc_feature (2)..(2): Xaa can be Tyr, Phe, Trp, Met, Leu, Ala, Ile, Val, or Ser
  misc_feature (9)..(9): Xaa can be Phe, Leu, Met, Tyr, Ile, Val, Trp, or His
GXPKKGHGX

SEQ ID NO: 116366 - protein, 11 aa, Artificial Sequence
  Description of Artificial Sequence: Synthetic peptide
  Seed: GYPKKGHGHSY (MAR1_HUMAN)
  misc_feature (2)..(2): Xaa can be Arg, Tyr, Phe, Trp, His, Gln, Gly, Ala, Met, Lys, Ser, Thr, Leu, Val, Ile, or Asn
  misc_feature (11)..(11): Xaa can be Tyr, Phe, Leu, Met, Trp, Ile, Val, Arg, Lys, or His
GXPKKGHGHSX

SEQ ID NO: 116367 - protein, 10 aa, Artificial Sequence
  Description of Artificial Sequence: Synthetic peptide
  Seed: GYRALMDKSL (MAR1_HUMAN)
  misc_feature (2)..(2): Xaa can be Arg, Lys, His, Met, Gln, Ala, Thr, Gly, Ile, Cys, Leu, Asp, Asn, Ser, Glu, Trp, Phe, Val, Pro, or Tyr
  misc_feature (10)..(10): Xaa can be Leu, Met, Phe, or Ile
GXRALMDKSX

SEQ ID NO: 116368 - protein, 8 aa, Artificial Sequence
  Description of Artificial Sequence: Synthetic peptide
  Seed: HFIYGYPK (MAR1_HUMAN)
  misc_feature (2)..(2): Xaa can be Thr, Phe, Trp, Met, Tyr, Val, Ile, Asn, Gln, Leu, Ala, Ser, or Gly
  misc_feature (8)..(8): Xaa can be Arg, or Lys
HXIYGYPX

SEQ ID NO: 116369 - protein, 9 aa, Artificial Sequence
  Description of Artificial Sequence: Synthetic peptide
  Seed: HFIYGYPKK (MAR1_HUMAN)
  misc_feature (2)..(2): Xaa can be Thr, Met, Ser, Leu, Val, Ile, Ala, Phe, Asp, Tyr, Glu, Gly, Cys, Pro, Asn, Gln, Trp, or Hi s
  misc_feature (9)..(9): Xaa can be Arg, Lys, Tyr, Leu, His, Val, Ile, Met, Ala, or Phe
HXIYGYPKX

SEQ ID NO: 116370 - protein, 8 aa, Artificial Sequence
  Description of Artificial Sequence: Synthetic peptide
  Seed: HRDSKVSL (MAR1_HUMAN)
  misc_feature (2)..(2): Xaa can be Phe, Tyr, Trp, His, Arg, Leu, Ala, Ser, Met, Gln, Asn, Thr, Val, Cys, Gly, Ile, Lys, Pro, Asp, or Glu
  misc_feature (8)..(8): Xaa can be Met, Phe, Leu, Ile, Val, Tyr, Trp, Cys, or Ala
HXDSKVSX

SEQ ID NO: 116371 - protein, 9 aa, Artificial Sequence
  Description of Artificial Sequence: Synthetic peptide
  Seed: HRDSKVSLQ (MAR1_HUMAN)
  misc_feature (2)..(2): Xaa can be Arg, Phe, Tyr, Trp, Gln, Leu, Gly, Ile, Val, Ala, Met, Asn, Glu, Asp, Pro, Ser, Thr, Lys, His, or Cys
  misc_feature (9)..(9): Xaa can be Leu, Phe, Lys, Met, Ile, Arg, Tyr, Val, Trp, Gln, or His
HXDSKVSLX

SEQ ID NO: 116372 - protein, 11 aa, Artificial Sequence
  Description of Artificial Sequence: Synthetic peptide
  Seed: HRDSKVSLQEK (MAR1_HUMAN)
  misc_feature (2)..(2): Xaa can be Arg, Tyr, Trp, Phe, Gly, His, Gln, Glu, Ala, Met, Asn, or Leu
  misc_feature (11)..(11): Xaa can be Phe, Lys, Tyr, Met, Trp, Leu, Ile, Val, His, or Arg
HXDSKVSLQEX

SEQ ID NO: 116373 - protein, 9 aa, Artificial Sequence
  Description of Artificial Sequence: Synthetic peptide
  Seed: HSYTTAEEA (MAR1_HUMAN)
  misc_feature (2)..(2): Xaa can be Pro, His, Gln, Ala, Ser, Arg, Val, Gly, Ile, Thr, Glu, Asn, Met, Leu, Asp, Lys, Cys, Phe, Tyr, or Trp
  misc_feature (9)..(9): Xaa can be Tyr, Met, Leu, Phe, Val, Ile, Ala, Trp, His, Lys, Cys, Arg, Thr, Pro, Ser, Gln, Gly, Glu, Asn, or Asp
HXYTTAEEX

SEQ ID NO: 116374 - protein, 8 aa, Artificial Sequence
  Description of Artificial Sequence: Synthetic peptide
  Seed: HVGTQCAL (MAR1_HUMAN)
  misc_feature (2)..(2): Xaa can be Ala, Gly, Thr, Tyr, Asn, Glu, Phe, Arg, Gln, Val, Ser, His, or Ile
  misc_feature (8)..(8): Xaa can be Leu, or Met
HXGTQCAX

SEQ ID NO: 116375 - protein, 10 aa, Artificial Sequence
  Description of Artificial Sequence: Synthetic peptide
  Seed: HVGTQCALTR (MAR1_HUMAN)
  misc_feature (2)..(2): Xaa can be Ala, Thr, Leu, Met, Ser, Gln, Ile, Gly, Phe, Tyr, Val, Trp, or Asn
  misc_feature (10)..(10): Xaa can be Arg, Lys, Tyr, Phe, Met, or Leu
HXGTQCALTX

SEQ ID NO: 116376 - protein, 11 aa, Artificial Sequence
  Description of Artificial Sequence: Synthetic peptide
  Seed: HVGTQCALTRR (MAR1_HUMAN)
  misc_feature (2)..(2): Xaa can be Leu, Val, Met, Ser, Ala, Thr, Ile, Gly, Tyr, Phe, Trp, Pro, Cys, Lys, His, Glu, Arg, Gln, Asp, or Asn
  misc_feature (11)..(11): Xaa can be Arg, or Lys
HXGTQCALTRX

SEQ ID NO: 116377 - protein, 9 aa, Artificial Sequence
  Description of Artificial Sequence: Synthetic peptide
  Seed: IGCWYCRRR (MAR1_HUMAN)
  misc_feature (2)..(2): Xaa can be Thr, Gln, Phe, Met, Leu, Ser, Trp, Tyr, Val, Ile, Asp, Asn, Gly, Ala, or Pro
  misc_feature (9)..(9): Xaa can be Arg, or Lys
IXCWYCRRX

SEQ ID NO: 116378 - protein, 8 aa, Artificial Sequence
  Description of Artificial Sequence: Synthetic peptide
  Seed: IGILTVIL (MAR1_HUMAN)
  misc_feature (2)..(2): Xaa can be Gln, Gly, Ser, Glu, Ala, Asn, or Met
  misc_feature (8)..(8): Xaa can be Ile, Val, Leu, Met, or Phe
IXILTVIX

SEQ ID NO: 116379 - protein, 10 aa, Artificial Sequence
  Description of Artificial Sequence: Synthetic peptide
  Seed: IGILTVILGV (MAR1_HUMAN)
  misc_feature (2)..(2): Xaa can be Met, Leu, Gln, Phe, Ser, Thr, Tyr, Val, Ile, His, Trp, Pro, Ala, Lys, Glu, Asn, Arg, Asp, Cys, or Gly
  misc_feature (10)..(10): Xaa can be Ile, Leu, Val, Ala, Met, or Thr
IXILTVILGX

SEQ ID NO: 116380 - protein, 8 aa, Artificial Sequence
  Description of Artificial Sequence: Synthetic peptide
  Seed: ILGVLLLI (MAR1_HUMAN)
  misc_feature (2)..(2): Xaa can be Met, or Leu
  misc_feature (8)..(8): Xaa can be Ile, Leu, or Val
IXGVLLLX

SEQ ID NO: 116381 - protein, 8 aa, Artificial Sequence
  Description of Artificial Sequence: Synthetic peptide
  Seed: ILTVILGV (MAR1_HUMAN)
  misc_feature (2)..(2): Xaa can be Leu, or Met
  misc_feature (8)..(8): Xaa can be Leu, Val, or Ile
IXTVILGX

SEQ ID NO: 116382 - protein, 9 aa, Artificial Sequence
  Description of Artificial Sequence: Synthetic peptide
  Seed: ILTVILGVL (MAR1_HUMAN)
  misc_feature (2)..(2): Xaa can be Met, Leu, Ala, Ile, Val, Thr, Gln, Ser, or Gly
  misc_feature (9)..(9): Xaa can be Leu, Val, Ile, Met, Ala, Thr, or Phe
IXTVILGVX

SEQ ID NO: 116383 - protein, 10 aa, Artificial Sequence
  Description of Artificial Sequence: Synthetic peptide
  Seed: ILTVILGVLL (MAR1_HUMAN)
  misc_feature (2)..(2): Xaa can be Met, Leu, or Ile
  misc_feature (10)..(10): Xaa can be Val, Leu, Ile, Met, or Ala
IXTVILGVLX

SEQ ID NO: 116384 - protein, 10 aa, Artificial Sequence
  Description of Artificial Sequence: Synthetic peptide
  Seed: KGHGHSYTTA (MAR1_HUMAN)
  misc_feature (2)..(2): Xaa can be Thr, Ser, Val, Ala, Met, Ile, Tyr, Phe, Gln, Leu, Trp, Gly, Cys, Asn, or His
  misc_feature (10)..(10): Xaa can be Lys, Ala, Val, Arg, Met, Ile, Leu, Tyr, Ser, Gly, Thr, Phe, Cys, His, Gln, Glu, Asn, or Pr o
KXHGHSYTTX

SEQ ID NO: 116385 - protein, 8 aa, Artificial Sequence
  Description of Artificial Sequence: Synthetic peptide
  Seed: KKGHGHSY (MAR1_HUMAN)
  misc_feature (2)..(2): Xaa can be Gln, Met, Glu, Lys, Phe, Tyr, His, Leu, Ala, or Arg
  misc_feature (8)..(8): Xaa can be Tyr, Phe, Met, or Leu
KXGHGHSX

SEQ ID NO: 116386 - protein, 11 aa, Artificial Sequence
  Description of Artificial Sequence: Synthetic peptide
  Seed: KLSAEQSPPPY (MAR1_HUMAN)
  misc_feature (2)..(2): Xaa can be Met, Gln, Leu, Val, Ile, Ala, Gly, Tyr, Pro, Thr, Ser, Glu, Trp, or Phe
  misc_feature (11)..(11): Xaa can be Tyr, Phe, Met, or Trp
KXSAEQSPPPX

SEQ ID NO: 116387 - protein, 9 aa, Artificial Sequence
  Description of Artificial Sequence: Synthetic peptide
  Seed: KSLHVGTQC (MAR1_HUMAN)
  misc_feature (2)..(2): Xaa can be Ala, Ser, Thr, Leu, Ile, Cys, Gly, Met, Asn, Val, Gln, Asp, Phe, Glu, Pro, Lys, Tyr, His, Trp, or Arg
  misc_feature (9)..(9): Xaa can be Trp, Phe, Val, Ile, Met, Leu, Tyr, Cys, or Ala
KXLHVGTQX

SEQ ID NO: 116388 - protein, 10 aa, Artificial Sequence
  Description of Artificial Sequence: Synthetic peptide
  Seed: KSLHVGTQCA (MAR1_HUMAN)
  misc_feature (2)..(2): Xaa can be Thr, Ser, Tyr, Val, Ile, Gln, Ala, Phe, Met, or Gly
  misc_feature (10)..(10): Xaa can be Lys, Ala, Val, or Ile
KXLHVGTQCX

SEQ ID NO: 116389 - protein, 11 aa, Artificial Sequence
  Description of Artificial Sequence: Synthetic peptide
  Seed: KSLHVGTQCAL (MAR1_HUMAN)
  misc_feature (2)..(2): Xaa can be Thr, Ala, Ser, Val, Ile, Leu, Cys, Gly, Asn, Gln, Met, Lys, Phe, Glu, Pro, Trp, Asp, or Ty r
  misc_feature (11)..(11): Xaa can be Trp, Phe, Tyr, Met, Val, Leu, Ile, or Cys
KXLHVGTQCAX

SEQ ID NO: 116390 - protein, 10 aa, Artificial Sequence
  Description of Artificial Sequence: Synthetic peptide
  Seed: LGVLLLIGCW (MAR1_HUMAN)
  misc_feature (2)..(2): Xaa can be Thr, Ala, Ser, Met, Val, Cys, Asn, Pro, Gly, Ile, Gln, or Leu
  misc_feature (10)..(10): Xaa can be Trp, or Phe
LXVLLLIGCX

SEQ ID NO: 116391 - protein, 8 aa, Artificial Sequence
  Description of Artificial Sequence: Synthetic peptide
  Seed: LHVGTQCA (MAR1_HUMAN)
  misc_feature (2)..(2): Xaa can be , or His
  misc_feature (8)..(8): Xaa can be Ile, Val, Ala, or Leu
LXVGTQCX

SEQ ID NO: 116392 - protein, 9 aa, Artificial Sequence
  Description of Artificial Sequence: Synthetic peptide
  Seed: LHVGTQCAL (MAR1_HUMAN)
  misc_feature (2)..(2): Xaa can be His, Gln, Arg, Lys, Met, Glu, Leu, Ala, Phe, Asn, Ser, Gly, Tyr, Thr, Pro, Ile, Val, Cys, or Trp
  misc_feature (9)..(9): Xaa can be Phe, Tyr, Met, Leu, Trp, Ala, Ile, Val, His, Cys, Gly, Pro, Thr, or Ser
LXVGTQCAX

SEQ ID NO: 116393 - protein, 8 aa, Artificial Sequence
  Description of Artificial Sequence: Synthetic peptide
  Seed: LIGCWYCR (MAR1_HUMAN)
  misc_feature (2)..(2): Xaa can be Tyr, Phe, Met, Thr, Gln, Ser, Ile, Val, Leu, or Trp
  misc_feature (8)..(8): Xaa can be Arg, or Lys
LXGCWYCX

SEQ ID NO: 116394 - protein, 9 aa, Artificial Sequence
  Description of Artificial Sequence: Synthetic peptide
  Seed: LIGCWYCRR (MAR1_HUMAN)
  misc_feature (2)..(2): Xaa can be Met, Thr, Leu, Tyr, Ala, Ser, Gln, Gly, Ile, Phe, Trp, Asn, Pro, Val, Asp, or His
  misc_feature (9)..(9): Xaa can be Arg, Lys, Tyr, or Leu
LXGCWYCRX

SEQ ID NO: 116395 - protein, 10 aa, Artificial Sequence
  Description of Artificial Sequence: Synthetic peptide
  Seed: LIGCWYCRRR (MAR1_HUMAN)
  misc_feature (2)..(2): Xaa can be Thr, Gln, Leu, Ile, Val, Ser, Trp, Met, Phe, Tyr, Gly, Ala, or Asn
  misc_feature (10)..(10): Xaa can be Arg, or Lys
LXGCWYCRRX

SEQ ID NO: 116396 - protein, 9 aa, Artificial Sequence
  Description of Artificial Sequence: Synthetic peptide
  Seed: LLIGCWYCR (MAR1_HUMAN)
  misc_feature (2)..(2): Xaa can be Leu, Met, Thr, Val, Phe, Trp, Gln, Tyr, Ile, Ser, Asp, Lys, Arg, His, Gly, Asn, Glu, Ala, Cys, or Pro
  misc_feature (9)..(9): Xaa can be Lys, Arg, His, Tyr, Val, Leu, or Met
LXIGCWYCX

SEQ ID NO: 116397 - protein, 10 aa, Artificial Sequence
  Description of Artificial Sequence: Synthetic peptide
  Seed: LLIGCWYCRR (MAR1_HUMAN)
  misc_feature (2)..(2): Xaa can be Phe, Tyr, Met, Val, Thr, Gln, Ser, Ile, Trp, Leu, Arg, Cys, Gly, Ala, Glu, Asn, Lys, His, Pro, or Asp
  misc_feature (10)..(10): Xaa can be Arg, Lys, Tyr, His, Gln, Gly, Ile, Glu, Phe, Trp, Asn, Met, Leu, Val, Ser, Pro, Ala, Asp, Thr, or Cys
LXIGCWYCRX

SEQ ID NO: 116398 - protein, 11 aa, Artificial Sequence
  Description of Artificial Sequence: Synthetic peptide
  Seed: LLIGCWYCRRR (MAR1_HUMAN)
  misc_feature (2)..(2): Xaa can be Met, Val, Phe, Ala, Gln, Tyr, Trp, Ile, Leu, Thr, Ser, Asn, Arg, or Gly
  misc_feature (11)..(11): Xaa can be Arg, Lys, Tyr, or His
LXIGCWYCRRX

SEQ ID NO: 116399 - protein, 9 aa, Artificial Sequence
  Description of Artificial Sequence: Synthetic peptide
  Seed: LLLIGCWYC (MAR1_HUMAN)
  misc_feature (2)..(2): Xaa can be Met, Leu, Ile, Gln, Val, Ala, Thr, Ser, Glu, Asn, Gly, Phe, or Cys
  misc_feature (9)..(9): Xaa can be Val, Leu, Ile, Ala, Met, Thr, Phe, Cys, or Ser
LXLIGCWYX

SEQ ID NO: 116400 - protein, 10 aa, Artificial Sequence
  Description of Artificial Sequence: Synthetic peptide
  Seed: LLLIGCWYCR (MAR1_HUMAN)
  misc_feature (2)..(2): Xaa can be Met, Tyr, Glu, Gln, Ser, His, Gly, Arg, Phe, Asn, Trp, Asp, Leu, Pro, Val, Thr, Lys, Ile, Ala, or Cys
  misc_feature (10)..(10): Xaa can be Arg, Lys, His, or Tyr
LXLIGCWYCX

SEQ ID NO: 116401 - protein, 11 aa, Artificial Sequence
  Description of Artificial Sequence: Synthetic peptide
  Seed: LLLIGCWYCRR (MAR1_HUMAN)
  misc_feature (2)..(2): Xaa can be Met, Val, Leu, Ala, Ser, Arg, Tyr, Phe, Gln, Thr, Lys, Ile, Trp, His, Cys, Gly, or Asn
  misc_feature (11)..(11): Xaa can be Arg, or Lys
LXLIGCWYCRX

SEQ ID NO: 116402 - protein, 8 aa, Artificial Sequence
  Description of Artificial Sequence: Synthetic peptide
  Seed: LMDKSLHV (MAR1_HUMAN)
  misc_feature (2)..(2): Xaa can be Ala, Phe, Tyr, Ser, Thr, Trp, Ile, Val, Gly, Leu, Asp, Pro, Cys, Glu, His, Asn, Gln, Met, Lys, or Arg
  misc_feature (8)..(8): Xaa can be Leu, Val, Met, Ile, Phe, Tyr, Cys, Ala, Trp, or Thr
LXDKSLHX

SEQ ID NO: 116403 - protein, 9 aa, Artificial Sequence
  Description of Artificial Sequence: Synthetic peptide
  Seed: LQEKNCEPV (MAR1_HUMAN)
  misc_feature (2)..(2): Xaa can be Met, Leu, Gln, Val, or Ile
  misc_feature (9)..(9): Xaa can be Val, Ile, or Leu
LXEKNCEPX

SEQ ID NO: 116404 - protein, 10 aa, Artificial Sequence
  Description of Artificial Sequence: Synthetic peptide
  Seed: LSAEQSPPPY (MAR1_HUMAN)
  misc_feature (2)..(2): Xaa can be Ala, Ser, Thr, Val, Gln, Met, Ile, Gly, Pro, Leu, Lys, Arg, Glu, His, Phe, Asp, Cys, Tyr, Asn, or Trp
  misc_feature (10)..(10): Xaa can be Tyr, Phe, Met, Trp, Leu, Lys, His, Arg, Ile, Ala, or Val
LXAEQSPPPX

SEQ ID NO: 116405 - protein, 10 aa, Artificial Sequence
  Description of Artificial Sequence: Synthetic peptide
  Seed: LTRRCPQEGF (MAR1_HUMAN)
  misc_feature (2)..(2): Xaa can be Arg, Ser, Gly, Thr, Asn, Ala, Gln, Cys, Leu, Val, Asp, Ile, Met, Pro, or Glu
  misc_feature (10)..(10): Xaa can be Leu, Trp, Phe, Ile, Met, Tyr, Lys, or Arg
LXRRCPQEGX

SEQ ID NO: 116406 - protein, 9 aa, Artificial Sequence
  Description of Artificial Sequence: Synthetic peptide
  Seed: LTVILGVLL (MAR1_HUMAN)
  misc_feature (2)..(2): Xaa can be Arg, Ala, Ser, Gly, Thr, Val, Ile, Met, Leu, Gln, Asn, Asp, Cys, Phe, Glu, Trp, Pro, Tyr, or Lys
  misc_feature (9)..(9): Xaa can be Trp, Leu, Lys, Phe, Ile, Val, Met, Tyr, Arg, His, or Ala
LXVILGVLX

SEQ ID NO: 116407 - protein, 10 aa, Artificial Sequence
  Description of Artificial Sequence: Synthetic peptide
  Seed: LTVILGVLLL (MAR1_HUMAN)
  misc_feature (2)..(2): Xaa can be Arg, Thr, Ser, Ala, Gly, Cys, Val, Gln, Met, Leu, Asn, Ile, or Pro
  misc_feature (10)..(10): Xaa can be Leu, Trp, Phe, Tyr, Met, Ile, Lys, or Arg
LXVILGVLLX

SEQ ID NO: 116408 - protein, 8 aa, Artificial Sequence
  Description of Artificial Sequence: Synthetic peptide
  Seed: MPREDAHF (MAR1_HUMAN)
  misc_feature (2)..(2): Xaa can be , or Pro
  misc_feature (8)..(8): Xaa can be Met, Leu, Tyr, Ile, Phe, or Val
MXREDAHX

SEQ ID NO: 116409 - protein, 9 aa, Artificial Sequence
  Description of Artificial Sequence: Synthetic peptide
  Seed: MPREDAHFI (MAR1_HUMAN)
  misc_feature (2)..(2): Xaa can be Pro, Ala, Val, Ser, Ile, Leu, Met, Cys, Thr, Gln, Phe, Gly, Asp, Asn, or Glu
  misc_feature (9)..(9): Xaa can be Trp, Tyr, Phe, Met, Leu, Ile, Val, Ala, Cys, His, Arg, Ser, Gln, Pro, Gly, Glu, Thr, or Ly s
MXREDAHFX

SEQ ID NO: 116410 - protein, 10 aa, Artificial Sequence
  Description of Artificial Sequence: Synthetic peptide
  Seed: MPREDAHFIY (MAR1_HUMAN)
  misc_feature (2)..(2): Xaa can be Pro, Gln, Met, Ala, Val, His, Ser, Ile, Lys, Leu, Thr, Glu, Arg, Tyr, Asp, Trp, Gly, Cys, Asn, or Phe
  misc_feature (10)..(10): Xaa can be Phe, Tyr, Met, Trp, Leu, His, Val, Ile, Ala, Gly, Thr, Arg, Pro, Ser, Cys, or Lys
MXREDAHFIX

SEQ ID NO: 116411 - protein, 11 aa, Artificial Sequence
  Description of Artificial Sequence: Synthetic peptide
  Seed: MPREDAHFIYG (MAR1_HUMAN)
  misc_feature (2)..(2): Xaa can be Pro, Ala, or Met
  misc_feature (11)..(11): Xaa can be Tyr, Phe, Val, Ile, Arg, Leu, Ser, Ala, Cys, Asp, His, Pro, Gly, Lys, Glu, Trp, Asn, Met, Thr, or Gln
MXREDAHFIYX

SEQ ID NO: 116412 - protein, 8 aa, Artificial Sequence
  Description of Artificial Sequence: Synthetic peptide
  Seed: NAPPAYEK (MAR1_HUMAN)
  misc_feature (2)..(2): Xaa can be Ala, Ser, Thr, Val, Ile, Gly, Leu, Phe, Gln, Met, Tyr, Asn, or Cys
  misc_feature (8)..(8): Xaa can be Leu, Phe, Tyr, Met, Lys, Ile, Arg, Val, or Trp
NXPPAYEX

SEQ ID NO: 116413 - protein, 9 aa, Artificial Sequence
  Description of Artificial Sequence: Synthetic peptide
  Seed: NAPPAYEKL (MAR1_HUMAN)
  misc_feature (2)..(2): Xaa can be Pro, Ala, Ser, Leu, Gln, Tyr, Thr, Ile, Val, Met, Arg, Glu, Phe, His, Gly, Asp, Asn, Trp, Cys, or Lys
  misc_feature (9)..(9): Xaa can be Val, Leu, Met, Phe, Tyr, Ile, Trp, Lys, Arg, Ala, Cys, His, Thr, Ser, Gly, or Pro
NXPPAYEKX

SEQ ID NO: 116414 - protein, 9 aa, Artificial Sequence
  Description of Artificial Sequence: Synthetic peptide
  Seed: NGYRALMDK (MAR1_HUMAN)
  misc_feature (2)..(2): Xaa can be Val, Ile, Ala, Ser, Thr, Gly, Gln, Leu, Met, Asp, Glu, Pro, Cys, Asn, or Phe
  misc_feature (9)..(9): Xaa can be Lys, Arg, Tyr, or His
NXYRALMDX

SEQ ID NO: 116415 - protein, 9 aa, Artificial Sequence
  Description of Artificial Sequence: Synthetic peptide
  Seed: PKKGHGHSY (MAR1_HUMAN)
  misc_feature (2)..(2): Xaa can be Gln, Leu, Arg, Glu, Ile, Ala, Val, Met, Lys, His, or Ser
  misc_feature (9)..(9): Xaa can be Tyr, Phe, Leu, or Met
PXKGHGHSX

SEQ ID NO: 116416 - protein, 9 aa, Artificial Sequence
  Description of Artificial Sequence: Synthetic peptide
  Seed: PNAPPAYEK (MAR1_HUMAN)
  misc_feature (2)..(2): Xaa can be Ala, Val, Ile, Gly, Met, Ser, Leu, Thr, Asp, Asn, Gln, or Phe
  misc_feature (9)..(9): Xaa can be Lys, or Arg
PXAPPAYEX

SEQ ID NO: 116417 - protein, 9 aa, Artificial Sequence
  Description of Artificial Sequence: Synthetic peptide
  Seed: PPAYEKLSA (MAR1_HUMAN)
  misc_feature (2)..(2): Xaa can be Pro, or Ala
  misc_feature (9)..(9): Xaa can be Ala, or Val
PXAYEKLSX

SEQ ID NO: 116418 - protein, 9 aa, Artificial Sequence
  Description of Artificial Sequence: Synthetic peptide
  Seed: PVVPNAPPA (MAR1_HUMAN)
  misc_feature (2)..(2): Xaa can be Pro, Ala, Ser, Gly, Ile, Leu, or Val
  misc_feature (9)..(9): Xaa can be Ala, Leu, Cys, Met, Thr, Ile, Val, Pro, Gly, Ser, or Phe
PXVPNAPPX

SEQ ID NO: 116419 - protein, 10 aa, Artificial Sequence
  Description of Artificial Sequence: Synthetic peptide
  Seed: PVVPNAPPAY (MAR1_HUMAN)
  misc_feature (2)..(2): Xaa can be Pro, Met, Ala, Thr, Val, Ser, Leu, Gln, Ile, Glu, Gly, Asn, Arg, Lys, Tyr, His, Cys, Phe, Asp, or Trp
  misc_feature (10)..(10): Xaa can be Tyr, Phe, Met, Leu, or Trp
PXVPNAPPAX

SEQ ID NO: 116420 - protein, 11 aa, Artificial Sequence
  Description of Artificial Sequence: Synthetic peptide
  Seed: QEGFDHRDSKV (MAR1_HUMAN)
  misc_feature (2)..(2): Xaa can be , or Glu
  misc_feature (11)..(11): Xaa can be Met, Ile, Val, Leu, Phe, Cys, or Ala
QXGFDHRDSKX

SEQ ID NO: 116421 - protein, 8 aa, Artificial Sequence
  Description of Artificial Sequence: Synthetic peptide
  Seed: QEKNCEPV (MAR1_HUMAN)
  misc_feature (2)..(2): Xaa can be Glu, or Asp
  misc_feature (8)..(8): Xaa can be Leu, Val, Phe, Ile, Met, or Ala
QXKNCEPX

SEQ ID NO: 116422 - protein, 9 aa, Artificial Sequence
  Description of Artificial Sequence: Synthetic peptide
  Seed: QEKNCEPVV (MAR1_HUMAN)
  misc_feature (2)..(2): Xaa can be Glu, Asp, Gln, Met, Ala, Leu, Val, Ile, or Ser
  misc_feature (9)..(9): Xaa can be Val, Ile, Leu, Phe, Ala, Met, Trp, Tyr, Cys, Pro, Thr, Glu, His, Ser, Asp, or Gly
QXKNCEPVX

SEQ ID NO: 116423 - protein, 10 aa, Artificial Sequence
  Description of Artificial Sequence: Synthetic peptide
  Seed: QEKNCEPVVP (MAR1_HUMAN)
  misc_feature (2)..(2): Xaa can be , or Glu
  misc_feature (10)..(10): Xaa can be Met, Thr, Tyr, Ala, Gly, Trp, Ser, Cys, Ile, Phe, Val, Leu, or Pro
QXKNCEPVVX

SEQ ID NO: 116424 - protein, 9 aa, Artificial Sequence
  Description of Artificial Sequence: Synthetic peptide
  Seed: RALMDKSLH (MAR1_HUMAN)
  misc_feature (2)..(2): Xaa can be Ala, Ser, Val, Thr, Ile, or Gln
  misc_feature (9)..(9): Xaa can be Tyr, Phe, Met, Leu, or His
RXLMDKSLX

SEQ ID NO: 116425 - protein, 10 aa, Artificial Sequence
  Description of Artificial Sequence: Synthetic peptide
  Seed: RALMDKSLHV (MAR1_HUMAN)
  misc_feature (2)..(2): Xaa can be Ala, Phe, Thr, Tyr, Ser, Gln, Gly, Val, Asp, Asn, Leu, Cys, Met, Arg, His, Trp, Pro, Ile, Glu, or Lys
  misc_feature (10)..(10): Xaa can be Thr, Ala, Ile, Leu, Cys, Val, Met, Phe, Tyr, Ser, or Trp
RXLMDKSLHX

SEQ ID NO: 116426 - protein, 11 aa, Artificial Sequence
  Description of Artificial Sequence: Synthetic peptide
  Seed: RALMDKSLHVG (MAR1_HUMAN)
  misc_feature (2)..(2): Xaa can be Leu, Trp, Glu, Lys, Cys, Val, Ala, Met, Tyr, Phe, Arg, His, Ser, Pro, Gly, Thr, Gln, Asp, Asn, or Ile
  misc_feature (11)..(11): Xaa can be Tyr, Thr, Asp, Phe, Met, Asn, Ser, Ala, Gln, Cys, Leu, His, Glu, Val, Trp, Lys, Ile, Pro, Arg, or Gly
RXLMDKSLHVX

SEQ ID NO: 116427 - protein, 10 aa, Artificial Sequence
  Description of Artificial Sequence: Synthetic peptide
  Seed: RDSKVSLQEK (MAR1_HUMAN)
  misc_feature (2)..(2): Xaa can be Val, Thr, Met, Trp, Phe, Tyr, Ile, Ser, Ala, Glu, Lys, Leu, Arg, His, Gln, Gly, Asp, Pro, Asn, or Cys
  misc_feature (10)..(10): Xaa can be Leu, Met, Thr, Lys, Ala, Ser, Tyr, Ile, Val, Gly, Arg, Phe, or Cys
RXSKVSLQEX

SEQ ID NO: 116428 - protein, 8 aa, Artificial Sequence
  Description of Artificial Sequence: Synthetic peptide
  Seed: REDAHFIY (MAR1_HUMAN)
  misc_feature (2)..(2): Xaa can be Glu, Asp, or Gln
  misc_feature (8)..(8): Xaa can be Phe, Leu, Tyr, Met, Val, Trp, Ile, Ala, Cys, or Thr
RXDAHFIX

SEQ ID NO: 116429 - protein, 9 aa, Artificial Sequence
  Description of Artificial Sequence: Synthetic peptide
  Seed: REDAHFIYG (MAR1_HUMAN)
  misc_feature (2)..(2): Xaa can be Glu, Asp, Gln, Ala, Ser, Pro, Val, Asn, Met, Ile, Gly, or Thr
  misc_feature (9)..(9): Xaa can be Leu, Met, Phe, Ile, Tyr, Val, Trp, Cys, Ala, Pro, Thr, Ser, Lys, Asp, Arg, Asn, Gln, His, Gly, or Glu
RXDAHFIYX

SEQ ID NO: 116430 - protein, 10 aa, Artificial Sequence
  Description of Artificial Sequence: Synthetic peptide
  Seed: REDAHFIYGY (MAR1_HUMAN)
  misc_feature (2)..(2): Xaa can be Glu, Gln, Thr, Trp, Asp, Ser, Tyr, Met, Val, Phe, Ala, Lys, Leu, Ile, Gly, His, Asn, Arg, Cys, or Pro
  misc_feature (10)..(10): Xaa can be Tyr, Phe, Met, Lys, Leu, Val, Trp, Ile, His, Arg, Pro, Cys, Ser, Ala, Thr, or Gly
RXDAHFIYGX

SEQ ID NO: 116431 - protein, 10 aa, Artificial Sequence
  Description of Artificial Sequence: Synthetic peptide
  Seed: RNGYRALMDK (MAR1_HUMAN)
  misc_feature (2)..(2): Xaa can be Thr, Val, Met, Ser, Ile, Leu, Phe, Tyr, Ala, Gln, Cys, Arg, His, Trp, Asn, Glu, Lys, Gly, Pro, or Asp
  misc_feature (10)..(10): Xaa can be Lys, Ala, Tyr, Arg, His, Val, Ile, Met, or Leu
RXGYRALMDX

SEQ ID NO: 116432 - protein, 8 aa, Artificial Sequence
  Description of Artificial Sequence: Synthetic peptide
  Seed: RRCPQEGF (MAR1_HUMAN)
  misc_feature (2)..(2): Xaa can be Arg, or Tyr
  misc_feature (8)..(8): Xaa can be Phe, Val, Arg, Lys, Ile, Leu, Trp, Tyr, or Met
RXCPQEGX

SEQ ID NO: 116433 - protein, 10 aa, Artificial Sequence
  Description of Artificial Sequence: Synthetic peptide
  Seed: RRCPQEGFDH (MAR1_HUMAN)
  misc_feature (2)..(2): Xaa can be Arg, or Gln
  misc_feature (10)..(10): Xaa can be Lys, Phe, Tyr, His, Arg, Trp, Val, Gln, Met, Ile, Leu, or Ala
RXCPQEGFDX

SEQ ID NO: 116434 - protein, 11 aa, Artificial Sequence
  Description of Artificial Sequence: Synthetic peptide
  Seed: RRCPQEGFDHR (MAR1_HUMAN)
  misc_feature (2)..(2): Xaa can be Arg, Gln, Tyr, His, Phe, Ala, or Trp
  misc_feature (11)..(11): Xaa can be Phe, Tyr, Leu, Lys, Trp, Met, Ala, Val, Gln, His, Arg, Cys, or Ile
RXCPQEGFDHX

SEQ ID NO: 116435 - protein, 8 aa, Artificial Sequence
  Description of Artificial Sequence: Synthetic peptide
  Seed: RRNGYRAL (MAR1_HUMAN)
  misc_feature (2)..(2): Xaa can be Arg, Gln, Tyr, His, Ala, Phe, Ser, Glu, or Asp
  misc_feature (8)..(8): Xaa can be Leu, Phe, Tyr, Met, Ile, Trp, Val, Lys, or Arg
RXNGYRAX

SEQ ID NO: 116436 - protein, 9 aa, Artificial Sequence
  Description of Artificial Sequence: Synthetic peptide
  Seed: RRNGYRALM (MAR1_HUMAN)
  misc_feature (2)..(2): Xaa can be Arg, Gln, Met, Glu, Lys, Tyr, Ala, His, Gly, Asn, Phe, Ser, Trp, Asp, Leu, Val, Thr, Ile, Pro, or Cys
  misc_feature (9)..(9): Xaa can be Phe, Tyr, Leu, Met, Ile, Val, Lys, His, Trp, Arg, Ala, Gly, Thr, Cys, Ser, Gln, Asn, Pro, or Glu
RXNGYRALX

SEQ ID NO: 116437 - protein, 10 aa, Artificial Sequence
  Description of Artificial Sequence: Synthetic peptide
  Seed: RRNGYRALMD (MAR1_HUMAN)
  misc_feature (2)..(2): Xaa can be Arg, or Gln
  misc_feature (10)..(10): Xaa can be Lys, Arg, Phe, Leu, Met, Glu, Tyr, Ser, Thr, Pro, Val, Ala, Gly, Asp, Gln, Asn, His, Cys, Trp, or Ile
RXNGYRALMX

SEQ ID NO: 116438 - protein, 11 aa, Artificial Sequence
  Description of Artificial Sequence: Synthetic peptide
  Seed: RRNGYRALMDK (MAR1_HUMAN)
  misc_feature (2)..(2): Xaa can be , or Arg
  misc_feature (11)..(11): Xaa can be Gly, Thr, Ala, Phe, Lys, Trp, Leu, Arg, His, Ile, Tyr, Val, Met, or Ser
RXNGYRALMDX

SEQ ID NO: 116439 - protein, 9 aa, Artificial Sequence
  Description of Artificial Sequence: Synthetic peptide
  Seed: RRRNGYRAL (MAR1_HUMAN)
  misc_feature (2)..(2): Xaa can be Gln, Arg, Tyr, Met, Phe, Ala, His, Lys, Glu, Leu, Trp, Asp, Ser, Ile, Val, Gly, Pro, Thr, Asn, or Cys
  misc_feature (9)..(9): Xaa can be Phe, Tyr, Leu, Met, Trp, Ile, His, Val, Ala, Cys, Gln, Lys, Arg, Thr, Gly, Ser, Asn, Glu, or Pro
RXRNGYRAX

SEQ ID NO: 116440 - protein, 10 aa, Artificial Sequence
  Description of Artificial Sequence: Synthetic peptide
  Seed: RRRNGYRALM (MAR1_HUMAN)
  misc_feature (2)..(2): Xaa can be Arg, Lys, Met, Gln, His, Trp, Glu, Val, Tyr, Leu, Pro, Gly, Ile, Cys, Ser, Asn, Thr, Phe, Asp, or Ala
  misc_feature (10)..(10): Xaa can be Arg, His, Lys, Val, Met, Leu, Tyr, Ala, Ile, Phe, Trp, Gln, Cys, Ser, Thr, Glu, Asn, or Gl y
RXRNGYRALX

SEQ ID NO: 116441 - protein, 11 aa, Artificial Sequence
  Description of Artificial Sequence: Synthetic peptide
  Seed: RRRNGYRALMD (MAR1_HUMAN)
  misc_feature (2)..(2): Xaa can be Arg, or Gln
  misc_feature (11)..(11): Xaa can be Lys, Met, His, Trp, Leu, Ser, Tyr, Gln, Phe, Val, Arg, Thr, Cys, Asn, Ala, Pro, Asp, Glu, Gly, or Ile
RXRNGYRALMX

SEQ ID NO: 116442 - protein, 9 aa, Artificial Sequence
  Description of Artificial Sequence: Synthetic peptide
  Seed: SAEQSPPPY (MAR1_HUMAN)
  misc_feature (2)..(2): Xaa can be Ala, Gln, Pro, Met, Ser, Ile, Val, Thr, Phe, Tyr, Gly, Leu, Arg, Cys, Asn, Asp, His, Lys, Trp, or Glu
  misc_feature (9)..(9): Xaa can be Phe, Tyr, Leu, Met, Val, Ile, Arg, Lys, His, Trp, Ala, or Cys
SXEQSPPPX

SEQ ID NO: 116443 - protein, 9 aa, Artificial Sequence
  Description of Artificial Sequence: Synthetic peptide
  Seed: SLHVGTQCA (MAR1_HUMAN)
  misc_feature (2)..(2): Xaa can be Leu, Met, Ile, Val, Thr, Gln, Ala, or Ser
  misc_feature (9)..(9): Xaa can be Val, Leu, Ile, Ala, or Met
SXHVGTQCX

SEQ ID NO: 116444 - protein, 10 aa, Artificial Sequence
  Description of Artificial Sequence: Synthetic peptide
  Seed: SLHVGTQCAL (MAR1_HUMAN)
  misc_feature (2)..(2): Xaa can be Met, Gln, Leu, Val, Ile, Phe, Tyr, Glu, Ala, His, Thr, Trp, Asn, Gly, Pro, Ser, Lys, Arg, Cys, or Asp
  misc_feature (10)..(10): Xaa can be Leu, Met, Tyr, Phe, Ile, Val, Trp, Ala, or His
SXHVGTQCAX

SEQ ID NO: 116445 - protein, 10 aa, Artificial Sequence
  Description of Artificial Sequence: Synthetic peptide
  Seed: SLQEKNCEPV (MAR1_HUMAN)
  misc_feature (2)..(2): Xaa can be Met, Leu, Ile, Val, or Gln
  misc_feature (10)..(10): Xaa can be Val, Met, Leu, Ile, or Ala
SXQEKNCEPX

SEQ ID NO: 116446 - protein, 11 aa, Artificial Sequence
  Description of Artificial Sequence: Synthetic peptide
  Seed: SLQEKNCEPVV (MAR1_HUMAN)
  misc_feature (2)..(2): Xaa can be Leu, or Met
  misc_feature (11)..(11): Xaa can be Ile, Leu, Val, or Met
SXQEKNCEPVX

SEQ ID NO: 116447 - protein, 8 aa, Artificial Sequence
  Description of Artificial Sequence: Synthetic peptide
  Seed: TAEEAAGI (MAR1_HUMAN)
  misc_feature (2)..(2): Xaa can be Ala, Ser, Ile, Leu, Thr, or Val
  misc_feature (8)..(8): Xaa can be Leu, Met, Phe, or Ile
TXEEAAGX

SEQ ID NO: 116448 - protein, 10 aa, Artificial Sequence
  Description of Artificial Sequence: Synthetic peptide
  Seed: TAEEAAGIGI (MAR1_HUMAN)
  misc_feature (2)..(2): Xaa can be Ser, Ala, Val, Thr, Leu, Ile, Met, Cys, Gly, Phe, Gln, Tyr, or Pro
  misc_feature (10)..(10): Xaa can be Leu, Met, Phe, Ile, Val, or Tyr
TXEEAAGIGX

SEQ ID NO: 116449 - protein, 11 aa, Artificial Sequence
  Description of Artificial Sequence: Synthetic peptide
  Seed: TAEEAAGIGIL (MAR1_HUMAN)
  misc_feature (2)..(2): Xaa can be Ala, Thr, Ser, Leu, Ile, Val, Trp, Asn, Tyr, Asp, Phe, Gln, Glu, Cys, Gly, Met, Pro, Lys, His, or Arg
  misc_feature (11)..(11): Xaa can be Leu, Lys, Arg, Met, Phe, Ile, or Val
TXEEAAGIGIX

SEQ ID NO: 116450 - protein, 9 aa, Artificial Sequence
  Description of Artificial Sequence: Synthetic peptide
  Seed: TRRCPQEGF (MAR1_HUMAN)
  misc_feature (2)..(2): Xaa can be Arg, Gln, Tyr, His, Gly, Ile, Ala, Ser, Leu, Val, Met, Lys, Glu, Asn, Phe, or Thr
  misc_feature (9)..(9): Xaa can be Phe, Leu, Tyr, Met, Lys, Trp, Ile, Val, His, or Arg
TXRCPQEGX

SEQ ID NO: 116451 - protein, 9 aa, Artificial Sequence
  Description of Artificial Sequence: Synthetic peptide
  Seed: TTAEEAAGI (MAR1_HUMAN)
  misc_feature (2)..(2): Xaa can be Thr, Leu, Met, Val, Ile, Ala, Ser, Gln, Gly, Phe, Asn, Tyr, Trp, Glu, Asp, Pro, or His
  misc_feature (9)..(9): Xaa can be Lys, Arg, Leu, Val, Phe, Met, Tyr, Ala, Ile, Thr, Cys, or Trp
TXAEEAAGX

SEQ ID NO: 116452 - protein, 11 aa, Artificial Sequence
  Description of Artificial Sequence: Synthetic peptide
  Seed: TTAEEAAGIGI (MAR1_HUMAN)
  misc_feature (2)..(2): Xaa can be Leu, Met, Ala, Val, Thr, Ser, Ile, Gly, Gln, Cys, Pro, Asn, Asp, Tyr, Trp, Phe, or Glu
  misc_feature (11)..(11): Xaa can be Trp, Lys, Leu, Met, Phe, Ile, Val, Ala, Arg, Tyr, Cys, or Thr
TXAEEAAGIGX

SEQ ID NO: 116453 - protein, 8 aa, Artificial Sequence
  Description of Artificial Sequence: Synthetic peptide
  Seed: TVILGVLL (MAR1_HUMAN)
  misc_feature (2)..(2): Xaa can be Ala, Thr, Gly, Ser, Ile, or Val
  misc_feature (8)..(8): Xaa can be Leu, Ile, or Met
TXILGVLX

SEQ ID NO: 116454 - protein, 9 aa, Artificial Sequence
  Description of Artificial Sequence: Synthetic peptide
  Seed: TVILGVLLL (MAR1_HUMAN)
  misc_feature (2)..(2): Xaa can be Arg, Gln, Ser, Ala, Thr, Val, Leu, Ile, Gly, Met, Asn, Glu, Asp, Cys, Lys, Phe, Tyr, Pro, His, or Trp
  misc_feature (9)..(9): Xaa can be Phe, Leu, Tyr, Trp, Ile, Met, Val, Lys, Arg, His, Ala, Cys, Thr, or Gln
TXILGVLLX

SEQ ID NO: 116455 - protein, 10 aa, Artificial Sequence
  Description of Artificial Sequence: Synthetic peptide
  Seed: TVILGVLLLI (MAR1_HUMAN)
  misc_feature (2)..(2): Xaa can be Gln, Leu, Met, Val, Ile, Thr, Pro, Trp, Asn, Phe, Glu, Tyr, Asp, Gly, Lys, Ser, Arg, Ala, Cys, or His
  misc_feature (10)..(10): Xaa can be Val, Leu, Ala, Ile, Met, Thr, Ser, or Phe
TXILGVLLLX

SEQ ID NO: 116456 - protein, 9 aa, Artificial Sequence
  Description of Artificial Sequence: Synthetic peptide
  Seed: VGTQCALTR (MAR1_HUMAN)
  misc_feature (2)..(2): Xaa can be Val, Thr, Ala, Ser, Ile, Met, Leu, Gly, Tyr, Gln, Pro, Asp, Trp, Phe, Asn, Cys, or His
  misc_feature (9)..(9): Xaa can be Arg, Lys, Leu, Met, Tyr, Phe, Ile, Val, His, or Ala
VXTQCALTX

SEQ ID NO: 116457 - protein, 10 aa, Artificial Sequence
  Description of Artificial Sequence: Synthetic peptide
  Seed: VGTQCALTRR (MAR1_HUMAN)
  misc_feature (2)..(2): Xaa can be Arg, Phe, Trp, Met, Leu, Tyr, Gln, Glu, Cys, Ser, Ile, Gly, His, Asp, Asn, Ala, Val, Lys, Thr, or Pro
  misc_feature (10)..(10): Xaa can be Arg, or Lys
VXTQCALTRX

SEQ ID NO: 116458 - protein, 9 aa, Artificial Sequence
  Description of Artificial Sequence: Synthetic peptide
  Seed: VILGVLLLI (MAR1_HUMAN)
  misc_feature (2)..(2): Xaa can be Arg, Met, Leu, Gln, Ala, Thr, Ile, Ser, Val, Asn, Cys, Phe, Gly, Glu, Pro, Asp, Tyr, Lys, His, or Trp
  misc_feature (9)..(9): Xaa can be Arg, Lys, Trp, Val, Leu, Ile, Phe, Met, Tyr, His, Thr, Ala, Cys, Ser, Gly, Pro, Gln, Glu, or Asn
VXLGVLLLX

SEQ ID NO: 116459 - protein, 9 aa, Artificial Sequence
  Description of Artificial Sequence: Synthetic peptide
  Seed: VLLLIGCWY (MAR1_HUMAN)
  misc_feature (2)..(2): Xaa can be Phe, Val, Ala, Gln, Met, Leu, Pro, Thr, Asn, Asp, Glu, Ile, Tyr, His, Trp, Gly, or Ser
  misc_feature (9)..(9): Xaa can be Tyr, or Phe
VXLLIGCWX

SEQ ID NO: 116460 - protein, 11 aa, Artificial Sequence
  Description of Artificial Sequence: Synthetic peptide
  Seed: VLLLIGCWYCR (MAR1_HUMAN)
  misc_feature (2)..(2): Xaa can be Met, Ala, Pro, Lys, Cys, Ile, Leu, Tyr, Asp, Gly, Phe, Thr, Glu, Asn, Arg, His, Gln, Val, Ser, or Trp
  misc_feature (11)..(11): Xaa can be Arg, or Lys
VXLLIGCWYCX

SEQ ID NO: 116461 - protein, 8 aa, Artificial Sequence
  Description of Artificial Sequence: Synthetic peptide
  Seed: VPNAPPAY (MAR1_HUMAN)
  misc_feature (2)..(2): Xaa can be Ala, Pro, Ser, Ile, Val, Thr, Gly, Met, Gln, Asn, Leu, Phe, Glu, Cys, Lys, Asp, Tyr, or Tr p
  misc_feature (8)..(8): Xaa can be Tyr, Phe, Leu, Met, His, Ile, Val, Lys, Ala, Trp, Cys, Thr, Ser, Gln, Arg, Gly, or Pro
VXNAPPAX

SEQ ID NO: 116462 - protein, 10 aa, Artificial Sequence
  Description of Artificial Sequence: Synthetic peptide
  Seed: VPNAPPAYEK (MAR1_HUMAN)
  misc_feature (2)..(2): Xaa can be Pro, Ala, Thr, Gly, Leu, Val, Met, Ile, Ser, Asp, Gln, Asn, Cys, Glu, or Phe
  misc_feature (10)..(10): Xaa can be Lys, Arg, Ala, Tyr, His, Phe, Glu, Pro, Ile, Thr, Val, Met, Leu, Trp, Gln, Gly, Cys, or Se r
VXNAPPAYEX

SEQ ID NO: 116463 - protein, 11 aa, Artificial Sequence
  Description of Artificial Sequence: Synthetic peptide
  Seed: VPNAPPAYEKL (MAR1_HUMAN)
  misc_feature (2)..(2): Xaa can be Pro, Ala, Ser, or Val
  misc_feature (11)..(11): Xaa can be Leu, Met, Phe, Ile, Trp, Val, Ala, Thr, Pro, Cys, Ser, Tyr, or Gly
VXNAPPAYEKX

SEQ ID NO: 116464 - protein, 9 aa, Artificial Sequence
  Description of Artificial Sequence: Synthetic peptide
  Seed: VVPNAPPAY (MAR1_HUMAN)
  misc_feature (2)..(2): Xaa can be Ala, Tyr, Ser, Phe, Val, Ile, Arg, Gly, Leu, Thr, Met, Pro, Trp, Gln, Cys, Asn, Glu, Asp, His, or Lys
  misc_feature (9)..(9): Xaa can be Met, Ile, Val, Phe, Leu, Tyr, Trp, Arg, Lys, Cys, Ala, His, Thr, Ser, Gln, Pro, Gly, Glu, or Asn
VXPNAPPAX

SEQ ID NO: 116465 - protein, 11 aa, Artificial Sequence
  Description of Artificial Sequence: Synthetic peptide
  Seed: VVPNAPPAYEK (MAR1_HUMAN)
  misc_feature (2)..(2): Xaa can be Ala, Ser, Thr, Val, Leu, Met, Gly, Ile, or Cys
  misc_feature (11)..(11): Xaa can be Phe, Leu, Lys, Met, Arg, Tyr, Trp, Ile, or Val
VXPNAPPAYEX

SEQ ID NO: 116466 - protein, 9 aa, Artificial Sequence
  Description of Artificial Sequence: Synthetic peptide
  Seed: WYCRRRNGY (MAR1_HUMAN)
  misc_feature (2)..(2): Xaa can be Tyr, Phe, Ala, Ile, Gln, Leu, Ser, Val, Met, or Thr
  misc_feature (9)..(9): Xaa can be Tyr, Phe, Met, or Leu
WXCRRRNGX

SEQ ID NO: 116467 - protein, 10 aa, Artificial Sequence
  Description of Artificial Sequence: Synthetic peptide
  Seed: WYCRRRNGYR (MAR1_HUMAN)
  misc_feature (2)..(2): Xaa can be Phe, Met, Thr, Tyr, Leu, Ala, Gln, Ile, Trp, Gly, Ser, or Val
  misc_feature (10)..(10): Xaa can be Arg, or Lys
WXCRRRNGYX

SEQ ID NO: 116468 - protein, 11 aa, Artificial Sequence
  Description of Artificial Sequence: Synthetic peptide
  Seed: YCRRRNGYRAL (MAR1_HUMAN)
  misc_feature (2)..(2): Xaa can be Met, Pro, Ala, Leu, Val, Gln, Ile, Phe, Asn, Ser, Gly, Trp, Thr, Lys, Arg, Glu, Tyr, or Cy s
  misc_feature (11)..(11): Xaa can be Leu, Met, Phe, Ile, Val, Ala, Cys, or Thr
YXRRRNGYRAX

SEQ ID NO: 116469 - protein, 9 aa, Artificial Sequence
  Description of Artificial Sequence: Synthetic peptide
  Seed: YEKLSAEQS (MAR1_HUMAN)
  misc_feature (2)..(2): Xaa can be Glu, Asp, or Gln
  misc_feature (9)..(9): Xaa can be Met, Ala, Leu, Val, Ile, Phe, Cys, Pro, Glu, Gln, Tyr, Trp, Thr, Asp, Lys, Gly, or Ser
YXKLSAEQX

SEQ ID NO: 116470 - protein, 10 aa, Artificial Sequence
  Description of Artificial Sequence: Synthetic peptide
  Seed: YEKLSAEQSP (MAR1_HUMAN)
  misc_feature (2)..(2): Xaa can be , or Glu
  misc_feature (10)..(10): Xaa can be Gly, Met, Pro, Cys, Phe, Thr, Ala, Ile, Ser, Val, or Leu
YXKLSAEQSX

SEQ ID NO: 116471 - protein, 10 aa, Artificial Sequence
  Description of Artificial Sequence: Synthetic peptide
  Seed: YGYPKKGHGH (MAR1_HUMAN)
  misc_feature (2)..(2): Xaa can be Ala, Ser, Val, Thr, Ile, Gly, Met, Gln, Glu, Leu, Asn, Cys, Pro, Asp, Lys, Phe, Tyr, Arg, Trp, or His
  misc_feature (10)..(10): Xaa can be Tyr, Phe, Met, Leu, His, Trp, Ile, Val, Ala, Cys, Arg, Lys, Gly, Gln, Asn, Thr, Ser, or Pr o
YXYPKKGHGX

SEQ ID NO: 116472 - protein, 9 aa, Artificial Sequence
  Description of Artificial Sequence: Synthetic peptide
  Seed: YPKKGHGHS (MAR1_HUMAN)
  misc_feature (2)..(2): Xaa can be Pro, Ala, Val, Ile, Leu, Ser, or Met
  misc_feature (9)..(9): Xaa can be Leu, Met, Ile, Ala, Phe, Val, Gly, Trp, Cys, Pro, Tyr, Ser, or Thr
YXKKGHGHX

SEQ ID NO: 116473 - protein, 10 aa, Artificial Sequence
  Description of Artificial Sequence: Synthetic peptide
  Seed: YPKKGHGHSY (MAR1_HUMAN)
  misc_feature (2)..(2): Xaa can be Pro, Ala, Ser, Arg, Val, Thr, Ile, Gln, Tyr, Met, Phe, Leu, His, Gly, Glu, Trp, Asn, Cys, Lys, or Asp
  misc_feature (10)..(10): Xaa can be Phe, Met, Tyr, Leu, Trp, His, Ile, Val, Cys, Ala, Lys, Arg, Gln, Thr, Gly, Ser, Glu, Pro, or Asn
YXKKGHGHSX

SEQ ID NO: 116474 - protein, 11 aa, Artificial Sequence
  Description of Artificial Sequence: Synthetic peptide
  Seed: YPKKGHGHSYT (MAR1_HUMAN)
  misc_feature (2)..(2): Xaa can be , or Pro
  misc_feature (11)..(11): Xaa can be Ala, Thr, Cys, Ile, Phe, Met, Val, or Leu
YXKKGHGHSYX

SEQ ID NO: 116475 - protein, 9 aa, Artificial Sequence
  Description of Artificial Sequence: Synthetic peptide
  Seed: YRALMDKSL (MAR1_HUMAN)
  misc_feature (2)..(2): Xaa can be Arg, His, Tyr, Gln, Met, Phe, Lys, Ala, Trp, Glu, Gly, Leu, Pro, Thr, Val, Ile, Ser, Asn, or Asp
  misc_feature (9)..(9): Xaa can be Leu, Phe, Tyr, Met, Ile, Val, Trp, His, Ala, Cys, Thr, Pro, Arg, Lys, Gly, or Ser
YXALMDKSX

SEQ ID NO: 116476 - protein, 11 aa, Artificial Sequence
  Description of Artificial Sequence: Synthetic peptide
  Seed: YRALMDKSLHV (MAR1_HUMAN)
  misc_feature (2)..(2): Xaa can be Ile, Arg, Gln, Lys, Trp, Thr, Leu, Val, Glu, Asn, Gly, Asp, Phe, Tyr, Cys, Pro, Ala, His, Ser, or Met
  misc_feature (11)..(11): Xaa can be Thr, Met, Cys, Leu, Ser, Phe, Ile, Ala, or Val
YXALMDKSLHX

SEQ ID NO: 116477 - protein, 10 aa, Artificial Sequence
  Description of Artificial Sequence: Synthetic peptide
  Seed: YTTAEEAAGI (MAR1_HUMAN)
  misc_feature (2)..(2): Xaa can be Leu, Met, Gln, Thr, Ile, Pro, Ser, Tyr, Ala, Arg, Val, His, Phe, Asp, Asn, Trp, Lys, Glu, Gly, or Cys
  misc_feature (10)..(10): Xaa can be Ile, Met, Val, Ala, Leu, Phe, Gly, Ser, Thr, or Cys
YXTAEEAAGX

SEQ ID NO: 116478 - protein, 11 aa, Artificial Sequence
  Description of Artificial Sequence: Synthetic peptide
  Seed: FSDEGGFTCFF (MOG_HUMAN)
FADEGGFTCFY

SEQ ID NO: 116479 - protein, 10 aa, Artificial Sequence
  Description of Artificial Sequence: Synthetic peptide
  Seed: FSDEGGFTCF (MOG_HUMAN)
FADEGGFTCY

SEQ ID NO: 116480 - protein, 11 aa, Artificial Sequence
  Description of Artificial Sequence: Synthetic peptide
  Seed: FSDEGGFTCFF (MOG_HUMAN)
FTDEGGFTCFY

SEQ ID NO: 116481 - protein, 9 aa, Artificial Sequence
  Description of Artificial Sequence: Synthetic peptide
  Seed: FSDEGGFTC (MOG_HUMAN)
FTDEGGFTF

SEQ ID NO: 116482 - protein, 10 aa, Artificial Sequence
  Description of Artificial Sequence: Synthetic peptide
  Seed: FVIVPVLGPL (MOG_HUMAN)
FTIVPVLGPM

SEQ ID NO: 116483 - protein, 10 aa, Artificial Sequence
  Description of Artificial Sequence: Synthetic peptide
  Seed: FVIVPVLGPL (MOG_HUMAN)
FTIVPVLGPV

SEQ ID NO: 116484 - protein, 9 aa, Artificial Sequence
  Description of Artificial Sequence: Synthetic peptide
  Seed: FYWVSPGVL (MOG_HUMAN)
FYWVSPGVF

SEQ ID NO: 116485 - protein, 9 aa, Artificial Sequence
  Description of Artificial Sequence: Synthetic peptide
  Seed: IFLCLQYRL (MOG_HUMAN)
IYLCLQYRF

SEQ ID NO: 116486 - protein, 9 aa, Artificial Sequence
  Description of Artificial Sequence: Synthetic peptide
  Seed: LLLQVSSSY (MOG_HUMAN)
LMLQVSSSY

SEQ ID NO: 116487 - protein, 9 aa, Artificial Sequence
  Description of Artificial Sequence: Synthetic peptide
  Seed: LPSCLCSFL (MOG_HUMAN)
LPSCLCSFF

SEQ ID NO: 116488 - protein, 9 aa, Artificial Sequence
  Description of Artificial Sequence: Synthetic peptide
  Seed: LPSCLCSFL (MOG_HUMAN)
LPSCLCSFM

SEQ ID NO: 116489 - protein, 9 aa, Artificial Sequence
  Description of Artificial Sequence: Synthetic peptide
  Seed: LLLQVSSSY (MOG_HUMAN)
LTLQVSSSY

SEQ ID NO: 116490 - protein, 9 aa, Artificial Sequence
  Description of Artificial Sequence: Synthetic peptide
  Seed: MASLSRPSL (MOG_HUMAN)
MPSLSRPSM

SEQ ID NO: 116491 - protein, 9 aa, Artificial Sequence
  Description of Artificial Sequence: Synthetic peptide
  Seed: PFSRVVHLY (MOG_HUMAN)
PMSRVVHLY

SEQ ID NO: 116492 - protein, 10 aa, Artificial Sequence
  Description of Artificial Sequence: Synthetic peptide
  Seed: RTFDPHFLRV (MOG_HUMAN)
RAFDPHFLRF

SEQ ID NO: 116493 - protein, 9 aa, Artificial Sequence
  Description of Artificial Sequence: Synthetic peptide
  Seed: RTFDPHFLR (MOG_HUMAN)
RMFDPHFLK

SEQ ID NO: 116494 - protein, 9 aa, Artificial Sequence
  Description of Artificial Sequence: Synthetic peptide
  Seed: RTFDPHFLR (MOG_HUMAN)
RMFDPHFLR

SEQ ID NO: 116495 - protein, 10 aa, Artificial Sequence
  Description of Artificial Sequence: Synthetic peptide
  Seed: RTFDPHFLRV (MOG_HUMAN)
RMFDPHFLRL

SEQ ID NO: 116496 - protein, 10 aa, Artificial Sequence
  Description of Artificial Sequence: Synthetic peptide
  Seed: RTFDPHFLRV (MOG_HUMAN)
RMFDPHFLRV

SEQ ID NO: 116497 - protein, 9 aa, Artificial Sequence
  Description of Artificial Sequence: Synthetic peptide
  Seed: RTFDPHFLR (MOG_HUMAN)
RTFDPHFLK

SEQ ID NO: 116498 - protein, 9 aa, Artificial Sequence
  Description of Artificial Sequence: Synthetic peptide
  Seed: RTFDPHFLR (MOG_HUMAN)
RVFDPHFLR

SEQ ID NO: 116499 - protein, 10 aa, Artificial Sequence
  Description of Artificial Sequence: Synthetic peptide
  Seed: RVPCWKITLF (MOG_HUMAN)
RYPCWKITLF

SEQ ID NO: 116500 - protein, 9 aa, Artificial Sequence
  Description of Artificial Sequence: Synthetic peptide
  Seed: SLPSCLCSF (MOG_HUMAN)
SMPSCLCSL

SEQ ID NO: 116501 - protein, 9 aa, Artificial Sequence
  Description of Artificial Sequence: Synthetic peptide
  Seed: SYAGQFRVI (MOG_HUMAN)
SRAGQFRVM

SEQ ID NO: 116502 - protein, 9 aa, Artificial Sequence
  Description of Artificial Sequence: Synthetic peptide
  Seed: SSYAGQFRV (MOG_HUMAN)
STYAGQFRV

SEQ ID NO: 116503 - protein, 9 aa, Artificial Sequence
  Description of Artificial Sequence: Synthetic peptide
  Seed: SYAGQFRVI (MOG_HUMAN)
SYAGQFRVF

SEQ ID NO: 116504 - protein, 9 aa, Artificial Sequence
  Description of Artificial Sequence: Synthetic peptide
  Seed: TFDPHFLRV (MOG_HUMAN)
TADPHFLRL

SEQ ID NO: 116505 - protein, 9 aa, Artificial Sequence
  Description of Artificial Sequence: Synthetic peptide
  Seed: TFDPHFLRV (MOG_HUMAN)
TFDPHFLRL

SEQ ID NO: 116506 - protein, 9 aa, Artificial Sequence
  Description of Artificial Sequence: Synthetic peptide
  Seed: TFDPHFLRV (MOG_HUMAN)
TYDPHFLRL

SEQ ID NO: 116507 - protein, 9 aa, Artificial Sequence
  Description of Artificial Sequence: Synthetic peptide
  Seed: VSPGVLVLL (MOG_HUMAN)
VAPGVLVLL

SEQ ID NO: 116508 - protein, 9 aa, Artificial Sequence
  Description of Artificial Sequence: Synthetic peptide
  Seed: WVSPGVLVL (MOG_HUMAN)
WASPGVLVL

SEQ ID NO: 116509 - protein, 9 aa, Artificial Sequence
  Description of Artificial Sequence: Synthetic peptide
  Seed: WVSPGVLVL (MOG_HUMAN)
WASPGVLVM

SEQ ID NO: 116510 - protein, 9 aa, Artificial Sequence
  Description of Artificial Sequence: Synthetic peptide
  Seed: YQEEAAMEL (MOG_HUMAN)
YAEEAAMEL

SEQ ID NO: 116511 - protein, 9 aa, Artificial Sequence
  Description of Artificial Sequence: Synthetic peptide
  Seed: YRPPFSRVV (MOG_HUMAN)
YAPPFSRVL

SEQ ID NO: 116512 - protein, 9 aa, Artificial Sequence
  Description of Artificial Sequence: Synthetic peptide
  Seed: YQEEAAMEL (MOG_HUMAN)
YMEEAAMEL

SEQ ID NO: 116513 - protein, 9 aa, Artificial Sequence
  Description of Artificial Sequence: Synthetic peptide
  Seed: YRPPFSRVV (MOG_HUMAN)
YQPPFSRVL

SEQ ID NO: 116514 - protein, 9 aa, Artificial Sequence
  Description of Artificial Sequence: Synthetic peptide
  Seed: YRPPFSRVV (MOG_HUMAN)
YRPPFSRVI

SEQ ID NO: 116515 - protein, 9 aa, Artificial Sequence
  Description of Artificial Sequence: Synthetic peptide
  Seed: YRPPFSRVV (MOG_HUMAN)
YRPPFSRVM

SEQ ID NO: 116516 - protein, 10 aa, Homo sapiens
  Native (MOG_HUMAN)
AEIENLHRTF

SEQ ID NO: 116517 - protein, 10 aa, Homo sapiens
  Native (MOG_HUMAN)
ATGMEVGWYR

SEQ ID NO: 116518 - protein, 11 aa, Homo sapiens
  Native (MOG_HUMAN)
DAIGEGKVTLR

SEQ ID NO: 116519 - protein, 9 aa, Homo sapiens
  Native (MOG_HUMAN)
EEAAMELKV

SEQ ID NO: 116520 - protein, 9 aa, Homo sapiens
  Native (MOG_HUMAN)
FLLLLLLQV

SEQ ID NO: 116521 - protein, 10 aa, Homo sapiens
  Native (MOG_HUMAN)
FSDEGGFTCF

SEQ ID NO: 116522 - protein, 9 aa, Homo sapiens
  Native (MOG_HUMAN)
FSRVVHLYR

SEQ ID NO: 116523 - protein, 10 aa, Homo sapiens
  Native (MOG_HUMAN)
FTCFFRDHSY

SEQ ID NO: 116524 - protein, 10 aa, Homo sapiens
  Native (MOG_HUMAN)
FVIVPVLGPL

SEQ ID NO: 116525 - protein, 9 aa, Homo sapiens
  Native (MOG_HUMAN)
FYWVSPGVL

SEQ ID NO: 116526 - protein, 9 aa, Homo sapiens
  Native (MOG_HUMAN)
HRTFDPHFL

SEQ ID NO: 116527 - protein, 9 aa, Homo sapiens
  Native (MOG_HUMAN)
HSYQEEAAM

SEQ ID NO: 116528 - protein, 9 aa, Homo sapiens
  Native (MOG_HUMAN)
IFLCLQYRL

SEQ ID NO: 116529 - protein, 9 aa, Homo sapiens
  Native (MOG_HUMAN)
ITLFVIVPV

SEQ ID NO: 116530 - protein, 9 aa, Homo sapiens
  Native (MOG_HUMAN)
LAGQFLEEL

SEQ ID NO: 116531 - protein, 9 aa, Homo sapiens
  Native (MOG_HUMAN)
LAVLPVLLL

SEQ ID NO: 116532 - protein, 9 aa, Homo sapiens
  Native (MOG_HUMAN)
LIFLCLQYR

SEQ ID NO: 116533 - protein, 9 aa, Homo sapiens
  Native (MOG_HUMAN)
LLAVLPVLL

SEQ ID NO: 116534 - protein, 9 aa, Homo sapiens
  Native (MOG_HUMAN)
LLLQITVGL

SEQ ID NO: 116535 - protein, 9 aa, Homo sapiens
  Native (MOG_HUMAN)
LLLQVSSSY

SEQ ID NO: 116536 - protein, 10 aa, Homo sapiens
  Native (MOG_HUMAN)
LPSCLCSFLL

SEQ ID NO: 116537 - protein, 9 aa, Homo sapiens
  Native (MOG_HUMAN)
LQITVGLIF

SEQ ID NO: 116538 - protein, 9 aa, Homo sapiens
  Native (MOG_HUMAN)
MASLSRPSL

SEQ ID NO: 116539 - protein, 9 aa, Homo sapiens
  Native (MOG_HUMAN)
MELKVEDPF

SEQ ID NO: 116540 - protein, 10 aa, Homo sapiens
  Native (MOG_HUMAN)
MEVGWYRPPF

SEQ ID NO: 116541 - protein, 11 aa, Homo sapiens
  Native (MOG_HUMAN)
RFSDEGGFTCF

SEQ ID NO: 116542 - protein, 11 aa, Homo sapiens
  Native (MOG_HUMAN)
RRLAGQFLEEL

SEQ ID NO: 116543 - protein, 9 aa, Homo sapiens
  Native (MOG_HUMAN)
RTFDPHFLR

SEQ ID NO: 116544 - protein, 9 aa, Homo sapiens
  Native (MOG_HUMAN)
RVIGPRHPI

SEQ ID NO: 116545 - protein, 10 aa, Homo sapiens
  Native (MOG_HUMAN)
RVIGPRHPIR

SEQ ID NO: 116546 - protein, 10 aa, Homo sapiens
  Native (MOG_HUMAN)
RVVHLYRNGK

SEQ ID NO: 116547 - protein, 9 aa, Homo sapiens
  Native (MOG_HUMAN)
SRPSLPSCL

SEQ ID NO: 116548 - protein, 9 aa, Homo sapiens
  Native (MOG_HUMAN)
SSYAGQFRV

SEQ ID NO: 116549 - protein, 9 aa, Homo sapiens
  Native (MOG_HUMAN)
SYAGQFRVI

SEQ ID NO: 116550 - protein, 9 aa, Homo sapiens
  Native (MOG_HUMAN)
TFDPHFLRV

SEQ ID NO: 116551 - protein, 9 aa, Homo sapiens
  Native (MOG_HUMAN)
VALIICYNW

SEQ ID NO: 116552 - protein, 11 aa, Homo sapiens
  Native (MOG_HUMAN)
VIGPRHPIRAL

SEQ ID NO: 116553 - protein, 9 aa, Homo sapiens
  Native (MOG_HUMAN)
VLGPLVALI

SEQ ID NO: 116554 - protein, 9 aa, Homo sapiens
  Native (MOG_HUMAN)
VLLAVLPVL

SEQ ID NO: 116555 - protein, 9 aa, Homo sapiens
  Native (MOG_HUMAN)
VPCWKITLF

SEQ ID NO: 116556 - protein, 8 aa, Homo sapiens
  Native (MOG_HUMAN)
VPVLGPLV

SEQ ID NO: 116557 - protein, 10 aa, Homo sapiens
  Native (MOG_HUMAN)
VPVLGPLVAL

SEQ ID NO: 116558 - protein, 9 aa, Homo sapiens
  Native (MOG_HUMAN)
VSPGVLVLL

SEQ ID NO: 116559 - protein, 9 aa, Homo sapiens
  Native (MOG_HUMAN)
VSSSYAGQF

SEQ ID NO: 116560 - protein, 9 aa, Homo sapiens
  Native (MOG_HUMAN)
VVHLYRNGK

SEQ ID NO: 116561 - protein, 9 aa, Homo sapiens
  Native (MOG_HUMAN)
WVSPGVLVL

SEQ ID NO: 116562 - protein, 9 aa, Homo sapiens
  Native (MOG_HUMAN)
YQEEAAMEL

SEQ ID NO: 116563 - protein, 9 aa, Homo sapiens
  Native (MOG_HUMAN)
YRPPFSRVV

SEQ ID NO: 116564 - protein, 9 aa, Artificial Sequence
  Description of Artificial Sequence: Synthetic peptide
  Seed: LIICYNWLH (MOG_HUMAN)
LVICYNWLK

SEQ ID NO: 116565 - protein, 9 aa, Artificial Sequence
  Description of Artificial Sequence: Synthetic peptide
  Seed: KLRAEIENL (MOG_HUMAN)
KTRAEIENS

SEQ ID NO: 116566 - protein, 9 aa, Artificial Sequence
  Description of Artificial Sequence: Synthetic peptide
  Seed: LLLQVSSSY (MOG_HUMAN)
LKLQVSSSF

SEQ ID NO: 116567 - protein, 9 aa, Artificial Sequence
  Description of Artificial Sequence: Synthetic peptide
  Seed: LSRPSLPSC (MOG_HUMAN)
LTRPSLPSG

SEQ ID NO: 116568 - protein, 9 aa, Artificial Sequence
  Description of Artificial Sequence: Synthetic peptide
  Seed: VLGPLVALI (MOG_HUMAN)
VMGPLVALL

SEQ ID NO: 116569 - protein, 9 aa, Artificial Sequence
  Description of Artificial Sequence: Synthetic peptide
  Seed: IGEGKVTLR (MOG_HUMAN)
IAEGKVTLY

SEQ ID NO: 116570 - protein, 9 aa, Artificial Sequence
  Description of Artificial Sequence: Synthetic peptide
  Seed: LLLQVSSSY (MOG_HUMAN)
LALQVSSSW

SEQ ID NO: 116571 - protein, 10 aa, Artificial Sequence
  Description of Artificial Sequence: Synthetic peptide
  Seed: LLLQVSSSYA (MOG_HUMAN)
LMLQVSSSYY

SEQ ID NO: 116572 - protein, 9 aa, Artificial Sequence
  Description of Artificial Sequence: Synthetic peptide
  Seed: LLLQITVGL (MOG_HUMAN)
LLLQITVGF

SEQ ID NO: 116573 - protein, 9 aa, Artificial Sequence
  Description of Artificial Sequence: Synthetic peptide
  Seed: SSYAGQFRV (MOG_HUMAN)
SYYAGQFRF

SEQ ID NO: 116574 - protein, 9 aa, Artificial Sequence
  Description of Artificial Sequence: Synthetic peptide
  Seed: FYWVSPGVL (MOG_HUMAN)
FSWVSPGVV

SEQ ID NO: 116575 - protein, 10 aa, Artificial Sequence
  Description of Artificial Sequence: Synthetic peptide
  Seed: RVPCWKITLF (MOG_HUMAN)
RWPCWKITLW

SEQ ID NO: 116576 - protein, 11 aa, Artificial Sequence
  Description of Artificial Sequence: Synthetic peptide
  Seed: RRLAGQFLEEL (MOG_HUMAN)
RRLAGQFLEEF

SEQ ID NO: 116577 - protein, 10 aa, Artificial Sequence
  Description of Artificial Sequence: Synthetic peptide
  Seed: FDPHFLRVPC (MOG_HUMAN)
FGPHFLRVPL

SEQ ID NO: 116578 - protein, 9 aa, Artificial Sequence
  Description of Artificial Sequence: Synthetic peptide
  Seed: LSRPSLPSC (MOG_HUMAN)
LVRPSLPSF

SEQ ID NO: 116579 - protein, 10 aa, Artificial Sequence
  Description of Artificial Sequence: Synthetic peptide
  Seed: RVIGPRHPIR (MOG_HUMAN)
RSIGPRHPIV

SEQ ID NO: 116580 - protein, 10 aa, Artificial Sequence
  Description of Artificial Sequence: Synthetic peptide
  Seed: RLRGKLRAEI (MOG_HUMAN)
RMRGKLRAEV

SEQ ID NO: 116581 - protein, 10 aa, Artificial Sequence
  Description of Artificial Sequence: Synthetic peptide
  Seed: RTFDPHFLRV (MOG_HUMAN)
RYFDPHFLRV

SEQ ID NO: 116582 - protein, 10 aa, Artificial Sequence
  Description of Artificial Sequence: Synthetic peptide
  Seed: TGMEVGWYRP (MOG_HUMAN)
TMMEVGWYRV

SEQ ID NO: 116583 - protein, 9 aa, Artificial Sequence
  Description of Artificial Sequence: Synthetic peptide
  Seed: LIFLCLQYR (MOG_HUMAN)
LYFLCLQYK

SEQ ID NO: 116584 - protein, 9 aa, Artificial Sequence
  Description of Artificial Sequence: Synthetic peptide
  Seed: FSDEGGFTC (MOG_HUMAN)
FSDEGGFTI

SEQ ID NO: 116585 - protein, 8 aa, Artificial Sequence
  Description of Artificial Sequence: Synthetic peptide
  Seed: LLQVSSSY (MOG_HUMAN)
LQQVSSSY

SEQ ID NO: 116586 - protein, 10 aa, Artificial Sequence
  Description of Artificial Sequence: Synthetic peptide
  Seed: RDHSYQEEAA (MOG_HUMAN)
REHSYQEEAA

SEQ ID NO: 116587 - protein, 9 aa, Artificial Sequence
  Description of Artificial Sequence: Synthetic peptide
  Seed: LQVSSSYAG (MOG_HUMAN)
LSVSSSYAY

SEQ ID NO: 116588 - protein, 9 aa, Artificial Sequence
  Description of Artificial Sequence: Synthetic peptide
  Seed: ALVGDEVEL (MOG_HUMAN)
AVVGDEVEV

SEQ ID NO: 116589 - protein, 9 aa, Artificial Sequence
  Description of Artificial Sequence: Synthetic peptide
  Seed: SLPSCLCSF (MOG_HUMAN)
SYPSCLCSY

SEQ ID NO: 116590 - protein, 11 aa, Artificial Sequence
  Description of Artificial Sequence: Synthetic peptide
  Seed: RDHSYQEEAAM (MOG_HUMAN)
RHHSYQEEAAY

SEQ ID NO: 116591 - protein, 9 aa, Artificial Sequence
  Description of Artificial Sequence: Synthetic peptide
  Seed: QITVGLIFL (MOG_HUMAN)
QLTVGLIFI

SEQ ID NO: 116592 - protein, 9 aa, Artificial Sequence
  Description of Artificial Sequence: Synthetic peptide
  Seed: MASLSRPSL (MOG_HUMAN)
MWSLSRPSF

SEQ ID NO: 116593 - protein, 9 aa, Artificial Sequence
  Description of Artificial Sequence: Synthetic peptide
  Seed: VLPVLLLQI (MOG_HUMAN)
VGPVLLLQL

SEQ ID NO: 116594 - protein, 10 aa, Artificial Sequence
  Description of Artificial Sequence: Synthetic peptide
  Seed: RIRNVRFSDE (MOG_HUMAN)
RMRNVRFSDL

SEQ ID NO: 116595 - protein, 11 aa, Artificial Sequence
  Description of Artificial Sequence: Synthetic peptide
  Seed: YWVSPGVLVLL (MOG_HUMAN)
YYVSPGVLVLL

SEQ ID NO: 116596 - protein, 9 aa, Artificial Sequence
  Description of Artificial Sequence: Synthetic peptide
  Seed: RVPCWKITL (MOG_HUMAN)
RSPCWKITL

SEQ ID NO: 116597 - protein, 9 aa, Artificial Sequence
  Description of Artificial Sequence: Synthetic peptide
  Seed: VSPGVLVLL (MOG_HUMAN)
VRPGVLVLM

SEQ ID NO: 116598 - protein, 9 aa, Artificial Sequence
  Description of Artificial Sequence: Synthetic peptide
  Seed: QITVGLIFL (MOG_HUMAN)
QMTVGLIFI

SEQ ID NO: 116599 - protein, 9 aa, Artificial Sequence
  Description of Artificial Sequence: Synthetic peptide
  Seed: LQITVGLIF (MOG_HUMAN)
LMITVGLIL

SEQ ID NO: 116600 - protein, 11 aa, Artificial Sequence
  Description of Artificial Sequence: Synthetic peptide
  Seed: RTFDPHFLRVP (MOG_HUMAN)
RQFDPHFLRVR

SEQ ID NO: 116601 - protein, 10 aa, Artificial Sequence
  Description of Artificial Sequence: Synthetic peptide
  Seed: FRVIGPRHPI (MOG_HUMAN)
FVVIGPRHPI

SEQ ID NO: 116602 - protein, 9 aa, Artificial Sequence
  Description of Artificial Sequence: Synthetic peptide
  Seed: LIFLCLQYR (MOG_HUMAN)
LAFLCLQYK

SEQ ID NO: 116603 - protein, 9 aa, Artificial Sequence
  Description of Artificial Sequence: Synthetic peptide
  Seed: LQITVGLIF (MOG_HUMAN)
LHITVGLIL

SEQ ID NO: 116604 - protein, 10 aa, Artificial Sequence
  Description of Artificial Sequence: Synthetic peptide
  Seed: ATGMEVGWYR (MOG_HUMAN)
ACGMEVGWYR

SEQ ID NO: 116605 - protein, 9 aa, Artificial Sequence
  Description of Artificial Sequence: Synthetic peptide
  Seed: RIRNVRFSD (MOG_HUMAN)
RVRNVRFSN

SEQ ID NO: 116606 - protein, 9 aa, Artificial Sequence
  Description of Artificial Sequence: Synthetic peptide
  Seed: RIRNVRFSD (MOG_HUMAN)
RQRNVRFSY

SEQ ID NO: 116607 - protein, 9 aa, Artificial Sequence
  Description of Artificial Sequence: Synthetic peptide
  Seed: SSYAGQFRV (MOG_HUMAN)
SMYAGQFRA

SEQ ID NO: 116608 - protein, 9 aa, Artificial Sequence
  Description of Artificial Sequence: Synthetic peptide
  Seed: WVSPGVLVL (MOG_HUMAN)
WESPGVLVY

SEQ ID NO: 116609 - protein, 11 aa, Artificial Sequence
  Description of Artificial Sequence: Synthetic peptide
  Seed: HRTFDPHFLRV (MOG_HUMAN)
HDTFDPHFLRR

SEQ ID NO: 116610 - protein, 9 aa, Artificial Sequence
  Description of Artificial Sequence: Synthetic peptide
  Seed: EYRGRTELL (MOG_HUMAN)
ELRGRTELL

SEQ ID NO: 116611 - protein, 9 aa, Artificial Sequence
  Description of Artificial Sequence: Synthetic peptide
  Seed: VVHLYRNGK (MOG_HUMAN)
VMHLYRNGR

SEQ ID NO: 116612 - protein, 10 aa, Artificial Sequence
  Description of Artificial Sequence: Synthetic peptide
  Seed: YWVSPGVLVL (MOG_HUMAN)
YHVSPGVLVY

SEQ ID NO: 116613 - protein, 9 aa, Artificial Sequence
  Description of Artificial Sequence: Synthetic peptide
  Seed: RVPCWKITL (MOG_HUMAN)
RQPCWKITL

SEQ ID NO: 116614 - protein, 10 aa, Artificial Sequence
  Description of Artificial Sequence: Synthetic peptide
  Seed: FDPHFLRVPC (MOG_HUMAN)
FHPHFLRVPF

SEQ ID NO: 116615 - protein, 10 aa, Artificial Sequence
  Description of Artificial Sequence: Synthetic peptide
  Seed: IGPRHPIRAL (MOG_HUMAN)
IVPRHPIRAV

SEQ ID NO: 116616 - protein, 9 aa, Artificial Sequence
  Description of Artificial Sequence: Synthetic peptide
  Seed: LVLLAVLPV (MOG_HUMAN)
LMLLAVLPL

SEQ ID NO: 116617 - protein, 9 aa, Artificial Sequence
  Description of Artificial Sequence: Synthetic peptide
  Seed: HSYQEEAAM (MOG_HUMAN)
HTYQEEAAM

SEQ ID NO: 116618 - protein, 10 aa, Artificial Sequence
  Description of Artificial Sequence: Synthetic peptide
  Seed: NLHRTFDPHF (MOG_HUMAN)
NQHRTFDPHY

SEQ ID NO: 116619 - protein, 9 aa, Artificial Sequence
  Description of Artificial Sequence: Synthetic peptide
  Seed: RVPCWKITL (MOG_HUMAN)
RQPCWKITV

SEQ ID NO: 116620 - protein, 11 aa, Artificial Sequence
  Description of Artificial Sequence: Synthetic peptide
  Seed: FSDEGGFTCFF (MOG_HUMAN)
FMDEGGFTCFM

SEQ ID NO: 116621 - protein, 10 aa, Artificial Sequence
  Description of Artificial Sequence: Synthetic peptide
  Seed: VLLLQITVGL (MOG_HUMAN)
VDLLQITVGL

SEQ ID NO: 116622 - protein, 8 aa, Artificial Sequence
  Description of Artificial Sequence: Synthetic peptide
  Seed: FSRVVHLY (MOG_HUMAN)
FSRVVHLL

SEQ ID NO: 116623 - protein, 10 aa, Artificial Sequence
  Description of Artificial Sequence: Synthetic peptide
  Seed: SLSRPSLPSC (MOG_HUMAN)
SVSRPSLPSA

SEQ ID NO: 116624 - protein, 11 aa, Artificial Sequence
  Description of Artificial Sequence: Synthetic peptide
  Seed: VLVLLAVLPVL (MOG_HUMAN)
VRVLLAVLPVV

SEQ ID NO: 116625 - protein, 11 aa, Artificial Sequence
  Description of Artificial Sequence: Synthetic peptide
  Seed: NATGMEVGWYR (MOG_HUMAN)
NVTGMEVGWYK

SEQ ID NO: 116626 - protein, 10 aa, Artificial Sequence
  Description of Artificial Sequence: Synthetic peptide
  Seed: YWVSPGVLVL (MOG_HUMAN)
YHVSPGVLVF

SEQ ID NO: 116627 - protein, 9 aa, Artificial Sequence
  Description of Artificial Sequence: Synthetic peptide
  Seed: RVPCWKITL (MOG_HUMAN)
RMPCWKITM

SEQ ID NO: 116628 - protein, 10 aa, Artificial Sequence
  Description of Artificial Sequence: Synthetic peptide
  Seed: FRVIGPRHPI (MOG_HUMAN)
FMVIGPRHPM

SEQ ID NO: 116629 - protein, 9 aa, Artificial Sequence
  Description of Artificial Sequence: Synthetic peptide
  Seed: LIICYNWLH (MOG_HUMAN)
LIICYNWLK

SEQ ID NO: 116630 - protein, 9 aa, Artificial Sequence
  Description of Artificial Sequence: Synthetic peptide
  Seed: RTFDPHFLR (MOG_HUMAN)
RQFDPHFLI

SEQ ID NO: 116631 - protein, 9 aa, Artificial Sequence
  Description of Artificial Sequence: Synthetic peptide
  Seed: HSYQEEAAM (MOG_HUMAN)
HTYQEEAAY

SEQ ID NO: 116632 - protein, 10 aa, Artificial Sequence
  Description of Artificial Sequence: Synthetic peptide
  Seed: RLRGKLRAEI (MOG_HUMAN)
RFRGKLRAEK

SEQ ID NO: 116633 - protein, 10 aa, Artificial Sequence
  Description of Artificial Sequence: Synthetic peptide
  Seed: SSYAGQFRVI (MOG_HUMAN)
SFYAGQFRVL

SEQ ID NO: 116634 - protein, 9 aa, Artificial Sequence
  Description of Artificial Sequence: Synthetic peptide
  Seed: VLGPLVALI (MOG_HUMAN)
VQGPLVALV

SEQ ID NO: 116635 - protein, 9 aa, Artificial Sequence
  Description of Artificial Sequence: Synthetic peptide
  Seed: VLGPLVALI (MOG_HUMAN)
VVGPLVALI

SEQ ID NO: 116636 - protein, 11 aa, Artificial Sequence
  Description of Artificial Sequence: Synthetic peptide
  Seed: FVIVPVLGPLV (MOG_HUMAN)
FMIVPVLGPLV

SEQ ID NO: 116637 - protein, 9 aa, Artificial Sequence
  Description of Artificial Sequence: Synthetic peptide
  Seed: LHRRLAGQF (MOG_HUMAN)
LMRRLAGQY

SEQ ID NO: 116638 - protein, 9 aa, Artificial Sequence
  Description of Artificial Sequence: Synthetic peptide
  Seed: VSSSYAGQF (MOG_HUMAN)
VSSSYAGQW

SEQ ID NO: 116639 - protein, 9 aa, Artificial Sequence
  Description of Artificial Sequence: Synthetic peptide
  Seed: FSRVVHLYR (MOG_HUMAN)
FMRVVHLYK

SEQ ID NO: 116640 - protein, 10 aa, Artificial Sequence
  Description of Artificial Sequence: Synthetic peptide
  Seed: RIRNVRFSDE (MOG_HUMAN)
RFRNVRFSDA

SEQ ID NO: 116641 - protein, 10 aa, Artificial Sequence
  Description of Artificial Sequence: Synthetic peptide
  Seed: VPVLGPLVAL (MOG_HUMAN)
VYVLGPLVAV

SEQ ID NO: 116642 - protein, 9 aa, Artificial Sequence
  Description of Artificial Sequence: Synthetic peptide
  Seed: HFLRVPCWK (MOG_HUMAN)
HYLRVPCWR

SEQ ID NO: 116643 - protein, 10 aa, Artificial Sequence
  Description of Artificial Sequence: Synthetic peptide
  Seed: RIRNVRFSDE (MOG_HUMAN)
RFRNVRFSDM

SEQ ID NO: 116644 - protein, 10 aa, Artificial Sequence
  Description of Artificial Sequence: Synthetic peptide
  Seed: ITLFVIVPVL (MOG_HUMAN)
INLFVIVPVV

SEQ ID NO: 116645 - protein, 9 aa, Artificial Sequence
  Description of Artificial Sequence: Synthetic peptide
  Seed: EGGFTCFFR (MOG_HUMAN)
ELGFTCFFR

SEQ ID NO: 116646 - protein, 9 aa, Artificial Sequence
  Description of Artificial Sequence: Synthetic peptide
  Seed: GPRHPIRAL (MOG_HUMAN)
GARHPIRAL

SEQ ID NO: 116647 - protein, 10 aa, Artificial Sequence
  Description of Artificial Sequence: Synthetic peptide
  Seed: FDPHFLRVPC (MOG_HUMAN)
FLPHFLRVPV

SEQ ID NO: 116648 - protein, 10 aa, Artificial Sequence
  Description of Artificial Sequence: Synthetic peptide
  Seed: FDPHFLRVPC (MOG_HUMAN)
FHPHFLRVPM

SEQ ID NO: 116649 - protein, 9 aa, Artificial Sequence
  Description of Artificial Sequence: Synthetic peptide
  Seed: AEIENLHRT (MOG_HUMAN)
AEIENLHRP

SEQ ID NO: 116650 - protein, 9 aa, Artificial Sequence
  Description of Artificial Sequence: Synthetic peptide
  Seed: SDEGGFTCF (MOG_HUMAN)
SMEGGFTCF

SEQ ID NO: 116651 - protein, 10 aa, Artificial Sequence
  Description of Artificial Sequence: Synthetic peptide
  Seed: FDPHFLRVPC (MOG_HUMAN)
FGPHFLRVPA

SEQ ID NO: 116652 - protein, 9 aa, Artificial Sequence
  Description of Artificial Sequence: Synthetic peptide
  Seed: VIVPVLGPL (MOG_HUMAN)
VIVPVLGPI

SEQ ID NO: 116653 - protein, 10 aa, Artificial Sequence
  Description of Artificial Sequence: Synthetic peptide
  Seed: RTFDPHFLRV (MOG_HUMAN)
RIFDPHFLRW

SEQ ID NO: 116654 - protein, 10 aa, Artificial Sequence
  Description of Artificial Sequence: Synthetic peptide
  Seed: SCLCSFLLLL (MOG_HUMAN)
SYLCSFLLLV

SEQ ID NO: 116655 - protein, 9 aa, Artificial Sequence
  Description of Artificial Sequence: Synthetic peptide
  Seed: TFDPHFLRV (MOG_HUMAN)
TNDPHFLRF

SEQ ID NO: 116656 - protein, 11 aa, Artificial Sequence
  Description of Artificial Sequence: Synthetic peptide
  Seed: ELLKDAIGEGK (MOG_HUMAN)
EVLKDAIGEGR

SEQ ID NO: 116657 - protein, 9 aa, Artificial Sequence
  Description of Artificial Sequence: Synthetic peptide
  Seed: KLRAEIENL (MOG_HUMAN)
KLRAEIENY

SEQ ID NO: 116658 - protein, 10 aa, Artificial Sequence
  Description of Artificial Sequence: Synthetic peptide
  Seed: FVIVPVLGPL (MOG_HUMAN)
FIIVPVLGPY

SEQ ID NO: 116659 - protein, 11 aa, Artificial Sequence
  Description of Artificial Sequence: Synthetic peptide
  Seed: RRLAGQFLEEL (MOG_HUMAN)
RMLAGQFLEEL

SEQ ID NO: 116660 - protein, 8 aa, Artificial Sequence
  Description of Artificial Sequence: Synthetic peptide
  Seed: LLQVSSSY (MOG_HUMAN)
LQQVSSSF

SEQ ID NO: 116661 - protein, 10 aa, Artificial Sequence
  Description of Artificial Sequence: Synthetic peptide
  Seed: RIRNVRFSDE (MOG_HUMAN)
RTRNVRFSDA

SEQ ID NO: 116662 - protein, 11 aa, Artificial Sequence
  Description of Artificial Sequence: Synthetic peptide
  Seed: RISPGKNATGM (MOG_HUMAN)
RPSPGKNATGV

SEQ ID NO: 116663 - protein, 9 aa, Artificial Sequence
  Description of Artificial Sequence: Synthetic peptide
  Seed: CLCSFLLLL (MOG_HUMAN)
CSCSFLLLW

SEQ ID NO: 116664 - protein, 10 aa, Artificial Sequence
  Description of Artificial Sequence: Synthetic peptide
  Seed: FDPHFLRVPC (MOG_HUMAN)
FYPHFLRVPL

SEQ ID NO: 116665 - protein, 10 aa, Artificial Sequence
  Description of Artificial Sequence: Synthetic peptide
  Seed: LLLLQVSSSY (MOG_HUMAN)
LRLLQVSSSF

SEQ ID NO: 116666 - protein, 10 aa, Artificial Sequence
  Description of Artificial Sequence: Synthetic peptide
  Seed: DAIGEGKVTL (MOG_HUMAN)
DIIGEGKVTK

SEQ ID NO: 116667 - protein, 9 aa, Artificial Sequence
  Description of Artificial Sequence: Synthetic peptide
  Seed: LLLQVSSSY (MOG_HUMAN)
LKLQVSSSL

SEQ ID NO: 116668 - protein, 10 aa, Artificial Sequence
  Description of Artificial Sequence: Synthetic peptide
  Seed: RTFDPHFLRV (MOG_HUMAN)
RQFDPHFLRY

SEQ ID NO: 116669 - protein, 9 aa, Artificial Sequence
  Description of Artificial Sequence: Synthetic peptide
  Seed: TFDPHFLRV (MOG_HUMAN)
TGDPHFLRW

SEQ ID NO: 116670 - protein, 10 aa, Artificial Sequence
  Description of Artificial Sequence: Synthetic peptide
  Seed: IGPRHPIRAL (MOG_HUMAN)
IMPRHPIRAL

SEQ ID NO: 116671 - protein, 9 aa, Artificial Sequence
  Description of Artificial Sequence: Synthetic peptide
  Seed: HSYQEEAAM (MOG_HUMAN)
HTYQEEAAF

SEQ ID NO: 116672 - protein, 9 aa, Artificial Sequence
  Description of Artificial Sequence: Synthetic peptide
  Seed: YQEEAAMEL (MOG_HUMAN)
YVEEAAMEY

SEQ ID NO: 116673 - protein, 10 aa, Artificial Sequence
  Description of Artificial Sequence: Synthetic peptide
  Seed: IGPRHPIRAL (MOG_HUMAN)
IRPRHPIRAM

SEQ ID NO: 116674 - protein, 9 aa, Artificial Sequence
  Description of Artificial Sequence: Synthetic peptide
  Seed: MASLSRPSL (MOG_HUMAN)
MQSLSRPSY

SEQ ID NO: 116675 - protein, 10 aa, Artificial Sequence
  Description of Artificial Sequence: Synthetic peptide
  Seed: RRLAGQFLEE (MOG_HUMAN)
RRLAGQFLEV

SEQ ID NO: 116676 - protein, 11 aa, Artificial Sequence
  Description of Artificial Sequence: Synthetic peptide
  Seed: FSDEGGFTCFF (MOG_HUMAN)
FGDEGGFTCFM

SEQ ID NO: 116677 - protein, 9 aa, Artificial Sequence
  Description of Artificial Sequence: Synthetic peptide
  Seed: LAVLPVLLL (MOG_HUMAN)
LLVLPVLLV

SEQ ID NO: 116678 - protein, 10 aa, Artificial Sequence
  Description of Artificial Sequence: Synthetic peptide
  Seed: FVIVPVLGPL (MOG_HUMAN)
FHIVPVLGPV

SEQ ID NO: 116679 - protein, 10 aa, Artificial Sequence
  Description of Artificial Sequence: Synthetic peptide
  Seed: ATGMEVGWYR (MOG_HUMAN)
AVGMEVGWYR

SEQ ID NO: 116680 - protein, 10 aa, Artificial Sequence
  Description of Artificial Sequence: Synthetic peptide
  Seed: RVIGPRHPIR (MOG_HUMAN)
RAIGPRHPIK

SEQ ID NO: 116681 - protein, 9 aa, Artificial Sequence
  Description of Artificial Sequence: Synthetic peptide
  Seed: RIRNVRFSD (MOG_HUMAN)
RMRNVRFSA

SEQ ID NO: 116682 - protein, 10 aa, Artificial Sequence
  Description of Artificial Sequence: Synthetic peptide
  Seed: RTFDPHFLRV (MOG_HUMAN)
RIFDPHFLRL

SEQ ID NO: 116683 - protein, 9 aa, Artificial Sequence
  Description of Artificial Sequence: Synthetic peptide
  Seed: TFDPHFLRV (MOG_HUMAN)
TLDPHFLRM

SEQ ID NO: 116684 - protein, 10 aa, Artificial Sequence
  Description of Artificial Sequence: Synthetic peptide
  Seed: APEYRGRTEL (MOG_HUMAN)
APEYRGRTEM

SEQ ID NO: 116685 - protein, 9 aa, Artificial Sequence
  Description of Artificial Sequence: Synthetic peptide
  Seed: LLLQVSSSY (MOG_HUMAN)
LVLQVSSSW

SEQ ID NO: 116686 - protein, 10 aa, Artificial Sequence
  Description of Artificial Sequence: Synthetic peptide
  Seed: DAIGEGKVTL (MOG_HUMAN)
DSIGEGKVTW

SEQ ID NO: 116687 - protein, 10 aa, Artificial Sequence
  Description of Artificial Sequence: Synthetic peptide
  Seed: TGMEVGWYRP (MOG_HUMAN)
TAMEVGWYRR

SEQ ID NO: 116688 - protein, 9 aa, Artificial Sequence
  Description of Artificial Sequence: Synthetic peptide
  Seed: LQVSSSYAG (MOG_HUMAN)
LMVSSSYAW

SEQ ID NO: 116689 - protein, 10 aa, Artificial Sequence
  Description of Artificial Sequence: Synthetic peptide
  Seed: LLLLQVSSSY (MOG_HUMAN)
LELLQVSSSY

SEQ ID NO: 116690 - protein, 10 aa, Artificial Sequence
  Description of Artificial Sequence: Synthetic peptide
  Seed: RVVHLYRNGK (MOG_HUMAN)
RFVHLYRNGK

SEQ ID NO: 116691 - protein, 10 aa, Artificial Sequence
  Description of Artificial Sequence: Synthetic peptide
  Seed: FRVIGPRHPI (MOG_HUMAN)
FLVIGPRHPA

SEQ ID NO: 116692 - protein, 9 aa, Artificial Sequence
  Description of Artificial Sequence: Synthetic peptide
  Seed: YWVSPGVLV (MOG_HUMAN)
YWVSPGVLW

SEQ ID NO: 116693 - protein, 10 aa, Artificial Sequence
  Description of Artificial Sequence: Synthetic peptide
  Seed: SSYAGQFRVI (MOG_HUMAN)
SYYAGQFRVL

SEQ ID NO: 116694 - protein, 10 aa, Artificial Sequence
  Description of Artificial Sequence: Synthetic peptide
  Seed: RTFDPHFLRV (MOG_HUMAN)
RYFDPHFLRW

SEQ ID NO: 116695 - protein, 9 aa, Artificial Sequence
  Description of Artificial Sequence: Synthetic peptide
  Seed: VLLAVLPVL (MOG_HUMAN)
VVLAVLPVF

SEQ ID NO: 116696 - protein, 10 aa, Artificial Sequence
  Description of Artificial Sequence: Synthetic peptide
  Seed: RTFDPHFLRV (MOG_HUMAN)
RTFDPHFLRT

SEQ ID NO: 116697 - protein, 10 aa, Artificial Sequence
  Description of Artificial Sequence: Synthetic peptide
  Seed: LLLLQVSSSY (MOG_HUMAN)
LKLLQVSSSY

SEQ ID NO: 116698 - protein, 9 aa, Artificial Sequence
  Description of Artificial Sequence: Synthetic peptide
  Seed: YQEEAAMEL (MOG_HUMAN)
YNEEAAMEM

SEQ ID NO: 116699 - protein, 11 aa, Artificial Sequence
  Description of Artificial Sequence: Synthetic peptide
  Seed: RFSDEGGFTCF (MOG_HUMAN)
RVSDEGGFTCW

SEQ ID NO: 116700 - protein, 9 aa, Artificial Sequence
  Description of Artificial Sequence: Synthetic peptide
  Seed: LSRPSLPSC (MOG_HUMAN)
LVRPSLPSG

SEQ ID NO: 116701 - protein, 10 aa, Artificial Sequence
  Description of Artificial Sequence: Synthetic peptide
  Seed: IFLCLQYRLR (MOG_HUMAN)
IQLCLQYRLR

SEQ ID NO: 116702 - protein, 10 aa, Artificial Sequence
  Description of Artificial Sequence: Synthetic peptide
  Seed: RTFDPHFLRV (MOG_HUMAN)
RTFDPHFLRD

SEQ ID NO: 116703 - protein, 10 aa, Artificial Sequence
  Description of Artificial Sequence: Synthetic peptide
  Seed: AGQFRVIGPR (MOG_HUMAN)
AIQFRVIGPR

SEQ ID NO: 116704 - protein, 8 aa, Artificial Sequence
  Description of Artificial Sequence: Synthetic peptide
  Seed: LGPLVALI (MOG_HUMAN)
LPPLVALI

SEQ ID NO: 116705 - protein, 10 aa, Artificial Sequence
  Description of Artificial Sequence: Synthetic peptide
  Seed: LQITVGLIFL (MOG_HUMAN)
LLITVGLIFL

SEQ ID NO: 116706 - protein, 10 aa, Artificial Sequence
  Description of Artificial Sequence: Synthetic peptide
  Seed: RIRNVRFSDE (MOG_HUMAN)
RTRNVRFSDY

SEQ ID NO: 116707 - protein, 11 aa, Artificial Sequence
  Description of Artificial Sequence: Synthetic peptide
  Seed: NATGMEVGWYR (MOG_HUMAN)
NWTGMEVGWYR

SEQ ID NO: 116708 - protein, 11 aa, Artificial Sequence
  Description of Artificial Sequence: Synthetic peptide
  Seed: FSDEGGFTCFF (MOG_HUMAN)
FMDEGGFTCFL

SEQ ID NO: 116709 - protein, 9 aa, Artificial Sequence
  Description of Artificial Sequence: Synthetic peptide
  Seed: RVIGPRHPI (MOG_HUMAN)
RSIGPRHPW

SEQ ID NO: 116710 - protein, 10 aa, Artificial Sequence
  Description of Artificial Sequence: Synthetic peptide
  Seed: LIICYNWLHR (MOG_HUMAN)
LTICYNWLHR

SEQ ID NO: 116711 - protein, 9 aa, Artificial Sequence
  Description of Artificial Sequence: Synthetic peptide
  Seed: AEIENLHRT (MOG_HUMAN)
ADIENLHRV

SEQ ID NO: 116712 - protein, 10 aa, Artificial Sequence
  Description of Artificial Sequence: Synthetic peptide
  Seed: LLQITVGLIF (MOG_HUMAN)
LMQITVGLIM

SEQ ID NO: 116713 - protein, 10 aa, Artificial Sequence
  Description of Artificial Sequence: Synthetic peptide
  Seed: SSYAGQFRVI (MOG_HUMAN)
SAYAGQFRVF

SEQ ID NO: 116714 - protein, 9 aa, Artificial Sequence
  Description of Artificial Sequence: Synthetic peptide
  Seed: SDEGGFTCF (MOG_HUMAN)
SEEGGFTCM

SEQ ID NO: 116715 - protein, 9 aa, Artificial Sequence
  Description of Artificial Sequence: Synthetic peptide
  Seed: FSDEGGFTC (MOG_HUMAN)
FYDEGGFTM

SEQ ID NO: 116716 - protein, 10 aa, Artificial Sequence
  Description of Artificial Sequence: Synthetic peptide
  Seed: AVLPVLLLQI (MOG_HUMAN)
AVLPVLLLQV

SEQ ID NO: 116717 - protein, 9 aa, Artificial Sequence
  Description of Artificial Sequence: Synthetic peptide
  Seed: DQAPEYRGR (MOG_HUMAN)
DVAPEYRGK

SEQ ID NO: 116718 - protein, 9 aa, Artificial Sequence
  Description of Artificial Sequence: Synthetic peptide
  Seed: SLPSCLCSF (MOG_HUMAN)
SGPSCLCSL

SEQ ID NO: 116719 - protein, 9 aa, Artificial Sequence
  Description of Artificial Sequence: Synthetic peptide
  Seed: FLEELRNPF (MOG_HUMAN)
FYEELRNPM

SEQ ID NO: 116720 - protein, 10 aa, Artificial Sequence
  Description of Artificial Sequence: Synthetic peptide
  Seed: RLRGKLRAEI (MOG_HUMAN)
RVRGKLRAEA

SEQ ID NO: 116721 - protein, 9 aa, Artificial Sequence
  Description of Artificial Sequence: Synthetic peptide
  Seed: RRLAGQFLE (MOG_HUMAN)
RRLAGQFLG

SEQ ID NO: 116722 - protein, 10 aa, Artificial Sequence
  Description of Artificial Sequence: Synthetic peptide
  Seed: FSDEGGFTCF (MOG_HUMAN)
FADEGGFTCF

SEQ ID NO: 116723 - protein, 10 aa, Artificial Sequence
  Description of Artificial Sequence: Synthetic peptide
  Seed: RTFDPHFLRV (MOG_HUMAN)
RLFDPHFLRG

SEQ ID NO: 116724 - protein, 11 aa, Artificial Sequence
  Description of Artificial Sequence: Synthetic peptide
  Seed: HRTFDPHFLRV (MOG_HUMAN)
HMTFDPHFLRA

SEQ ID NO: 116725 - protein, 10 aa, Artificial Sequence
  Description of Artificial Sequence: Synthetic peptide
  Seed: KVTLRIRNVR (MOG_HUMAN)
KGTLRIRNVR

SEQ ID NO: 116726 - protein, 11 aa, Artificial Sequence
  Description of Artificial Sequence: Synthetic peptide
  Seed: LHRTFDPHFLR (MOG_HUMAN)
LARTFDPHFLR

SEQ ID NO: 116727 - protein, 9 aa, Artificial Sequence
  Description of Artificial Sequence: Synthetic peptide
  Seed: VSPGVLVLL (MOG_HUMAN)
VRPGVLVLI

SEQ ID NO: 116728 - protein, 9 aa, Artificial Sequence
  Description of Artificial Sequence: Synthetic peptide
  Seed: RIRNVRFSD (MOG_HUMAN)
RSRNVRFSC

SEQ ID NO: 116729 - protein, 11 aa, Artificial Sequence
  Description of Artificial Sequence: Synthetic peptide
  Seed: RDHSYQEEAAM (MOG_HUMAN)
REHSYQEEAAC

SEQ ID NO: 116730 - protein, 9 aa, Artificial Sequence
  Description of Artificial Sequence: Synthetic peptide
  Seed: LLLQVSSSY (MOG_HUMAN)
LPLQVSSSF

SEQ ID NO: 116731 - protein, 9 aa, Artificial Sequence
  Description of Artificial Sequence: Synthetic peptide
  Seed: LLLQVSSSY (MOG_HUMAN)
LQLQVSSSV

SEQ ID NO: 116732 - protein, 10 aa, Artificial Sequence
  Description of Artificial Sequence: Synthetic peptide
  Seed: RTFDPHFLRV (MOG_HUMAN)
RVFDPHFLRH

SEQ ID NO: 116733 - protein, 10 aa, Artificial Sequence
  Description of Artificial Sequence: Synthetic peptide
  Seed: FDPHFLRVPC (MOG_HUMAN)
FMPHFLRVPT

SEQ ID NO: 116734 - protein, 9 aa, Artificial Sequence
  Description of Artificial Sequence: Synthetic peptide
  Seed: VLGPLVALI (MOG_HUMAN)
VVGPLVALV

SEQ ID NO: 116735 - protein, 10 aa, Artificial Sequence
  Description of Artificial Sequence: Synthetic peptide
  Seed: VGDEVELPCR (MOG_HUMAN)
VVDEVELPCY

SEQ ID NO: 116736 - protein, 9 aa, Artificial Sequence
  Description of Artificial Sequence: Synthetic peptide
  Seed: LLLQVSSSY (MOG_HUMAN)
LSLQVSSSW

SEQ ID NO: 116737 - protein, 9 aa, Artificial Sequence
  Description of Artificial Sequence: Synthetic peptide
  Seed: HFLRVPCWK (MOG_HUMAN)
HWLRVPCWR

SEQ ID NO: 116738 - protein, 10 aa, Artificial Sequence
  Description of Artificial Sequence: Synthetic peptide
  Seed: RVPCWKITLF (MOG_HUMAN)
RWPCWKITLM

SEQ ID NO: 116739 - protein, 11 aa, Artificial Sequence
  Description of Artificial Sequence: Synthetic peptide
  Seed: NATGMEVGWYR (MOG_HUMAN)
NETGMEVGWYR

SEQ ID NO: 116740 - protein, 9 aa, Artificial Sequence
  Description of Artificial Sequence: Synthetic peptide
  Seed: SYAGQFRVI (MOG_HUMAN)
SAAGQFRVV

SEQ ID NO: 116741 - protein, 9 aa, Artificial Sequence
  Description of Artificial Sequence: Synthetic peptide
  Seed: YQEEAAMEL (MOG_HUMAN)
YPEEAAMEM

SEQ ID NO: 116742 - protein, 11 aa, Artificial Sequence
  Description of Artificial Sequence: Synthetic peptide
  Seed: FSDEGGFTCFF (MOG_HUMAN)
FSDEGGFTCFI

SEQ ID NO: 116743 - protein, 10 aa, Artificial Sequence
  Description of Artificial Sequence: Synthetic peptide
  Seed: FTCFFRDHSY (MOG_HUMAN)
FACFFRDHSR

SEQ ID NO: 116744 - protein, 9 aa, Artificial Sequence
  Description of Artificial Sequence: Synthetic peptide
  Seed: FSDEGGFTC (MOG_HUMAN)
FVDEGGFTC

SEQ ID NO: 116745 - protein, 9 aa, Artificial Sequence
  Description of Artificial Sequence: Synthetic peptide
  Seed: RIRNVRFSD (MOG_HUMAN)
RVRNVRFSS

SEQ ID NO: 116746 - protein, 9 aa, Artificial Sequence
  Description of Artificial Sequence: Synthetic peptide
  Seed: CLQYRLRGK (MOG_HUMAN)
CMQYRLRGR

SEQ ID NO: 116747 - protein, 9 aa, Artificial Sequence
  Description of Artificial Sequence: Synthetic peptide
  Seed: FSDEGGFTC (MOG_HUMAN)
FNDEGGFTI

SEQ ID NO: 116748 - protein, 8 aa, Artificial Sequence
  Description of Artificial Sequence: Synthetic peptide
  Seed: SSYAGQFR (MOG_HUMAN)
SMYAGQFR

SEQ ID NO: 116749 - protein, 10 aa, Artificial Sequence
  Description of Artificial Sequence: Synthetic peptide
  Seed: VPVLGPLVAL (MOG_HUMAN)
VMVLGPLVAF

SEQ ID NO: 116750 - protein, 8 aa, Artificial Sequence
  Description of Artificial Sequence: Synthetic peptide
  Seed: FSDEGGFT (MOG_HUMAN)
FIDEGGFL

SEQ ID NO: 116751 - protein, 9 aa, Artificial Sequence
  Description of Artificial Sequence: Synthetic peptide
  Seed: FSRVVHLYR (MOG_HUMAN)
FNRVVHLYR

SEQ ID NO: 116752 - protein, 11 aa, Artificial Sequence
  Description of Artificial Sequence: Synthetic peptide
  Seed: RTFDPHFLRVP (MOG_HUMAN)
RIFDPHFLRVR

SEQ ID NO: 116753 - protein, 9 aa, Artificial Sequence
  Description of Artificial Sequence: Synthetic peptide
  Seed: RAEIENLHR (MOG_HUMAN)
RMEIENLHY

SEQ ID NO: 116754 - protein, 9 aa, Artificial Sequence
  Description of Artificial Sequence: Synthetic peptide
  Seed: RVIGPRHPI (MOG_HUMAN)
RTIGPRHPY

SEQ ID NO: 116755 - protein, 10 aa, Artificial Sequence
  Description of Artificial Sequence: Synthetic peptide
  Seed: RALVGDEVEL (MOG_HUMAN)
RLLVGDEVEL

SEQ ID NO: 116756 - protein, 9 aa, Artificial Sequence
  Description of Artificial Sequence: Synthetic peptide
  Seed: YQEEAAMEL (MOG_HUMAN)
YMEEAAMEW

SEQ ID NO: 116757 - protein, 9 aa, Artificial Sequence
  Description of Artificial Sequence: Synthetic peptide
  Seed: YRPPFSRVV (MOG_HUMAN)
YNPPFSRVL

SEQ ID NO: 116758 - protein, 9 aa, Artificial Sequence
  Description of Artificial Sequence: Synthetic peptide
  Seed: CSFLLLLLL (MOG_HUMAN)
CAFLLLLLW

SEQ ID NO: 116759 - protein, 9 aa, Artificial Sequence
  Description of Artificial Sequence: Synthetic peptide
  Seed: LLLQITVGL (MOG_HUMAN)
LVLQITVGI

SEQ ID NO: 116760 - protein, 9 aa, Artificial Sequence
  Description of Artificial Sequence: Synthetic peptide
  Seed: FYWVSPGVL (MOG_HUMAN)
FKWVSPGVY

SEQ ID NO: 116761 - protein, 10 aa, Artificial Sequence
  Description of Artificial Sequence: Synthetic peptide
  Seed: IGPRHPIRAL (MOG_HUMAN)
IPPRHPIRAM

SEQ ID NO: 116762 - protein, 9 aa, Artificial Sequence
  Description of Artificial Sequence: Synthetic peptide
  Seed: RIRNVRFSD (MOG_HUMAN)
RVRNVRFST

SEQ ID NO: 116763 - protein, 10 aa, Artificial Sequence
  Description of Artificial Sequence: Synthetic peptide
  Seed: FDPHFLRVPC (MOG_HUMAN)
FQPHFLRVPA

SEQ ID NO: 116764 - protein, 9 aa, Artificial Sequence
  Description of Artificial Sequence: Synthetic peptide
  Seed: RVIGPRHPI (MOG_HUMAN)
RLIGPRHPV

SEQ ID NO: 116765 - protein, 9 aa, Artificial Sequence
  Description of Artificial Sequence: Synthetic peptide
  Seed: RIRNVRFSD (MOG_HUMAN)
RTRNVRFSE

SEQ ID NO: 116766 - protein, 10 aa, Artificial Sequence
  Description of Artificial Sequence: Synthetic peptide
  Seed: VLLAVLPVLL (MOG_HUMAN)
VILAVLPVLL

SEQ ID NO: 116767 - protein, 10 aa, Artificial Sequence
  Description of Artificial Sequence: Synthetic peptide
  Seed: RTFDPHFLRV (MOG_HUMAN)
RHFDPHFLRY

SEQ ID NO: 116768 - protein, 10 aa, Artificial Sequence
  Description of Artificial Sequence: Synthetic peptide
  Seed: YWVSPGVLVL (MOG_HUMAN)
YRVSPGVLVM

SEQ ID NO: 116769 - protein, 10 aa, Artificial Sequence
  Description of Artificial Sequence: Synthetic peptide
  Seed: MEVGWYRPPF (MOG_HUMAN)
MVVGWYRPPY

SEQ ID NO: 116770 - protein, 9 aa, Artificial Sequence
  Description of Artificial Sequence: Synthetic peptide
  Seed: VGDEVELPC (MOG_HUMAN)
VCDEVELPF

SEQ ID NO: 116771 - protein, 11 aa, Artificial Sequence
  Description of Artificial Sequence: Synthetic peptide
  Seed: RRLAGQFLEEL (MOG_HUMAN)
RRLAGQFLEEK

SEQ ID NO: 116772 - protein, 10 aa, Artificial Sequence
  Description of Artificial Sequence: Synthetic peptide
  Seed: TGMEVGWYRP (MOG_HUMAN)
TYMEVGWYRR

SEQ ID NO: 116773 - protein, 9 aa, Artificial Sequence
  Description of Artificial Sequence: Synthetic peptide
  Seed: KLRAEIENL (MOG_HUMAN)
KMRAEIENV

SEQ ID NO: 116774 - protein, 9 aa, Artificial Sequence
  Description of Artificial Sequence: Synthetic peptide
  Seed: FLEELRNPF (MOG_HUMAN)
FMEELRNPA

SEQ ID NO: 116775 - protein, 10 aa, Artificial Sequence
  Description of Artificial Sequence: Synthetic peptide
  Seed: PPFSRVVHLY (MOG_HUMAN)
PYFSRVVHLY

SEQ ID NO: 116776 - protein, 9 aa, Artificial Sequence
  Description of Artificial Sequence: Synthetic peptide
  Seed: SCLCSFLLL (MOG_HUMAN)
SILCSFLLV

SEQ ID NO: 116777 - protein, 9 aa, Artificial Sequence
  Description of Artificial Sequence: Synthetic peptide
  Seed: SYAGQFRVI (MOG_HUMAN)
SYAGQFRVV

SEQ ID NO: 116778 - protein, 10 aa, Artificial Sequence
  Description of Artificial Sequence: Synthetic peptide
  Seed: ITLFVIVPVL (MOG_HUMAN)
IDLFVIVPVV

SEQ ID NO: 116779 - protein, 9 aa, Artificial Sequence
  Description of Artificial Sequence: Synthetic peptide
  Seed: SSYAGQFRV (MOG_HUMAN)
SAYAGQFRF

SEQ ID NO: 116780 - protein, 9 aa, Artificial Sequence
  Description of Artificial Sequence: Synthetic peptide
  Seed: ALVGDEVEL (MOG_HUMAN)
ALVGDEVEW

SEQ ID NO: 116781 - protein, 9 aa, Artificial Sequence
  Description of Artificial Sequence: Synthetic peptide
  Seed: AIGEGKVTL (MOG_HUMAN)
AYGEGKVTY

SEQ ID NO: 116782 - protein, 9 aa, Artificial Sequence
  Description of Artificial Sequence: Synthetic peptide
  Seed: LCSFLLLLL (MOG_HUMAN)
LQSFLLLLV

SEQ ID NO: 116783 - protein, 9 aa, Artificial Sequence
  Description of Artificial Sequence: Synthetic peptide
  Seed: RIRNVRFSD (MOG_HUMAN)
RGRNVRFSL

SEQ ID NO: 116784 - protein, 9 aa, Artificial Sequence
  Description of Artificial Sequence: Synthetic peptide
  Seed: LSRPSLPSC (MOG_HUMAN)
LPRPSLPSL

SEQ ID NO: 116785 - protein, 11 aa, Artificial Sequence
  Description of Artificial Sequence: Synthetic peptide
  Seed: RTFDPHFLRVP (MOG_HUMAN)
RMFDPHFLRVA

SEQ ID NO: 116786 - protein, 11 aa, Artificial Sequence
  Description of Artificial Sequence: Synthetic peptide
  Seed: VIGPRHPIRAL (MOG_HUMAN)
VLGPRHPIRAM

SEQ ID NO: 116787 - protein, 10 aa, Artificial Sequence
  Description of Artificial Sequence: Synthetic peptide
  Seed: YWVSPGVLVL (MOG_HUMAN)
YFVSPGVLVL

SEQ ID NO: 116788 - protein, 11 aa, Artificial Sequence
  Description of Artificial Sequence: Synthetic peptide
  Seed: LVLLAVLPVLL (MOG_HUMAN)
LYLLAVLPVLV

SEQ ID NO: 116789 - protein, 10 aa, Artificial Sequence
  Description of Artificial Sequence: Synthetic peptide
  Seed: CLCSFLLLLL (MOG_HUMAN)
CVCSFLLLLV

SEQ ID NO: 116790 - protein, 10 aa, Artificial Sequence
  Description of Artificial Sequence: Synthetic peptide
  Seed: RLRGKLRAEI (MOG_HUMAN)
RSRGKLRAEA

SEQ ID NO: 116791 - protein, 9 aa, Artificial Sequence
  Description of Artificial Sequence: Synthetic peptide
  Seed: ICYNWLHRR (MOG_HUMAN)
IGYNWLHRK

SEQ ID NO: 116792 - protein, 10 aa, Artificial Sequence
  Description of Artificial Sequence: Synthetic peptide
  Seed: RTFDPHFLRV (MOG_HUMAN)
RSFDPHFLRQ

SEQ ID NO: 116793 - protein, 10 aa, Artificial Sequence
  Description of Artificial Sequence: Synthetic peptide
  Seed: LLLLQVSSSY (MOG_HUMAN)
LTLLQVSSSY

SEQ ID NO: 116794 - protein, 10 aa, Artificial Sequence
  Description of Artificial Sequence: Synthetic peptide
  Seed: VLLLQITVGL (MOG_HUMAN)
VMLLQITVGL

SEQ ID NO: 116795 - protein, 9 aa, Artificial Sequence
  Description of Artificial Sequence: Synthetic peptide
  Seed: FLLLLLLQV (MOG_HUMAN)
FMLLLLLQV

SEQ ID NO: 116796 - protein, 9 aa, Artificial Sequence
  Description of Artificial Sequence: Synthetic peptide
  Seed: MASLSRPSL (MOG_HUMAN)
MQSLSRPSW

SEQ ID NO: 116797 - protein, 9 aa, Artificial Sequence
  Description of Artificial Sequence: Synthetic peptide
  Seed: ITVGLIFLC (MOG_HUMAN)
IVVGLIFLW

SEQ ID NO: 116798 - protein, 10 aa, Artificial Sequence
  Description of Artificial Sequence: Synthetic peptide
  Seed: RTFDPHFLRV (MOG_HUMAN)
RVFDPHFLRK

SEQ ID NO: 116799 - protein, 9 aa, Artificial Sequence
  Description of Artificial Sequence: Synthetic peptide
  Seed: MASLSRPSL (MOG_HUMAN)
MESLSRPSM

SEQ ID NO: 116800 - protein, 10 aa, Artificial Sequence
  Description of Artificial Sequence: Synthetic peptide
  Seed: RTFDPHFLRV (MOG_HUMAN)
RFFDPHFLRQ

SEQ ID NO: 116801 - protein, 9 aa, Artificial Sequence
  Description of Artificial Sequence: Synthetic peptide
  Seed: IGEGKVTLR (MOG_HUMAN)
IAEGKVTLL

SEQ ID NO: 116802 - protein, 9 aa, Artificial Sequence
  Description of Artificial Sequence: Synthetic peptide
  Seed: YQEEAAMEL (MOG_HUMAN)
YYEEAAMEY

SEQ ID NO: 116803 - protein, 9 aa, Artificial Sequence
  Description of Artificial Sequence: Synthetic peptide
  Seed: RTFDPHFLR (MOG_HUMAN)
RAFDPHFLR

SEQ ID NO: 116804 - protein, 9 aa, Artificial Sequence
  Description of Artificial Sequence: Synthetic peptide
  Seed: RIRNVRFSD (MOG_HUMAN)
RVRNVRFSA

SEQ ID NO: 116805 - protein, 10 aa, Artificial Sequence
  Description of Artificial Sequence: Synthetic peptide
  Seed: KVTLRIRNVR (MOG_HUMAN)
KNTLRIRNVR

SEQ ID NO: 116806 - protein, 10 aa, Artificial Sequence
  Description of Artificial Sequence: Synthetic peptide
  Seed: TGMEVGWYRP (MOG_HUMAN)
TWMEVGWYRK

SEQ ID NO: 116807 - protein, 10 aa, Artificial Sequence
  Description of Artificial Sequence: Synthetic peptide
  Seed: RIRNVRFSDE (MOG_HUMAN)
RSRNVRFSDT

SEQ ID NO: 116808 - protein, 10 aa, Artificial Sequence
  Description of Artificial Sequence: Synthetic peptide
  Seed: HRTFDPHFLR (MOG_HUMAN)
HYTFDPHFLY

SEQ ID NO: 116809 - protein, 10 aa, Artificial Sequence
  Description of Artificial Sequence: Synthetic peptide
  Seed: RTFDPHFLRV (MOG_HUMAN)
RYFDPHFLRQ

SEQ ID NO: 116810 - protein, 9 aa, Artificial Sequence
  Description of Artificial Sequence: Synthetic peptide
  Seed: FLEELRNPF (MOG_HUMAN)
FPEELRNPI

SEQ ID NO: 116811 - protein, 9 aa, Artificial Sequence
  Description of Artificial Sequence: Synthetic peptide
  Seed: VIVPVLGPL (MOG_HUMAN)
VQVPVLGPL

SEQ ID NO: 116812 - protein, 9 aa, Artificial Sequence
  Description of Artificial Sequence: Synthetic peptide
  Seed: LLLQVSSSY (MOG_HUMAN)
LLLQVSSSM

SEQ ID NO: 116813 - protein, 9 aa, Artificial Sequence
  Description of Artificial Sequence: Synthetic peptide
  Seed: LIICYNWLH (MOG_HUMAN)
LTICYNWLK

SEQ ID NO: 116814 - protein, 10 aa, Artificial Sequence
  Description of Artificial Sequence: Synthetic peptide
  Seed: RRLAGQFLEE (MOG_HUMAN)
RRLAGQFLEK

SEQ ID NO: 116815 - protein, 11 aa, Artificial Sequence
  Description of Artificial Sequence: Synthetic peptide
  Seed: SSSYAGQFRVI (MOG_HUMAN)
SHSYAGQFRVF

SEQ ID NO: 116816 - protein, 10 aa, Artificial Sequence
  Description of Artificial Sequence: Synthetic peptide
  Seed: DAIGEGKVTL (MOG_HUMAN)
DLIGEGKVTW

SEQ ID NO: 116817 - protein, 11 aa, Artificial Sequence
  Description of Artificial Sequence: Synthetic peptide
  Seed: HSYQEEAAMEL (MOG_HUMAN)
HMYQEEAAMEL

SEQ ID NO: 116818 - protein, 9 aa, Artificial Sequence
  Description of Artificial Sequence: Synthetic peptide
  Seed: SYAGQFRVI (MOG_HUMAN)
SQAGQFRVL

SEQ ID NO: 116819 - protein, 11 aa, Artificial Sequence
  Description of Artificial Sequence: Synthetic peptide
  Seed: HSYQEEAAMEL (MOG_HUMAN)
HAYQEEAAMEH

SEQ ID NO: 116820 - protein, 10 aa, Artificial Sequence
  Description of Artificial Sequence: Synthetic peptide
  Seed: FVIVPVLGPL (MOG_HUMAN)
FPIVPVLGPV

SEQ ID NO: 116821 - protein, 9 aa, Artificial Sequence
  Description of Artificial Sequence: Synthetic peptide
  Seed: FSRVVHLYR (MOG_HUMAN)
FLRVVHLYR

SEQ ID NO: 116822 - protein, 9 aa, Artificial Sequence
  Description of Artificial Sequence: Synthetic peptide
  Seed: YRPPFSRVV (MOG_HUMAN)
YLPPFSRVF

SEQ ID NO: 116823 - protein, 9 aa, Artificial Sequence
  Description of Artificial Sequence: Synthetic peptide
  Seed: VGDEVELPC (MOG_HUMAN)
VWDEVELPM

SEQ ID NO: 116824 - protein, 9 aa, Artificial Sequence
  Description of Artificial Sequence: Synthetic peptide
  Seed: FLEELRNPF (MOG_HUMAN)
FYEELRNPY

SEQ ID NO: 116825 - protein, 11 aa, Artificial Sequence
  Description of Artificial Sequence: Synthetic peptide
  Seed: RLAGQFLEELR (MOG_HUMAN)
RFAGQFLEELR

SEQ ID NO: 116826 - protein, 9 aa, Artificial Sequence
  Description of Artificial Sequence: Synthetic peptide
  Seed: YRLRGKLRA (MOG_HUMAN)
YRLRGKLRK

SEQ ID NO: 116827 - protein, 9 aa, Artificial Sequence
  Description of Artificial Sequence: Synthetic peptide
  Seed: RRLAGQFLE (MOG_HUMAN)
RRLAGQFLM

SEQ ID NO: 116828 - protein, 9 aa, Artificial Sequence
  Description of Artificial Sequence: Synthetic peptide
  Seed: AEIENLHRT (MOG_HUMAN)
ADIENLHRW

SEQ ID NO: 116829 - protein, 9 aa, Artificial Sequence
  Description of Artificial Sequence: Synthetic peptide
  Seed: LSRPSLPSC (MOG_HUMAN)
LMRPSLPSY

SEQ ID NO: 116830 - protein, 11 aa, Artificial Sequence
  Description of Artificial Sequence: Synthetic peptide
  Seed: LHRTFDPHFLR (MOG_HUMAN)
LVRTFDPHFLR

SEQ ID NO: 116831 - protein, 10 aa, Artificial Sequence
  Description of Artificial Sequence: Synthetic peptide
  Seed: RIRNVRFSDE (MOG_HUMAN)
RMRNVRFSDA

SEQ ID NO: 116832 - protein, 9 aa, Artificial Sequence
  Description of Artificial Sequence: Synthetic peptide
  Seed: IRALVGDEV (MOG_HUMAN)
IHALVGDEI

SEQ ID NO: 116833 - protein, 10 aa, Artificial Sequence
  Description of Artificial Sequence: Synthetic peptide
  Seed: FSDEGGFTCF (MOG_HUMAN)
FSDEGGFTCL

SEQ ID NO: 116834 - protein, 9 aa, Artificial Sequence
  Description of Artificial Sequence: Synthetic peptide
  Seed: GQFRVIGPR (MOG_HUMAN)
GAFRVIGPR

SEQ ID NO: 116835 - protein, 10 aa, Artificial Sequence
  Description of Artificial Sequence: Synthetic peptide
  Seed: LLQITVGLIF (MOG_HUMAN)
LCQITVGLIM

SEQ ID NO: 116836 - protein, 11 aa, Artificial Sequence
  Description of Artificial Sequence: Synthetic peptide
  Seed: LHRTFDPHFLR (MOG_HUMAN)
LRRTFDPHFLK

SEQ ID NO: 116837 - protein, 9 aa, Artificial Sequence
  Description of Artificial Sequence: Synthetic peptide
  Seed: SSYAGQFRV (MOG_HUMAN)
SMYAGQFRW

SEQ ID NO: 116838 - protein, 9 aa, Artificial Sequence
  Description of Artificial Sequence: Synthetic peptide
  Seed: KVEDPFYWV (MOG_HUMAN)
KMEDPFYWC

SEQ ID NO: 116839 - protein, 10 aa, Artificial Sequence
  Description of Artificial Sequence: Synthetic peptide
  Seed: FDPHFLRVPC (MOG_HUMAN)
FRPHFLRVPM

SEQ ID NO: 116840 - protein, 10 aa, Artificial Sequence
  Description of Artificial Sequence: Synthetic peptide
  Seed: LLLQVSSSYA (MOG_HUMAN)
LQLQVSSSYL

SEQ ID NO: 116841 - protein, 9 aa, Artificial Sequence
  Description of Artificial Sequence: Synthetic peptide
  Seed: TCFFRDHSY (MOG_HUMAN)
TAFFRDHSI

SEQ ID NO: 116842 - protein, 9 aa, Artificial Sequence
  Description of Artificial Sequence: Synthetic peptide
  Seed: VVHLYRNGK (MOG_HUMAN)
VVHLYRNGR

SEQ ID NO: 116843 - protein, 9 aa, Artificial Sequence
  Description of Artificial Sequence: Synthetic peptide
  Seed: SSYAGQFRV (MOG_HUMAN)
SSYAGQFRR

SEQ ID NO: 116844 - protein, 10 aa, Artificial Sequence
  Description of Artificial Sequence: Synthetic peptide
  Seed: RTFDPHFLRV (MOG_HUMAN)
RIFDPHFLRV

SEQ ID NO: 116845 - protein, 10 aa, Artificial Sequence
  Description of Artificial Sequence: Synthetic peptide
  Seed: FDPHFLRVPC (MOG_HUMAN)
FSPHFLRVPV

SEQ ID NO: 116846 - protein, 9 aa, Artificial Sequence
  Description of Artificial Sequence: Synthetic peptide
  Seed: ICYNWLHRR (MOG_HUMAN)
IIYNWLHRY

SEQ ID NO: 116847 - protein, 10 aa, Artificial Sequence
  Description of Artificial Sequence: Synthetic peptide
  Seed: TGMEVGWYRP (MOG_HUMAN)
TVMEVGWYRI

SEQ ID NO: 116848 - protein, 9 aa, Artificial Sequence
  Description of Artificial Sequence: Synthetic peptide
  Seed: FSDEGGFTC (MOG_HUMAN)
FMDEGGFTC

SEQ ID NO: 116849 - protein, 9 aa, Artificial Sequence
  Description of Artificial Sequence: Synthetic peptide
  Seed: CLCSFLLLL (MOG_HUMAN)
CMCSFLLLY

SEQ ID NO: 116850 - protein, 9 aa, Artificial Sequence
  Description of Artificial Sequence: Synthetic peptide
  Seed: SLPSCLCSF (MOG_HUMAN)
SSPSCLCSL

SEQ ID NO: 116851 - protein, 10 aa, Artificial Sequence
  Description of Artificial Sequence: Synthetic peptide
  Seed: FDPHFLRVPC (MOG_HUMAN)
FQPHFLRVPF

SEQ ID NO: 116852 - protein, 10 aa, Artificial Sequence
  Description of Artificial Sequence: Synthetic peptide
  Seed: FDPHFLRVPC (MOG_HUMAN)
FAPHFLRVPT

SEQ ID NO: 116853 - protein, 9 aa, Artificial Sequence
  Description of Artificial Sequence: Synthetic peptide
  Seed: RPSLPSCLC (MOG_HUMAN)
RPSLPSCLV

SEQ ID NO: 116854 - protein, 10 aa, Artificial Sequence
  Description of Artificial Sequence: Synthetic peptide
  Seed: HRTFDPHFLR (MOG_HUMAN)
HQTFDPHFLY

SEQ ID NO: 116855 - protein, 9 aa, Artificial Sequence
  Description of Artificial Sequence: Synthetic peptide
  Seed: HFLRVPCWK (MOG_HUMAN)
HMLRVPCWR

SEQ ID NO: 116856 - protein, 10 aa, Artificial Sequence
  Description of Artificial Sequence: Synthetic peptide
  Seed: VLLLQITVGL (MOG_HUMAN)
VRLLQITVGI

SEQ ID NO: 116857 - protein, 9 aa, Artificial Sequence
  Description of Artificial Sequence: Synthetic peptide
  Seed: RVIGPRHPI (MOG_HUMAN)
RTIGPRHPL

SEQ ID NO: 116858 - protein, 10 aa, Artificial Sequence
  Description of Artificial Sequence: Synthetic peptide
  Seed: RTFDPHFLRV (MOG_HUMAN)
RMFDPHFLRD

SEQ ID NO: 116859 - protein, 9 aa, Artificial Sequence
  Description of Artificial Sequence: Synthetic peptide
  Seed: GPRHPIRAL (MOG_HUMAN)
GPRHPIRAM

SEQ ID NO: 116860 - protein, 11 aa, Artificial Sequence
  Description of Artificial Sequence: Synthetic peptide
  Seed: FSDEGGFTCFF (MOG_HUMAN)
FLDEGGFTCFL

SEQ ID NO: 116861 - protein, 9 aa, Artificial Sequence
  Description of Artificial Sequence: Synthetic peptide
  Seed: LQVSSSYAG (MOG_HUMAN)
LQVSSSYAL

SEQ ID NO: 116862 - protein, 9 aa, Artificial Sequence
  Description of Artificial Sequence: Synthetic peptide
  Seed: LPSCLCSFL (MOG_HUMAN)
LPSCLCSFW

SEQ ID NO: 116863 - protein, 10 aa, Artificial Sequence
  Description of Artificial Sequence: Synthetic peptide
  Seed: ATGMEVGWYR (MOG_HUMAN)
ACGMEVGWYK

SEQ ID NO: 116864 - protein, 9 aa, Artificial Sequence
  Description of Artificial Sequence: Synthetic peptide
  Seed: YRPPFSRVV (MOG_HUMAN)
YNPPFSRVV

SEQ ID NO: 116865 - protein, 10 aa, Artificial Sequence
  Description of Artificial Sequence: Synthetic peptide
  Seed: DEGGFTCFFR (MOG_HUMAN)
DFGGFTCFFK

SEQ ID NO: 116866 - protein, 9 aa, Artificial Sequence
  Description of Artificial Sequence: Synthetic peptide
  Seed: YRPPFSRVV (MOG_HUMAN)
YYPPFSRVW

SEQ ID NO: 116867 - protein, 9 aa, Artificial Sequence
  Description of Artificial Sequence: Synthetic peptide
  Seed: VSPGVLVLL (MOG_HUMAN)
VAPGVLVLM

SEQ ID NO: 116868 - protein, 9 aa, Artificial Sequence
  Description of Artificial Sequence: Synthetic peptide
  Seed: LAGQFLEEL (MOG_HUMAN)
LLGQFLEEV

SEQ ID NO: 116869 - protein, 9 aa, Artificial Sequence
  Description of Artificial Sequence: Synthetic peptide
  Seed: ALVGDEVEL (MOG_HUMAN)
AIVGDEVEL

SEQ ID NO: 116870 - protein, 10 aa, Artificial Sequence
  Description of Artificial Sequence: Synthetic peptide
  Seed: LLQITVGLIF (MOG_HUMAN)
LTQITVGLIM

SEQ ID NO: 116871 - protein, 11 aa, Artificial Sequence
  Description of Artificial Sequence: Synthetic peptide
  Seed: RFSDEGGFTCF (MOG_HUMAN)
RYSDEGGFTCF

SEQ ID NO: 116872 - protein, 9 aa, Artificial Sequence
  Description of Artificial Sequence: Synthetic peptide
  Seed: KLRAEIENL (MOG_HUMAN)
KARAEIENY

SEQ ID NO: 116873 - protein, 9 aa, Artificial Sequence
  Description of Artificial Sequence: Synthetic peptide
  Seed: LQITVGLIF (MOG_HUMAN)
LHITVGLII

SEQ ID NO: 116874 - protein, 9 aa, Artificial Sequence
  Description of Artificial Sequence: Synthetic peptide
  Seed: SRPSLPSCL (MOG_HUMAN)
SVPSLPSCI

SEQ ID NO: 116875 - protein, 11 aa, Artificial Sequence
  Description of Artificial Sequence: Synthetic peptide
  Seed: VIGPRHPIRAL (MOG_HUMAN)
VQGPRHPIRAL

SEQ ID NO: 116876 - protein, 9 aa, Artificial Sequence
  Description of Artificial Sequence: Synthetic peptide
  Seed: VLPVLLLQI (MOG_HUMAN)
VYPVLLLQL

SEQ ID NO: 116877 - protein, 9 aa, Artificial Sequence
  Description of Artificial Sequence: Synthetic peptide
  Seed: WVSPGVLVL (MOG_HUMAN)
WMSPGVLVM

SEQ ID NO: 116878 - protein, 9 aa, Artificial Sequence
  Description of Artificial Sequence: Synthetic peptide
  Seed: RTFDPHFLR (MOG_HUMAN)
RAFDPHFLM

SEQ ID NO: 116879 - protein, 10 aa, Artificial Sequence
  Description of Artificial Sequence: Synthetic peptide
  Seed: FDPHFLRVPC (MOG_HUMAN)
FNPHFLRVPP

SEQ ID NO: 116880 - protein, 11 aa, Artificial Sequence
  Description of Artificial Sequence: Synthetic peptide
  Seed: SDEGGFTCFFR (MOG_HUMAN)
SFEGGFTCFFR

SEQ ID NO: 116881 - protein, 10 aa, Artificial Sequence
  Description of Artificial Sequence: Synthetic peptide
  Seed: YWVSPGVLVL (MOG_HUMAN)
YFVSPGVLVM

SEQ ID NO: 116882 - protein, 9 aa, Artificial Sequence
  Description of Artificial Sequence: Synthetic peptide
  Seed: YRPPFSRVV (MOG_HUMAN)
YLPPFSRVI

SEQ ID NO: 116883 - protein, 10 aa, Artificial Sequence
  Description of Artificial Sequence: Synthetic peptide
  Seed: FSDEGGFTCF (MOG_HUMAN)
FNDEGGFTCF

SEQ ID NO: 116884 - protein, 9 aa, Artificial Sequence
  Description of Artificial Sequence: Synthetic peptide
  Seed: IICYNWLHR (MOG_HUMAN)
IMCYNWLHK

SEQ ID NO: 116885 - protein, 9 aa, Artificial Sequence
  Description of Artificial Sequence: Synthetic peptide
  Seed: WVSPGVLVL (MOG_HUMAN)
WTSPGVLVW

SEQ ID NO: 116886 - protein, 9 aa, Artificial Sequence
  Description of Artificial Sequence: Synthetic peptide
  Seed: KVEDPFYWV (MOG_HUMAN)
KIEDPFYWV

SEQ ID NO: 116887 - protein, 9 aa, Artificial Sequence
  Description of Artificial Sequence: Synthetic peptide
  Seed: LPSCLCSFL (MOG_HUMAN)
LASCLCSFY

SEQ ID NO: 116888 - protein, 9 aa, Artificial Sequence
  Description of Artificial Sequence: Synthetic peptide
  Seed: LQVSSSYAG (MOG_HUMAN)
LKVSSSYAW

SEQ ID NO: 116889 - protein, 10 aa, Artificial Sequence
  Description of Artificial Sequence: Synthetic peptide
  Seed: IGPRHPIRAL (MOG_HUMAN)
IYPRHPIRAI

SEQ ID NO: 116890 - protein, 9 aa, Artificial Sequence
  Description of Artificial Sequence: Synthetic peptide
  Seed: VLGPLVALI (MOG_HUMAN)
VTGPLVALM

SEQ ID NO: 116891 - protein, 10 aa, Artificial Sequence
  Description of Artificial Sequence: Synthetic peptide
  Seed: LVLLAVLPVL (MOG_HUMAN)
LGLLAVLPVL

SEQ ID NO: 116892 - protein, 10 aa, Artificial Sequence
  Description of Artificial Sequence: Synthetic peptide
  Seed: RRLAGQFLEE (MOG_HUMAN)
RRLAGQFLEM

SEQ ID NO: 116893 - protein, 10 aa, Artificial Sequence
  Description of Artificial Sequence: Synthetic peptide
  Seed: FSDEGGFTCF (MOG_HUMAN)
FLDEGGFTCV

SEQ ID NO: 116894 - protein, 10 aa, Artificial Sequence
  Description of Artificial Sequence: Synthetic peptide
  Seed: WYRPPFSRVV (MOG_HUMAN)
WFRPPFSRVM

SEQ ID NO: 116895 - protein, 10 aa, Artificial Sequence
  Description of Artificial Sequence: Synthetic peptide
  Seed: EYRGRTELLK (MOG_HUMAN)
EVRGRTELLR

SEQ ID NO: 116896 - protein, 10 aa, Artificial Sequence
  Description of Artificial Sequence: Synthetic peptide
  Seed: RVIGPRHPIR (MOG_HUMAN)
RFIGPRHPIR

SEQ ID NO: 116897 - protein, 9 aa, Artificial Sequence
  Description of Artificial Sequence: Synthetic peptide
  Seed: VSPGVLVLL (MOG_HUMAN)
VYPGVLVLY

SEQ ID NO: 116898 - protein, 9 aa, Artificial Sequence
  Description of Artificial Sequence: Synthetic peptide
  Seed: FSDEGGFTC (MOG_HUMAN)
FADEGGFTV

SEQ ID NO: 116899 - protein, 11 aa, Artificial Sequence
  Description of Artificial Sequence: Synthetic peptide
  Seed: NATGMEVGWYR (MOG_HUMAN)
NMTGMEVGWYK

SEQ ID NO: 116900 - protein, 10 aa, Artificial Sequence
  Description of Artificial Sequence: Synthetic peptide
  Seed: LLLLQVSSSY (MOG_HUMAN)
LALLQVSSSF

SEQ ID NO: 116901 - protein, 10 aa, Artificial Sequence
  Description of Artificial Sequence: Synthetic peptide
  Seed: FLLLLLLQVS (MOG_HUMAN)
FELLLLLQVV

SEQ ID NO: 116902 - protein, 10 aa, Artificial Sequence
  Description of Artificial Sequence: Synthetic peptide
  Seed: FSDEGGFTCF (MOG_HUMAN)
FLDEGGFTCL

SEQ ID NO: 116903 - protein, 9 aa, Artificial Sequence
  Description of Artificial Sequence: Synthetic peptide
  Seed: RIRNVRFSD (MOG_HUMAN)
RARNVRFSA

SEQ ID NO: 116904 - protein, 9 aa, Artificial Sequence
  Description of Artificial Sequence: Synthetic peptide
  Seed: VGDEVELPC (MOG_HUMAN)
VMDEVELPV

SEQ ID NO: 116905 - protein, 11 aa, Artificial Sequence
  Description of Artificial Sequence: Synthetic peptide
  Seed: RFSDEGGFTCF (MOG_HUMAN)
RLSDEGGFTCW

SEQ ID NO: 116906 - protein, 9 aa, Artificial Sequence
  Description of Artificial Sequence: Synthetic peptide
  Seed: AIGEGKVTL (MOG_HUMAN)
AQGEGKVTW

SEQ ID NO: 116907 - protein, 10 aa, Artificial Sequence
  Description of Artificial Sequence: Synthetic peptide
  Seed: FSDEGGFTCF (MOG_HUMAN)
FSDEGGFTCM

SEQ ID NO: 116908 - protein, 9 aa, Artificial Sequence
  Description of Artificial Sequence: Synthetic peptide
  Seed: HFLRVPCWK (MOG_HUMAN)
HNLRVPCWR

SEQ ID NO: 116909 - protein, 10 aa, Artificial Sequence
  Description of Artificial Sequence: Synthetic peptide
  Seed: VLLAVLPVLL (MOG_HUMAN)
VPLAVLPVLL

SEQ ID NO: 116910 - protein, 10 aa, Artificial Sequence
  Description of Artificial Sequence: Synthetic peptide
  Seed: RALVGDEVEL (MOG_HUMAN)
RILVGDEVEW

SEQ ID NO: 116911 - protein, 11 aa, Artificial Sequence
  Description of Artificial Sequence: Synthetic peptide
  Seed: RTFDPHFLRVP (MOG_HUMAN)
RFFDPHFLRVK

SEQ ID NO: 116912 - protein, 10 aa, Artificial Sequence
  Description of Artificial Sequence: Synthetic peptide
  Seed: KNATGMEVGW (MOG_HUMAN)
KIATGMEVGW

SEQ ID NO: 116913 - protein, 11 aa, Artificial Sequence
  Description of Artificial Sequence: Synthetic peptide
  Seed: VLVLLAVLPVL (MOG_HUMAN)
VWVLLAVLPVV

SEQ ID NO: 116914 - protein, 9 aa, Artificial Sequence
  Description of Artificial Sequence: Synthetic peptide
  Seed: AIGEGKVTL (MOG_HUMAN)
AEGEGKVTF

SEQ ID NO: 116915 - protein, 10 aa, Artificial Sequence
  Description of Artificial Sequence: Synthetic peptide
  Seed: RTFDPHFLRV (MOG_HUMAN)
RSFDPHFLRD

SEQ ID NO: 116916 - protein, 11 aa, Artificial Sequence
  Description of Artificial Sequence: Synthetic peptide
  Seed: HRTFDPHFLRV (MOG_HUMAN)
HMTFDPHFLRW

SEQ ID NO: 116917 - protein, 10 aa, Artificial Sequence
  Description of Artificial Sequence: Synthetic peptide
  Seed: FYWVSPGVLV (MOG_HUMAN)
FKWVSPGVLF

SEQ ID NO: 116918 - protein, 9 aa, Artificial Sequence
  Description of Artificial Sequence: Synthetic peptide
  Seed: LLAVLPVLL (MOG_HUMAN)
LLAVLPVLY

SEQ ID NO: 116919 - protein, 9 aa, Artificial Sequence
  Description of Artificial Sequence: Synthetic peptide
  Seed: QITVGLIFL (MOG_HUMAN)
QLTVGLIFL

SEQ ID NO: 116920 - protein, 10 aa, Artificial Sequence
  Description of Artificial Sequence: Synthetic peptide
  Seed: LLQITVGLIF (MOG_HUMAN)
LNQITVGLIF

SEQ ID NO: 116921 - protein, 10 aa, Artificial Sequence
  Description of Artificial Sequence: Synthetic peptide
  Seed: RTFDPHFLRV (MOG_HUMAN)
RWFDPHFLRN

SEQ ID NO: 116922 - protein, 9 aa, Artificial Sequence
  Description of Artificial Sequence: Synthetic peptide
  Seed: VIVPVLGPL (MOG_HUMAN)
VVVPVLGPI

SEQ ID NO: 116923 - protein, 9 aa, Artificial Sequence
  Description of Artificial Sequence: Synthetic peptide
  Seed: MASLSRPSL (MOG_HUMAN)
MLSLSRPSY

SEQ ID NO: 116924 - protein, 11 aa, Artificial Sequence
  Description of Artificial Sequence: Synthetic peptide
  Seed: HSYQEEAAMEL (MOG_HUMAN)
HTYQEEAAMEW

SEQ ID NO: 116925 - protein, 9 aa, Artificial Sequence
  Description of Artificial Sequence: Synthetic peptide
  Seed: RIRNVRFSD (MOG_HUMAN)
RARNVRFST

SEQ ID NO: 116926 - protein, 10 aa, Artificial Sequence
  Description of Artificial Sequence: Synthetic peptide
  Seed: LIFLCLQYRL (MOG_HUMAN)
LMFLCLQYRK

SEQ ID NO: 116927 - protein, 10 aa, Artificial Sequence
  Description of Artificial Sequence: Synthetic peptide
  Seed: ITLFVIVPVL (MOG_HUMAN)
ILLFVIVPVA

SEQ ID NO: 116928 - protein, 9 aa, Artificial Sequence
  Description of Artificial Sequence: Synthetic peptide
  Seed: LLLQITVGL (MOG_HUMAN)
LMLQITVGT

SEQ ID NO: 116929 - protein, 9 aa, Artificial Sequence
  Description of Artificial Sequence: Synthetic peptide
  Seed: QDGDQAPEY (MOG_HUMAN)
QEGDQAPEF

SEQ ID NO: 116930 - protein, 9 aa, Artificial Sequence
  Description of Artificial Sequence: Synthetic peptide
  Seed: SSSYAGQFR (MOG_HUMAN)
STSYAGQFY

SEQ ID NO: 116931 - protein, 10 aa, Artificial Sequence
  Description of Artificial Sequence: Synthetic peptide
  Seed: PVLGPLVALI (MOG_HUMAN)
PFLGPLVALV

SEQ ID NO: 116932 - protein, 11 aa, Artificial Sequence
  Description of Artificial Sequence: Synthetic peptide
  Seed: DAIGEGKVTLR (MOG_HUMAN)
DYIGEGKVTLR

SEQ ID NO: 116933 - protein, 10 aa, Artificial Sequence
  Description of Artificial Sequence: Synthetic peptide
  Seed: KITLFVIVPV (MOG_HUMAN)
KMTLFVIVPA

SEQ ID NO: 116934 - protein, 9 aa, Artificial Sequence
  Description of Artificial Sequence: Synthetic peptide
  Seed: TFDPHFLRV (MOG_HUMAN)
TQDPHFLRV

SEQ ID NO: 116935 - protein, 10 aa, Artificial Sequence
  Description of Artificial Sequence: Synthetic peptide
  Seed: KNATGMEVGW (MOG_HUMAN)
KFATGMEVGW

SEQ ID NO: 116936 - protein, 11 aa, Artificial Sequence
  Description of Artificial Sequence: Synthetic peptide
  Seed: VRFSDEGGFTC (MOG_HUMAN)
VHFSDEGGFTF

SEQ ID NO: 116937 - protein, 9 aa, Artificial Sequence
  Description of Artificial Sequence: Synthetic peptide
  Seed: LLLQVSSSY (MOG_HUMAN)
LSLQVSSSF

SEQ ID NO: 116938 - protein, 9 aa, Artificial Sequence
  Description of Artificial Sequence: Synthetic peptide
  Seed: LLLQVSSSY (MOG_HUMAN)
LILQVSSSM

SEQ ID NO: 116939 - protein, 9 aa, Artificial Sequence
  Description of Artificial Sequence: Synthetic peptide
  Seed: SLPSCLCSF (MOG_HUMAN)
SFPSCLCSL

SEQ ID NO: 116940 - protein, 10 aa, Artificial Sequence
  Description of Artificial Sequence: Synthetic peptide
  Seed: FTCFFRDHSY (MOG_HUMAN)
FMCFFRDHSM

SEQ ID NO: 116941 - protein, 10 aa, Artificial Sequence
  Description of Artificial Sequence: Synthetic peptide
  Seed: FSDEGGFTCF (MOG_HUMAN)
FGDEGGFTCI

SEQ ID NO: 116942 - protein, 11 aa, Artificial Sequence
  Description of Artificial Sequence: Synthetic peptide
  Seed: KDQDGDQAPEY (MOG_HUMAN)
KIQDGDQAPEY

SEQ ID NO: 116943 - protein, 9 aa, Artificial Sequence
  Description of Artificial Sequence: Synthetic peptide
  Seed: LIICYNWLH (MOG_HUMAN)
LVICYNWLR

SEQ ID NO: 116944 - protein, 10 aa, Artificial Sequence
  Description of Artificial Sequence: Synthetic peptide
  Seed: LLLLQVSSSY (MOG_HUMAN)
LSLLQVSSSY

SEQ ID NO: 116945 - protein, 9 aa, Artificial Sequence
  Description of Artificial Sequence: Synthetic peptide
  Seed: IICYNWLHR (MOG_HUMAN)
ITCYNWLHR

SEQ ID NO: 116946 - protein, 9 aa, Artificial Sequence
  Description of Artificial Sequence: Synthetic peptide
  Seed: FLEELRNPF (MOG_HUMAN)
FKEELRNPF

SEQ ID NO: 116947 - protein, 9 aa, Artificial Sequence
  Description of Artificial Sequence: Synthetic peptide
  Seed: RTFDPHFLR (MOG_HUMAN)
RIFDPHFLL

SEQ ID NO: 116948 - protein, 11 aa, Artificial Sequence
  Description of Artificial Sequence: Synthetic peptide
  Seed: YWVSPGVLVLL (MOG_HUMAN)
YWVSPGVLVLF

SEQ ID NO: 116949 - protein, 10 aa, Artificial Sequence
  Description of Artificial Sequence: Synthetic peptide
  Seed: WYRPPFSRVV (MOG_HUMAN)
WYRPPFSRVY

SEQ ID NO: 116950 - protein, 10 aa, Artificial Sequence
  Description of Artificial Sequence: Synthetic peptide
  Seed: FVIVPVLGPL (MOG_HUMAN)
FWIVPVLGPA

SEQ ID NO: 116951 - protein, 9 aa, Artificial Sequence
  Description of Artificial Sequence: Synthetic peptide
  Seed: VLLAVLPVL (MOG_HUMAN)
VTLAVLPVF

SEQ ID NO: 116952 - protein, 9 aa, Artificial Sequence
  Description of Artificial Sequence: Synthetic peptide
  Seed: KLRAEIENL (MOG_HUMAN)
KVRAEIENV

SEQ ID NO: 116953 - protein, 10 aa, Artificial Sequence
  Description of Artificial Sequence: Synthetic peptide
  Seed: LLQITVGLIF (MOG_HUMAN)
LLQITVGLIM

SEQ ID NO: 116954 - protein, 9 aa, Artificial Sequence
  Description of Artificial Sequence: Synthetic peptide
  Seed: ITLFVIVPV (MOG_HUMAN)
IMLFVIVPT

SEQ ID NO: 116955 - protein, 8 aa, Artificial Sequence
  Description of Artificial Sequence: Synthetic peptide
  Seed: YRPPFSRV (MOG_HUMAN)
YRPPFSRF

SEQ ID NO: 116956 - protein, 9 aa, Artificial Sequence
  Description of Artificial Sequence: Synthetic peptide
  Seed: IVPVLGPLV (MOG_HUMAN)
IAPVLGPLL

SEQ ID NO: 116957 - protein, 9 aa, Artificial Sequence
  Description of Artificial Sequence: Synthetic peptide
  Seed: YWVSPGVLV (MOG_HUMAN)
YRVSPGVLL

SEQ ID NO: 116958 - protein, 10 aa, Artificial Sequence
  Description of Artificial Sequence: Synthetic peptide
  Seed: RIRNVRFSDE (MOG_HUMAN)
RTRNVRFSDF

SEQ ID NO: 116959 - protein, 9 aa, Artificial Sequence
  Description of Artificial Sequence: Synthetic peptide
  Seed: FSDEGGFTC (MOG_HUMAN)
FLDEGGFTT

SEQ ID NO: 116960 - protein, 9 aa, Artificial Sequence
  Description of Artificial Sequence: Synthetic peptide
  Seed: WVSPGVLVL (MOG_HUMAN)
WMSPGVLVL

SEQ ID NO: 116961 - protein, 9 aa, Artificial Sequence
  Description of Artificial Sequence: Synthetic peptide
  Seed: VSPGVLVLL (MOG_HUMAN)
VLPGVLVLI

SEQ ID NO: 116962 - protein, 11 aa, Artificial Sequence
  Description of Artificial Sequence: Synthetic peptide
  Seed: ELLKDAIGEGK (MOG_HUMAN)
ETLKDAIGEGK

SEQ ID NO: 116963 - protein, 9 aa, Artificial Sequence
  Description of Artificial Sequence: Synthetic peptide
  Seed: LSRPSLPSC (MOG_HUMAN)
LLRPSLPSY

SEQ ID NO: 116964 - protein, 9 aa, Artificial Sequence
  Description of Artificial Sequence: Synthetic peptide
  Seed: SSYAGQFRV (MOG_HUMAN)
SFYAGQFRY

SEQ ID NO: 116965 - protein, 11 aa, Artificial Sequence
  Description of Artificial Sequence: Synthetic peptide
  Seed: RFSDEGGFTCF (MOG_HUMAN)
RNSDEGGFTCW

SEQ ID NO: 116966 - protein, 10 aa, Artificial Sequence
  Description of Artificial Sequence: Synthetic peptide
  Seed: HRTFDPHFLR (MOG_HUMAN)
HRTFDPHFLF

SEQ ID NO: 116967 - protein, 10 aa, Artificial Sequence
  Description of Artificial Sequence: Synthetic peptide
  Seed: RTFDPHFLRV (MOG_HUMAN)
REFDPHFLRY

SEQ ID NO: 116968 - protein, 10 aa, Artificial Sequence
  Description of Artificial Sequence: Synthetic peptide
  Seed: WVSPGVLVLL (MOG_HUMAN)
WMSPGVLVLV

SEQ ID NO: 116969 - protein, 9 aa, Artificial Sequence
  Description of Artificial Sequence: Synthetic peptide
  Seed: RVIGPRHPI (MOG_HUMAN)
RWIGPRHPF

SEQ ID NO: 116970 - protein, 9 aa, Artificial Sequence
  Description of Artificial Sequence: Synthetic peptide
  Seed: AEIENLHRT (MOG_HUMAN)
ADIENLHRI

SEQ ID NO: 116971 - protein, 9 aa, Artificial Sequence
  Description of Artificial Sequence: Synthetic peptide
  Seed: FSDEGGFTC (MOG_HUMAN)
FYDEGGFTT

SEQ ID NO: 116972 - protein, 9 aa, Artificial Sequence
  Description of Artificial Sequence: Synthetic peptide
  Seed: SYAGQFRVI (MOG_HUMAN)
SFAGQFRVY

SEQ ID NO: 116973 - protein, 10 aa, Artificial Sequence
  Description of Artificial Sequence: Synthetic peptide
  Seed: ITLFVIVPVL (MOG_HUMAN)
ISLFVIVPVF

SEQ ID NO: 116974 - protein, 10 aa, Artificial Sequence
  Description of Artificial Sequence: Synthetic peptide
  Seed: VLLAVLPVLL (MOG_HUMAN)
VCLAVLPVLL

SEQ ID NO: 116975 - protein, 10 aa, Artificial Sequence
  Description of Artificial Sequence: Synthetic peptide
  Seed: RTFDPHFLRV (MOG_HUMAN)
RYFDPHFLRS

SEQ ID NO: 116976 - protein, 9 aa, Artificial Sequence
  Description of Artificial Sequence: Synthetic peptide
  Seed: VVHLYRNGK (MOG_HUMAN)
VTHLYRNGR

SEQ ID NO: 116977 - protein, 10 aa, Artificial Sequence
  Description of Artificial Sequence: Synthetic peptide
  Seed: LLLLQVSSSY (MOG_HUMAN)
LSLLQVSSSF

SEQ ID NO: 116978 - protein, 10 aa, Artificial Sequence
  Description of Artificial Sequence: Synthetic peptide
  Seed: RTFDPHFLRV (MOG_HUMAN)
RWFDPHFLRC

SEQ ID NO: 116979 - protein, 10 aa, Artificial Sequence
  Description of Artificial Sequence: Synthetic peptide
  Seed: DAIGEGKVTL (MOG_HUMAN)
DVIGEGKVTF

SEQ ID NO: 116980 - protein, 9 aa, Artificial Sequence
  Description of Artificial Sequence: Synthetic peptide
  Seed: MASLSRPSL (MOG_HUMAN)
MPSLSRPSS

SEQ ID NO: 116981 - protein, 9 aa, Artificial Sequence
  Description of Artificial Sequence: Synthetic peptide
  Seed: FSDEGGFTC (MOG_HUMAN)
FTDEGGFTV

SEQ ID NO: 116982 - protein, 10 aa, Artificial Sequence
  Description of Artificial Sequence: Synthetic peptide
  Seed: RTFDPHFLRV (MOG_HUMAN)
RMFDPHFLRC

SEQ ID NO: 116983 - protein, 9 aa, Artificial Sequence
  Description of Artificial Sequence: Synthetic peptide
  Seed: FLEELRNPF (MOG_HUMAN)
FAEELRNPY

SEQ ID NO: 116984 - protein, 9 aa, Artificial Sequence
  Description of Artificial Sequence: Synthetic peptide
  Seed: LQVSSSYAG (MOG_HUMAN)
LEVSSSYAF

SEQ ID NO: 116985 - protein, 10 aa, Artificial Sequence
  Description of Artificial Sequence: Synthetic peptide
  Seed: FVIVPVLGPL (MOG_HUMAN)
FHIVPVLGPA

SEQ ID NO: 116986 - protein, 10 aa, Artificial Sequence
  Description of Artificial Sequence: Synthetic peptide
  Seed: LVLLAVLPVL (MOG_HUMAN)
LQLLAVLPVL

SEQ ID NO: 116987 - protein, 9 aa, Artificial Sequence
  Description of Artificial Sequence: Synthetic peptide
  Seed: RIRNVRFSD (MOG_HUMAN)
RTRNVRFSF

SEQ ID NO: 116988 - protein, 8 aa, Artificial Sequence
  Description of Artificial Sequence: Synthetic peptide
  Seed: FSRVVHLY (MOG_HUMAN)
FQRVVHLF

SEQ ID NO: 116989 - protein, 9 aa, Artificial Sequence
  Description of Artificial Sequence: Synthetic peptide
  Seed: SRPSLPSCL (MOG_HUMAN)
STPSLPSCM

SEQ ID NO: 116990 - protein, 11 aa, Artificial Sequence
  Description of Artificial Sequence: Synthetic peptide
  Seed: RRLAGQFLEEL (MOG_HUMAN)
RRLAGQFLEEY

SEQ ID NO: 116991 - protein, 9 aa, Artificial Sequence
  Description of Artificial Sequence: Synthetic peptide
  Seed: LLLQITVGL (MOG_HUMAN)
LVLQITVGF

SEQ ID NO: 116992 - protein, 10 aa, Artificial Sequence
  Description of Artificial Sequence: Synthetic peptide
  Seed: FLLLLLLQVS (MOG_HUMAN)
FCLLLLLQVV

SEQ ID NO: 116993 - protein, 10 aa, Artificial Sequence
  Description of Artificial Sequence: Synthetic peptide
  Seed: FDPHFLRVPC (MOG_HUMAN)
FFPHFLRVPI

SEQ ID NO: 116994 - protein, 10 aa, Artificial Sequence
  Description of Artificial Sequence: Synthetic peptide
  Seed: LLLQVSSSYA (MOG_HUMAN)
LMLQVSSSYK

SEQ ID NO: 116995 - protein, 9 aa, Artificial Sequence
  Description of Artificial Sequence: Synthetic peptide
  Seed: VGDEVELPC (MOG_HUMAN)
VFDEVELPV

SEQ ID NO: 116996 - protein, 10 aa, Artificial Sequence
  Description of Artificial Sequence: Synthetic peptide
  Seed: YWVSPGVLVL (MOG_HUMAN)
YLVSPGVLVY

SEQ ID NO: 116997 - protein, 10 aa, Artificial Sequence
  Description of Artificial Sequence: Synthetic peptide
  Seed: TGMEVGWYRP (MOG_HUMAN)
TFMEVGWYRH

SEQ ID NO: 116998 - protein, 11 aa, Artificial Sequence
  Description of Artificial Sequence: Synthetic peptide
  Seed: RDHSYQEEAAM (MOG_HUMAN)
RFHSYQEEAAF

SEQ ID NO: 116999 - protein, 10 aa, Artificial Sequence
  Description of Artificial Sequence: Synthetic peptide
  Seed: LIFLCLQYRL (MOG_HUMAN)
LAFLCLQYRR

SEQ ID NO: 117000 - protein, 9 aa, Artificial Sequence
  Description of Artificial Sequence: Synthetic peptide
  Seed: FSDEGGFTC (MOG_HUMAN)
FMDEGGFTA

SEQ ID NO: 117001 - protein, 9 aa, Artificial Sequence
  Description of Artificial Sequence: Synthetic peptide
  Seed: LSRPSLPSC (MOG_HUMAN)
LSRPSLPSM

SEQ ID NO: 117002 - protein, 9 aa, Artificial Sequence
  Description of Artificial Sequence: Synthetic peptide
  Seed: MASLSRPSL (MOG_HUMAN)
MASLSRPSW

SEQ ID NO: 117003 - protein, 9 aa, Artificial Sequence
  Description of Artificial Sequence: Synthetic peptide
  Seed: LLLQVSSSY (MOG_HUMAN)
LQLQVSSSL

SEQ ID NO: 117004 - protein, 9 aa, Artificial Sequence
  Description of Artificial Sequence: Synthetic peptide
  Seed: TFDPHFLRV (MOG_HUMAN)
TTDPHFLRF

SEQ ID NO: 117005 - protein, 9 aa, Artificial Sequence
  Description of Artificial Sequence: Synthetic peptide
  Seed: VSPGVLVLL (MOG_HUMAN)
VRPGVLVLL

SEQ ID NO: 117006 - protein, 11 aa, Artificial Sequence
  Description of Artificial Sequence: Synthetic peptide
  Seed: MELKVEDPFYW (MOG_HUMAN)
MILKVEDPFYW

SEQ ID NO: 117007 - protein, 9 aa, Artificial Sequence
  Description of Artificial Sequence: Synthetic peptide
  Seed: VLLAVLPVL (MOG_HUMAN)
VQLAVLPVM

SEQ ID NO: 117008 - protein, 9 aa, Artificial Sequence
  Description of Artificial Sequence: Synthetic peptide
  Seed: RVPCWKITL (MOG_HUMAN)
RWPCWKITM

SEQ ID NO: 117009 - protein, 9 aa, Artificial Sequence
  Description of Artificial Sequence: Synthetic peptide
  Seed: SYAGQFRVI (MOG_HUMAN)
SRAGQFRVI

SEQ ID NO: 117010 - protein, 9 aa, Artificial Sequence
  Description of Artificial Sequence: Synthetic peptide
  Seed: YQEEAAMEL (MOG_HUMAN)
YYEEAAMEM

SEQ ID NO: 117011 - protein, 9 aa, Artificial Sequence
  Description of Artificial Sequence: Synthetic peptide
  Seed: YRPPFSRVV (MOG_HUMAN)
YRPPFSRVF

SEQ ID NO: 117012 - protein, 10 aa, Artificial Sequence
  Description of Artificial Sequence: Synthetic peptide
  Seed: LLLQVSSSYA (MOG_HUMAN)
LMLQVSSSYD

SEQ ID NO: 117013 - protein, 10 aa, Artificial Sequence
  Description of Artificial Sequence: Synthetic peptide
  Seed: TGMEVGWYRP (MOG_HUMAN)
TVMEVGWYRH

SEQ ID NO: 117014 - protein, 10 aa, Artificial Sequence
  Description of Artificial Sequence: Synthetic peptide
  Seed: YWVSPGVLVL (MOG_HUMAN)
YMVSPGVLVL

SEQ ID NO: 117015 - protein, 9 aa, Artificial Sequence
  Description of Artificial Sequence: Synthetic peptide
  Seed: RVIGPRHPI (MOG_HUMAN)
RLIGPRHPM

SEQ ID NO: 117016 - protein, 9 aa, Artificial Sequence
  Description of Artificial Sequence: Synthetic peptide
  Seed: SSYAGQFRV (MOG_HUMAN)
SAYAGQFRY

SEQ ID NO: 117017 - protein, 10 aa, Artificial Sequence
  Description of Artificial Sequence: Synthetic peptide
  Seed: FRVIGPRHPI (MOG_HUMAN)
FCVIGPRHPV

SEQ ID NO: 117018 - protein, 11 aa, Artificial Sequence
  Description of Artificial Sequence: Synthetic peptide
  Seed: DAIGEGKVTLR (MOG_HUMAN)
DYIGEGKVTLK

SEQ ID NO: 117019 - protein, 10 aa, Artificial Sequence
  Description of Artificial Sequence: Synthetic peptide
  Seed: FRVIGPRHPI (MOG_HUMAN)
FTVIGPRHPA

SEQ ID NO: 117020 - protein, 9 aa, Artificial Sequence
  Description of Artificial Sequence: Synthetic peptide
  Seed: SSYAGQFRV (MOG_HUMAN)
SLYAGQFRF

SEQ ID NO: 117021 - protein, 9 aa, Artificial Sequence
  Description of Artificial Sequence: Synthetic peptide
  Seed: ALVGDEVEL (MOG_HUMAN)
AQVGDEVEW

SEQ ID NO: 117022 - protein, 9 aa, Artificial Sequence
  Description of Artificial Sequence: Synthetic peptide
  Seed: AIGEGKVTL (MOG_HUMAN)
ASGEGKVTM

SEQ ID NO: 117023 - protein, 10 aa, Artificial Sequence
  Description of Artificial Sequence: Synthetic peptide
  Seed: ITLFVIVPVL (MOG_HUMAN)
IGLFVIVPVV

SEQ ID NO: 117024 - protein, 10 aa, Artificial Sequence
  Description of Artificial Sequence: Synthetic peptide
  Seed: YWVSPGVLVL (MOG_HUMAN)
YIVSPGVLVM

SEQ ID NO: 117025 - protein, 9 aa, Artificial Sequence
  Description of Artificial Sequence: Synthetic peptide
  Seed: VRFSDEGGF (MOG_HUMAN)
VHFSDEGGL

SEQ ID NO: 117026 - protein, 10 aa, Artificial Sequence
  Description of Artificial Sequence: Synthetic peptide
  Seed: IGPRHPIRAL (MOG_HUMAN)
IEPRHPIRAV

SEQ ID NO: 117027 - protein, 9 aa, Artificial Sequence
  Description of Artificial Sequence: Synthetic peptide
  Seed: YRPPFSRVV (MOG_HUMAN)
YYPPFSRVF

SEQ ID NO: 117028 - protein, 9 aa, Artificial Sequence
  Description of Artificial Sequence: Synthetic peptide
  Seed: VSPGVLVLL (MOG_HUMAN)
VSPGVLVLW

SEQ ID NO: 117029 - protein, 9 aa, Artificial Sequence
  Description of Artificial Sequence: Synthetic peptide
  Seed: WVSPGVLVL (MOG_HUMAN)
WASPGVLVY

SEQ ID NO: 117030 - protein, 9 aa, Artificial Sequence
  Description of Artificial Sequence: Synthetic peptide
  Seed: RVIGPRHPI (MOG_HUMAN)
RWIGPRHPY

SEQ ID NO: 117031 - protein, 9 aa, Artificial Sequence
  Description of Artificial Sequence: Synthetic peptide
  Seed: SSYAGQFRV (MOG_HUMAN)
SVYAGQFRA

SEQ ID NO: 117032 - protein, 9 aa, Artificial Sequence
  Description of Artificial Sequence: Synthetic peptide
  Seed: LQITVGLIF (MOG_HUMAN)
LSITVGLIW

SEQ ID NO: 117033 - protein, 11 aa, Artificial Sequence
  Description of Artificial Sequence: Synthetic peptide
  Seed: RLAGQFLEELR (MOG_HUMAN)
RYAGQFLEELR

SEQ ID NO: 117034 - protein, 9 aa, Artificial Sequence
  Description of Artificial Sequence: Synthetic peptide
  Seed: SSYAGQFRV (MOG_HUMAN)
SMYAGQFRR

SEQ ID NO: 117035 - protein, 9 aa, Artificial Sequence
  Description of Artificial Sequence: Synthetic peptide
  Seed: TFDPHFLRV (MOG_HUMAN)
TSDPHFLRM

SEQ ID NO: 117036 - protein, 9 aa, Artificial Sequence
  Description of Artificial Sequence: Synthetic peptide
  Seed: MASLSRPSL (MOG_HUMAN)
MVSLSRPSW

SEQ ID NO: 117037 - protein, 11 aa, Artificial Sequence
  Description of Artificial Sequence: Synthetic peptide
  Seed: RIRNVRFSDEG (MOG_HUMAN)
RVRNVRFSDEV

SEQ ID NO: 117038 - protein, 10 aa, Artificial Sequence
  Description of Artificial Sequence: Synthetic peptide
  Seed: FSDEGGFTCF (MOG_HUMAN)
FVDEGGFTCW

SEQ ID NO: 117039 - protein, 9 aa, Artificial Sequence
  Description of Artificial Sequence: Synthetic peptide
  Seed: VSPGVLVLL (MOG_HUMAN)
VQPGVLVLV

SEQ ID NO: 117040 - protein, 10 aa, Artificial Sequence
  Description of Artificial Sequence: Synthetic peptide
  Seed: FVIVPVLGPL (MOG_HUMAN)
FSIVPVLGPV

SEQ ID NO: 117041 - protein, 9 aa, Artificial Sequence
  Description of Artificial Sequence: Synthetic peptide
  Seed: FSDEGGFTC (MOG_HUMAN)
FVDEGGFTV

SEQ ID NO: 117042 - protein, 9 aa, Artificial Sequence
  Description of Artificial Sequence: Synthetic peptide
  Seed: EYRGRTELL (MOG_HUMAN)
EARGRTELL

SEQ ID NO: 117043 - protein, 9 aa, Artificial Sequence
  Description of Artificial Sequence: Synthetic peptide
  Seed: TGMEVGWYR (MOG_HUMAN)
TMMEVGWYI

SEQ ID NO: 117044 - protein, 10 aa, Artificial Sequence
  Description of Artificial Sequence: Synthetic peptide
  Seed: FDPHFLRVPC (MOG_HUMAN)
FKPHFLRVPA

SEQ ID NO: 117045 - protein, 9 aa, Artificial Sequence
  Description of Artificial Sequence: Synthetic peptide
  Seed: MELKVEDPF (MOG_HUMAN)
MVLKVEDPF

SEQ ID NO: 117046 - protein, 10 aa, Artificial Sequence
  Description of Artificial Sequence: Synthetic peptide
  Seed: IGPRHPIRAL (MOG_HUMAN)
IFPRHPIRAF

SEQ ID NO: 117047 - protein, 10 aa, Artificial Sequence
  Description of Artificial Sequence: Synthetic peptide
  Seed: RIRNVRFSDE (MOG_HUMAN)
RVRNVRFSDA

SEQ ID NO: 117048 - protein, 11 aa, Artificial Sequence
  Description of Artificial Sequence: Synthetic peptide
  Seed: IRALVGDEVEL (MOG_HUMAN)
IHALVGDEVEM

SEQ ID NO: 117049 - protein, 10 aa, Artificial Sequence
  Description of Artificial Sequence: Synthetic peptide
  Seed: ICYNWLHRRL (MOG_HUMAN)
IYYNWLHRRF

SEQ ID NO: 117050 - protein, 10 aa, Artificial Sequence
  Description of Artificial Sequence: Synthetic peptide
  Seed: SLSRPSLPSC (MOG_HUMAN)
SVSRPSLPSL

SEQ ID NO: 117051 - protein, 9 aa, Artificial Sequence
  Description of Artificial Sequence: Synthetic peptide
  Seed: YWVSPGVLV (MOG_HUMAN)
YFVSPGVLV

SEQ ID NO: 117052 - protein, 9 aa, Artificial Sequence
  Description of Artificial Sequence: Synthetic peptide
  Seed: MASLSRPSL (MOG_HUMAN)
MPSLSRPSV

SEQ ID NO: 117053 - protein, 10 aa, Artificial Sequence
  Description of Artificial Sequence: Synthetic peptide
  Seed: VLLLQITVGL (MOG_HUMAN)
VWLLQITVGL

SEQ ID NO: 117054 - protein, 9 aa, Artificial Sequence
  Description of Artificial Sequence: Synthetic peptide
  Seed: LLAVLPVLL (MOG_HUMAN)
LVAVLPVLV

SEQ ID NO: 117055 - protein, 10 aa, Artificial Sequence
  Description of Artificial Sequence: Synthetic peptide
  Seed: TGMEVGWYRP (MOG_HUMAN)
TMMEVGWYRT

SEQ ID NO: 117056 - protein, 10 aa, Artificial Sequence
  Description of Artificial Sequence: Synthetic peptide
  Seed: SLSRPSLPSC (MOG_HUMAN)
SFSRPSLPSM

SEQ ID NO: 117057 - protein, 9 aa, Artificial Sequence
  Description of Artificial Sequence: Synthetic peptide
  Seed: SLPSCLCSF (MOG_HUMAN)
SRPSCLCSL

SEQ ID NO: 117058 - protein, 11 aa, Artificial Sequence
  Description of Artificial Sequence: Synthetic peptide
  Seed: RDHSYQEEAAM (MOG_HUMAN)
RYHSYQEEAAY

SEQ ID NO: 117059 - protein, 9 aa, Artificial Sequence
  Description of Artificial Sequence: Synthetic peptide
  Seed: LLLQVSSSY (MOG_HUMAN)
LALQVSSSL

SEQ ID NO: 117060 - protein, 9 aa, Artificial Sequence
  Description of Artificial Sequence: Synthetic peptide
  Seed: RPSLPSCLC (MOG_HUMAN)
RPSLPSCLI

SEQ ID NO: 117061 - protein, 11 aa, Artificial Sequence
  Description of Artificial Sequence: Synthetic peptide
  Seed: RDHSYQEEAAM (MOG_HUMAN)
RDHSYQEEAAW

SEQ ID NO: 117062 - protein, 10 aa, Artificial Sequence
  Description of Artificial Sequence: Synthetic peptide
  Seed: YWVSPGVLVL (MOG_HUMAN)
YLVSPGVLVV

SEQ ID NO: 117063 - protein, 10 aa, Artificial Sequence
  Description of Artificial Sequence: Synthetic peptide
  Seed: ATGMEVGWYR (MOG_HUMAN)
AEGMEVGWYR

SEQ ID NO: 117064 - protein, 11 aa, Artificial Sequence
  Description of Artificial Sequence: Synthetic peptide
  Seed: RDHSYQEEAAM (MOG_HUMAN)
RSHSYQEEAAF

SEQ ID NO: 117065 - protein, 10 aa, Artificial Sequence
  Description of Artificial Sequence: Synthetic peptide
  Seed: SCLCSFLLLL (MOG_HUMAN)
STLCSFLLLL

SEQ ID NO: 117066 - protein, 9 aa, Artificial Sequence
  Description of Artificial Sequence: Synthetic peptide
  Seed: LKVEDPFYW (MOG_HUMAN)
LQVEDPFYW

SEQ ID NO: 117067 - protein, 9 aa, Artificial Sequence
  Description of Artificial Sequence: Synthetic peptide
  Seed: SRPSLPSCL (MOG_HUMAN)
SVPSLPSCM

SEQ ID NO: 117068 - protein, 10 aa, Artificial Sequence
  Description of Artificial Sequence: Synthetic peptide
  Seed: VGWYRPPFSR (MOG_HUMAN)
VHWYRPPFSR

SEQ ID NO: 117069 - protein, 9 aa, Artificial Sequence
  Description of Artificial Sequence: Synthetic peptide
  Seed: SRPSLPSCL (MOG_HUMAN)
SVPSLPSCF

SEQ ID NO: 117070 - protein, 9 aa, Artificial Sequence
  Description of Artificial Sequence: Synthetic peptide
  Seed: ITVGLIFLC (MOG_HUMAN)
IAVGLIFLW

SEQ ID NO: 117071 - protein, 9 aa, Artificial Sequence
  Description of Artificial Sequence: Synthetic peptide
  Seed: LIFLCLQYR (MOG_HUMAN)
LTFLCLQYK

SEQ ID NO: 117072 - protein, 10 aa, Artificial Sequence
  Description of Artificial Sequence: Synthetic peptide
  Seed: VLLLQITVGL (MOG_HUMAN)
VCLLQITVGV

SEQ ID NO: 117073 - protein, 11 aa, Artificial Sequence
  Description of Artificial Sequence: Synthetic peptide
  Seed: FSDEGGFTCFF (MOG_HUMAN)
FSDEGGFTCFL

SEQ ID NO: 117074 - protein, 11 aa, Artificial Sequence
  Description of Artificial Sequence: Synthetic peptide
  Seed: RVPCWKITLFV (MOG_HUMAN)
RLPCWKITLFI

SEQ ID NO: 117075 - protein, 10 aa, Artificial Sequence
  Description of Artificial Sequence: Synthetic peptide
  Seed: RVIGPRHPIR (MOG_HUMAN)
RFIGPRHPIK

SEQ ID NO: 117076 - protein, 10 aa, Artificial Sequence
  Description of Artificial Sequence: Synthetic peptide
  Seed: RIRNVRFSDE (MOG_HUMAN)
RGRNVRFSDK

SEQ ID NO: 117077 - protein, 10 aa, Artificial Sequence
  Description of Artificial Sequence: Synthetic peptide
  Seed: RIRNVRFSDE (MOG_HUMAN)
RMRNVRFSDM

SEQ ID NO: 117078 - protein, 10 aa, Artificial Sequence
  Description of Artificial Sequence: Synthetic peptide
  Seed: YWVSPGVLVL (MOG_HUMAN)
YSVSPGVLVL

SEQ ID NO: 117079 - protein, 9 aa, Artificial Sequence
  Description of Artificial Sequence: Synthetic peptide
  Seed: LLAVLPVLL (MOG_HUMAN)
LIAVLPVLY

SEQ ID NO: 117080 - protein, 10 aa, Artificial Sequence
  Description of Artificial Sequence: Synthetic peptide
  Seed: TGMEVGWYRP (MOG_HUMAN)
TIMEVGWYRR

SEQ ID NO: 117081 - protein, 9 aa, Artificial Sequence
  Description of Artificial Sequence: Synthetic peptide
  Seed: LLLQVSSSY (MOG_HUMAN)
LELQVSSSY

SEQ ID NO: 117082 - protein, 10 aa, Artificial Sequence
  Description of Artificial Sequence: Synthetic peptide
  Seed: SLSRPSLPSC (MOG_HUMAN)
SRSRPSLPSV

SEQ ID NO: 117083 - protein, 9 aa, Artificial Sequence
  Description of Artificial Sequence: Synthetic peptide
  Seed: LLLQVSSSY (MOG_HUMAN)
LQLQVSSSF

SEQ ID NO: 117084 - protein, 10 aa, Artificial Sequence
  Description of Artificial Sequence: Synthetic peptide
  Seed: VLLAVLPVLL (MOG_HUMAN)
VTLAVLPVLL

SEQ ID NO: 117085 - protein, 10 aa, Artificial Sequence
  Description of Artificial Sequence: Synthetic peptide
  Seed: RVVHLYRNGK (MOG_HUMAN)
RCVHLYRNGR

SEQ ID NO: 117086 - protein, 9 aa, Artificial Sequence
  Description of Artificial Sequence: Synthetic peptide
  Seed: RVIGPRHPI (MOG_HUMAN)
RAIGPRHPV

SEQ ID NO: 117087 - protein, 9 aa, Artificial Sequence
  Description of Artificial Sequence: Synthetic peptide
  Seed: VIVPVLGPL (MOG_HUMAN)
VLVPVLGPM

SEQ ID NO: 117088 - protein, 9 aa, Artificial Sequence
  Description of Artificial Sequence: Synthetic peptide
  Seed: FSDEGGFTC (MOG_HUMAN)
FFDEGGFTT

SEQ ID NO: 117089 - protein, 10 aa, Artificial Sequence
  Description of Artificial Sequence: Synthetic peptide
  Seed: DAIGEGKVTL (MOG_HUMAN)
DVIGEGKVTW

SEQ ID NO: 117090 - protein, 9 aa, Artificial Sequence
  Description of Artificial Sequence: Synthetic peptide
  Seed: RVPCWKITL (MOG_HUMAN)
RLPCWKITK

SEQ ID NO: 117091 - protein, 10 aa, Artificial Sequence
  Description of Artificial Sequence: Synthetic peptide
  Seed: ATGMEVGWYR (MOG_HUMAN)
AHGMEVGWYR

SEQ ID NO: 117092 - protein, 9 aa, Artificial Sequence
  Description of Artificial Sequence: Synthetic peptide
  Seed: RIRNVRFSD (MOG_HUMAN)
RARNVRFSM

SEQ ID NO: 117093 - protein, 11 aa, Artificial Sequence
  Description of Artificial Sequence: Synthetic peptide
  Seed: DAIGEGKVTLR (MOG_HUMAN)
DIIGEGKVTLR

SEQ ID NO: 117094 - protein, 9 aa, Artificial Sequence
  Description of Artificial Sequence: Synthetic peptide
  Seed: VLPVLLLQI (MOG_HUMAN)
VTPVLLLQM

SEQ ID NO: 117095 - protein, 10 aa, Artificial Sequence
  Description of Artificial Sequence: Synthetic peptide
  Seed: WVSPGVLVLL (MOG_HUMAN)
WASPGVLVLL

SEQ ID NO: 117096 - protein, 10 aa, Artificial Sequence
  Description of Artificial Sequence: Synthetic peptide
  Seed: FDPHFLRVPC (MOG_HUMAN)
FMPHFLRVPA

SEQ ID NO: 117097 - protein, 10 aa, Artificial Sequence
  Description of Artificial Sequence: Synthetic peptide
  Seed: FDPHFLRVPC (MOG_HUMAN)
FWPHFLRVPP

SEQ ID NO: 117098 - protein, 11 aa, Artificial Sequence
  Description of Artificial Sequence: Synthetic peptide
  Seed: SSSYAGQFRVI (MOG_HUMAN)
SGSYAGQFRVF

SEQ ID NO: 117099 - protein, 10 aa, Artificial Sequence
  Description of Artificial Sequence: Synthetic peptide
  Seed: FDPHFLRVPC (MOG_HUMAN)
FSPHFLRVPL

SEQ ID NO: 117100 - protein, 10 aa, Artificial Sequence
  Description of Artificial Sequence: Synthetic peptide
  Seed: FDPHFLRVPC (MOG_HUMAN)
FFPHFLRVPP

SEQ ID NO: 117101 - protein, 10 aa, Artificial Sequence
  Description of Artificial Sequence: Synthetic peptide
  Seed: FSDEGGFTCF (MOG_HUMAN)
FQDEGGFTCW

SEQ ID NO: 117102 - protein, 9 aa, Artificial Sequence
  Description of Artificial Sequence: Synthetic peptide
  Seed: RIRNVRFSD (MOG_HUMAN)
RGRNVRFSS

SEQ ID NO: 117103 - protein, 9 aa, Artificial Sequence
  Description of Artificial Sequence: Synthetic peptide
  Seed: VVHLYRNGK (MOG_HUMAN)
VIHLYRNGR

SEQ ID NO: 117104 - protein, 9 aa, Artificial Sequence
  Description of Artificial Sequence: Synthetic peptide
  Seed: MELKVEDPF (MOG_HUMAN)
MRLKVEDPY

SEQ ID NO: 117105 - protein, 10 aa, Artificial Sequence
  Description of Artificial Sequence: Synthetic peptide
  Seed: FVIVPVLGPL (MOG_HUMAN)
FMIVPVLGPT

SEQ ID NO: 117106 - protein, 9 aa, Artificial Sequence
  Description of Artificial Sequence: Synthetic peptide
  Seed: LLLQVSSSY (MOG_HUMAN)
LGLQVSSSW

SEQ ID NO: 117107 - protein, 10 aa, Artificial Sequence
  Description of Artificial Sequence: Synthetic peptide
  Seed: SLSRPSLPSC (MOG_HUMAN)
SRSRPSLPSL

SEQ ID NO: 117108 - protein, 9 aa, Artificial Sequence
  Description of Artificial Sequence: Synthetic peptide
  Seed: SYAGQFRVI (MOG_HUMAN)
SAAGQFRVI

SEQ ID NO: 117109 - protein, 9 aa, Artificial Sequence
  Description of Artificial Sequence: Synthetic peptide
  Seed: RVIGPRHPI (MOG_HUMAN)
RYIGPRHPK

SEQ ID NO: 117110 - protein, 11 aa, Artificial Sequence
  Description of Artificial Sequence: Synthetic peptide
  Seed: RFSDEGGFTCF (MOG_HUMAN)
RRSDEGGFTCM

SEQ ID NO: 117111 - protein, 11 aa, Artificial Sequence
  Description of Artificial Sequence: Synthetic peptide
  Seed: RFSDEGGFTCF (MOG_HUMAN)
RVSDEGGFTCF

SEQ ID NO: 117112 - protein, 9 aa, Artificial Sequence
  Description of Artificial Sequence: Synthetic peptide
  Seed: LCSFLLLLL (MOG_HUMAN)
LLSFLLLLM

SEQ ID NO: 117113 - protein, 9 aa, Artificial Sequence
  Description of Artificial Sequence: Synthetic peptide
  Seed: LSRPSLPSC (MOG_HUMAN)
LPRPSLPSC

SEQ ID NO: 117114 - protein, 11 aa, Artificial Sequence
  Description of Artificial Sequence: Synthetic peptide
  Seed: FYWVSPGVLVL (MOG_HUMAN)
FYWVSPGVLVM

SEQ ID NO: 117115 - protein, 9 aa, Artificial Sequence
  Description of Artificial Sequence: Synthetic peptide
  Seed: RVIGPRHPI (MOG_HUMAN)
RYIGPRHPM

SEQ ID NO: 117116 - protein, 10 aa, Artificial Sequence
  Description of Artificial Sequence: Synthetic peptide
  Seed: FLLLLLLQVS (MOG_HUMAN)
FALLLLLQVV

SEQ ID NO: 117117 - protein, 9 aa, Artificial Sequence
  Description of Artificial Sequence: Synthetic peptide
  Seed: FLEELRNPF (MOG_HUMAN)
FFEELRNPI

SEQ ID NO: 117118 - protein, 10 aa, Artificial Sequence
  Description of Artificial Sequence: Synthetic peptide
  Seed: ATGMEVGWYR (MOG_HUMAN)
AMGMEVGWYR

SEQ ID NO: 117119 - protein, 10 aa, Artificial Sequence
  Description of Artificial Sequence: Synthetic peptide
  Seed: LPVLLLQITV (MOG_HUMAN)
LMVLLLQITV

SEQ ID NO: 117120 - protein, 9 aa, Artificial Sequence
  Description of Artificial Sequence: Synthetic peptide
  Seed: GWYRPPFSR (MOG_HUMAN)
GAYRPPFSK

SEQ ID NO: 117121 - protein, 9 aa, Artificial Sequence
  Description of Artificial Sequence: Synthetic peptide
  Seed: TCFFRDHSY (MOG_HUMAN)
TWFFRDHSY

SEQ ID NO: 117122 - protein, 10 aa, Artificial Sequence
  Description of Artificial Sequence: Synthetic peptide
  Seed: FYWVSPGVLV (MOG_HUMAN)
FYWVSPGVLL

SEQ ID NO: 117123 - protein, 10 aa, Artificial Sequence
  Description of Artificial Sequence: Synthetic peptide
  Seed: RRLAGQFLEE (MOG_HUMAN)
RRLAGQFLEH

SEQ ID NO: 117124 - protein, 10 aa, Artificial Sequence
  Description of Artificial Sequence: Synthetic peptide
  Seed: VGDEVELPCR (MOG_HUMAN)
VADEVELPCY

SEQ ID NO: 117125 - protein, 9 aa, Artificial Sequence
  Description of Artificial Sequence: Synthetic peptide
  Seed: SSYAGQFRV (MOG_HUMAN)
SMYAGQFRV

SEQ ID NO: 117126 - protein, 9 aa, Artificial Sequence
  Description of Artificial Sequence: Synthetic peptide
  Seed: VGDEVELPC (MOG_HUMAN)
VIDEVELPI

SEQ ID NO: 117127 - protein, 10 aa, Artificial Sequence
  Description of Artificial Sequence: Synthetic peptide
  Seed: RTFDPHFLRV (MOG_HUMAN)
RLFDPHFLRY

SEQ ID NO: 117128 - protein, 10 aa, Artificial Sequence
  Description of Artificial Sequence: Synthetic peptide
  Seed: SCLCSFLLLL (MOG_HUMAN)
SYLCSFLLLL

SEQ ID NO: 117129 - protein, 9 aa, Artificial Sequence
  Description of Artificial Sequence: Synthetic peptide
  Seed: MELKVEDPF (MOG_HUMAN)
MELKVEDPY

SEQ ID NO: 117130 - protein, 9 aa, Artificial Sequence
  Description of Artificial Sequence: Synthetic peptide
  Seed: HSYQEEAAM (MOG_HUMAN)
HQYQEEAAM

SEQ ID NO: 117131 - protein, 10 aa, Artificial Sequence
  Description of Artificial Sequence: Synthetic peptide
  Seed: FVIVPVLGPL (MOG_HUMAN)
FSIVPVLGPM

SEQ ID NO: 117132 - protein, 9 aa, Artificial Sequence
  Description of Artificial Sequence: Synthetic peptide
  Seed: VLPVLLLQI (MOG_HUMAN)
VIPVLLLQL

SEQ ID NO: 117133 - protein, 9 aa, Artificial Sequence
  Description of Artificial Sequence: Synthetic peptide
  Seed: LKDAIGEGK (MOG_HUMAN)
LMDAIGEGY

SEQ ID NO: 117134 - protein, 9 aa, Artificial Sequence
  Description of Artificial Sequence: Synthetic peptide
  Seed: VSPGVLVLL (MOG_HUMAN)
VGPGVLVLL

SEQ ID NO: 117135 - protein, 10 aa, Artificial Sequence
  Description of Artificial Sequence: Synthetic peptide
  Seed: LVLLAVLPVL (MOG_HUMAN)
LYLLAVLPVA

SEQ ID NO: 117136 - protein, 9 aa, Artificial Sequence
  Description of Artificial Sequence: Synthetic peptide
  Seed: WVSPGVLVL (MOG_HUMAN)
WMSPGVLVA

SEQ ID NO: 117137 - protein, 10 aa, Artificial Sequence
  Description of Artificial Sequence: Synthetic peptide
  Seed: LQYRLRGKLR (MOG_HUMAN)
LYYRLRGKLR

SEQ ID NO: 117138 - protein, 9 aa, Artificial Sequence
  Description of Artificial Sequence: Synthetic peptide
  Seed: TFDPHFLRV (MOG_HUMAN)
TPDPHFLRL

SEQ ID NO: 117139 - protein, 10 aa, Artificial Sequence
  Description of Artificial Sequence: Synthetic peptide
  Seed: SLSRPSLPSC (MOG_HUMAN)
SPSRPSLPSK

SEQ ID NO: 117140 - protein, 11 aa, Artificial Sequence
  Description of Artificial Sequence: Synthetic peptide
  Seed: VIGPRHPIRAL (MOG_HUMAN)
VFGPRHPIRAL

SEQ ID NO: 117141 - protein, 10 aa, Artificial Sequence
  Description of Artificial Sequence: Synthetic peptide
  Seed: LQITVGLIFL (MOG_HUMAN)
LQITVGLIFY

SEQ ID NO: 117142 - protein, 10 aa, Artificial Sequence
  Description of Artificial Sequence: Synthetic peptide
  Seed: RTFDPHFLRV (MOG_HUMAN)
RNFDPHFLRR

SEQ ID NO: 117143 - protein, 9 aa, Artificial Sequence
  Description of Artificial Sequence: Synthetic peptide
  Seed: YQEEAAMEL (MOG_HUMAN)
YFEEAAMEI

SEQ ID NO: 117144 - protein, 11 aa, Artificial Sequence
  Description of Artificial Sequence: Synthetic peptide
  Seed: RFSDEGGFTCF (MOG_HUMAN)
RLSDEGGFTCI

SEQ ID NO: 117145 - protein, 10 aa, Artificial Sequence
  Description of Artificial Sequence: Synthetic peptide
  Seed: SDEGGFTCFF (MOG_HUMAN)
SEEGGFTCFW

SEQ ID NO: 117146 - protein, 10 aa, Artificial Sequence
  Description of Artificial Sequence: Synthetic peptide
  Seed: RTFDPHFLRV (MOG_HUMAN)
RTFDPHFLRI

SEQ ID NO: 117147 - protein, 10 aa, Artificial Sequence
  Description of Artificial Sequence: Synthetic peptide
  Seed: YWVSPGVLVL (MOG_HUMAN)
YMVSPGVLVM

SEQ ID NO: 117148 - protein, 9 aa, Artificial Sequence
  Description of Artificial Sequence: Synthetic peptide
  Seed: GPLVALIIC (MOG_HUMAN)
GPLVALIIA

SEQ ID NO: 117149 - protein, 9 aa, Artificial Sequence
  Description of Artificial Sequence: Synthetic peptide
  Seed: FLEELRNPF (MOG_HUMAN)
FLEELRNPV

SEQ ID NO: 117150 - protein, 10 aa, Artificial Sequence
  Description of Artificial Sequence: Synthetic peptide
  Seed: RTFDPHFLRV (MOG_HUMAN)
RSFDPHFLRP

SEQ ID NO: 117151 - protein, 9 aa, Artificial Sequence
  Description of Artificial Sequence: Synthetic peptide
  Seed: RTFDPHFLR (MOG_HUMAN)
RLFDPHFLH

SEQ ID NO: 117152 - protein, 11 aa, Artificial Sequence
  Description of Artificial Sequence: Synthetic peptide
  Seed: SSSYAGQFRVI (MOG_HUMAN)
SRSYAGQFRVF

SEQ ID NO: 117153 - protein, 10 aa, Artificial Sequence
  Description of Artificial Sequence: Synthetic peptide
  Seed: SCLCSFLLLL (MOG_HUMAN)
SKLCSFLLLL

SEQ ID NO: 117154 - protein, 9 aa, Artificial Sequence
  Description of Artificial Sequence: Synthetic peptide
  Seed: RVIGPRHPI (MOG_HUMAN)
RIIGPRHPR

SEQ ID NO: 117155 - protein, 10 aa, Artificial Sequence
  Description of Artificial Sequence: Synthetic peptide
  Seed: VLLLQITVGL (MOG_HUMAN)
VGLLQITVGV

SEQ ID NO: 117156 - protein, 9 aa, Artificial Sequence
  Description of Artificial Sequence: Synthetic peptide
  Seed: RIRNVRFSD (MOG_HUMAN)
RVRNVRFSC

SEQ ID NO: 117157 - protein, 9 aa, Artificial Sequence
  Description of Artificial Sequence: Synthetic peptide
  Seed: RVIGPRHPI (MOG_HUMAN)
RQIGPRHPI

SEQ ID NO: 117158 - protein, 9 aa, Artificial Sequence
  Description of Artificial Sequence: Synthetic peptide
  Seed: SSYAGQFRV (MOG_HUMAN)
SMYAGQFRK

SEQ ID NO: 117159 - protein, 8 aa, Artificial Sequence
  Description of Artificial Sequence: Synthetic peptide
  Seed: YRPPFSRV (MOG_HUMAN)
YRPPFSRY

SEQ ID NO: 117160 - protein, 11 aa, Artificial Sequence
  Description of Artificial Sequence: Synthetic peptide
  Seed: RISPGKNATGM (MOG_HUMAN)
RMSPGKNATGY

SEQ ID NO: 117161 - protein, 9 aa, Artificial Sequence
  Description of Artificial Sequence: Synthetic peptide
  Seed: VLPVLLLQI (MOG_HUMAN)
VVPVLLLQL

SEQ ID NO: 117162 - protein, 9 aa, Artificial Sequence
  Description of Artificial Sequence: Synthetic peptide
  Seed: VLLAVLPVL (MOG_HUMAN)
VMLAVLPVA

SEQ ID NO: 117163 - protein, 9 aa, Artificial Sequence
  Description of Artificial Sequence: Synthetic peptide
  Seed: KLRAEIENL (MOG_HUMAN)
KLRAEIENF

SEQ ID NO: 117164 - protein, 9 aa, Artificial Sequence
  Description of Artificial Sequence: Synthetic peptide
  Seed: LSRPSLPSC (MOG_HUMAN)
LTRPSLPSY

SEQ ID NO: 117165 - protein, 9 aa, Artificial Sequence
  Description of Artificial Sequence: Synthetic peptide
  Seed: AEIENLHRT (MOG_HUMAN)
ADIENLHRF

SEQ ID NO: 117166 - protein, 10 aa, Artificial Sequence
  Description of Artificial Sequence: Synthetic peptide
  Seed: FVIVPVLGPL (MOG_HUMAN)
FTIVPVLGPL

SEQ ID NO: 117167 - protein, 9 aa, Artificial Sequence
  Description of Artificial Sequence: Synthetic peptide
  Seed: LIICYNWLH (MOG_HUMAN)
LLICYNWLK

SEQ ID NO: 117168 - protein, 9 aa, Artificial Sequence
  Description of Artificial Sequence: Synthetic peptide
  Seed: LLLQVSSSY (MOG_HUMAN)
LQLQVSSSI

SEQ ID NO: 117169 - protein, 9 aa, Artificial Sequence
  Description of Artificial Sequence: Synthetic peptide
  Seed: SSYAGQFRV (MOG_HUMAN)
SLYAGQFRC

SEQ ID NO: 117170 - protein, 9 aa, Artificial Sequence
  Description of Artificial Sequence: Synthetic peptide
  Seed: LLLQITVGL (MOG_HUMAN)
LPLQITVGY

SEQ ID NO: 117171 - protein, 9 aa, Artificial Sequence
  Description of Artificial Sequence: Synthetic peptide
  Seed: MASLSRPSL (MOG_HUMAN)
MSSLSRPSW

SEQ ID NO: 117172 - protein, 10 aa, Artificial Sequence
  Description of Artificial Sequence: Synthetic peptide
  Seed: PVLGPLVALI (MOG_HUMAN)
PFLGPLVALI

SEQ ID NO: 117173 - protein, 10 aa, Artificial Sequence
  Description of Artificial Sequence: Synthetic peptide
  Seed: PVLGPLVALI (MOG_HUMAN)
PWLGPLVALL

SEQ ID NO: 117174 - protein, 11 aa, Artificial Sequence
  Description of Artificial Sequence: Synthetic peptide
  Seed: RFSDEGGFTCF (MOG_HUMAN)
RSSDEGGFTCY

SEQ ID NO: 117175 - protein, 9 aa, Artificial Sequence
  Description of Artificial Sequence: Synthetic peptide
  Seed: TCFFRDHSY (MOG_HUMAN)
TFFFRDHSY

SEQ ID NO: 117176 - protein, 9 aa, Artificial Sequence
  Description of Artificial Sequence: Synthetic peptide
  Seed: TLFVIVPVL (MOG_HUMAN)
TMFVIVPVY

SEQ ID NO: 117177 - protein, 10 aa, Artificial Sequence
  Description of Artificial Sequence: Synthetic peptide
  Seed: SFLLLLLLQV (MOG_HUMAN)
SALLLLLLQV

SEQ ID NO: 117178 - protein, 9 aa, Artificial Sequence
  Description of Artificial Sequence: Synthetic peptide
  Seed: YRPPFSRVV (MOG_HUMAN)
YTPPFSRVI

SEQ ID NO: 117179 - protein, 9 aa, Artificial Sequence
  Description of Artificial Sequence: Synthetic peptide
  Seed: LVLLAVLPV (MOG_HUMAN)
LMLLAVLPA

SEQ ID NO: 117180 - protein, 9 aa, Artificial Sequence
  Description of Artificial Sequence: Synthetic peptide
  Seed: YQEEAAMEL (MOG_HUMAN)
YREEAAMEY

SEQ ID NO: 117181 - protein, 11 aa, Artificial Sequence
  Description of Artificial Sequence: Synthetic peptide
  Seed: VRFSDEGGFTC (MOG_HUMAN)
VHFSDEGGFTI

SEQ ID NO: 117182 - protein, 10 aa, Artificial Sequence
  Description of Artificial Sequence: Synthetic peptide
  Seed: LLLQVSSSYA (MOG_HUMAN)
LLLQVSSSYV

SEQ ID NO: 117183 - protein, 9 aa, Artificial Sequence
  Description of Artificial Sequence: Synthetic peptide
  Seed: SSYAGQFRV (MOG_HUMAN)
SWYAGQFRY

SEQ ID NO: 117184 - protein, 8 aa, Artificial Sequence
  Description of Artificial Sequence: Synthetic peptide
  Seed: FSDEGGFT (MOG_HUMAN)
FLDEGGFI

SEQ ID NO: 117185 - protein, 10 aa, Artificial Sequence
  Description of Artificial Sequence: Synthetic peptide
  Seed: IICYNWLHRR (MOG_HUMAN)
IFCYNWLHRK

SEQ ID NO: 117186 - protein, 9 aa, Artificial Sequence
  Description of Artificial Sequence: Synthetic peptide
  Seed: SSYAGQFRV (MOG_HUMAN)
STYAGQFRA

SEQ ID NO: 117187 - protein, 9 aa, Artificial Sequence
  Description of Artificial Sequence: Synthetic peptide
  Seed: RVPCWKITL (MOG_HUMAN)
RYPCWKITW

SEQ ID NO: 117188 - protein, 9 aa, Artificial Sequence
  Description of Artificial Sequence: Synthetic peptide
  Seed: YRPPFSRVV (MOG_HUMAN)
YAPPFSRVF

SEQ ID NO: 117189 - protein, 10 aa, Artificial Sequence
  Description of Artificial Sequence: Synthetic peptide
  Seed: FSDEGGFTCF (MOG_HUMAN)
FYDEGGFTCF

SEQ ID NO: 117190 - protein, 10 aa, Artificial Sequence
  Description of Artificial Sequence: Synthetic peptide
  Seed: QFLEELRNPF (MOG_HUMAN)
QYLEELRNPW

SEQ ID NO: 117191 - protein, 10 aa, Artificial Sequence
  Description of Artificial Sequence: Synthetic peptide
  Seed: FRVIGPRHPI (MOG_HUMAN)
FEVIGPRHPI

SEQ ID NO: 117192 - protein, 10 aa, Artificial Sequence
  Description of Artificial Sequence: Synthetic peptide
  Seed: RTFDPHFLRV (MOG_HUMAN)
RFFDPHFLRY

SEQ ID NO: 117193 - protein, 9 aa, Artificial Sequence
  Description of Artificial Sequence: Synthetic peptide
  Seed: TCFFRDHSY (MOG_HUMAN)
TTFFRDHSL

SEQ ID NO: 117194 - protein, 9 aa, Artificial Sequence
  Description of Artificial Sequence: Synthetic peptide
  Seed: RVIGPRHPI (MOG_HUMAN)
RNIGPRHPY

SEQ ID NO: 117195 - protein, 9 aa, Artificial Sequence
  Description of Artificial Sequence: Synthetic peptide
  Seed: CLCSFLLLL (MOG_HUMAN)
CMCSFLLLI

SEQ ID NO: 117196 - protein, 10 aa, Artificial Sequence
  Description of Artificial Sequence: Synthetic peptide
  Seed: GLIFLCLQYR (MOG_HUMAN)
GYIFLCLQYR

SEQ ID NO: 117197 - protein, 9 aa, Artificial Sequence
  Description of Artificial Sequence: Synthetic peptide
  Seed: YQEEAAMEL (MOG_HUMAN)
YQEEAAMEF

SEQ ID NO: 117198 - protein, 10 aa, Artificial Sequence
  Description of Artificial Sequence: Synthetic peptide
  Seed: VLVLLAVLPV (MOG_HUMAN)
VQVLLAVLPV

SEQ ID NO: 117199 - protein, 10 aa, Artificial Sequence
  Description of Artificial Sequence: Synthetic peptide
  Seed: VSSSYAGQFR (MOG_HUMAN)
VVSSYAGQFK

SEQ ID NO: 117200 - protein, 9 aa, Artificial Sequence
  Description of Artificial Sequence: Synthetic peptide
  Seed: RIRNVRFSD (MOG_HUMAN)
RWRNVRFSS

SEQ ID NO: 117201 - protein, 9 aa, Artificial Sequence
  Description of Artificial Sequence: Synthetic peptide
  Seed: VSPGVLVLL (MOG_HUMAN)
VLPGVLVLR

SEQ ID NO: 117202 - protein, 9 aa, Artificial Sequence
  Description of Artificial Sequence: Synthetic peptide
  Seed: RIRNVRFSD (MOG_HUMAN)
RCRNVRFSA

SEQ ID NO: 117203 - protein, 10 aa, Artificial Sequence
  Description of Artificial Sequence: Synthetic peptide
  Seed: LQITVGLIFL (MOG_HUMAN)
LMITVGLIFI

SEQ ID NO: 117204 - protein, 11 aa, Artificial Sequence
  Description of Artificial Sequence: Synthetic peptide
  Seed: SSSYAGQFRVI (MOG_HUMAN)
SESYAGQFRVF

SEQ ID NO: 117205 - protein, 10 aa, Artificial Sequence
  Description of Artificial Sequence: Synthetic peptide
  Seed: RLRGKLRAEI (MOG_HUMAN)
RVRGKLRAEI

SEQ ID NO: 117206 - protein, 9 aa, Artificial Sequence
  Description of Artificial Sequence: Synthetic peptide
  Seed: SYAGQFRVI (MOG_HUMAN)
SYAGQFRVW

SEQ ID NO: 117207 - protein, 9 aa, Artificial Sequence
  Description of Artificial Sequence: Synthetic peptide
  Seed: YQEEAAMEL (MOG_HUMAN)
YVEEAAMEF

SEQ ID NO: 117208 - protein, 10 aa, Artificial Sequence
  Description of Artificial Sequence: Synthetic peptide
  Seed: FDPHFLRVPC (MOG_HUMAN)
FPPHFLRVPL

SEQ ID NO: 117209 - protein, 9 aa, Artificial Sequence
  Description of Artificial Sequence: Synthetic peptide
  Seed: LLLQITVGL (MOG_HUMAN)
LVLQITVGA

SEQ ID NO: 117210 - protein, 10 aa, Artificial Sequence
  Description of Artificial Sequence: Synthetic peptide
  Seed: LVLLAVLPVL (MOG_HUMAN)
LALLAVLPVV

SEQ ID NO: 117211 - protein, 10 aa, Artificial Sequence
  Description of Artificial Sequence: Synthetic peptide
  Seed: HRTFDPHFLR (MOG_HUMAN)
HRTFDPHFLL

SEQ ID NO: 117212 - protein, 10 aa, Artificial Sequence
  Description of Artificial Sequence: Synthetic peptide
  Seed: LLLQVSSSYA (MOG_HUMAN)
LSLQVSSSYV

SEQ ID NO: 117213 - protein, 9 aa, Artificial Sequence
  Description of Artificial Sequence: Synthetic peptide
  Seed: YRPPFSRVV (MOG_HUMAN)
YTPPFSRVA

SEQ ID NO: 117214 - protein, 9 aa, Artificial Sequence
  Description of Artificial Sequence: Synthetic peptide
  Seed: YQEEAAMEL (MOG_HUMAN)
YIEEAAMEI

SEQ ID NO: 117215 - protein, 9 aa, Artificial Sequence
  Description of Artificial Sequence: Synthetic peptide
  Seed: IICYNWLHR (MOG_HUMAN)
IVCYNWLHK

SEQ ID NO: 117216 - protein, 10 aa, Artificial Sequence
  Description of Artificial Sequence: Synthetic peptide
  Seed: SSYAGQFRVI (MOG_HUMAN)
SVYAGQFRVK

SEQ ID NO: 117217 - protein, 9 aa, Artificial Sequence
  Description of Artificial Sequence: Synthetic peptide
  Seed: LAVLPVLLL (MOG_HUMAN)
LVVLPVLLW

SEQ ID NO: 117218 - protein, 9 aa, Artificial Sequence
  Description of Artificial Sequence: Synthetic peptide
  Seed: GWYRPPFSR (MOG_HUMAN)
GLYRPPFSK

SEQ ID NO: 117219 - protein, 9 aa, Artificial Sequence
  Description of Artificial Sequence: Synthetic peptide
  Seed: RTFDPHFLR (MOG_HUMAN)
RMFDPHFLW

SEQ ID NO: 117220 - protein, 10 aa, Artificial Sequence
  Description of Artificial Sequence: Synthetic peptide
  Seed: RDHSYQEEAA (MOG_HUMAN)
REHSYQEEAI

SEQ ID NO: 117221 - protein, 9 aa, Artificial Sequence
  Description of Artificial Sequence: Synthetic peptide
  Seed: LLAVLPVLL (MOG_HUMAN)
LTAVLPVLL

SEQ ID NO: 117222 - protein, 10 aa, Artificial Sequence
  Description of Artificial Sequence: Synthetic peptide
  Seed: LLQITVGLIF (MOG_HUMAN)
LVQITVGLIF

SEQ ID NO: 117223 - protein, 10 aa, Artificial Sequence
  Description of Artificial Sequence: Synthetic peptide
  Seed: KNATGMEVGW (MOG_HUMAN)
KKATGMEVGW

SEQ ID NO: 117224 - protein, 8 aa, Artificial Sequence
  Description of Artificial Sequence: Synthetic peptide
  Seed: VLGPLVAL (MOG_HUMAN)
VAGPLVAF

SEQ ID NO: 117225 - protein, 9 aa, Artificial Sequence
  Description of Artificial Sequence: Synthetic peptide
  Seed: GEGKVTLRI (MOG_HUMAN)
GQGKVTLRF

SEQ ID NO: 117226 - protein, 9 aa, Artificial Sequence
  Description of Artificial Sequence: Synthetic peptide
  Seed: HSYQEEAAM (MOG_HUMAN)
HAYQEEAAH

SEQ ID NO: 117227 - protein, 11 aa, Artificial Sequence
  Description of Artificial Sequence: Synthetic peptide
  Seed: RTFDPHFLRVP (MOG_HUMAN)
RMFDPHFLRVL

SEQ ID NO: 117228 - protein, 10 aa, Artificial Sequence
  Description of Artificial Sequence: Synthetic peptide
  Seed: RTFDPHFLRV (MOG_HUMAN)
RVFDPHFLRQ

SEQ ID NO: 117229 - protein, 9 aa, Artificial Sequence
  Description of Artificial Sequence: Synthetic peptide
  Seed: TLFVIVPVL (MOG_HUMAN)
TQFVIVPVF

SEQ ID NO: 117230 - protein, 9 aa, Artificial Sequence
  Description of Artificial Sequence: Synthetic peptide
  Seed: FSRVVHLYR (MOG_HUMAN)
FTRVVHLYA

SEQ ID NO: 117231 - protein, 9 aa, Artificial Sequence
  Description of Artificial Sequence: Synthetic peptide
  Seed: YWVSPGVLV (MOG_HUMAN)
YFVSPGVLY

SEQ ID NO: 117232 - protein, 10 aa, Artificial Sequence
  Description of Artificial Sequence: Synthetic peptide
  Seed: FRVIGPRHPI (MOG_HUMAN)
FIVIGPRHPI

SEQ ID NO: 117233 - protein, 9 aa, Artificial Sequence
  Description of Artificial Sequence: Synthetic peptide
  Seed: RIRNVRFSD (MOG_HUMAN)
RFRNVRFSY

SEQ ID NO: 117234 - protein, 10 aa, Artificial Sequence
  Description of Artificial Sequence: Synthetic peptide
  Seed: FDPHFLRVPC (MOG_HUMAN)
FLPHFLRVPL

SEQ ID NO: 117235 - protein, 11 aa, Artificial Sequence
  Description of Artificial Sequence: Synthetic peptide
  Seed: VGDEVELPCRI (MOG_HUMAN)
VVDEVELPCRL

SEQ ID NO: 117236 - protein, 9 aa, Artificial Sequence
  Description of Artificial Sequence: Synthetic peptide
  Seed: CLCSFLLLL (MOG_HUMAN)
CMCSFLLLK

SEQ ID NO: 117237 - protein, 10 aa, Artificial Sequence
  Description of Artificial Sequence: Synthetic peptide
  Seed: RTFDPHFLRV (MOG_HUMAN)
RQFDPHFLRS

SEQ ID NO: 117238 - protein, 9 aa, Artificial Sequence
  Description of Artificial Sequence: Synthetic peptide
  Seed: RTFDPHFLR (MOG_HUMAN)
RRFDPHFLY

SEQ ID NO: 117239 - protein, 9 aa, Artificial Sequence
  Description of Artificial Sequence: Synthetic peptide
  Seed: CWKITLFVI (MOG_HUMAN)
CYKITLFVL

SEQ ID NO: 117240 - protein, 10 aa, Artificial Sequence
  Description of Artificial Sequence: Synthetic peptide
  Seed: SDEGGFTCFF (MOG_HUMAN)
SDEGGFTCFW

SEQ ID NO: 117241 - protein, 10 aa, Artificial Sequence
  Description of Artificial Sequence: Synthetic peptide
  Seed: TGMEVGWYRP (MOG_HUMAN)
TFMEVGWYRA

SEQ ID NO: 117242 - protein, 9 aa, Artificial Sequence
  Description of Artificial Sequence: Synthetic peptide
  Seed: IVPVLGPLV (MOG_HUMAN)
IVPVLGPLM

SEQ ID NO: 117243 - protein, 9 aa, Artificial Sequence
  Description of Artificial Sequence: Synthetic peptide
  Seed: LLLQITVGL (MOG_HUMAN)
LTLQITVGI

SEQ ID NO: 117244 - protein, 10 aa, Artificial Sequence
  Description of Artificial Sequence: Synthetic peptide
  Seed: FDPHFLRVPC (MOG_HUMAN)
FVPHFLRVPP

SEQ ID NO: 117245 - protein, 11 aa, Artificial Sequence
  Description of Artificial Sequence: Synthetic peptide
  Seed: RLAGQFLEELR (MOG_HUMAN)
RVAGQFLEELR

SEQ ID NO: 117246 - protein, 9 aa, Artificial Sequence
  Description of Artificial Sequence: Synthetic peptide
  Seed: TLRIRNVRF (MOG_HUMAN)
TMRIRNVRL

SEQ ID NO: 117247 - protein, 9 aa, Artificial Sequence
  Description of Artificial Sequence: Synthetic peptide
  Seed: YRPPFSRVV (MOG_HUMAN)
YMPPFSRVM

SEQ ID NO: 117248 - protein, 10 aa, Artificial Sequence
  Description of Artificial Sequence: Synthetic peptide
  Seed: FVIVPVLGPL (MOG_HUMAN)
FAIVPVLGPM

SEQ ID NO: 117249 - protein, 9 aa, Artificial Sequence
  Description of Artificial Sequence: Synthetic peptide
  Seed: MELKVEDPF (MOG_HUMAN)
MELKVEDPL

SEQ ID NO: 117250 - protein, 11 aa, Artificial Sequence
  Description of Artificial Sequence: Synthetic peptide
  Seed: DGDQAPEYRGR (MOG_HUMAN)
DVDQAPEYRGR

SEQ ID NO: 117251 - protein, 10 aa, Artificial Sequence
  Description of Artificial Sequence: Synthetic peptide
  Seed: HRTFDPHFLR (MOG_HUMAN)
HGTFDPHFLK

SEQ ID NO: 117252 - protein, 10 aa, Artificial Sequence
  Description of Artificial Sequence: Synthetic peptide
  Seed: FRVIGPRHPI (MOG_HUMAN)
FSVIGPRHPI

SEQ ID NO: 117253 - protein, 9 aa, Artificial Sequence
  Description of Artificial Sequence: Synthetic peptide
  Seed: SSSYAGQFR (MOG_HUMAN)
SVSYAGQFR

SEQ ID NO: 117254 - protein, 9 aa, Artificial Sequence
  Description of Artificial Sequence: Synthetic peptide
  Seed: FLEELRNPF (MOG_HUMAN)
FWEELRNPM

SEQ ID NO: 117255 - protein, 10 aa, Artificial Sequence
  Description of Artificial Sequence: Synthetic peptide
  Seed: ITLFVIVPVL (MOG_HUMAN)
IKLFVIVPVV

SEQ ID NO: 117256 - protein, 11 aa, Artificial Sequence
  Description of Artificial Sequence: Synthetic peptide
  Seed: MELKVEDPFYW (MOG_HUMAN)
MALKVEDPFYW

SEQ ID NO: 117257 - protein, 10 aa, Artificial Sequence
  Description of Artificial Sequence: Synthetic peptide
  Seed: SSYAGQFRVI (MOG_HUMAN)
SLYAGQFRVW

SEQ ID NO: 117258 - protein, 9 aa, Artificial Sequence
  Description of Artificial Sequence: Synthetic peptide
  Seed: EEAAMELKV (MOG_HUMAN)
EQAAMELKW

SEQ ID NO: 117259 - protein, 9 aa, Artificial Sequence
  Description of Artificial Sequence: Synthetic peptide
  Seed: VIVPVLGPL (MOG_HUMAN)
VVVPVLGPV

SEQ ID NO: 117260 - protein, 9 aa, Artificial Sequence
  Description of Artificial Sequence: Synthetic peptide
  Seed: AIGEGKVTL (MOG_HUMAN)
ATGEGKVTI

SEQ ID NO: 117261 - protein, 9 aa, Artificial Sequence
  Description of Artificial Sequence: Synthetic peptide
  Seed: YRPPFSRVV (MOG_HUMAN)
YFPPFSRVH

SEQ ID NO: 117262 - protein, 10 aa, Artificial Sequence
  Description of Artificial Sequence: Synthetic peptide
  Seed: ICYNWLHRRL (MOG_HUMAN)
IFYNWLHRRF

SEQ ID NO: 117263 - protein, 9 aa, Artificial Sequence
  Description of Artificial Sequence: Synthetic peptide
  Seed: YQEEAAMEL (MOG_HUMAN)
YMEEAAMEA

SEQ ID NO: 117264 - protein, 10 aa, Artificial Sequence
  Description of Artificial Sequence: Synthetic peptide
  Seed: FLLLLLLQVS (MOG_HUMAN)
FLLLLLLQVI

SEQ ID NO: 117265 - protein, 10 aa, Artificial Sequence
  Description of Artificial Sequence: Synthetic peptide
  Seed: KITLFVIVPV (MOG_HUMAN)
KGTLFVIVPV

SEQ ID NO: 117266 - protein, 9 aa, Artificial Sequence
  Description of Artificial Sequence: Synthetic peptide
  Seed: LQVSSSYAG (MOG_HUMAN)
LVVSSSYAF

SEQ ID NO: 117267 - protein, 11 aa, Artificial Sequence
  Description of Artificial Sequence: Synthetic peptide
  Seed: MELKVEDPFYW (MOG_HUMAN)
MCLKVEDPFYW

SEQ ID NO: 117268 - protein, 10 aa, Artificial Sequence
  Description of Artificial Sequence: Synthetic peptide
  Seed: FTCFFRDHSY (MOG_HUMAN)
FPCFFRDHSF

SEQ ID NO: 117269 - protein, 9 aa, Artificial Sequence
  Description of Artificial Sequence: Synthetic peptide
  Seed: TGMEVGWYR (MOG_HUMAN)
TCMEVGWYR

SEQ ID NO: 117270 - protein, 9 aa, Artificial Sequence
  Description of Artificial Sequence: Synthetic peptide
  Seed: WVSPGVLVL (MOG_HUMAN)
WPSPGVLVW

SEQ ID NO: 117271 - protein, 9 aa, Artificial Sequence
  Description of Artificial Sequence: Synthetic peptide
  Seed: FSDEGGFTC (MOG_HUMAN)
FYDEGGFTV

SEQ ID NO: 117272 - protein, 9 aa, Artificial Sequence
  Description of Artificial Sequence: Synthetic peptide
  Seed: RRLAGQFLE (MOG_HUMAN)
RRLAGQFLK

SEQ ID NO: 117273 - protein, 10 aa, Artificial Sequence
  Description of Artificial Sequence: Synthetic peptide
  Seed: ELPCRISPGK (MOG_HUMAN)
ESPCRISPGR

SEQ ID NO: 117274 - protein, 9 aa, Artificial Sequence
  Description of Artificial Sequence: Synthetic peptide
  Seed: SSYAGQFRV (MOG_HUMAN)
SIYAGQFRL

SEQ ID NO: 117275 - protein, 10 aa, Artificial Sequence
  Description of Artificial Sequence: Synthetic peptide
  Seed: LQITVGLIFL (MOG_HUMAN)
LQITVGLIFF

SEQ ID NO: 117276 - protein, 9 aa, Artificial Sequence
  Description of Artificial Sequence: Synthetic peptide
  Seed: FSDEGGFTC (MOG_HUMAN)
FPDEGGFTV

SEQ ID NO: 117277 - protein, 8 aa, Artificial Sequence
  Description of Artificial Sequence: Synthetic peptide
  Seed: RIRNVRFS (MOG_HUMAN)
RTRNVRFF

SEQ ID NO: 117278 - protein, 8 aa, Artificial Sequence
  Description of Artificial Sequence: Synthetic peptide
  Seed: FSDEGGFT (MOG_HUMAN)
FLDEGGFM

SEQ ID NO: 117279 - protein, 9 aa, Artificial Sequence
  Description of Artificial Sequence: Synthetic peptide
  Seed: LQVSSSYAG (MOG_HUMAN)
LSVSSSYAM

SEQ ID NO: 117280 - protein, 9 aa, Artificial Sequence
  Description of Artificial Sequence: Synthetic peptide
  Seed: LAGQFLEEL (MOG_HUMAN)
LTGQFLEEF

SEQ ID NO: 117281 - protein, 9 aa, Artificial Sequence
  Description of Artificial Sequence: Synthetic peptide
  Seed: FLEELRNPF (MOG_HUMAN)
FVEELRNPV

SEQ ID NO: 117282 - protein, 10 aa, Artificial Sequence
  Description of Artificial Sequence: Synthetic peptide
  Seed: RVIGPRHPIR (MOG_HUMAN)
RGIGPRHPIK

SEQ ID NO: 117283 - protein, 9 aa, Artificial Sequence
  Description of Artificial Sequence: Synthetic peptide
  Seed: MELKVEDPF (MOG_HUMAN)
MRLKVEDPF

SEQ ID NO: 117284 - protein, 9 aa, Artificial Sequence
  Description of Artificial Sequence: Synthetic peptide
  Seed: ITVGLIFLC (MOG_HUMAN)
IVVGLIFLL

SEQ ID NO: 117285 - protein, 10 aa, Artificial Sequence
  Description of Artificial Sequence: Synthetic peptide
  Seed: RLAGQFLEEL (MOG_HUMAN)
RIAGQFLEEY

SEQ ID NO: 117286 - protein, 10 aa, Artificial Sequence
  Description of Artificial Sequence: Synthetic peptide
  Seed: VGWYRPPFSR (MOG_HUMAN)
VIWYRPPFSK

SEQ ID NO: 117287 - protein, 9 aa, Artificial Sequence
  Description of Artificial Sequence: Synthetic peptide
  Seed: VVHLYRNGK (MOG_HUMAN)
VTHLYRNGK

SEQ ID NO: 117288 - protein, 9 aa, Artificial Sequence
  Description of Artificial Sequence: Synthetic peptide
  Seed: RVIGPRHPI (MOG_HUMAN)
RGIGPRHPW

SEQ ID NO: 117289 - protein, 10 aa, Artificial Sequence
  Description of Artificial Sequence: Synthetic peptide
  Seed: RTFDPHFLRV (MOG_HUMAN)
RYFDPHFLRE

SEQ ID NO: 117290 - protein, 10 aa, Artificial Sequence
  Description of Artificial Sequence: Synthetic peptide
  Seed: RVIGPRHPIR (MOG_HUMAN)
RNIGPRHPIR

SEQ ID NO: 117291 - protein, 10 aa, Artificial Sequence
  Description of Artificial Sequence: Synthetic peptide
  Seed: SFLLLLLLQV (MOG_HUMAN)
SLLLLLLLQV

SEQ ID NO: 117292 - protein, 10 aa, Artificial Sequence
  Description of Artificial Sequence: Synthetic peptide
  Seed: FYWVSPGVLV (MOG_HUMAN)
FRWVSPGVLF

SEQ ID NO: 117293 - protein, 10 aa, Artificial Sequence
  Description of Artificial Sequence: Synthetic peptide
  Seed: TGMEVGWYRP (MOG_HUMAN)
TWMEVGWYRR

SEQ ID NO: 117294 - protein, 10 aa, Artificial Sequence
  Description of Artificial Sequence: Synthetic peptide
  Seed: WYRPPFSRVV (MOG_HUMAN)
WYRPPFSRVM

SEQ ID NO: 117295 - protein, 9 aa, Artificial Sequence
  Description of Artificial Sequence: Synthetic peptide
  Seed: RPPFSRVVH (MOG_HUMAN)
RPPFSRVVM

SEQ ID NO: 117296 - protein, 9 aa, Artificial Sequence
  Description of Artificial Sequence: Synthetic peptide
  Seed: YWVSPGVLV (MOG_HUMAN)
YYVSPGVLM

SEQ ID NO: 117297 - protein, 10 aa, Artificial Sequence
  Description of Artificial Sequence: Synthetic peptide
  Seed: ITLFVIVPVL (MOG_HUMAN)
ISLFVIVPVY

SEQ ID NO: 117298 - protein, 9 aa, Artificial Sequence
  Description of Artificial Sequence: Synthetic peptide
  Seed: EVGWYRPPF (MOG_HUMAN)
EIGWYRPPR

SEQ ID NO: 117299 - protein, 9 aa, Artificial Sequence
  Description of Artificial Sequence: Synthetic peptide
  Seed: VSPGVLVLL (MOG_HUMAN)
VFPGVLVLF

SEQ ID NO: 117300 - protein, 10 aa, Artificial Sequence
  Description of Artificial Sequence: Synthetic peptide
  Seed: AIGEGKVTLR (MOG_HUMAN)
AMGEGKVTLK

SEQ ID NO: 117301 - protein, 10 aa, Artificial Sequence
  Description of Artificial Sequence: Synthetic peptide
  Seed: SCLCSFLLLL (MOG_HUMAN)
SILCSFLLLI

SEQ ID NO: 117302 - protein, 9 aa, Artificial Sequence
  Description of Artificial Sequence: Synthetic peptide
  Seed: VSPGVLVLL (MOG_HUMAN)
VWPGVLVLF

SEQ ID NO: 117303 - protein, 10 aa, Artificial Sequence
  Description of Artificial Sequence: Synthetic peptide
  Seed: FSDEGGFTCF (MOG_HUMAN)
FVDEGGFTCM

SEQ ID NO: 117304 - protein, 11 aa, Artificial Sequence
  Description of Artificial Sequence: Synthetic peptide
  Seed: PPFSRVVHLYR (MOG_HUMAN)
PSFSRVVHLYR

SEQ ID NO: 117305 - protein, 10 aa, Artificial Sequence
  Description of Artificial Sequence: Synthetic peptide
  Seed: KVTLRIRNVR (MOG_HUMAN)
KQTLRIRNVR

SEQ ID NO: 117306 - protein, 10 aa, Artificial Sequence
  Description of Artificial Sequence: Synthetic peptide
  Seed: FSDEGGFTCF (MOG_HUMAN)
FGDEGGFTCM

SEQ ID NO: 117307 - protein, 9 aa, Artificial Sequence
  Description of Artificial Sequence: Synthetic peptide
  Seed: RPPFSRVVH (MOG_HUMAN)
RPPFSRVVI

SEQ ID NO: 117308 - protein, 9 aa, Artificial Sequence
  Description of Artificial Sequence: Synthetic peptide
  Seed: LLAVLPVLL (MOG_HUMAN)
LMAVLPVLA

SEQ ID NO: 117309 - protein, 10 aa, Artificial Sequence
  Description of Artificial Sequence: Synthetic peptide
  Seed: VGWYRPPFSR (MOG_HUMAN)
VFWYRPPFSR

SEQ ID NO: 117310 - protein, 9 aa, Artificial Sequence
  Description of Artificial Sequence: Synthetic peptide
  Seed: WVSPGVLVL (MOG_HUMAN)
WPSPGVLVV

SEQ ID NO: 117311 - protein, 10 aa, Artificial Sequence
  Description of Artificial Sequence: Synthetic peptide
  Seed: FDPHFLRVPC (MOG_HUMAN)
FSPHFLRVPP

SEQ ID NO: 117312 - protein, 9 aa, Artificial Sequence
  Description of Artificial Sequence: Synthetic peptide
  Seed: LAVLPVLLL (MOG_HUMAN)
LAVLPVLLW

SEQ ID NO: 117313 - protein, 9 aa, Artificial Sequence
  Description of Artificial Sequence: Synthetic peptide
  Seed: RIRNVRFSD (MOG_HUMAN)
RGRNVRFST

SEQ ID NO: 117314 - protein, 10 aa, Artificial Sequence
  Description of Artificial Sequence: Synthetic peptide
  Seed: SSYAGQFRVI (MOG_HUMAN)
STYAGQFRVY

SEQ ID NO: 117315 - protein, 10 aa, Artificial Sequence
  Description of Artificial Sequence: Synthetic peptide
  Seed: VPVLGPLVAL (MOG_HUMAN)
VMVLGPLVAY

SEQ ID NO: 117316 - protein, 9 aa, Artificial Sequence
  Description of Artificial Sequence: Synthetic peptide
  Seed: AIGEGKVTL (MOG_HUMAN)
AAGEGKVTL

SEQ ID NO: 117317 - protein, 10 aa, Artificial Sequence
  Description of Artificial Sequence: Synthetic peptide
  Seed: FSDEGGFTCF (MOG_HUMAN)
FMDEGGFTCI

SEQ ID NO: 117318 - protein, 9 aa, Artificial Sequence
  Description of Artificial Sequence: Synthetic peptide
  Seed: RTFDPHFLR (MOG_HUMAN)
RMFDPHFLA

SEQ ID NO: 117319 - protein, 9 aa, Artificial Sequence
  Description of Artificial Sequence: Synthetic peptide
  Seed: HSYQEEAAM (MOG_HUMAN)
HQYQEEAAY

SEQ ID NO: 117320 - protein, 10 aa, Artificial Sequence
  Description of Artificial Sequence: Synthetic peptide
  Seed: RTFDPHFLRV (MOG_HUMAN)
RIFDPHFLRN

SEQ ID NO: 117321 - protein, 9 aa, Artificial Sequence
  Description of Artificial Sequence: Synthetic peptide
  Seed: RIRNVRFSD (MOG_HUMAN)
RYRNVRFSL

SEQ ID NO: 117322 - protein, 10 aa, Artificial Sequence
  Description of Artificial Sequence: Synthetic peptide
  Seed: SFLLLLLLQV (MOG_HUMAN)
SMLLLLLLQV

SEQ ID NO: 117323 - protein, 9 aa, Artificial Sequence
  Description of Artificial Sequence: Synthetic peptide
  Seed: LQVSSSYAG (MOG_HUMAN)
LQVSSSYAM

SEQ ID NO: 117324 - protein, 8 aa, Artificial Sequence
  Description of Artificial Sequence: Synthetic peptide
  Seed: FSDEGGFT (MOG_HUMAN)
FFDEGGFL

SEQ ID NO: 117325 - protein, 11 aa, Artificial Sequence
  Description of Artificial Sequence: Synthetic peptide
  Seed: DAIGEGKVTLR (MOG_HUMAN)
DSIGEGKVTLR

SEQ ID NO: 117326 - protein, 10 aa, Artificial Sequence
  Description of Artificial Sequence: Synthetic peptide
  Seed: TGMEVGWYRP (MOG_HUMAN)
TFMEVGWYRG

SEQ ID NO: 117327 - protein, 9 aa, Artificial Sequence
  Description of Artificial Sequence: Synthetic peptide
  Seed: TFDPHFLRV (MOG_HUMAN)
TLDPHFLRI

SEQ ID NO: 117328 - protein, 10 aa, Artificial Sequence
  Description of Artificial Sequence: Synthetic peptide
  Seed: FVIVPVLGPL (MOG_HUMAN)
FMIVPVLGPM

SEQ ID NO: 117329 - protein, 10 aa, Artificial Sequence
  Description of Artificial Sequence: Synthetic peptide
  Seed: LVLLAVLPVL (MOG_HUMAN)
LRLLAVLPVL

SEQ ID NO: 117330 - protein, 9 aa, Artificial Sequence
  Description of Artificial Sequence: Synthetic peptide
  Seed: LAVLPVLLL (MOG_HUMAN)
LSVLPVLLL

SEQ ID NO: 117331 - protein, 9 aa, Artificial Sequence
  Description of Artificial Sequence: Synthetic peptide
  Seed: LSRPSLPSC (MOG_HUMAN)
LARPSLPSY

SEQ ID NO: 117332 - protein, 9 aa, Artificial Sequence
  Description of Artificial Sequence: Synthetic peptide
  Seed: TFDPHFLRV (MOG_HUMAN)
TWDPHFLRY

SEQ ID NO: 117333 - protein, 9 aa, Artificial Sequence
  Description of Artificial Sequence: Synthetic peptide
  Seed: YRPPFSRVV (MOG_HUMAN)
YYPPFSRVT

SEQ ID NO: 117334 - protein, 9 aa, Artificial Sequence
  Description of Artificial Sequence: Synthetic peptide
  Seed: LAVLPVLLL (MOG_HUMAN)
LTVLPVLLL

SEQ ID NO: 117335 - protein, 9 aa, Artificial Sequence
  Description of Artificial Sequence: Synthetic peptide
  Seed: LAGQFLEEL (MOG_HUMAN)
LMGQFLEEV

SEQ ID NO: 117336 - protein, 9 aa, Artificial Sequence
  Description of Artificial Sequence: Synthetic peptide
  Seed: LAGQFLEEL (MOG_HUMAN)
LMGQFLEEM

SEQ ID NO: 117337 - protein, 10 aa, Artificial Sequence
  Description of Artificial Sequence: Synthetic peptide
  Seed: SLSRPSLPSC (MOG_HUMAN)
SCSRPSLPSI

SEQ ID NO: 117338 - protein, 9 aa, Artificial Sequence
  Description of Artificial Sequence: Synthetic peptide
  Seed: SRPSLPSCL (MOG_HUMAN)
SHPSLPSCI

SEQ ID NO: 117339 - protein, 10 aa, Artificial Sequence
  Description of Artificial Sequence: Synthetic peptide
  Seed: LLLQVSSSYA (MOG_HUMAN)
LMLQVSSSYL

SEQ ID NO: 117340 - protein, 9 aa, Artificial Sequence
  Description of Artificial Sequence: Synthetic peptide
  Seed: GWYRPPFSR (MOG_HUMAN)
GTYRPPFSR

SEQ ID NO: 117341 - protein, 9 aa, Artificial Sequence
  Description of Artificial Sequence: Synthetic peptide
  Seed: LLLQITVGL (MOG_HUMAN)
LMLQITVGI

SEQ ID NO: 117342 - protein, 8 aa, Artificial Sequence
  Description of Artificial Sequence: Synthetic peptide
  Seed: IENLHRTF (MOG_HUMAN)
IENLHRTL

SEQ ID NO: 117343 - protein, 11 aa, Artificial Sequence
  Description of Artificial Sequence: Synthetic peptide
  Seed: RLAGQFLEELR (MOG_HUMAN)
RTAGQFLEELR

SEQ ID NO: 117344 - protein, 9 aa, Artificial Sequence
  Description of Artificial Sequence: Synthetic peptide
  Seed: LSRPSLPSC (MOG_HUMAN)
LARPSLPSV

SEQ ID NO: 117345 - protein, 10 aa, Artificial Sequence
  Description of Artificial Sequence: Synthetic peptide
  Seed: ISPGKNATGM (MOG_HUMAN)
IIPGKNATGL

SEQ ID NO: 117346 - protein, 9 aa, Artificial Sequence
  Description of Artificial Sequence: Synthetic peptide
  Seed: TFDPHFLRV (MOG_HUMAN)
TVDPHFLRV

SEQ ID NO: 117347 - protein, 9 aa, Artificial Sequence
  Description of Artificial Sequence: Synthetic peptide
  Seed: SCLCSFLLL (MOG_HUMAN)
SLLCSFLLA

SEQ ID NO: 117348 - protein, 9 aa, Artificial Sequence
  Description of Artificial Sequence: Synthetic peptide
  Seed: LAVLPVLLL (MOG_HUMAN)
LPVLPVLLV

SEQ ID NO: 117349 - protein, 10 aa, Artificial Sequence
  Description of Artificial Sequence: Synthetic peptide
  Seed: GPRHPIRALV (MOG_HUMAN)
GWRHPIRALL

SEQ ID NO: 117350 - protein, 11 aa, Artificial Sequence
  Description of Artificial Sequence: Synthetic peptide
  Seed: VIGPRHPIRAL (MOG_HUMAN)
VLGPRHPIRAL

SEQ ID NO: 117351 - protein, 10 aa, Artificial Sequence
  Description of Artificial Sequence: Synthetic peptide
  Seed: SLPSCLCSFL (MOG_HUMAN)
SIPSCLCSFL

SEQ ID NO: 117352 - protein, 10 aa, Artificial Sequence
  Description of Artificial Sequence: Synthetic peptide
  Seed: RTFDPHFLRV (MOG_HUMAN)
RMFDPHFLRF

SEQ ID NO: 117353 - protein, 10 aa, Artificial Sequence
  Description of Artificial Sequence: Synthetic peptide
  Seed: FVIVPVLGPL (MOG_HUMAN)
FLIVPVLGPS

SEQ ID NO: 117354 - protein, 10 aa, Artificial Sequence
  Description of Artificial Sequence: Synthetic peptide
  Seed: GPRHPIRALV (MOG_HUMAN)
GKRHPIRALL

SEQ ID NO: 117355 - protein, 10 aa, Artificial Sequence
  Description of Artificial Sequence: Synthetic peptide
  Seed: RLRGKLRAEI (MOG_HUMAN)
RLRGKLRAEV

SEQ ID NO: 117356 - protein, 9 aa, Artificial Sequence
  Description of Artificial Sequence: Synthetic peptide
  Seed: TFDPHFLRV (MOG_HUMAN)
TFDPHFLRY

SEQ ID NO: 117357 - protein, 10 aa, Artificial Sequence
  Description of Artificial Sequence: Synthetic peptide
  Seed: FLLLLLLQVS (MOG_HUMAN)
FTLLLLLQVV

SEQ ID NO: 117358 - protein, 10 aa, Artificial Sequence
  Description of Artificial Sequence: Synthetic peptide
  Seed: LLLQVSSSYA (MOG_HUMAN)
LMLQVSSSYM

SEQ ID NO: 117359 - protein, 9 aa, Artificial Sequence
  Description of Artificial Sequence: Synthetic peptide
  Seed: YRPPFSRVV (MOG_HUMAN)
YFPPFSRVY

SEQ ID NO: 117360 - protein, 11 aa, Artificial Sequence
  Description of Artificial Sequence: Synthetic peptide
  Seed: SSSYAGQFRVI (MOG_HUMAN)
SCSYAGQFRVF

SEQ ID NO: 117361 - protein, 9 aa, Artificial Sequence
  Description of Artificial Sequence: Synthetic peptide
  Seed: VPVLGPLVA (MOG_HUMAN)
VPVLGPLVF

SEQ ID NO: 117362 - protein, 8 aa, Artificial Sequence
  Description of Artificial Sequence: Synthetic peptide
  Seed: VLGPLVAL (MOG_HUMAN)
VSGPLVAL

SEQ ID NO: 117363 - protein, 10 aa, Artificial Sequence
  Description of Artificial Sequence: Synthetic peptide
  Seed: YWVSPGVLVL (MOG_HUMAN)
YLVSPGVLVF

SEQ ID NO: 117364 - protein, 8 aa, Artificial Sequence
  Description of Artificial Sequence: Synthetic peptide
  Seed: YAGQFRVI (MOG_HUMAN)
YSGQFRVL

SEQ ID NO: 117365 - protein, 9 aa, Artificial Sequence
  Description of Artificial Sequence: Synthetic peptide
  Seed: SSYAGQFRV (MOG_HUMAN)
SSYAGQFRM

SEQ ID NO: 117366 - protein, 10 aa, Artificial Sequence
  Description of Artificial Sequence: Synthetic peptide
  Seed: RVPCWKITLF (MOG_HUMAN)
RYPCWKITLI

SEQ ID NO: 117367 - protein, 9 aa, Artificial Sequence
  Description of Artificial Sequence: Synthetic peptide
  Seed: YRPPFSRVV (MOG_HUMAN)
YWPPFSRVF

SEQ ID NO: 117368 - protein, 10 aa, Artificial Sequence
  Description of Artificial Sequence: Synthetic peptide
  Seed: SLSRPSLPSC (MOG_HUMAN)
SASRPSLPSV

SEQ ID NO: 117369 - protein, 10 aa, Artificial Sequence
  Description of Artificial Sequence: Synthetic peptide
  Seed: RLRGKLRAEI (MOG_HUMAN)
RLRGKLRAEK

SEQ ID NO: 117370 - protein, 9 aa, Artificial Sequence
  Description of Artificial Sequence: Synthetic peptide
  Seed: LKVEDPFYW (MOG_HUMAN)
LNVEDPFYW

SEQ ID NO: 117371 - protein, 9 aa, Artificial Sequence
  Description of Artificial Sequence: Synthetic peptide
  Seed: FLEELRNPF (MOG_HUMAN)
FQEELRNPY

SEQ ID NO: 117372 - protein, 10 aa, Artificial Sequence
  Description of Artificial Sequence: Synthetic peptide
  Seed: WVSPGVLVLL (MOG_HUMAN)
WTSPGVLVLI

SEQ ID NO: 117373 - protein, 10 aa, Artificial Sequence
  Description of Artificial Sequence: Synthetic peptide
  Seed: FDPHFLRVPC (MOG_HUMAN)
FDPHFLRVPV

SEQ ID NO: 117374 - protein, 11 aa, Artificial Sequence
  Description of Artificial Sequence: Synthetic peptide
  Seed: DAIGEGKVTLR (MOG_HUMAN)
DMIGEGKVTLK

SEQ ID NO: 117375 - protein, 9 aa, Artificial Sequence
  Description of Artificial Sequence: Synthetic peptide
  Seed: LAGQFLEEL (MOG_HUMAN)
LTGQFLEEW

SEQ ID NO: 117376 - protein, 9 aa, Artificial Sequence
  Description of Artificial Sequence: Synthetic peptide
  Seed: RVPCWKITL (MOG_HUMAN)
RSPCWKITR

SEQ ID NO: 117377 - protein, 10 aa, Artificial Sequence
  Description of Artificial Sequence: Synthetic peptide
  Seed: RPPFSRVVHL (MOG_HUMAN)
RWPFSRVVHM

SEQ ID NO: 117378 - protein, 9 aa, Artificial Sequence
  Description of Artificial Sequence: Synthetic peptide
  Seed: IICYNWLHR (MOG_HUMAN)
IVCYNWLHR

SEQ ID NO: 117379 - protein, 10 aa, Artificial Sequence
  Description of Artificial Sequence: Synthetic peptide
  Seed: LIFLCLQYRL (MOG_HUMAN)
LLFLCLQYRR

SEQ ID NO: 117380 - protein, 11 aa, Artificial Sequence
  Description of Artificial Sequence: Synthetic peptide
  Seed: ELLKDAIGEGK (MOG_HUMAN)
EILKDAIGEGR

SEQ ID NO: 117381 - protein, 11 aa, Artificial Sequence
  Description of Artificial Sequence: Synthetic peptide
  Seed: HRTFDPHFLRV (MOG_HUMAN)
HYTFDPHFLRK

SEQ ID NO: 117382 - protein, 9 aa, Artificial Sequence
  Description of Artificial Sequence: Synthetic peptide
  Seed: VLGPLVALI (MOG_HUMAN)
VIGPLVALR

SEQ ID NO: 117383 - protein, 10 aa, Artificial Sequence
  Description of Artificial Sequence: Synthetic peptide
  Seed: SCLCSFLLLL (MOG_HUMAN)
SMLCSFLLLT

SEQ ID NO: 117384 - protein, 9 aa, Artificial Sequence
  Description of Artificial Sequence: Synthetic peptide
  Seed: SSYAGQFRV (MOG_HUMAN)
SIYAGQFRV

SEQ ID NO: 117385 - protein, 9 aa, Artificial Sequence
  Description of Artificial Sequence: Synthetic peptide
  Seed: LAGQFLEEL (MOG_HUMAN)
LAGQFLEEY

SEQ ID NO: 117386 - protein, 10 aa, Artificial Sequence
  Description of Artificial Sequence: Synthetic peptide
  Seed: RTFDPHFLRV (MOG_HUMAN)
RVFDPHFLRL

SEQ ID NO: 117387 - protein, 9 aa, Artificial Sequence
  Description of Artificial Sequence: Synthetic peptide
  Seed: SSYAGQFRV (MOG_HUMAN)
SAYAGQFRR

SEQ ID NO: 117388 - protein, 11 aa, Artificial Sequence
  Description of Artificial Sequence: Synthetic peptide
  Seed: MELKVEDPFYW (MOG_HUMAN)
MSLKVEDPFYF

SEQ ID NO: 117389 - protein, 9 aa, Artificial Sequence
  Description of Artificial Sequence: Synthetic peptide
  Seed: SSYAGQFRV (MOG_HUMAN)
SEYAGQFRV

SEQ ID NO: 117390 - protein, 9 aa, Artificial Sequence
  Description of Artificial Sequence: Synthetic peptide
  Seed: TGMEVGWYR (MOG_HUMAN)
TGMEVGWYK

SEQ ID NO: 117391 - protein, 10 aa, Artificial Sequence
  Description of Artificial Sequence: Synthetic peptide
  Seed: FRVIGPRHPI (MOG_HUMAN)
FWVIGPRHPV

SEQ ID NO: 117392 - protein, 9 aa, Artificial Sequence
  Description of Artificial Sequence: Synthetic peptide
  Seed: LQVSSSYAG (MOG_HUMAN)
LLVSSSYAM

SEQ ID NO: 117393 - protein, 10 aa, Artificial Sequence
  Description of Artificial Sequence: Synthetic peptide
  Seed: FDPHFLRVPC (MOG_HUMAN)
FGPHFLRVPV

SEQ ID NO: 117394 - protein, 8 aa, Artificial Sequence
  Description of Artificial Sequence: Synthetic peptide
  Seed: LLAVLPVL (MOG_HUMAN)
LQAVLPVI

SEQ ID NO: 117395 - protein, 11 aa, Artificial Sequence
  Description of Artificial Sequence: Synthetic peptide
  Seed: KDQDGDQAPEY (MOG_HUMAN)
KMQDGDQAPEY

SEQ ID NO: 117396 - protein, 9 aa, Artificial Sequence
  Description of Artificial Sequence: Synthetic peptide
  Seed: MASLSRPSL (MOG_HUMAN)
MNSLSRPSY

SEQ ID NO: 117397 - protein, 9 aa, Artificial Sequence
  Description of Artificial Sequence: Synthetic peptide
  Seed: LAGQFLEEL (MOG_HUMAN)
LQGQFLEEV

SEQ ID NO: 117398 - protein, 10 aa, Artificial Sequence
  Description of Artificial Sequence: Synthetic peptide
  Seed: VLLLQITVGL (MOG_HUMAN)
VDLLQITVGV

SEQ ID NO: 117399 - protein, 10 aa, Artificial Sequence
  Description of Artificial Sequence: Synthetic peptide
  Seed: IGPRHPIRAL (MOG_HUMAN)
IGPRHPIRAI

SEQ ID NO: 117400 - protein, 9 aa, Artificial Sequence
  Description of Artificial Sequence: Synthetic peptide
  Seed: TGMEVGWYR (MOG_HUMAN)
TMMEVGWYR

SEQ ID NO: 117401 - protein, 8 aa, Artificial Sequence
  Description of Artificial Sequence: Synthetic peptide
  Seed: FSDEGGFT (MOG_HUMAN)
FCDEGGFL

SEQ ID NO: 117402 - protein, 11 aa, Artificial Sequence
  Description of Artificial Sequence: Synthetic peptide
  Seed: RISPGKNATGM (MOG_HUMAN)
RPSPGKNATGI

SEQ ID NO: 117403 - protein, 10 aa, Artificial Sequence
  Description of Artificial Sequence: Synthetic peptide
  Seed: FLLLLLLQVS (MOG_HUMAN)
FRLLLLLQVV

SEQ ID NO: 117404 - protein, 10 aa, Artificial Sequence
  Description of Artificial Sequence: Synthetic peptide
  Seed: YWVSPGVLVL (MOG_HUMAN)
YWVSPGVLVW

SEQ ID NO: 117405 - protein, 9 aa, Artificial Sequence
  Description of Artificial Sequence: Synthetic peptide
  Seed: GQFRVIGPR (MOG_HUMAN)
GMFRVIGPR

SEQ ID NO: 117406 - protein, 11 aa, Artificial Sequence
  Description of Artificial Sequence: Synthetic peptide
  Seed: VIGPRHPIRAL (MOG_HUMAN)
VMGPRHPIRAL

SEQ ID NO: 117407 - protein, 9 aa, Artificial Sequence
  Description of Artificial Sequence: Synthetic peptide
  Seed: LIFLCLQYR (MOG_HUMAN)
LYFLCLQYR

SEQ ID NO: 117408 - protein, 8 aa, Artificial Sequence
  Description of Artificial Sequence: Synthetic peptide
  Seed: VTLRIRNV (MOG_HUMAN)
VQLRIRNL

SEQ ID NO: 117409 - protein, 10 aa, Artificial Sequence
  Description of Artificial Sequence: Synthetic peptide
  Seed: TGMEVGWYRP (MOG_HUMAN)
TVMEVGWYRD

SEQ ID NO: 117410 - protein, 9 aa, Artificial Sequence
  Description of Artificial Sequence: Synthetic peptide
  Seed: RAEIENLHR (MOG_HUMAN)
RLEIENLHY

SEQ ID NO: 117411 - protein, 10 aa, Artificial Sequence
  Description of Artificial Sequence: Synthetic peptide
  Seed: FSRVVHLYRN (MOG_HUMAN)
FYRVVHLYRR

SEQ ID NO: 117412 - protein, 10 aa, Artificial Sequence
  Description of Artificial Sequence: Synthetic peptide
  Seed: RTFDPHFLRV (MOG_HUMAN)
RIFDPHFLRC

SEQ ID NO: 117413 - protein, 11 aa, Artificial Sequence
  Description of Artificial Sequence: Synthetic peptide
  Seed: RLAGQFLEELR (MOG_HUMAN)
RMAGQFLEELR

SEQ ID NO: 117414 - protein, 11 aa, Artificial Sequence
  Description of Artificial Sequence: Synthetic peptide
  Seed: KDAIGEGKVTL (MOG_HUMAN)
KEAIGEGKVTF

SEQ ID NO: 117415 - protein, 9 aa, Artificial Sequence
  Description of Artificial Sequence: Synthetic peptide
  Seed: FYWVSPGVL (MOG_HUMAN)
FQWVSPGVF

SEQ ID NO: 117416 - protein, 9 aa, Artificial Sequence
  Description of Artificial Sequence: Synthetic peptide
  Seed: LQITVGLIF (MOG_HUMAN)
LNITVGLIF

SEQ ID NO: 117417 - protein, 10 aa, Artificial Sequence
  Description of Artificial Sequence: Synthetic peptide
  Seed: VLLLQITVGL (MOG_HUMAN)
VILLQITVGV

SEQ ID NO: 117418 - protein, 10 aa, Artificial Sequence
  Description of Artificial Sequence: Synthetic peptide
  Seed: MEVGWYRPPF (MOG_HUMAN)
MIVGWYRPPY

SEQ ID NO: 117419 - protein, 10 aa, Artificial Sequence
  Description of Artificial Sequence: Synthetic peptide
  Seed: HFLRVPCWKI (MOG_HUMAN)
HYLRVPCWKI

SEQ ID NO: 117420 - protein, 9 aa, Artificial Sequence
  Description of Artificial Sequence: Synthetic peptide
  Seed: TLFVIVPVL (MOG_HUMAN)
TMFVIVPVI

SEQ ID NO: 117421 - protein, 10 aa, Artificial Sequence
  Description of Artificial Sequence: Synthetic peptide
  Seed: FDPHFLRVPC (MOG_HUMAN)
FVPHFLRVPF

SEQ ID NO: 117422 - protein, 9 aa, Artificial Sequence
  Description of Artificial Sequence: Synthetic peptide
  Seed: MELKVEDPF (MOG_HUMAN)
MELKVEDPM

SEQ ID NO: 117423 - protein, 10 aa, Artificial Sequence
  Description of Artificial Sequence: Synthetic peptide
  Seed: DAIGEGKVTL (MOG_HUMAN)
DAIGEGKVTK

SEQ ID NO: 117424 - protein, 9 aa, Artificial Sequence
  Description of Artificial Sequence: Synthetic peptide
  Seed: VSSSYAGQF (MOG_HUMAN)
VYSSYAGQY

SEQ ID NO: 117425 - protein, 11 aa, Artificial Sequence
  Description of Artificial Sequence: Synthetic peptide
  Seed: FSDEGGFTCFF (MOG_HUMAN)
FGDEGGFTCFL

SEQ ID NO: 117426 - protein, 9 aa, Artificial Sequence
  Description of Artificial Sequence: Synthetic peptide
  Seed: MASLSRPSL (MOG_HUMAN)
MWSLSRPSY

SEQ ID NO: 117427 - protein, 8 aa, Artificial Sequence
  Description of Artificial Sequence: Synthetic peptide
  Seed: DEVELPCR (MOG_HUMAN)
DEVELPCF

SEQ ID NO: 117428 - protein, 9 aa, Artificial Sequence
  Description of Artificial Sequence: Synthetic peptide
  Seed: FYWVSPGVL (MOG_HUMAN)
FWWVSPGVM

SEQ ID NO: 117429 - protein, 9 aa, Artificial Sequence
  Description of Artificial Sequence: Synthetic peptide
  Seed: FLEELRNPF (MOG_HUMAN)
FFEELRNPM

SEQ ID NO: 117430 - protein, 9 aa, Artificial Sequence
  Description of Artificial Sequence: Synthetic peptide
  Seed: VLLAVLPVL (MOG_HUMAN)
VILAVLPVI

SEQ ID NO: 117431 - protein, 9 aa, Artificial Sequence
  Description of Artificial Sequence: Synthetic peptide
  Seed: LVLLAVLPV (MOG_HUMAN)
LLLLAVLPI

SEQ ID NO: 117432 - protein, 11 aa, Artificial Sequence
  Description of Artificial Sequence: Synthetic peptide
  Seed: LHRTFDPHFLR (MOG_HUMAN)
LFRTFDPHFLK

SEQ ID NO: 117433 - protein, 9 aa, Artificial Sequence
  Description of Artificial Sequence: Synthetic peptide
  Seed: HFLRVPCWK (MOG_HUMAN)
HFLRVPCWR

SEQ ID NO: 117434 - protein, 9 aa, Artificial Sequence
  Description of Artificial Sequence: Synthetic peptide
  Seed: VRFSDEGGF (MOG_HUMAN)
VKFSDEGGY

SEQ ID NO: 117435 - protein, 11 aa, Artificial Sequence
  Description of Artificial Sequence: Synthetic peptide
  Seed: LIFLCLQYRLR (MOG_HUMAN)
LSFLCLQYRLR

SEQ ID NO: 117436 - protein, 10 aa, Artificial Sequence
  Description of Artificial Sequence: Synthetic peptide
  Seed: RTFDPHFLRV (MOG_HUMAN)
RSFDPHFLRG

SEQ ID NO: 117437 - protein, 11 aa, Artificial Sequence
  Description of Artificial Sequence: Synthetic peptide
  Seed: LQVSSSYAGQF (MOG_HUMAN)
LKVSSSYAGQF

SEQ ID NO: 117438 - protein, 9 aa, Artificial Sequence
  Description of Artificial Sequence: Synthetic peptide
  Seed: SSYAGQFRV (MOG_HUMAN)
STYAGQFRM

SEQ ID NO: 117439 - protein, 9 aa, Artificial Sequence
  Description of Artificial Sequence: Synthetic peptide
  Seed: ALVGDEVEL (MOG_HUMAN)
AIVGDEVEF

SEQ ID NO: 117440 - protein, 9 aa, Artificial Sequence
  Description of Artificial Sequence: Synthetic peptide
  Seed: VVHLYRNGK (MOG_HUMAN)
VSHLYRNGK

SEQ ID NO: 117441 - protein, 9 aa, Artificial Sequence
  Description of Artificial Sequence: Synthetic peptide
  Seed: SSYAGQFRV (MOG_HUMAN)
SAYAGQFRI

SEQ ID NO: 117442 - protein, 9 aa, Artificial Sequence
  Description of Artificial Sequence: Synthetic peptide
  Seed: YRPPFSRVV (MOG_HUMAN)
YKPPFSRVL

SEQ ID NO: 117443 - protein, 9 aa, Artificial Sequence
  Description of Artificial Sequence: Synthetic peptide
  Seed: LQVSSSYAG (MOG_HUMAN)
LMVSSSYAH

SEQ ID NO: 117444 - protein, 10 aa, Artificial Sequence
  Description of Artificial Sequence: Synthetic peptide
  Seed: ATGMEVGWYR (MOG_HUMAN)
AYGMEVGWYR

SEQ ID NO: 117445 - protein, 9 aa, Artificial Sequence
  Description of Artificial Sequence: Synthetic peptide
  Seed: FLLLLLLQV (MOG_HUMAN)
FQLLLLLQV

SEQ ID NO: 117446 - protein, 9 aa, Artificial Sequence
  Description of Artificial Sequence: Synthetic peptide
  Seed: QEEAAMELK (MOG_HUMAN)
QSEAAMELY

SEQ ID NO: 117447 - protein, 10 aa, Artificial Sequence
  Description of Artificial Sequence: Synthetic peptide
  Seed: SLSRPSLPSC (MOG_HUMAN)
SMSRPSLPSV

SEQ ID NO: 117448 - protein, 9 aa, Artificial Sequence
  Description of Artificial Sequence: Synthetic peptide
  Seed: RRLAGQFLE (MOG_HUMAN)
RRLAGQFLS

SEQ ID NO: 117449 - protein, 11 aa, Artificial Sequence
  Description of Artificial Sequence: Synthetic peptide
  Seed: RIRNVRFSDEG (MOG_HUMAN)
RYRNVRFSDEA

SEQ ID NO: 117450 - protein, 10 aa, Artificial Sequence
  Description of Artificial Sequence: Synthetic peptide
  Seed: WVSPGVLVLL (MOG_HUMAN)
WMSPGVLVLM

SEQ ID NO: 117451 - protein, 11 aa, Artificial Sequence
  Description of Artificial Sequence: Synthetic peptide
  Seed: VRFSDEGGFTC (MOG_HUMAN)
VHFSDEGGFTL

SEQ ID NO: 117452 - protein, 9 aa, Artificial Sequence
  Description of Artificial Sequence: Synthetic peptide
  Seed: FYWVSPGVL (MOG_HUMAN)
FVWVSPGVY

SEQ ID NO: 117453 - protein, 9 aa, Artificial Sequence
  Description of Artificial Sequence: Synthetic peptide
  Seed: LAGQFLEEL (MOG_HUMAN)
LIGQFLEEI

SEQ ID NO: 117454 - protein, 10 aa, Artificial Sequence
  Description of Artificial Sequence: Synthetic peptide
  Seed: LVLLAVLPVL (MOG_HUMAN)
LILLAVLPVI

SEQ ID NO: 117455 - protein, 8 aa, Artificial Sequence
  Description of Artificial Sequence: Synthetic peptide
  Seed: FSDEGGFT (MOG_HUMAN)
FTDEGGFM

SEQ ID NO: 117456 - protein, 9 aa, Artificial Sequence
  Description of Artificial Sequence: Synthetic peptide
  Seed: ALVGDEVEL (MOG_HUMAN)
AMVGDEVEV

SEQ ID NO: 117457 - protein, 9 aa, Artificial Sequence
  Description of Artificial Sequence: Synthetic peptide
  Seed: SRPSLPSCL (MOG_HUMAN)
SWPSLPSCM

SEQ ID NO: 117458 - protein, 9 aa, Artificial Sequence
  Description of Artificial Sequence: Synthetic peptide
  Seed: RVPCWKITL (MOG_HUMAN)
RSPCWKITW

SEQ ID NO: 117459 - protein, 9 aa, Artificial Sequence
  Description of Artificial Sequence: Synthetic peptide
  Seed: YWVSPGVLV (MOG_HUMAN)
YFVSPGVLI

SEQ ID NO: 117460 - protein, 9 aa, Artificial Sequence
  Description of Artificial Sequence: Synthetic peptide
  Seed: SSYAGQFRV (MOG_HUMAN)
STYAGQFRW

SEQ ID NO: 117461 - protein, 10 aa, Artificial Sequence
  Description of Artificial Sequence: Synthetic peptide
  Seed: GPRHPIRALV (MOG_HUMAN)
GRRHPIRALL

SEQ ID NO: 117462 - protein, 9 aa, Artificial Sequence
  Description of Artificial Sequence: Synthetic peptide
  Seed: LSRPSLPSC (MOG_HUMAN)
LGRPSLPSY

SEQ ID NO: 117463 - protein, 9 aa, Artificial Sequence
  Description of Artificial Sequence: Synthetic peptide
  Seed: TCFFRDHSY (MOG_HUMAN)
TPFFRDHSM

SEQ ID NO: 117464 - protein, 9 aa, Artificial Sequence
  Description of Artificial Sequence: Synthetic peptide
  Seed: VSPGVLVLL (MOG_HUMAN)
VVPGVLVLY

SEQ ID NO: 117465 - protein, 10 aa, Artificial Sequence
  Description of Artificial Sequence: Synthetic peptide
  Seed: RVPCWKITLF (MOG_HUMAN)
RFPCWKITLF

SEQ ID NO: 117466 - protein, 10 aa, Artificial Sequence
  Description of Artificial Sequence: Synthetic peptide
  Seed: IGPRHPIRAL (MOG_HUMAN)
IHPRHPIRAF

SEQ ID NO: 117467 - protein, 10 aa, Artificial Sequence
  Description of Artificial Sequence: Synthetic peptide
  Seed: VSSSYAGQFR (MOG_HUMAN)
VMSSYAGQFR

SEQ ID NO: 117468 - protein, 10 aa, Artificial Sequence
  Description of Artificial Sequence: Synthetic peptide
  Seed: RVPCWKITLF (MOG_HUMAN)
RFPCWKITLI

SEQ ID NO: 117469 - protein, 10 aa, Artificial Sequence
  Description of Artificial Sequence: Synthetic peptide
  Seed: FTCFFRDHSY (MOG_HUMAN)
FACFFRDHSF

SEQ ID NO: 117470 - protein, 10 aa, Artificial Sequence
  Description of Artificial Sequence: Synthetic peptide
  Seed: VLLAVLPVLL (MOG_HUMAN)
VTLAVLPVLV

SEQ ID NO: 117471 - protein, 10 aa, Artificial Sequence
  Description of Artificial Sequence: Synthetic peptide
  Seed: FLLLLLLQVS (MOG_HUMAN)
FSLLLLLQVV

SEQ ID NO: 117472 - protein, 9 aa, Artificial Sequence
  Description of Artificial Sequence: Synthetic peptide
  Seed: LIICYNWLH (MOG_HUMAN)
LNICYNWLR

SEQ ID NO: 117473 - protein, 9 aa, Artificial Sequence
  Description of Artificial Sequence: Synthetic peptide
  Seed: ALVGDEVEL (MOG_HUMAN)
AQVGDEVEY

SEQ ID NO: 117474 - protein, 10 aa, Artificial Sequence
  Description of Artificial Sequence: Synthetic peptide
  Seed: TGMEVGWYRP (MOG_HUMAN)
TMMEVGWYRR

SEQ ID NO: 117475 - protein, 10 aa, Artificial Sequence
  Description of Artificial Sequence: Synthetic peptide
  Seed: ISPGKNATGM (MOG_HUMAN)
IAPGKNATGM

SEQ ID NO: 117476 - protein, 11 aa, Artificial Sequence
  Description of Artificial Sequence: Synthetic peptide
  Seed: NATGMEVGWYR (MOG_HUMAN)
NRTGMEVGWYR

SEQ ID NO: 117477 - protein, 10 aa, Artificial Sequence
  Description of Artificial Sequence: Synthetic peptide
  Seed: SLSRPSLPSC (MOG_HUMAN)
SESRPSLPSI

SEQ ID NO: 117478 - protein, 9 aa, Artificial Sequence
  Description of Artificial Sequence: Synthetic peptide
  Seed: FSDEGGFTC (MOG_HUMAN)
FIDEGGFTA

SEQ ID NO: 117479 - protein, 9 aa, Artificial Sequence
  Description of Artificial Sequence: Synthetic peptide
  Seed: DQAPEYRGR (MOG_HUMAN)
DYAPEYRGR

SEQ ID NO: 117480 - protein, 10 aa, Artificial Sequence
  Description of Artificial Sequence: Synthetic peptide
  Seed: IGPRHPIRAL (MOG_HUMAN)
IQPRHPIRAI

SEQ ID NO: 117481 - protein, 9 aa, Artificial Sequence
  Description of Artificial Sequence: Synthetic peptide
  Seed: YRPPFSRVV (MOG_HUMAN)
YMPPFSRVL

SEQ ID NO: 117482 - protein, 9 aa, Artificial Sequence
  Description of Artificial Sequence: Synthetic peptide
  Seed: FSDEGGFTC (MOG_HUMAN)
FADEGGFTC

SEQ ID NO: 117483 - protein, 11 aa, Artificial Sequence
  Description of Artificial Sequence: Synthetic peptide
  Seed: FVIVPVLGPLV (MOG_HUMAN)
FMIVPVLGPLI

SEQ ID NO: 117484 - protein, 10 aa, Artificial Sequence
  Description of Artificial Sequence: Synthetic peptide
  Seed: RVVHLYRNGK (MOG_HUMAN)
RYVHLYRNGK

SEQ ID NO: 117485 - protein, 10 aa, Artificial Sequence
  Description of Artificial Sequence: Synthetic peptide
  Seed: LIFLCLQYRL (MOG_HUMAN)
LIFLCLQYRR

SEQ ID NO: 117486 - protein, 10 aa, Artificial Sequence
  Description of Artificial Sequence: Synthetic peptide
  Seed: LLLQVSSSYA (MOG_HUMAN)
LTLQVSSSYY

SEQ ID NO: 117487 - protein, 10 aa, Artificial Sequence
  Description of Artificial Sequence: Synthetic peptide
  Seed: FRVIGPRHPI (MOG_HUMAN)
FPVIGPRHPI

SEQ ID NO: 117488 - protein, 10 aa, Artificial Sequence
  Description of Artificial Sequence: Synthetic peptide
  Seed: FRVIGPRHPI (MOG_HUMAN)
FHVIGPRHPL

SEQ ID NO: 117489 - protein, 9 aa, Artificial Sequence
  Description of Artificial Sequence: Synthetic peptide
  Seed: LIICYNWLH (MOG_HUMAN)
LFICYNWLK

SEQ ID NO: 117490 - protein, 10 aa, Artificial Sequence
  Description of Artificial Sequence: Synthetic peptide
  Seed: KNATGMEVGW (MOG_HUMAN)
KTATGMEVGF

SEQ ID NO: 117491 - protein, 10 aa, Artificial Sequence
  Description of Artificial Sequence: Synthetic peptide
  Seed: SCLCSFLLLL (MOG_HUMAN)
SMLCSFLLLA

SEQ ID NO: 117492 - protein, 10 aa, Artificial Sequence
  Description of Artificial Sequence: Synthetic peptide
  Seed: AEIENLHRTF (MOG_HUMAN)
AEIENLHRTA

SEQ ID NO: 117493 - protein, 11 aa, Artificial Sequence
  Description of Artificial Sequence: Synthetic peptide
  Seed: SSSYAGQFRVI (MOG_HUMAN)
SNSYAGQFRVF

SEQ ID NO: 117494 - protein, 9 aa, Artificial Sequence
  Description of Artificial Sequence: Synthetic peptide
  Seed: LAGQFLEEL (MOG_HUMAN)
LTGQFLEEI

SEQ ID NO: 117495 - protein, 10 aa, Artificial Sequence
  Description of Artificial Sequence: Synthetic peptide
  Seed: LLLQVSSSYA (MOG_HUMAN)
LQLQVSSSYN

SEQ ID NO: 117496 - protein, 11 aa, Artificial Sequence
  Description of Artificial Sequence: Synthetic peptide
  Seed: VLVLLAVLPVL (MOG_HUMAN)
VCVLLAVLPVV

SEQ ID NO: 117497 - protein, 10 aa, Artificial Sequence
  Description of Artificial Sequence: Synthetic peptide
  Seed: YWVSPGVLVL (MOG_HUMAN)
YKVSPGVLVF

SEQ ID NO: 117498 - protein, 9 aa, Artificial Sequence
  Description of Artificial Sequence: Synthetic peptide
  Seed: KVEDPFYWV (MOG_HUMAN)
KLEDPFYWC

SEQ ID NO: 117499 - protein, 10 aa, Artificial Sequence
  Description of Artificial Sequence: Synthetic peptide
  Seed: VLLAVLPVLL (MOG_HUMAN)
VGLAVLPVLL

SEQ ID NO: 117500 - protein, 10 aa, Artificial Sequence
  Description of Artificial Sequence: Synthetic peptide
  Seed: RVVHLYRNGK (MOG_HUMAN)
RRVHLYRNGR

SEQ ID NO: 117501 - protein, 10 aa, Artificial Sequence
  Description of Artificial Sequence: Synthetic peptide
  Seed: RTFDPHFLRV (MOG_HUMAN)
RLFDPHFLRV

SEQ ID NO: 117502 - protein, 10 aa, Artificial Sequence
  Description of Artificial Sequence: Synthetic peptide
  Seed: SLSRPSLPSC (MOG_HUMAN)
SESRPSLPSK

SEQ ID NO: 117503 - protein, 9 aa, Artificial Sequence
  Description of Artificial Sequence: Synthetic peptide
  Seed: DQAPEYRGR (MOG_HUMAN)
DIAPEYRGR

SEQ ID NO: 117504 - protein, 8 aa, Artificial Sequence
  Description of Artificial Sequence: Synthetic peptide
  Seed: SRVVHLYR (MOG_HUMAN)
SFVVHLYR

SEQ ID NO: 117505 - protein, 9 aa, Artificial Sequence
  Description of Artificial Sequence: Synthetic peptide
  Seed: RRLAGQFLE (MOG_HUMAN)
RRLAGQFLF

SEQ ID NO: 117506 - protein, 10 aa, Artificial Sequence
  Description of Artificial Sequence: Synthetic peptide
  Seed: RLRGKLRAEI (MOG_HUMAN)
RSRGKLRAEI

SEQ ID NO: 117507 - protein, 9 aa, Artificial Sequence
  Description of Artificial Sequence: Synthetic peptide
  Seed: CLCSFLLLL (MOG_HUMAN)
CLCSFLLLI

SEQ ID NO: 117508 - protein, 9 aa, Artificial Sequence
  Description of Artificial Sequence: Synthetic peptide
  Seed: FSDEGGFTC (MOG_HUMAN)
FADEGGFTL

SEQ ID NO: 117509 - protein, 9 aa, Artificial Sequence
  Description of Artificial Sequence: Synthetic peptide
  Seed: LCSFLLLLL (MOG_HUMAN)
LSSFLLLLL

SEQ ID NO: 117510 - protein, 10 aa, Artificial Sequence
  Description of Artificial Sequence: Synthetic peptide
  Seed: FVIVPVLGPL (MOG_HUMAN)
FSIVPVLGPI

SEQ ID NO: 117511 - protein, 9 aa, Artificial Sequence
  Description of Artificial Sequence: Synthetic peptide
  Seed: LSRPSLPSC (MOG_HUMAN)
LVRPSLPSY

SEQ ID NO: 117512 - protein, 9 aa, Artificial Sequence
  Description of Artificial Sequence: Synthetic peptide
  Seed: MELKVEDPF (MOG_HUMAN)
MQLKVEDPI

SEQ ID NO: 117513 - protein, 9 aa, Artificial Sequence
  Description of Artificial Sequence: Synthetic peptide
  Seed: VPCWKITLF (MOG_HUMAN)
VACWKITLY

SEQ ID NO: 117514 - protein, 9 aa, Artificial Sequence
  Description of Artificial Sequence: Synthetic peptide
  Seed: RIRNVRFSD (MOG_HUMAN)
RLRNVRFSS

SEQ ID NO: 117515 - protein, 9 aa, Artificial Sequence
  Description of Artificial Sequence: Synthetic peptide
  Seed: TLFVIVPVL (MOG_HUMAN)
TMFVIVPVM

SEQ ID NO: 117516 - protein, 9 aa, Artificial Sequence
  Description of Artificial Sequence: Synthetic peptide
  Seed: VSSSYAGQF (MOG_HUMAN)
VSSSYAGQL

SEQ ID NO: 117517 - protein, 10 aa, Artificial Sequence
  Description of Artificial Sequence: Synthetic peptide
  Seed: FDPHFLRVPC (MOG_HUMAN)
FTPHFLRVPS

SEQ ID NO: 117518 - protein, 9 aa, Artificial Sequence
  Description of Artificial Sequence: Synthetic peptide
  Seed: FLEELRNPF (MOG_HUMAN)
FSEELRNPL

SEQ ID NO: 117519 - protein, 9 aa, Artificial Sequence
  Description of Artificial Sequence: Synthetic peptide
  Seed: RIRNVRFSD (MOG_HUMAN)
RTRNVRFSG

SEQ ID NO: 117520 - protein, 9 aa, Artificial Sequence
  Description of Artificial Sequence: Synthetic peptide
  Seed: SYAGQFRVI (MOG_HUMAN)
SRAGQFRVV

SEQ ID NO: 117521 - protein, 11 aa, Artificial Sequence
  Description of Artificial Sequence: Synthetic peptide
  Seed: RPSLPSCLCSF (MOG_HUMAN)
RPSLPSCLCSA

SEQ ID NO: 117522 - protein, 10 aa, Artificial Sequence
  Description of Artificial Sequence: Synthetic peptide
  Seed: VLGPLVALII (MOG_HUMAN)
VMGPLVALIV

SEQ ID NO: 117523 - protein, 11 aa, Artificial Sequence
  Description of Artificial Sequence: Synthetic peptide
  Seed: RRLAGQFLEEL (MOG_HUMAN)
RRLAGQFLEEM

SEQ ID NO: 117524 - protein, 10 aa, Artificial Sequence
  Description of Artificial Sequence: Synthetic peptide
  Seed: LLKDAIGEGK (MOG_HUMAN)
LVKDAIGEGR

SEQ ID NO: 117525 - protein, 9 aa, Artificial Sequence
  Description of Artificial Sequence: Synthetic peptide
  Seed: VLLAVLPVL (MOG_HUMAN)
VMLAVLPVT

SEQ ID NO: 117526 - protein, 11 aa, Artificial Sequence
  Description of Artificial Sequence: Synthetic peptide
  Seed: HRTFDPHFLRV (MOG_HUMAN)
HTTFDPHFLRK

SEQ ID NO: 117527 - protein, 10 aa, Artificial Sequence
  Description of Artificial Sequence: Synthetic peptide
  Seed: ITLFVIVPVL (MOG_HUMAN)
IELFVIVPVV

SEQ ID NO: 117528 - protein, 10 aa, Artificial Sequence
  Description of Artificial Sequence: Synthetic peptide
  Seed: KITLFVIVPV (MOG_HUMAN)
KCTLFVIVPV

SEQ ID NO: 117529 - protein, 9 aa, Artificial Sequence
  Description of Artificial Sequence: Synthetic peptide
  Seed: SCLCSFLLL (MOG_HUMAN)
SSLCSFLLW

SEQ ID NO: 117530 - protein, 9 aa, Artificial Sequence
  Description of Artificial Sequence: Synthetic peptide
  Seed: FSDEGGFTC (MOG_HUMAN)
FIDEGGFTL

SEQ ID NO: 117531 - protein, 10 aa, Artificial Sequence
  Description of Artificial Sequence: Synthetic peptide
  Seed: LVALIICYNW (MOG_HUMAN)
LSALIICYNW

SEQ ID NO: 117532 - protein, 10 aa, Artificial Sequence
  Description of Artificial Sequence: Synthetic peptide
  Seed: PVLGPLVALI (MOG_HUMAN)
PMLGPLVALV

SEQ ID NO: 117533 - protein, 11 aa, Artificial Sequence
  Description of Artificial Sequence: Synthetic peptide
  Seed: RFSDEGGFTCF (MOG_HUMAN)
RTSDEGGFTCF

SEQ ID NO: 117534 - protein, 8 aa, Artificial Sequence
  Description of Artificial Sequence: Synthetic peptide
  Seed: YWVSPGVL (MOG_HUMAN)
YFVSPGVM

SEQ ID NO: 117535 - protein, 9 aa, Artificial Sequence
  Description of Artificial Sequence: Synthetic peptide
  Seed: YQEEAAMEL (MOG_HUMAN)
YIEEAAMEF

SEQ ID NO: 117536 - protein, 8 aa, Artificial Sequence
  Description of Artificial Sequence: Synthetic peptide
  Seed: LGPLVALI (MOG_HUMAN)
LPPLVALV

SEQ ID NO: 117537 - protein, 9 aa, Artificial Sequence
  Description of Artificial Sequence: Synthetic peptide
  Seed: VGDEVELPC (MOG_HUMAN)
VYDEVELPL

SEQ ID NO: 117538 - protein, 10 aa, Artificial Sequence
  Description of Artificial Sequence: Synthetic peptide
  Seed: LVLLAVLPVL (MOG_HUMAN)
LDLLAVLPVV

SEQ ID NO: 117539 - protein, 8 aa, Artificial Sequence
  Description of Artificial Sequence: Synthetic peptide
  Seed: RTFDPHFL (MOG_HUMAN)
RAFDPHFW

SEQ ID NO: 117540 - protein, 9 aa, Artificial Sequence
  Description of Artificial Sequence: Synthetic peptide
  Seed: LLLQVSSSY (MOG_HUMAN)
LMLQVSSSL

SEQ ID NO: 117541 - protein, 9 aa, Artificial Sequence
  Description of Artificial Sequence: Synthetic peptide
  Seed: KLRAEIENL (MOG_HUMAN)
KMRAEIENY

SEQ ID NO: 117542 - protein, 11 aa, Artificial Sequence
  Description of Artificial Sequence: Synthetic peptide
  Seed: RAEIENLHRTF (MOG_HUMAN)
RSEIENLHRTW

SEQ ID NO: 117543 - protein, 9 aa, Artificial Sequence
  Description of Artificial Sequence: Synthetic peptide
  Seed: RIRNVRFSD (MOG_HUMAN)
RWRNVRFSP

SEQ ID NO: 117544 - protein, 9 aa, Artificial Sequence
  Description of Artificial Sequence: Synthetic peptide
  Seed: TCFFRDHSY (MOG_HUMAN)
TAFFRDHSY

SEQ ID NO: 117545 - protein, 10 aa, Artificial Sequence
  Description of Artificial Sequence: Synthetic peptide
  Seed: FSDEGGFTCF (MOG_HUMAN)
FYDEGGFTCL

SEQ ID NO: 117546 - protein, 9 aa, Artificial Sequence
  Description of Artificial Sequence: Synthetic peptide
  Seed: RVPCWKITL (MOG_HUMAN)
RIPCWKITW

SEQ ID NO: 117547 - protein, 9 aa, Artificial Sequence
  Description of Artificial Sequence: Synthetic peptide
  Seed: GLIFLCLQY (MOG_HUMAN)
GAIFLCLQY

SEQ ID NO: 117548 - protein, 10 aa, Artificial Sequence
  Description of Artificial Sequence: Synthetic peptide
  Seed: CLCSFLLLLL (MOG_HUMAN)
CICSFLLLLV

SEQ ID NO: 117549 - protein, 9 aa, Artificial Sequence
  Description of Artificial Sequence: Synthetic peptide
  Seed: VIVPVLGPL (MOG_HUMAN)
VTVPVLGPI

SEQ ID NO: 117550 - protein, 9 aa, Artificial Sequence
  Description of Artificial Sequence: Synthetic peptide
  Seed: ITVGLIFLC (MOG_HUMAN)
ITVGLIFLW

SEQ ID NO: 117551 - protein, 10 aa, Artificial Sequence
  Description of Artificial Sequence: Synthetic peptide
  Seed: FVIVPVLGPL (MOG_HUMAN)
FCIVPVLGPA

SEQ ID NO: 117552 - protein, 10 aa, Artificial Sequence
  Description of Artificial Sequence: Synthetic peptide
  Seed: VPVLGPLVAL (MOG_HUMAN)
VPVLGPLVAV

SEQ ID NO: 117553 - protein, 9 aa, Artificial Sequence
  Description of Artificial Sequence: Synthetic peptide
  Seed: RTFDPHFLR (MOG_HUMAN)
RVFDPHFLV

SEQ ID NO: 117554 - protein, 9 aa, Artificial Sequence
  Description of Artificial Sequence: Synthetic peptide
  Seed: SSYAGQFRV (MOG_HUMAN)
SAYAGQFRL

SEQ ID NO: 117555 - protein, 9 aa, Artificial Sequence
  Description of Artificial Sequence: Synthetic peptide
  Seed: VIVPVLGPL (MOG_HUMAN)
VIVPVLGPV

SEQ ID NO: 117556 - protein, 11 aa, Artificial Sequence
  Description of Artificial Sequence: Synthetic peptide
  Seed: VIGPRHPIRAL (MOG_HUMAN)
VMGPRHPIRAM

SEQ ID NO: 117557 - protein, 10 aa, Artificial Sequence
  Description of Artificial Sequence: Synthetic peptide
  Seed: FVIVPVLGPL (MOG_HUMAN)
FNIVPVLGPV

SEQ ID NO: 117558 - protein, 9 aa, Artificial Sequence
  Description of Artificial Sequence: Synthetic peptide
  Seed: FLEELRNPF (MOG_HUMAN)
FYEELRNPF

SEQ ID NO: 117559 - protein, 9 aa, Artificial Sequence
  Description of Artificial Sequence: Synthetic peptide
  Seed: YWVSPGVLV (MOG_HUMAN)
YWVSPGVLL

SEQ ID NO: 117560 - protein, 11 aa, Artificial Sequence
  Description of Artificial Sequence: Synthetic peptide
  Seed: LHRTFDPHFLR (MOG_HUMAN)
LLRTFDPHFLR

SEQ ID NO: 117561 - protein, 9 aa, Artificial Sequence
  Description of Artificial Sequence: Synthetic peptide
  Seed: YRPPFSRVV (MOG_HUMAN)
YLPPFSRVY

SEQ ID NO: 117562 - protein, 9 aa, Artificial Sequence
  Description of Artificial Sequence: Synthetic peptide
  Seed: VLGPLVALI (MOG_HUMAN)
VRGPLVALV

SEQ ID NO: 117563 - protein, 9 aa, Artificial Sequence
  Description of Artificial Sequence: Synthetic peptide
  Seed: WVSPGVLVL (MOG_HUMAN)
WISPGVLVL

SEQ ID NO: 117564 - protein, 10 aa, Artificial Sequence
  Description of Artificial Sequence: Synthetic peptide
  Seed: SLSRPSLPSC (MOG_HUMAN)
SESRPSLPSV

SEQ ID NO: 117565 - protein, 9 aa, Artificial Sequence
  Description of Artificial Sequence: Synthetic peptide
  Seed: RIRNVRFSD (MOG_HUMAN)
RLRNVRFSF

SEQ ID NO: 117566 - protein, 9 aa, Artificial Sequence
  Description of Artificial Sequence: Synthetic peptide
  Seed: LAGQFLEEL (MOG_HUMAN)
LVGQFLEEL

SEQ ID NO: 117567 - protein, 10 aa, Artificial Sequence
  Description of Artificial Sequence: Synthetic peptide
  Seed: AEIENLHRTF (MOG_HUMAN)
AEIENLHRTM

SEQ ID NO: 117568 - protein, 9 aa, Artificial Sequence
  Description of Artificial Sequence: Synthetic peptide
  Seed: SCLCSFLLL (MOG_HUMAN)
SSLCSFLLV

SEQ ID NO: 117569 - protein, 10 aa, Artificial Sequence
  Description of Artificial Sequence: Synthetic peptide
  Seed: LQITVGLIFL (MOG_HUMAN)
LIITVGLIFV

SEQ ID NO: 117570 - protein, 11 aa, Artificial Sequence
  Description of Artificial Sequence: Synthetic peptide
  Seed: PPFSRVVHLYR (MOG_HUMAN)
PTFSRVVHLYR

SEQ ID NO: 117571 - protein, 9 aa, Artificial Sequence
  Description of Artificial Sequence: Synthetic peptide
  Seed: HSYQEEAAM (MOG_HUMAN)
HEYQEEAAF

SEQ ID NO: 117572 - protein, 9 aa, Artificial Sequence
  Description of Artificial Sequence: Synthetic peptide
  Seed: RIRNVRFSD (MOG_HUMAN)
RFRNVRFSM

SEQ ID NO: 117573 - protein, 10 aa, Artificial Sequence
  Description of Artificial Sequence: Synthetic peptide
  Seed: FDPHFLRVPC (MOG_HUMAN)
FGPHFLRVPF

SEQ ID NO: 117574 - protein, 10 aa, Artificial Sequence
  Description of Artificial Sequence: Synthetic peptide
  Seed: SLSRPSLPSC (MOG_HUMAN)
SGSRPSLPSV

SEQ ID NO: 117575 - protein, 9 aa, Artificial Sequence
  Description of Artificial Sequence: Synthetic peptide
  Seed: FYWVSPGVL (MOG_HUMAN)
FYWVSPGVW

SEQ ID NO: 117576 - protein, 9 aa, Artificial Sequence
  Description of Artificial Sequence: Synthetic peptide
  Seed: RIRNVRFSD (MOG_HUMAN)
RMRNVRFSN

SEQ ID NO: 117577 - protein, 10 aa, Artificial Sequence
  Description of Artificial Sequence: Synthetic peptide
  Seed: RLRGKLRAEI (MOG_HUMAN)
RTRGKLRAES

SEQ ID NO: 117578 - protein, 9 aa, Artificial Sequence
  Description of Artificial Sequence: Synthetic peptide
  Seed: YRPPFSRVV (MOG_HUMAN)
YIPPFSRVV

SEQ ID NO: 117579 - protein, 8 aa, Artificial Sequence
  Description of Artificial Sequence: Synthetic peptide
  Seed: IENLHRTF (MOG_HUMAN)
IQNLHRTF

SEQ ID NO: 117580 - protein, 9 aa, Artificial Sequence
  Description of Artificial Sequence: Synthetic peptide
  Seed: SRPSLPSCL (MOG_HUMAN)
SAPSLPSCF

SEQ ID NO: 117581 - protein, 9 aa, Artificial Sequence
  Description of Artificial Sequence: Synthetic peptide
  Seed: TLFVIVPVL (MOG_HUMAN)
TAFVIVPVY

SEQ ID NO: 117582 - protein, 10 aa, Artificial Sequence
  Description of Artificial Sequence: Synthetic peptide
  Seed: LIFLCLQYRL (MOG_HUMAN)
LTFLCLQYRK

SEQ ID NO: 117583 - protein, 10 aa, Artificial Sequence
  Description of Artificial Sequence: Synthetic peptide
  Seed: FSDEGGFTCF (MOG_HUMAN)
FCDEGGFTCI

SEQ ID NO: 117584 - protein, 9 aa, Artificial Sequence
  Description of Artificial Sequence: Synthetic peptide
  Seed: VSSSYAGQF (MOG_HUMAN)
VKSSYAGQF

SEQ ID NO: 117585 - protein, 9 aa, Artificial Sequence
  Description of Artificial Sequence: Synthetic peptide
  Seed: IFLCLQYRL (MOG_HUMAN)
IYLCLQYRW

SEQ ID NO: 117586 - protein, 9 aa, Artificial Sequence
  Description of Artificial Sequence: Synthetic peptide
  Seed: HRRLAGQFL (MOG_HUMAN)
HHRLAGQFA

SEQ ID NO: 117587 - protein, 9 aa, Artificial Sequence
  Description of Artificial Sequence: Synthetic peptide
  Seed: LQVSSSYAG (MOG_HUMAN)
LQVSSSYAY

SEQ ID NO: 117588 - protein, 10 aa, Artificial Sequence
  Description of Artificial Sequence: Synthetic peptide
  Seed: IGPRHPIRAL (MOG_HUMAN)
IKPRHPIRAM

SEQ ID NO: 117589 - protein, 9 aa, Artificial Sequence
  Description of Artificial Sequence: Synthetic peptide
  Seed: YRPPFSRVV (MOG_HUMAN)
YGPPFSRVY

SEQ ID NO: 117590 - protein, 10 aa, Artificial Sequence
  Description of Artificial Sequence: Synthetic peptide
  Seed: FSDEGGFTCF (MOG_HUMAN)
FVDEGGFTCI

SEQ ID NO: 117591 - protein, 10 aa, Artificial Sequence
  Description of Artificial Sequence: Synthetic peptide
  Seed: IGPRHPIRAL (MOG_HUMAN)
IWPRHPIRAL

SEQ ID NO: 117592 - protein, 10 aa, Artificial Sequence
  Description of Artificial Sequence: Synthetic peptide
  Seed: HRTFDPHFLR (MOG_HUMAN)
HDTFDPHFLY

SEQ ID NO: 117593 - protein, 8 aa, Artificial Sequence
  Description of Artificial Sequence: Synthetic peptide
  Seed: IENLHRTF (MOG_HUMAN)
IANLHRTY

SEQ ID NO: 117594 - protein, 9 aa, Artificial Sequence
  Description of Artificial Sequence: Synthetic peptide
  Seed: CLCSFLLLL (MOG_HUMAN)
CVCSFLLLL

SEQ ID NO: 117595 - protein, 10 aa, Artificial Sequence
  Description of Artificial Sequence: Synthetic peptide
  Seed: ISPGKNATGM (MOG_HUMAN)
ILPGKNATGL

SEQ ID NO: 117596 - protein, 9 aa, Artificial Sequence
  Description of Artificial Sequence: Synthetic peptide
  Seed: VLGPLVALI (MOG_HUMAN)
VMGPLVALM

SEQ ID NO: 117597 - protein, 11 aa, Artificial Sequence
  Description of Artificial Sequence: Synthetic peptide
  Seed: RISPGKNATGM (MOG_HUMAN)
RLSPGKNATGY

SEQ ID NO: 117598 - protein, 9 aa, Artificial Sequence
  Description of Artificial Sequence: Synthetic peptide
  Seed: SCLCSFLLL (MOG_HUMAN)
SALCSFLLV

SEQ ID NO: 117599 - protein, 10 aa, Artificial Sequence
  Description of Artificial Sequence: Synthetic peptide
  Seed: VGWYRPPFSR (MOG_HUMAN)
VWWYRPPFSR

SEQ ID NO: 117600 - protein, 10 aa, Artificial Sequence
  Description of Artificial Sequence: Synthetic peptide
  Seed: SLSRPSLPSC (MOG_HUMAN)
SYSRPSLPSM

SEQ ID NO: 117601 - protein, 11 aa, Artificial Sequence
  Description of Artificial Sequence: Synthetic peptide
  Seed: FSDEGGFTCFF (MOG_HUMAN)
FLDEGGFTCFI

SEQ ID NO: 117602 - protein, 10 aa, Artificial Sequence
  Description of Artificial Sequence: Synthetic peptide
  Seed: RTFDPHFLRV (MOG_HUMAN)
RQFDPHFLRI

SEQ ID NO: 117603 - protein, 9 aa, Artificial Sequence
  Description of Artificial Sequence: Synthetic peptide
  Seed: LLLQVSSSY (MOG_HUMAN)
LTLQVSSSF

SEQ ID NO: 117604 - protein, 9 aa, Artificial Sequence
  Description of Artificial Sequence: Synthetic peptide
  Seed: YRLRGKLRA (MOG_HUMAN)
YRLRGKLRV

SEQ ID NO: 117605 - protein, 10 aa, Artificial Sequence
  Description of Artificial Sequence: Synthetic peptide
  Seed: RTFDPHFLRV (MOG_HUMAN)
RWFDPHFLRA

SEQ ID NO: 117606 - protein, 10 aa, Artificial Sequence
  Description of Artificial Sequence: Synthetic peptide
  Seed: AEIENLHRTF (MOG_HUMAN)
AEIENLHRTC

SEQ ID NO: 117607 - protein, 9 aa, Artificial Sequence
  Description of Artificial Sequence: Synthetic peptide
  Seed: LIFLCLQYR (MOG_HUMAN)
LFFLCLQYK

SEQ ID NO: 117608 - protein, 8 aa, Artificial Sequence
  Description of Artificial Sequence: Synthetic peptide
  Seed: RIRNVRFS (MOG_HUMAN)
RVRNVRFK

SEQ ID NO: 117609 - protein, 10 aa, Artificial Sequence
  Description of Artificial Sequence: Synthetic peptide
  Seed: RLAGQFLEEL (MOG_HUMAN)
RMAGQFLEEM

SEQ ID NO: 117610 - protein, 10 aa, Artificial Sequence
  Description of Artificial Sequence: Synthetic peptide
  Seed: RTFDPHFLRV (MOG_HUMAN)
RQFDPHFLRD

SEQ ID NO: 117611 - protein, 9 aa, Artificial Sequence
  Description of Artificial Sequence: Synthetic peptide
  Seed: SSYAGQFRV (MOG_HUMAN)
SVYAGQFRW

SEQ ID NO: 117612 - protein, 10 aa, Artificial Sequence
  Description of Artificial Sequence: Synthetic peptide
  Seed: VGDEVELPCR (MOG_HUMAN)
VLDEVELPCY

SEQ ID NO: 117613 - protein, 8 aa, Artificial Sequence
  Description of Artificial Sequence: Synthetic peptide
  Seed: FSDEGGFT (MOG_HUMAN)
FADEGGFF

SEQ ID NO: 117614 - protein, 10 aa, Artificial Sequence
  Description of Artificial Sequence: Synthetic peptide
  Seed: IGPRHPIRAL (MOG_HUMAN)
ILPRHPIRAM

SEQ ID NO: 117615 - protein, 9 aa, Artificial Sequence
  Description of Artificial Sequence: Synthetic peptide
  Seed: WVSPGVLVL (MOG_HUMAN)
WTSPGVLVI

SEQ ID NO: 117616 - protein, 10 aa, Artificial Sequence
  Description of Artificial Sequence: Synthetic peptide
  Seed: SLSRPSLPSC (MOG_HUMAN)
SWSRPSLPSI

SEQ ID NO: 117617 - protein, 9 aa, Artificial Sequence
  Description of Artificial Sequence: Synthetic peptide
  Seed: LLLQVSSSY (MOG_HUMAN)
LRLQVSSSF

SEQ ID NO: 117618 - protein, 11 aa, Artificial Sequence
  Description of Artificial Sequence: Synthetic peptide
  Seed: DAIGEGKVTLR (MOG_HUMAN)
DLIGEGKVTLR

SEQ ID NO: 117619 - protein, 9 aa, Artificial Sequence
  Description of Artificial Sequence: Synthetic peptide
  Seed: RIRNVRFSD (MOG_HUMAN)
RVRNVRFSI

SEQ ID NO: 117620 - protein, 10 aa, Artificial Sequence
  Description of Artificial Sequence: Synthetic peptide
  Seed: SLSRPSLPSC (MOG_HUMAN)
SYSRPSLPSA

SEQ ID NO: 117621 - protein, 9 aa, Artificial Sequence
  Description of Artificial Sequence: Synthetic peptide
  Seed: TLRIRNVRF (MOG_HUMAN)
TARIRNVRL

SEQ ID NO: 117622 - protein, 11 aa, Artificial Sequence
  Description of Artificial Sequence: Synthetic peptide
  Seed: LVLLAVLPVLL (MOG_HUMAN)
LYLLAVLPVLL

SEQ ID NO: 117623 - protein, 9 aa, Artificial Sequence
  Description of Artificial Sequence: Synthetic peptide
  Seed: RVIGPRHPI (MOG_HUMAN)
RAIGPRHPW

SEQ ID NO: 117624 - protein, 10 aa, Artificial Sequence
  Description of Artificial Sequence: Synthetic peptide
  Seed: SCLCSFLLLL (MOG_HUMAN)
SVLCSFLLLV

SEQ ID NO: 117625 - protein, 9 aa, Artificial Sequence
  Description of Artificial Sequence: Synthetic peptide
  Seed: RTFDPHFLR (MOG_HUMAN)
RSFDPHFLW

SEQ ID NO: 117626 - protein, 10 aa, Artificial Sequence
  Description of Artificial Sequence: Synthetic peptide
  Seed: RTFDPHFLRV (MOG_HUMAN)
RYFDPHFLRF

SEQ ID NO: 117627 - protein, 11 aa, Artificial Sequence
  Description of Artificial Sequence: Synthetic peptide
  Seed: RFSDEGGFTCF (MOG_HUMAN)
RRSDEGGFTCL

SEQ ID NO: 117628 - protein, 9 aa, Artificial Sequence
  Description of Artificial Sequence: Synthetic peptide
  Seed: QDGDQAPEY (MOG_HUMAN)
QMGDQAPEY

SEQ ID NO: 117629 - protein, 8 aa, Artificial Sequence
  Description of Artificial Sequence: Synthetic peptide
  Seed: VPVLGPLV (MOG_HUMAN)
VPVLGPLA

SEQ ID NO: 117630 - protein, 11 aa, Artificial Sequence
  Description of Artificial Sequence: Synthetic peptide
  Seed: KITLFVIVPVL (MOG_HUMAN)
KMTLFVIVPVV

SEQ ID NO: 117631 - protein, 11 aa, Artificial Sequence
  Description of Artificial Sequence: Synthetic peptide
  Seed: RDHSYQEEAAM (MOG_HUMAN)
RLHSYQEEAAY

SEQ ID NO: 117632 - protein, 10 aa, Artificial Sequence
  Description of Artificial Sequence: Synthetic peptide
  Seed: TGMEVGWYRP (MOG_HUMAN)
TMMEVGWYRP

SEQ ID NO: 117633 - protein, 9 aa, Artificial Sequence
  Description of Artificial Sequence: Synthetic peptide
  Seed: SSYAGQFRV (MOG_HUMAN)
SLYAGQFRL

SEQ ID NO: 117634 - protein, 10 aa, Artificial Sequence
  Description of Artificial Sequence: Synthetic peptide
  Seed: WVSPGVLVLL (MOG_HUMAN)
WLSPGVLVLL

SEQ ID NO: 117635 - protein, 10 aa, Artificial Sequence
  Description of Artificial Sequence: Synthetic peptide
  Seed: RLAGQFLEEL (MOG_HUMAN)
RLAGQFLEEM

SEQ ID NO: 117636 - protein, 9 aa, Artificial Sequence
  Description of Artificial Sequence: Synthetic peptide
  Seed: IGEGKVTLR (MOG_HUMAN)
IIEGKVTLY

SEQ ID NO: 117637 - protein, 9 aa, Artificial Sequence
  Description of Artificial Sequence: Synthetic peptide
  Seed: DQAPEYRGR (MOG_HUMAN)
DTAPEYRGR

SEQ ID NO: 117638 - protein, 10 aa, Artificial Sequence
  Description of Artificial Sequence: Synthetic peptide
  Seed: VPVLGPLVAL (MOG_HUMAN)
VAVLGPLVAL

SEQ ID NO: 117639 - protein, 9 aa, Artificial Sequence
  Description of Artificial Sequence: Synthetic peptide
  Seed: RIRNVRFSD (MOG_HUMAN)
RIRNVRFSE

SEQ ID NO: 117640 - protein, 10 aa, Artificial Sequence
  Description of Artificial Sequence: Synthetic peptide
  Seed: RVPCWKITLF (MOG_HUMAN)
RSPCWKITLW

SEQ ID NO: 117641 - protein, 11 aa, Artificial Sequence
  Description of Artificial Sequence: Synthetic peptide
  Seed: LHRTFDPHFLR (MOG_HUMAN)
LHRTFDPHFLK

SEQ ID NO: 117642 - protein, 8 aa, Artificial Sequence
  Description of Artificial Sequence: Synthetic peptide
  Seed: GGFTCFFR (MOG_HUMAN)
GLFTCFFR

SEQ ID NO: 117643 - protein, 9 aa, Artificial Sequence
  Description of Artificial Sequence: Synthetic peptide
  Seed: SSYAGQFRV (MOG_HUMAN)
SIYAGQFRF

SEQ ID NO: 117644 - protein, 9 aa, Artificial Sequence
  Description of Artificial Sequence: Synthetic peptide
  Seed: VIVPVLGPL (MOG_HUMAN)
VMVPVLGPK

SEQ ID NO: 117645 - protein, 9 aa, Artificial Sequence
  Description of Artificial Sequence: Synthetic peptide
  Seed: ITLFVIVPV (MOG_HUMAN)
IMLFVIVPL

SEQ ID NO: 117646 - protein, 9 aa, Artificial Sequence
  Description of Artificial Sequence: Synthetic peptide
  Seed: LLAVLPVLL (MOG_HUMAN)
LQAVLPVLV

SEQ ID NO: 117647 - protein, 9 aa, Artificial Sequence
  Description of Artificial Sequence: Synthetic peptide
  Seed: MASLSRPSL (MOG_HUMAN)
MSSLSRPSF

SEQ ID NO: 117648 - protein, 10 aa, Artificial Sequence
  Description of Artificial Sequence: Synthetic peptide
  Seed: RPPFSRVVHL (MOG_HUMAN)
RTPFSRVVHL

SEQ ID NO: 117649 - protein, 9 aa, Artificial Sequence
  Description of Artificial Sequence: Synthetic peptide
  Seed: RVIGPRHPI (MOG_HUMAN)
RSIGPRHPF

SEQ ID NO: 117650 - protein, 9 aa, Artificial Sequence
  Description of Artificial Sequence: Synthetic peptide
  Seed: LLLQVSSSY (MOG_HUMAN)
LPLQVSSSY

SEQ ID NO: 117651 - protein, 9 aa, Artificial Sequence
  Description of Artificial Sequence: Synthetic peptide
  Seed: RIRNVRFSD (MOG_HUMAN)
RSRNVRFSA

SEQ ID NO: 117652 - protein, 9 aa, Artificial Sequence
  Description of Artificial Sequence: Synthetic peptide
  Seed: AIGEGKVTL (MOG_HUMAN)
AQGEGKVTY

SEQ ID NO: 117653 - protein, 10 aa, Artificial Sequence
  Description of Artificial Sequence: Synthetic peptide
  Seed: IGPRHPIRAL (MOG_HUMAN)
ICPRHPIRAI

SEQ ID NO: 117654 - protein, 9 aa, Artificial Sequence
  Description of Artificial Sequence: Synthetic peptide
  Seed: CLCSFLLLL (MOG_HUMAN)
CACSFLLLW

SEQ ID NO: 117655 - protein, 10 aa, Artificial Sequence
  Description of Artificial Sequence: Synthetic peptide
  Seed: YQEEAAMELK (MOG_HUMAN)
YSEEAAMELY

SEQ ID NO: 117656 - protein, 9 aa, Artificial Sequence
  Description of Artificial Sequence: Synthetic peptide
  Seed: SCLCSFLLL (MOG_HUMAN)
SSLCSFLLL

SEQ ID NO: 117657 - protein, 10 aa, Artificial Sequence
  Description of Artificial Sequence: Synthetic peptide
  Seed: TGMEVGWYRP (MOG_HUMAN)
TMMEVGWYRI

SEQ ID NO: 117658 - protein, 9 aa, Artificial Sequence
  Description of Artificial Sequence: Synthetic peptide
  Seed: LLLQVSSSY (MOG_HUMAN)
LELQVSSSF

SEQ ID NO: 117659 - protein, 11 aa, Artificial Sequence
  Description of Artificial Sequence: Synthetic peptide
  Seed: FSDEGGFTCFF (MOG_HUMAN)
FTDEGGFTCFI

SEQ ID NO: 117660 - protein, 10 aa, Artificial Sequence
  Description of Artificial Sequence: Synthetic peptide
  Seed: RIRNVRFSDE (MOG_HUMAN)
RSRNVRFSDY

SEQ ID NO: 117661 - protein, 9 aa, Artificial Sequence
  Description of Artificial Sequence: Synthetic peptide
  Seed: SCLCSFLLL (MOG_HUMAN)
SILCSFLLI

SEQ ID NO: 117662 - protein, 10 aa, Artificial Sequence
  Description of Artificial Sequence: Synthetic peptide
  Seed: RTFDPHFLRV (MOG_HUMAN)
RLFDPHFLRE

SEQ ID NO: 117663 - protein, 10 aa, Artificial Sequence
  Description of Artificial Sequence: Synthetic peptide
  Seed: SCLCSFLLLL (MOG_HUMAN)
SALCSFLLLV

SEQ ID NO: 117664 - protein, 9 aa, Artificial Sequence
  Description of Artificial Sequence: Synthetic peptide
  Seed: VGDEVELPC (MOG_HUMAN)
VVDEVELPI

SEQ ID NO: 117665 - protein, 9 aa, Artificial Sequence
  Description of Artificial Sequence: Synthetic peptide
  Seed: VIVPVLGPL (MOG_HUMAN)
VVVPVLGPM

SEQ ID NO: 117666 - protein, 9 aa, Artificial Sequence
  Description of Artificial Sequence: Synthetic peptide
  Seed: VIVPVLGPL (MOG_HUMAN)
VLVPVLGPA

SEQ ID NO: 117667 - protein, 10 aa, Artificial Sequence
  Description of Artificial Sequence: Synthetic peptide
  Seed: ITLFVIVPVL (MOG_HUMAN)
ICLFVIVPVV

SEQ ID NO: 117668 - protein, 10 aa, Artificial Sequence
  Description of Artificial Sequence: Synthetic peptide
  Seed: LSRPSLPSCL (MOG_HUMAN)
LSRPSLPSCK

SEQ ID NO: 117669 - protein, 10 aa, Artificial Sequence
  Description of Artificial Sequence: Synthetic peptide
  Seed: IGPRHPIRAL (MOG_HUMAN)
IYPRHPIRAL

SEQ ID NO: 117670 - protein, 9 aa, Artificial Sequence
  Description of Artificial Sequence: Synthetic peptide
  Seed: MASLSRPSL (MOG_HUMAN)
MTSLSRPSF

SEQ ID NO: 117671 - protein, 9 aa, Artificial Sequence
  Description of Artificial Sequence: Synthetic peptide
  Seed: RTFDPHFLR (MOG_HUMAN)
RKFDPHFLR

SEQ ID NO: 117672 - protein, 9 aa, Artificial Sequence
  Description of Artificial Sequence: Synthetic peptide
  Seed: TFDPHFLRV (MOG_HUMAN)
TCDPHFLRF

SEQ ID NO: 117673 - protein, 9 aa, Artificial Sequence
  Description of Artificial Sequence: Synthetic peptide
  Seed: KLRAEIENL (MOG_HUMAN)
KVRAEIENM

SEQ ID NO: 117674 - protein, 9 aa, Artificial Sequence
  Description of Artificial Sequence: Synthetic peptide
  Seed: LHRTFDPHF (MOG_HUMAN)
LQRTFDPHF

SEQ ID NO: 117675 - protein, 9 aa, Artificial Sequence
  Description of Artificial Sequence: Synthetic peptide
  Seed: ALVGDEVEL (MOG_HUMAN)
ASVGDEVEL

SEQ ID NO: 117676 - protein, 8 aa, Artificial Sequence
  Description of Artificial Sequence: Synthetic peptide
  Seed: FSDEGGFT (MOG_HUMAN)
FVDEGGFL

SEQ ID NO: 117677 - protein, 8 aa, Artificial Sequence
  Description of Artificial Sequence: Synthetic peptide
  Seed: TFDPHFLR (MOG_HUMAN)
TMDPHFLY

SEQ ID NO: 117678 - protein, 9 aa, Artificial Sequence
  Description of Artificial Sequence: Synthetic peptide
  Seed: SRPSLPSCL (MOG_HUMAN)
SLPSLPSCL

SEQ ID NO: 117679 - protein, 9 aa, Artificial Sequence
  Description of Artificial Sequence: Synthetic peptide
  Seed: CLCSFLLLL (MOG_HUMAN)
CTCSFLLLR

SEQ ID NO: 117680 - protein, 9 aa, Artificial Sequence
  Description of Artificial Sequence: Synthetic peptide
  Seed: FSDEGGFTC (MOG_HUMAN)
FWDEGGFTI

SEQ ID NO: 117681 - protein, 9 aa, Artificial Sequence
  Description of Artificial Sequence: Synthetic peptide
  Seed: RRLAGQFLE (MOG_HUMAN)
RQLAGQFLV

SEQ ID NO: 117682 - protein, 9 aa, Artificial Sequence
  Description of Artificial Sequence: Synthetic peptide
  Seed: RTFDPHFLR (MOG_HUMAN)
RFFDPHFLY

SEQ ID NO: 117683 - protein, 10 aa, Artificial Sequence
  Description of Artificial Sequence: Synthetic peptide
  Seed: KNATGMEVGW (MOG_HUMAN)
KEATGMEVGW

SEQ ID NO: 117684 - protein, 10 aa, Artificial Sequence
  Description of Artificial Sequence: Synthetic peptide
  Seed: HRTFDPHFLR (MOG_HUMAN)
HITFDPHFLK

SEQ ID NO: 117685 - protein, 9 aa, Artificial Sequence
  Description of Artificial Sequence: Synthetic peptide
  Seed: ICYNWLHRR (MOG_HUMAN)
INYNWLHRR

SEQ ID NO: 117686 - protein, 9 aa, Artificial Sequence
  Description of Artificial Sequence: Synthetic peptide
  Seed: RVIGPRHPI (MOG_HUMAN)
RSIGPRHPL

SEQ ID NO: 117687 - protein, 10 aa, Artificial Sequence
  Description of Artificial Sequence: Synthetic peptide
  Seed: LLLLQVSSSY (MOG_HUMAN)
LFLLQVSSSY

SEQ ID NO: 117688 - protein, 10 aa, Artificial Sequence
  Description of Artificial Sequence: Synthetic peptide
  Seed: FVIVPVLGPL (MOG_HUMAN)
FDIVPVLGPI

SEQ ID NO: 117689 - protein, 11 aa, Artificial Sequence
  Description of Artificial Sequence: Synthetic peptide
  Seed: RIRNVRFSDEG (MOG_HUMAN)
RTRNVRFSDEA

SEQ ID NO: 117690 - protein, 9 aa, Artificial Sequence
  Description of Artificial Sequence: Synthetic peptide
  Seed: LLAVLPVLL (MOG_HUMAN)
LQAVLPVLF

SEQ ID NO: 117691 - protein, 9 aa, Artificial Sequence
  Description of Artificial Sequence: Synthetic peptide
  Seed: TLFVIVPVL (MOG_HUMAN)
TLFVIVPVV

SEQ ID NO: 117692 - protein, 9 aa, Artificial Sequence
  Description of Artificial Sequence: Synthetic peptide
  Seed: RIRNVRFSD (MOG_HUMAN)
RMRNVRFSV

SEQ ID NO: 117693 - protein, 10 aa, Artificial Sequence
  Description of Artificial Sequence: Synthetic peptide
  Seed: RLRGKLRAEI (MOG_HUMAN)
RTRGKLRAEI

SEQ ID NO: 117694 - protein, 11 aa, Artificial Sequence
  Description of Artificial Sequence: Synthetic peptide
  Seed: RFSDEGGFTCF (MOG_HUMAN)
RASDEGGFTCY

SEQ ID NO: 117695 - protein, 10 aa, Artificial Sequence
  Description of Artificial Sequence: Synthetic peptide
  Seed: MEVGWYRPPF (MOG_HUMAN)
MEVGWYRPPL

SEQ ID NO: 117696 - protein, 10 aa, Artificial Sequence
  Description of Artificial Sequence: Synthetic peptide
  Seed: RVIGPRHPIR (MOG_HUMAN)
RLIGPRHPIR

SEQ ID NO: 117697 - protein, 10 aa, Artificial Sequence
  Description of Artificial Sequence: Synthetic peptide
  Seed: PVLGPLVALI (MOG_HUMAN)
PILGPLVALV

SEQ ID NO: 117698 - protein, 9 aa, Artificial Sequence
  Description of Artificial Sequence: Synthetic peptide
  Seed: YRPPFSRVV (MOG_HUMAN)
YKPPFSRVM

SEQ ID NO: 117699 - protein, 9 aa, Artificial Sequence
  Description of Artificial Sequence: Synthetic peptide
  Seed: RIRNVRFSD (MOG_HUMAN)
RSRNVRFSE

SEQ ID NO: 117700 - protein, 10 aa, Artificial Sequence
  Description of Artificial Sequence: Synthetic peptide
  Seed: KNATGMEVGW (MOG_HUMAN)
KHATGMEVGW

SEQ ID NO: 117701 - protein, 10 aa, Artificial Sequence
  Description of Artificial Sequence: Synthetic peptide
  Seed: RALVGDEVEL (MOG_HUMAN)
RTLVGDEVEF

SEQ ID NO: 117702 - protein, 10 aa, Artificial Sequence
  Description of Artificial Sequence: Synthetic peptide
  Seed: GLIFLCLQYR (MOG_HUMAN)
GLIFLCLQYK

SEQ ID NO: 117703 - protein, 9 aa, Artificial Sequence
  Description of Artificial Sequence: Synthetic peptide
  Seed: RIRNVRFSD (MOG_HUMAN)
RMRNVRFSH

SEQ ID NO: 117704 - protein, 9 aa, Artificial Sequence
  Description of Artificial Sequence: Synthetic peptide
  Seed: WVSPGVLVL (MOG_HUMAN)
WLSPGVLVI

SEQ ID NO: 117705 - protein, 10 aa, Artificial Sequence
  Description of Artificial Sequence: Synthetic peptide
  Seed: WYRPPFSRVV (MOG_HUMAN)
WFRPPFSRVY

SEQ ID NO: 117706 - protein, 9 aa, Artificial Sequence
  Description of Artificial Sequence: Synthetic peptide
  Seed: FYWVSPGVL (MOG_HUMAN)
FAWVSPGVL

SEQ ID NO: 117707 - protein, 9 aa, Artificial Sequence
  Description of Artificial Sequence: Synthetic peptide
  Seed: LAGQFLEEL (MOG_HUMAN)
LQGQFLEEL

SEQ ID NO: 117708 - protein, 9 aa, Artificial Sequence
  Description of Artificial Sequence: Synthetic peptide
  Seed: RIRNVRFSD (MOG_HUMAN)
RYRNVRFSH

SEQ ID NO: 117709 - protein, 9 aa, Artificial Sequence
  Description of Artificial Sequence: Synthetic peptide
  Seed: RTFDPHFLR (MOG_HUMAN)
RDFDPHFLY

SEQ ID NO: 117710 - protein, 9 aa, Artificial Sequence
  Description of Artificial Sequence: Synthetic peptide
  Seed: HSYQEEAAM (MOG_HUMAN)
HQYQEEAAI

SEQ ID NO: 117711 - protein, 10 aa, Artificial Sequence
  Description of Artificial Sequence: Synthetic peptide
  Seed: RVIGPRHPIR (MOG_HUMAN)
RMIGPRHPIR

SEQ ID NO: 117712 - protein, 10 aa, Artificial Sequence
  Description of Artificial Sequence: Synthetic peptide
  Seed: FDPHFLRVPC (MOG_HUMAN)
FIPHFLRVPP

SEQ ID NO: 117713 - protein, 9 aa, Artificial Sequence
  Description of Artificial Sequence: Synthetic peptide
  Seed: RIRNVRFSD (MOG_HUMAN)
RGRNVRFSI

SEQ ID NO: 117714 - protein, 9 aa, Artificial Sequence
  Description of Artificial Sequence: Synthetic peptide
  Seed: VLGPLVALI (MOG_HUMAN)
VSGPLVALI

SEQ ID NO: 117715 - protein, 9 aa, Artificial Sequence
  Description of Artificial Sequence: Synthetic peptide
  Seed: GQFRVIGPR (MOG_HUMAN)
GWFRVIGPR

SEQ ID NO: 117716 - protein, 10 aa, Artificial Sequence
  Description of Artificial Sequence: Synthetic peptide
  Seed: HRTFDPHFLR (MOG_HUMAN)
HETFDPHFLR

SEQ ID NO: 117717 - protein, 9 aa, Artificial Sequence
  Description of Artificial Sequence: Synthetic peptide
  Seed: WVSPGVLVL (MOG_HUMAN)
WISPGVLVY

SEQ ID NO: 117718 - protein, 9 aa, Artificial Sequence
  Description of Artificial Sequence: Synthetic peptide
  Seed: YRPPFSRVV (MOG_HUMAN)
YYPPFSRVH

SEQ ID NO: 117719 - protein, 10 aa, Artificial Sequence
  Description of Artificial Sequence: Synthetic peptide
  Seed: MEVGWYRPPF (MOG_HUMAN)
MEVGWYRPPW

SEQ ID NO: 117720 - protein, 10 aa, Artificial Sequence
  Description of Artificial Sequence: Synthetic peptide
  Seed: KVTLRIRNVR (MOG_HUMAN)
KTTLRIRNVR

SEQ ID NO: 117721 - protein, 10 aa, Artificial Sequence
  Description of Artificial Sequence: Synthetic peptide
  Seed: IFLCLQYRLR (MOG_HUMAN)
IWLCLQYRLR

SEQ ID NO: 117722 - protein, 11 aa, Artificial Sequence
  Description of Artificial Sequence: Synthetic peptide
  Seed: FSDEGGFTCFF (MOG_HUMAN)
FTDEGGFTCFW

SEQ ID NO: 117723 - protein, 8 aa, Artificial Sequence
  Description of Artificial Sequence: Synthetic peptide
  Seed: FSDEGGFT (MOG_HUMAN)
FVDEGGFI

SEQ ID NO: 117724 - protein, 10 aa, Artificial Sequence
  Description of Artificial Sequence: Synthetic peptide
  Seed: SLSRPSLPSC (MOG_HUMAN)
SKSRPSLPSL

SEQ ID NO: 117725 - protein, 9 aa, Artificial Sequence
  Description of Artificial Sequence: Synthetic peptide
  Seed: EGGFTCFFR (MOG_HUMAN)
EIGFTCFFR

SEQ ID NO: 117726 - protein, 9 aa, Artificial Sequence
  Description of Artificial Sequence: Synthetic peptide
  Seed: FYWVSPGVL (MOG_HUMAN)
FFWVSPGVI

SEQ ID NO: 117727 - protein, 9 aa, Artificial Sequence
  Description of Artificial Sequence: Synthetic peptide
  Seed: FSDEGGFTC (MOG_HUMAN)
FADEGGFTM

SEQ ID NO: 117728 - protein, 9 aa, Artificial Sequence
  Description of Artificial Sequence: Synthetic peptide
  Seed: RTFDPHFLR (MOG_HUMAN)
RFFDPHFLK

SEQ ID NO: 117729 - protein, 10 aa, Artificial Sequence
  Description of Artificial Sequence: Synthetic peptide
  Seed: VPVLGPLVAL (MOG_HUMAN)
VQVLGPLVAY

SEQ ID NO: 117730 - protein, 9 aa, Artificial Sequence
  Description of Artificial Sequence: Synthetic peptide
  Seed: LQITVGLIF (MOG_HUMAN)
LEITVGLIY

SEQ ID NO: 117731 - protein, 10 aa, Artificial Sequence
  Description of Artificial Sequence: Synthetic peptide
  Seed: AEIENLHRTF (MOG_HUMAN)
AHIENLHRTL

SEQ ID NO: 117732 - protein, 10 aa, Artificial Sequence
  Description of Artificial Sequence: Synthetic peptide
  Seed: LLQITVGLIF (MOG_HUMAN)
LFQITVGLIY

SEQ ID NO: 117733 - protein, 9 aa, Artificial Sequence
  Description of Artificial Sequence: Synthetic peptide
  Seed: RTFDPHFLR (MOG_HUMAN)
RCFDPHFLK

SEQ ID NO: 117734 - protein, 10 aa, Artificial Sequence
  Description of Artificial Sequence: Synthetic peptide
  Seed: FRVIGPRHPI (MOG_HUMAN)
FNVIGPRHPI

SEQ ID NO: 117735 - protein, 9 aa, Artificial Sequence
  Description of Artificial Sequence: Synthetic peptide
  Seed: LSRPSLPSC (MOG_HUMAN)
LSRPSLPSL

SEQ ID NO: 117736 - protein, 10 aa, Artificial Sequence
  Description of Artificial Sequence: Synthetic peptide
  Seed: YWVSPGVLVL (MOG_HUMAN)
YVVSPGVLVL

SEQ ID NO: 117737 - protein, 11 aa, Artificial Sequence
  Description of Artificial Sequence: Synthetic peptide
  Seed: RDHSYQEEAAM (MOG_HUMAN)
RVHSYQEEAAW

SEQ ID NO: 117738 - protein, 8 aa, Artificial Sequence
  Description of Artificial Sequence: Synthetic peptide
  Seed: VIGPRHPI (MOG_HUMAN)
VSGPRHPV

SEQ ID NO: 117739 - protein, 10 aa, Artificial Sequence
  Description of Artificial Sequence: Synthetic peptide
  Seed: ICYNWLHRRL (MOG_HUMAN)
IWYNWLHRRF

SEQ ID NO: 117740 - protein, 10 aa, Artificial Sequence
  Description of Artificial Sequence: Synthetic peptide
  Seed: TGMEVGWYRP (MOG_HUMAN)
TFMEVGWYRD

SEQ ID NO: 117741 - protein, 8 aa, Artificial Sequence
  Description of Artificial Sequence: Synthetic peptide
  Seed: RTFDPHFL (MOG_HUMAN)
RTFDPHFY

SEQ ID NO: 117742 - protein, 10 aa, Artificial Sequence
  Description of Artificial Sequence: Synthetic peptide
  Seed: ISPGKNATGM (MOG_HUMAN)
ISPGKNATGL

SEQ ID NO: 117743 - protein, 10 aa, Artificial Sequence
  Description of Artificial Sequence: Synthetic peptide
  Seed: LLQITVGLIF (MOG_HUMAN)
LSQITVGLIF

SEQ ID NO: 117744 - protein, 9 aa, Artificial Sequence
  Description of Artificial Sequence: Synthetic peptide
  Seed: TGMEVGWYR (MOG_HUMAN)
TWMEVGWYK

SEQ ID NO: 117745 - protein, 10 aa, Artificial Sequence
  Description of Artificial Sequence: Synthetic peptide
  Seed: LIFLCLQYRL (MOG_HUMAN)
LCFLCLQYRR

SEQ ID NO: 117746 - protein, 10 aa, Artificial Sequence
  Description of Artificial Sequence: Synthetic peptide
  Seed: FVIVPVLGPL (MOG_HUMAN)
FVIVPVLGPA

SEQ ID NO: 117747 - protein, 10 aa, Artificial Sequence
  Description of Artificial Sequence: Synthetic peptide
  Seed: RLAGQFLEEL (MOG_HUMAN)
RIAGQFLEEI

SEQ ID NO: 117748 - protein, 9 aa, Artificial Sequence
  Description of Artificial Sequence: Synthetic peptide
  Seed: FSDEGGFTC (MOG_HUMAN)
FLDEGGFTF

SEQ ID NO: 117749 - protein, 10 aa, Artificial Sequence
  Description of Artificial Sequence: Synthetic peptide
  Seed: FDPHFLRVPC (MOG_HUMAN)
FRPHFLRVPT

SEQ ID NO: 117750 - protein, 10 aa, Artificial Sequence
  Description of Artificial Sequence: Synthetic peptide
  Seed: GKLRAEIENL (MOG_HUMAN)
GMLRAEIENV

SEQ ID NO: 117751 - protein, 9 aa, Artificial Sequence
  Description of Artificial Sequence: Synthetic peptide
  Seed: FLEELRNPF (MOG_HUMAN)
FAEELRNPM

SEQ ID NO: 117752 - protein, 9 aa, Artificial Sequence
  Description of Artificial Sequence: Synthetic peptide
  Seed: ITVGLIFLC (MOG_HUMAN)
ISVGLIFLV

SEQ ID NO: 117753 - protein, 10 aa, Artificial Sequence
  Description of Artificial Sequence: Synthetic peptide
  Seed: RPPFSRVVHL (MOG_HUMAN)
RSPFSRVVHL

SEQ ID NO: 117754 - protein, 10 aa, Artificial Sequence
  Description of Artificial Sequence: Synthetic peptide
  Seed: FDPHFLRVPC (MOG_HUMAN)
FMPHFLRVPL

SEQ ID NO: 117755 - protein, 10 aa, Artificial Sequence
  Description of Artificial Sequence: Synthetic peptide
  Seed: LLLLQVSSSY (MOG_HUMAN)
LQLLQVSSSY

SEQ ID NO: 117756 - protein, 10 aa, Artificial Sequence
  Description of Artificial Sequence: Synthetic peptide
  Seed: SSYAGQFRVI (MOG_HUMAN)
SDYAGQFRVF

SEQ ID NO: 117757 - protein, 10 aa, Artificial Sequence
  Description of Artificial Sequence: Synthetic peptide
  Seed: SSYAGQFRVI (MOG_HUMAN)
SDYAGQFRVW

SEQ ID NO: 117758 - protein, 9 aa, Artificial Sequence
  Description of Artificial Sequence: Synthetic peptide
  Seed: WVSPGVLVL (MOG_HUMAN)
WFSPGVLVM

SEQ ID NO: 117759 - protein, 11 aa, Artificial Sequence
  Description of Artificial Sequence: Synthetic peptide
  Seed: KDAIGEGKVTL (MOG_HUMAN)
KEAIGEGKVTT

SEQ ID NO: 117760 - protein, 10 aa, Artificial Sequence
  Description of Artificial Sequence: Synthetic peptide
  Seed: SLSRPSLPSC (MOG_HUMAN)
SMSRPSLPSM

SEQ ID NO: 117761 - protein, 11 aa, Artificial Sequence
  Description of Artificial Sequence: Synthetic peptide
  Seed: RFSDEGGFTCF (MOG_HUMAN)
RVSDEGGFTCL

SEQ ID NO: 117762 - protein, 10 aa, Artificial Sequence
  Description of Artificial Sequence: Synthetic peptide
  Seed: RPPFSRVVHL (MOG_HUMAN)
RHPFSRVVHL

SEQ ID NO: 117763 - protein, 9 aa, Artificial Sequence
  Description of Artificial Sequence: Synthetic peptide
  Seed: HSYQEEAAM (MOG_HUMAN)
HHYQEEAAL

SEQ ID NO: 117764 - protein, 9 aa, Artificial Sequence
  Description of Artificial Sequence: Synthetic peptide
  Seed: FSDEGGFTC (MOG_HUMAN)
FSDEGGFTV

SEQ ID NO: 117765 - protein, 9 aa, Artificial Sequence
  Description of Artificial Sequence: Synthetic peptide
  Seed: LQVSSSYAG (MOG_HUMAN)
LEVSSSYAM

SEQ ID NO: 117766 - protein, 9 aa, Artificial Sequence
  Description of Artificial Sequence: Synthetic peptide
  Seed: TGMEVGWYR (MOG_HUMAN)
TSMEVGWYR

SEQ ID NO: 117767 - protein, 10 aa, Artificial Sequence
  Description of Artificial Sequence: Synthetic peptide
  Seed: SSYAGQFRVI (MOG_HUMAN)
SWYAGQFRVF

SEQ ID NO: 117768 - protein, 10 aa, Artificial Sequence
  Description of Artificial Sequence: Synthetic peptide
  Seed: FDPHFLRVPC (MOG_HUMAN)
FLPHFLRVPA

SEQ ID NO: 117769 - protein, 10 aa, Artificial Sequence
  Description of Artificial Sequence: Synthetic peptide
  Seed: RLAGQFLEEL (MOG_HUMAN)
RLAGQFLEEV

SEQ ID NO: 117770 - protein, 10 aa, Artificial Sequence
  Description of Artificial Sequence: Synthetic peptide
  Seed: RVIGPRHPIR (MOG_HUMAN)
RCIGPRHPIR

SEQ ID NO: 117771 - protein, 10 aa, Artificial Sequence
  Description of Artificial Sequence: Synthetic peptide
  Seed: ELPCRISPGK (MOG_HUMAN)
EVPCRISPGK

SEQ ID NO: 117772 - protein, 10 aa, Artificial Sequence
  Description of Artificial Sequence: Synthetic peptide
  Seed: AGQFRVIGPR (MOG_HUMAN)
AMQFRVIGPR

SEQ ID NO: 117773 - protein, 11 aa, Artificial Sequence
  Description of Artificial Sequence: Synthetic peptide
  Seed: LQVSSSYAGQF (MOG_HUMAN)
LMVSSSYAGQF

SEQ ID NO: 117774 - protein, 8 aa, Artificial Sequence
  Description of Artificial Sequence: Synthetic peptide
  Seed: RIRNVRFS (MOG_HUMAN)
RTRNVRFS

SEQ ID NO: 117775 - protein, 9 aa, Artificial Sequence
  Description of Artificial Sequence: Synthetic peptide
  Seed: AIGEGKVTL (MOG_HUMAN)
ASGEGKVTY

SEQ ID NO: 117776 - protein, 10 aa, Artificial Sequence
  Description of Artificial Sequence: Synthetic peptide
  Seed: VGWYRPPFSR (MOG_HUMAN)
VVWYRPPFSK

SEQ ID NO: 117777 - protein, 9 aa, Artificial Sequence
  Description of Artificial Sequence: Synthetic peptide
  Seed: AIGEGKVTL (MOG_HUMAN)
AQGEGKVTM

SEQ ID NO: 117778 - protein, 9 aa, Artificial Sequence
  Description of Artificial Sequence: Synthetic peptide
  Seed: YQEEAAMEL (MOG_HUMAN)
YMEEAAMEM

SEQ ID NO: 117779 - protein, 10 aa, Artificial Sequence
  Description of Artificial Sequence: Synthetic peptide
  Seed: LLLLQVSSSY (MOG_HUMAN)
LDLLQVSSSY

SEQ ID NO: 117780 - protein, 9 aa, Artificial Sequence
  Description of Artificial Sequence: Synthetic peptide
  Seed: DQAPEYRGR (MOG_HUMAN)
DMAPEYRGR

SEQ ID NO: 117781 - protein, 9 aa, Artificial Sequence
  Description of Artificial Sequence: Synthetic peptide
  Seed: WVSPGVLVL (MOG_HUMAN)
WNSPGVLVF

SEQ ID NO: 117782 - protein, 10 aa, Artificial Sequence
  Description of Artificial Sequence: Synthetic peptide
  Seed: FRVIGPRHPI (MOG_HUMAN)
FSVIGPRHPV

SEQ ID NO: 117783 - protein, 9 aa, Artificial Sequence
  Description of Artificial Sequence: Synthetic peptide
  Seed: SLPSCLCSF (MOG_HUMAN)
STPSCLCSM

SEQ ID NO: 117784 - protein, 9 aa, Artificial Sequence
  Description of Artificial Sequence: Synthetic peptide
  Seed: MASLSRPSL (MOG_HUMAN)
MPSLSRPSY

SEQ ID NO: 117785 - protein, 9 aa, Artificial Sequence
  Description of Artificial Sequence: Synthetic peptide
  Seed: FLEELRNPF (MOG_HUMAN)
FFEELRNPY

SEQ ID NO: 117786 - protein, 10 aa, Artificial Sequence
  Description of Artificial Sequence: Synthetic peptide
  Seed: FLLLLLLQVS (MOG_HUMAN)
FHLLLLLQVV

SEQ ID NO: 117787 - protein, 10 aa, Artificial Sequence
  Description of Artificial Sequence: Synthetic peptide
  Seed: LLLQVSSSYA (MOG_HUMAN)
LMLQVSSSYI

SEQ ID NO: 117788 - protein, 10 aa, Artificial Sequence
  Description of Artificial Sequence: Synthetic peptide
  Seed: SLSRPSLPSC (MOG_HUMAN)
SGSRPSLPSA

SEQ ID NO: 117789 - protein, 10 aa, Artificial Sequence
  Description of Artificial Sequence: Synthetic peptide
  Seed: RTFDPHFLRV (MOG_HUMAN)
RFFDPHFLRC

SEQ ID NO: 117790 - protein, 10 aa, Artificial Sequence
  Description of Artificial Sequence: Synthetic peptide
  Seed: LLLQVSSSYA (MOG_HUMAN)
LILQVSSSYI

SEQ ID NO: 117791 - protein, 9 aa, Artificial Sequence
  Description of Artificial Sequence: Synthetic peptide
  Seed: WVSPGVLVL (MOG_HUMAN)
WRSPGVLVL

SEQ ID NO: 117792 - protein, 10 aa, Artificial Sequence
  Description of Artificial Sequence: Synthetic peptide
  Seed: HFLRVPCWKI (MOG_HUMAN)
HFLRVPCWKF

SEQ ID NO: 117793 - protein, 9 aa, Artificial Sequence
  Description of Artificial Sequence: Synthetic peptide
  Seed: FLEELRNPF (MOG_HUMAN)
FSEELRNPY

SEQ ID NO: 117794 - protein, 9 aa, Artificial Sequence
  Description of Artificial Sequence: Synthetic peptide
  Seed: VGDEVELPC (MOG_HUMAN)
VYDEVELPV

SEQ ID NO: 117795 - protein, 9 aa, Artificial Sequence
  Description of Artificial Sequence: Synthetic peptide
  Seed: LLLQITVGL (MOG_HUMAN)
LILQITVGY

SEQ ID NO: 117796 - protein, 9 aa, Artificial Sequence
  Description of Artificial Sequence: Synthetic peptide
  Seed: FYWVSPGVL (MOG_HUMAN)
FQWVSPGVY

SEQ ID NO: 117797 - protein, 9 aa, Artificial Sequence
  Description of Artificial Sequence: Synthetic peptide
  Seed: SLPSCLCSF (MOG_HUMAN)
SQPSCLCSI

SEQ ID NO: 117798 - protein, 9 aa, Artificial Sequence
  Description of Artificial Sequence: Synthetic peptide
  Seed: SSYAGQFRV (MOG_HUMAN)
STYAGQFRR

SEQ ID NO: 117799 - protein, 10 aa, Artificial Sequence
  Description of Artificial Sequence: Synthetic peptide
  Seed: LSRPSLPSCL (MOG_HUMAN)
LARPSLPSCK

SEQ ID NO: 117800 - protein, 9 aa, Artificial Sequence
  Description of Artificial Sequence: Synthetic peptide
  Seed: IVPVLGPLV (MOG_HUMAN)
IPPVLGPLV

SEQ ID NO: 117801 - protein, 10 aa, Artificial Sequence
  Description of Artificial Sequence: Synthetic peptide
  Seed: LIICYNWLHR (MOG_HUMAN)
LVICYNWLHR

SEQ ID NO: 117802 - protein, 10 aa, Artificial Sequence
  Description of Artificial Sequence: Synthetic peptide
  Seed: AGQFRVIGPR (MOG_HUMAN)
AAQFRVIGPR

SEQ ID NO: 117803 - protein, 9 aa, Artificial Sequence
  Description of Artificial Sequence: Synthetic peptide
  Seed: YRPPFSRVV (MOG_HUMAN)
YAPPFSRVM

SEQ ID NO: 117804 - protein, 9 aa, Artificial Sequence
  Description of Artificial Sequence: Synthetic peptide
  Seed: LKVEDPFYW (MOG_HUMAN)
LAVEDPFYW

SEQ ID NO: 117805 - protein, 10 aa, Artificial Sequence
  Description of Artificial Sequence: Synthetic peptide
  Seed: SLSRPSLPSC (MOG_HUMAN)
SASRPSLPSI

SEQ ID NO: 117806 - protein, 9 aa, Artificial Sequence
  Description of Artificial Sequence: Synthetic peptide
  Seed: VLPVLLLQI (MOG_HUMAN)
VWPVLLLQF

SEQ ID NO: 117807 - protein, 10 aa, Artificial Sequence
  Description of Artificial Sequence: Synthetic peptide
  Seed: RRLAGQFLEE (MOG_HUMAN)
RRLAGQFLEA

SEQ ID NO: 117808 - protein, 9 aa, Artificial Sequence
  Description of Artificial Sequence: Synthetic peptide
  Seed: DQAPEYRGR (MOG_HUMAN)
DSAPEYRGR

SEQ ID NO: 117809 - protein, 10 aa, Artificial Sequence
  Description of Artificial Sequence: Synthetic peptide
  Seed: LLLLQVSSSY (MOG_HUMAN)
LKLLQVSSSM

SEQ ID NO: 117810 - protein, 9 aa, Artificial Sequence
  Description of Artificial Sequence: Synthetic peptide
  Seed: TFDPHFLRV (MOG_HUMAN)
TMDPHFLRC

SEQ ID NO: 117811 - protein, 9 aa, Artificial Sequence
  Description of Artificial Sequence: Synthetic peptide
  Seed: LPCRISPGK (MOG_HUMAN)
LTCRISPGK

SEQ ID NO: 117812 - protein, 10 aa, Artificial Sequence
  Description of Artificial Sequence: Synthetic peptide
  Seed: FVIVPVLGPL (MOG_HUMAN)
FAIVPVLGPY

SEQ ID NO: 117813 - protein, 9 aa, Artificial Sequence
  Description of Artificial Sequence: Synthetic peptide
  Seed: HRTFDPHFL (MOG_HUMAN)
HHTFDPHFI

SEQ ID NO: 117814 - protein, 9 aa, Artificial Sequence
  Description of Artificial Sequence: Synthetic peptide
  Seed: RIRNVRFSD (MOG_HUMAN)
RVRNVRFSF

SEQ ID NO: 117815 - protein, 10 aa, Artificial Sequence
  Description of Artificial Sequence: Synthetic peptide
  Seed: CLCSFLLLLL (MOG_HUMAN)
CQCSFLLLLV

SEQ ID NO: 117816 - protein, 10 aa, Artificial Sequence
  Description of Artificial Sequence: Synthetic peptide
  Seed: YQEEAAMELK (MOG_HUMAN)
YMEEAAMELY

SEQ ID NO: 117817 - protein, 9 aa, Artificial Sequence
  Description of Artificial Sequence: Synthetic peptide
  Seed: TFDPHFLRV (MOG_HUMAN)
TLDPHFLRY

SEQ ID NO: 117818 - protein, 10 aa, Artificial Sequence
  Description of Artificial Sequence: Synthetic peptide
  Seed: VPVLGPLVAL (MOG_HUMAN)
VDVLGPLVAV

SEQ ID NO: 117819 - protein, 10 aa, Artificial Sequence
  Description of Artificial Sequence: Synthetic peptide
  Seed: HRTFDPHFLR (MOG_HUMAN)
HPTFDPHFLR

SEQ ID NO: 117820 - protein, 11 aa, Artificial Sequence
  Description of Artificial Sequence: Synthetic peptide
  Seed: VRFSDEGGFTC (MOG_HUMAN)
VQFSDEGGFTL

SEQ ID NO: 117821 - protein, 9 aa, Artificial Sequence
  Description of Artificial Sequence: Synthetic peptide
  Seed: QITVGLIFL (MOG_HUMAN)
QLTVGLIFV

SEQ ID NO: 117822 - protein, 9 aa, Artificial Sequence
  Description of Artificial Sequence: Synthetic peptide
  Seed: DQAPEYRGR (MOG_HUMAN)
DGAPEYRGR

SEQ ID NO: 117823 - protein, 9 aa, Artificial Sequence
  Description of Artificial Sequence: Synthetic peptide
  Seed: LVLLAVLPV (MOG_HUMAN)
LMLLAVLPV

SEQ ID NO: 117824 - protein, 11 aa, Artificial Sequence
  Description of Artificial Sequence: Synthetic peptide
  Seed: SSSYAGQFRVI (MOG_HUMAN)
SYSYAGQFRVW

SEQ ID NO: 117825 - protein, 10 aa, Artificial Sequence
  Description of Artificial Sequence: Synthetic peptide
  Seed: ATGMEVGWYR (MOG_HUMAN)
AHGMEVGWYK

SEQ ID NO: 117826 - protein, 10 aa, Artificial Sequence
  Description of Artificial Sequence: Synthetic peptide
  Seed: RLAGQFLEEL (MOG_HUMAN)
RVAGQFLEEI

SEQ ID NO: 117827 - protein, 10 aa, Artificial Sequence
  Description of Artificial Sequence: Synthetic peptide
  Seed: TGMEVGWYRP (MOG_HUMAN)
TMMEVGWYRN

SEQ ID NO: 117828 - protein, 9 aa, Artificial Sequence
  Description of Artificial Sequence: Synthetic peptide
  Seed: HSYQEEAAM (MOG_HUMAN)
HAYQEEAAW

SEQ ID NO: 117829 - protein, 9 aa, Artificial Sequence
  Description of Artificial Sequence: Synthetic peptide
  Seed: RRLAGQFLE (MOG_HUMAN)
RQLAGQFLM

SEQ ID NO: 117830 - protein, 10 aa, Artificial Sequence
  Description of Artificial Sequence: Synthetic peptide
  Seed: RTFDPHFLRV (MOG_HUMAN)
RVFDPHFLRV

SEQ ID NO: 117831 - protein, 9 aa, Artificial Sequence
  Description of Artificial Sequence: Synthetic peptide
  Seed: ALVGDEVEL (MOG_HUMAN)
ALVGDEVEI

SEQ ID NO: 117832 - protein, 10 aa, Artificial Sequence
  Description of Artificial Sequence: Synthetic peptide
  Seed: YWVSPGVLVL (MOG_HUMAN)
YCVSPGVLVF

SEQ ID NO: 117833 - protein, 9 aa, Artificial Sequence
  Description of Artificial Sequence: Synthetic peptide
  Seed: AIGEGKVTL (MOG_HUMAN)
AYGEGKVTL

SEQ ID NO: 117834 - protein, 11 aa, Artificial Sequence
  Description of Artificial Sequence: Synthetic peptide
  Seed: RRLAGQFLEEL (MOG_HUMAN)
RYLAGQFLEEV

SEQ ID NO: 117835 - protein, 9 aa, Artificial Sequence
  Description of Artificial Sequence: Synthetic peptide
  Seed: VGDEVELPC (MOG_HUMAN)
VYDEVELPI

SEQ ID NO: 117836 - protein, 9 aa, Artificial Sequence
  Description of Artificial Sequence: Synthetic peptide
  Seed: VSSSYAGQF (MOG_HUMAN)
VLSSYAGQY

SEQ ID NO: 117837 - protein, 10 aa, Artificial Sequence
  Description of Artificial Sequence: Synthetic peptide
  Seed: IGPRHPIRAL (MOG_HUMAN)
IIPRHPIRAI

SEQ ID NO: 117838 - protein, 10 aa, Artificial Sequence
  Description of Artificial Sequence: Synthetic peptide
  Seed: RVIGPRHPIR (MOG_HUMAN)
RVIGPRHPIA

SEQ ID NO: 117839 - protein, 9 aa, Artificial Sequence
  Description of Artificial Sequence: Synthetic peptide
  Seed: RVPCWKITL (MOG_HUMAN)
RMPCWKITV

SEQ ID NO: 117840 - protein, 9 aa, Artificial Sequence
  Description of Artificial Sequence: Synthetic peptide
  Seed: RTFDPHFLR (MOG_HUMAN)
RLFDPHFLM

SEQ ID NO: 117841 - protein, 10 aa, Artificial Sequence
  Description of Artificial Sequence: Synthetic peptide
  Seed: KITLFVIVPV (MOG_HUMAN)
KQTLFVIVPI

SEQ ID NO: 117842 - protein, 11 aa, Artificial Sequence
  Description of Artificial Sequence: Synthetic peptide
  Seed: PPFSRVVHLYR (MOG_HUMAN)
PKFSRVVHLYR

SEQ ID NO: 117843 - protein, 9 aa, Artificial Sequence
  Description of Artificial Sequence: Synthetic peptide
  Seed: FLEELRNPF (MOG_HUMAN)
FFEELRNPF

SEQ ID NO: 117844 - protein, 9 aa, Artificial Sequence
  Description of Artificial Sequence: Synthetic peptide
  Seed: RVPCWKITL (MOG_HUMAN)
RAPCWKITI

SEQ ID NO: 117845 - protein, 10 aa, Artificial Sequence
  Description of Artificial Sequence: Synthetic peptide
  Seed: TGMEVGWYRP (MOG_HUMAN)
TMMEVGWYRM

SEQ ID NO: 117846 - protein, 9 aa, Artificial Sequence
  Description of Artificial Sequence: Synthetic peptide
  Seed: CLCSFLLLL (MOG_HUMAN)
CACSFLLLL

SEQ ID NO: 117847 - protein, 10 aa, Artificial Sequence
  Description of Artificial Sequence: Synthetic peptide
  Seed: VGWYRPPFSR (MOG_HUMAN)
VKWYRPPFSR

SEQ ID NO: 117848 - protein, 10 aa, Artificial Sequence
  Description of Artificial Sequence: Synthetic peptide
  Seed: HRTFDPHFLR (MOG_HUMAN)
HLTFDPHFLK

SEQ ID NO: 117849 - protein, 9 aa, Artificial Sequence
  Description of Artificial Sequence: Synthetic peptide
  Seed: FLEELRNPF (MOG_HUMAN)
FFEELRNPV

SEQ ID NO: 117850 - protein, 9 aa, Artificial Sequence
  Description of Artificial Sequence: Synthetic peptide
  Seed: TFDPHFLRV (MOG_HUMAN)
TFDPHFLRM

SEQ ID NO: 117851 - protein, 9 aa, Artificial Sequence
  Description of Artificial Sequence: Synthetic peptide
  Seed: RVIGPRHPI (MOG_HUMAN)
RPIGPRHPL

SEQ ID NO: 117852 - protein, 10 aa, Artificial Sequence
  Description of Artificial Sequence: Synthetic peptide
  Seed: RLAGQFLEEL (MOG_HUMAN)
RQAGQFLEEV

SEQ ID NO: 117853 - protein, 10 aa, Artificial Sequence
  Description of Artificial Sequence: Synthetic peptide
  Seed: SLSRPSLPSC (MOG_HUMAN)
SNSRPSLPSA

SEQ ID NO: 117854 - protein, 9 aa, Artificial Sequence
  Description of Artificial Sequence: Synthetic peptide
  Seed: VLGPLVALI (MOG_HUMAN)
VIGPLVALI

SEQ ID NO: 117855 - protein, 10 aa, Artificial Sequence
  Description of Artificial Sequence: Synthetic peptide
  Seed: ITLFVIVPVL (MOG_HUMAN)
ILLFVIVPVL

SEQ ID NO: 117856 - protein, 10 aa, Artificial Sequence
  Description of Artificial Sequence: Synthetic peptide
  Seed: LIFLCLQYRL (MOG_HUMAN)
LWFLCLQYRR

SEQ ID NO: 117857 - protein, 9 aa, Artificial Sequence
  Description of Artificial Sequence: Synthetic peptide
  Seed: MASLSRPSL (MOG_HUMAN)
MTSLSRPSI

SEQ ID NO: 117858 - protein, 9 aa, Artificial Sequence
  Description of Artificial Sequence: Synthetic peptide
  Seed: WVSPGVLVL (MOG_HUMAN)
WLSPGVLVM

SEQ ID NO: 117859 - protein, 8 aa, Artificial Sequence
  Description of Artificial Sequence: Synthetic peptide
  Seed: VLLAVLPV (MOG_HUMAN)
VMLAVLPV

SEQ ID NO: 117860 - protein, 10 aa, Artificial Sequence
  Description of Artificial Sequence: Synthetic peptide
  Seed: RALVGDEVEL (MOG_HUMAN)
RMLVGDEVEW

SEQ ID NO: 117861 - protein, 9 aa, Artificial Sequence
  Description of Artificial Sequence: Synthetic peptide
  Seed: RTFDPHFLR (MOG_HUMAN)
RAFDPHFLK

SEQ ID NO: 117862 - protein, 9 aa, Artificial Sequence
  Description of Artificial Sequence: Synthetic peptide
  Seed: FSDEGGFTC (MOG_HUMAN)
FIDEGGFTC

SEQ ID NO: 117863 - protein, 10 aa, Artificial Sequence
  Description of Artificial Sequence: Synthetic peptide
  Seed: YWVSPGVLVL (MOG_HUMAN)
YIVSPGVLVF

SEQ ID NO: 117864 - protein, 9 aa, Artificial Sequence
  Description of Artificial Sequence: Synthetic peptide
  Seed: YQEEAAMEL (MOG_HUMAN)
YPEEAAMEV

SEQ ID NO: 117865 - protein, 9 aa, Artificial Sequence
  Description of Artificial Sequence: Synthetic peptide
  Seed: SYAGQFRVI (MOG_HUMAN)
SYAGQFRVL

SEQ ID NO: 117866 - protein, 9 aa, Artificial Sequence
  Description of Artificial Sequence: Synthetic peptide
  Seed: CLCSFLLLL (MOG_HUMAN)
CTCSFLLLL

SEQ ID NO: 117867 - protein, 9 aa, Artificial Sequence
  Description of Artificial Sequence: Synthetic peptide
  Seed: KVTLRIRNV (MOG_HUMAN)
KSTLRIRNK

SEQ ID NO: 117868 - protein, 9 aa, Artificial Sequence
  Description of Artificial Sequence: Synthetic peptide
  Seed: KLRAEIENL (MOG_HUMAN)
KSRAEIENI

SEQ ID NO: 117869 - protein, 11 aa, Artificial Sequence
  Description of Artificial Sequence: Synthetic peptide
  Seed: FSDEGGFTCFF (MOG_HUMAN)
FYDEGGFTCFM

SEQ ID NO: 117870 - protein, 9 aa, Artificial Sequence
  Description of Artificial Sequence: Synthetic peptide
  Seed: AIGEGKVTL (MOG_HUMAN)
ATGEGKVTM

SEQ ID NO: 117871 - protein, 9 aa, Artificial Sequence
  Description of Artificial Sequence: Synthetic peptide
  Seed: TCFFRDHSY (MOG_HUMAN)
TTFFRDHSY

SEQ ID NO: 117872 - protein, 10 aa, Artificial Sequence
  Description of Artificial Sequence: Synthetic peptide
  Seed: FSDEGGFTCF (MOG_HUMAN)
FTDEGGFTCM

SEQ ID NO: 117873 - protein, 9 aa, Artificial Sequence
  Description of Artificial Sequence: Synthetic peptide
  Seed: VSPGVLVLL (MOG_HUMAN)
VLPGVLVLM

SEQ ID NO: 117874 - protein, 9 aa, Artificial Sequence
  Description of Artificial Sequence: Synthetic peptide
  Seed: WVSPGVLVL (MOG_HUMAN)
WVSPGVLVW

SEQ ID NO: 117875 - protein, 10 aa, Artificial Sequence
  Description of Artificial Sequence: Synthetic peptide
  Seed: FDPHFLRVPC (MOG_HUMAN)
FAPHFLRVPM

SEQ ID NO: 117876 - protein, 9 aa, Artificial Sequence
  Description of Artificial Sequence: Synthetic peptide
  Seed: SLPSCLCSF (MOG_HUMAN)
SVPSCLCSF

SEQ ID NO: 117877 - protein, 10 aa, Artificial Sequence
  Description of Artificial Sequence: Synthetic peptide
  Seed: IGPRHPIRAL (MOG_HUMAN)
IYPRHPIRAM

SEQ ID NO: 117878 - protein, 9 aa, Artificial Sequence
  Description of Artificial Sequence: Synthetic peptide
  Seed: VPCWKITLF (MOG_HUMAN)
VLCWKITLF

SEQ ID NO: 117879 - protein, 9 aa, Artificial Sequence
  Description of Artificial Sequence: Synthetic peptide
  Seed: LSRPSLPSC (MOG_HUMAN)
LMRPSLPSI

SEQ ID NO: 117880 - protein, 9 aa, Artificial Sequence
  Description of Artificial Sequence: Synthetic peptide
  Seed: TFDPHFLRV (MOG_HUMAN)
TCDPHFLRV

SEQ ID NO: 117881 - protein, 10 aa, Artificial Sequence
  Description of Artificial Sequence: Synthetic peptide
  Seed: SLSRPSLPSC (MOG_HUMAN)
STSRPSLPSK

SEQ ID NO: 117882 - protein, 9 aa, Artificial Sequence
  Description of Artificial Sequence: Synthetic peptide
  Seed: ALVGDEVEL (MOG_HUMAN)
AQVGDEVEF

SEQ ID NO: 117883 - protein, 11 aa, Artificial Sequence
  Description of Artificial Sequence: Synthetic peptide
  Seed: RISPGKNATGM (MOG_HUMAN)
RMSPGKNATGL

SEQ ID NO: 117884 - protein, 10 aa, Artificial Sequence
  Description of Artificial Sequence: Synthetic peptide
  Seed: ATGMEVGWYR (MOG_HUMAN)
ALGMEVGWYK

SEQ ID NO: 117885 - protein, 11 aa, Artificial Sequence
  Description of Artificial Sequence: Synthetic peptide
  Seed: HSYQEEAAMEL (MOG_HUMAN)
HVYQEEAAMEW

SEQ ID NO: 117886 - protein, 8 aa, Artificial Sequence
  Description of Artificial Sequence: Synthetic peptide
  Seed: VTLRIRNV (MOG_HUMAN)
VQLRIRNI

SEQ ID NO: 117887 - protein, 11 aa, Artificial Sequence
  Description of Artificial Sequence: Synthetic peptide
  Seed: IGPRHPIRALV (MOG_HUMAN)
ISPRHPIRALL

SEQ ID NO: 117888 - protein, 10 aa, Artificial Sequence
  Description of Artificial Sequence: Synthetic peptide
  Seed: FRVIGPRHPI (MOG_HUMAN)
FWVIGPRHPI

SEQ ID NO: 117889 - protein, 9 aa, Artificial Sequence
  Description of Artificial Sequence: Synthetic peptide
  Seed: YWVSPGVLV (MOG_HUMAN)
YYVSPGVLI

SEQ ID NO: 117890 - protein, 11 aa, Artificial Sequence
  Description of Artificial Sequence: Synthetic peptide
  Seed: RDHSYQEEAAM (MOG_HUMAN)
RWHSYQEEAAW

SEQ ID NO: 117891 - protein, 9 aa, Artificial Sequence
  Description of Artificial Sequence: Synthetic peptide
  Seed: LAVLPVLLL (MOG_HUMAN)
LMVLPVLLW

SEQ ID NO: 117892 - protein, 10 aa, Artificial Sequence
  Description of Artificial Sequence: Synthetic peptide
  Seed: LIFLCLQYRL (MOG_HUMAN)
LFFLCLQYRR

SEQ ID NO: 117893 - protein, 10 aa, Artificial Sequence
  Description of Artificial Sequence: Synthetic peptide
  Seed: FRVIGPRHPI (MOG_HUMAN)
FLVIGPRHPI

SEQ ID NO: 117894 - protein, 9 aa, Artificial Sequence
  Description of Artificial Sequence: Synthetic peptide
  Seed: FLRVPCWKI (MOG_HUMAN)
FLRVPCWKL

SEQ ID NO: 117895 - protein, 10 aa, Artificial Sequence
  Description of Artificial Sequence: Synthetic peptide
  Seed: HRTFDPHFLR (MOG_HUMAN)
HNTFDPHFLR

SEQ ID NO: 117896 - protein, 10 aa, Artificial Sequence
  Description of Artificial Sequence: Synthetic peptide
  Seed: RLRGKLRAEI (MOG_HUMAN)
RARGKLRAEK

SEQ ID NO: 117897 - protein, 9 aa, Artificial Sequence
  Description of Artificial Sequence: Synthetic peptide
  Seed: WVSPGVLVL (MOG_HUMAN)
WSSPGVLVL

SEQ ID NO: 117898 - protein, 11 aa, Artificial Sequence
  Description of Artificial Sequence: Synthetic peptide
  Seed: ALIICYNWLHR (MOG_HUMAN)
ARIICYNWLHR

SEQ ID NO: 117899 - protein, 9 aa, Artificial Sequence
  Description of Artificial Sequence: Synthetic peptide
  Seed: VIVPVLGPL (MOG_HUMAN)
VMVPVLGPI

SEQ ID NO: 117900 - protein, 10 aa, Artificial Sequence
  Description of Artificial Sequence: Synthetic peptide
  Seed: HRTFDPHFLR (MOG_HUMAN)
HKTFDPHFLK

SEQ ID NO: 117901 - protein, 10 aa, Artificial Sequence
  Description of Artificial Sequence: Synthetic peptide
  Seed: IGPRHPIRAL (MOG_HUMAN)
IDPRHPIRAV

SEQ ID NO: 117902 - protein, 10 aa, Artificial Sequence
  Description of Artificial Sequence: Synthetic peptide
  Seed: FRVIGPRHPI (MOG_HUMAN)
FVVIGPRHPV

SEQ ID NO: 117903 - protein, 9 aa, Artificial Sequence
  Description of Artificial Sequence: Synthetic peptide
  Seed: DQAPEYRGR (MOG_HUMAN)
DIAPEYRGK

SEQ ID NO: 117904 - protein, 10 aa, Artificial Sequence
  Description of Artificial Sequence: Synthetic peptide
  Seed: ATGMEVGWYR (MOG_HUMAN)
AYGMEVGWYK

SEQ ID NO: 117905 - protein, 9 aa, Artificial Sequence
  Description of Artificial Sequence: Synthetic peptide
  Seed: FYWVSPGVL (MOG_HUMAN)
FVWVSPGVF

SEQ ID NO: 117906 - protein, 10 aa, Artificial Sequence
  Description of Artificial Sequence: Synthetic peptide
  Seed: FDPHFLRVPC (MOG_HUMAN)
FWPHFLRVPM

SEQ ID NO: 117907 - protein, 10 aa, Artificial Sequence
  Description of Artificial Sequence: Synthetic peptide
  Seed: SLSRPSLPSC (MOG_HUMAN)
STSRPSLPSV

SEQ ID NO: 117908 - protein, 10 aa, Artificial Sequence
  Description of Artificial Sequence: Synthetic peptide
  Seed: LQITVGLIFL (MOG_HUMAN)
LMITVGLIFF

SEQ ID NO: 117909 - protein, 9 aa, Artificial Sequence
  Description of Artificial Sequence: Synthetic peptide
  Seed: LKDAIGEGK (MOG_HUMAN)
LADAIGEGY

SEQ ID NO: 117910 - protein, 9 aa, Artificial Sequence
  Description of Artificial Sequence: Synthetic peptide
  Seed: SCLCSFLLL (MOG_HUMAN)
SVLCSFLLV

SEQ ID NO: 117911 - protein, 9 aa, Artificial Sequence
  Description of Artificial Sequence: Synthetic peptide
  Seed: YQEEAAMEL (MOG_HUMAN)
YGEEAAMEF

SEQ ID NO: 117912 - protein, 11 aa, Artificial Sequence
  Description of Artificial Sequence: Synthetic peptide
  Seed: HSYQEEAAMEL (MOG_HUMAN)
HAYQEEAAMEF

SEQ ID NO: 117913 - protein, 8 aa, Artificial Sequence
  Description of Artificial Sequence: Synthetic peptide
  Seed: IENLHRTF (MOG_HUMAN)
IENLHRTV

SEQ ID NO: 117914 - protein, 11 aa, Artificial Sequence
  Description of Artificial Sequence: Synthetic peptide
  Seed: VIGPRHPIRAL (MOG_HUMAN)
VFGPRHPIRAM

SEQ ID NO: 117915 - protein, 10 aa, Artificial Sequence
  Description of Artificial Sequence: Synthetic peptide
  Seed: SSYAGQFRVI (MOG_HUMAN)
SSYAGQFRVY

SEQ ID NO: 117916 - protein, 9 aa, Artificial Sequence
  Description of Artificial Sequence: Synthetic peptide
  Seed: VPVLGPLVA (MOG_HUMAN)
VHVLGPLVA

SEQ ID NO: 117917 - protein, 10 aa, Artificial Sequence
  Description of Artificial Sequence: Synthetic peptide
  Seed: IGPRHPIRAL (MOG_HUMAN)
IRPRHPIRAV

SEQ ID NO: 117918 - protein, 9 aa, Artificial Sequence
  Description of Artificial Sequence: Synthetic peptide
  Seed: HSYQEEAAM (MOG_HUMAN)
HVYQEEAAW

SEQ ID NO: 117919 - protein, 10 aa, Artificial Sequence
  Description of Artificial Sequence: Synthetic peptide
  Seed: YWVSPGVLVL (MOG_HUMAN)
YEVSPGVLVF

SEQ ID NO: 117920 - protein, 11 aa, Artificial Sequence
  Description of Artificial Sequence: Synthetic peptide
  Seed: FVIVPVLGPLV (MOG_HUMAN)
FLIVPVLGPLL

SEQ ID NO: 117921 - protein, 10 aa, Artificial Sequence
  Description of Artificial Sequence: Synthetic peptide
  Seed: RTFDPHFLRV (MOG_HUMAN)
RLFDPHFLRC

SEQ ID NO: 117922 - protein, 10 aa, Artificial Sequence
  Description of Artificial Sequence: Synthetic peptide
  Seed: FTCFFRDHSY (MOG_HUMAN)
FTCFFRDHSF

SEQ ID NO: 117923 - protein, 11 aa, Artificial Sequence
  Description of Artificial Sequence: Synthetic peptide
  Seed: FVIVPVLGPLV (MOG_HUMAN)
FLIVPVLGPLV

SEQ ID NO: 117924 - protein, 9 aa, Artificial Sequence
  Description of Artificial Sequence: Synthetic peptide
  Seed: VLLAVLPVL (MOG_HUMAN)
VMLAVLPVI

SEQ ID NO: 117925 - protein, 10 aa, Artificial Sequence
  Description of Artificial Sequence: Synthetic peptide
  Seed: SLSRPSLPSC (MOG_HUMAN)
SNSRPSLPSK

SEQ ID NO: 117926 - protein, 9 aa, Artificial Sequence
  Description of Artificial Sequence: Synthetic peptide
  Seed: SYAGQFRVI (MOG_HUMAN)
SFAGQFRVL

SEQ ID NO: 117927 - protein, 9 aa, Artificial Sequence
  Description of Artificial Sequence: Synthetic peptide
  Seed: FYWVSPGVL (MOG_HUMAN)
FTWVSPGVL

SEQ ID NO: 117928 - protein, 10 aa, Artificial Sequence
  Description of Artificial Sequence: Synthetic peptide
  Seed: RTFDPHFLRV (MOG_HUMAN)
RTFDPHFLRK

SEQ ID NO: 117929 - protein, 10 aa, Artificial Sequence
  Description of Artificial Sequence: Synthetic peptide
  Seed: IFLCLQYRLR (MOG_HUMAN)
ILLCLQYRLR

SEQ ID NO: 117930 - protein, 9 aa, Artificial Sequence
  Description of Artificial Sequence: Synthetic peptide
  Seed: RVPCWKITL (MOG_HUMAN)
RTPCWKITY

SEQ ID NO: 117931 - protein, 9 aa, Artificial Sequence
  Description of Artificial Sequence: Synthetic peptide
  Seed: HSYQEEAAM (MOG_HUMAN)
HSYQEEAAF

SEQ ID NO: 117932 - protein, 10 aa, Artificial Sequence
  Description of Artificial Sequence: Synthetic peptide
  Seed: SLPSCLCSFL (MOG_HUMAN)
SVPSCLCSFL

SEQ ID NO: 117933 - protein, 10 aa, Artificial Sequence
  Description of Artificial Sequence: Synthetic peptide
  Seed: LLQITVGLIF (MOG_HUMAN)
LEQITVGLIY

SEQ ID NO: 117934 - protein, 10 aa, Artificial Sequence
  Description of Artificial Sequence: Synthetic peptide
  Seed: LIICYNWLHR (MOG_HUMAN)
LQICYNWLHR

SEQ ID NO: 117935 - protein, 11 aa, Artificial Sequence
  Description of Artificial Sequence: Synthetic peptide
  Seed: RFSDEGGFTCF (MOG_HUMAN)
RMSDEGGFTCF

SEQ ID NO: 117936 - protein, 9 aa, Artificial Sequence
  Description of Artificial Sequence: Synthetic peptide
  Seed: LAGQFLEEL (MOG_HUMAN)
LIGQFLEEA

SEQ ID NO: 117937 - protein, 9 aa, Artificial Sequence
  Description of Artificial Sequence: Synthetic peptide
  Seed: RIRNVRFSD (MOG_HUMAN)
RTRNVRFSL

SEQ ID NO: 117938 - protein, 11 aa, Artificial Sequence
  Description of Artificial Sequence: Synthetic peptide
  Seed: RDHSYQEEAAM (MOG_HUMAN)
RMHSYQEEAAW

SEQ ID NO: 117939 - protein, 10 aa, Artificial Sequence
  Description of Artificial Sequence: Synthetic peptide
  Seed: VLLAVLPVLL (MOG_HUMAN)
VFLAVLPVLV

SEQ ID NO: 117940 - protein, 10 aa, Artificial Sequence
  Description of Artificial Sequence: Synthetic peptide
  Seed: SLSRPSLPSC (MOG_HUMAN)
SDSRPSLPSI

SEQ ID NO: 117941 - protein, 9 aa, Artificial Sequence
  Description of Artificial Sequence: Synthetic peptide
  Seed: GQFRVIGPR (MOG_HUMAN)
GTFRVIGPK

SEQ ID NO: 117942 - protein, 10 aa, Artificial Sequence
  Description of Artificial Sequence: Synthetic peptide
  Seed: FRVIGPRHPI (MOG_HUMAN)
FLVIGPRHPL

SEQ ID NO: 117943 - protein, 10 aa, Artificial Sequence
  Description of Artificial Sequence: Synthetic peptide
  Seed: SPGVLVLLAV (MOG_HUMAN)
SPGVLVLLAA

SEQ ID NO: 117944 - protein, 10 aa, Artificial Sequence
  Description of Artificial Sequence: Synthetic peptide
  Seed: FSDEGGFTCF (MOG_HUMAN)
FVDEGGFTCF

SEQ ID NO: 117945 - protein, 9 aa, Artificial Sequence
  Description of Artificial Sequence: Synthetic peptide
  Seed: HSYQEEAAM (MOG_HUMAN)
HSYQEEAAY

SEQ ID NO: 117946 - protein, 9 aa, Artificial Sequence
  Description of Artificial Sequence: Synthetic peptide
  Seed: RVIGPRHPI (MOG_HUMAN)
RPIGPRHPS

SEQ ID NO: 117947 - protein, 11 aa, Artificial Sequence
  Description of Artificial Sequence: Synthetic peptide
  Seed: DAIGEGKVTLR (MOG_HUMAN)
DVIGEGKVTLY

SEQ ID NO: 117948 - protein, 9 aa, Artificial Sequence
  Description of Artificial Sequence: Synthetic peptide
  Seed: DGDQAPEYR (MOG_HUMAN)
DTDQAPEYY

SEQ ID NO: 117949 - protein, 9 aa, Artificial Sequence
  Description of Artificial Sequence: Synthetic peptide
  Seed: WVSPGVLVL (MOG_HUMAN)
WYSPGVLVV

SEQ ID NO: 117950 - protein, 9 aa, Artificial Sequence
  Description of Artificial Sequence: Synthetic peptide
  Seed: LSRPSLPSC (MOG_HUMAN)
LQRPSLPSK

SEQ ID NO: 117951 - protein, 10 aa, Artificial Sequence
  Description of Artificial Sequence: Synthetic peptide
  Seed: RTFDPHFLRV (MOG_HUMAN)
RVFDPHFLRW

SEQ ID NO: 117952 - protein, 9 aa, Artificial Sequence
  Description of Artificial Sequence: Synthetic peptide
  Seed: YQEEAAMEL (MOG_HUMAN)
YAEEAAMEY

SEQ ID NO: 117953 - protein, 10 aa, Artificial Sequence
  Description of Artificial Sequence: Synthetic peptide
  Seed: KITLFVIVPV (MOG_HUMAN)
KPTLFVIVPV

SEQ ID NO: 117954 - protein, 10 aa, Artificial Sequence
  Description of Artificial Sequence: Synthetic peptide
  Seed: LLLLQVSSSY (MOG_HUMAN)
LPLLQVSSSY

SEQ ID NO: 117955 - protein, 9 aa, Artificial Sequence
  Description of Artificial Sequence: Synthetic peptide
  Seed: RIRNVRFSD (MOG_HUMAN)
RFRNVRFSP

SEQ ID NO: 117956 - protein, 9 aa, Artificial Sequence
  Description of Artificial Sequence: Synthetic peptide
  Seed: ICYNWLHRR (MOG_HUMAN)
IMYNWLHRF

SEQ ID NO: 117957 - protein, 9 aa, Artificial Sequence
  Description of Artificial Sequence: Synthetic peptide
  Seed: YWVSPGVLV (MOG_HUMAN)
YWVSPGVLF

SEQ ID NO: 117958 - protein, 10 aa, Artificial Sequence
  Description of Artificial Sequence: Synthetic peptide
  Seed: YWVSPGVLVL (MOG_HUMAN)
YEVSPGVLVY

SEQ ID NO: 117959 - protein, 9 aa, Artificial Sequence
  Description of Artificial Sequence: Synthetic peptide
  Seed: RVPCWKITL (MOG_HUMAN)
RAPCWKITL

SEQ ID NO: 117960 - protein, 10 aa, Artificial Sequence
  Description of Artificial Sequence: Synthetic peptide
  Seed: AEIENLHRTF (MOG_HUMAN)
AHIENLHRTI

SEQ ID NO: 117961 - protein, 10 aa, Artificial Sequence
  Description of Artificial Sequence: Synthetic peptide
  Seed: FSDEGGFTCF (MOG_HUMAN)
FNDEGGFTCL

SEQ ID NO: 117962 - protein, 9 aa, Artificial Sequence
  Description of Artificial Sequence: Synthetic peptide
  Seed: ITVGLIFLC (MOG_HUMAN)
ITVGLIFLV

SEQ ID NO: 117963 - protein, 9 aa, Artificial Sequence
  Description of Artificial Sequence: Synthetic peptide
  Seed: GPRHPIRAL (MOG_HUMAN)
GPRHPIRAV

SEQ ID NO: 117964 - protein, 10 aa, Artificial Sequence
  Description of Artificial Sequence: Synthetic peptide
  Seed: SFLLLLLLQV (MOG_HUMAN)
SWLLLLLLQV

SEQ ID NO: 117965 - protein, 10 aa, Artificial Sequence
  Description of Artificial Sequence: Synthetic peptide
  Seed: SLSRPSLPSC (MOG_HUMAN)
SKSRPSLPSI

SEQ ID NO: 117966 - protein, 10 aa, Artificial Sequence
  Description of Artificial Sequence: Synthetic peptide
  Seed: MEVGWYRPPF (MOG_HUMAN)
MAVGWYRPPY

SEQ ID NO: 117967 - protein, 9 aa, Artificial Sequence
  Description of Artificial Sequence: Synthetic peptide
  Seed: TCFFRDHSY (MOG_HUMAN)
THFFRDHSY

SEQ ID NO: 117968 - protein, 9 aa, Artificial Sequence
  Description of Artificial Sequence: Synthetic peptide
  Seed: IVPVLGPLV (MOG_HUMAN)
IVPVLGPLL

SEQ ID NO: 117969 - protein, 9 aa, Artificial Sequence
  Description of Artificial Sequence: Synthetic peptide
  Seed: LIFLCLQYR (MOG_HUMAN)
LLFLCLQYK

SEQ ID NO: 117970 - protein, 9 aa, Artificial Sequence
  Description of Artificial Sequence: Synthetic peptide
  Seed: YRPPFSRVV (MOG_HUMAN)
YTPPFSRVY

SEQ ID NO: 117971 - protein, 10 aa, Artificial Sequence
  Description of Artificial Sequence: Synthetic peptide
  Seed: MEVGWYRPPF (MOG_HUMAN)
MLVGWYRPPY

SEQ ID NO: 117972 - protein, 9 aa, Artificial Sequence
  Description of Artificial Sequence: Synthetic peptide
  Seed: LLQITVGLI (MOG_HUMAN)
LMQITVGLV

SEQ ID NO: 117973 - protein, 10 aa, Artificial Sequence
  Description of Artificial Sequence: Synthetic peptide
  Seed: FDPHFLRVPC (MOG_HUMAN)
FRPHFLRVPP

SEQ ID NO: 117974 - protein, 9 aa, Artificial Sequence
  Description of Artificial Sequence: Synthetic peptide
  Seed: TGMEVGWYR (MOG_HUMAN)
TNMEVGWYK

SEQ ID NO: 117975 - protein, 9 aa, Artificial Sequence
  Description of Artificial Sequence: Synthetic peptide
  Seed: VVHLYRNGK (MOG_HUMAN)
VQHLYRNGR

SEQ ID NO: 117976 - protein, 9 aa, Artificial Sequence
  Description of Artificial Sequence: Synthetic peptide
  Seed: EVGWYRPPF (MOG_HUMAN)
EAGWYRPPR

SEQ ID NO: 117977 - protein, 10 aa, Artificial Sequence
  Description of Artificial Sequence: Synthetic peptide
  Seed: LLLLQVSSSY (MOG_HUMAN)
LDLLQVSSSF

SEQ ID NO: 117978 - protein, 9 aa, Artificial Sequence
  Description of Artificial Sequence: Synthetic peptide
  Seed: RVIGPRHPI (MOG_HUMAN)
RMIGPRHPV

SEQ ID NO: 117979 - protein, 10 aa, Artificial Sequence
  Description of Artificial Sequence: Synthetic peptide
  Seed: EYRGRTELLK (MOG_HUMAN)
EFRGRTELLR

SEQ ID NO: 117980 - protein, 9 aa, Artificial Sequence
  Description of Artificial Sequence: Synthetic peptide
  Seed: LQITVGLIF (MOG_HUMAN)
LTITVGLIM

SEQ ID NO: 117981 - protein, 10 aa, Artificial Sequence
  Description of Artificial Sequence: Synthetic peptide
  Seed: FLLLLLLQVS (MOG_HUMAN)
FYLLLLLQVV

SEQ ID NO: 117982 - protein, 9 aa, Artificial Sequence
  Description of Artificial Sequence: Synthetic peptide
  Seed: TFDPHFLRV (MOG_HUMAN)
TVDPHFLRW

SEQ ID NO: 117983 - protein, 10 aa, Artificial Sequence
  Description of Artificial Sequence: Synthetic peptide
  Seed: SLSRPSLPSC (MOG_HUMAN)
SDSRPSLPSA

SEQ ID NO: 117984 - protein, 10 aa, Artificial Sequence
  Description of Artificial Sequence: Synthetic peptide
  Seed: FSDEGGFTCF (MOG_HUMAN)
FADEGGFTCW

SEQ ID NO: 117985 - protein, 9 aa, Artificial Sequence
  Description of Artificial Sequence: Synthetic peptide
  Seed: LQITVGLIF (MOG_HUMAN)
LIITVGLIF

SEQ ID NO: 117986 - protein, 9 aa, Artificial Sequence
  Description of Artificial Sequence: Synthetic peptide
  Seed: MASLSRPSL (MOG_HUMAN)
MFSLSRPSL

SEQ ID NO: 117987 - protein, 9 aa, Artificial Sequence
  Description of Artificial Sequence: Synthetic peptide
  Seed: FSDEGGFTC (MOG_HUMAN)
FTDEGGFTA

SEQ ID NO: 117988 - protein, 10 aa, Artificial Sequence
  Description of Artificial Sequence: Synthetic peptide
  Seed: RTFDPHFLRV (MOG_HUMAN)
RMFDPHFLRE

SEQ ID NO: 117989 - protein, 10 aa, Artificial Sequence
  Description of Artificial Sequence: Synthetic peptide
  Seed: FRVIGPRHPI (MOG_HUMAN)
FKVIGPRHPV

SEQ ID NO: 117990 - protein, 9 aa, Artificial Sequence
  Description of Artificial Sequence: Synthetic peptide
  Seed: MELKVEDPF (MOG_HUMAN)
MQLKVEDPL

SEQ ID NO: 117991 - protein, 9 aa, Artificial Sequence
  Description of Artificial Sequence: Synthetic peptide
  Seed: LAGQFLEEL (MOG_HUMAN)
LRGQFLEEY

SEQ ID NO: 117992 - protein, 9 aa, Artificial Sequence
  Description of Artificial Sequence: Synthetic peptide
  Seed: VGDEVELPC (MOG_HUMAN)
VIDEVELPM

SEQ ID NO: 117993 - protein, 10 aa, Artificial Sequence
  Description of Artificial Sequence: Synthetic peptide
  Seed: RIRNVRFSDE (MOG_HUMAN)
RIRNVRFSDA

SEQ ID NO: 117994 - protein, 10 aa, Artificial Sequence
  Description of Artificial Sequence: Synthetic peptide
  Seed: RPPFSRVVHL (MOG_HUMAN)
RDPFSRVVHL

SEQ ID NO: 117995 - protein, 10 aa, Artificial Sequence
  Description of Artificial Sequence: Synthetic peptide
  Seed: KNATGMEVGW (MOG_HUMAN)
KYATGMEVGW

SEQ ID NO: 117996 - protein, 9 aa, Artificial Sequence
  Description of Artificial Sequence: Synthetic peptide
  Seed: TFDPHFLRV (MOG_HUMAN)
TNDPHFLRL

SEQ ID NO: 117997 - protein, 9 aa, Artificial Sequence
  Description of Artificial Sequence: Synthetic peptide
  Seed: EEAAMELKV (MOG_HUMAN)
EEAAMELKP

SEQ ID NO: 117998 - protein, 9 aa, Artificial Sequence
  Description of Artificial Sequence: Synthetic peptide
  Seed: SLPSCLCSF (MOG_HUMAN)
SAPSCLCSV

SEQ ID NO: 117999 - protein, 10 aa, Artificial Sequence
  Description of Artificial Sequence: Synthetic peptide
  Seed: AVLPVLLLQI (MOG_HUMAN)
AQLPVLLLQL

SEQ ID NO: 118000 - protein, 9 aa, Artificial Sequence
  Description of Artificial Sequence: Synthetic peptide
  Seed: TFDPHFLRV (MOG_HUMAN)
TADPHFLRW

SEQ ID NO: 118001 - protein, 10 aa, Artificial Sequence
  Description of Artificial Sequence: Synthetic peptide
  Seed: GPRHPIRALV (MOG_HUMAN)
GPRHPIRALA

SEQ ID NO: 118002 - protein, 9 aa, Artificial Sequence
  Description of Artificial Sequence: Synthetic peptide
  Seed: GQFRVIGPR (MOG_HUMAN)
GGFRVIGPR

SEQ ID NO: 118003 - protein, 9 aa, Artificial Sequence
  Description of Artificial Sequence: Synthetic peptide
  Seed: MASLSRPSL (MOG_HUMAN)
MHSLSRPSF

SEQ ID NO: 118004 - protein, 8 aa, Artificial Sequence
  Description of Artificial Sequence: Synthetic peptide
  Seed: GGFTCFFR (MOG_HUMAN)
GIFTCFFR

SEQ ID NO: 118005 - protein, 10 aa, Artificial Sequence
  Description of Artificial Sequence: Synthetic peptide
  Seed: VLLAVLPVLL (MOG_HUMAN)
VRLAVLPVLL

SEQ ID NO: 118006 - protein, 9 aa, Artificial Sequence
  Description of Artificial Sequence: Synthetic peptide
  Seed: RIRNVRFSD (MOG_HUMAN)
RNRNVRFSI

SEQ ID NO: 118007 - protein, 9 aa, Artificial Sequence
  Description of Artificial Sequence: Synthetic peptide
  Seed: VGDEVELPC (MOG_HUMAN)
VMDEVELPF

SEQ ID NO: 118008 - protein, 11 aa, Artificial Sequence
  Description of Artificial Sequence: Synthetic peptide
  Seed: NATGMEVGWYR (MOG_HUMAN)
NLTGMEVGWYR

SEQ ID NO: 118009 - protein, 9 aa, Artificial Sequence
  Description of Artificial Sequence: Synthetic peptide
  Seed: HFLRVPCWK (MOG_HUMAN)
HTLRVPCWK

SEQ ID NO: 118010 - protein, 10 aa, Artificial Sequence
  Description of Artificial Sequence: Synthetic peptide
  Seed: FDPHFLRVPC (MOG_HUMAN)
FEPHFLRVPS

SEQ ID NO: 118011 - protein, 9 aa, Artificial Sequence
  Description of Artificial Sequence: Synthetic peptide
  Seed: RVIGPRHPI (MOG_HUMAN)
RPIGPRHPT

SEQ ID NO: 118012 - protein, 10 aa, Artificial Sequence
  Description of Artificial Sequence: Synthetic peptide
  Seed: SYQEEAAMEL (MOG_HUMAN)
SFQEEAAMEM

SEQ ID NO: 118013 - protein, 9 aa, Artificial Sequence
  Description of Artificial Sequence: Synthetic peptide
  Seed: RVPCWKITL (MOG_HUMAN)
RAPCWKITR

SEQ ID NO: 118014 - protein, 9 aa, Artificial Sequence
  Description of Artificial Sequence: Synthetic peptide
  Seed: KVEDPFYWV (MOG_HUMAN)
KQEDPFYWL

SEQ ID NO: 118015 - protein, 10 aa, Artificial Sequence
  Description of Artificial Sequence: Synthetic peptide
  Seed: VLLAVLPVLL (MOG_HUMAN)
VFLAVLPVLL

SEQ ID NO: 118016 - protein, 10 aa, Artificial Sequence
  Description of Artificial Sequence: Synthetic peptide
  Seed: FLLLLLLQVS (MOG_HUMAN)
FNLLLLLQVV

SEQ ID NO: 118017 - protein, 10 aa, Artificial Sequence
  Description of Artificial Sequence: Synthetic peptide
  Seed: FRVIGPRHPI (MOG_HUMAN)
FQVIGPRHPI

SEQ ID NO: 118018 - protein, 10 aa, Artificial Sequence
  Description of Artificial Sequence: Synthetic peptide
  Seed: FDPHFLRVPC (MOG_HUMAN)
FDPHFLRVPA

SEQ ID NO: 118019 - protein, 10 aa, Artificial Sequence
  Description of Artificial Sequence: Synthetic peptide
  Seed: FDPHFLRVPC (MOG_HUMAN)
FYPHFLRVPA

SEQ ID NO: 118020 - protein, 10 aa, Artificial Sequence
  Description of Artificial Sequence: Synthetic peptide
  Seed: IGPRHPIRAL (MOG_HUMAN)
ITPRHPIRAV

SEQ ID NO: 118021 - protein, 9 aa, Artificial Sequence
  Description of Artificial Sequence: Synthetic peptide
  Seed: LLLQVSSSY (MOG_HUMAN)
LTLQVSSSI

SEQ ID NO: 118022 - protein, 10 aa, Artificial Sequence
  Description of Artificial Sequence: Synthetic peptide
  Seed: RVVHLYRNGK (MOG_HUMAN)
RDVHLYRNGK

SEQ ID NO: 118023 - protein, 9 aa, Artificial Sequence
  Description of Artificial Sequence: Synthetic peptide
  Seed: RDHSYQEEA (MOG_HUMAN)
RDHSYQEEI

SEQ ID NO: 118024 - protein, 9 aa, Artificial Sequence
  Description of Artificial Sequence: Synthetic peptide
  Seed: LLAVLPVLL (MOG_HUMAN)
LQAVLPVLY

SEQ ID NO: 118025 - protein, 11 aa, Artificial Sequence
  Description of Artificial Sequence: Synthetic peptide
  Seed: RISPGKNATGM (MOG_HUMAN)
RISPGKNATGY

SEQ ID NO: 118026 - protein, 10 aa, Artificial Sequence
  Description of Artificial Sequence: Synthetic peptide
  Seed: LVLLAVLPVL (MOG_HUMAN)
LILLAVLPVV

SEQ ID NO: 118027 - protein, 9 aa, Artificial Sequence
  Description of Artificial Sequence: Synthetic peptide
  Seed: VLLAVLPVL (MOG_HUMAN)
VILAVLPVY

SEQ ID NO: 118028 - protein, 9 aa, Artificial Sequence
  Description of Artificial Sequence: Synthetic peptide
  Seed: FLLLLLLQV (MOG_HUMAN)
FSLLLLLQV

SEQ ID NO: 118029 - protein, 10 aa, Artificial Sequence
  Description of Artificial Sequence: Synthetic peptide
  Seed: DAIGEGKVTL (MOG_HUMAN)
DTIGEGKVTY

SEQ ID NO: 118030 - protein, 9 aa, Artificial Sequence
  Description of Artificial Sequence: Synthetic peptide
  Seed: VLGPLVALI (MOG_HUMAN)
VLGPLVALW

SEQ ID NO: 118031 - protein, 9 aa, Artificial Sequence
  Description of Artificial Sequence: Synthetic peptide
  Seed: HRTFDPHFL (MOG_HUMAN)
HHTFDPHFF

SEQ ID NO: 118032 - protein, 10 aa, Artificial Sequence
  Description of Artificial Sequence: Synthetic peptide
  Seed: VLLLQITVGL (MOG_HUMAN)
VKLLQITVGV

SEQ ID NO: 118033 - protein, 9 aa, Artificial Sequence
  Description of Artificial Sequence: Synthetic peptide
  Seed: SLPSCLCSF (MOG_HUMAN)
SYPSCLCSM

SEQ ID NO: 118034 - protein, 8 aa, Artificial Sequence
  Description of Artificial Sequence: Synthetic peptide
  Seed: VLGPLVAL (MOG_HUMAN)
VQGPLVAI

SEQ ID NO: 118035 - protein, 10 aa, Artificial Sequence
  Description of Artificial Sequence: Synthetic peptide
  Seed: FTCFFRDHSY (MOG_HUMAN)
FSCFFRDHSR

SEQ ID NO: 118036 - protein, 8 aa, Artificial Sequence
  Description of Artificial Sequence: Synthetic peptide
  Seed: RGKLRAEI (MOG_HUMAN)
RPKLRAEL

SEQ ID NO: 118037 - protein, 9 aa, Artificial Sequence
  Description of Artificial Sequence: Synthetic peptide
  Seed: WVSPGVLVL (MOG_HUMAN)
WISPGVLVM

SEQ ID NO: 118038 - protein, 10 aa, Artificial Sequence
  Description of Artificial Sequence: Synthetic peptide
  Seed: SLSRPSLPSC (MOG_HUMAN)
SWSRPSLPSK

SEQ ID NO: 118039 - protein, 10 aa, Artificial Sequence
  Description of Artificial Sequence: Synthetic peptide
  Seed: FDPHFLRVPC (MOG_HUMAN)
FGPHFLRVPP

SEQ ID NO: 118040 - protein, 9 aa, Artificial Sequence
  Description of Artificial Sequence: Synthetic peptide
  Seed: WVSPGVLVL (MOG_HUMAN)
WVSPGVLVF

SEQ ID NO: 118041 - protein, 10 aa, Artificial Sequence
  Description of Artificial Sequence: Synthetic peptide
  Seed: RTFDPHFLRV (MOG_HUMAN)
RSFDPHFLRH

SEQ ID NO: 118042 - protein, 9 aa, Artificial Sequence
  Description of Artificial Sequence: Synthetic peptide
  Seed: VSPGVLVLL (MOG_HUMAN)
VFPGVLVLM

SEQ ID NO: 118043 - protein, 9 aa, Artificial Sequence
  Description of Artificial Sequence: Synthetic peptide
  Seed: FYWVSPGVL (MOG_HUMAN)
FEWVSPGVY

SEQ ID NO: 118044 - protein, 9 aa, Artificial Sequence
  Description of Artificial Sequence: Synthetic peptide
  Seed: TLFVIVPVL (MOG_HUMAN)
TAFVIVPVM

SEQ ID NO: 118045 - protein, 9 aa, Artificial Sequence
  Description of Artificial Sequence: Synthetic peptide
  Seed: VSSSYAGQF (MOG_HUMAN)
VASSYAGQM

SEQ ID NO: 118046 - protein, 10 aa, Artificial Sequence
  Description of Artificial Sequence: Synthetic peptide
  Seed: SDEGGFTCFF (MOG_HUMAN)
SCEGGFTCFW

SEQ ID NO: 118047 - protein, 10 aa, Artificial Sequence
  Description of Artificial Sequence: Synthetic peptide
  Seed: QEEAAMELKV (MOG_HUMAN)
QEEAAMELKF

SEQ ID NO: 118048 - protein, 8 aa, Artificial Sequence
  Description of Artificial Sequence: Synthetic peptide
  Seed: YAGQFRVI (MOG_HUMAN)
YQGQFRVV

SEQ ID NO: 118049 - protein, 9 aa, Artificial Sequence
  Description of Artificial Sequence: Synthetic peptide
  Seed: RIRNVRFSD (MOG_HUMAN)
RIRNVRFST

SEQ ID NO: 118050 - protein, 9 aa, Artificial Sequence
  Description of Artificial Sequence: Synthetic peptide
  Seed: TFDPHFLRV (MOG_HUMAN)
TYDPHFLRI

SEQ ID NO: 118051 - protein, 11 aa, Artificial Sequence
  Description of Artificial Sequence: Synthetic peptide
  Seed: RIRNVRFSDEG (MOG_HUMAN)
RYRNVRFSDEK

SEQ ID NO: 118052 - protein, 9 aa, Artificial Sequence
  Description of Artificial Sequence: Synthetic peptide
  Seed: YQEEAAMEL (MOG_HUMAN)
YEEEAAMEI

SEQ ID NO: 118053 - protein, 9 aa, Artificial Sequence
  Description of Artificial Sequence: Synthetic peptide
  Seed: RTFDPHFLR (MOG_HUMAN)
RQFDPHFLK

SEQ ID NO: 118054 - protein, 10 aa, Artificial Sequence
  Description of Artificial Sequence: Synthetic peptide
  Seed: AIGEGKVTLR (MOG_HUMAN)
AAGEGKVTLY

SEQ ID NO: 118055 - protein, 9 aa, Artificial Sequence
  Description of Artificial Sequence: Synthetic peptide
  Seed: LLLQVSSSY (MOG_HUMAN)
LHLQVSSSF

SEQ ID NO: 118056 - protein, 10 aa, Artificial Sequence
  Description of Artificial Sequence: Synthetic peptide
  Seed: FDPHFLRVPC (MOG_HUMAN)
FHPHFLRVPP

SEQ ID NO: 118057 - protein, 9 aa, Artificial Sequence
  Description of Artificial Sequence: Synthetic peptide
  Seed: FLLLLLLQV (MOG_HUMAN)
FQLLLLLQI

SEQ ID NO: 118058 - protein, 10 aa, Artificial Sequence
  Description of Artificial Sequence: Synthetic peptide
  Seed: VGWYRPPFSR (MOG_HUMAN)
VMWYRPPFSR

SEQ ID NO: 118059 - protein, 9 aa, Artificial Sequence
  Description of Artificial Sequence: Synthetic peptide
  Seed: VLGPLVALI (MOG_HUMAN)
VAGPLVALV

SEQ ID NO: 118060 - protein, 10 aa, Artificial Sequence
  Description of Artificial Sequence: Synthetic peptide
  Seed: HRTFDPHFLR (MOG_HUMAN)
HITFDPHFLR

SEQ ID NO: 118061 - protein, 9 aa, Artificial Sequence
  Description of Artificial Sequence: Synthetic peptide
  Seed: VSPGVLVLL (MOG_HUMAN)
VIPGVLVLI

SEQ ID NO: 118062 - protein, 9 aa, Artificial Sequence
  Description of Artificial Sequence: Synthetic peptide
  Seed: LKDAIGEGK (MOG_HUMAN)
LIDAIGEGY

SEQ ID NO: 118063 - protein, 9 aa, Artificial Sequence
  Description of Artificial Sequence: Synthetic peptide
  Seed: VLPVLLLQI (MOG_HUMAN)
VLPVLLLQV

SEQ ID NO: 118064 - protein, 9 aa, Artificial Sequence
  Description of Artificial Sequence: Synthetic peptide
  Seed: FSDEGGFTC (MOG_HUMAN)
FADEGGFTI

SEQ ID NO: 118065 - protein, 9 aa, Artificial Sequence
  Description of Artificial Sequence: Synthetic peptide
  Seed: LKVEDPFYW (MOG_HUMAN)
LTVEDPFYL

SEQ ID NO: 118066 - protein, 9 aa, Artificial Sequence
  Description of Artificial Sequence: Synthetic peptide
  Seed: AEIENLHRT (MOG_HUMAN)
AEIENLHRA

SEQ ID NO: 118067 - protein, 9 aa, Artificial Sequence
  Description of Artificial Sequence: Synthetic peptide
  Seed: ITVGLIFLC (MOG_HUMAN)
ITVGLIFLF

SEQ ID NO: 118068 - protein, 11 aa, Artificial Sequence
  Description of Artificial Sequence: Synthetic peptide
  Seed: HRTFDPHFLRV (MOG_HUMAN)
HHTFDPHFLRR

SEQ ID NO: 118069 - protein, 10 aa, Artificial Sequence
  Description of Artificial Sequence: Synthetic peptide
  Seed: SCLCSFLLLL (MOG_HUMAN)
SLLCSFLLLA

SEQ ID NO: 118070 - protein, 11 aa, Artificial Sequence
  Description of Artificial Sequence: Synthetic peptide
  Seed: IGPRHPIRALV (MOG_HUMAN)
IRPRHPIRALL

SEQ ID NO: 118071 - protein, 9 aa, Artificial Sequence
  Description of Artificial Sequence: Synthetic peptide
  Seed: RTFDPHFLR (MOG_HUMAN)
RVFDPHFLI

SEQ ID NO: 118072 - protein, 9 aa, Artificial Sequence
  Description of Artificial Sequence: Synthetic peptide
  Seed: RTFDPHFLR (MOG_HUMAN)
RLFDPHFLR

SEQ ID NO: 118073 - protein, 10 aa, Artificial Sequence
  Description of Artificial Sequence: Synthetic peptide
  Seed: RTFDPHFLRV (MOG_HUMAN)
RQFDPHFLRW

SEQ ID NO: 118074 - protein, 9 aa, Artificial Sequence
  Description of Artificial Sequence: Synthetic peptide
  Seed: MELKVEDPF (MOG_HUMAN)
MSLKVEDPF

SEQ ID NO: 118075 - protein, 9 aa, Artificial Sequence
  Description of Artificial Sequence: Synthetic peptide
  Seed: LLLQITVGL (MOG_HUMAN)
LMLQITVGK

SEQ ID NO: 118076 - protein, 9 aa, Artificial Sequence
  Description of Artificial Sequence: Synthetic peptide
  Seed: RIRNVRFSD (MOG_HUMAN)
RARNVRFSQ

SEQ ID NO: 118077 - protein, 10 aa, Artificial Sequence
  Description of Artificial Sequence: Synthetic peptide
  Seed: AIGEGKVTLR (MOG_HUMAN)
AVGEGKVTLK

SEQ ID NO: 118078 - protein, 9 aa, Artificial Sequence
  Description of Artificial Sequence: Synthetic peptide
  Seed: RDHSYQEEA (MOG_HUMAN)
REHSYQEEI

SEQ ID NO: 118079 - protein, 9 aa, Artificial Sequence
  Description of Artificial Sequence: Synthetic peptide
  Seed: RVPCWKITL (MOG_HUMAN)
RMPCWKITL

SEQ ID NO: 118080 - protein, 10 aa, Artificial Sequence
  Description of Artificial Sequence: Synthetic peptide
  Seed: DAIGEGKVTL (MOG_HUMAN)
DMIGEGKVTR

SEQ ID NO: 118081 - protein, 10 aa, Artificial Sequence
  Description of Artificial Sequence: Synthetic peptide
  Seed: RTFDPHFLRV (MOG_HUMAN)
RRFDPHFLRI

SEQ ID NO: 118082 - protein, 9 aa, Artificial Sequence
  Description of Artificial Sequence: Synthetic peptide
  Seed: GPRHPIRAL (MOG_HUMAN)
GPRHPIRAC

SEQ ID NO: 118083 - protein, 10 aa, Artificial Sequence
  Description of Artificial Sequence: Synthetic peptide
  Seed: RTFDPHFLRV (MOG_HUMAN)
RQFDPHFLRC

SEQ ID NO: 118084 - protein, 10 aa, Artificial Sequence
  Description of Artificial Sequence: Synthetic peptide
  Seed: RTFDPHFLRV (MOG_HUMAN)
RVFDPHFLRT

SEQ ID NO: 118085 - protein, 10 aa, Artificial Sequence
  Description of Artificial Sequence: Synthetic peptide
  Seed: FVIVPVLGPL (MOG_HUMAN)
FQIVPVLGPY

SEQ ID NO: 118086 - protein, 8 aa, Artificial Sequence
  Description of Artificial Sequence: Synthetic peptide
  Seed: FSDEGGFT (MOG_HUMAN)
FSDEGGFI

SEQ ID NO: 118087 - protein, 11 aa, Artificial Sequence
  Description of Artificial Sequence: Synthetic peptide
  Seed: VIGPRHPIRAL (MOG_HUMAN)
VPGPRHPIRAL

SEQ ID NO: 118088 - protein, 10 aa, Artificial Sequence
  Description of Artificial Sequence: Synthetic peptide
  Seed: SLSRPSLPSC (MOG_HUMAN)
SLSRPSLPSL

SEQ ID NO: 118089 - protein, 10 aa, Artificial Sequence
  Description of Artificial Sequence: Synthetic peptide
  Seed: IGPRHPIRAL (MOG_HUMAN)
IVPRHPIRAI

SEQ ID NO: 118090 - protein, 11 aa, Artificial Sequence
  Description of Artificial Sequence: Synthetic peptide
  Seed: VIGPRHPIRAL (MOG_HUMAN)
VAGPRHPIRAM

SEQ ID NO: 118091 - protein, 9 aa, Artificial Sequence
  Description of Artificial Sequence: Synthetic peptide
  Seed: IFLCLQYRL (MOG_HUMAN)
IWLCLQYRM

SEQ ID NO: 118092 - protein, 9 aa, Artificial Sequence
  Description of Artificial Sequence: Synthetic peptide
  Seed: MELKVEDPF (MOG_HUMAN)
MKLKVEDPF

SEQ ID NO: 118093 - protein, 9 aa, Artificial Sequence
  Description of Artificial Sequence: Synthetic peptide
  Seed: KLRAEIENL (MOG_HUMAN)
KQRAEIENL

SEQ ID NO: 118094 - protein, 10 aa, Artificial Sequence
  Description of Artificial Sequence: Synthetic peptide
  Seed: RALVGDEVEL (MOG_HUMAN)
RMLVGDEVEI

SEQ ID NO: 118095 - protein, 10 aa, Artificial Sequence
  Description of Artificial Sequence: Synthetic peptide
  Seed: AVLPVLLLQI (MOG_HUMAN)
AMLPVLLLQL

SEQ ID NO: 118096 - protein, 9 aa, Artificial Sequence
  Description of Artificial Sequence: Synthetic peptide
  Seed: LSRPSLPSC (MOG_HUMAN)
LYRPSLPSK

SEQ ID NO: 118097 - protein, 10 aa, Artificial Sequence
  Description of Artificial Sequence: Synthetic peptide
  Seed: LVLLAVLPVL (MOG_HUMAN)
LTLLAVLPVV

SEQ ID NO: 118098 - protein, 10 aa, Artificial Sequence
  Description of Artificial Sequence: Synthetic peptide
  Seed: SLSRPSLPSC (MOG_HUMAN)
SPSRPSLPSI

SEQ ID NO: 118099 - protein, 9 aa, Artificial Sequence
  Description of Artificial Sequence: Synthetic peptide
  Seed: YRPPFSRVV (MOG_HUMAN)
YWPPFSRVL

SEQ ID NO: 118100 - protein, 9 aa, Artificial Sequence
  Description of Artificial Sequence: Synthetic peptide
  Seed: RIRNVRFSD (MOG_HUMAN)
RYRNVRFST

SEQ ID NO: 118101 - protein, 9 aa, Artificial Sequence
  Description of Artificial Sequence: Synthetic peptide
  Seed: FSDEGGFTC (MOG_HUMAN)
FQDEGGFTY

SEQ ID NO: 118102 - protein, 10 aa, Artificial Sequence
  Description of Artificial Sequence: Synthetic peptide
  Seed: YWVSPGVLVL (MOG_HUMAN)
YLVSPGVLVI

SEQ ID NO: 118103 - protein, 11 aa, Artificial Sequence
  Description of Artificial Sequence: Synthetic peptide
  Seed: NATGMEVGWYR (MOG_HUMAN)
NSTGMEVGWYK

SEQ ID NO: 118104 - protein, 9 aa, Artificial Sequence
  Description of Artificial Sequence: Synthetic peptide
  Seed: HSYQEEAAM (MOG_HUMAN)
HQYQEEAAV

SEQ ID NO: 118105 - protein, 9 aa, Artificial Sequence
  Description of Artificial Sequence: Synthetic peptide
  Seed: RVVHLYRNG (MOG_HUMAN)
RTVHLYRNK

SEQ ID NO: 118106 - protein, 10 aa, Artificial Sequence
  Description of Artificial Sequence: Synthetic peptide
  Seed: FSDEGGFTCF (MOG_HUMAN)
FQDEGGFTCI

SEQ ID NO: 118107 - protein, 9 aa, Artificial Sequence
  Description of Artificial Sequence: Synthetic peptide
  Seed: LKVEDPFYW (MOG_HUMAN)
LAVEDPFYF

SEQ ID NO: 118108 - protein, 9 aa, Artificial Sequence
  Description of Artificial Sequence: Synthetic peptide
  Seed: WVSPGVLVL (MOG_HUMAN)
WISPGVLVW

SEQ ID NO: 118109 - protein, 9 aa, Artificial Sequence
  Description of Artificial Sequence: Synthetic peptide
  Seed: WVSPGVLVL (MOG_HUMAN)
WLSPGVLVA

SEQ ID NO: 118110 - protein, 9 aa, Artificial Sequence
  Description of Artificial Sequence: Synthetic peptide
  Seed: KVEDPFYWV (MOG_HUMAN)
KMEDPFYWT

SEQ ID NO: 118111 - protein, 9 aa, Artificial Sequence
  Description of Artificial Sequence: Synthetic peptide
  Seed: SSYAGQFRV (MOG_HUMAN)
SMYAGQFRC

SEQ ID NO: 118112 - protein, 10 aa, Artificial Sequence
  Description of Artificial Sequence: Synthetic peptide
  Seed: FSDEGGFTCF (MOG_HUMAN)
FSDEGGFTCY

SEQ ID NO: 118113 - protein, 9 aa, Artificial Sequence
  Description of Artificial Sequence: Synthetic peptide
  Seed: VIVPVLGPL (MOG_HUMAN)
VTVPVLGPK

SEQ ID NO: 118114 - protein, 9 aa, Artificial Sequence
  Description of Artificial Sequence: Synthetic peptide
  Seed: FLLLLLLQV (MOG_HUMAN)
FMLLLLLQM

SEQ ID NO: 118115 - protein, 9 aa, Artificial Sequence
  Description of Artificial Sequence: Synthetic peptide
  Seed: VIVPVLGPL (MOG_HUMAN)
VAVPVLGPH

SEQ ID NO: 118116 - protein, 10 aa, Artificial Sequence
  Description of Artificial Sequence: Synthetic peptide
  Seed: VLLLQITVGL (MOG_HUMAN)
VRLLQITVGV

SEQ ID NO: 118117 - protein, 11 aa, Artificial Sequence
  Description of Artificial Sequence: Synthetic peptide
  Seed: RFSDEGGFTCF (MOG_HUMAN)
RISDEGGFTCY

SEQ ID NO: 118118 - protein, 10 aa, Artificial Sequence
  Description of Artificial Sequence: Synthetic peptide
  Seed: AVLPVLLLQI (MOG_HUMAN)
ALLPVLLLQA

SEQ ID NO: 118119 - protein, 9 aa, Artificial Sequence
  Description of Artificial Sequence: Synthetic peptide
  Seed: RVIGPRHPI (MOG_HUMAN)
RTIGPRHPS

SEQ ID NO: 118120 - protein, 10 aa, Artificial Sequence
  Description of Artificial Sequence: Synthetic peptide
  Seed: RIRNVRFSDE (MOG_HUMAN)
RFRNVRFSDI

SEQ ID NO: 118121 - protein, 9 aa, Artificial Sequence
  Description of Artificial Sequence: Synthetic peptide
  Seed: GQFRVIGPR (MOG_HUMAN)
GSFRVIGPR

SEQ ID NO: 118122 - protein, 9 aa, Artificial Sequence
  Description of Artificial Sequence: Synthetic peptide
  Seed: RIRNVRFSD (MOG_HUMAN)
RMRNVRFST

SEQ ID NO: 118123 - protein, 9 aa, Artificial Sequence
  Description of Artificial Sequence: Synthetic peptide
  Seed: RVPCWKITL (MOG_HUMAN)
RSPCWKITY

SEQ ID NO: 118124 - protein, 9 aa, Artificial Sequence
  Description of Artificial Sequence: Synthetic peptide
  Seed: LQITVGLIF (MOG_HUMAN)
LQITVGLIW

SEQ ID NO: 118125 - protein, 8 aa, Artificial Sequence
  Description of Artificial Sequence: Synthetic peptide
  Seed: YWVSPGVL (MOG_HUMAN)
YYVSPGVY

SEQ ID NO: 118126 - protein, 9 aa, Artificial Sequence
  Description of Artificial Sequence: Synthetic peptide
  Seed: TFDPHFLRV (MOG_HUMAN)
TEDPHFLRM

SEQ ID NO: 118127 - protein, 9 aa, Artificial Sequence
  Description of Artificial Sequence: Synthetic peptide
  Seed: VSPGVLVLL (MOG_HUMAN)
VAPGVLVLV

SEQ ID NO: 118128 - protein, 9 aa, Artificial Sequence
  Description of Artificial Sequence: Synthetic peptide
  Seed: YRPPFSRVV (MOG_HUMAN)
YFPPFSRVI

SEQ ID NO: 118129 - protein, 10 aa, Artificial Sequence
  Description of Artificial Sequence: Synthetic peptide
  Seed: DEGGFTCFFR (MOG_HUMAN)
DFGGFTCFFR

SEQ ID NO: 118130 - protein, 9 aa, Artificial Sequence
  Description of Artificial Sequence: Synthetic peptide
  Seed: FYWVSPGVL (MOG_HUMAN)
FSWVSPGVI

SEQ ID NO: 118131 - protein, 10 aa, Artificial Sequence
  Description of Artificial Sequence: Synthetic peptide
  Seed: KITLFVIVPV (MOG_HUMAN)
KRTLFVIVPV

SEQ ID NO: 118132 - protein, 10 aa, Artificial Sequence
  Description of Artificial Sequence: Synthetic peptide
  Seed: RVPCWKITLF (MOG_HUMAN)
RLPCWKITLF

SEQ ID NO: 118133 - protein, 11 aa, Artificial Sequence
  Description of Artificial Sequence: Synthetic peptide
  Seed: RRLAGQFLEEL (MOG_HUMAN)
RYLAGQFLEEL

SEQ ID NO: 118134 - protein, 9 aa, Artificial Sequence
  Description of Artificial Sequence: Synthetic peptide
  Seed: YQEEAAMEL (MOG_HUMAN)
YHEEAAMEI

SEQ ID NO: 118135 - protein, 9 aa, Artificial Sequence
  Description of Artificial Sequence: Synthetic peptide
  Seed: CLCSFLLLL (MOG_HUMAN)
CICSFLLLI

SEQ ID NO: 118136 - protein, 9 aa, Artificial Sequence
  Description of Artificial Sequence: Synthetic peptide
  Seed: TFDPHFLRV (MOG_HUMAN)
TIDPHFLRI

SEQ ID NO: 118137 - protein, 9 aa, Artificial Sequence
  Description of Artificial Sequence: Synthetic peptide
  Seed: FSDEGGFTC (MOG_HUMAN)
FGDEGGFTV

SEQ ID NO: 118138 - protein, 9 aa, Artificial Sequence
  Description of Artificial Sequence: Synthetic peptide
  Seed: TFDPHFLRV (MOG_HUMAN)
TRDPHFLRF

SEQ ID NO: 118139 - protein, 10 aa, Artificial Sequence
  Description of Artificial Sequence: Synthetic peptide
  Seed: FYWVSPGVLV (MOG_HUMAN)
FFWVSPGVLF

SEQ ID NO: 118140 - protein, 10 aa, Artificial Sequence
  Description of Artificial Sequence: Synthetic peptide
  Seed: YWVSPGVLVL (MOG_HUMAN)
YYVSPGVLVI

SEQ ID NO: 118141 - protein, 9 aa, Artificial Sequence
  Description of Artificial Sequence: Synthetic peptide
  Seed: FSDEGGFTC (MOG_HUMAN)
FSDEGGFTW

SEQ ID NO: 118142 - protein, 9 aa, Artificial Sequence
  Description of Artificial Sequence: Synthetic peptide
  Seed: YRPPFSRVV (MOG_HUMAN)
YWPPFSRVY

SEQ ID NO: 118143 - protein, 10 aa, Artificial Sequence
  Description of Artificial Sequence: Synthetic peptide
  Seed: SSYAGQFRVI (MOG_HUMAN)
SNYAGQFRVF

SEQ ID NO: 118144 - protein, 10 aa, Artificial Sequence
  Description of Artificial Sequence: Synthetic peptide
  Seed: FSDEGGFTCF (MOG_HUMAN)
FQDEGGFTCL

SEQ ID NO: 118145 - protein, 10 aa, Artificial Sequence
  Description of Artificial Sequence: Synthetic peptide
  Seed: RPPFSRVVHL (MOG_HUMAN)
RPPFSRVVHF

SEQ ID NO: 118146 - protein, 9 aa, Artificial Sequence
  Description of Artificial Sequence: Synthetic peptide
  Seed: ICYNWLHRR (MOG_HUMAN)
ILYNWLHRV

SEQ ID NO: 118147 - protein, 9 aa, Artificial Sequence
  Description of Artificial Sequence: Synthetic peptide
  Seed: FSDEGGFTC (MOG_HUMAN)
FVDEGGFTF

SEQ ID NO: 118148 - protein, 10 aa, Artificial Sequence
  Description of Artificial Sequence: Synthetic peptide
  Seed: MELKVEDPFY (MOG_HUMAN)
MQLKVEDPFY

SEQ ID NO: 118149 - protein, 10 aa, Artificial Sequence
  Description of Artificial Sequence: Synthetic peptide
  Seed: TGMEVGWYRP (MOG_HUMAN)
TVMEVGWYRS

SEQ ID NO: 118150 - protein, 9 aa, Artificial Sequence
  Description of Artificial Sequence: Synthetic peptide
  Seed: WVSPGVLVL (MOG_HUMAN)
WPSPGVLVM

SEQ ID NO: 118151 - protein, 9 aa, Artificial Sequence
  Description of Artificial Sequence: Synthetic peptide
  Seed: SRPSLPSCL (MOG_HUMAN)
SIPSLPSCM

SEQ ID NO: 118152 - protein, 9 aa, Artificial Sequence
  Description of Artificial Sequence: Synthetic peptide
  Seed: LLLQVSSSY (MOG_HUMAN)
LSLQVSSSY

SEQ ID NO: 118153 - protein, 10 aa, Artificial Sequence
  Description of Artificial Sequence: Synthetic peptide
  Seed: IGPRHPIRAL (MOG_HUMAN)
IMPRHPIRAV

SEQ ID NO: 118154 - protein, 9 aa, Artificial Sequence
  Description of Artificial Sequence: Synthetic peptide
  Seed: RVPCWKITL (MOG_HUMAN)
RSPCWKITK

SEQ ID NO: 118155 - protein, 9 aa, Artificial Sequence
  Description of Artificial Sequence: Synthetic peptide
  Seed: EGGFTCFFR (MOG_HUMAN)
ELGFTCFFK

SEQ ID NO: 118156 - protein, 9 aa, Artificial Sequence
  Description of Artificial Sequence: Synthetic peptide
  Seed: SLPSCLCSF (MOG_HUMAN)
SIPSCLCSL

SEQ ID NO: 118157 - protein, 9 aa, Artificial Sequence
  Description of Artificial Sequence: Synthetic peptide
  Seed: RTFDPHFLR (MOG_HUMAN)
RGFDPHFLK

SEQ ID NO: 118158 - protein, 9 aa, Artificial Sequence
  Description of Artificial Sequence: Synthetic peptide
  Seed: VIVPVLGPL (MOG_HUMAN)
VIVPVLGPY

SEQ ID NO: 118159 - protein, 9 aa, Artificial Sequence
  Description of Artificial Sequence: Synthetic peptide
  Seed: LLLQITVGL (MOG_HUMAN)
LLLQITVGA

SEQ ID NO: 118160 - protein, 8 aa, Artificial Sequence
  Description of Artificial Sequence: Synthetic peptide
  Seed: VTLRIRNV (MOG_HUMAN)
VQLRIRNV

SEQ ID NO: 118161 - protein, 10 aa, Artificial Sequence
  Description of Artificial Sequence: Synthetic peptide
  Seed: HRTFDPHFLR (MOG_HUMAN)
HVTFDPHFLR

SEQ ID NO: 118162 - protein, 9 aa, Artificial Sequence
  Description of Artificial Sequence: Synthetic peptide
  Seed: LLLQVSSSY (MOG_HUMAN)
LILQVSSSF

SEQ ID NO: 118163 - protein, 10 aa, Artificial Sequence
  Description of Artificial Sequence: Synthetic peptide
  Seed: FDPHFLRVPC (MOG_HUMAN)
FEPHFLRVPA

SEQ ID NO: 118164 - protein, 10 aa, Artificial Sequence
  Description of Artificial Sequence: Synthetic peptide
  Seed: RTFDPHFLRV (MOG_HUMAN)
RWFDPHFLRK

SEQ ID NO: 118165 - protein, 10 aa, Artificial Sequence
  Description of Artificial Sequence: Synthetic peptide
  Seed: RVVHLYRNGK (MOG_HUMAN)
RNVHLYRNGR

SEQ ID NO: 118166 - protein, 9 aa, Artificial Sequence
  Description of Artificial Sequence: Synthetic peptide
  Seed: YQEEAAMEL (MOG_HUMAN)
YPEEAAMEL

SEQ ID NO: 118167 - protein, 8 aa, Artificial Sequence
  Description of Artificial Sequence: Synthetic peptide
  Seed: LLQVSSSY (MOG_HUMAN)
LMQVSSSF

SEQ ID NO: 118168 - protein, 9 aa, Artificial Sequence
  Description of Artificial Sequence: Synthetic peptide
  Seed: LSRPSLPSC (MOG_HUMAN)
LQRPSLPSV

SEQ ID NO: 118169 - protein, 9 aa, Artificial Sequence
  Description of Artificial Sequence: Synthetic peptide
  Seed: VLGPLVALI (MOG_HUMAN)
VMGPLVALW

SEQ ID NO: 118170 - protein, 8 aa, Artificial Sequence
  Description of Artificial Sequence: Synthetic peptide
  Seed: IENLHRTF (MOG_HUMAN)
IDNLHRTF

SEQ ID NO: 118171 - protein, 9 aa, Artificial Sequence
  Description of Artificial Sequence: Synthetic peptide
  Seed: RIRNVRFSD (MOG_HUMAN)
RQRNVRFSG

SEQ ID NO: 118172 - protein, 10 aa, Artificial Sequence
  Description of Artificial Sequence: Synthetic peptide
  Seed: SDEGGFTCFF (MOG_HUMAN)
SPEGGFTCFW

SEQ ID NO: 118173 - protein, 11 aa, Artificial Sequence
  Description of Artificial Sequence: Synthetic peptide
  Seed: RFSDEGGFTCF (MOG_HUMAN)
RRSDEGGFTCY

SEQ ID NO: 118174 - protein, 11 aa, Artificial Sequence
  Description of Artificial Sequence: Synthetic peptide
  Seed: RRLAGQFLEEL (MOG_HUMAN)
RRLAGQFLEEV

SEQ ID NO: 118175 - protein, 9 aa, Artificial Sequence
  Description of Artificial Sequence: Synthetic peptide
  Seed: RVIGPRHPI (MOG_HUMAN)
RQIGPRHPR

SEQ ID NO: 118176 - protein, 11 aa, Artificial Sequence
  Description of Artificial Sequence: Synthetic peptide
  Seed: RFSDEGGFTCF (MOG_HUMAN)
RLSDEGGFTCF

SEQ ID NO: 118177 - protein, 10 aa, Artificial Sequence
  Description of Artificial Sequence: Synthetic peptide
  Seed: SCLCSFLLLL (MOG_HUMAN)
SGLCSFLLLV

SEQ ID NO: 118178 - protein, 10 aa, Artificial Sequence
  Description of Artificial Sequence: Synthetic peptide
  Seed: DAIGEGKVTL (MOG_HUMAN)
DSIGEGKVTR

SEQ ID NO: 118179 - protein, 9 aa, Artificial Sequence
  Description of Artificial Sequence: Synthetic peptide
  Seed: FSDEGGFTC (MOG_HUMAN)
FSDEGGFTL

SEQ ID NO: 118180 - protein, 9 aa, Artificial Sequence
  Description of Artificial Sequence: Synthetic peptide
  Seed: RIRNVRFSD (MOG_HUMAN)
RTRNVRFSQ

SEQ ID NO: 118181 - protein, 10 aa, Artificial Sequence
  Description of Artificial Sequence: Synthetic peptide
  Seed: SCLCSFLLLL (MOG_HUMAN)
SHLCSFLLLV

SEQ ID NO: 118182 - protein, 10 aa, Artificial Sequence
  Description of Artificial Sequence: Synthetic peptide
  Seed: APEYRGRTEL (MOG_HUMAN)
APEYRGRTEV

SEQ ID NO: 118183 - protein, 8 aa, Artificial Sequence
  Description of Artificial Sequence: Synthetic peptide
  Seed: VIGPRHPI (MOG_HUMAN)
VTGPRHPM

SEQ ID NO: 118184 - protein, 9 aa, Artificial Sequence
  Description of Artificial Sequence: Synthetic peptide
  Seed: RRLAGQFLE (MOG_HUMAN)
RQLAGQFLF

SEQ ID NO: 118185 - protein, 9 aa, Artificial Sequence
  Description of Artificial Sequence: Synthetic peptide
  Seed: ICYNWLHRR (MOG_HUMAN)
ILYNWLHRF

SEQ ID NO: 118186 - protein, 10 aa, Artificial Sequence
  Description of Artificial Sequence: Synthetic peptide
  Seed: RTFDPHFLRV (MOG_HUMAN)
RVFDPHFLRG

SEQ ID NO: 118187 - protein, 9 aa, Artificial Sequence
  Description of Artificial Sequence: Synthetic peptide
  Seed: VGDEVELPC (MOG_HUMAN)
VSDEVELPL

SEQ ID NO: 118188 - protein, 9 aa, Artificial Sequence
  Description of Artificial Sequence: Synthetic peptide
  Seed: KLRAEIENL (MOG_HUMAN)
KIRAEIENA

SEQ ID NO: 118189 - protein, 11 aa, Artificial Sequence
  Description of Artificial Sequence: Synthetic peptide
  Seed: RDHSYQEEAAM (MOG_HUMAN)
RQHSYQEEAAF

SEQ ID NO: 118190 - protein, 11 aa, Artificial Sequence
  Description of Artificial Sequence: Synthetic peptide
  Seed: RIRNVRFSDEG (MOG_HUMAN)
RIRNVRFSDEK

SEQ ID NO: 118191 - protein, 9 aa, Artificial Sequence
  Description of Artificial Sequence: Synthetic peptide
  Seed: YRPPFSRVV (MOG_HUMAN)
YKPPFSRVV

SEQ ID NO: 118192 - protein, 9 aa, Artificial Sequence
  Description of Artificial Sequence: Synthetic peptide
  Seed: GEGKVTLRI (MOG_HUMAN)
GEGKVTLRY

SEQ ID NO: 118193 - protein, 9 aa, Artificial Sequence
  Description of Artificial Sequence: Synthetic peptide
  Seed: TGMEVGWYR (MOG_HUMAN)
TIMEVGWYK

SEQ ID NO: 118194 - protein, 9 aa, Artificial Sequence
  Description of Artificial Sequence: Synthetic peptide
  Seed: MASLSRPSL (MOG_HUMAN)
MFSLSRPSY

SEQ ID NO: 118195 - protein, 9 aa, Artificial Sequence
  Description of Artificial Sequence: Synthetic peptide
  Seed: RVPCWKITL (MOG_HUMAN)
RIPCWKITV

SEQ ID NO: 118196 - protein, 9 aa, Artificial Sequence
  Description of Artificial Sequence: Synthetic peptide
  Seed: LAGQFLEEL (MOG_HUMAN)
LMGQFLEEL

SEQ ID NO: 118197 - protein, 10 aa, Artificial Sequence
  Description of Artificial Sequence: Synthetic peptide
  Seed: LLLLQVSSSY (MOG_HUMAN)
LILLQVSSSF

SEQ ID NO: 118198 - protein, 10 aa, Artificial Sequence
  Description of Artificial Sequence: Synthetic peptide
  Seed: RIRNVRFSDE (MOG_HUMAN)
RVRNVRFSDK

SEQ ID NO: 118199 - protein, 9 aa, Artificial Sequence
  Description of Artificial Sequence: Synthetic peptide
  Seed: ICYNWLHRR (MOG_HUMAN)
IVYNWLHRY

SEQ ID NO: 118200 - protein, 10 aa, Artificial Sequence
  Description of Artificial Sequence: Synthetic peptide
  Seed: LIFLCLQYRL (MOG_HUMAN)
LHFLCLQYRR

SEQ ID NO: 118201 - protein, 8 aa, Artificial Sequence
  Description of Artificial Sequence: Synthetic peptide
  Seed: FSDEGGFT (MOG_HUMAN)
FSDEGGFV

SEQ ID NO: 118202 - protein, 8 aa, Artificial Sequence
  Description of Artificial Sequence: Synthetic peptide
  Seed: RIRNVRFS (MOG_HUMAN)
RVRNVRFV

SEQ ID NO: 118203 - protein, 10 aa, Artificial Sequence
  Description of Artificial Sequence: Synthetic peptide
  Seed: FSDEGGFTCF (MOG_HUMAN)
FCDEGGFTCL

SEQ ID NO: 118204 - protein, 11 aa, Artificial Sequence
  Description of Artificial Sequence: Synthetic peptide
  Seed: RDHSYQEEAAM (MOG_HUMAN)
RIHSYQEEAAF

SEQ ID NO: 118205 - protein, 10 aa, Artificial Sequence
  Description of Artificial Sequence: Synthetic peptide
  Seed: YWVSPGVLVL (MOG_HUMAN)
YSVSPGVLVM

SEQ ID NO: 118206 - protein, 10 aa, Artificial Sequence
  Description of Artificial Sequence: Synthetic peptide
  Seed: SSYAGQFRVI (MOG_HUMAN)
SYYAGQFRVI

SEQ ID NO: 118207 - protein, 9 aa, Artificial Sequence
  Description of Artificial Sequence: Synthetic peptide
  Seed: MASLSRPSL (MOG_HUMAN)
MPSLSRPSI

SEQ ID NO: 118208 - protein, 10 aa, Artificial Sequence
  Description of Artificial Sequence: Synthetic peptide
  Seed: RTFDPHFLRV (MOG_HUMAN)
RSFDPHFLRE

SEQ ID NO: 118209 - protein, 9 aa, Artificial Sequence
  Description of Artificial Sequence: Synthetic peptide
  Seed: VSSSYAGQF (MOG_HUMAN)
VQSSYAGQF

SEQ ID NO: 118210 - protein, 10 aa, Artificial Sequence
  Description of Artificial Sequence: Synthetic peptide
  Seed: FRVIGPRHPI (MOG_HUMAN)
FAVIGPRHPI

SEQ ID NO: 118211 - protein, 10 aa, Artificial Sequence
  Description of Artificial Sequence: Synthetic peptide
  Seed: FSDEGGFTCF (MOG_HUMAN)
FIDEGGFTCF

SEQ ID NO: 118212 - protein, 9 aa, Artificial Sequence
  Description of Artificial Sequence: Synthetic peptide
  Seed: RIRNVRFSD (MOG_HUMAN)
RSRNVRFSL

SEQ ID NO: 118213 - protein, 9 aa, Artificial Sequence
  Description of Artificial Sequence: Synthetic peptide
  Seed: VGDEVELPC (MOG_HUMAN)
VNDEVELPM

SEQ ID NO: 118214 - protein, 9 aa, Artificial Sequence
  Description of Artificial Sequence: Synthetic peptide
  Seed: LVLLAVLPV (MOG_HUMAN)
LMLLAVLPM

SEQ ID NO: 118215 - protein, 9 aa, Artificial Sequence
  Description of Artificial Sequence: Synthetic peptide
  Seed: VLPVLLLQI (MOG_HUMAN)
VLPVLLLQL

SEQ ID NO: 118216 - protein, 9 aa, Artificial Sequence
  Description of Artificial Sequence: Synthetic peptide
  Seed: VSSSYAGQF (MOG_HUMAN)
VQSSYAGQL

SEQ ID NO: 118217 - protein, 9 aa, Artificial Sequence
  Description of Artificial Sequence: Synthetic peptide
  Seed: FSDEGGFTC (MOG_HUMAN)
FWDEGGFTM

SEQ ID NO: 118218 - protein, 11 aa, Artificial Sequence
  Description of Artificial Sequence: Synthetic peptide
  Seed: RFSDEGGFTCF (MOG_HUMAN)
RQSDEGGFTCY

SEQ ID NO: 118219 - protein, 10 aa, Artificial Sequence
  Description of Artificial Sequence: Synthetic peptide
  Seed: TGMEVGWYRP (MOG_HUMAN)
TMMEVGWYRW

SEQ ID NO: 118220 - protein, 9 aa, Artificial Sequence
  Description of Artificial Sequence: Synthetic peptide
  Seed: ALVGDEVEL (MOG_HUMAN)
AAVGDEVEM

SEQ ID NO: 118221 - protein, 9 aa, Artificial Sequence
  Description of Artificial Sequence: Synthetic peptide
  Seed: LAGQFLEEL (MOG_HUMAN)
LMGQFLEEI

SEQ ID NO: 118222 - protein, 11 aa, Artificial Sequence
  Description of Artificial Sequence: Synthetic peptide
  Seed: LLLLLQVSSSY (MOG_HUMAN)
LKLLLQVSSSY

SEQ ID NO: 118223 - protein, 8 aa, Artificial Sequence
  Description of Artificial Sequence: Synthetic peptide
  Seed: YNWLHRRL (MOG_HUMAN)
YAWLHRRY

SEQ ID NO: 118224 - protein, 9 aa, Artificial Sequence
  Description of Artificial Sequence: Synthetic peptide
  Seed: LHRTFDPHF (MOG_HUMAN)
LLRTFDPHF

SEQ ID NO: 118225 - protein, 10 aa, Artificial Sequence
  Description of Artificial Sequence: Synthetic peptide
  Seed: RLRGKLRAEI (MOG_HUMAN)
RYRGKLRAEK

SEQ ID NO: 118226 - protein, 8 aa, Artificial Sequence
  Description of Artificial Sequence: Synthetic peptide
  Seed: FSRVVHLY (MOG_HUMAN)
FARVVHLM

SEQ ID NO: 118227 - protein, 8 aa, Artificial Sequence
  Description of Artificial Sequence: Synthetic peptide
  Seed: YAGQFRVI (MOG_HUMAN)
YAGQFRVY

SEQ ID NO: 118228 - protein, 9 aa, Artificial Sequence
  Description of Artificial Sequence: Synthetic peptide
  Seed: YRPPFSRVV (MOG_HUMAN)
YMPPFSRVI

SEQ ID NO: 118229 - protein, 10 aa, Artificial Sequence
  Description of Artificial Sequence: Synthetic peptide
  Seed: SSYAGQFRVI (MOG_HUMAN)
SYYAGQFRVF

SEQ ID NO: 118230 - protein, 9 aa, Artificial Sequence
  Description of Artificial Sequence: Synthetic peptide
  Seed: TGMEVGWYR (MOG_HUMAN)
TFMEVGWYR

SEQ ID NO: 118231 - protein, 10 aa, Artificial Sequence
  Description of Artificial Sequence: Synthetic peptide
  Seed: ITLFVIVPVL (MOG_HUMAN)
IMLFVIVPVI

SEQ ID NO: 118232 - protein, 8 aa, Artificial Sequence
  Description of Artificial Sequence: Synthetic peptide
  Seed: RIRNVRFS (MOG_HUMAN)
RTRNVRFA

SEQ ID NO: 118233 - protein, 10 aa, Artificial Sequence
  Description of Artificial Sequence: Synthetic peptide
  Seed: RVPCWKITLF (MOG_HUMAN)
RYPCWKITLL

SEQ ID NO: 118234 - protein, 10 aa, Artificial Sequence
  Description of Artificial Sequence: Synthetic peptide
  Seed: LLLQVSSSYA (MOG_HUMAN)
LQLQVSSSYM

SEQ ID NO: 118235 - protein, 9 aa, Artificial Sequence
  Description of Artificial Sequence: Synthetic peptide
  Seed: LLLQVSSSY (MOG_HUMAN)
LPLQVSSSW

SEQ ID NO: 118236 - protein, 9 aa, Artificial Sequence
  Description of Artificial Sequence: Synthetic peptide
  Seed: LQITVGLIF (MOG_HUMAN)
LAITVGLIY

SEQ ID NO: 118237 - protein, 11 aa, Artificial Sequence
  Description of Artificial Sequence: Synthetic peptide
  Seed: SDEGGFTCFFR (MOG_HUMAN)
SLEGGFTCFFR

SEQ ID NO: 118238 - protein, 10 aa, Artificial Sequence
  Description of Artificial Sequence: Synthetic peptide
  Seed: PFSRVVHLYR (MOG_HUMAN)
PYSRVVHLYR

SEQ ID NO: 118239 - protein, 8 aa, Artificial Sequence
  Description of Artificial Sequence: Synthetic peptide
  Seed: YAGQFRVI (MOG_HUMAN)
YAGQFRVM

SEQ ID NO: 118240 - protein, 10 aa, Artificial Sequence
  Description of Artificial Sequence: Synthetic peptide
  Seed: ATGMEVGWYR (MOG_HUMAN)
ANGMEVGWYK

SEQ ID NO: 118241 - protein, 10 aa, Artificial Sequence
  Description of Artificial Sequence: Synthetic peptide
  Seed: FDPHFLRVPC (MOG_HUMAN)
FMPHFLRVPP

SEQ ID NO: 118242 - protein, 9 aa, Artificial Sequence
  Description of Artificial Sequence: Synthetic peptide
  Seed: RTFDPHFLR (MOG_HUMAN)
RHFDPHFLY

SEQ ID NO: 118243 - protein, 10 aa, Artificial Sequence
  Description of Artificial Sequence: Synthetic peptide
  Seed: IGPRHPIRAL (MOG_HUMAN)
ICPRHPIRAV

SEQ ID NO: 118244 - protein, 10 aa, Artificial Sequence
  Description of Artificial Sequence: Synthetic peptide
  Seed: MEVGWYRPPF (MOG_HUMAN)
MMVGWYRPPF

SEQ ID NO: 118245 - protein, 10 aa, Artificial Sequence
  Description of Artificial Sequence: Synthetic peptide
  Seed: FYWVSPGVLV (MOG_HUMAN)
FWWVSPGVLF

SEQ ID NO: 118246 - protein, 9 aa, Artificial Sequence
  Description of Artificial Sequence: Synthetic peptide
  Seed: AIGEGKVTL (MOG_HUMAN)
APGEGKVTA

SEQ ID NO: 118247 - protein, 9 aa, Artificial Sequence
  Description of Artificial Sequence: Synthetic peptide
  Seed: CLCSFLLLL (MOG_HUMAN)
CMCSFLLLL

SEQ ID NO: 118248 - protein, 9 aa, Artificial Sequence
  Description of Artificial Sequence: Synthetic peptide
  Seed: WVSPGVLVL (MOG_HUMAN)
WQSPGVLVI

SEQ ID NO: 118249 - protein, 10 aa, Artificial Sequence
  Description of Artificial Sequence: Synthetic peptide
  Seed: VLLAVLPVLL (MOG_HUMAN)
VSLAVLPVLV

SEQ ID NO: 118250 - protein, 8 aa, Artificial Sequence
  Description of Artificial Sequence: Synthetic peptide
  Seed: YNWLHRRL (MOG_HUMAN)
YAWLHRRL

SEQ ID NO: 118251 - protein, 9 aa, Artificial Sequence
  Description of Artificial Sequence: Synthetic peptide
  Seed: VIVPVLGPL (MOG_HUMAN)
VMVPVLGPL

SEQ ID NO: 118252 - protein, 9 aa, Artificial Sequence
  Description of Artificial Sequence: Synthetic peptide
  Seed: LQVSSSYAG (MOG_HUMAN)
LKVSSSYAL

SEQ ID NO: 118253 - protein, 10 aa, Artificial Sequence
  Description of Artificial Sequence: Synthetic peptide
  Seed: RIRNVRFSDE (MOG_HUMAN)
RVRNVRFSDF

SEQ ID NO: 118254 - protein, 11 aa, Artificial Sequence
  Description of Artificial Sequence: Synthetic peptide
  Seed: VGDEVELPCRI (MOG_HUMAN)
VADEVELPCRM

SEQ ID NO: 118255 - protein, 10 aa, Artificial Sequence
  Description of Artificial Sequence: Synthetic peptide
  Seed: RTFDPHFLRV (MOG_HUMAN)
RVFDPHFLRI

SEQ ID NO: 118256 - protein, 10 aa, Artificial Sequence
  Description of Artificial Sequence: Synthetic peptide
  Seed: TGMEVGWYRP (MOG_HUMAN)
TMMEVGWYRE

SEQ ID NO: 118257 - protein, 11 aa, Artificial Sequence
  Description of Artificial Sequence: Synthetic peptide
  Seed: RPSLPSCLCSF (MOG_HUMAN)
RTSLPSCLCSF

SEQ ID NO: 118258 - protein, 10 aa, Artificial Sequence
  Description of Artificial Sequence: Synthetic peptide
  Seed: LSRPSLPSCL (MOG_HUMAN)
LARPSLPSCY

SEQ ID NO: 118259 - protein, 9 aa, Artificial Sequence
  Description of Artificial Sequence: Synthetic peptide
  Seed: YRPPFSRVV (MOG_HUMAN)
YHPPFSRVY

SEQ ID NO: 118260 - protein, 11 aa, Artificial Sequence
  Description of Artificial Sequence: Synthetic peptide
  Seed: LVLLAVLPVLL (MOG_HUMAN)
LMLLAVLPVLV

SEQ ID NO: 118261 - protein, 11 aa, Artificial Sequence
  Description of Artificial Sequence: Synthetic peptide
  Seed: RISPGKNATGM (MOG_HUMAN)
RMSPGKNATGF

SEQ ID NO: 118262 - protein, 9 aa, Artificial Sequence
  Description of Artificial Sequence: Synthetic peptide
  Seed: YQEEAAMEL (MOG_HUMAN)
YMEEAAMEI

SEQ ID NO: 118263 - protein, 11 aa, Artificial Sequence
  Description of Artificial Sequence: Synthetic peptide
  Seed: VGLIFLCLQYR (MOG_HUMAN)
VRLIFLCLQYR

SEQ ID NO: 118264 - protein, 10 aa, Artificial Sequence
  Description of Artificial Sequence: Synthetic peptide
  Seed: SFLLLLLLQV (MOG_HUMAN)
SHLLLLLLQV

SEQ ID NO: 118265 - protein, 11 aa, Artificial Sequence
  Description of Artificial Sequence: Synthetic peptide
  Seed: FSDEGGFTCFF (MOG_HUMAN)
FTDEGGFTCFL

SEQ ID NO: 118266 - protein, 9 aa, Artificial Sequence
  Description of Artificial Sequence: Synthetic peptide
  Seed: ITLFVIVPV (MOG_HUMAN)
ILLFVIVPT

SEQ ID NO: 118267 - protein, 9 aa, Artificial Sequence
  Description of Artificial Sequence: Synthetic peptide
  Seed: AIGEGKVTL (MOG_HUMAN)
ARGEGKVTF

SEQ ID NO: 118268 - protein, 10 aa, Artificial Sequence
  Description of Artificial Sequence: Synthetic peptide
  Seed: FVIVPVLGPL (MOG_HUMAN)
FAIVPVLGPR

SEQ ID NO: 118269 - protein, 10 aa, Artificial Sequence
  Description of Artificial Sequence: Synthetic peptide
  Seed: HRTFDPHFLR (MOG_HUMAN)
HETFDPHFLK

SEQ ID NO: 118270 - protein, 10 aa, Artificial Sequence
  Description of Artificial Sequence: Synthetic peptide
  Seed: LLQITVGLIF (MOG_HUMAN)
LPQITVGLIM

SEQ ID NO: 118271 - protein, 10 aa, Artificial Sequence
  Description of Artificial Sequence: Synthetic peptide
  Seed: TGMEVGWYRP (MOG_HUMAN)
TMMEVGWYRQ

SEQ ID NO: 118272 - protein, 10 aa, Artificial Sequence
  Description of Artificial Sequence: Synthetic peptide
  Seed: TGMEVGWYRP (MOG_HUMAN)
TFMEVGWYRP

SEQ ID NO: 118273 - protein, 9 aa, Artificial Sequence
  Description of Artificial Sequence: Synthetic peptide
  Seed: FSDEGGFTC (MOG_HUMAN)
FMDEGGFTV

SEQ ID NO: 118274 - protein, 9 aa, Artificial Sequence
  Description of Artificial Sequence: Synthetic peptide
  Seed: FSDEGGFTC (MOG_HUMAN)
FCDEGGFTM

SEQ ID NO: 118275 - protein, 9 aa, Artificial Sequence
  Description of Artificial Sequence: Synthetic peptide
  Seed: SRPSLPSCL (MOG_HUMAN)
SMPSLPSCI

SEQ ID NO: 118276 - protein, 8 aa, Artificial Sequence
  Description of Artificial Sequence: Synthetic peptide
  Seed: YWVSPGVL (MOG_HUMAN)
YFVSPGVY

SEQ ID NO: 118277 - protein, 10 aa, Artificial Sequence
  Description of Artificial Sequence: Synthetic peptide
  Seed: FVIVPVLGPL (MOG_HUMAN)
FEIVPVLGPA

SEQ ID NO: 118278 - protein, 11 aa, Artificial Sequence
  Description of Artificial Sequence: Synthetic peptide
  Seed: RDHSYQEEAAM (MOG_HUMAN)
REHSYQEEAAW

SEQ ID NO: 118279 - protein, 9 aa, Artificial Sequence
  Description of Artificial Sequence: Synthetic peptide
  Seed: RIRNVRFSD (MOG_HUMAN)
RMRNVRFSS

SEQ ID NO: 118280 - protein, 9 aa, Artificial Sequence
  Description of Artificial Sequence: Synthetic peptide
  Seed: VLLAVLPVL (MOG_HUMAN)
VALAVLPVV

SEQ ID NO: 118281 - protein, 9 aa, Artificial Sequence
  Description of Artificial Sequence: Synthetic peptide
  Seed: TFDPHFLRV (MOG_HUMAN)
TCDPHFLRY

SEQ ID NO: 118282 - protein, 9 aa, Artificial Sequence
  Description of Artificial Sequence: Synthetic peptide
  Seed: MELKVEDPF (MOG_HUMAN)
MLLKVEDPY

SEQ ID NO: 118283 - protein, 9 aa, Artificial Sequence
  Description of Artificial Sequence: Synthetic peptide
  Seed: YRPPFSRVV (MOG_HUMAN)
YYPPFSRVA

SEQ ID NO: 118284 - protein, 9 aa, Artificial Sequence
  Description of Artificial Sequence: Synthetic peptide
  Seed: SLPSCLCSF (MOG_HUMAN)
SQPSCLCSL

SEQ ID NO: 118285 - protein, 11 aa, Artificial Sequence
  Description of Artificial Sequence: Synthetic peptide
  Seed: QVSSSYAGQFR (MOG_HUMAN)
QMSSSYAGQFR

SEQ ID NO: 118286 - protein, 9 aa, Artificial Sequence
  Description of Artificial Sequence: Synthetic peptide
  Seed: TLFVIVPVL (MOG_HUMAN)
TAFVIVPVL

SEQ ID NO: 118287 - protein, 10 aa, Artificial Sequence
  Description of Artificial Sequence: Synthetic peptide
  Seed: EYRGRTELLK (MOG_HUMAN)
ETRGRTELLR

SEQ ID NO: 118288 - protein, 9 aa, Artificial Sequence
  Description of Artificial Sequence: Synthetic peptide
  Seed: MASLSRPSL (MOG_HUMAN)
MPSLSRPSL

SEQ ID NO: 118289 - protein, 9 aa, Artificial Sequence
  Description of Artificial Sequence: Synthetic peptide
  Seed: ICYNWLHRR (MOG_HUMAN)
IMYNWLHRL

SEQ ID NO: 118290 - protein, 10 aa, Artificial Sequence
  Description of Artificial Sequence: Synthetic peptide
  Seed: FVIVPVLGPL (MOG_HUMAN)
FDIVPVLGPA

SEQ ID NO: 118291 - protein, 11 aa, Artificial Sequence
  Description of Artificial Sequence: Synthetic peptide
  Seed: RIRNVRFSDEG (MOG_HUMAN)
RMRNVRFSDEK

SEQ ID NO: 118292 - protein, 9 aa, Artificial Sequence
  Description of Artificial Sequence: Synthetic peptide
  Seed: SSSYAGQFR (MOG_HUMAN)
SSSYAGQFK

SEQ ID NO: 118293 - protein, 10 aa, Artificial Sequence
  Description of Artificial Sequence: Synthetic peptide
  Seed: FDPHFLRVPC (MOG_HUMAN)
FEPHFLRVPP

SEQ ID NO: 118294 - protein, 10 aa, Artificial Sequence
  Description of Artificial Sequence: Synthetic peptide
  Seed: HRTFDPHFLR (MOG_HUMAN)
HTTFDPHFLK

SEQ ID NO: 118295 - protein, 10 aa, Artificial Sequence
  Description of Artificial Sequence: Synthetic peptide
  Seed: RTFDPHFLRV (MOG_HUMAN)
RWFDPHFLRD

SEQ ID NO: 118296 - protein, 10 aa, Artificial Sequence
  Description of Artificial Sequence: Synthetic peptide
  Seed: LIFLCLQYRL (MOG_HUMAN)
LSFLCLQYRK

SEQ ID NO: 118297 - protein, 9 aa, Artificial Sequence
  Description of Artificial Sequence: Synthetic peptide
  Seed: VSSSYAGQF (MOG_HUMAN)
VQSSYAGQY

SEQ ID NO: 118298 - protein, 9 aa, Artificial Sequence
  Description of Artificial Sequence: Synthetic peptide
  Seed: VLPVLLLQI (MOG_HUMAN)
VSPVLLLQM

SEQ ID NO: 118299 - protein, 10 aa, Artificial Sequence
  Description of Artificial Sequence: Synthetic peptide
  Seed: FSDEGGFTCF (MOG_HUMAN)
FWDEGGFTCM

SEQ ID NO: 118300 - protein, 9 aa, Artificial Sequence
  Description of Artificial Sequence: Synthetic peptide
  Seed: MASLSRPSL (MOG_HUMAN)
MFSLSRPSI

SEQ ID NO: 118301 - protein, 10 aa, Artificial Sequence
  Description of Artificial Sequence: Synthetic peptide
  Seed: RVIGPRHPIR (MOG_HUMAN)
RSIGPRHPIK

SEQ ID NO: 118302 - protein, 11 aa, Artificial Sequence
  Description of Artificial Sequence: Synthetic peptide
  Seed: VLVLLAVLPVL (MOG_HUMAN)
VLVLLAVLPVV

SEQ ID NO: 118303 - protein, 10 aa, Artificial Sequence
  Description of Artificial Sequence: Synthetic peptide
  Seed: SFLLLLLLQV (MOG_HUMAN)
SYLLLLLLQV

SEQ ID NO: 118304 - protein, 10 aa, Artificial Sequence
  Description of Artificial Sequence: Synthetic peptide
  Seed: FRVIGPRHPI (MOG_HUMAN)
FTVIGPRHPI

SEQ ID NO: 118305 - protein, 9 aa, Artificial Sequence
  Description of Artificial Sequence: Synthetic peptide
  Seed: LAGQFLEEL (MOG_HUMAN)
LRGQFLEEL

SEQ ID NO: 118306 - protein, 9 aa, Artificial Sequence
  Description of Artificial Sequence: Synthetic peptide
  Seed: LLQVSSSYA (MOG_HUMAN)
LLQVSSSYV

SEQ ID NO: 118307 - protein, 9 aa, Artificial Sequence
  Description of Artificial Sequence: Synthetic peptide
  Seed: LLQVSSSYA (MOG_HUMAN)
LMQVSSSYL

SEQ ID NO: 118308 - protein, 10 aa, Artificial Sequence
  Description of Artificial Sequence: Synthetic peptide
  Seed: RVIGPRHPIR (MOG_HUMAN)
RTIGPRHPIK

SEQ ID NO: 118309 - protein, 9 aa, Artificial Sequence
  Description of Artificial Sequence: Synthetic peptide
  Seed: AIGEGKVTL (MOG_HUMAN)
AMGEGKVTY

SEQ ID NO: 118310 - protein, 9 aa, Artificial Sequence
  Description of Artificial Sequence: Synthetic peptide
  Seed: AIGEGKVTL (MOG_HUMAN)
AQGEGKVTV

SEQ ID NO: 118311 - protein, 9 aa, Artificial Sequence
  Description of Artificial Sequence: Synthetic peptide
  Seed: TGMEVGWYR (MOG_HUMAN)
TAMEVGWYR

SEQ ID NO: 118312 - protein, 8 aa, Artificial Sequence
  Description of Artificial Sequence: Synthetic peptide
  Seed: RIRNVRFS (MOG_HUMAN)
RLRNVRFK

SEQ ID NO: 118313 - protein, 10 aa, Artificial Sequence
  Description of Artificial Sequence: Synthetic peptide
  Seed: IICYNWLHRR (MOG_HUMAN)
IMCYNWLHRK

SEQ ID NO: 118314 - protein, 9 aa, Artificial Sequence
  Description of Artificial Sequence: Synthetic peptide
  Seed: RIRNVRFSD (MOG_HUMAN)
RIRNVRFSA

SEQ ID NO: 118315 - protein, 10 aa, Artificial Sequence
  Description of Artificial Sequence: Synthetic peptide
  Seed: RVVHLYRNGK (MOG_HUMAN)
RCVHLYRNGK

SEQ ID NO: 118316 - protein, 10 aa, Artificial Sequence
  Description of Artificial Sequence: Synthetic peptide
  Seed: TGMEVGWYRP (MOG_HUMAN)
TVMEVGWYRL

SEQ ID NO: 118317 - protein, 9 aa, Artificial Sequence
  Description of Artificial Sequence: Synthetic peptide
  Seed: CLCSFLLLL (MOG_HUMAN)
CVCSFLLLR

SEQ ID NO: 118318 - protein, 9 aa, Artificial Sequence
  Description of Artificial Sequence: Synthetic peptide
  Seed: EGGFTCFFR (MOG_HUMAN)
EAGFTCFFK

SEQ ID NO: 118319 - protein, 9 aa, Artificial Sequence
  Description of Artificial Sequence: Synthetic peptide
  Seed: FLEELRNPF (MOG_HUMAN)
FAEELRNPF

SEQ ID NO: 118320 - protein, 9 aa, Artificial Sequence
  Description of Artificial Sequence: Synthetic peptide
  Seed: GEGKVTLRI (MOG_HUMAN)
GQGKVTLRL

SEQ ID NO: 118321 - protein, 9 aa, Artificial Sequence
  Description of Artificial Sequence: Synthetic peptide
  Seed: RVPCWKITL (MOG_HUMAN)
RTPCWKITR

SEQ ID NO: 118322 - protein, 9 aa, Artificial Sequence
  Description of Artificial Sequence: Synthetic peptide
  Seed: TFDPHFLRV (MOG_HUMAN)
TYDPHFLRF

SEQ ID NO: 118323 - protein, 9 aa, Artificial Sequence
  Description of Artificial Sequence: Synthetic peptide
  Seed: YQEEAAMEL (MOG_HUMAN)
YFEEAAMEM

SEQ ID NO: 118324 - protein, 10 aa, Artificial Sequence
  Description of Artificial Sequence: Synthetic peptide
  Seed: FRVIGPRHPI (MOG_HUMAN)
FKVIGPRHPI

SEQ ID NO: 118325 - protein, 10 aa, Artificial Sequence
  Description of Artificial Sequence: Synthetic peptide
  Seed: FLLLLLLQVS (MOG_HUMAN)
FVLLLLLQVV

SEQ ID NO: 118326 - protein, 9 aa, Artificial Sequence
  Description of Artificial Sequence: Synthetic peptide
  Seed: IGEGKVTLR (MOG_HUMAN)
ITEGKVTLF

SEQ ID NO: 118327 - protein, 10 aa, Artificial Sequence
  Description of Artificial Sequence: Synthetic peptide
  Seed: SSYAGQFRVI (MOG_HUMAN)
SSYAGQFRVF

SEQ ID NO: 118328 - protein, 10 aa, Artificial Sequence
  Description of Artificial Sequence: Synthetic peptide
  Seed: TGMEVGWYRP (MOG_HUMAN)
TFMEVGWYRC

SEQ ID NO: 118329 - protein, 10 aa, Artificial Sequence
  Description of Artificial Sequence: Synthetic peptide
  Seed: MEVGWYRPPF (MOG_HUMAN)
MQVGWYRPPL

SEQ ID NO: 118330 - protein, 9 aa, Artificial Sequence
  Description of Artificial Sequence: Synthetic peptide
  Seed: LIICYNWLH (MOG_HUMAN)
LYICYNWLK

SEQ ID NO: 118331 - protein, 10 aa, Artificial Sequence
  Description of Artificial Sequence: Synthetic peptide
  Seed: RVPCWKITLF (MOG_HUMAN)
RYPCWKITLM

SEQ ID NO: 118332 - protein, 9 aa, Artificial Sequence
  Description of Artificial Sequence: Synthetic peptide
  Seed: HSYQEEAAM (MOG_HUMAN)
HYYQEEAAF

SEQ ID NO: 118333 - protein, 10 aa, Artificial Sequence
  Description of Artificial Sequence: Synthetic peptide
  Seed: MEVGWYRPPF (MOG_HUMAN)
MKVGWYRPPF

SEQ ID NO: 118334 - protein, 9 aa, Artificial Sequence
  Description of Artificial Sequence: Synthetic peptide
  Seed: VLLAVLPVL (MOG_HUMAN)
VVLAVLPVV

SEQ ID NO: 118335 - protein, 9 aa, Artificial Sequence
  Description of Artificial Sequence: Synthetic peptide
  Seed: FLEELRNPF (MOG_HUMAN)
FMEELRNPM

SEQ ID NO: 118336 - protein, 9 aa, Artificial Sequence
  Description of Artificial Sequence: Synthetic peptide
  Seed: FSDEGGFTC (MOG_HUMAN)
FLDEGGFTM

SEQ ID NO: 118337 - protein, 10 aa, Artificial Sequence
  Description of Artificial Sequence: Synthetic peptide
  Seed: RPPFSRVVHL (MOG_HUMAN)
RPPFSRVVHM

SEQ ID NO: 118338 - protein, 10 aa, Artificial Sequence
  Description of Artificial Sequence: Synthetic peptide
  Seed: RLAGQFLEEL (MOG_HUMAN)
RLAGQFLEEW

SEQ ID NO: 118339 - protein, 9 aa, Artificial Sequence
  Description of Artificial Sequence: Synthetic peptide
  Seed: SRPSLPSCL (MOG_HUMAN)
SAPSLPSCV

SEQ ID NO: 118340 - protein, 9 aa, Artificial Sequence
  Description of Artificial Sequence: Synthetic peptide
  Seed: HRTFDPHFL (MOG_HUMAN)
HHTFDPHFM

SEQ ID NO: 118341 - protein, 9 aa, Artificial Sequence
  Description of Artificial Sequence: Synthetic peptide
  Seed: TCFFRDHSY (MOG_HUMAN)
TQFFRDHSI

SEQ ID NO: 118342 - protein, 9 aa, Artificial Sequence
  Description of Artificial Sequence: Synthetic peptide
  Seed: VPVLGPLVA (MOG_HUMAN)
VHVLGPLVV

SEQ ID NO: 118343 - protein, 8 aa, Artificial Sequence
  Description of Artificial Sequence: Synthetic peptide
  Seed: VIGPRHPI (MOG_HUMAN)
VAGPRHPY

SEQ ID NO: 118344 - protein, 10 aa, Artificial Sequence
  Description of Artificial Sequence: Synthetic peptide
  Seed: DAIGEGKVTL (MOG_HUMAN)
DLIGEGKVTR

SEQ ID NO: 118345 - protein, 11 aa, Artificial Sequence
  Description of Artificial Sequence: Synthetic peptide
  Seed: YWVSPGVLVLL (MOG_HUMAN)
YYVSPGVLVLW

SEQ ID NO: 118346 - protein, 10 aa, Artificial Sequence
  Description of Artificial Sequence: Synthetic peptide
  Seed: RALVGDEVEL (MOG_HUMAN)
RILVGDEVEF

SEQ ID NO: 118347 - protein, 9 aa, Artificial Sequence
  Description of Artificial Sequence: Synthetic peptide
  Seed: LAGQFLEEL (MOG_HUMAN)
LVGQFLEEI

SEQ ID NO: 118348 - protein, 9 aa, Artificial Sequence
  Description of Artificial Sequence: Synthetic peptide
  Seed: FLLLLLLQV (MOG_HUMAN)
FILLLLLQI

SEQ ID NO: 118349 - protein, 9 aa, Artificial Sequence
  Description of Artificial Sequence: Synthetic peptide
  Seed: YQEEAAMEL (MOG_HUMAN)
YCEEAAMEV

SEQ ID NO: 118350 - protein, 11 aa, Artificial Sequence
  Description of Artificial Sequence: Synthetic peptide
  Seed: RIRNVRFSDEG (MOG_HUMAN)
RTRNVRFSDEI

SEQ ID NO: 118351 - protein, 9 aa, Artificial Sequence
  Description of Artificial Sequence: Synthetic peptide
  Seed: RIRNVRFSD (MOG_HUMAN)
RARNVRFSS

SEQ ID NO: 118352 - protein, 11 aa, Artificial Sequence
  Description of Artificial Sequence: Synthetic peptide
  Seed: FSDEGGFTCFF (MOG_HUMAN)
FWDEGGFTCFM

SEQ ID NO: 118353 - protein, 9 aa, Artificial Sequence
  Description of Artificial Sequence: Synthetic peptide
  Seed: FLCLQYRLR (MOG_HUMAN)
FYCLQYRLR

SEQ ID NO: 118354 - protein, 10 aa, Artificial Sequence
  Description of Artificial Sequence: Synthetic peptide
  Seed: LLAVLPVLLL (MOG_HUMAN)
LLAVLPVLLV

SEQ ID NO: 118355 - protein, 10 aa, Artificial Sequence
  Description of Artificial Sequence: Synthetic peptide
  Seed: IGPRHPIRAL (MOG_HUMAN)
ISPRHPIRAV

SEQ ID NO: 118356 - protein, 11 aa, Artificial Sequence
  Description of Artificial Sequence: Synthetic peptide
  Seed: LQVSSSYAGQF (MOG_HUMAN)
LAVSSSYAGQW

SEQ ID NO: 118357 - protein, 10 aa, Artificial Sequence
  Description of Artificial Sequence: Synthetic peptide
  Seed: VLLAVLPVLL (MOG_HUMAN)
VCLAVLPVLV

SEQ ID NO: 118358 - protein, 9 aa, Artificial Sequence
  Description of Artificial Sequence: Synthetic peptide
  Seed: VSSSYAGQF (MOG_HUMAN)
VASSYAGQY

SEQ ID NO: 118359 - protein, 10 aa, Artificial Sequence
  Description of Artificial Sequence: Synthetic peptide
  Seed: FDPHFLRVPC (MOG_HUMAN)
FEPHFLRVPL

SEQ ID NO: 118360 - protein, 10 aa, Artificial Sequence
  Description of Artificial Sequence: Synthetic peptide
  Seed: KNATGMEVGW (MOG_HUMAN)
KDATGMEVGW

SEQ ID NO: 118361 - protein, 9 aa, Artificial Sequence
  Description of Artificial Sequence: Synthetic peptide
  Seed: GWYRPPFSR (MOG_HUMAN)
GFYRPPFSR

SEQ ID NO: 118362 - protein, 9 aa, Artificial Sequence
  Description of Artificial Sequence: Synthetic peptide
  Seed: RVPCWKITL (MOG_HUMAN)
RAPCWKITM

SEQ ID NO: 118363 - protein, 9 aa, Artificial Sequence
  Description of Artificial Sequence: Synthetic peptide
  Seed: FSDEGGFTC (MOG_HUMAN)
FGDEGGFTM

SEQ ID NO: 118364 - protein, 10 aa, Artificial Sequence
  Description of Artificial Sequence: Synthetic peptide
  Seed: HRTFDPHFLR (MOG_HUMAN)
HHTFDPHFLY

SEQ ID NO: 118365 - protein, 9 aa, Artificial Sequence
  Description of Artificial Sequence: Synthetic peptide
  Seed: ICYNWLHRR (MOG_HUMAN)
IMYNWLHRI

SEQ ID NO: 118366 - protein, 10 aa, Artificial Sequence
  Description of Artificial Sequence: Synthetic peptide
  Seed: FSDEGGFTCF (MOG_HUMAN)
FMDEGGFTCV

SEQ ID NO: 118367 - protein, 9 aa, Artificial Sequence
  Description of Artificial Sequence: Synthetic peptide
  Seed: FYWVSPGVL (MOG_HUMAN)
FQWVSPGVI

SEQ ID NO: 118368 - protein, 9 aa, Artificial Sequence
  Description of Artificial Sequence: Synthetic peptide
  Seed: YQEEAAMEL (MOG_HUMAN)
YYEEAAMEL

SEQ ID NO: 118369 - protein, 10 aa, Artificial Sequence
  Description of Artificial Sequence: Synthetic peptide
  Seed: AGQFRVIGPR (MOG_HUMAN)
ATQFRVIGPR

SEQ ID NO: 118370 - protein, 10 aa, Artificial Sequence
  Description of Artificial Sequence: Synthetic peptide
  Seed: LIFLCLQYRL (MOG_HUMAN)
LEFLCLQYRR

SEQ ID NO: 118371 - protein, 10 aa, Artificial Sequence
  Description of Artificial Sequence: Synthetic peptide
  Seed: RIRNVRFSDE (MOG_HUMAN)
RIRNVRFSDM

SEQ ID NO: 118372 - protein, 9 aa, Artificial Sequence
  Description of Artificial Sequence: Synthetic peptide
  Seed: TCFFRDHSY (MOG_HUMAN)
TKFFRDHSY

SEQ ID NO: 118373 - protein, 10 aa, Artificial Sequence
  Description of Artificial Sequence: Synthetic peptide
  Seed: LLLLQVSSSY (MOG_HUMAN)
LNLLQVSSSY

SEQ ID NO: 118374 - protein, 10 aa, Artificial Sequence
  Description of Artificial Sequence: Synthetic peptide
  Seed: WVSPGVLVLL (MOG_HUMAN)
WLSPGVLVLI

SEQ ID NO: 118375 - protein, 9 aa, Artificial Sequence
  Description of Artificial Sequence: Synthetic peptide
  Seed: RVIGPRHPI (MOG_HUMAN)
RQIGPRHPY

SEQ ID NO: 118376 - protein, 9 aa, Artificial Sequence
  Description of Artificial Sequence: Synthetic peptide
  Seed: RVPCWKITL (MOG_HUMAN)
RRPCWKITL

SEQ ID NO: 118377 - protein, 9 aa, Artificial Sequence
  Description of Artificial Sequence: Synthetic peptide
  Seed: SYAGQFRVI (MOG_HUMAN)
SFAGQFRVV

SEQ ID NO: 118378 - protein, 9 aa, Artificial Sequence
  Description of Artificial Sequence: Synthetic peptide
  Seed: LIFLCLQYR (MOG_HUMAN)
LSFLCLQYK

SEQ ID NO: 118379 - protein, 9 aa, Artificial Sequence
  Description of Artificial Sequence: Synthetic peptide
  Seed: VLLAVLPVL (MOG_HUMAN)
VTLAVLPVR

SEQ ID NO: 118380 - protein, 9 aa, Artificial Sequence
  Description of Artificial Sequence: Synthetic peptide
  Seed: AIGEGKVTL (MOG_HUMAN)
AIGEGKVTW

SEQ ID NO: 118381 - protein, 8 aa, Artificial Sequence
  Description of Artificial Sequence: Synthetic peptide
  Seed: FSRVVHLY (MOG_HUMAN)
FSRVVHLW

SEQ ID NO: 118382 - protein, 9 aa, Artificial Sequence
  Description of Artificial Sequence: Synthetic peptide
  Seed: VLLAVLPVL (MOG_HUMAN)
VMLAVLPVM

SEQ ID NO: 118383 - protein, 9 aa, Artificial Sequence
  Description of Artificial Sequence: Synthetic peptide
  Seed: LQVSSSYAG (MOG_HUMAN)
LNVSSSYAY

SEQ ID NO: 118384 - protein, 9 aa, Artificial Sequence
  Description of Artificial Sequence: Synthetic peptide
  Seed: SSYAGQFRV (MOG_HUMAN)
SIYAGQFRW

SEQ ID NO: 118385 - protein, 10 aa, Artificial Sequence
  Description of Artificial Sequence: Synthetic peptide
  Seed: RALVGDEVEL (MOG_HUMAN)
RLLVGDEVEW

SEQ ID NO: 118386 - protein, 9 aa, Artificial Sequence
  Description of Artificial Sequence: Synthetic peptide
  Seed: MASLSRPSL (MOG_HUMAN)
MRSLSRPSL

SEQ ID NO: 118387 - protein, 11 aa, Artificial Sequence
  Description of Artificial Sequence: Synthetic peptide
  Seed: HSYQEEAAMEL (MOG_HUMAN)
HIYQEEAAMEW

SEQ ID NO: 118388 - protein, 9 aa, Artificial Sequence
  Description of Artificial Sequence: Synthetic peptide
  Seed: WVSPGVLVL (MOG_HUMAN)
WCSPGVLVY

SEQ ID NO: 118389 - protein, 10 aa, Artificial Sequence
  Description of Artificial Sequence: Synthetic peptide
  Seed: RIRNVRFSDE (MOG_HUMAN)
RQRNVRFSDK

SEQ ID NO: 118390 - protein, 10 aa, Artificial Sequence
  Description of Artificial Sequence: Synthetic peptide
  Seed: SCLCSFLLLL (MOG_HUMAN)
SQLCSFLLLA

SEQ ID NO: 118391 - protein, 9 aa, Artificial Sequence
  Description of Artificial Sequence: Synthetic peptide
  Seed: LKVEDPFYW (MOG_HUMAN)
LMVEDPFYW

SEQ ID NO: 118392 - protein, 8 aa, Artificial Sequence
  Description of Artificial Sequence: Synthetic peptide
  Seed: YNWLHRRL (MOG_HUMAN)
YQWLHRRV

SEQ ID NO: 118393 - protein, 9 aa, Artificial Sequence
  Description of Artificial Sequence: Synthetic peptide
  Seed: KLRAEIENL (MOG_HUMAN)
KQRAEIENF

SEQ ID NO: 118394 - protein, 10 aa, Artificial Sequence
  Description of Artificial Sequence: Synthetic peptide
  Seed: SLSRPSLPSC (MOG_HUMAN)
SNSRPSLPSV

SEQ ID NO: 118395 - protein, 9 aa, Artificial Sequence
  Description of Artificial Sequence: Synthetic peptide
  Seed: LLAVLPVLL (MOG_HUMAN)
LVAVLPVLY

SEQ ID NO: 118396 - protein, 9 aa, Artificial Sequence
  Description of Artificial Sequence: Synthetic peptide
  Seed: YQEEAAMEL (MOG_HUMAN)
YFEEAAMEY

SEQ ID NO: 118397 - protein, 9 aa, Artificial Sequence
  Description of Artificial Sequence: Synthetic peptide
  Seed: LLAVLPVLL (MOG_HUMAN)
LLAVLPVLA

SEQ ID NO: 118398 - protein, 9 aa, Artificial Sequence
  Description of Artificial Sequence: Synthetic peptide
  Seed: ICYNWLHRR (MOG_HUMAN)
ITYNWLHRL

SEQ ID NO: 118399 - protein, 9 aa, Artificial Sequence
  Description of Artificial Sequence: Synthetic peptide
  Seed: LQVSSSYAG (MOG_HUMAN)
LVVSSSYAM

SEQ ID NO: 118400 - protein, 11 aa, Artificial Sequence
  Description of Artificial Sequence: Synthetic peptide
  Seed: SSSYAGQFRVI (MOG_HUMAN)
SISYAGQFRVF

SEQ ID NO: 118401 - protein, 10 aa, Artificial Sequence
  Description of Artificial Sequence: Synthetic peptide
  Seed: AVLPVLLLQI (MOG_HUMAN)
ALLPVLLLQI

SEQ ID NO: 118402 - protein, 9 aa, Artificial Sequence
  Description of Artificial Sequence: Synthetic peptide
  Seed: LLLQITVGL (MOG_HUMAN)
LALQITVGL

SEQ ID NO: 118403 - protein, 9 aa, Artificial Sequence
  Description of Artificial Sequence: Synthetic peptide
  Seed: TFDPHFLRV (MOG_HUMAN)
TWDPHFLRF

SEQ ID NO: 118404 - protein, 10 aa, Artificial Sequence
  Description of Artificial Sequence: Synthetic peptide
  Seed: VLLLQITVGL (MOG_HUMAN)
VTLLQITVGI

SEQ ID NO: 118405 - protein, 10 aa, Artificial Sequence
  Description of Artificial Sequence: Synthetic peptide
  Seed: ATGMEVGWYR (MOG_HUMAN)
AKGMEVGWYR

SEQ ID NO: 118406 - protein, 9 aa, Artificial Sequence
  Description of Artificial Sequence: Synthetic peptide
  Seed: SSYAGQFRV (MOG_HUMAN)
SMYAGQFRI

SEQ ID NO: 118407 - protein, 9 aa, Artificial Sequence
  Description of Artificial Sequence: Synthetic peptide
  Seed: LSRPSLPSC (MOG_HUMAN)
LNRPSLPSK

SEQ ID NO: 118408 - protein, 9 aa, Artificial Sequence
  Description of Artificial Sequence: Synthetic peptide
  Seed: LSRPSLPSC (MOG_HUMAN)
LIRPSLPSI

SEQ ID NO: 118409 - protein, 10 aa, Artificial Sequence
  Description of Artificial Sequence: Synthetic peptide
  Seed: LIFLCLQYRL (MOG_HUMAN)
LQFLCLQYRK

SEQ ID NO: 118410 - protein, 9 aa, Artificial Sequence
  Description of Artificial Sequence: Synthetic peptide
  Seed: HSYQEEAAM (MOG_HUMAN)
HRYQEEAAY

SEQ ID NO: 118411 - protein, 10 aa, Artificial Sequence
  Description of Artificial Sequence: Synthetic peptide
  Seed: HRTFDPHFLR (MOG_HUMAN)
HATFDPHFLK

SEQ ID NO: 118412 - protein, 9 aa, Artificial Sequence
  Description of Artificial Sequence: Synthetic peptide
  Seed: RIRNVRFSD (MOG_HUMAN)
RFRNVRFSV

SEQ ID NO: 118413 - protein, 10 aa, Artificial Sequence
  Description of Artificial Sequence: Synthetic peptide
  Seed: RPPFSRVVHL (MOG_HUMAN)
RMPFSRVVHM

SEQ ID NO: 118414 - protein, 10 aa, Artificial Sequence
  Description of Artificial Sequence: Synthetic peptide
  Seed: SLSRPSLPSC (MOG_HUMAN)
SDSRPSLPSK

SEQ ID NO: 118415 - protein, 10 aa, Artificial Sequence
  Description of Artificial Sequence: Synthetic peptide
  Seed: FDPHFLRVPC (MOG_HUMAN)
FEPHFLRVPM

SEQ ID NO: 118416 - protein, 11 aa, Artificial Sequence
  Description of Artificial Sequence: Synthetic peptide
  Seed: SSSYAGQFRVI (MOG_HUMAN)
STSYAGQFRVF

SEQ ID NO: 118417 - protein, 10 aa, Artificial Sequence
  Description of Artificial Sequence: Synthetic peptide
  Seed: SLSRPSLPSC (MOG_HUMAN)
SMSRPSLPSI

SEQ ID NO: 118418 - protein, 9 aa, Artificial Sequence
  Description of Artificial Sequence: Synthetic peptide
  Seed: LQITVGLIF (MOG_HUMAN)
LSITVGLIF

SEQ ID NO: 118419 - protein, 9 aa, Artificial Sequence
  Description of Artificial Sequence: Synthetic peptide
  Seed: VSPGVLVLL (MOG_HUMAN)
VSPGVLVLV

SEQ ID NO: 118420 - protein, 11 aa, Artificial Sequence
  Description of Artificial Sequence: Synthetic peptide
  Seed: RDHSYQEEAAM (MOG_HUMAN)
RHHSYQEEAAW

SEQ ID NO: 118421 - protein, 10 aa, Artificial Sequence
  Description of Artificial Sequence: Synthetic peptide
  Seed: SLPSCLCSFL (MOG_HUMAN)
SMPSCLCSFI

SEQ ID NO: 118422 - protein, 10 aa, Artificial Sequence
  Description of Artificial Sequence: Synthetic peptide
  Seed: LLQITVGLIF (MOG_HUMAN)
LIQITVGLIY

SEQ ID NO: 118423 - protein, 10 aa, Artificial Sequence
  Description of Artificial Sequence: Synthetic peptide
  Seed: FVIVPVLGPL (MOG_HUMAN)
FRIVPVLGPI

SEQ ID NO: 118424 - protein, 9 aa, Artificial Sequence
  Description of Artificial Sequence: Synthetic peptide
  Seed: LQVSSSYAG (MOG_HUMAN)
LMVSSSYAV

SEQ ID NO: 118425 - protein, 11 aa, Artificial Sequence
  Description of Artificial Sequence: Synthetic peptide
  Seed: LQVSSSYAGQF (MOG_HUMAN)
LSVSSSYAGQW

SEQ ID NO: 118426 - protein, 9 aa, Artificial Sequence
  Description of Artificial Sequence: Synthetic peptide
  Seed: SLPSCLCSF (MOG_HUMAN)
SWPSCLCSF

SEQ ID NO: 118427 - protein, 11 aa, Artificial Sequence
  Description of Artificial Sequence: Synthetic peptide
  Seed: VLVLLAVLPVL (MOG_HUMAN)
VDVLLAVLPVV

SEQ ID NO: 118428 - protein, 10 aa, Artificial Sequence
  Description of Artificial Sequence: Synthetic peptide
  Seed: LQITVGLIFL (MOG_HUMAN)
LVITVGLIFL

SEQ ID NO: 118429 - protein, 10 aa, Artificial Sequence
  Description of Artificial Sequence: Synthetic peptide
  Seed: CRISPGKNAT (MOG_HUMAN)
CHISPGKNAA

SEQ ID NO: 118430 - protein, 9 aa, Artificial Sequence
  Description of Artificial Sequence: Synthetic peptide
  Seed: VPCWKITLF (MOG_HUMAN)
VPCWKITLA

SEQ ID NO: 118431 - protein, 9 aa, Artificial Sequence
  Description of Artificial Sequence: Synthetic peptide
  Seed: GWYRPPFSR (MOG_HUMAN)
GMYRPPFSK

SEQ ID NO: 118432 - protein, 10 aa, Artificial Sequence
  Description of Artificial Sequence: Synthetic peptide
  Seed: SCLCSFLLLL (MOG_HUMAN)
SHLCSFLLLL

SEQ ID NO: 118433 - protein, 9 aa, Artificial Sequence
  Description of Artificial Sequence: Synthetic peptide
  Seed: RTFDPHFLR (MOG_HUMAN)
RSFDPHFLR

SEQ ID NO: 118434 - protein, 9 aa, Artificial Sequence
  Description of Artificial Sequence: Synthetic peptide
  Seed: LQITVGLIF (MOG_HUMAN)
LTITVGLIF

SEQ ID NO: 118435 - protein, 10 aa, Artificial Sequence
  Description of Artificial Sequence: Synthetic peptide
  Seed: RVVHLYRNGK (MOG_HUMAN)
RHVHLYRNGR

SEQ ID NO: 118436 - protein, 9 aa, Artificial Sequence
  Description of Artificial Sequence: Synthetic peptide
  Seed: ICYNWLHRR (MOG_HUMAN)
IMYNWLHRR

SEQ ID NO: 118437 - protein, 9 aa, Artificial Sequence
  Description of Artificial Sequence: Synthetic peptide
  Seed: LAVLPVLLL (MOG_HUMAN)
LLVLPVLLY

SEQ ID NO: 118438 - protein, 10 aa, Artificial Sequence
  Description of Artificial Sequence: Synthetic peptide
  Seed: VSSSYAGQFR (MOG_HUMAN)
VASSYAGQFK

SEQ ID NO: 118439 - protein, 9 aa, Artificial Sequence
  Description of Artificial Sequence: Synthetic peptide
  Seed: VGDEVELPC (MOG_HUMAN)
VSDEVELPI

SEQ ID NO: 118440 - protein, 9 aa, Artificial Sequence
  Description of Artificial Sequence: Synthetic peptide
  Seed: TCFFRDHSY (MOG_HUMAN)
TVFFRDHSF

SEQ ID NO: 118441 - protein, 9 aa, Artificial Sequence
  Description of Artificial Sequence: Synthetic peptide
  Seed: MELKVEDPF (MOG_HUMAN)
MILKVEDPF

SEQ ID NO: 118442 - protein, 9 aa, Artificial Sequence
  Description of Artificial Sequence: Synthetic peptide
  Seed: LQVSSSYAG (MOG_HUMAN)
LHVSSSYAY

SEQ ID NO: 118443 - protein, 10 aa, Artificial Sequence
  Description of Artificial Sequence: Synthetic peptide
  Seed: LVLLAVLPVL (MOG_HUMAN)
LFLLAVLPVL

SEQ ID NO: 118444 - protein, 9 aa, Artificial Sequence
  Description of Artificial Sequence: Synthetic peptide
  Seed: FYWVSPGVL (MOG_HUMAN)
FTWVSPGVY

SEQ ID NO: 118445 - protein, 10 aa, Artificial Sequence
  Description of Artificial Sequence: Synthetic peptide
  Seed: SLSRPSLPSC (MOG_HUMAN)
SFSRPSLPSA

SEQ ID NO: 118446 - protein, 9 aa, Artificial Sequence
  Description of Artificial Sequence: Synthetic peptide
  Seed: IVPVLGPLV (MOG_HUMAN)
ISPVLGPLL

SEQ ID NO: 118447 - protein, 10 aa, Artificial Sequence
  Description of Artificial Sequence: Synthetic peptide
  Seed: LLQITVGLIF (MOG_HUMAN)
LQQITVGLIM

SEQ ID NO: 118448 - protein, 10 aa, Artificial Sequence
  Description of Artificial Sequence: Synthetic peptide
  Seed: RTFDPHFLRV (MOG_HUMAN)
RGFDPHFLRK

SEQ ID NO: 118449 - protein, 11 aa, Artificial Sequence
  Description of Artificial Sequence: Synthetic peptide
  Seed: RISPGKNATGM (MOG_HUMAN)
RMSPGKNATGW

SEQ ID NO: 118450 - protein, 10 aa, Artificial Sequence
  Description of Artificial Sequence: Synthetic peptide
  Seed: WVSPGVLVLL (MOG_HUMAN)
WVSPGVLVLV

SEQ ID NO: 118451 - protein, 10 aa, Artificial Sequence
  Description of Artificial Sequence: Synthetic peptide
  Seed: LLLQVSSSYA (MOG_HUMAN)
LWLQVSSSYV

SEQ ID NO: 118452 - protein, 9 aa, Artificial Sequence
  Description of Artificial Sequence: Synthetic peptide
  Seed: LLAVLPVLL (MOG_HUMAN)
LAAVLPVLM

SEQ ID NO: 118453 - protein, 10 aa, Artificial Sequence
  Description of Artificial Sequence: Synthetic peptide
  Seed: FVIVPVLGPL (MOG_HUMAN)
FYIVPVLGPL

SEQ ID NO: 118454 - protein, 11 aa, Artificial Sequence
  Description of Artificial Sequence: Synthetic peptide
  Seed: RDHSYQEEAAM (MOG_HUMAN)
RGHSYQEEAAW

SEQ ID NO: 118455 - protein, 9 aa, Artificial Sequence
  Description of Artificial Sequence: Synthetic peptide
  Seed: VSPGVLVLL (MOG_HUMAN)
VVPGVLVLI

SEQ ID NO: 118456 - protein, 9 aa, Artificial Sequence
  Description of Artificial Sequence: Synthetic peptide
  Seed: LAVLPVLLL (MOG_HUMAN)
LTVLPVLLM

SEQ ID NO: 118457 - protein, 9 aa, Artificial Sequence
  Description of Artificial Sequence: Synthetic peptide
  Seed: RTFDPHFLR (MOG_HUMAN)
RTFDPHFLM

SEQ ID NO: 118458 - protein, 11 aa, Artificial Sequence
  Description of Artificial Sequence: Synthetic peptide
  Seed: IGPRHPIRALV (MOG_HUMAN)
IMPRHPIRALL

SEQ ID NO: 118459 - protein, 10 aa, Artificial Sequence
  Description of Artificial Sequence: Synthetic peptide
  Seed: IFLCLQYRLR (MOG_HUMAN)
ISLCLQYRLR

SEQ ID NO: 118460 - protein, 9 aa, Artificial Sequence
  Description of Artificial Sequence: Synthetic peptide
  Seed: LLLQVSSSY (MOG_HUMAN)
LMLQVSSSV

SEQ ID NO: 118461 - protein, 8 aa, Artificial Sequence
  Description of Artificial Sequence: Synthetic peptide
  Seed: FSDEGGFT (MOG_HUMAN)
FMDEGGFL

SEQ ID NO: 118462 - protein, 10 aa, Artificial Sequence
  Description of Artificial Sequence: Synthetic peptide
  Seed: AEIENLHRTF (MOG_HUMAN)
ALIENLHRTY

SEQ ID NO: 118463 - protein, 10 aa, Artificial Sequence
  Description of Artificial Sequence: Synthetic peptide
  Seed: ATGMEVGWYR (MOG_HUMAN)
AWGMEVGWYK

SEQ ID NO: 118464 - protein, 10 aa, Artificial Sequence
  Description of Artificial Sequence: Synthetic peptide
  Seed: FDPHFLRVPC (MOG_HUMAN)
FTPHFLRVPL

SEQ ID NO: 118465 - protein, 9 aa, Artificial Sequence
  Description of Artificial Sequence: Synthetic peptide
  Seed: LQYRLRGKL (MOG_HUMAN)
LQYRLRGKY

SEQ ID NO: 118466 - protein, 9 aa, Artificial Sequence
  Description of Artificial Sequence: Synthetic peptide
  Seed: LAGQFLEEL (MOG_HUMAN)
LIGQFLEEL

SEQ ID NO: 118467 - protein, 9 aa, Artificial Sequence
  Description of Artificial Sequence: Synthetic peptide
  Seed: SPGKNATGM (MOG_HUMAN)
SMGKNATGY

SEQ ID NO: 118468 - protein, 11 aa, Artificial Sequence
  Description of Artificial Sequence: Synthetic peptide
  Seed: HSYQEEAAMEL (MOG_HUMAN)
HAYQEEAAMEL

SEQ ID NO: 118469 - protein, 9 aa, Artificial Sequence
  Description of Artificial Sequence: Synthetic peptide
  Seed: RRLAGQFLE (MOG_HUMAN)
RRLAGQFLQ

SEQ ID NO: 118470 - protein, 9 aa, Artificial Sequence
  Description of Artificial Sequence: Synthetic peptide
  Seed: WVSPGVLVL (MOG_HUMAN)
WASPGVLVF

SEQ ID NO: 118471 - protein, 10 aa, Artificial Sequence
  Description of Artificial Sequence: Synthetic peptide
  Seed: RTFDPHFLRV (MOG_HUMAN)
RYFDPHFLRR

SEQ ID NO: 118472 - protein, 10 aa, Artificial Sequence
  Description of Artificial Sequence: Synthetic peptide
  Seed: LVLLAVLPVL (MOG_HUMAN)
LILLAVLPVL

SEQ ID NO: 118473 - protein, 9 aa, Artificial Sequence
  Description of Artificial Sequence: Synthetic peptide
  Seed: LIICYNWLH (MOG_HUMAN)
LAICYNWLR

SEQ ID NO: 118474 - protein, 9 aa, Artificial Sequence
  Description of Artificial Sequence: Synthetic peptide
  Seed: CSFLLLLLL (MOG_HUMAN)
CMFLLLLLL

SEQ ID NO: 118475 - protein, 9 aa, Artificial Sequence
  Description of Artificial Sequence: Synthetic peptide
  Seed: FYWVSPGVL (MOG_HUMAN)
FQWVSPGVL

SEQ ID NO: 118476 - protein, 10 aa, Artificial Sequence
  Description of Artificial Sequence: Synthetic peptide
  Seed: RALVGDEVEL (MOG_HUMAN)
RALVGDEVEW

SEQ ID NO: 118477 - protein, 9 aa, Artificial Sequence
  Description of Artificial Sequence: Synthetic peptide
  Seed: RVIGPRHPI (MOG_HUMAN)
RIIGPRHPK

SEQ ID NO: 118478 - protein, 9 aa, Artificial Sequence
  Description of Artificial Sequence: Synthetic peptide
  Seed: TFDPHFLRV (MOG_HUMAN)
TIDPHFLRY

SEQ ID NO: 118479 - protein, 10 aa, Artificial Sequence
  Description of Artificial Sequence: Synthetic peptide
  Seed: LVLLAVLPVL (MOG_HUMAN)
LYLLAVLPVV

SEQ ID NO: 118480 - protein, 9 aa, Artificial Sequence
  Description of Artificial Sequence: Synthetic peptide
  Seed: RVIGPRHPI (MOG_HUMAN)
RVIGPRHPV

SEQ ID NO: 118481 - protein, 9 aa, Artificial Sequence
  Description of Artificial Sequence: Synthetic peptide
  Seed: LAGQFLEEL (MOG_HUMAN)
LQGQFLEEM

SEQ ID NO: 118482 - protein, 9 aa, Artificial Sequence
  Description of Artificial Sequence: Synthetic peptide
  Seed: RIRNVRFSD (MOG_HUMAN)
RIRNVRFSP

SEQ ID NO: 118483 - protein, 9 aa, Artificial Sequence
  Description of Artificial Sequence: Synthetic peptide
  Seed: SLPSCLCSF (MOG_HUMAN)
SWPSCLCSI

SEQ ID NO: 118484 - protein, 10 aa, Artificial Sequence
  Description of Artificial Sequence: Synthetic peptide
  Seed: FDPHFLRVPC (MOG_HUMAN)
FTPHFLRVPM

SEQ ID NO: 118485 - protein, 9 aa, Artificial Sequence
  Description of Artificial Sequence: Synthetic peptide
  Seed: YRPPFSRVV (MOG_HUMAN)
YVPPFSRVY

SEQ ID NO: 118486 - protein, 9 aa, Artificial Sequence
  Description of Artificial Sequence: Synthetic peptide
  Seed: VSSSYAGQF (MOG_HUMAN)
VVSSYAGQW

SEQ ID NO: 118487 - protein, 10 aa, Artificial Sequence
  Description of Artificial Sequence: Synthetic peptide
  Seed: IGPRHPIRAL (MOG_HUMAN)
ILPRHPIRAI

SEQ ID NO: 118488 - protein, 9 aa, Artificial Sequence
  Description of Artificial Sequence: Synthetic peptide
  Seed: KLRAEIENL (MOG_HUMAN)
KTRAEIENI

SEQ ID NO: 118489 - protein, 9 aa, Artificial Sequence
  Description of Artificial Sequence: Synthetic peptide
  Seed: WYRPPFSRV (MOG_HUMAN)
WYRPPFSRW

SEQ ID NO: 118490 - protein, 10 aa, Artificial Sequence
  Description of Artificial Sequence: Synthetic peptide
  Seed: DAIGEGKVTL (MOG_HUMAN)
DSIGEGKVTY

SEQ ID NO: 118491 - protein, 10 aa, Artificial Sequence
  Description of Artificial Sequence: Synthetic peptide
  Seed: FVIVPVLGPL (MOG_HUMAN)
FSIVPVLGPY

SEQ ID NO: 118492 - protein, 9 aa, Artificial Sequence
  Description of Artificial Sequence: Synthetic peptide
  Seed: GQFRVIGPR (MOG_HUMAN)
GRFRVIGPF

SEQ ID NO: 118493 - protein, 9 aa, Artificial Sequence
  Description of Artificial Sequence: Synthetic peptide
  Seed: LSRPSLPSC (MOG_HUMAN)
LPRPSLPSS

SEQ ID NO: 118494 - protein, 9 aa, Artificial Sequence
  Description of Artificial Sequence: Synthetic peptide
  Seed: RTFDPHFLR (MOG_HUMAN)
RGFDPHFLF

SEQ ID NO: 118495 - protein, 10 aa, Artificial Sequence
  Description of Artificial Sequence: Synthetic peptide
  Seed: ATGMEVGWYR (MOG_HUMAN)
AKGMEVGWYK

SEQ ID NO: 118496 - protein, 9 aa, Artificial Sequence
  Description of Artificial Sequence: Synthetic peptide
  Seed: RVIGPRHPI (MOG_HUMAN)
RWIGPRHPM

SEQ ID NO: 118497 - protein, 9 aa, Artificial Sequence
  Description of Artificial Sequence: Synthetic peptide
  Seed: LLLQITVGL (MOG_HUMAN)
LVLQITVGY

SEQ ID NO: 118498 - protein, 9 aa, Artificial Sequence
  Description of Artificial Sequence: Synthetic peptide
  Seed: TFDPHFLRV (MOG_HUMAN)
TVDPHFLRY

SEQ ID NO: 118499 - protein, 9 aa, Artificial Sequence
  Description of Artificial Sequence: Synthetic peptide
  Seed: FSDEGGFTC (MOG_HUMAN)
FFDEGGFTV

SEQ ID NO: 118500 - protein, 9 aa, Artificial Sequence
  Description of Artificial Sequence: Synthetic peptide
  Seed: VLPVLLLQI (MOG_HUMAN)
VMPVLLLQI

SEQ ID NO: 118501 - protein, 10 aa, Artificial Sequence
  Description of Artificial Sequence: Synthetic peptide
  Seed: VIVPVLGPLV (MOG_HUMAN)
VMVPVLGPLI

SEQ ID NO: 118502 - protein, 10 aa, Artificial Sequence
  Description of Artificial Sequence: Synthetic peptide
  Seed: APEYRGRTEL (MOG_HUMAN)
APEYRGRTEA

SEQ ID NO: 118503 - protein, 10 aa, Artificial Sequence
  Description of Artificial Sequence: Synthetic peptide
  Seed: LLLLQVSSSY (MOG_HUMAN)
LALLQVSSSY

SEQ ID NO: 118504 - protein, 10 aa, Artificial Sequence
  Description of Artificial Sequence: Synthetic peptide
  Seed: SLSRPSLPSC (MOG_HUMAN)
SRSRPSLPSK

SEQ ID NO: 118505 - protein, 10 aa, Artificial Sequence
  Description of Artificial Sequence: Synthetic peptide
  Seed: AVLPVLLLQI (MOG_HUMAN)
ALLPVLLLQV

SEQ ID NO: 118506 - protein, 10 aa, Artificial Sequence
  Description of Artificial Sequence: Synthetic peptide
  Seed: FDPHFLRVPC (MOG_HUMAN)
FIPHFLRVPT

SEQ ID NO: 118507 - protein, 9 aa, Artificial Sequence
  Description of Artificial Sequence: Synthetic peptide
  Seed: RVIGPRHPI (MOG_HUMAN)
RLIGPRHPK

SEQ ID NO: 118508 - protein, 9 aa, Artificial Sequence
  Description of Artificial Sequence: Synthetic peptide
  Seed: EEAAMELKV (MOG_HUMAN)
EEAAMELKW

SEQ ID NO: 118509 - protein, 9 aa, Artificial Sequence
  Description of Artificial Sequence: Synthetic peptide
  Seed: RVPCWKITL (MOG_HUMAN)
RIPCWKITR

SEQ ID NO: 118510 - protein, 11 aa, Artificial Sequence
  Description of Artificial Sequence: Synthetic peptide
  Seed: RDHSYQEEAAM (MOG_HUMAN)
RSHSYQEEAAY

SEQ ID NO: 118511 - protein, 9 aa, Artificial Sequence
  Description of Artificial Sequence: Synthetic peptide
  Seed: WVSPGVLVL (MOG_HUMAN)
WGSPGVLVF

SEQ ID NO: 118512 - protein, 9 aa, Artificial Sequence
  Description of Artificial Sequence: Synthetic peptide
  Seed: RVPCWKITL (MOG_HUMAN)
RLPCWKITY

SEQ ID NO: 118513 - protein, 10 aa, Artificial Sequence
  Description of Artificial Sequence: Synthetic peptide
  Seed: AEIENLHRTF (MOG_HUMAN)
AHIENLHRTY

SEQ ID NO: 118514 - protein, 10 aa, Artificial Sequence
  Description of Artificial Sequence: Synthetic peptide
  Seed: ELPCRISPGK (MOG_HUMAN)
EIPCRISPGK

SEQ ID NO: 118515 - protein, 9 aa, Artificial Sequence
  Description of Artificial Sequence: Synthetic peptide
  Seed: LHRRLAGQF (MOG_HUMAN)
LKRRLAGQF

SEQ ID NO: 118516 - protein, 11 aa, Artificial Sequence
  Description of Artificial Sequence: Synthetic peptide
  Seed: RRLAGQFLEEL (MOG_HUMAN)
RYLAGQFLEEI

SEQ ID NO: 118517 - protein, 9 aa, Artificial Sequence
  Description of Artificial Sequence: Synthetic peptide
  Seed: FLEELRNPF (MOG_HUMAN)
FMEELRNPV

SEQ ID NO: 118518 - protein, 10 aa, Artificial Sequence
  Description of Artificial Sequence: Synthetic peptide
  Seed: FVIVPVLGPL (MOG_HUMAN)
FFIVPVLGPA

SEQ ID NO: 118519 - protein, 9 aa, Artificial Sequence
  Description of Artificial Sequence: Synthetic peptide
  Seed: ITLFVIVPV (MOG_HUMAN)
IILFVIVPL

SEQ ID NO: 118520 - protein, 9 aa, Artificial Sequence
  Description of Artificial Sequence: Synthetic peptide
  Seed: WVSPGVLVL (MOG_HUMAN)
WKSPGVLVM

SEQ ID NO: 118521 - protein, 9 aa, Artificial Sequence
  Description of Artificial Sequence: Synthetic peptide
  Seed: MASLSRPSL (MOG_HUMAN)
MSSLSRPSI

SEQ ID NO: 118522 - protein, 9 aa, Artificial Sequence
  Description of Artificial Sequence: Synthetic peptide
  Seed: RTFDPHFLR (MOG_HUMAN)
RGFDPHFLW

SEQ ID NO: 118523 - protein, 9 aa, Artificial Sequence
  Description of Artificial Sequence: Synthetic peptide
  Seed: SPGKNATGM (MOG_HUMAN)
SPGKNATGY

SEQ ID NO: 118524 - protein, 9 aa, Artificial Sequence
  Description of Artificial Sequence: Synthetic peptide
  Seed: LSRPSLPSC (MOG_HUMAN)
LSRPSLPSY

SEQ ID NO: 118525 - protein, 9 aa, Artificial Sequence
  Description of Artificial Sequence: Synthetic peptide
  Seed: FSDEGGFTC (MOG_HUMAN)
FLDEGGFTI

SEQ ID NO: 118526 - protein, 9 aa, Artificial Sequence
  Description of Artificial Sequence: Synthetic peptide
  Seed: YQEEAAMEL (MOG_HUMAN)
YWEEAAMEV

SEQ ID NO: 118527 - protein, 10 aa, Artificial Sequence
  Description of Artificial Sequence: Synthetic peptide
  Seed: GKLRAEIENL (MOG_HUMAN)
GFLRAEIENV

SEQ ID NO: 118528 - protein, 10 aa, Artificial Sequence
  Description of Artificial Sequence: Synthetic peptide
  Seed: YWVSPGVLVL (MOG_HUMAN)
YFVSPGVLVF

SEQ ID NO: 118529 - protein, 11 aa, Artificial Sequence
  Description of Artificial Sequence: Synthetic peptide
  Seed: HRTFDPHFLRV (MOG_HUMAN)
HMTFDPHFLRP

SEQ ID NO: 118530 - protein, 9 aa, Artificial Sequence
  Description of Artificial Sequence: Synthetic peptide
  Seed: SRPSLPSCL (MOG_HUMAN)
SSPSLPSCV

SEQ ID NO: 118531 - protein, 10 aa, Artificial Sequence
  Description of Artificial Sequence: Synthetic peptide
  Seed: VLLAVLPVLL (MOG_HUMAN)
VALAVLPVLL

SEQ ID NO: 118532 - protein, 10 aa, Artificial Sequence
  Description of Artificial Sequence: Synthetic peptide
  Seed: LLKDAIGEGK (MOG_HUMAN)
LTKDAIGEGR

SEQ ID NO: 118533 - protein, 10 aa, Artificial Sequence
  Description of Artificial Sequence: Synthetic peptide
  Seed: VSSSYAGQFR (MOG_HUMAN)
VTSSYAGQFR

SEQ ID NO: 118534 - protein, 9 aa, Artificial Sequence
  Description of Artificial Sequence: Synthetic peptide
  Seed: LLAVLPVLL (MOG_HUMAN)
LAAVLPVLV

SEQ ID NO: 118535 - protein, 10 aa, Artificial Sequence
  Description of Artificial Sequence: Synthetic peptide
  Seed: LLQITVGLIF (MOG_HUMAN)
LGQITVGLIF

SEQ ID NO: 118536 - protein, 9 aa, Artificial Sequence
  Description of Artificial Sequence: Synthetic peptide
  Seed: FSRVVHLYR (MOG_HUMAN)
FLRVVHLYK

SEQ ID NO: 118537 - protein, 10 aa, Artificial Sequence
  Description of Artificial Sequence: Synthetic peptide
  Seed: LVLLAVLPVL (MOG_HUMAN)
LMLLAVLPVA

SEQ ID NO: 118538 - protein, 9 aa, Artificial Sequence
  Description of Artificial Sequence: Synthetic peptide
  Seed: LQVSSSYAG (MOG_HUMAN)
LSVSSSYAL

SEQ ID NO: 118539 - protein, 9 aa, Artificial Sequence
  Description of Artificial Sequence: Synthetic peptide
  Seed: SRPSLPSCL (MOG_HUMAN)
SFPSLPSCM

SEQ ID NO: 118540 - protein, 10 aa, Artificial Sequence
  Description of Artificial Sequence: Synthetic peptide
  Seed: IGPRHPIRAL (MOG_HUMAN)
IEPRHPIRAL

SEQ ID NO: 118541 - protein, 9 aa, Artificial Sequence
  Description of Artificial Sequence: Synthetic peptide
  Seed: TCFFRDHSY (MOG_HUMAN)
TAFFRDHSV

SEQ ID NO: 118542 - protein, 11 aa, Artificial Sequence
  Description of Artificial Sequence: Synthetic peptide
  Seed: PPFSRVVHLYR (MOG_HUMAN)
PLFSRVVHLYR

SEQ ID NO: 118543 - protein, 10 aa, Artificial Sequence
  Description of Artificial Sequence: Synthetic peptide
  Seed: AEIENLHRTF (MOG_HUMAN)
AVIENLHRTW

SEQ ID NO: 118544 - protein, 10 aa, Artificial Sequence
  Description of Artificial Sequence: Synthetic peptide
  Seed: GPRHPIRALV (MOG_HUMAN)
GPRHPIRALM

SEQ ID NO: 118545 - protein, 11 aa, Artificial Sequence
  Description of Artificial Sequence: Synthetic peptide
  Seed: RFSDEGGFTCF (MOG_HUMAN)
RVSDEGGFTCM

SEQ ID NO: 118546 - protein, 9 aa, Artificial Sequence
  Description of Artificial Sequence: Synthetic peptide
  Seed: FSDEGGFTC (MOG_HUMAN)
FTDEGGFTM

SEQ ID NO: 118547 - protein, 10 aa, Artificial Sequence
  Description of Artificial Sequence: Synthetic peptide
  Seed: GLIFLCLQYR (MOG_HUMAN)
GHIFLCLQYR

SEQ ID NO: 118548 - protein, 9 aa, Artificial Sequence
  Description of Artificial Sequence: Synthetic peptide
  Seed: NATGMEVGW (MOG_HUMAN)
NSTGMEVGW

SEQ ID NO: 118549 - protein, 9 aa, Artificial Sequence
  Description of Artificial Sequence: Synthetic peptide
  Seed: TLFVIVPVL (MOG_HUMAN)
TRFVIVPVF

SEQ ID NO: 118550 - protein, 8 aa, Artificial Sequence
  Description of Artificial Sequence: Synthetic peptide
  Seed: FSDEGGFT (MOG_HUMAN)
FVDEGGFV

SEQ ID NO: 118551 - protein, 10 aa, Artificial Sequence
  Description of Artificial Sequence: Synthetic peptide
  Seed: RRLAGQFLEE (MOG_HUMAN)
RRLAGQFLEF

SEQ ID NO: 118552 - protein, 9 aa, Artificial Sequence
  Description of Artificial Sequence: Synthetic peptide
  Seed: LLLQITVGL (MOG_HUMAN)
LALQITVGV

SEQ ID NO: 118553 - protein, 9 aa, Artificial Sequence
  Description of Artificial Sequence: Synthetic peptide
  Seed: AIGEGKVTL (MOG_HUMAN)
AVGEGKVTL

SEQ ID NO: 118554 - protein, 9 aa, Artificial Sequence
  Description of Artificial Sequence: Synthetic peptide
  Seed: LIFLCLQYR (MOG_HUMAN)
LWFLCLQYK

SEQ ID NO: 118555 - protein, 9 aa, Artificial Sequence
  Description of Artificial Sequence: Synthetic peptide
  Seed: LQVSSSYAG (MOG_HUMAN)
LAVSSSYAY

SEQ ID NO: 118556 - protein, 10 aa, Artificial Sequence
  Description of Artificial Sequence: Synthetic peptide
  Seed: FDPHFLRVPC (MOG_HUMAN)
FTPHFLRVPA

SEQ ID NO: 118557 - protein, 9 aa, Artificial Sequence
  Description of Artificial Sequence: Synthetic peptide
  Seed: SLPSCLCSF (MOG_HUMAN)
SQPSCLCSV

SEQ ID NO: 118558 - protein, 9 aa, Artificial Sequence
  Description of Artificial Sequence: Synthetic peptide
  Seed: WVSPGVLVL (MOG_HUMAN)
WYSPGVLVI

SEQ ID NO: 118559 - protein, 9 aa, Artificial Sequence
  Description of Artificial Sequence: Synthetic peptide
  Seed: RVIGPRHPI (MOG_HUMAN)
RTIGPRHPA

SEQ ID NO: 118560 - protein, 9 aa, Artificial Sequence
  Description of Artificial Sequence: Synthetic peptide
  Seed: FLLLLLLQV (MOG_HUMAN)
FTLLLLLQV

SEQ ID NO: 118561 - protein, 9 aa, Artificial Sequence
  Description of Artificial Sequence: Synthetic peptide
  Seed: VIVPVLGPL (MOG_HUMAN)
VTVPVLGPL

SEQ ID NO: 118562 - protein, 10 aa, Artificial Sequence
  Description of Artificial Sequence: Synthetic peptide
  Seed: RLAGQFLEEL (MOG_HUMAN)
RAAGQFLEEV

SEQ ID NO: 118563 - protein, 10 aa, Artificial Sequence
  Description of Artificial Sequence: Synthetic peptide
  Seed: RVVHLYRNGK (MOG_HUMAN)
RSVHLYRNGK

SEQ ID NO: 118564 - protein, 10 aa, Artificial Sequence
  Description of Artificial Sequence: Synthetic peptide
  Seed: SSYAGQFRVI (MOG_HUMAN)
STYAGQFRVW

SEQ ID NO: 118565 - protein, 9 aa, Artificial Sequence
  Description of Artificial Sequence: Synthetic peptide
  Seed: LLLQITVGL (MOG_HUMAN)
LSLQITVGF

SEQ ID NO: 118566 - protein, 9 aa, Artificial Sequence
  Description of Artificial Sequence: Synthetic peptide
  Seed: TLFVIVPVL (MOG_HUMAN)
TRFVIVPVL

SEQ ID NO: 118567 - protein, 10 aa, Artificial Sequence
  Description of Artificial Sequence: Synthetic peptide
  Seed: RLAGQFLEEL (MOG_HUMAN)
RVAGQFLEEY

SEQ ID NO: 118568 - protein, 9 aa, Artificial Sequence
  Description of Artificial Sequence: Synthetic peptide
  Seed: RTFDPHFLR (MOG_HUMAN)
RAFDPHFLI

SEQ ID NO: 118569 - protein, 10 aa, Artificial Sequence
  Description of Artificial Sequence: Synthetic peptide
  Seed: RTFDPHFLRV (MOG_HUMAN)
RTFDPHFLRW

SEQ ID NO: 118570 - protein, 11 aa, Artificial Sequence
  Description of Artificial Sequence: Synthetic peptide
  Seed: ALIICYNWLHR (MOG_HUMAN)
AMIICYNWLHR

SEQ ID NO: 118571 - protein, 9 aa, Artificial Sequence
  Description of Artificial Sequence: Synthetic peptide
  Seed: IICYNWLHR (MOG_HUMAN)
IICYNWLHK

SEQ ID NO: 118572 - protein, 10 aa, Artificial Sequence
  Description of Artificial Sequence: Synthetic peptide
  Seed: KNATGMEVGW (MOG_HUMAN)
KTATGMEVGY

SEQ ID NO: 118573 - protein, 10 aa, Artificial Sequence
  Description of Artificial Sequence: Synthetic peptide
  Seed: SLSRPSLPSC (MOG_HUMAN)
SKSRPSLPSK

SEQ ID NO: 118574 - protein, 10 aa, Artificial Sequence
  Description of Artificial Sequence: Synthetic peptide
  Seed: FVIVPVLGPL (MOG_HUMAN)
FQIVPVLGPA

SEQ ID NO: 118575 - protein, 9 aa, Artificial Sequence
  Description of Artificial Sequence: Synthetic peptide
  Seed: VLPVLLLQI (MOG_HUMAN)
VVPVLLLQV

SEQ ID NO: 118576 - protein, 9 aa, Artificial Sequence
  Description of Artificial Sequence: Synthetic peptide
  Seed: YWVSPGVLV (MOG_HUMAN)
YYVSPGVLL

SEQ ID NO: 118577 - protein, 9 aa, Artificial Sequence
  Description of Artificial Sequence: Synthetic peptide
  Seed: LHRTFDPHF (MOG_HUMAN)
LQRTFDPHY

SEQ ID NO: 118578 - protein, 9 aa, Artificial Sequence
  Description of Artificial Sequence: Synthetic peptide
  Seed: RVIGPRHPI (MOG_HUMAN)
RYIGPRHPL

SEQ ID NO: 118579 - protein, 10 aa, Artificial Sequence
  Description of Artificial Sequence: Synthetic peptide
  Seed: PFSRVVHLYR (MOG_HUMAN)
PKSRVVHLYR

SEQ ID NO: 118580 - protein, 10 aa, Artificial Sequence
  Description of Artificial Sequence: Synthetic peptide
  Seed: RTFDPHFLRV (MOG_HUMAN)
RCFDPHFLRR

SEQ ID NO: 118581 - protein, 10 aa, Artificial Sequence
  Description of Artificial Sequence: Synthetic peptide
  Seed: RTFDPHFLRV (MOG_HUMAN)
RLFDPHFLRQ

SEQ ID NO: 118582 - protein, 9 aa, Artificial Sequence
  Description of Artificial Sequence: Synthetic peptide
  Seed: SYAGQFRVI (MOG_HUMAN)
SFAGQFRVI

SEQ ID NO: 118583 - protein, 10 aa, Artificial Sequence
  Description of Artificial Sequence: Synthetic peptide
  Seed: KVTLRIRNVR (MOG_HUMAN)
KLTLRIRNVR

SEQ ID NO: 118584 - protein, 10 aa, Artificial Sequence
  Description of Artificial Sequence: Synthetic peptide
  Seed: KNATGMEVGW (MOG_HUMAN)
KSATGMEVGW

SEQ ID NO: 118585 - protein, 10 aa, Artificial Sequence
  Description of Artificial Sequence: Synthetic peptide
  Seed: RALVGDEVEL (MOG_HUMAN)
RQLVGDEVEM

SEQ ID NO: 118586 - protein, 9 aa, Artificial Sequence
  Description of Artificial Sequence: Synthetic peptide
  Seed: YRPPFSRVV (MOG_HUMAN)
YRPPFSRVL

SEQ ID NO: 118587 - protein, 9 aa, Artificial Sequence
  Description of Artificial Sequence: Synthetic peptide
  Seed: AIGEGKVTL (MOG_HUMAN)
ATGEGKVTL

SEQ ID NO: 118588 - protein, 11 aa, Artificial Sequence
  Description of Artificial Sequence: Synthetic peptide
  Seed: PPFSRVVHLYR (MOG_HUMAN)
PYFSRVVHLYR

SEQ ID NO: 118589 - protein, 10 aa, Artificial Sequence
  Description of Artificial Sequence: Synthetic peptide
  Seed: FSRVVHLYRN (MOG_HUMAN)
FIRVVHLYRR

SEQ ID NO: 118590 - protein, 10 aa, Artificial Sequence
  Description of Artificial Sequence: Synthetic peptide
  Seed: AEIENLHRTF (MOG_HUMAN)
AVIENLHRTY

SEQ ID NO: 118591 - protein, 9 aa, Artificial Sequence
  Description of Artificial Sequence: Synthetic peptide
  Seed: VLGPLVALI (MOG_HUMAN)
VAGPLVALF

SEQ ID NO: 118592 - protein, 11 aa, Artificial Sequence
  Description of Artificial Sequence: Synthetic peptide
  Seed: SLPSCLCSFLL (MOG_HUMAN)
SMPSCLCSFLV

SEQ ID NO: 118593 - protein, 9 aa, Artificial Sequence
  Description of Artificial Sequence: Synthetic peptide
  Seed: LAVLPVLLL (MOG_HUMAN)
LMVLPVLLL

SEQ ID NO: 118594 - protein, 9 aa, Artificial Sequence
  Description of Artificial Sequence: Synthetic peptide
  Seed: TFDPHFLRV (MOG_HUMAN)
TRDPHFLRI

SEQ ID NO: 118595 - protein, 9 aa, Artificial Sequence
  Description of Artificial Sequence: Synthetic peptide
  Seed: SRPSLPSCL (MOG_HUMAN)
SSPSLPSCL

SEQ ID NO: 118596 - protein, 9 aa, Artificial Sequence
  Description of Artificial Sequence: Synthetic peptide
  Seed: FSDEGGFTC (MOG_HUMAN)
FYDEGGFTY

SEQ ID NO: 118597 - protein, 10 aa, Artificial Sequence
  Description of Artificial Sequence: Synthetic peptide
  Seed: LLLQVSSSYA (MOG_HUMAN)
LVLQVSSSYL

SEQ ID NO: 118598 - protein, 9 aa, Artificial Sequence
  Description of Artificial Sequence: Synthetic peptide
  Seed: GWYRPPFSR (MOG_HUMAN)
GSYRPPFSR

SEQ ID NO: 118599 - protein, 10 aa, Artificial Sequence
  Description of Artificial Sequence: Synthetic peptide
  Seed: RLAGQFLEEL (MOG_HUMAN)
RAAGQFLEEY

SEQ ID NO: 118600 - protein, 9 aa, Artificial Sequence
  Description of Artificial Sequence: Synthetic peptide
  Seed: FSDEGGFTC (MOG_HUMAN)
FTDEGGFTW

SEQ ID NO: 118601 - protein, 9 aa, Artificial Sequence
  Description of Artificial Sequence: Synthetic peptide
  Seed: LQVSSSYAG (MOG_HUMAN)
LRVSSSYAF

SEQ ID NO: 118602 - protein, 11 aa, Artificial Sequence
  Description of Artificial Sequence: Synthetic peptide
  Seed: NATGMEVGWYR (MOG_HUMAN)
NMTGMEVGWYR

SEQ ID NO: 118603 - protein, 9 aa, Artificial Sequence
  Description of Artificial Sequence: Synthetic peptide
  Seed: YRPPFSRVV (MOG_HUMAN)
YIPPFSRVY

SEQ ID NO: 118604 - protein, 11 aa, Artificial Sequence
  Description of Artificial Sequence: Synthetic peptide
  Seed: VRFSDEGGFTC (MOG_HUMAN)
VRFSDEGGFTI

SEQ ID NO: 118605 - protein, 10 aa, Artificial Sequence
  Description of Artificial Sequence: Synthetic peptide
  Seed: HRTFDPHFLR (MOG_HUMAN)
HMTFDPHFLY

SEQ ID NO: 118606 - protein, 10 aa, Artificial Sequence
  Description of Artificial Sequence: Synthetic peptide
  Seed: VLLLQITVGL (MOG_HUMAN)
VELLQITVGI

SEQ ID NO: 118607 - protein, 10 aa, Artificial Sequence
  Description of Artificial Sequence: Synthetic peptide
  Seed: RTFDPHFLRV (MOG_HUMAN)
RIFDPHFLRH

SEQ ID NO: 118608 - protein, 9 aa, Artificial Sequence
  Description of Artificial Sequence: Synthetic peptide
  Seed: YRPPFSRVV (MOG_HUMAN)
YSPPFSRVF

SEQ ID NO: 118609 - protein, 11 aa, Artificial Sequence
  Description of Artificial Sequence: Synthetic peptide
  Seed: YWVSPGVLVLL (MOG_HUMAN)
YYVSPGVLVLM

SEQ ID NO: 118610 - protein, 9 aa, Artificial Sequence
  Description of Artificial Sequence: Synthetic peptide
  Seed: ITVGLIFLC (MOG_HUMAN)
IAVGLIFLL

SEQ ID NO: 118611 - protein, 9 aa, Artificial Sequence
  Description of Artificial Sequence: Synthetic peptide
  Seed: TCFFRDHSY (MOG_HUMAN)
TIFFRDHSF

SEQ ID NO: 118612 - protein, 10 aa, Artificial Sequence
  Description of Artificial Sequence: Synthetic peptide
  Seed: FSDEGGFTCF (MOG_HUMAN)
FIDEGGFTCY

SEQ ID NO: 118613 - protein, 9 aa, Artificial Sequence
  Description of Artificial Sequence: Synthetic peptide
  Seed: VGDEVELPC (MOG_HUMAN)
VSDEVELPM

SEQ ID NO: 118614 - protein, 9 aa, Artificial Sequence
  Description of Artificial Sequence: Synthetic peptide
  Seed: RTFDPHFLR (MOG_HUMAN)
RVFDPHFLY

SEQ ID NO: 118615 - protein, 10 aa, Artificial Sequence
  Description of Artificial Sequence: Synthetic peptide
  Seed: SCLCSFLLLL (MOG_HUMAN)
SWLCSFLLLI

SEQ ID NO: 118616 - protein, 9 aa, Artificial Sequence
  Description of Artificial Sequence: Synthetic peptide
  Seed: MELKVEDPF (MOG_HUMAN)
MKLKVEDPY

SEQ ID NO: 118617 - protein, 9 aa, Artificial Sequence
  Description of Artificial Sequence: Synthetic peptide
  Seed: WVSPGVLVL (MOG_HUMAN)
WESPGVLVF

SEQ ID NO: 118618 - protein, 10 aa, Artificial Sequence
  Description of Artificial Sequence: Synthetic peptide
  Seed: FVIVPVLGPL (MOG_HUMAN)
FEIVPVLGPI

SEQ ID NO: 118619 - protein, 9 aa, Artificial Sequence
  Description of Artificial Sequence: Synthetic peptide
  Seed: ALVGDEVEL (MOG_HUMAN)
AMVGDEVEL

SEQ ID NO: 118620 - protein, 10 aa, Artificial Sequence
  Description of Artificial Sequence: Synthetic peptide
  Seed: RTFDPHFLRV (MOG_HUMAN)
RFFDPHFLRV

SEQ ID NO: 118621 - protein, 9 aa, Artificial Sequence
  Description of Artificial Sequence: Synthetic peptide
  Seed: FLLLLLLQV (MOG_HUMAN)
FILLLLLQV

SEQ ID NO: 118622 - protein, 9 aa, Artificial Sequence
  Description of Artificial Sequence: Synthetic peptide
  Seed: AIGEGKVTL (MOG_HUMAN)
AYGEGKVTI

SEQ ID NO: 118623 - protein, 9 aa, Artificial Sequence
  Description of Artificial Sequence: Synthetic peptide
  Seed: MASLSRPSL (MOG_HUMAN)
MLSLSRPSM

SEQ ID NO: 118624 - protein, 10 aa, Artificial Sequence
  Description of Artificial Sequence: Synthetic peptide
  Seed: FSDEGGFTCF (MOG_HUMAN)
FPDEGGFTCF

SEQ ID NO: 118625 - protein, 9 aa, Artificial Sequence
  Description of Artificial Sequence: Synthetic peptide
  Seed: YRPPFSRVV (MOG_HUMAN)
YSPPFSRVM

SEQ ID NO: 118626 - protein, 10 aa, Artificial Sequence
  Description of Artificial Sequence: Synthetic peptide
  Seed: RDHSYQEEAA (MOG_HUMAN)
REHSYQEEAM

SEQ ID NO: 118627 - protein, 9 aa, Artificial Sequence
  Description of Artificial Sequence: Synthetic peptide
  Seed: LIFLCLQYR (MOG_HUMAN)
LTFLCLQYR

SEQ ID NO: 118628 - protein, 11 aa, Artificial Sequence
  Description of Artificial Sequence: Synthetic peptide
  Seed: FSDEGGFTCFF (MOG_HUMAN)
FADEGGFTCFF

SEQ ID NO: 118629 - protein, 9 aa, Artificial Sequence
  Description of Artificial Sequence: Synthetic peptide
  Seed: TFDPHFLRV (MOG_HUMAN)
TQDPHFLRI

SEQ ID NO: 118630 - protein, 9 aa, Artificial Sequence
  Description of Artificial Sequence: Synthetic peptide
  Seed: FLRVPCWKI (MOG_HUMAN)
FMRVPCWKI

SEQ ID NO: 118631 - protein, 10 aa, Artificial Sequence
  Description of Artificial Sequence: Synthetic peptide
  Seed: RTFDPHFLRV (MOG_HUMAN)
RFFDPHFLRL

SEQ ID NO: 118632 - protein, 9 aa, Artificial Sequence
  Description of Artificial Sequence: Synthetic peptide
  Seed: VLLAVLPVL (MOG_HUMAN)
VLLAVLPVT

SEQ ID NO: 118633 - protein, 11 aa, Artificial Sequence
  Description of Artificial Sequence: Synthetic peptide
  Seed: HSYQEEAAMEL (MOG_HUMAN)
HVYQEEAAMEY

SEQ ID NO: 118634 - protein, 9 aa, Artificial Sequence
  Description of Artificial Sequence: Synthetic peptide
  Seed: YQEEAAMEL (MOG_HUMAN)
YHEEAAMEY

SEQ ID NO: 118635 - protein, 9 aa, Artificial Sequence
  Description of Artificial Sequence: Synthetic peptide
  Seed: ALIICYNWL (MOG_HUMAN)
AMIICYNWV

SEQ ID NO: 118636 - protein, 10 aa, Artificial Sequence
  Description of Artificial Sequence: Synthetic peptide
  Seed: FDPHFLRVPC (MOG_HUMAN)
FKPHFLRVPL

SEQ ID NO: 118637 - protein, 10 aa, Artificial Sequence
  Description of Artificial Sequence: Synthetic peptide
  Seed: AEIENLHRTF (MOG_HUMAN)
AMIENLHRTF

SEQ ID NO: 118638 - protein, 10 aa, Artificial Sequence
  Description of Artificial Sequence: Synthetic peptide
  Seed: IICYNWLHRR (MOG_HUMAN)
ITCYNWLHRR

SEQ ID NO: 118639 - protein, 10 aa, Artificial Sequence
  Description of Artificial Sequence: Synthetic peptide
  Seed: FDPHFLRVPC (MOG_HUMAN)
FEPHFLRVPV

SEQ ID NO: 118640 - protein, 9 aa, Artificial Sequence
  Description of Artificial Sequence: Synthetic peptide
  Seed: RVIGPRHPI (MOG_HUMAN)
RTIGPRHPM

SEQ ID NO: 118641 - protein, 9 aa, Artificial Sequence
  Description of Artificial Sequence: Synthetic peptide
  Seed: CLCSFLLLL (MOG_HUMAN)
CLCSFLLLA

SEQ ID NO: 118642 - protein, 10 aa, Artificial Sequence
  Description of Artificial Sequence: Synthetic peptide
  Seed: FDPHFLRVPC (MOG_HUMAN)
FHPHFLRVPT

SEQ ID NO: 118643 - protein, 10 aa, Artificial Sequence
  Description of Artificial Sequence: Synthetic peptide
  Seed: RTFDPHFLRV (MOG_HUMAN)
RTFDPHFLRN

SEQ ID NO: 118644 - protein, 9 aa, Artificial Sequence
  Description of Artificial Sequence: Synthetic peptide
  Seed: LKVEDPFYW (MOG_HUMAN)
LQVEDPFYF

SEQ ID NO: 118645 - protein, 9 aa, Artificial Sequence
  Description of Artificial Sequence: Synthetic peptide
  Seed: TLFVIVPVL (MOG_HUMAN)
TMFVIVPVF

SEQ ID NO: 118646 - protein, 8 aa, Artificial Sequence
  Description of Artificial Sequence: Synthetic peptide
  Seed: RIRNVRFS (MOG_HUMAN)
RFRNVRFK

SEQ ID NO: 118647 - protein, 9 aa, Artificial Sequence
  Description of Artificial Sequence: Synthetic peptide
  Seed: SSSYAGQFR (MOG_HUMAN)
SMSYAGQFK

SEQ ID NO: 118648 - protein, 10 aa, Artificial Sequence
  Description of Artificial Sequence: Synthetic peptide
  Seed: ATGMEVGWYR (MOG_HUMAN)
AGGMEVGWYR

SEQ ID NO: 118649 - protein, 10 aa, Artificial Sequence
  Description of Artificial Sequence: Synthetic peptide
  Seed: VLLAVLPVLL (MOG_HUMAN)
VYLAVLPVLL

SEQ ID NO: 118650 - protein, 9 aa, Artificial Sequence
  Description of Artificial Sequence: Synthetic peptide
  Seed: RTFDPHFLR (MOG_HUMAN)
RMFDPHFLY

SEQ ID NO: 118651 - protein, 9 aa, Artificial Sequence
  Description of Artificial Sequence: Synthetic peptide
  Seed: RVPCWKITL (MOG_HUMAN)
RWPCWKITV

SEQ ID NO: 118652 - protein, 10 aa, Artificial Sequence
  Description of Artificial Sequence: Synthetic peptide
  Seed: RPPFSRVVHL (MOG_HUMAN)
RLPFSRVVHL

SEQ ID NO: 118653 - protein, 10 aa, Artificial Sequence
  Description of Artificial Sequence: Synthetic peptide
  Seed: FDPHFLRVPC (MOG_HUMAN)
FYPHFLRVPV

SEQ ID NO: 118654 - protein, 10 aa, Artificial Sequence
  Description of Artificial Sequence: Synthetic peptide
  Seed: SSYAGQFRVI (MOG_HUMAN)
SWYAGQFRVI

SEQ ID NO: 118655 - protein, 11 aa, Artificial Sequence
  Description of Artificial Sequence: Synthetic peptide
  Seed: LIFLCLQYRLR (MOG_HUMAN)
LMFLCLQYRLR

SEQ ID NO: 118656 - protein, 10 aa, Artificial Sequence
  Description of Artificial Sequence: Synthetic peptide
  Seed: ATGMEVGWYR (MOG_HUMAN)
ATGMEVGWYK

SEQ ID NO: 118657 - protein, 9 aa, Artificial Sequence
  Description of Artificial Sequence: Synthetic peptide
  Seed: LSRPSLPSC (MOG_HUMAN)
LTRPSLPSS

SEQ ID NO: 118658 - protein, 9 aa, Artificial Sequence
  Description of Artificial Sequence: Synthetic peptide
  Seed: AEIENLHRT (MOG_HUMAN)
AEIENLHRS

SEQ ID NO: 118659 - protein, 9 aa, Artificial Sequence
  Description of Artificial Sequence: Synthetic peptide
  Seed: LAGQFLEEL (MOG_HUMAN)
LTGQFLEEL

SEQ ID NO: 118660 - protein, 9 aa, Artificial Sequence
  Description of Artificial Sequence: Synthetic peptide
  Seed: TLFVIVPVL (MOG_HUMAN)
TAFVIVPVI

SEQ ID NO: 118661 - protein, 10 aa, Artificial Sequence
  Description of Artificial Sequence: Synthetic peptide
  Seed: SLSRPSLPSC (MOG_HUMAN)
SSSRPSLPSI

SEQ ID NO: 118662 - protein, 9 aa, Artificial Sequence
  Description of Artificial Sequence: Synthetic peptide
  Seed: VLGPLVALI (MOG_HUMAN)
VSGPLVALY

SEQ ID NO: 118663 - protein, 9 aa, Artificial Sequence
  Description of Artificial Sequence: Synthetic peptide
  Seed: KVEDPFYWV (MOG_HUMAN)
KLEDPFYWI

SEQ ID NO: 118664 - protein, 10 aa, Artificial Sequence
  Description of Artificial Sequence: Synthetic peptide
  Seed: LSRPSLPSCL (MOG_HUMAN)
LQRPSLPSCK

SEQ ID NO: 118665 - protein, 9 aa, Artificial Sequence
  Description of Artificial Sequence: Synthetic peptide
  Seed: HFLRVPCWK (MOG_HUMAN)
HILRVPCWR

SEQ ID NO: 118666 - protein, 9 aa, Artificial Sequence
  Description of Artificial Sequence: Synthetic peptide
  Seed: ITVGLIFLC (MOG_HUMAN)
ISVGLIFLI

SEQ ID NO: 118667 - protein, 9 aa, Artificial Sequence
  Description of Artificial Sequence: Synthetic peptide
  Seed: AIGEGKVTL (MOG_HUMAN)
AAGEGKVTF

SEQ ID NO: 118668 - protein, 10 aa, Artificial Sequence
  Description of Artificial Sequence: Synthetic peptide
  Seed: SSYAGQFRVI (MOG_HUMAN)
SLYAGQFRVF

SEQ ID NO: 118669 - protein, 11 aa, Artificial Sequence
  Description of Artificial Sequence: Synthetic peptide
  Seed: LHRTFDPHFLR (MOG_HUMAN)
LGRTFDPHFLK

SEQ ID NO: 118670 - protein, 10 aa, Artificial Sequence
  Description of Artificial Sequence: Synthetic peptide
  Seed: VPVLGPLVAL (MOG_HUMAN)
VPVLGPLVAT

SEQ ID NO: 118671 - protein, 10 aa, Artificial Sequence
  Description of Artificial Sequence: Synthetic peptide
  Seed: CLCSFLLLLL (MOG_HUMAN)
CMCSFLLLLA

SEQ ID NO: 118672 - protein, 11 aa, Artificial Sequence
  Description of Artificial Sequence: Synthetic peptide
  Seed: HSYQEEAAMEL (MOG_HUMAN)
HTYQEEAAMEF

SEQ ID NO: 118673 - protein, 9 aa, Artificial Sequence
  Description of Artificial Sequence: Synthetic peptide
  Seed: WVSPGVLVL (MOG_HUMAN)
WHSPGVLVV

SEQ ID NO: 118674 - protein, 9 aa, Artificial Sequence
  Description of Artificial Sequence: Synthetic peptide
  Seed: LLLQITVGL (MOG_HUMAN)
LQLQITVGF

SEQ ID NO: 118675 - protein, 9 aa, Artificial Sequence
  Description of Artificial Sequence: Synthetic peptide
  Seed: TFDPHFLRV (MOG_HUMAN)
TTDPHFLRL

SEQ ID NO: 118676 - protein, 10 aa, Artificial Sequence
  Description of Artificial Sequence: Synthetic peptide
  Seed: RTFDPHFLRV (MOG_HUMAN)
RTFDPHFLRE

SEQ ID NO: 118677 - protein, 9 aa, Artificial Sequence
  Description of Artificial Sequence: Synthetic peptide
  Seed: YRPPFSRVV (MOG_HUMAN)
YAPPFSRVA

SEQ ID NO: 118678 - protein, 10 aa, Artificial Sequence
  Description of Artificial Sequence: Synthetic peptide
  Seed: ATGMEVGWYR (MOG_HUMAN)
AIGMEVGWYR

SEQ ID NO: 118679 - protein, 11 aa, Artificial Sequence
  Description of Artificial Sequence: Synthetic peptide
  Seed: HRTFDPHFLRV (MOG_HUMAN)
HATFDPHFLRR

SEQ ID NO: 118680 - protein, 9 aa, Artificial Sequence
  Description of Artificial Sequence: Synthetic peptide
  Seed: HSYQEEAAM (MOG_HUMAN)
HYYQEEAAY

SEQ ID NO: 118681 - protein, 11 aa, Artificial Sequence
  Description of Artificial Sequence: Synthetic peptide
  Seed: RPPFSRVVHLY (MOG_HUMAN)
RTPFSRVVHLY

SEQ ID NO: 118682 - protein, 10 aa, Artificial Sequence
  Description of Artificial Sequence: Synthetic peptide
  Seed: KITLFVIVPV (MOG_HUMAN)
KLTLFVIVPV

SEQ ID NO: 118683 - protein, 9 aa, Artificial Sequence
  Description of Artificial Sequence: Synthetic peptide
  Seed: RIRNVRFSD (MOG_HUMAN)
RHRNVRFSK

SEQ ID NO: 118684 - protein, 9 aa, Artificial Sequence
  Description of Artificial Sequence: Synthetic peptide
  Seed: FLEELRNPF (MOG_HUMAN)
FYEELRNPL

SEQ ID NO: 118685 - protein, 10 aa, Artificial Sequence
  Description of Artificial Sequence: Synthetic peptide
  Seed: RTFDPHFLRV (MOG_HUMAN)
RVFDPHFLRP

SEQ ID NO: 118686 - protein, 9 aa, Artificial Sequence
  Description of Artificial Sequence: Synthetic peptide
  Seed: LLLQVSSSY (MOG_HUMAN)
LELQVSSSM

SEQ ID NO: 118687 - protein, 9 aa, Artificial Sequence
  Description of Artificial Sequence: Synthetic peptide
  Seed: SSSYAGQFR (MOG_HUMAN)
STSYAGQFK

SEQ ID NO: 118688 - protein, 10 aa, Artificial Sequence
  Description of Artificial Sequence: Synthetic peptide
  Seed: VPVLGPLVAL (MOG_HUMAN)
VVVLGPLVAY

SEQ ID NO: 118689 - protein, 9 aa, Artificial Sequence
  Description of Artificial Sequence: Synthetic peptide
  Seed: YRLRGKLRA (MOG_HUMAN)
YRLRGKLRR

SEQ ID NO: 118690 - protein, 9 aa, Artificial Sequence
  Description of Artificial Sequence: Synthetic peptide
  Seed: FSDEGGFTC (MOG_HUMAN)
FNDEGGFTY

SEQ ID NO: 118691 - protein, 9 aa, Artificial Sequence
  Description of Artificial Sequence: Synthetic peptide
  Seed: RTFDPHFLR (MOG_HUMAN)
RTFDPHFLH

SEQ ID NO: 118692 - protein, 8 aa, Artificial Sequence
  Description of Artificial Sequence: Synthetic peptide
  Seed: FSDEGGFT (MOG_HUMAN)
FIDEGGFM

SEQ ID NO: 118693 - protein, 9 aa, Artificial Sequence
  Description of Artificial Sequence: Synthetic peptide
  Seed: FLEELRNPF (MOG_HUMAN)
FVEELRNPL

SEQ ID NO: 118694 - protein, 10 aa, Artificial Sequence
  Description of Artificial Sequence: Synthetic peptide
  Seed: VLLLQITVGL (MOG_HUMAN)
VFLLQITVGL

SEQ ID NO: 118695 - protein, 9 aa, Artificial Sequence
  Description of Artificial Sequence: Synthetic peptide
  Seed: LVLLAVLPV (MOG_HUMAN)
LMLLAVLPT

SEQ ID NO: 118696 - protein, 8 aa, Artificial Sequence
  Description of Artificial Sequence: Synthetic peptide
  Seed: FSRVVHLY (MOG_HUMAN)
FPRVVHLY

SEQ ID NO: 118697 - protein, 11 aa, Artificial Sequence
  Description of Artificial Sequence: Synthetic peptide
  Seed: VIGPRHPIRAL (MOG_HUMAN)
VCGPRHPIRAM

SEQ ID NO: 118698 - protein, 9 aa, Artificial Sequence
  Description of Artificial Sequence: Synthetic peptide
  Seed: FSDEGGFTC (MOG_HUMAN)
FFDEGGFTW

SEQ ID NO: 118699 - protein, 9 aa, Artificial Sequence
  Description of Artificial Sequence: Synthetic peptide
  Seed: YRPPFSRVV (MOG_HUMAN)
YVPPFSRVI

SEQ ID NO: 118700 - protein, 10 aa, Artificial Sequence
  Description of Artificial Sequence: Synthetic peptide
  Seed: ATGMEVGWYR (MOG_HUMAN)
AFGMEVGWYK

SEQ ID NO: 118701 - protein, 9 aa, Artificial Sequence
  Description of Artificial Sequence: Synthetic peptide
  Seed: ITLFVIVPV (MOG_HUMAN)
IMLFVIVPI

SEQ ID NO: 118702 - protein, 9 aa, Artificial Sequence
  Description of Artificial Sequence: Synthetic peptide
  Seed: CLCSFLLLL (MOG_HUMAN)
CMCSFLLLA

SEQ ID NO: 118703 - protein, 10 aa, Artificial Sequence
  Description of Artificial Sequence: Synthetic peptide
  Seed: SCLCSFLLLL (MOG_HUMAN)
SMLCSFLLLM

SEQ ID NO: 118704 - protein, 9 aa, Artificial Sequence
  Description of Artificial Sequence: Synthetic peptide
  Seed: RAEIENLHR (MOG_HUMAN)
RAEIENLHY

SEQ ID NO: 118705 - protein, 9 aa, Artificial Sequence
  Description of Artificial Sequence: Synthetic peptide
  Seed: LSRPSLPSC (MOG_HUMAN)
LARPSLPSM

SEQ ID NO: 118706 - protein, 10 aa, Artificial Sequence
  Description of Artificial Sequence: Synthetic peptide
  Seed: ATGMEVGWYR (MOG_HUMAN)
ADGMEVGWYK

SEQ ID NO: 118707 - protein, 9 aa, Artificial Sequence
  Description of Artificial Sequence: Synthetic peptide
  Seed: FSDEGGFTC (MOG_HUMAN)
FRDEGGFTV

SEQ ID NO: 118708 - protein, 9 aa, Artificial Sequence
  Description of Artificial Sequence: Synthetic peptide
  Seed: AEIENLHRT (MOG_HUMAN)
AEIENLHRM

SEQ ID NO: 118709 - protein, 10 aa, Artificial Sequence
  Description of Artificial Sequence: Synthetic peptide
  Seed: LLQITVGLIF (MOG_HUMAN)
LDQITVGLIY

SEQ ID NO: 118710 - protein, 11 aa, Artificial Sequence
  Description of Artificial Sequence: Synthetic peptide
  Seed: PPFSRVVHLYR (MOG_HUMAN)
PFFSRVVHLYR

SEQ ID NO: 118711 - protein, 10 aa, Artificial Sequence
  Description of Artificial Sequence: Synthetic peptide
  Seed: PVLGPLVALI (MOG_HUMAN)
PWLGPLVALV

SEQ ID NO: 118712 - protein, 9 aa, Artificial Sequence
  Description of Artificial Sequence: Synthetic peptide
  Seed: IVPVLGPLV (MOG_HUMAN)
IMPVLGPLL

SEQ ID NO: 118713 - protein, 8 aa, Artificial Sequence
  Description of Artificial Sequence: Synthetic peptide
  Seed: TFDPHFLR (MOG_HUMAN)
TVDPHFLY

SEQ ID NO: 118714 - protein, 9 aa, Artificial Sequence
  Description of Artificial Sequence: Synthetic peptide
  Seed: AIGEGKVTL (MOG_HUMAN)
AMGEGKVTM

SEQ ID NO: 118715 - protein, 9 aa, Artificial Sequence
  Description of Artificial Sequence: Synthetic peptide
  Seed: LAGQFLEEL (MOG_HUMAN)
LQGQFLEEF

SEQ ID NO: 118716 - protein, 10 aa, Artificial Sequence
  Description of Artificial Sequence: Synthetic peptide
  Seed: RLAGQFLEEL (MOG_HUMAN)
RQAGQFLEEI

SEQ ID NO: 118717 - protein, 10 aa, Artificial Sequence
  Description of Artificial Sequence: Synthetic peptide
  Seed: LLLLQVSSSY (MOG_HUMAN)
LCLLQVSSSF

SEQ ID NO: 118718 - protein, 9 aa, Artificial Sequence
  Description of Artificial Sequence: Synthetic peptide
  Seed: TLFVIVPVL (MOG_HUMAN)
TQFVIVPVY

SEQ ID NO: 118719 - protein, 9 aa, Artificial Sequence
  Description of Artificial Sequence: Synthetic peptide
  Seed: LLLQVSSSY (MOG_HUMAN)
LRLQVSSSY

SEQ ID NO: 118720 - protein, 9 aa, Artificial Sequence
  Description of Artificial Sequence: Synthetic peptide
  Seed: LQYRLRGKL (MOG_HUMAN)
LKYRLRGKF

SEQ ID NO: 118721 - protein, 9 aa, Artificial Sequence
  Description of Artificial Sequence: Synthetic peptide
  Seed: FLLLLLLQV (MOG_HUMAN)
FMLLLLLQR

SEQ ID NO: 118722 - protein, 10 aa, Artificial Sequence
  Description of Artificial Sequence: Synthetic peptide
  Seed: MEVGWYRPPF (MOG_HUMAN)
MSVGWYRPPF

SEQ ID NO: 118723 - protein, 10 aa, Artificial Sequence
  Description of Artificial Sequence: Synthetic peptide
  Seed: FLLLLLLQVS (MOG_HUMAN)
FLLLLLLQVL

SEQ ID NO: 118724 - protein, 10 aa, Artificial Sequence
  Description of Artificial Sequence: Synthetic peptide
  Seed: LVLLAVLPVL (MOG_HUMAN)
LLLLAVLPVL

SEQ ID NO: 118725 - protein, 9 aa, Artificial Sequence
  Description of Artificial Sequence: Synthetic peptide
  Seed: YRLRGKLRA (MOG_HUMAN)
YRLRGKLRL

SEQ ID NO: 118726 - protein, 9 aa, Artificial Sequence
  Description of Artificial Sequence: Synthetic peptide
  Seed: RVIGPRHPI (MOG_HUMAN)
RLIGPRHPF

SEQ ID NO: 118727 - protein, 9 aa, Artificial Sequence
  Description of Artificial Sequence: Synthetic peptide
  Seed: LIICYNWLH (MOG_HUMAN)
LTICYNWLR

SEQ ID NO: 118728 - protein, 9 aa, Artificial Sequence
  Description of Artificial Sequence: Synthetic peptide
  Seed: WVSPGVLVL (MOG_HUMAN)
WWSPGVLVM

SEQ ID NO: 118729 - protein, 10 aa, Artificial Sequence
  Description of Artificial Sequence: Synthetic peptide
  Seed: SLSRPSLPSC (MOG_HUMAN)
SVSRPSLPSM

SEQ ID NO: 118730 - protein, 9 aa, Artificial Sequence
  Description of Artificial Sequence: Synthetic peptide
  Seed: VSPGVLVLL (MOG_HUMAN)
VLPGVLVLF

SEQ ID NO: 118731 - protein, 9 aa, Artificial Sequence
  Description of Artificial Sequence: Synthetic peptide
  Seed: VSPGVLVLL (MOG_HUMAN)
VTPGVLVLI

SEQ ID NO: 118732 - protein, 9 aa, Artificial Sequence
  Description of Artificial Sequence: Synthetic peptide
  Seed: TLRIRNVRF (MOG_HUMAN)
TQRIRNVRY

SEQ ID NO: 118733 - protein, 9 aa, Artificial Sequence
  Description of Artificial Sequence: Synthetic peptide
  Seed: GLIFLCLQY (MOG_HUMAN)
GMIFLCLQK

SEQ ID NO: 118734 - protein, 9 aa, Artificial Sequence
  Description of Artificial Sequence: Synthetic peptide
  Seed: FYWVSPGVL (MOG_HUMAN)
FYWVSPGVY

SEQ ID NO: 118735 - protein, 9 aa, Artificial Sequence
  Description of Artificial Sequence: Synthetic peptide
  Seed: RIRNVRFSD (MOG_HUMAN)
RIRNVRFSN

SEQ ID NO: 118736 - protein, 10 aa, Artificial Sequence
  Description of Artificial Sequence: Synthetic peptide
  Seed: IGPRHPIRAL (MOG_HUMAN)
IFPRHPIRAI

SEQ ID NO: 118737 - protein, 10 aa, Artificial Sequence
  Description of Artificial Sequence: Synthetic peptide
  Seed: LSRPSLPSCL (MOG_HUMAN)
LTRPSLPSCY

SEQ ID NO: 118738 - protein, 11 aa, Artificial Sequence
  Description of Artificial Sequence: Synthetic peptide
  Seed: VRFSDEGGFTC (MOG_HUMAN)
VRFSDEGGFTL

SEQ ID NO: 118739 - protein, 10 aa, Artificial Sequence
  Description of Artificial Sequence: Synthetic peptide
  Seed: FTCFFRDHSY (MOG_HUMAN)
FFCFFRDHSY

SEQ ID NO: 118740 - protein, 8 aa, Artificial Sequence
  Description of Artificial Sequence: Synthetic peptide
  Seed: VIGPRHPI (MOG_HUMAN)
VTGPRHPF

SEQ ID NO: 118741 - protein, 10 aa, Artificial Sequence
  Description of Artificial Sequence: Synthetic peptide
  Seed: LVLLAVLPVL (MOG_HUMAN)
LHLLAVLPVL

SEQ ID NO: 118742 - protein, 10 aa, Artificial Sequence
  Description of Artificial Sequence: Synthetic peptide
  Seed: LIFLCLQYRL (MOG_HUMAN)
LQFLCLQYRR

SEQ ID NO: 118743 - protein, 10 aa, Artificial Sequence
  Description of Artificial Sequence: Synthetic peptide
  Seed: VLLLQITVGL (MOG_HUMAN)
VNLLQITVGL

SEQ ID NO: 118744 - protein, 9 aa, Artificial Sequence
  Description of Artificial Sequence: Synthetic peptide
  Seed: RIRNVRFSD (MOG_HUMAN)
RQRNVRFSS

SEQ ID NO: 118745 - protein, 11 aa, Artificial Sequence
  Description of Artificial Sequence: Synthetic peptide
  Seed: VIGPRHPIRAL (MOG_HUMAN)
VEGPRHPIRAM

SEQ ID NO: 118746 - protein, 10 aa, Artificial Sequence
  Description of Artificial Sequence: Synthetic peptide
  Seed: SLSRPSLPSC (MOG_HUMAN)
SYSRPSLPSK

SEQ ID NO: 118747 - protein, 9 aa, Artificial Sequence
  Description of Artificial Sequence: Synthetic peptide
  Seed: VPVLGPLVA (MOG_HUMAN)
VAVLGPLVF

SEQ ID NO: 118748 - protein, 9 aa, Artificial Sequence
  Description of Artificial Sequence: Synthetic peptide
  Seed: ITVGLIFLC (MOG_HUMAN)
IAVGLIFLA

SEQ ID NO: 118749 - protein, 8 aa, Artificial Sequence
  Description of Artificial Sequence: Synthetic peptide
  Seed: RPPFSRVV (MOG_HUMAN)
RPPFSRVM

SEQ ID NO: 118750 - protein, 10 aa, Artificial Sequence
  Description of Artificial Sequence: Synthetic peptide
  Seed: AEIENLHRTF (MOG_HUMAN)
ATIENLHRTF

SEQ ID NO: 118751 - protein, 10 aa, Artificial Sequence
  Description of Artificial Sequence: Synthetic peptide
  Seed: DAIGEGKVTL (MOG_HUMAN)
DVIGEGKVTK

SEQ ID NO: 118752 - protein, 9 aa, Artificial Sequence
  Description of Artificial Sequence: Synthetic peptide
  Seed: VGDEVELPC (MOG_HUMAN)
VQDEVELPF

SEQ ID NO: 118753 - protein, 9 aa, Artificial Sequence
  Description of Artificial Sequence: Synthetic peptide
  Seed: VVHLYRNGK (MOG_HUMAN)
VYHLYRNGR

SEQ ID NO: 118754 - protein, 9 aa, Artificial Sequence
  Description of Artificial Sequence: Synthetic peptide
  Seed: RVPCWKITL (MOG_HUMAN)
RVPCWKITW

SEQ ID NO: 118755 - protein, 9 aa, Artificial Sequence
  Description of Artificial Sequence: Synthetic peptide
  Seed: VSPGVLVLL (MOG_HUMAN)
VVPGVLVLV

SEQ ID NO: 118756 - protein, 10 aa, Artificial Sequence
  Description of Artificial Sequence: Synthetic peptide
  Seed: LLQITVGLIF (MOG_HUMAN)
LQQITVGLIY

SEQ ID NO: 118757 - protein, 9 aa, Artificial Sequence
  Description of Artificial Sequence: Synthetic peptide
  Seed: VLGPLVALI (MOG_HUMAN)
VLGPLVALA

SEQ ID NO: 118758 - protein, 9 aa, Artificial Sequence
  Description of Artificial Sequence: Synthetic peptide
  Seed: YRLRGKLRA (MOG_HUMAN)
YRLRGKLRI

SEQ ID NO: 118759 - protein, 10 aa, Artificial Sequence
  Description of Artificial Sequence: Synthetic peptide
  Seed: LVLLAVLPVL (MOG_HUMAN)
LMLLAVLPVV

SEQ ID NO: 118760 - protein, 10 aa, Artificial Sequence
  Description of Artificial Sequence: Synthetic peptide
  Seed: LVLLAVLPVL (MOG_HUMAN)
LKLLAVLPVI

SEQ ID NO: 118761 - protein, 9 aa, Artificial Sequence
  Description of Artificial Sequence: Synthetic peptide
  Seed: CLCSFLLLL (MOG_HUMAN)
CICSFLLLV

SEQ ID NO: 118762 - protein, 10 aa, Artificial Sequence
  Description of Artificial Sequence: Synthetic peptide
  Seed: HRTFDPHFLR (MOG_HUMAN)
HFTFDPHFLK

SEQ ID NO: 118763 - protein, 10 aa, Artificial Sequence
  Description of Artificial Sequence: Synthetic peptide
  Seed: FDPHFLRVPC (MOG_HUMAN)
FMPHFLRVPS

SEQ ID NO: 118764 - protein, 9 aa, Artificial Sequence
  Description of Artificial Sequence: Synthetic peptide
  Seed: RIRNVRFSD (MOG_HUMAN)
RYRNVRFSY

SEQ ID NO: 118765 - protein, 9 aa, Artificial Sequence
  Description of Artificial Sequence: Synthetic peptide
  Seed: EGGFTCFFR (MOG_HUMAN)
EFGFTCFFR

SEQ ID NO: 118766 - protein, 9 aa, Artificial Sequence
  Description of Artificial Sequence: Synthetic peptide
  Seed: HRRLAGQFL (MOG_HUMAN)
HHRLAGQFY

SEQ ID NO: 118767 - protein, 9 aa, Artificial Sequence
  Description of Artificial Sequence: Synthetic peptide
  Seed: RIRNVRFSD (MOG_HUMAN)
RTRNVRFSP

SEQ ID NO: 118768 - protein, 9 aa, Artificial Sequence
  Description of Artificial Sequence: Synthetic peptide
  Seed: GQFRVIGPR (MOG_HUMAN)
GRFRVIGPR

SEQ ID NO: 118769 - protein, 9 aa, Artificial Sequence
  Description of Artificial Sequence: Synthetic peptide
  Seed: SSYAGQFRV (MOG_HUMAN)
SMYAGQFRM

SEQ ID NO: 118770 - protein, 10 aa, Artificial Sequence
  Description of Artificial Sequence: Synthetic peptide
  Seed: RVVHLYRNGK (MOG_HUMAN)
RTVHLYRNGK

SEQ ID NO: 118771 - protein, 8 aa, Artificial Sequence
  Description of Artificial Sequence: Synthetic peptide
  Seed: RIRNVRFS (MOG_HUMAN)
RTRNVRFY

SEQ ID NO: 118772 - protein, 10 aa, Artificial Sequence
  Description of Artificial Sequence: Synthetic peptide
  Seed: FYWVSPGVLV (MOG_HUMAN)
FYWVSPGVLW

SEQ ID NO: 118773 - protein, 9 aa, Artificial Sequence
  Description of Artificial Sequence: Synthetic peptide
  Seed: YQEEAAMEL (MOG_HUMAN)
YREEAAMEI

SEQ ID NO: 118774 - protein, 9 aa, Artificial Sequence
  Description of Artificial Sequence: Synthetic peptide
  Seed: SDEGGFTCF (MOG_HUMAN)
SEEGGFTCW

SEQ ID NO: 118775 - protein, 8 aa, Artificial Sequence
  Description of Artificial Sequence: Synthetic peptide
  Seed: VLGPLVAL (MOG_HUMAN)
VVGPLVAL

SEQ ID NO: 118776 - protein, 9 aa, Artificial Sequence
  Description of Artificial Sequence: Synthetic peptide
  Seed: RIRNVRFSD (MOG_HUMAN)
RTRNVRFST

SEQ ID NO: 118777 - protein, 11 aa, Artificial Sequence
  Description of Artificial Sequence: Synthetic peptide
  Seed: HRTFDPHFLRV (MOG_HUMAN)
HMTFDPHFLRH

SEQ ID NO: 118778 - protein, 9 aa, Artificial Sequence
  Description of Artificial Sequence: Synthetic peptide
  Seed: VLLAVLPVL (MOG_HUMAN)
VMLAVLPVL

SEQ ID NO: 118779 - protein, 10 aa, Artificial Sequence
  Description of Artificial Sequence: Synthetic peptide
  Seed: ICYNWLHRRL (MOG_HUMAN)
IYYNWLHRRL

SEQ ID NO: 118780 - protein, 9 aa, Artificial Sequence
  Description of Artificial Sequence: Synthetic peptide
  Seed: RVPCWKITL (MOG_HUMAN)
RTPCWKITK

SEQ ID NO: 118781 - protein, 10 aa, Artificial Sequence
  Description of Artificial Sequence: Synthetic peptide
  Seed: VGWYRPPFSR (MOG_HUMAN)
VAWYRPPFSR

SEQ ID NO: 118782 - protein, 11 aa, Artificial Sequence
  Description of Artificial Sequence: Synthetic peptide
  Seed: FSDEGGFTCFF (MOG_HUMAN)
FTDEGGFTCFM

SEQ ID NO: 118783 - protein, 9 aa, Artificial Sequence
  Description of Artificial Sequence: Synthetic peptide
  Seed: KLRAEIENL (MOG_HUMAN)
KFRAEIENK

SEQ ID NO: 118784 - protein, 10 aa, Artificial Sequence
  Description of Artificial Sequence: Synthetic peptide
  Seed: KVTLRIRNVR (MOG_HUMAN)
KSTLRIRNVR

SEQ ID NO: 118785 - protein, 9 aa, Artificial Sequence
  Description of Artificial Sequence: Synthetic peptide
  Seed: IVPVLGPLV (MOG_HUMAN)
ITPVLGPLM

SEQ ID NO: 118786 - protein, 9 aa, Artificial Sequence
  Description of Artificial Sequence: Synthetic peptide
  Seed: KDAIGEGKV (MOG_HUMAN)
KEAIGEGKL

SEQ ID NO: 118787 - protein, 10 aa, Artificial Sequence
  Description of Artificial Sequence: Synthetic peptide
  Seed: GLIFLCLQYR (MOG_HUMAN)
GVIFLCLQYR

SEQ ID NO: 118788 - protein, 9 aa, Artificial Sequence
  Description of Artificial Sequence: Synthetic peptide
  Seed: IRALVGDEV (MOG_HUMAN)
IHALVGDEL

SEQ ID NO: 118789 - protein, 9 aa, Artificial Sequence
  Description of Artificial Sequence: Synthetic peptide
  Seed: SSSYAGQFR (MOG_HUMAN)
SFSYAGQFR

SEQ ID NO: 118790 - protein, 10 aa, Artificial Sequence
  Description of Artificial Sequence: Synthetic peptide
  Seed: FRVIGPRHPI (MOG_HUMAN)
FAVIGPRHPV

SEQ ID NO: 118791 - protein, 9 aa, Artificial Sequence
  Description of Artificial Sequence: Synthetic peptide
  Seed: YQEEAAMEL (MOG_HUMAN)
YTEEAAMEY

SEQ ID NO: 118792 - protein, 9 aa, Artificial Sequence
  Description of Artificial Sequence: Synthetic peptide
  Seed: TFDPHFLRV (MOG_HUMAN)
TSDPHFLRA

SEQ ID NO: 118793 - protein, 11 aa, Artificial Sequence
  Description of Artificial Sequence: Synthetic peptide
  Seed: RDHSYQEEAAM (MOG_HUMAN)
REHSYQEEAAL

SEQ ID NO: 118794 - protein, 9 aa, Artificial Sequence
  Description of Artificial Sequence: Synthetic peptide
  Seed: FLEELRNPF (MOG_HUMAN)
FKEELRNPY

SEQ ID NO: 118795 - protein, 9 aa, Artificial Sequence
  Description of Artificial Sequence: Synthetic peptide
  Seed: FSRVVHLYR (MOG_HUMAN)
FIRVVHLYK

SEQ ID NO: 118796 - protein, 10 aa, Artificial Sequence
  Description of Artificial Sequence: Synthetic peptide
  Seed: IGPRHPIRAL (MOG_HUMAN)
IMPRHPIRAF

SEQ ID NO: 118797 - protein, 9 aa, Artificial Sequence
  Description of Artificial Sequence: Synthetic peptide
  Seed: FSRVVHLYR (MOG_HUMAN)
FYRVVHLYR

SEQ ID NO: 118798 - protein, 9 aa, Artificial Sequence
  Description of Artificial Sequence: Synthetic peptide
  Seed: RTFDPHFLR (MOG_HUMAN)
RVFDPHFLA

SEQ ID NO: 118799 - protein, 9 aa, Artificial Sequence
  Description of Artificial Sequence: Synthetic peptide
  Seed: RVPCWKITL (MOG_HUMAN)
RQPCWKITI

SEQ ID NO: 118800 - protein, 10 aa, Artificial Sequence
  Description of Artificial Sequence: Synthetic peptide
  Seed: SCLCSFLLLL (MOG_HUMAN)
SELCSFLLLL

SEQ ID NO: 118801 - protein, 9 aa, Artificial Sequence
  Description of Artificial Sequence: Synthetic peptide
  Seed: YQEEAAMEL (MOG_HUMAN)
YAEEAAMEM

SEQ ID NO: 118802 - protein, 9 aa, Artificial Sequence
  Description of Artificial Sequence: Synthetic peptide
  Seed: TFDPHFLRV (MOG_HUMAN)
TMDPHFLRI

SEQ ID NO: 118803 - protein, 9 aa, Artificial Sequence
  Description of Artificial Sequence: Synthetic peptide
  Seed: RVIGPRHPI (MOG_HUMAN)
RMIGPRHPM

SEQ ID NO: 118804 - protein, 9 aa, Artificial Sequence
  Description of Artificial Sequence: Synthetic peptide
  Seed: RTFDPHFLR (MOG_HUMAN)
RHFDPHFLR

SEQ ID NO: 118805 - protein, 9 aa, Artificial Sequence
  Description of Artificial Sequence: Synthetic peptide
  Seed: SLPSCLCSF (MOG_HUMAN)
SAPSCLCSL

SEQ ID NO: 118806 - protein, 9 aa, Artificial Sequence
  Description of Artificial Sequence: Synthetic peptide
  Seed: VLGPLVALI (MOG_HUMAN)
VTGPLVALI

SEQ ID NO: 118807 - protein, 9 aa, Artificial Sequence
  Description of Artificial Sequence: Synthetic peptide
  Seed: AIGEGKVTL (MOG_HUMAN)
AEGEGKVTM

SEQ ID NO: 118808 - protein, 10 aa, Artificial Sequence
  Description of Artificial Sequence: Synthetic peptide
  Seed: VLLAVLPVLL (MOG_HUMAN)
VFLAVLPVLA

SEQ ID NO: 118809 - protein, 9 aa, Artificial Sequence
  Description of Artificial Sequence: Synthetic peptide
  Seed: FSDEGGFTC (MOG_HUMAN)
FPDEGGFTM

SEQ ID NO: 118810 - protein, 9 aa, Artificial Sequence
  Description of Artificial Sequence: Synthetic peptide
  Seed: VLLAVLPVL (MOG_HUMAN)
VMLAVLPVF

SEQ ID NO: 118811 - protein, 8 aa, Artificial Sequence
  Description of Artificial Sequence: Synthetic peptide
  Seed: HPIRALVG (MOG_HUMAN)
HPIRALVA

SEQ ID NO: 118812 - protein, 9 aa, Artificial Sequence
  Description of Artificial Sequence: Synthetic peptide
  Seed: YQEEAAMEL (MOG_HUMAN)
YQEEAAMEV

SEQ ID NO: 118813 - protein, 9 aa, Artificial Sequence
  Description of Artificial Sequence: Synthetic peptide
  Seed: WVSPGVLVL (MOG_HUMAN)
WQSPGVLVF

SEQ ID NO: 118814 - protein, 9 aa, Artificial Sequence
  Description of Artificial Sequence: Synthetic peptide
  Seed: LQVSSSYAG (MOG_HUMAN)
LHVSSSYAM

SEQ ID NO: 118815 - protein, 10 aa, Artificial Sequence
  Description of Artificial Sequence: Synthetic peptide
  Seed: MEVGWYRPPF (MOG_HUMAN)
MQVGWYRPPF

SEQ ID NO: 118816 - protein, 10 aa, Artificial Sequence
  Description of Artificial Sequence: Synthetic peptide
  Seed: VLLLQITVGL (MOG_HUMAN)
VLLLQITVGV

SEQ ID NO: 118817 - protein, 10 aa, Artificial Sequence
  Description of Artificial Sequence: Synthetic peptide
  Seed: HRTFDPHFLR (MOG_HUMAN)
HQTFDPHFLK

SEQ ID NO: 118818 - protein, 10 aa, Artificial Sequence
  Description of Artificial Sequence: Synthetic peptide
  Seed: RTFDPHFLRV (MOG_HUMAN)
RQFDPHFLRK

SEQ ID NO: 118819 - protein, 10 aa, Artificial Sequence
  Description of Artificial Sequence: Synthetic peptide
  Seed: IGPRHPIRAL (MOG_HUMAN)
IIPRHPIRAL

SEQ ID NO: 118820 - protein, 9 aa, Artificial Sequence
  Description of Artificial Sequence: Synthetic peptide
  Seed: WVSPGVLVL (MOG_HUMAN)
WRSPGVLVF

SEQ ID NO: 118821 - protein, 9 aa, Artificial Sequence
  Description of Artificial Sequence: Synthetic peptide
  Seed: YRPPFSRVV (MOG_HUMAN)
YIPPFSRVF

SEQ ID NO: 118822 - protein, 10 aa, Artificial Sequence
  Description of Artificial Sequence: Synthetic peptide
  Seed: FSDEGGFTCF (MOG_HUMAN)
FPDEGGFTCL

SEQ ID NO: 118823 - protein, 9 aa, Artificial Sequence
  Description of Artificial Sequence: Synthetic peptide
  Seed: SSYAGQFRV (MOG_HUMAN)
SGYAGQFRY

SEQ ID NO: 118824 - protein, 11 aa, Artificial Sequence
  Description of Artificial Sequence: Synthetic peptide
  Seed: VRFSDEGGFTC (MOG_HUMAN)
VRFSDEGGFTW

SEQ ID NO: 118825 - protein, 10 aa, Artificial Sequence
  Description of Artificial Sequence: Synthetic peptide
  Seed: IICYNWLHRR (MOG_HUMAN)
IMCYNWLHRR

SEQ ID NO: 118826 - protein, 10 aa, Artificial Sequence
  Description of Artificial Sequence: Synthetic peptide
  Seed: LLLQVSSSYA (MOG_HUMAN)
LMLQVSSSYA

SEQ ID NO: 118827 - protein, 9 aa, Artificial Sequence
  Description of Artificial Sequence: Synthetic peptide
  Seed: WVSPGVLVL (MOG_HUMAN)
WASPGVLVW

SEQ ID NO: 118828 - protein, 10 aa, Artificial Sequence
  Description of Artificial Sequence: Synthetic peptide
  Seed: FYWVSPGVLV (MOG_HUMAN)
FYWVSPGVLM

SEQ ID NO: 118829 - protein, 9 aa, Artificial Sequence
  Description of Artificial Sequence: Synthetic peptide
  Seed: SRPSLPSCL (MOG_HUMAN)
SQPSLPSCL

SEQ ID NO: 118830 - protein, 10 aa, Artificial Sequence
  Description of Artificial Sequence: Synthetic peptide
  Seed: LLLLQVSSSY (MOG_HUMAN)
LMLLQVSSSF

SEQ ID NO: 118831 - protein, 10 aa, Artificial Sequence
  Description of Artificial Sequence: Synthetic peptide
  Seed: VPVLGPLVAL (MOG_HUMAN)
VQVLGPLVAV

SEQ ID NO: 118832 - protein, 9 aa, Artificial Sequence
  Description of Artificial Sequence: Synthetic peptide
  Seed: VPVLGPLVA (MOG_HUMAN)
VAVLGPLVM

SEQ ID NO: 118833 - protein, 9 aa, Artificial Sequence
  Description of Artificial Sequence: Synthetic peptide
  Seed: RIRNVRFSD (MOG_HUMAN)
RLRNVRFSV

SEQ ID NO: 118834 - protein, 9 aa, Artificial Sequence
  Description of Artificial Sequence: Synthetic peptide
  Seed: SYAGQFRVI (MOG_HUMAN)
SAAGQFRVL

SEQ ID NO: 118835 - protein, 11 aa, Artificial Sequence
  Description of Artificial Sequence: Synthetic peptide
  Seed: RFSDEGGFTCF (MOG_HUMAN)
RESDEGGFTCL

SEQ ID NO: 118836 - protein, 11 aa, Artificial Sequence
  Description of Artificial Sequence: Synthetic peptide
  Seed: RTFDPHFLRVP (MOG_HUMAN)
RFFDPHFLRVR

SEQ ID NO: 118837 - protein, 10 aa, Artificial Sequence
  Description of Artificial Sequence: Synthetic peptide
  Seed: YWVSPGVLVL (MOG_HUMAN)
YGVSPGVLVF

SEQ ID NO: 118838 - protein, 9 aa, Artificial Sequence
  Description of Artificial Sequence: Synthetic peptide
  Seed: YRPPFSRVV (MOG_HUMAN)
YGPPFSRVF

SEQ ID NO: 118839 - protein, 10 aa, Artificial Sequence
  Description of Artificial Sequence: Synthetic peptide
  Seed: LLQITVGLIF (MOG_HUMAN)
LRQITVGLIF

SEQ ID NO: 118840 - protein, 11 aa, Artificial Sequence
  Description of Artificial Sequence: Synthetic peptide
  Seed: RTFDPHFLRVP (MOG_HUMAN)
RMFDPHFLRVW

SEQ ID NO: 118841 - protein, 11 aa, Artificial Sequence
  Description of Artificial Sequence: Synthetic peptide
  Seed: KDAIGEGKVTL (MOG_HUMAN)
KEAIGEGKVTV

SEQ ID NO: 118842 - protein, 9 aa, Artificial Sequence
  Description of Artificial Sequence: Synthetic peptide
  Seed: TGMEVGWYR (MOG_HUMAN)
THMEVGWYR

SEQ ID NO: 118843 - protein, 9 aa, Artificial Sequence
  Description of Artificial Sequence: Synthetic peptide
  Seed: VLLAVLPVL (MOG_HUMAN)
VTLAVLPVI

SEQ ID NO: 118844 - protein, 10 aa, Artificial Sequence
  Description of Artificial Sequence: Synthetic peptide
  Seed: VLLAVLPVLL (MOG_HUMAN)
VALAVLPVLV

SEQ ID NO: 118845 - protein, 9 aa, Artificial Sequence
  Description of Artificial Sequence: Synthetic peptide
  Seed: YQEEAAMEL (MOG_HUMAN)
YFEEAAMEL

SEQ ID NO: 118846 - protein, 9 aa, Artificial Sequence
  Description of Artificial Sequence: Synthetic peptide
  Seed: SLPSCLCSF (MOG_HUMAN)
SLPSCLCSI

SEQ ID NO: 118847 - protein, 11 aa, Artificial Sequence
  Description of Artificial Sequence: Synthetic peptide
  Seed: HRTFDPHFLRV (MOG_HUMAN)
HFTFDPHFLRK

SEQ ID NO: 118848 - protein, 9 aa, Artificial Sequence
  Description of Artificial Sequence: Synthetic peptide
  Seed: VLPVLLLQI (MOG_HUMAN)
VYPVLLLQF

SEQ ID NO: 118849 - protein, 9 aa, Artificial Sequence
  Description of Artificial Sequence: Synthetic peptide
  Seed: LAGQFLEEL (MOG_HUMAN)
LAGQFLEEF

SEQ ID NO: 118850 - protein, 10 aa, Artificial Sequence
  Description of Artificial Sequence: Synthetic peptide
  Seed: FDPHFLRVPC (MOG_HUMAN)
FCPHFLRVPL

SEQ ID NO: 118851 - protein, 9 aa, Artificial Sequence
  Description of Artificial Sequence: Synthetic peptide
  Seed: FYWVSPGVL (MOG_HUMAN)
FAWVSPGVF

SEQ ID NO: 118852 - protein, 11 aa, Artificial Sequence
  Description of Artificial Sequence: Synthetic peptide
  Seed: VIGPRHPIRAL (MOG_HUMAN)
VYGPRHPIRAL

SEQ ID NO: 118853 - protein, 9 aa, Artificial Sequence
  Description of Artificial Sequence: Synthetic peptide
  Seed: RIRNVRFSD (MOG_HUMAN)
RTRNVRFSM

SEQ ID NO: 118854 - protein, 10 aa, Artificial Sequence
  Description of Artificial Sequence: Synthetic peptide
  Seed: IGPRHPIRAL (MOG_HUMAN)
IWPRHPIRAF

SEQ ID NO: 118855 - protein, 9 aa, Artificial Sequence
  Description of Artificial Sequence: Synthetic peptide
  Seed: CLCSFLLLL (MOG_HUMAN)
CACSFLLLF

SEQ ID NO: 118856 - protein, 10 aa, Artificial Sequence
  Description of Artificial Sequence: Synthetic peptide
  Seed: ITLFVIVPVL (MOG_HUMAN)
ISLFVIVPVV

SEQ ID NO: 118857 - protein, 9 aa, Artificial Sequence
  Description of Artificial Sequence: Synthetic peptide
  Seed: LIFLCLQYR (MOG_HUMAN)
LVFLCLQYR

SEQ ID NO: 118858 - protein, 10 aa, Artificial Sequence
  Description of Artificial Sequence: Synthetic peptide
  Seed: FSDEGGFTCF (MOG_HUMAN)
FVDEGGFTCL

SEQ ID NO: 118859 - protein, 9 aa, Artificial Sequence
  Description of Artificial Sequence: Synthetic peptide
  Seed: GLIFLCLQY (MOG_HUMAN)
GLIFLCLQK

SEQ ID NO: 118860 - protein, 9 aa, Artificial Sequence
  Description of Artificial Sequence: Synthetic peptide
  Seed: VIVPVLGPL (MOG_HUMAN)
VAVPVLGPF

SEQ ID NO: 118861 - protein, 9 aa, Artificial Sequence
  Description of Artificial Sequence: Synthetic peptide
  Seed: FLEELRNPF (MOG_HUMAN)
FSEELRNPF

SEQ ID NO: 118862 - protein, 10 aa, Artificial Sequence
  Description of Artificial Sequence: Synthetic peptide
  Seed: VLLLQITVGL (MOG_HUMAN)
VQLLQITVGI

SEQ ID NO: 118863 - protein, 9 aa, Artificial Sequence
  Description of Artificial Sequence: Synthetic peptide
  Seed: SLPSCLCSF (MOG_HUMAN)
SVPSCLCSM

SEQ ID NO: 118864 - protein, 9 aa, Artificial Sequence
  Description of Artificial Sequence: Synthetic peptide
  Seed: KLRAEIENL (MOG_HUMAN)
KTRAEIENY

SEQ ID NO: 118865 - protein, 9 aa, Artificial Sequence
  Description of Artificial Sequence: Synthetic peptide
  Seed: WVSPGVLVL (MOG_HUMAN)
WQSPGVLVA

SEQ ID NO: 118866 - protein, 10 aa, Artificial Sequence
  Description of Artificial Sequence: Synthetic peptide
  Seed: SLSRPSLPSC (MOG_HUMAN)
SMSRPSLPSA

SEQ ID NO: 118867 - protein, 9 aa, Artificial Sequence
  Description of Artificial Sequence: Synthetic peptide
  Seed: LSRPSLPSC (MOG_HUMAN)
LTRPSLPSM

SEQ ID NO: 118868 - protein, 9 aa, Artificial Sequence
  Description of Artificial Sequence: Synthetic peptide
  Seed: YWVSPGVLV (MOG_HUMAN)
YRVSPGVLF

SEQ ID NO: 118869 - protein, 11 aa, Artificial Sequence
  Description of Artificial Sequence: Synthetic peptide
  Seed: RISPGKNATGM (MOG_HUMAN)
RASPGKNATGW

SEQ ID NO: 118870 - protein, 10 aa, Artificial Sequence
  Description of Artificial Sequence: Synthetic peptide
  Seed: SSYAGQFRVI (MOG_HUMAN)
SIYAGQFRVW

SEQ ID NO: 118871 - protein, 9 aa, Artificial Sequence
  Description of Artificial Sequence: Synthetic peptide
  Seed: HFLRVPCWK (MOG_HUMAN)
HLLRVPCWR

SEQ ID NO: 118872 - protein, 10 aa, Artificial Sequence
  Description of Artificial Sequence: Synthetic peptide
  Seed: MEVGWYRPPF (MOG_HUMAN)
MVVGWYRPPF

SEQ ID NO: 118873 - protein, 11 aa, Artificial Sequence
  Description of Artificial Sequence: Synthetic peptide
  Seed: FLRVPCWKITL (MOG_HUMAN)
FLRVPCWKITV

SEQ ID NO: 118874 - protein, 9 aa, Artificial Sequence
  Description of Artificial Sequence: Synthetic peptide
  Seed: RRLAGQFLE (MOG_HUMAN)
RKLAGQFLI

SEQ ID NO: 118875 - protein, 9 aa, Artificial Sequence
  Description of Artificial Sequence: Synthetic peptide
  Seed: FSDEGGFTC (MOG_HUMAN)
FYDEGGFTA

SEQ ID NO: 118876 - protein, 10 aa, Artificial Sequence
  Description of Artificial Sequence: Synthetic peptide
  Seed: ISPGKNATGM (MOG_HUMAN)
IVPGKNATGL

SEQ ID NO: 118877 - protein, 10 aa, Artificial Sequence
  Description of Artificial Sequence: Synthetic peptide
  Seed: LSRPSLPSCL (MOG_HUMAN)
LFRPSLPSCK

SEQ ID NO: 118878 - protein, 9 aa, Artificial Sequence
  Description of Artificial Sequence: Synthetic peptide
  Seed: VGDEVELPC (MOG_HUMAN)
VLDEVELPV

SEQ ID NO: 118879 - protein, 9 aa, Artificial Sequence
  Description of Artificial Sequence: Synthetic peptide
  Seed: LKVEDPFYW (MOG_HUMAN)
LIVEDPFYW

SEQ ID NO: 118880 - protein, 9 aa, Artificial Sequence
  Description of Artificial Sequence: Synthetic peptide
  Seed: LLLQVSSSY (MOG_HUMAN)
LPLQVSSSL

SEQ ID NO: 118881 - protein, 10 aa, Artificial Sequence
  Description of Artificial Sequence: Synthetic peptide
  Seed: SSYAGQFRVI (MOG_HUMAN)
SGYAGQFRVF

SEQ ID NO: 118882 - protein, 9 aa, Artificial Sequence
  Description of Artificial Sequence: Synthetic peptide
  Seed: TLFVIVPVL (MOG_HUMAN)
TQFVIVPVV

SEQ ID NO: 118883 - protein, 8 aa, Artificial Sequence
  Description of Artificial Sequence: Synthetic peptide
  Seed: FSDEGGFT (MOG_HUMAN)
FVDEGGFM

SEQ ID NO: 118884 - protein, 10 aa, Artificial Sequence
  Description of Artificial Sequence: Synthetic peptide
  Seed: VIVPVLGPLV (MOG_HUMAN)
VVVPVLGPLV

SEQ ID NO: 118885 - protein, 9 aa, Artificial Sequence
  Description of Artificial Sequence: Synthetic peptide
  Seed: LAVLPVLLL (MOG_HUMAN)
LQVLPVLLY

SEQ ID NO: 118886 - protein, 10 aa, Artificial Sequence
  Description of Artificial Sequence: Synthetic peptide
  Seed: HRTFDPHFLR (MOG_HUMAN)
HLTFDPHFLR

SEQ ID NO: 118887 - protein, 10 aa, Artificial Sequence
  Description of Artificial Sequence: Synthetic peptide
  Seed: VTLRIRNVRF (MOG_HUMAN)
VTLRIRNVRW

SEQ ID NO: 118888 - protein, 9 aa, Artificial Sequence
  Description of Artificial Sequence: Synthetic peptide
  Seed: TFDPHFLRV (MOG_HUMAN)
TMDPHFLRY

SEQ ID NO: 118889 - protein, 9 aa, Artificial Sequence
  Description of Artificial Sequence: Synthetic peptide
  Seed: IVPVLGPLV (MOG_HUMAN)
IMPVLGPLV

SEQ ID NO: 118890 - protein, 9 aa, Artificial Sequence
  Description of Artificial Sequence: Synthetic peptide
  Seed: ALVGDEVEL (MOG_HUMAN)
AIVGDEVEV

SEQ ID NO: 118891 - protein, 10 aa, Artificial Sequence
  Description of Artificial Sequence: Synthetic peptide
  Seed: VPVLGPLVAL (MOG_HUMAN)
VKVLGPLVAV

SEQ ID NO: 118892 - protein, 9 aa, Artificial Sequence
  Description of Artificial Sequence: Synthetic peptide
  Seed: LSRPSLPSC (MOG_HUMAN)
LARPSLPSH

SEQ ID NO: 118893 - protein, 10 aa, Artificial Sequence
  Description of Artificial Sequence: Synthetic peptide
  Seed: FSDEGGFTCF (MOG_HUMAN)
FPDEGGFTCY

SEQ ID NO: 118894 - protein, 10 aa, Artificial Sequence
  Description of Artificial Sequence: Synthetic peptide
  Seed: FVIVPVLGPL (MOG_HUMAN)
FVIVPVLGPI

SEQ ID NO: 118895 - protein, 9 aa, Artificial Sequence
  Description of Artificial Sequence: Synthetic peptide
  Seed: RVIGPRHPI (MOG_HUMAN)
RAIGPRHPK

SEQ ID NO: 118896 - protein, 10 aa, Artificial Sequence
  Description of Artificial Sequence: Synthetic peptide
  Seed: LSRPSLPSCL (MOG_HUMAN)
LTRPSLPSCA

SEQ ID NO: 118897 - protein, 9 aa, Artificial Sequence
  Description of Artificial Sequence: Synthetic peptide
  Seed: SLPSCLCSF (MOG_HUMAN)
SIPSCLCSF

SEQ ID NO: 118898 - protein, 9 aa, Artificial Sequence
  Description of Artificial Sequence: Synthetic peptide
  Seed: ICYNWLHRR (MOG_HUMAN)
IVYNWLHRL

SEQ ID NO: 118899 - protein, 10 aa, Artificial Sequence
  Description of Artificial Sequence: Synthetic peptide
  Seed: LLLQITVGLI (MOG_HUMAN)
LQLQITVGLV

SEQ ID NO: 118900 - protein, 9 aa, Artificial Sequence
  Description of Artificial Sequence: Synthetic peptide
  Seed: LQVSSSYAG (MOG_HUMAN)
LYVSSSYAF

SEQ ID NO: 118901 - protein, 8 aa, Artificial Sequence
  Description of Artificial Sequence: Synthetic peptide
  Seed: RIRNVRFS (MOG_HUMAN)
RQRNVRFK

SEQ ID NO: 118902 - protein, 10 aa, Artificial Sequence
  Description of Artificial Sequence: Synthetic peptide
  Seed: IGPRHPIRAL (MOG_HUMAN)
ISPRHPIRAM

SEQ ID NO: 118903 - protein, 10 aa, Artificial Sequence
  Description of Artificial Sequence: Synthetic peptide
  Seed: DAIGEGKVTL (MOG_HUMAN)
DTIGEGKVTV

SEQ ID NO: 118904 - protein, 10 aa, Artificial Sequence
  Description of Artificial Sequence: Synthetic peptide
  Seed: RIRNVRFSDE (MOG_HUMAN)
RVRNVRFSDS

SEQ ID NO: 118905 - protein, 9 aa, Artificial Sequence
  Description of Artificial Sequence: Synthetic peptide
  Seed: IFLCLQYRL (MOG_HUMAN)
IYLCLQYRV

SEQ ID NO: 118906 - protein, 11 aa, Artificial Sequence
  Description of Artificial Sequence: Synthetic peptide
  Seed: RLAGQFLEELR (MOG_HUMAN)
RMAGQFLEELK

SEQ ID NO: 118907 - protein, 9 aa, Artificial Sequence
  Description of Artificial Sequence: Synthetic peptide
  Seed: YQEEAAMEL (MOG_HUMAN)
YTEEAAMEM

SEQ ID NO: 118908 - protein, 9 aa, Artificial Sequence
  Description of Artificial Sequence: Synthetic peptide
  Seed: YRPPFSRVV (MOG_HUMAN)
YFPPFSRVM

SEQ ID NO: 118909 - protein, 9 aa, Artificial Sequence
  Description of Artificial Sequence: Synthetic peptide
  Seed: WVSPGVLVL (MOG_HUMAN)
WISPGVLVF

SEQ ID NO: 118910 - protein, 9 aa, Artificial Sequence
  Description of Artificial Sequence: Synthetic peptide
  Seed: RVPCWKITL (MOG_HUMAN)
RWPCWKITI

SEQ ID NO: 118911 - protein, 9 aa, Artificial Sequence
  Description of Artificial Sequence: Synthetic peptide
  Seed: VGDEVELPC (MOG_HUMAN)
VFDEVELPM

SEQ ID NO: 118912 - protein, 10 aa, Artificial Sequence
  Description of Artificial Sequence: Synthetic peptide
  Seed: RLAGQFLEEL (MOG_HUMAN)
RTAGQFLEEF

SEQ ID NO: 118913 - protein, 9 aa, Artificial Sequence
  Description of Artificial Sequence: Synthetic peptide
  Seed: RIRNVRFSD (MOG_HUMAN)
RTRNVRFSN

SEQ ID NO: 118914 - protein, 9 aa, Artificial Sequence
  Description of Artificial Sequence: Synthetic peptide
  Seed: TFDPHFLRV (MOG_HUMAN)
TTDPHFLRM

SEQ ID NO: 118915 - protein, 9 aa, Artificial Sequence
  Description of Artificial Sequence: Synthetic peptide
  Seed: RVPCWKITL (MOG_HUMAN)
RMPCWKITF

SEQ ID NO: 118916 - protein, 9 aa, Artificial Sequence
  Description of Artificial Sequence: Synthetic peptide
  Seed: VLGPLVALI (MOG_HUMAN)
VQGPLVALL

SEQ ID NO: 118917 - protein, 9 aa, Artificial Sequence
  Description of Artificial Sequence: Synthetic peptide
  Seed: FLLLLLLQV (MOG_HUMAN)
FLLLLLLQI

SEQ ID NO: 118918 - protein, 10 aa, Artificial Sequence
  Description of Artificial Sequence: Synthetic peptide
  Seed: FSDEGGFTCF (MOG_HUMAN)
FVDEGGFTCY

SEQ ID NO: 118919 - protein, 9 aa, Artificial Sequence
  Description of Artificial Sequence: Synthetic peptide
  Seed: TLFVIVPVL (MOG_HUMAN)
TLFVIVPVI

SEQ ID NO: 118920 - protein, 9 aa, Artificial Sequence
  Description of Artificial Sequence: Synthetic peptide
  Seed: RTFDPHFLR (MOG_HUMAN)
RNFDPHFLW

SEQ ID NO: 118921 - protein, 11 aa, Artificial Sequence
  Description of Artificial Sequence: Synthetic peptide
  Seed: RDHSYQEEAAM (MOG_HUMAN)
RRHSYQEEAAY

SEQ ID NO: 118922 - protein, 10 aa, Artificial Sequence
  Description of Artificial Sequence: Synthetic peptide
  Seed: SCLCSFLLLL (MOG_HUMAN)
SMLCSFLLLI

SEQ ID NO: 118923 - protein, 9 aa, Artificial Sequence
  Description of Artificial Sequence: Synthetic peptide
  Seed: EVGWYRPPF (MOG_HUMAN)
ESGWYRPPR

SEQ ID NO: 118924 - protein, 9 aa, Artificial Sequence
  Description of Artificial Sequence: Synthetic peptide
  Seed: FSDEGGFTC (MOG_HUMAN)
FTDEGGFTH

SEQ ID NO: 118925 - protein, 11 aa, Artificial Sequence
  Description of Artificial Sequence: Synthetic peptide
  Seed: RISPGKNATGM (MOG_HUMAN)
RQSPGKNATGY

SEQ ID NO: 118926 - protein, 10 aa, Artificial Sequence
  Description of Artificial Sequence: Synthetic peptide
  Seed: SPGVLVLLAV (MOG_HUMAN)
SPGVLVLLAL

SEQ ID NO: 118927 - protein, 10 aa, Artificial Sequence
  Description of Artificial Sequence: Synthetic peptide
  Seed: TGMEVGWYRP (MOG_HUMAN)
TVMEVGWYRC

SEQ ID NO: 118928 - protein, 8 aa, Artificial Sequence
  Description of Artificial Sequence: Synthetic peptide
  Seed: RTFDPHFL (MOG_HUMAN)
RTFDPHFF

SEQ ID NO: 118929 - protein, 10 aa, Artificial Sequence
  Description of Artificial Sequence: Synthetic peptide
  Seed: IGPRHPIRAL (MOG_HUMAN)
IWPRHPIRAI

SEQ ID NO: 118930 - protein, 9 aa, Artificial Sequence
  Description of Artificial Sequence: Synthetic peptide
  Seed: GEGKVTLRI (MOG_HUMAN)
GQGKVTLRV

SEQ ID NO: 118931 - protein, 9 aa, Artificial Sequence
  Description of Artificial Sequence: Synthetic peptide
  Seed: HFLRVPCWK (MOG_HUMAN)
HGLRVPCWR

SEQ ID NO: 118932 - protein, 11 aa, Artificial Sequence
  Description of Artificial Sequence: Synthetic peptide
  Seed: RTFDPHFLRVP (MOG_HUMAN)
RYFDPHFLRVR

SEQ ID NO: 118933 - protein, 9 aa, Artificial Sequence
  Description of Artificial Sequence: Synthetic peptide
  Seed: VLGPLVALI (MOG_HUMAN)
VRGPLVALM

SEQ ID NO: 118934 - protein, 9 aa, Artificial Sequence
  Description of Artificial Sequence: Synthetic peptide
  Seed: LQVSSSYAG (MOG_HUMAN)
LMVSSSYAY

SEQ ID NO: 118935 - protein, 9 aa, Artificial Sequence
  Description of Artificial Sequence: Synthetic peptide
  Seed: CSFLLLLLL (MOG_HUMAN)
CTFLLLLLW

SEQ ID NO: 118936 - protein, 9 aa, Artificial Sequence
  Description of Artificial Sequence: Synthetic peptide
  Seed: RDHSYQEEA (MOG_HUMAN)
REHSYQEEV

SEQ ID NO: 118937 - protein, 8 aa, Artificial Sequence
  Description of Artificial Sequence: Synthetic peptide
  Seed: VIGPRHPI (MOG_HUMAN)
VSGPRHPM

SEQ ID NO: 118938 - protein, 9 aa, Artificial Sequence
  Description of Artificial Sequence: Synthetic peptide
  Seed: FSDEGGFTC (MOG_HUMAN)
FFDEGGFTY

SEQ ID NO: 118939 - protein, 9 aa, Artificial Sequence
  Description of Artificial Sequence: Synthetic peptide
  Seed: RIRNVRFSD (MOG_HUMAN)
RSRNVRFSN

SEQ ID NO: 118940 - protein, 9 aa, Artificial Sequence
  Description of Artificial Sequence: Synthetic peptide
  Seed: TFDPHFLRV (MOG_HUMAN)
TMDPHFLRV

SEQ ID NO: 118941 - protein, 10 aa, Artificial Sequence
  Description of Artificial Sequence: Synthetic peptide
  Seed: LLLQVSSSYA (MOG_HUMAN)
LVLQVSSSYY

SEQ ID NO: 118942 - protein, 10 aa, Artificial Sequence
  Description of Artificial Sequence: Synthetic peptide
  Seed: RTFDPHFLRV (MOG_HUMAN)
RAFDPHFLRE

SEQ ID NO: 118943 - protein, 10 aa, Artificial Sequence
  Description of Artificial Sequence: Synthetic peptide
  Seed: FVIVPVLGPL (MOG_HUMAN)
FNIVPVLGPL

SEQ ID NO: 118944 - protein, 9 aa, Artificial Sequence
  Description of Artificial Sequence: Synthetic peptide
  Seed: TFDPHFLRV (MOG_HUMAN)
TLDPHFLRA

SEQ ID NO: 118945 - protein, 9 aa, Artificial Sequence
  Description of Artificial Sequence: Synthetic peptide
  Seed: VLPVLLLQI (MOG_HUMAN)
VFPVLLLQF

SEQ ID NO: 118946 - protein, 9 aa, Artificial Sequence
  Description of Artificial Sequence: Synthetic peptide
  Seed: TFDPHFLRV (MOG_HUMAN)
TMDPHFLRL

SEQ ID NO: 118947 - protein, 10 aa, Artificial Sequence
  Description of Artificial Sequence: Synthetic peptide
  Seed: RTFDPHFLRV (MOG_HUMAN)
RVFDPHFLRR

SEQ ID NO: 118948 - protein, 11 aa, Artificial Sequence
  Description of Artificial Sequence: Synthetic peptide
  Seed: VGDEVELPCRI (MOG_HUMAN)
VADEVELPCRL

SEQ ID NO: 118949 - protein, 10 aa, Artificial Sequence
  Description of Artificial Sequence: Synthetic peptide
  Seed: WVSPGVLVLL (MOG_HUMAN)
WMSPGVLVLT

SEQ ID NO: 118950 - protein, 11 aa, Artificial Sequence
  Description of Artificial Sequence: Synthetic peptide
  Seed: RDHSYQEEAAM (MOG_HUMAN)
RLHSYQEEAAF

SEQ ID NO: 118951 - protein, 9 aa, Artificial Sequence
  Description of Artificial Sequence: Synthetic peptide
  Seed: YWVSPGVLV (MOG_HUMAN)
YFVSPGVLF

SEQ ID NO: 118952 - protein, 10 aa, Artificial Sequence
  Description of Artificial Sequence: Synthetic peptide
  Seed: FDPHFLRVPC (MOG_HUMAN)
FIPHFLRVPV

SEQ ID NO: 118953 - protein, 9 aa, Artificial Sequence
  Description of Artificial Sequence: Synthetic peptide
  Seed: TGMEVGWYR (MOG_HUMAN)
TYMEVGWYR

SEQ ID NO: 118954 - protein, 9 aa, Artificial Sequence
  Description of Artificial Sequence: Synthetic peptide
  Seed: VIVPVLGPL (MOG_HUMAN)
VMVPVLGPV

SEQ ID NO: 118955 - protein, 10 aa, Artificial Sequence
  Description of Artificial Sequence: Synthetic peptide
  Seed: SSYAGQFRVI (MOG_HUMAN)
SRYAGQFRVW

SEQ ID NO: 118956 - protein, 9 aa, Artificial Sequence
  Description of Artificial Sequence: Synthetic peptide
  Seed: VSPGVLVLL (MOG_HUMAN)
VQPGVLVLI

SEQ ID NO: 118957 - protein, 9 aa, Artificial Sequence
  Description of Artificial Sequence: Synthetic peptide
  Seed: VPCWKITLF (MOG_HUMAN)
VPCWKITLW

SEQ ID NO: 118958 - protein, 9 aa, Artificial Sequence
  Description of Artificial Sequence: Synthetic peptide
  Seed: FYWVSPGVL (MOG_HUMAN)
FAWVSPGVI

SEQ ID NO: 118959 - protein, 10 aa, Artificial Sequence
  Description of Artificial Sequence: Synthetic peptide
  Seed: TGMEVGWYRP (MOG_HUMAN)
TVMEVGWYRF

SEQ ID NO: 118960 - protein, 9 aa, Artificial Sequence
  Description of Artificial Sequence: Synthetic peptide
  Seed: FSRVVHLYR (MOG_HUMAN)
FSRVVHLYK

SEQ ID NO: 118961 - protein, 10 aa, Artificial Sequence
  Description of Artificial Sequence: Synthetic peptide
  Seed: SFLLLLLLQV (MOG_HUMAN)
SCLLLLLLQV

SEQ ID NO: 118962 - protein, 9 aa, Artificial Sequence
  Description of Artificial Sequence: Synthetic peptide
  Seed: IGEGKVTLR (MOG_HUMAN)
ITEGKVTLM

SEQ ID NO: 118963 - protein, 9 aa, Artificial Sequence
  Description of Artificial Sequence: Synthetic peptide
  Seed: SSYAGQFRV (MOG_HUMAN)
SVYAGQFRF

SEQ ID NO: 118964 - protein, 9 aa, Artificial Sequence
  Description of Artificial Sequence: Synthetic peptide
  Seed: AEIENLHRT (MOG_HUMAN)
AQIENLHRL

SEQ ID NO: 118965 - protein, 9 aa, Artificial Sequence
  Description of Artificial Sequence: Synthetic peptide
  Seed: HSYQEEAAM (MOG_HUMAN)
HCYQEEAAY

SEQ ID NO: 118966 - protein, 10 aa, Artificial Sequence
  Description of Artificial Sequence: Synthetic peptide
  Seed: LLQITVGLIF (MOG_HUMAN)
LMQITVGLIY

SEQ ID NO: 118967 - protein, 10 aa, Artificial Sequence
  Description of Artificial Sequence: Synthetic peptide
  Seed: YWVSPGVLVL (MOG_HUMAN)
YDVSPGVLVY

SEQ ID NO: 118968 - protein, 11 aa, Artificial Sequence
  Description of Artificial Sequence: Synthetic peptide
  Seed: VGLIFLCLQYR (MOG_HUMAN)
VMLIFLCLQYR

SEQ ID NO: 118969 - protein, 9 aa, Artificial Sequence
  Description of Artificial Sequence: Synthetic peptide
  Seed: VPCWKITLF (MOG_HUMAN)
VPCWKITLY

SEQ ID NO: 118970 - protein, 9 aa, Artificial Sequence
  Description of Artificial Sequence: Synthetic peptide
  Seed: SSYAGQFRV (MOG_HUMAN)
SIYAGQFRM

SEQ ID NO: 118971 - protein, 8 aa, Artificial Sequence
  Description of Artificial Sequence: Synthetic peptide
  Seed: RIRNVRFS (MOG_HUMAN)
RSRNVRFV

SEQ ID NO: 118972 - protein, 9 aa, Artificial Sequence
  Description of Artificial Sequence: Synthetic peptide
  Seed: RVIGPRHPI (MOG_HUMAN)
RPIGPRHPW

SEQ ID NO: 118973 - protein, 10 aa, Artificial Sequence
  Description of Artificial Sequence: Synthetic peptide
  Seed: FDPHFLRVPC (MOG_HUMAN)
FDPHFLRVPF

SEQ ID NO: 118974 - protein, 10 aa, Artificial Sequence
  Description of Artificial Sequence: Synthetic peptide
  Seed: RIRNVRFSDE (MOG_HUMAN)
RSRNVRFSDA

SEQ ID NO: 118975 - protein, 9 aa, Artificial Sequence
  Description of Artificial Sequence: Synthetic peptide
  Seed: VSPGVLVLL (MOG_HUMAN)
VAPGVLVLI

SEQ ID NO: 118976 - protein, 9 aa, Artificial Sequence
  Description of Artificial Sequence: Synthetic peptide
  Seed: FSDEGGFTC (MOG_HUMAN)
FCDEGGFTI

SEQ ID NO: 118977 - protein, 9 aa, Artificial Sequence
  Description of Artificial Sequence: Synthetic peptide
  Seed: RVIGPRHPI (MOG_HUMAN)
RCIGPRHPK

SEQ ID NO: 118978 - protein, 11 aa, Artificial Sequence
  Description of Artificial Sequence: Synthetic peptide
  Seed: HRTFDPHFLRV (MOG_HUMAN)
HMTFDPHFLRG

SEQ ID NO: 118979 - protein, 9 aa, Artificial Sequence
  Description of Artificial Sequence: Synthetic peptide
  Seed: VGDEVELPC (MOG_HUMAN)
VNDEVELPV

SEQ ID NO: 118980 - protein, 9 aa, Artificial Sequence
  Description of Artificial Sequence: Synthetic peptide
  Seed: LQITVGLIF (MOG_HUMAN)
LPITVGLIY

SEQ ID NO: 118981 - protein, 11 aa, Artificial Sequence
  Description of Artificial Sequence: Synthetic peptide
  Seed: VLVLLAVLPVL (MOG_HUMAN)
VTVLLAVLPVV

SEQ ID NO: 118982 - protein, 10 aa, Artificial Sequence
  Description of Artificial Sequence: Synthetic peptide
  Seed: ITLFVIVPVL (MOG_HUMAN)
IALFVIVPVV

SEQ ID NO: 118983 - protein, 10 aa, Artificial Sequence
  Description of Artificial Sequence: Synthetic peptide
  Seed: VLLAVLPVLL (MOG_HUMAN)
VHLAVLPVLL

SEQ ID NO: 118984 - protein, 9 aa, Artificial Sequence
  Description of Artificial Sequence: Synthetic peptide
  Seed: RTFDPHFLR (MOG_HUMAN)
RQFDPHFLY

SEQ ID NO: 118985 - protein, 10 aa, Artificial Sequence
  Description of Artificial Sequence: Synthetic peptide
  Seed: RTFDPHFLRV (MOG_HUMAN)
RAFDPHFLRG

SEQ ID NO: 118986 - protein, 10 aa, Artificial Sequence
  Description of Artificial Sequence: Synthetic peptide
  Seed: RTFDPHFLRV (MOG_HUMAN)
RWFDPHFLRY

SEQ ID NO: 118987 - protein, 10 aa, Artificial Sequence
  Description of Artificial Sequence: Synthetic peptide
  Seed: SSYAGQFRVI (MOG_HUMAN)
SCYAGQFRVW

SEQ ID NO: 118988 - protein, 9 aa, Artificial Sequence
  Description of Artificial Sequence: Synthetic peptide
  Seed: MASLSRPSL (MOG_HUMAN)
MQSLSRPSF

SEQ ID NO: 118989 - protein, 9 aa, Artificial Sequence
  Description of Artificial Sequence: Synthetic peptide
  Seed: RTFDPHFLR (MOG_HUMAN)
RQFDPHFLR

SEQ ID NO: 118990 - protein, 10 aa, Artificial Sequence
  Description of Artificial Sequence: Synthetic peptide
  Seed: YWVSPGVLVL (MOG_HUMAN)
YRVSPGVLVF

SEQ ID NO: 118991 - protein, 9 aa, Artificial Sequence
  Description of Artificial Sequence: Synthetic peptide
  Seed: LLLQITVGL (MOG_HUMAN)
LILQITVGA

SEQ ID NO: 118992 - protein, 11 aa, Artificial Sequence
  Description of Artificial Sequence: Synthetic peptide
  Seed: RFSDEGGFTCF (MOG_HUMAN)
RLSDEGGFTCM

SEQ ID NO: 118993 - protein, 9 aa, Artificial Sequence
  Description of Artificial Sequence: Synthetic peptide
  Seed: IGEGKVTLR (MOG_HUMAN)
ITEGKVTLK

SEQ ID NO: 118994 - protein, 9 aa, Artificial Sequence
  Description of Artificial Sequence: Synthetic peptide
  Seed: RAEIENLHR (MOG_HUMAN)
RVEIENLHY

SEQ ID NO: 118995 - protein, 9 aa, Artificial Sequence
  Description of Artificial Sequence: Synthetic peptide
  Seed: GPRHPIRAL (MOG_HUMAN)
GPRHPIRAF

SEQ ID NO: 118996 - protein, 9 aa, Artificial Sequence
  Description of Artificial Sequence: Synthetic peptide
  Seed: LQVSSSYAG (MOG_HUMAN)
LMVSSSYAL

SEQ ID NO: 118997 - protein, 8 aa, Artificial Sequence
  Description of Artificial Sequence: Synthetic peptide
  Seed: FSRVVHLY (MOG_HUMAN)
FARVVHLL

SEQ ID NO: 118998 - protein, 9 aa, Artificial Sequence
  Description of Artificial Sequence: Synthetic peptide
  Seed: HSYQEEAAM (MOG_HUMAN)
HRYQEEAAL

SEQ ID NO: 118999 - protein, 9 aa, Artificial Sequence
  Description of Artificial Sequence: Synthetic peptide
  Seed: MASLSRPSL (MOG_HUMAN)
MISLSRPSL

SEQ ID NO: 119000 - protein, 11 aa, Artificial Sequence
  Description of Artificial Sequence: Synthetic peptide
  Seed: RDHSYQEEAAM (MOG_HUMAN)
RTHSYQEEAAW

SEQ ID NO: 119001 - protein, 9 aa, Artificial Sequence
  Description of Artificial Sequence: Synthetic peptide
  Seed: RVPCWKITL (MOG_HUMAN)
RFPCWKITF

SEQ ID NO: 119002 - protein, 9 aa, Artificial Sequence
  Description of Artificial Sequence: Synthetic peptide
  Seed: RIRNVRFSD (MOG_HUMAN)
RIRNVRFSF

SEQ ID NO: 119003 - protein, 10 aa, Artificial Sequence
  Description of Artificial Sequence: Synthetic peptide
  Seed: AEIENLHRTF (MOG_HUMAN)
AQIENLHRTY

SEQ ID NO: 119004 - protein, 9 aa, Artificial Sequence
  Description of Artificial Sequence: Synthetic peptide
  Seed: FYWVSPGVL (MOG_HUMAN)
FSWVSPGVF

SEQ ID NO: 119005 - protein, 10 aa, Artificial Sequence
  Description of Artificial Sequence: Synthetic peptide
  Seed: VIVPVLGPLV (MOG_HUMAN)
VLVPVLGPLI

SEQ ID NO: 119006 - protein, 10 aa, Artificial Sequence
  Description of Artificial Sequence: Synthetic peptide
  Seed: RTFDPHFLRV (MOG_HUMAN)
RAFDPHFLRS

SEQ ID NO: 119007 - protein, 9 aa, Artificial Sequence
  Description of Artificial Sequence: Synthetic peptide
  Seed: VLLAVLPVL (MOG_HUMAN)
VSLAVLPVV

SEQ ID NO: 119008 - protein, 11 aa, Artificial Sequence
  Description of Artificial Sequence: Synthetic peptide
  Seed: LLLLLQVSSSY (MOG_HUMAN)
LKLLLQVSSSF

SEQ ID NO: 119009 - protein, 10 aa, Artificial Sequence
  Description of Artificial Sequence: Synthetic peptide
  Seed: HRTFDPHFLR (MOG_HUMAN)
HVTFDPHFLK

SEQ ID NO: 119010 - protein, 10 aa, Artificial Sequence
  Description of Artificial Sequence: Synthetic peptide
  Seed: RTFDPHFLRV (MOG_HUMAN)
RWFDPHFLRQ

SEQ ID NO: 119011 - protein, 9 aa, Artificial Sequence
  Description of Artificial Sequence: Synthetic peptide
  Seed: RTFDPHFLR (MOG_HUMAN)
RSFDPHFLA

SEQ ID NO: 119012 - protein, 9 aa, Artificial Sequence
  Description of Artificial Sequence: Synthetic peptide
  Seed: HSYQEEAAM (MOG_HUMAN)
HRYQEEAAI

SEQ ID NO: 119013 - protein, 10 aa, Artificial Sequence
  Description of Artificial Sequence: Synthetic peptide
  Seed: RTFDPHFLRV (MOG_HUMAN)
RHFDPHFLRR

SEQ ID NO: 119014 - protein, 9 aa, Artificial Sequence
  Description of Artificial Sequence: Synthetic peptide
  Seed: RTFDPHFLR (MOG_HUMAN)
RLFDPHFLF

SEQ ID NO: 119015 - protein, 9 aa, Artificial Sequence
  Description of Artificial Sequence: Synthetic peptide
  Seed: TGMEVGWYR (MOG_HUMAN)
TVMEVGWYR

SEQ ID NO: 119016 - protein, 10 aa, Artificial Sequence
  Description of Artificial Sequence: Synthetic peptide
  Seed: VLLAVLPVLL (MOG_HUMAN)
VVLAVLPVLL

SEQ ID NO: 119017 - protein, 10 aa, Artificial Sequence
  Description of Artificial Sequence: Synthetic peptide
  Seed: SLSRPSLPSC (MOG_HUMAN)
SQSRPSLPSL

SEQ ID NO: 119018 - protein, 11 aa, Artificial Sequence
  Description of Artificial Sequence: Synthetic peptide
  Seed: RFSDEGGFTCF (MOG_HUMAN)
RASDEGGFTCW

SEQ ID NO: 119019 - protein, 11 aa, Artificial Sequence
  Description of Artificial Sequence: Synthetic peptide
  Seed: VLVLLAVLPVL (MOG_HUMAN)
VMVLLAVLPVV

SEQ ID NO: 119020 - protein, 10 aa, Artificial Sequence
  Description of Artificial Sequence: Synthetic peptide
  Seed: TGMEVGWYRP (MOG_HUMAN)
TMMEVGWYRD

SEQ ID NO: 119021 - protein, 11 aa, Artificial Sequence
  Description of Artificial Sequence: Synthetic peptide
  Seed: HRTFDPHFLRV (MOG_HUMAN)
HVTFDPHFLRR

SEQ ID NO: 119022 - protein, 8 aa, Artificial Sequence
  Description of Artificial Sequence: Synthetic peptide
  Seed: FLCLQYRL (MOG_HUMAN)
FLCLQYRV

SEQ ID NO: 119023 - protein, 9 aa, Artificial Sequence
  Description of Artificial Sequence: Synthetic peptide
  Seed: LLLQVSSSY (MOG_HUMAN)
LFLQVSSSF

SEQ ID NO: 119024 - protein, 9 aa, Artificial Sequence
  Description of Artificial Sequence: Synthetic peptide
  Seed: ALVGDEVEL (MOG_HUMAN)
ATVGDEVEL

SEQ ID NO: 119025 - protein, 10 aa, Artificial Sequence
  Description of Artificial Sequence: Synthetic peptide
  Seed: RIRNVRFSDE (MOG_HUMAN)
RSRNVRFSDS

SEQ ID NO: 119026 - protein, 9 aa, Artificial Sequence
  Description of Artificial Sequence: Synthetic peptide
  Seed: RVPCWKITL (MOG_HUMAN)
RIPCWKITL

SEQ ID NO: 119027 - protein, 9 aa, Artificial Sequence
  Description of Artificial Sequence: Synthetic peptide
  Seed: YRPPFSRVV (MOG_HUMAN)
YAPPFSRVW

SEQ ID NO: 119028 - protein, 9 aa, Artificial Sequence
  Description of Artificial Sequence: Synthetic peptide
  Seed: LIICYNWLH (MOG_HUMAN)
LYICYNWLR

SEQ ID NO: 119029 - protein, 10 aa, Artificial Sequence
  Description of Artificial Sequence: Synthetic peptide
  Seed: HRTFDPHFLR (MOG_HUMAN)
HITFDPHFLY

SEQ ID NO: 119030 - protein, 9 aa, Artificial Sequence
  Description of Artificial Sequence: Synthetic peptide
  Seed: RIRNVRFSD (MOG_HUMAN)
RLRNVRFSL

SEQ ID NO: 119031 - protein, 9 aa, Artificial Sequence
  Description of Artificial Sequence: Synthetic peptide
  Seed: TGMEVGWYR (MOG_HUMAN)
TMMEVGWYM

SEQ ID NO: 119032 - protein, 10 aa, Artificial Sequence
  Description of Artificial Sequence: Synthetic peptide
  Seed: LIICYNWLHR (MOG_HUMAN)
LVICYNWLHK

SEQ ID NO: 119033 - protein, 10 aa, Artificial Sequence
  Description of Artificial Sequence: Synthetic peptide
  Seed: IGPRHPIRAL (MOG_HUMAN)
IAPRHPIRAF

SEQ ID NO: 119034 - protein, 10 aa, Artificial Sequence
  Description of Artificial Sequence: Synthetic peptide
  Seed: LLLQVSSSYA (MOG_HUMAN)
LELQVSSSYV

SEQ ID NO: 119035 - protein, 10 aa, Artificial Sequence
  Description of Artificial Sequence: Synthetic peptide
  Seed: RTFDPHFLRV (MOG_HUMAN)
REFDPHFLRR

SEQ ID NO: 119036 - protein, 10 aa, Artificial Sequence
  Description of Artificial Sequence: Synthetic peptide
  Seed: AEIENLHRTF (MOG_HUMAN)
ATIENLHRTY

SEQ ID NO: 119037 - protein, 9 aa, Artificial Sequence
  Description of Artificial Sequence: Synthetic peptide
  Seed: MELKVEDPF (MOG_HUMAN)
MKLKVEDPM

SEQ ID NO: 119038 - protein, 9 aa, Artificial Sequence
  Description of Artificial Sequence: Synthetic peptide
  Seed: RTFDPHFLR (MOG_HUMAN)
RMFDPHFLV

SEQ ID NO: 119039 - protein, 10 aa, Artificial Sequence
  Description of Artificial Sequence: Synthetic peptide
  Seed: WVSPGVLVLL (MOG_HUMAN)
WQSPGVLVLV

SEQ ID NO: 119040 - protein, 9 aa, Artificial Sequence
  Description of Artificial Sequence: Synthetic peptide
  Seed: LKVEDPFYW (MOG_HUMAN)
LSVEDPFYF

SEQ ID NO: 119041 - protein, 10 aa, Artificial Sequence
  Description of Artificial Sequence: Synthetic peptide
  Seed: FTCFFRDHSY (MOG_HUMAN)
FVCFFRDHSK

SEQ ID NO: 119042 - protein, 10 aa, Artificial Sequence
  Description of Artificial Sequence: Synthetic peptide
  Seed: IFLCLQYRLR (MOG_HUMAN)
IFLCLQYRLK

SEQ ID NO: 119043 - protein, 9 aa, Artificial Sequence
  Description of Artificial Sequence: Synthetic peptide
  Seed: RTFDPHFLR (MOG_HUMAN)
RTFDPHFLY

SEQ ID NO: 119044 - protein, 9 aa, Artificial Sequence
  Description of Artificial Sequence: Synthetic peptide
  Seed: RTFDPHFLR (MOG_HUMAN)
RAFDPHFLL

SEQ ID NO: 119045 - protein, 9 aa, Artificial Sequence
  Description of Artificial Sequence: Synthetic peptide
  Seed: FLEELRNPF (MOG_HUMAN)
FMEELRNPY

SEQ ID NO: 119046 - protein, 10 aa, Artificial Sequence
  Description of Artificial Sequence: Synthetic peptide
  Seed: EYRGRTELLK (MOG_HUMAN)
EYRGRTELLR

SEQ ID NO: 119047 - protein, 11 aa, Artificial Sequence
  Description of Artificial Sequence: Synthetic peptide
  Seed: RISPGKNATGM (MOG_HUMAN)
RISPGKNATGF

SEQ ID NO: 119048 - protein, 10 aa, Artificial Sequence
  Description of Artificial Sequence: Synthetic peptide
  Seed: FYWVSPGVLV (MOG_HUMAN)
FWWVSPGVLW

SEQ ID NO: 119049 - protein, 10 aa, Artificial Sequence
  Description of Artificial Sequence: Synthetic peptide
  Seed: RLRGKLRAEI (MOG_HUMAN)
RIRGKLRAEK

SEQ ID NO: 119050 - protein, 9 aa, Artificial Sequence
  Description of Artificial Sequence: Synthetic peptide
  Seed: RTELLKDAI (MOG_HUMAN)
RQELLKDAL

SEQ ID NO: 119051 - protein, 10 aa, Artificial Sequence
  Description of Artificial Sequence: Synthetic peptide
  Seed: RPPFSRVVHL (MOG_HUMAN)
RRPFSRVVHL

SEQ ID NO: 119052 - protein, 9 aa, Artificial Sequence
  Description of Artificial Sequence: Synthetic peptide
  Seed: YQEEAAMEL (MOG_HUMAN)
YSEEAAMEL

SEQ ID NO: 119053 - protein, 9 aa, Artificial Sequence
  Description of Artificial Sequence: Synthetic peptide
  Seed: IFLCLQYRL (MOG_HUMAN)
IFLCLQYRI

SEQ ID NO: 119054 - protein, 11 aa, Artificial Sequence
  Description of Artificial Sequence: Synthetic peptide
  Seed: LHRTFDPHFLR (MOG_HUMAN)
LTRTFDPHFLR

SEQ ID NO: 119055 - protein, 10 aa, Artificial Sequence
  Description of Artificial Sequence: Synthetic peptide
  Seed: RIRNVRFSDE (MOG_HUMAN)
RLRNVRFSDK

SEQ ID NO: 119056 - protein, 9 aa, Artificial Sequence
  Description of Artificial Sequence: Synthetic peptide
  Seed: FLEELRNPF (MOG_HUMAN)
FQEELRNPM

SEQ ID NO: 119057 - protein, 9 aa, Artificial Sequence
  Description of Artificial Sequence: Synthetic peptide
  Seed: YQEEAAMEL (MOG_HUMAN)
YEEEAAMEA

SEQ ID NO: 119058 - protein, 9 aa, Artificial Sequence
  Description of Artificial Sequence: Synthetic peptide
  Seed: LLLQVSSSY (MOG_HUMAN)
LQLQVSSSM

SEQ ID NO: 119059 - protein, 10 aa, Artificial Sequence
  Description of Artificial Sequence: Synthetic peptide
  Seed: SCLCSFLLLL (MOG_HUMAN)
SRLCSFLLLI

SEQ ID NO: 119060 - protein, 9 aa, Artificial Sequence
  Description of Artificial Sequence: Synthetic peptide
  Seed: RIRNVRFSD (MOG_HUMAN)
RWRNVRFSG

SEQ ID NO: 119061 - protein, 9 aa, Artificial Sequence
  Description of Artificial Sequence: Synthetic peptide
  Seed: LHRTFDPHF (MOG_HUMAN)
LKRTFDPHY

SEQ ID NO: 119062 - protein, 9 aa, Artificial Sequence
  Description of Artificial Sequence: Synthetic peptide
  Seed: LAGQFLEEL (MOG_HUMAN)
LMGQFLEET

SEQ ID NO: 119063 - protein, 11 aa, Artificial Sequence
  Description of Artificial Sequence: Synthetic peptide
  Seed: RDHSYQEEAAM (MOG_HUMAN)
RVHSYQEEAAF

SEQ ID NO: 119064 - protein, 10 aa, Artificial Sequence
  Description of Artificial Sequence: Synthetic peptide
  Seed: SSYAGQFRVI (MOG_HUMAN)
SYYAGQFRVM

SEQ ID NO: 119065 - protein, 10 aa, Artificial Sequence
  Description of Artificial Sequence: Synthetic peptide
  Seed: HRTFDPHFLR (MOG_HUMAN)
HHTFDPHFLK

SEQ ID NO: 119066 - protein, 9 aa, Artificial Sequence
  Description of Artificial Sequence: Synthetic peptide
  Seed: ALVGDEVEL (MOG_HUMAN)
AQVGDEVEV

SEQ ID NO: 119067 - protein, 11 aa, Artificial Sequence
  Description of Artificial Sequence: Synthetic peptide
  Seed: RRLAGQFLEEL (MOG_HUMAN)
RFLAGQFLEEL

SEQ ID NO: 119068 - protein, 9 aa, Artificial Sequence
  Description of Artificial Sequence: Synthetic peptide
  Seed: TFDPHFLRV (MOG_HUMAN)
TVDPHFLRF

SEQ ID NO: 119069 - protein, 9 aa, Artificial Sequence
  Description of Artificial Sequence: Synthetic peptide
  Seed: ICYNWLHRR (MOG_HUMAN)
IVYNWLHRR

SEQ ID NO: 119070 - protein, 8 aa, Artificial Sequence
  Description of Artificial Sequence: Synthetic peptide
  Seed: RIRNVRFS (MOG_HUMAN)
RSRNVRFA

SEQ ID NO: 119071 - protein, 9 aa, Artificial Sequence
  Description of Artificial Sequence: Synthetic peptide
  Seed: FLEELRNPF (MOG_HUMAN)
FIEELRNPL

SEQ ID NO: 119072 - protein, 10 aa, Artificial Sequence
  Description of Artificial Sequence: Synthetic peptide
  Seed: SDEGGFTCFF (MOG_HUMAN)
SLEGGFTCFW

SEQ ID NO: 119073 - protein, 9 aa, Artificial Sequence
  Description of Artificial Sequence: Synthetic peptide
  Seed: VTLRIRNVR (MOG_HUMAN)
VSLRIRNVR

SEQ ID NO: 119074 - protein, 10 aa, Artificial Sequence
  Description of Artificial Sequence: Synthetic peptide
  Seed: FRVIGPRHPI (MOG_HUMAN)
FTVIGPRHPL

SEQ ID NO: 119075 - protein, 10 aa, Artificial Sequence
  Description of Artificial Sequence: Synthetic peptide
  Seed: RLRGKLRAEI (MOG_HUMAN)
RQRGKLRAEK

SEQ ID NO: 119076 - protein, 9 aa, Artificial Sequence
  Description of Artificial Sequence: Synthetic peptide
  Seed: EGGFTCFFR (MOG_HUMAN)
ESGFTCFFR

SEQ ID NO: 119077 - protein, 10 aa, Artificial Sequence
  Description of Artificial Sequence: Synthetic peptide
  Seed: GLIFLCLQYR (MOG_HUMAN)
GAIFLCLQYR

SEQ ID NO: 119078 - protein, 10 aa, Artificial Sequence
  Description of Artificial Sequence: Synthetic peptide
  Seed: HRTFDPHFLR (MOG_HUMAN)
HDTFDPHFLK

SEQ ID NO: 119079 - protein, 11 aa, Artificial Sequence
  Description of Artificial Sequence: Synthetic peptide
  Seed: RDHSYQEEAAM (MOG_HUMAN)
RPHSYQEEAAW

SEQ ID NO: 119080 - protein, 8 aa, Artificial Sequence
  Description of Artificial Sequence: Synthetic peptide
  Seed: FSRVVHLY (MOG_HUMAN)
FQRVVHLY

SEQ ID NO: 119081 - protein, 10 aa, Artificial Sequence
  Description of Artificial Sequence: Synthetic peptide
  Seed: IGPRHPIRAL (MOG_HUMAN)
IDPRHPIRAF

SEQ ID NO: 119082 - protein, 9 aa, Artificial Sequence
  Description of Artificial Sequence: Synthetic peptide
  Seed: VVHLYRNGK (MOG_HUMAN)
VMHLYRNGK

SEQ ID NO: 119083 - protein, 9 aa, Artificial Sequence
  Description of Artificial Sequence: Synthetic peptide
  Seed: ITLFVIVPV (MOG_HUMAN)
IQLFVIVPA

SEQ ID NO: 119084 - protein, 10 aa, Artificial Sequence
  Description of Artificial Sequence: Synthetic peptide
  Seed: FDPHFLRVPC (MOG_HUMAN)
FVPHFLRVPA

SEQ ID NO: 119085 - protein, 9 aa, Artificial Sequence
  Description of Artificial Sequence: Synthetic peptide
  Seed: RIRNVRFSD (MOG_HUMAN)
RYRNVRFSI

SEQ ID NO: 119086 - protein, 9 aa, Artificial Sequence
  Description of Artificial Sequence: Synthetic peptide
  Seed: YRPPFSRVV (MOG_HUMAN)
YQPPFSRVY

SEQ ID NO: 119087 - protein, 9 aa, Artificial Sequence
  Description of Artificial Sequence: Synthetic peptide
  Seed: FLCLQYRLR (MOG_HUMAN)
FSCLQYRLR

SEQ ID NO: 119088 - protein, 11 aa, Artificial Sequence
  Description of Artificial Sequence: Synthetic peptide
  Seed: LHRTFDPHFLR (MOG_HUMAN)
LSRTFDPHFLK

SEQ ID NO: 119089 - protein, 9 aa, Artificial Sequence
  Description of Artificial Sequence: Synthetic peptide
  Seed: VGDEVELPC (MOG_HUMAN)
VVDEVELPL

SEQ ID NO: 119090 - protein, 8 aa, Artificial Sequence
  Description of Artificial Sequence: Synthetic peptide
  Seed: FSDEGGFT (MOG_HUMAN)
FLDEGGFF

SEQ ID NO: 119091 - protein, 9 aa, Artificial Sequence
  Description of Artificial Sequence: Synthetic peptide
  Seed: YRPPFSRVV (MOG_HUMAN)
YQPPFSRVF

SEQ ID NO: 119092 - protein, 9 aa, Artificial Sequence
  Description of Artificial Sequence: Synthetic peptide
  Seed: SSSYAGQFR (MOG_HUMAN)
SASYAGQFK

SEQ ID NO: 119093 - protein, 8 aa, Artificial Sequence
  Description of Artificial Sequence: Synthetic peptide
  Seed: FSDEGGFT (MOG_HUMAN)
FVDEGGFF

SEQ ID NO: 119094 - protein, 9 aa, Artificial Sequence
  Description of Artificial Sequence: Synthetic peptide
  Seed: TELLKDAIG (MOG_HUMAN)
TELLKDAIV

SEQ ID NO: 119095 - protein, 10 aa, Artificial Sequence
  Description of Artificial Sequence: Synthetic peptide
  Seed: HRTFDPHFLR (MOG_HUMAN)
HMTFDPHFLR

SEQ ID NO: 119096 - protein, 9 aa, Artificial Sequence
  Description of Artificial Sequence: Synthetic peptide
  Seed: FSDEGGFTC (MOG_HUMAN)
FNDEGGFTL

SEQ ID NO: 119097 - protein, 9 aa, Artificial Sequence
  Description of Artificial Sequence: Synthetic peptide
  Seed: SSYAGQFRV (MOG_HUMAN)
SVYAGQFRY

SEQ ID NO: 119098 - protein, 9 aa, Artificial Sequence
  Description of Artificial Sequence: Synthetic peptide
  Seed: TGMEVGWYR (MOG_HUMAN)
TFMEVGWYK

SEQ ID NO: 119099 - protein, 9 aa, Artificial Sequence
  Description of Artificial Sequence: Synthetic peptide
  Seed: IVPVLGPLV (MOG_HUMAN)
IQPVLGPLV

SEQ ID NO: 119100 - protein, 9 aa, Artificial Sequence
  Description of Artificial Sequence: Synthetic peptide
  Seed: LSRPSLPSC (MOG_HUMAN)
LVRPSLPSS

SEQ ID NO: 119101 - protein, 10 aa, Artificial Sequence
  Description of Artificial Sequence: Synthetic peptide
  Seed: VLLAVLPVLL (MOG_HUMAN)
VHLAVLPVLV

SEQ ID NO: 119102 - protein, 9 aa, Artificial Sequence
  Description of Artificial Sequence: Synthetic peptide
  Seed: RAEIENLHR (MOG_HUMAN)
RIEIENLHY

SEQ ID NO: 119103 - protein, 9 aa, Artificial Sequence
  Description of Artificial Sequence: Synthetic peptide
  Seed: ALVGDEVEL (MOG_HUMAN)
AMVGDEVEF

SEQ ID NO: 119104 - protein, 9 aa, Artificial Sequence
  Description of Artificial Sequence: Synthetic peptide
  Seed: FLRVPCWKI (MOG_HUMAN)
FLRVPCWKV

SEQ ID NO: 119105 - protein, 10 aa, Artificial Sequence
  Description of Artificial Sequence: Synthetic peptide
  Seed: FVIVPVLGPL (MOG_HUMAN)
FIIVPVLGPI

SEQ ID NO: 119106 - protein, 11 aa, Artificial Sequence
  Description of Artificial Sequence: Synthetic peptide
  Seed: RDHSYQEEAAM (MOG_HUMAN)
RWHSYQEEAAF

SEQ ID NO: 119107 - protein, 9 aa, Artificial Sequence
  Description of Artificial Sequence: Synthetic peptide
  Seed: KLRAEIENL (MOG_HUMAN)
KVRAEIENY

SEQ ID NO: 119108 - protein, 9 aa, Artificial Sequence
  Description of Artificial Sequence: Synthetic peptide
  Seed: FSRVVHLYR (MOG_HUMAN)
FYRVVHLYK

SEQ ID NO: 119109 - protein, 9 aa, Artificial Sequence
  Description of Artificial Sequence: Synthetic peptide
  Seed: CLCSFLLLL (MOG_HUMAN)
CQCSFLLLV

SEQ ID NO: 119110 - protein, 9 aa, Artificial Sequence
  Description of Artificial Sequence: Synthetic peptide
  Seed: YQEEAAMEL (MOG_HUMAN)
YYEEAAMEF

SEQ ID NO: 119111 - protein, 9 aa, Artificial Sequence
  Description of Artificial Sequence: Synthetic peptide
  Seed: YRPPFSRVV (MOG_HUMAN)
YSPPFSRVI

SEQ ID NO: 119112 - protein, 9 aa, Artificial Sequence
  Description of Artificial Sequence: Synthetic peptide
  Seed: ITLFVIVPV (MOG_HUMAN)
IQLFVIVPL

SEQ ID NO: 119113 - protein, 9 aa, Artificial Sequence
  Description of Artificial Sequence: Synthetic peptide
  Seed: RIRNVRFSD (MOG_HUMAN)
RYRNVRFSP

SEQ ID NO: 119114 - protein, 10 aa, Artificial Sequence
  Description of Artificial Sequence: Synthetic peptide
  Seed: YWVSPGVLVL (MOG_HUMAN)
YTVSPGVLVM

SEQ ID NO: 119115 - protein, 10 aa, Artificial Sequence
  Description of Artificial Sequence: Synthetic peptide
  Seed: VLLAVLPVLL (MOG_HUMAN)
VELAVLPVLL

SEQ ID NO: 119116 - protein, 9 aa, Artificial Sequence
  Description of Artificial Sequence: Synthetic peptide
  Seed: TGMEVGWYR (MOG_HUMAN)
TMMEVGWYL

SEQ ID NO: 119117 - protein, 9 aa, Artificial Sequence
  Description of Artificial Sequence: Synthetic peptide
  Seed: RVIGPRHPI (MOG_HUMAN)
RVIGPRHPM

SEQ ID NO: 119118 - protein, 9 aa, Artificial Sequence
  Description of Artificial Sequence: Synthetic peptide
  Seed: RVPCWKITL (MOG_HUMAN)
RQPCWKITY

SEQ ID NO: 119119 - protein, 9 aa, Artificial Sequence
  Description of Artificial Sequence: Synthetic peptide
  Seed: VEDPFYWVS (MOG_HUMAN)
VEDPFYWVL

SEQ ID NO: 119120 - protein, 11 aa, Artificial Sequence
  Description of Artificial Sequence: Synthetic peptide
  Seed: RDHSYQEEAAM (MOG_HUMAN)
RTHSYQEEAAY

SEQ ID NO: 119121 - protein, 10 aa, Artificial Sequence
  Description of Artificial Sequence: Synthetic peptide
  Seed: LQITVGLIFL (MOG_HUMAN)
LMITVGLIFM

SEQ ID NO: 119122 - protein, 10 aa, Artificial Sequence
  Description of Artificial Sequence: Synthetic peptide
  Seed: LLKDAIGEGK (MOG_HUMAN)
LTKDAIGEGY

SEQ ID NO: 119123 - protein, 9 aa, Artificial Sequence
  Description of Artificial Sequence: Synthetic peptide
  Seed: YQEEAAMEL (MOG_HUMAN)
YGEEAAMEV

SEQ ID NO: 119124 - protein, 9 aa, Artificial Sequence
  Description of Artificial Sequence: Synthetic peptide
  Seed: FYWVSPGVL (MOG_HUMAN)
FLWVSPGVY

SEQ ID NO: 119125 - protein, 9 aa, Artificial Sequence
  Description of Artificial Sequence: Synthetic peptide
  Seed: YQEEAAMEL (MOG_HUMAN)
YEEEAAMEV

SEQ ID NO: 119126 - protein, 10 aa, Artificial Sequence
  Description of Artificial Sequence: Synthetic peptide
  Seed: RIRNVRFSDE (MOG_HUMAN)
RYRNVRFSDM

SEQ ID NO: 119127 - protein, 9 aa, Artificial Sequence
  Description of Artificial Sequence: Synthetic peptide
  Seed: RTFDPHFLR (MOG_HUMAN)
RFFDPHFLR

SEQ ID NO: 119128 - protein, 9 aa, Artificial Sequence
  Description of Artificial Sequence: Synthetic peptide
  Seed: YRPPFSRVV (MOG_HUMAN)
YTPPFSRVF

SEQ ID NO: 119129 - protein, 10 aa, Artificial Sequence
  Description of Artificial Sequence: Synthetic peptide
  Seed: SFLLLLLLQV (MOG_HUMAN)
SKLLLLLLQV

SEQ ID NO: 119130 - protein, 9 aa, Artificial Sequence
  Description of Artificial Sequence: Synthetic peptide
  Seed: RIRNVRFSD (MOG_HUMAN)
RARNVRFSG

SEQ ID NO: 119131 - protein, 11 aa, Artificial Sequence
  Description of Artificial Sequence: Synthetic peptide
  Seed: RISPGKNATGM (MOG_HUMAN)
RLSPGKNATGF

SEQ ID NO: 119132 - protein, 9 aa, Artificial Sequence
  Description of Artificial Sequence: Synthetic peptide
  Seed: RVPCWKITL (MOG_HUMAN)
RIPCWKITY

SEQ ID NO: 119133 - protein, 9 aa, Artificial Sequence
  Description of Artificial Sequence: Synthetic peptide
  Seed: TFDPHFLRV (MOG_HUMAN)
TIDPHFLRW

SEQ ID NO: 119134 - protein, 11 aa, Artificial Sequence
  Description of Artificial Sequence: Synthetic peptide
  Seed: RTFDPHFLRVP (MOG_HUMAN)
RMFDPHFLRVG

SEQ ID NO: 119135 - protein, 10 aa, Artificial Sequence
  Description of Artificial Sequence: Synthetic peptide
  Seed: FTCFFRDHSY (MOG_HUMAN)
FSCFFRDHSY

SEQ ID NO: 119136 - protein, 11 aa, Artificial Sequence
  Description of Artificial Sequence: Synthetic peptide
  Seed: RTFDPHFLRVP (MOG_HUMAN)
RMFDPHFLRVQ

SEQ ID NO: 119137 - protein, 10 aa, Artificial Sequence
  Description of Artificial Sequence: Synthetic peptide
  Seed: LIFLCLQYRL (MOG_HUMAN)
LLFLCLQYRA

SEQ ID NO: 119138 - protein, 9 aa, Artificial Sequence
  Description of Artificial Sequence: Synthetic peptide
  Seed: SLPSCLCSF (MOG_HUMAN)
SFPSCLCSV

SEQ ID NO: 119139 - protein, 10 aa, Artificial Sequence
  Description of Artificial Sequence: Synthetic peptide
  Seed: LIFLCLQYRL (MOG_HUMAN)
LIFLCLQYRV

SEQ ID NO: 119140 - protein, 9 aa, Artificial Sequence
  Description of Artificial Sequence: Synthetic peptide
  Seed: ITVGLIFLC (MOG_HUMAN)
IVVGLIFLI

SEQ ID NO: 119141 - protein, 9 aa, Artificial Sequence
  Description of Artificial Sequence: Synthetic peptide
  Seed: KLRAEIENL (MOG_HUMAN)
KYRAEIENK

SEQ ID NO: 119142 - protein, 9 aa, Artificial Sequence
  Description of Artificial Sequence: Synthetic peptide
  Seed: FSDEGGFTC (MOG_HUMAN)
FIDEGGFTW
